United States Patent 7,745,391 (HUMAN THROMBOSPONDIN POLYPEPTIDE) - sequence listing, part 7

SEQ ID NO: 15734 - DNA, 3663 bp, Homo sapiens
  misc_feature (11)..(11): n is a, c, g, or t
gagctggcgcngtgccctggtggcagtggctgaagtggcggcggcttcggcggctgcggcggctgcaacagcttcgggctcggggttttggcggcggcgccggcgggctaggctgcgcggtgcggaccccggcgcgcggtccgggttgctggggcggcgcgtaagatgcctctaatggaggagtttctgagcagcacccctggcccagtggctttgaaagggagctcaaaccagagactatttcaagccctggatatcatatcctgagggccacaggagaagagaacatggctgtgagtttggatgacgacgtgccgctcatcctgaccttggatgagggtggcagtgccccactggctccctccaacggcctgggccaagaagagctacctagcaaaaatggcggcagctatgccatccacgactcccaggcccccagtctcagctctgggggtgagagttccccctccagccccgcacacaactgggagatgaattaccaagaggcagcaatctacctccaggaaggcgagaacaacgacaagttcttcacccaccccaaggatgccaaggcgctggcggcctacctctttgcacacaatcacctcttctacctgatggagctggccacggccctgctgctgctgctgctctccctgtgcgaggcccccgccgtccccgcactccggcttggcatctatgtccacgccaccctggagctgtttgccctgatggtggtagtgtttgaactctgcatgaagttacgctggctgggcctccacaccttcatccggcacaagcggaccatggtcaagacctcggtgctggtggtgcagtttgtcgaggccatcgtggtgttggtacggcagatgtcccatgtgcgggtgacccgagcactgcgctgcattttcctggtggactgtcggtattgcggtggcgtccggcgcaacctgcggcagatcttccagtccctgccgcccttcatggacatcctcctgctgctgctgttcttcatgatcatctttgccatcctcggtttctacttgttctcccctaacccttcagacccctacttcagcaccctggagaacagcatcgtcagtctgtttgtccttctgaccacagccaatttcccagatgtgatgatgccctcctactcccggaacccctggtcctgcgtcttcttcatcgtgtacctctccatcgagctgtatttcatcatgaacctgcttctggctgtggtgttcgacaccttcaatgacattgagaaacgcaagttcaagtctttgctactgcacaagcgaaccgctatccagcatgcctaccgcctgctcatcagccagaggaggcctgccggcatctcctacaggcagtttgaaggcctcatgcgcttctacaagccccggatgagtgccagggagcgctatcttaccttcaaggccctgaatcagaacaacacacccctgctcagcctaaaggacttttacgatatctacgaagttgctgctttgaagtggaaggccaagaaaaacagagagcactggtttgatgagcttcccaggacggcgctcctcatcttcaaaggtattaatatccttgtgaagtccaaggccttccagtatttcatgtacttggtggtggcagtcaacggggtctggatcctcgtggagacatttatgctgaaaggtgggaacttcttctccaagcacgtgccctggagttacctcgtctttctaactatctatggggtggagctgttcctgaaggttgccggcctgggccctgtggagtacttgtcttccggatggaacttgtttgacttctccgtgacagtgttcgccttcctgggactgctggcgctggccctcaacatggagcccttctatttcatcgtggtcctgcgccccctccagctgctgaggttgtttaagttgaaggagcgctaccgcaacgtgctggacaccatgttcgagctgctgccccggatggccagcctgggcctcaccctgctcatcttttactactccttcgccatcgtgggcatggagttcttctgcgggatcgtcttccccaactgctgcaacacgagtacagtggcagatgcctaccgctggcgcaaccacaccgtgggcaacaggaccgtggtggaggaaggctactattatctcaataattttgacaacatcctcaacagctttgtgaccctgtttgagctcacagttgtcaacaactggtacatcatcatggaaggcgtcacctctcagacctcccactggagccgcctctacttcatgaccttttacattgtgaccatggtggtgatgacgatcattgtcgcctttatcctcgaggccttcgtcttccgaatgaactacagccgcaagaaccaggactcggaagttgatggtggcatcacccttgagaaggaaatctccaaagaagagctggttgccgtcctggagctctaccgggaggcacggggggcctcctcggatgtcaccaggctgctggagaccctctcccagatggagagataccagcaacattccatggtgtttctgggacggcgatcaaggaccaagagcgacctgagcctgaagatgtaccaggaggagatccaggagtggtatgaggagcatgccagggagcaagagcagcagcgacaactcagcagcagtgcagcccccgccgcccagcagcccccaggcagccgccagcgctcccagaccgttacctagcccagcgcccgaaagccgtctcttctatgcaataacacaatagtattactctactgcgatgtacggaactgcggtgtgtgtacacatactcacgtatatgcacatatttatatacaggaagaaaaaagacagacaagatggggcttggtttataaccaccttgccctgtcttccttaactccagaagccagtttggtgaggggtgggggtgcggccaccaggtctgagctcttcctactgtggaaggctccagaaggcccttcacaaggagacccctcacctggatccagtcgactgcggggcttgcccctcatgtgggctggcctccatcggccacgtccaaagctgtcactgctactgcttcaggctcacatccccccgacctgatggcgtgcccgccccctctccctgcggcccatgccacaggtttctgtgttttgctttagggacagaaccacttaggaaggaaagaactcccggtctccagggtggtatttcagtgtctgtgataatgtcacgcaacacctcttcggggaccagtgcccaggatctaatggaagcggaattggggcaactgggcccatgtggccagagctcagttagccagtgccgggcggccacagattacactgaccaatctcctcccttggctctgcaagcctcccacccagccttctctggcttaacccttgttggcgaaaactcttccacagtggcctccttggggacccagaacccggaggaaggggcatgaggcaggaagtggggccgatgtctgcaacccagaccacttcgtggaatgggctcttgaccaaatccctttttttgcgatttacccgttcaagcaaaacaacgttttggttaactaaggattgtgctaaagccgataccaggtccttcacacgagatcctctagatcgacccc

SEQ ID NO: 15735 - DNA, 2387 bp, Homo sapiens
  misc_feature (11)..(11): n is a, c, g, or t
gagctggcgcngtgccctggtggcagtggctgaagtggcggcggcttcggcggctgcggcggctgcaacagcttcgggctcggggttttggcggcggcgccggcgggctaggctgcgcggtgcggaccccggcgcgcggtccgggttgctggggcggcgcgtaagatgcctctaatggaggagtttctgagcagcacccctggcccagtggctttgaaagggagctcaaaccagagactatttcaagccctggatatcatatcctgagggccacaggagaagagaacatggctgtgagtttggatgacgacgtgccgctcatcctgaccttggatgagggtggcagtgccccactggctccctccaacggcctgggccaagaagagctacctagcaaaaatggcggcagctatgccatccacgactcccaggcccccagtctcagctctgggggtgagagttccccctccagccccgcacacaactgggagatgaattaccaagaggcagcaatctacctccaggaaggcgagaacaacgacaagttcttcacccaccccaaggatgccaaggcgctggcggcctacctctttgcacacaatcacctcttctacctgatggagctggccacggccctgctgctgctgctgctctccctgtgcgaggcccccgccgtccccgcactccggcttggcatctatgtccacgccaccctggagctgtttgccctgatggtggtagtgtttgaactctgcatgaagttacgctggctgggcctccacaccttcatccggcacaagcggaccatggtcaagacctcggtgctggtggtgcagtttgtcgaggccatcgtggtgttggtacggcagatgtcccatgtgcgggtgacccgagcactgcgctgcattttcctggtggactgtcggtattgcggtggcgtccggcgcaacctgcggcagatcttccagtccctgccgcccttcatggacatcctcctgctgctgctgttcttcatgatcatctttgccatcctcggtttctacttgttctcccctaacccttcagacccctacttcagcaccctggagaacagcatcgtcagtctgtttgtccttctgaccacagccaatttcccagatgtgatgatgccctcctactcccggaacccctggtcctgcgtcttcttcatcgtgtacctctccatcgagctgtatttcatcatgaacctgcttctggctgtggtgttcgacaccttcaatgacattgagaaacgcaagttcaagtctttgctactgcacaagcgaaccgctatccagcatgcctaccgcctgctcatcagccagaggaggcctgccggcatctcctacaggcagtttgaaggcctcatgcgcttctacaagccccggatgagtgccagggagcgctatcttaccttcaaggccctgaatcagaacaacacacccctgctcagcctaaaggacttttacgatatctacgaagttgctgctttgaagtggaaggccaagaaaaacagagagcactggtttgatgagcttcccaggacggcgctcctcatcttcaaaggtattaatatccttgtgaagtccaaggccttccagtatttcatgtacttggtggtggcagtcaacggggtctggatcctcgtggagacatttatgctgaaaggtgggaacttcttctccaagcacgtgccctggagttacctcgtctttctaactatctatggggtggagctgttcctgaaggttgccggcctgggccctgtggagtacttgtcttccggatggaacttgtttgacttctccgtgacagtgttcgccttcctgggactgctggcgctggccctcaacatggagcccttctatttcatcgtggtcctgcgccccctccagctgctgaggttgtttaagttgaaggagcgctaccgcaacgtgctggacaccatgttcgagctgctgccccggatggccagcctgggcctcaccctgctcatcttttactactccttcgccatcgtgggcatggagttcttctgcgggatcgtcttccccaactgctgcaacacgagtacagtggcagatgcctaccgctggcgcaaccacaccgtgggcaacaggaccgtggtggaggaaggctactattatctcaataattttgacaacatcctcaacagctttgtgaccctgtttgagctcacggagaagtcaaacaagttccatccggaagacaagtactccacagggcccaggccggcaaccttcaggaacagctccaccccatagatagttagaaagacgaggtaactccaggcacgtgcttggagaagaagttcccacctttcagcataaatgtatcattagaggacc

SEQ ID NO: 15736 - DNA, 1648 bp, Homo sapiens
  misc_feature (11)..(11): n is a, c, g, or t
gagctggcgcngtgccctggtggcagtggctgaagtggcggcggcttcggcggctgcggcggctgcaacagcttcgggctcggggttttggcggcggcgccggcgggctaggctgcgcggtgcggaccccggcgcgcggtccgggttgctggggcggcgcgtaagatgcctctaatggaggagtttctgagcagcacccctggcccagtggctttgaaagggagctcaaaccagagactatttcaagccctggatatcatatcctgagggccacaggagaagagaacatggctgtgagtttggatgacgacgtgccgctcatcctgaccttggatgagggtggcagtgccccactggctccctccaacggcctgggccaagaagagctacctagcaaaaatggcggcagctatgccatccacgactcccaggcccccagtctcagctctgggggtgagagttccccctccagccccgcacacaactgggagatgaattaccaagaggcagcaatctacctccaggaaggcgagaacaacgacaagttcttcacccaccccaaggatgccaaggcgctggcggcctacctctttgcacacaatcacctcttctacctgatggagctggccacggccctgctgctgctgctgctctccctgtgcgaggcccccgccgtccccgcactccggcttggcatctatgtccacgccaccctggagctgtttgccctgatggtggtagtgtttgaactctgcatgaagttacgctggctgggcctccacaccttcatccggcacaagcggaccatggtcaagacctcggtgctggtggtgcagtttgtcgaggccatcgtggtgttggtacggcagatgtcccatgtgcgggtgacccgagcactgcgctgcattttcctggtggactgtcggtattgcggtggcgtccggcggtaaggcccgggtggggagctgggcagtcactatcctggcatggcctgacctctgggccagtggggcaggagcttgtgagtcagttagtgatgaggtcgaccctgcatgctggtggagtacacgcagactcactctccctctgccattccatccacgcacaggagaaagcggtattcctaccgcagtgtaggtttgctgcctctgggtccagggctttttcccatcttatccgcagccttccagagctgcttcctcgctctaggcatgttatctacccaaatgcaggcagctcagcagcgtccatgtgacacaagcagactctcctgccacctccatcgaggctgtaggaccaaactcaaaccagaccaagcctcgactgagatttattttgggagactcaatctggaaaattccttggctgggctactgttgctgagagtgggtttgcaattcattctctgtgcccatctgcaaagctagaaacaggactcagtgtccttgaaacaggcccagtgtcccaggactaagtggccttgaaatgtcttcatgccttccacatcctgctcatggaaactgacctttgcacccaaggtcatgcccttggccttctgctgctctgttccctgcttgcatggcactcacctccttggggcctcaccaggtggaggtggctgtgtgctacgcctgccctagttcttccc

SEQ ID NO: 15737 - DNA, 212 bp, Homo sapiens
cttatggcacaggcgaatcgtattcctgctgcaactggatggtgctggctttagtgactgcctcactcttcccagattgcacagctttctgtgtgctgaccctcccttcttcccaaattctccatcaaaactgtctgcacttgatctcttgagcccaggaggtcaagactgcagtgagccatgatcacaccactgcactccagcctgggcag

SEQ ID NO: 15738 - DNA, 1070 bp, Homo sapiens
ggataccagcagtcacacagcccttccattcttctggtgccacacacctgtgccagcacctggagttttttttcttctggggctgcctgatgttggcaggaagtgtgagagggctggagagaggagaaggcctcccgaggccagagtgggcactgcctctccagccccccgttccaggtatgcaggatgacggctgggctgcaggggctgacggtgctccatgcctgccacccacagacctcggtgctggtggtgcagtttgtcgaggccatcgtggtgttggtacggcagatgtcccatgtgcgggtgacccgagcactgcgctgcattttcctggtggactgtcggtattgcggtggcgtccggcggtaaggcccgggtggggagctgggcagtcactatcctggcatggcctgacctctgggccagtggggcaggagcttgtgagtcagttagtgatgaggtcgaccctgcatgctggtggagtacacgcagactcactctccctctgccattccatccacgcacaggagaaagcggtattcctaccgcagtgtaggtttgctgcctctgggtccagggctttttcccatcttatccgcagccttccagagctgcttcctcgctctaggcatgttatctacccaaatgcaggcagctcagcagcgtccatgtgacacaagcagactctcctgccacctccatcgaggctgtaggaccaaactcaaaccagaccaagcctcgactgagatttattttgggagactcaatctggaaaattccttggctgggctactgttgctgagagtgggtttgcaattcattctctgtgcccatctgcaaagctagaaacaggactcagtgtccttgaaacaggcccagtgtcccaggactaagtggccttgaaatgtcttcatgccttccacatcctgctcatggaaactgacctttgcacccaaggtcatgcccttggccttctgctgctctgttccctgcttgcatggcactcacctccttggggcctcaccaggtggaggtggctgtgtgctacgcctgccctagttcttccc

SEQ ID NO: 15739 - DNA, 5459 bp, Homo sapiens
cctgcctgggaaccaggggtggagttggccagagccaaacaatgtggacagagagcaaggaggggatgttctacagagacagatggcccagtgttgctgggagaggagggcgtggctgtcagcagggaagagcaacagatggccctgcaccaggggacaaatccagttgtttttaatttttaactaagtaggatattaatatgcttccaaaagtcaaaggattcaaaaagggtctgtctaccctattccttatagcccttgtagggcgactgatttcattgacttctcatttttccttcctgtgtttcttttggtaaagataagtcgatgtatttatgttttcttgtttcctcccttttgtacacattagagagcatactatttgtactcttttgtacttgcttttttcacttatcaagagaaaggaaaacatttgtaaccagctgtgctaattcttgccattatcagtacacagcatggaggttgatttgaagatgacgggatgtccatgtgagcatatgaagggactgccaggcttttcttctgccaaacggtgtctttttgctcttaagcctgggtgccaagtgaatctctctcctcttccaatgcagatggcggcagctatgccatccacgactcccaggcccccagtctcagctctgggggtgagagttccccctccagccccgcacacaactgggagatgaattaccaagaggcagcaatctacctccaggaaggcgagaacaacgacaagttcttcacccaccccaaggatgccaaggcgctggcggcctacctctttgcacacaatcacctcttctacctgatggagctggccacggccctgctgctgctgctgctctccctgtgcgaggcccccgccgtccccgcactccggcttggcatctatgtccacgccaccctggagctgtttgccctgatggtggtagtgtttgaactctgcatgaagttacgctggctgggcctccacaccttcatccggcacaagcggaccatggtcaagacctcggtgctggtggtgcagtttgtcgaggccatcgtggtgttggtacggcagatgtcccatgtgcgggtgacccgagcactgcgctgcattttcctggtggactgtcggtattgcggtggcgtccggcgcaacctgcggcagatcttccagtccctgccgcccttcatggacatcctcctgctgctgctgttcttcatgatcatctttgccatcctcggtttctacttgttctcccctaacccttcagacccctacttcagcaccctggagaacagcatcgtcagtctgtttgtccttctgaccacagccaatttcccagatgtgatgatgccctcctactcccggaacccctggtcctgcgtcttcttcatcgtgtacctctccatcgagctgtatttcatcatgaacctgcttctggctgtggtgttcgacaccttcaatgacattgagaaacgcaagttcaagtctttgctactgcacaagcgaaccgctatccagcatgcctaccgcctgctcatcagccagaggaggcctgccggcatctcctacaggcagtttgaaggcctcatgcgcttctacaagccccggatgagtgccagggagcgctatcttaccttcaaggccctgaatcagaacaacacacccctgctcagcctaaaggacttttacgatatctacgaagttgctgctttgaagtggaaggccaagaaaaacagagagcactggtttgatgagcttcccaggacggcgctcctcatcttcaaaggtattaatatccttgtgaagtccaaggccttccagtatttcatgtacttggtggtggcagtcaacggggtctggatcctcgtggagacatttatgctgaaaggtgggaacttcttctccaagcacgtgccctggagttacctcgtctttctaactatctatggggtggagctgttcctgaaggttgccggcctgggccctgtggagtacttgtcttccggatggaacttgtttgacttctccgtgacagtgttcgccttcctgggactgctggcgctggccctcaacatggagcccttctatttcatcgtggtcctgcgccccctccagctgctgaggttgtttaagttgaaggagcgctaccgcaacgtgctggacaccatgttcgagctgctgccccggatggccagcctgggcctcaccctgctcatcttttactactccttcgccatcgtgggcatggagttcttctgcgggatcgtcttccccaactgctgcaacacgagtacagtggcagatgcctaccgctggcgcaaccacaccgtgggcaacaggaccgtggtggaggaaggctactattatctcaataattttgacaacatcctcaacagctttgtgaccctgtttgagctcacagttgtcaacaactggtacatcatcatggaaggcgtcacctctcagacctcccactggagccgcctctacttcatgaccttttacattgtgaccatggtggtgatgacgatcattgtcgcctttatcctcgaggccttcgtcttccgaatgaactacagccgcaagaaccaggactcggaagttgatggtggcatcacccttgagaaggaaatctccaaagaagagctggttgccgtcctggagctctaccgggaggcacggggggcctcctcggatgtcaccaggctgctggagaccctctcccagatggagagataccagcaacattccatggtgtttctgggacggcgatcaaggaccaagagcgacctgagcctgaagatgtaccaggaggagatccaggagtggtatgaggagcatgccagggagcaagagcagcagcgacaactcagcagcagtgcagcccccgccgcccagcagcccccaggcagccgccagcgctcccagaccgttacctagcccagcgcccgaaagccgtctcttctatgcaataacacaatagtattactctactgcgatgtacggaactgcggtgtgtgtacacatactcacgtatatgcacatatttatatacaggaagaaaaaagacagacaagatggggcttggtttataaccaccttgccctgtcttccttaactccagaagccagtttggtgaggggtgggggtgcggccaccaggtctgagctcttcctactgtggaaggctccagaaggcccttcacaaggagacccctcacctggatccagtcgactgcggggcttgcccctcatgtgggctggcctccatcggccacgtccaaagctgtcactgctactgcttcaggctcacatccccccgacctgatggcgtgcccgccccctctccctgcggcccatgccacaggtttctgtgttttgctttagggacagaaccacttaggaaggaaagaactcccggtctccagggtggtatttcagtgtctgtgataatgtcacgcaacacctcttcggggaccagtgcccaggatctaatggaagcggaattggggcaactgggcccatgtggccagagctcagttagccagtgccgggcggccacagattacactgaccaatctcctcccttggctctgcaagcctcccacccagccttctctggcttaacccttgttggcgaaaactcttccacagtggcctccttggggacccagaacccggaggaaggggcatgaggcaggaagtggggccgatgtctgcaacccagaccacttcgtggaatgggctcttgaccaaatccctttttttgcgatttacccgttcaagcaaaacaacgttttggttaactaaggattgtgctaaagccgataccaggtccttcacacgtgtgcactaggaacaggagcgaacagcacagagagacgctccctgtgggacgcagcagccccgtggccccggcccagttcccagccaccctccctggctctgctcacaccagagatttccatagcaggagcggttggtgcagaagtaggttcagatgaacctcagttaacgtcgccacccctcctcccaccatggtaccctgtaggagccctgtatgacatctgagcgtggtggaggtaggagggttgccagctgcagtgaccctgccacagaggcagggtcagtgcagaggtcgctttggttccgcttccctgggccacagaacggaacacagcataggttctgcagcaggagccgcagtggcaggatggagggtgcgaagggcaaggagtgcactgctgggcattcctggccagccccggccctctggtgcctgcttcctgtgacttcagaaggcaggtggacagagcctccctctggccttgtcctcttcccagccacagaacgggcagggtggcacccgaccccaggggagcagtacctggtcccccaccccctcctcccaaccacctccaaggccaagctgggtcccatagccagcacggcatggttctccccttccccccttcccaggtcaggggagttggacaagtagcaggtgtttgtttttaaagcacagccctttgggaaagcaacacattattgagactcactgtgattcccccgggagtcagactggctttgtcctcttcctctctggagggccatgggccatcagcaggagctccacatcgagccccaggccagaaccccctccctttcacagagagggaactttattgcacaattgggtgccttttagcttttgtgtgttgaaatgggcgttttggaagcaagggtcaggggacagcttctaaaggtgtgagtctctgacctgagcatctgggcctcgcctgggcccttcttcctccccaggggtggaaacgtggaggggccagcagcaccccggggtctgcccaggggagtcaaggccccgaggtgggggggcctattccaggaggagtgggatctcggccctgtccagagcgagttaatgtgtccatctgcccaaccctgtcctgagaaaggacctggttttggccaggacctgacaaatacccaatggcagcagtgtcaacagacgggagtccagccagggtgggtgcccttgtcattgaggttagggacagctatccccaggttatgcctggccccacccagcagggagttggggtccccccacaggctgtgagctctgtgggccctgggatgtgatctagctcagatgccctctcatccttgatgtcatagttgagtgcacccaagtggcacccactggcggccaggggcacagcctggtggtggtggcaatagaactgtgcccctcctcagctcctcgcttcccctcccacagccccagccttactccaccatgcggacaatcattttgtacggatcacgggagcaatgctgtacggttttgtacactggtggtttgtttcctagaaaacccattgtgtctctggatttctagcacattactaaaagagcctctgctttgtaaa

SEQ ID NO: 15740 - DNA, 5370 bp, Homo sapiens
  misc_feature (11)..(11): n is a, c, g, or t
gagctggcgcngtgccctggtggcagtggctgaagtggcggcggcttcggcggctgcggcggctgcaacagcttcgggctcggggttttggcggcggcgccggcgggctaggctgcgcggtgcggaccccggcgcgcggtccgggttgctggggcggcgcgtaagatgcctctaatggaggagtttctgagcagcacccctggcccagtggctttgaaagggagctcaaaccagagactatttcaagccctggatatcatatcctgagggccacaggagaagagaacatggctgtgagtttggatgacgacgtgccgctcatcctgaccttggatgagggtggcagtgccccactggctccctccaacggcctgggccaagaagagctacctagcaaaaatggcggcagctatgccatccacgactcccaggcccccagtctcagctctgggggtgagagttccccctccagccccgcacacaactgggagatgaattaccaagaggcagcaatctacctccaggaaggcgagaacaacgacaagttcttcacccaccccaaggatgccaaggcgctggcggcctacctctttgcacacaatcacctcttctacctgatggagctggccacggccctgctgctgctgctgctctccctgtgcgaggcccccgccgtccccgcactccggcttggcatctatgtccacgccaccctggagctgtttgccctgatggtggtagtgtttgaactctgcatgaagttacgctggctgggcctccacaccttcatccggcacaagcggaccatggtcaagacctcggtgctggtggtgcagtttgtcgaggccatcgtggtgttggtacggcagatgtcccatgtgcgggtgacccgagcactgcgctgcattttcctggtggactgtcggtattgcggtggcgtccggcgcaacctgcggcagatcttccagtccctgccgcccttcatggacatcctcctgctgctgctgttcttcatgatcatctttgccatcctcggtttctacttgttctcccctaacccttcagacccctacttcagcaccctggagaacagcatcgtcagtctgtttgtccttctgaccacagccaatttcccagatgtgatgatgccctcctactcccggaacccctggtcctgcgtcttcttcatcgtgtacctctccatcgagctgtatttcatcatgaacctgcttctggctgtggtgttcgacaccttcaatgacattgagaaacgcaagttcaagtctttgctactgcacaagcgaaccgctatccagcatgcctaccgcctgctcatcagccagaggaggcctgccggcatctcctacaggcagtttgaaggcctcatgcgcttctacaagccccggatgagtgccagggagcgctatcttaccttcaaggccctgaatcagaacaacacacccctgctcagcctaaaggacttttacgatatctacgaagttgctgctttgaagtggaaggccaagaaaaacagagagcactggtttgatgagcttcccaggacggcgctcctcatcttcaaaggtattaatatccttgtgaagtccaaggccttccagtatttcatgtacttggtggtggcagtcaacggggtctggatcctcgtggagacatttatgctgaaaggtgggaacttcttctccaagcacgtgccctggagttacctcgtctttctaactatctatggggtggagctgttcctgaaggttgccggcctgggccctgtggagtacttgtcttccggatggaacttgtttgacttctccgtgacagtgttcgccttcctgggactgctggcgctggccctcaacatggagcccttctatttcatcgtggtcctgcgccccctccagctgctgaggttgtttaagttgaaggagcgctaccgcaacgtgctggacaccatgttcgagctgctgccccggatggccagcctgggcctcaccctgctcatcttttactactccttcgccatcgtgggcatggagttcttctgcgggatcgtcttccccaactgctgcaacacgagtacagtggcagatgcctaccgctggcgcaaccacaccgtgggcaacaggaccgtggtggaggaaggctactattatctcaataattttgacaacatcctcaacagctttgtgaccctgtttgagctcacagttgtcaacaactggtacatcatcatggaaggcgtcacctctcagacctcccactggagccgcctctacttcatgaccttttacattgtgaccatggtggtgatgacgatcattgtcgcctttatcctcgaggccttcgtcttccgaatgaactacagccgcaagaaccaggactcggaagttgatggtggcatcacccttgagaaggaaatctccaaagaagagctggttgccgtcctggagctctaccgggaggcacggggggcctcctcggatgtcaccaggctgctggagaccctctcccagatggagagataccagcaacattccatggtgtttctgggacggcgatcaaggaccaagagcgacctgagcctgaagatgtaccaggaggagatccagagatggtatcgctctgtcacctgggctggagtccagtggcgtgatcatagctcactgtagcctccaacccctgggctcaagtgatcctccccactcagcctacccaagcagctggaactacaggagtggtatgaggagcatgccagggagcaagagcagcagcgacaactcagcagcagtgcagcccccgccgcccagcagcccccaggcagccgccagcgctcccagaccgttacctagcccagcgcccgaaagccgtctcttctatgcaataacacaatagtattactctactgcgatgtacggaactgcggtgtgtgtacacatactcacgtatatgcacatatttatatacaggaagaaaaaagacagacaagatggggcttggtttataaccaccttgccctgtcttccttaactccagaagccagtttggtgaggggtgggggtgcggccaccaggtctgagctcttcctactgtggaaggctccagaaggcccttcacaaggagacccctcacctggatccagtcgactgcggggcttgcccctcatgtgggctggcctccatcggccacgtccaaagctgtcactgctactgcttcaggctcacatccccccgacctgatggcgtgcccgccccctctccctgcggcccatgccacaggtttctgtgttttgctttagggacagaaccacttaggaaggaaagaactcccggtctccagggtggtatttcagtgtctgtgataatgtcacgcaacacctcttcggggaccagtgcccaggatctaatggaagcggaattggggcaactgggcccatgtggccagagctcagttagccagtgccgggcggccacagattacactgaccaatctcctcccttggctctgcaagcctcccacccagccttctctggcttaacccttgttggcgaaaactcttccacagtggcctccttggggacccagaacccggaggaaggggcatgaggcaggaagtggggccgatgtctgcaacccagaccacttcgtggaatgggctcttgaccaaatccctttttttgcgatttacccgttcaagcaaaacaacgttttggttaactaaggattgtgctaaagccgataccaggtccttcacacgtgtgcactaggaacaggagcgaacagcacagagagacgctccctgtgggacgcagcagccccgtggccccggcccagttcccagccaccctccctggctctgctcacaccagagatttccatagcaggagcggttggtgcagaagtaggttcagatgaacctcagttaacgtcgccacccctcctcccaccatggtaccctgtaggagccctgtatgacatctgagcgtggtggaggtaggagggttgccagctgcagtgaccctgccacagaggcagggtcagtgcagaggtcgctttggttccgcttccctgggccacagaacggaacacagcataggttctgcagcaggagccgcagtggcaggatggagggtgcgaagggcaaggagtgcactgctgggcattcctggccagccccggccctctggtgcctgcttcctgtgacttcagaaggcaggtggacagagcctccctctggccttgtcctcttcccagccacagaacgggcagggtggcacccgaccccaggggagcagtacctggtcccccaccccctcctcccaaccacctccaaggccaagctgggtcccatagccagcacggcatggttctccccttccccccttcccaggtcaggggagttggacaagtagcaggtgtttgtttttaaagcacagccctttgggaaagcaacacattattgagactcactgtgattcccccgggagtcagactggctttgtcctcttcctctctggagggccatgggccatcagcaggagctccacatcgagccccaggccagaaccccctccctttcacagagagggaactttattgcacaattgggtgccttttagcttttgtgtgttgaaatgggcgttttggaagcaagggtcaggggacagcttctaaaggtgtgagtctctgacctgagcatctgggcctcgcctgggcccttcttcctccccaggggtggaaacgtggaggggccagcagcaccccggggtctgcccaggggagtcaaggccccgaggtgggggggcctattccaggaggagtgggatctcggccctgtccagagcgagttaatgtgtccatctgcccaaccctgtcctgagaaaggacctggttttggccaggacctgacaaatacccaatggcagcagtgtcaacagacgggagtccagccagggtgggtgcccttgtcattgaggttagggacagctatccccaggttatgcctggccccacccagcagggagttggggtccccccacaggctgtgagctctgtgggccctgggatgtgatctagctcagatgccctctcatccttgatgtcatagttgagtgcacccaagtggcacccactggcggccaggggcacagcctggtggtggtggcaatagaactgtgcccctcctcagctcctcgcttcccctcccacagccccagccttactccaccatgcggacaatcattttgtacggatcacgggagcaatgctgtacggttttgtacactggtggtttgtttcctagaaaacccattgtgtctctggatttctagcacattactaaaagagcctctgctttgtaaa

SEQ ID NO: 15741 - DNA, 3417 bp, Homo sapiens
ttcctgactgctgaaggagccctggccactcccctggacgactggatccagaaccagggcagcctttatcccagtagggctgggagtcgggaaagtttaaggaatggaataaagagatcagcaatgctcgccactttgtcactagaggggcaagcttcctctcctccatctctcacaaccagccacaaatcacggtggggtctgcgaagagccggggccatggagcagcctgtgtagacggggacctgccctgcatgggcaccccctcactggctgcttcccttggtctccaggaaggcgtcacctctcagacctcccactggagccgcctctacttcatgaccttttacattgtgaccatggtggtgatgacgatcattgtcgcctttatcctcgaggccttcgtcttccgaatgaactacagccgcaagaaccaggactcggaagttgatggtggcatcacccttgagaaggaaatctccaaagaagagctggttgccgtcctggagctctaccgggaggcacggggggcctcctcggatgtcaccaggctgctggagaccctctcccagatggagagataccagcaacattccatggtgtttctgggacggcgatcaaggaccaagagcgacctgagcctgaagatgtaccaggaggagatccagagatggtatcgctctgtcacctgggctggagtccagtggcgtgatcatagctcactgtagcctccaacccctgggctcaagtgatcctccccactcagcctacccaagcagctggaactacaggagtggtatgaggagcatgccagggagcaagagcagcagcgacaactcagcagcagtgcagcccccgccgcccagcagcccccaggcagccgccagcgctcccagaccgttacctagcccagcgcccgaaagccgtctcttctatgcaataacacaatagtattactctactgcgatgtacggaactgcggtgtgtgtacacatactcacgtatatgcacatatttatatacaggaagaaaaaagacagacaagatggggcttggtttataaccaccttgccctgtcttccttaactccagaagccagtttggtgaggggtgggggtgcggccaccaggtctgagctcttcctactgtggaaggctccagaaggcccttcacaaggagacccctcacctggatccagtcgactgcggggcttgcccctcatgtgggctggcctccatcggccacgtccaaagctgtcactgctactgcttcaggctcacatccccccgacctgatggcgtgcccgccccctctccctgcggcccatgccacaggtttctgtgttttgctttagggacagaaccacttaggaaggaaagaactcccggtctccagggtggtatttcagtgtctgtgataatgtcacgcaacacctcttcggggaccagtgcccaggatctaatggaagcggaattggggcaactgggcccatgtggccagagctcagttagccagtgccgggcggccacagattacactgaccaatctcctcccttggctctgcaagcctcccacccagccttctctggcttaacccttgttggcgaaaactcttccacagtggcctccttggggacccagaacccggaggaaggggcatgaggcaggaagtggggccgatgtctgcaacccagaccacttcgtggaatgggctcttgaccaaatccctttttttgcgatttacccgttcaagcaaaacaacgttttggttaactaaggattgtgctaaagccgataccaggtccttcacacgtgtgcactaggaacaggagcgaacagcacagagagacgctccctgtgggacgcagcagccccgtggccccggcccagttcccagccaccctccctggctctgctcacaccagagatttccatagcaggagcggttggtgcagaagtaggttcagatgaacctcagttaacgtcgccacccctcctcccaccatggtaccctgtaggagccctgtatgacatctgagcgtggtggaggtaggagggttgccagctgcagtgaccctgccacagaggcagggtcagtgcagaggtcgctttggttccgcttccctgggccacagaacggaacacagcataggttctgcagcaggagccgcagtggcaggatggagggtgcgaagggcaaggagtgcactgctgggcattcctggccagccccggccctctggtgcctgcttcctgtgacttcagaaggcaggtggacagagcctccctctggccttgtcctcttcccagccacagaacgggcagggtggcacccgaccccaggggagcagtacctggtcccccaccccctcctcccaaccacctccaaggccaagctgggtcccatagccagcacggcatggttctccccttccccccttcccaggtcaggggagttggacaagtagcaggtgtttgtttttaaagcacagccctttgggaaagcaacacattattgagactcactgtgattcccccgggagtcagactggctttgtcctcttcctctctggagggccatgggccatcagcaggagctccacatcgagccccaggccagaaccccctccctttcacagagagggaactttattgcacaattgggtgccttttagcttttgtgtgttgaaatgggcgttttggaagcaagggtcaggggacagcttctaaaggtgtgagtctctgacctgagcatctgggcctcgcctgggcccttcttcctccccaggggtggaaacgtggaggggccagcagcaccccggggtctgcccaggggagtcaaggccccgaggtgggggggcctattccaggaggagtgggatctcggccctgtccagagcgagttaatgtgtccatctgcccaaccctgtcctgagaaaggacctggttttggccaggacctgacaaatacccaatggcagcagtgtcaacagacgggagtccagccagggtgggtgcccttgtcattgaggttagggacagctatccccaggttatgcctggccccacccagcagggagttggggtccccccacaggctgtgagctctgtgggccctgggatgtgatctagctcagatgccctctcatccttgatgtcatagttgagtgcacccaagtggcacccactggcggccaggggcacagcctggtggtggtggcaatagaactgtgcccctcctcagctcctcgcttcccctcccacagccccagccttactccaccatgcggacaatcattttgtacggatcacgggagcaatgctgtacggttttgtacactggtggtttgtttcctagaaaacccattgtgtctctggatttctagcacattactaaaagagcctctgctttgtaaa

SEQ ID NO: 15742 - DNA, 5597 bp, Homo sapiens
  misc_feature (11)..(11): n is a, c, g, or t
  misc_feature (5315)..(5315): n is a, c, g, or t
  misc_feature (5317)..(5317): n is a, c, g, or t
gagctggcgcngtgccctggtggcagtggctgaagtggcggcggcttcggcggctgcggcggctgcaacagcttcgggctcggggttttggcggcggcgccggcgggctaggctgcgcggtgcggaccccggcgcgcggtccgggttgctggggcggcgcgtaagatgcctctaatggaggagtttctgagcagcacccctggcccagtggctttgaaagggagctcaaaccagagactatttcaagccctggatatcatatcctgagggccacaggagaagagaacatggctgtgagtttggatgacgacgtgccgctcatcctgaccttggatgagggtggcagtgccccactggctccctccaacggcctgggccaagaagagctacctagcaaaaatggcggcagctatgccatccacgactcccaggcccccagtctcagctctgggggtgagagttccccctccagccccgcacacaactgggagatgaattaccaagaggcagcaatctacctccaggaaggcgagaacaacgacaagttcttcacccaccccaaggatgccaaggcgctggcggcctacctctttgcacacaatcacctcttctacctgatggagctggccacggccctgctgctgctgctgctctccctgtgcgaggcccccgccgtccccgcactccggcttggcatctatgtccacgccaccctggagctgtttgccctgatggtggtagtgtttgaactctgcatgaagttacgctggctgggcctccacaccttcatccggcacaagcggaccatggtcaagacctcggtgctggtggtgcagtttgtcgaggccatcgtggtgttggtacggcagatgtcccatgtgcgggtgacccgagcactgcgctgcattttcctggtggactgtcggtattgcggtggcgtccggcgcaacctgcggcagatcttccagtccctgccgcccttcatggacatcctcctgctgctgctgttcttcatgatcatctttgccatcctcggtttctacttgttctcccctaacccttcagacccctacttcagcaccctggagaacagcatcgtcagtctgtttgtccttctgaccacagccaatttcccagatgtgatgatgccctcctactcccggaacccctggtcctgcgtcttcttcatcgtgtacctctccatcgagctgtatttcatcatgaacctgcttctggctgtggtgttcgacaccttcaatgacattgagaaacgcaagttcaagtctttgctactgcacaagcgaaccgctatccagcatgcctaccgcctgctcatcagccagaggaggcctgccggcatctcctacaggcagtttgaaggcctcatgcgcttctacaagccccggatgagtgccagggagcgctatcttaccttcaaggccctgaatcagaacaacacacccctgctcagcctaaaggacttttacgatatctacgaagttgctgctttgaagtggaaggccaagaaaaacagagagcactggtttgatgagcttcccaggacggcgctcctcatcttcaaaggtattaatatccttgtgaagtccaaggccttccagtatttcatgtacttggtggtggcagtcaacggggtctggatcctcgtggagacatttatgctgaaaggtgggaacttcttctccaagcacgtgccctggagttacctcgtctttctaactatctatggggtggagctgttcctgaaggttgccggcctgggccctgtggagtacttgtcttccggatggaacttgtttgacttctccgtgacagtgttcgccttcctgggactgctggcgctggccctcaacatggagcccttctatttcatcgtggtcctgcgccccctccagctgctgaggttgtttaagttgaaggagcgctaccgcaacgtgctggacaccatgttcgagctgctgccccggatggccagcctgggcctcaccctgctcatcttttactactccttcgccatcgtgggcatggagttcttctgcgggatcgtcttccccaactgctgcaacacgagtacagtggcagatgcctaccgctggcgcaaccacaccgtgggcaacaggaccgtggtggaggaaggctactattatctcaataattttgacaacatcctcaacagctttgtgaccctgtttgagctcacagttgtcaacaactggtacatcatcatggaaggcgtcacctctcagacctcccactggagccgcctctacttcatgaccttttacattgtgaccatggtggtgatgacgatcattgtcgcctttatcctcgaggccttcgtcttccgaatgaactacagccgcaagaaccaggactcggaagttgatggtggcatcacccttgagaaggaaatctccaaagaagagctggttgccgtcctggagctctaccgggaggcacggggggcctcctcggatgtcaccaggctgctggagaccctctcccagatggagagataccagcaacattccatggtgtttctgggacggcgatcaaggaccaagagcgacctgagcctgaagatgtaccaggaggagatccaggagtggtatgaggagcatgccagggagcaagagcagcagcgacaactcagcagcagtgcagcccccgccgcccagcagcccccaggcagccgccagcgctcccagaccgttacctagcccagcgcccgaaagccgtctcttctatgcaataacacaatagtattactctactgcgatgtacggaactgcggtgtgtgtacacatactcacgtatatgcacatatttatatacaggaagaaaaaagacagacaagatggggcttggtttataaccaccttgccctgtcttccttaactccagaagccagtttggtgaggggtgggggtgcggccaccaggtctgagctcttcctactgtggaaggctccagaaggcccttcacaaggagacccctcacctggatccagtcgactgcggggcttgcccctcatgtgggctggcctccatcggccacgtccaaagctgtcactgctactgcttcaggctcacatccccccgacctgatggcgtgcccgccccctctccctgcggcccatgccacaggtttctgtgttttgctttagggacagaaccacttaggaaggaaagaactcccggtctccagggtggtatttcagtgtctgtgataatgtcacgcaacacctcttcggggaccagtgcccaggatctaatggaagcggaattggggcaactgggcccatgtggccagagctcagttagccagtgccgggcggccacagattacactgaccaatctcctcccttggctctgcaagcctcccacccagccttctctggcttaacccttgttggcgaaaactcttccacagtggcctccttggggacccagaacccggaggaaggggcatgaggcaggaagtggggccgatgtctgcaacccagaccacttcgtggaatgggctcttgaccaaatccctttttttgcgatttacccgttcaagcaaaacaacgttttggttaactaaggattgtgctaaagccgataccaggtccttcacacgtgtgcactaggaacaggagcgaacagcacagagagacgctccctgtgggacgcagcagccccgtggccccggcccagttcccagccaccctccctggctctgctcacaccagagatttccatagcaggagcggttggtgcagaagtaggttcagatgaacctcagttaacgtcgccacccctcctcccaccatggtaccctgtaggagccctgtatgacatctgagcgtggtggaggtaggagggttgccagctgcagtgaccctgccacagaggcagggtcagtgcagaggtcgctttggttccgcttccctgggccacagaacggaacacagcataggttctgcagcaggagccgcagtggcaggatggagggtgcgaagggcaaggagtgcactgctgggcattcctggccagccccggccctctggtgcctgcttcctgtgacttcagaaggcaggtggacagagcctccctctggccttgtcctcttcccagccacagaacgggcagggtggcacccgaccccaggggagcagtacctggtcccccaccccctcctcccaaccacctccaaggccaagctgggtcccatagccagcacggcatggttctccccttccccccttcccaggtcaggggagttggacaagtagcaggtgtttgtttttaaagcacagccctttgggaaagcaacacattattgagactcactgtgattcccccgggagtcagactggctttgtcctcttcctctctggagggccatgggccatcagcaggagctccacatcgagccccaggccagaaccccctccctttcacagagagggaactttattgcacaattgggtgccttttagcttttgtgtgttgaaatgggcgttttggaagcaagggtcaggggacagcttctaaaggtgtgagtctctgacctgagcatctgggcctcgcctgggcccttcttcctccccaggggtggaaacgtggaggggccagcagcaccccggggtctgcccaggggagtcaaggccccgaggtgggggggcctattccaggaggagtgggatctcggccctgtccagagcgagttaatgtgtccatctgcccaaccctgtcctgagaaaggacctggttttggccaggacctgacaaatacccaatggcagcagtgtcaacagacgggagtccagccagggtgggtgcccttgtcattgaggttagggacagctatccccaggttatgcctggccccacccagcagggagttggggtccccccacaggctgtgagctctgtgggccctgggatgtgatctagctcagatgccctctcatccttgatgtcatagttgagtgcacccaagtggcacccactggcggccaggggcacagcctggtggtggtggcaatagaactgtgcccctcctcagctcctcgcttcccctcccacagccccagccttactccaccatgcggacaatcattttgtacggatcacgggagcaatgctgtacggttttgtacactggtggtttgtttcctagaaaacccattgtgtctctggatttctagcacattactaaaagagcctctgctttgtaaaaaaaaaaaaaaaaaaaaaaaaaaaaaaacaaaaaaaaaaaaaaaaaaaaaaaaaaaaaaaaaaaacananaaaaaaaaaaaaaaaattcactgcccggcgttttacaccgtgagactggaaaaccctggggttccccacttaatcgcttggagaaaatccccttttgccagttggggaataccaaagagcccgcactgtggcctttccaacagtggccaacctgaatggaaagggaaattgaagcttaatatttgtaaattcggtaaaatttggtaacaactacttcttaccaattggccgaattggaaactccttttgattccgcttagggttgaggtttctcgttggt

SEQ ID NO: 15743 - DNA, 3962 bp, Homo sapiens
  misc_feature (11)..(11): n is a, c, g, or t
gagctggcgcngtgccctggtggcagtggctgaagtggcggcggcttcggcggctgcggcggctgcaacagcttcgggctcggggttttggcggcggcgccggcgggctaggctgcgcggtgcggaccccggcgcgcggtccgggttgctggggcggcgcgtaagatgcctctaatggaggagtttctgagcagcacccctggcccagtggctttgaaagggagctcaaaccagagactatttcaagccctggatatcatatcctgagggccacaggagaagagaacatggctgtgagtttggatgacgacgtgccgctcatcctgaccttggatgagggtggcagtgccccactggctccctccaacggcctgggccaagaagagctacctagcaaaaatggcggcagctatgccatccacgactcccaggcccccagtctcagctctgggggtgagagttccccctccagccccgcacacaactgggagatgaattaccaagaggcagcaatctacctccaggaaggcgagaacaacgacaagttcttcacccaccccaaggatgccaaggcgctggcggcctacctctttgcacacaatcacctcttctacctgatggagctggccacggccctgctgctgctgctgctctccctgtgcgaggcccccgccgtccccgcactccggcttggcatctatgtccacgccaccctggagctgtttgccctgatggtggtagtgtttgaactctgcatgaagttacgctggctgggcctccacaccttcatccggcacaagcggaccatggtcaagacctcggtgctggtggtgcagtttgtcgaggccatcgtggtgttggtacggcagatgtcccatgtgcgggtgacccgagcactgcgctgcattttcctggtggactgtcggtattgcggtggcgtccggcgcaacctgcggcagatcttccagtccctgccgcccttcatggacatcctcctgctgctgctgttcttcatgatcatctttgccatcctcggtttctacttgttctcccctaacccttcagacccctacttcagcaccctggagaacagcatcgtcagtctgtttgtccttctgaccacagccaatttcccagatgtgatgatgccctcctactcccggaacccctggtcctgcgtcttcttcatcgtgtacctctccatcgagctgtatttcatcatgaacctgcttctggctgtggtgttcgacaccttcaatgacattgagaaacgcaagttcaagtctttgctactgcacaagcgaaccgctatccagcatgcctaccgcctgctcatcagccagaggaggcctgccggcatctcctacaggcagtttgaaggcctcatgcgcttctacaagccccggatgagtgccagggagcgctatcttaccttcaaggccctgaatcagaacaacacacccctgctcagcctaaaggacttttacgatatctacgaagttgctgctttgaagtggaaggccaagaaaaacagagagcactggtttgatgagcttcccaggacggcgctcctcatcttcaaaggtattaatatccttgtgaagtccaaggccttccagtatttcatgtacttggtggtggcagtcaacggggtctggatcctcgtggagacatttatgctgaaaggtgggaacttcttctccaagcacgtgccctggagttacctcgtctttctaactatctatggggtggagctgttcctgaaggttgccggcctgggccctgtggagtacttgtcttccggatggaacttgtttgacttctccgtgacagtgttcgccttcctgggactgctggcgctggccctcaacatggagcccttctatttcatcgtggtcctgcgccccctccagctgctgaggttgtttaagttgaaggagcgctaccgcaacgtgctggacaccatgttcgagctgctgccccggatggccagcctgggcctcaccctgctcatcttttactactccttcgccatcgtgggcatggagttcttctgcgggatcgtcttccccaactgctgcaacacgagtacagtggcagatgcctaccgctggcgcaaccacaccgtgggcaacaggaccgtggtggaggaaggctactattatctcaataattttgacaacatcctcaacagctttgtgaccctgtttgagctcacagttgtcaacaactggtacatcatcatggaaggcgtcacctctcagacctcccactggagccgcctctacttcatgaccttttacattgtgaccatggtggtgatgacgatcattgtcgcctttatcctcgaggccttcgtcttccgaatgaactacagccgcaagaaccaggactcggaagttgatggtggcatcacccttgagaaggaaatctccaaagaagagctggttgccgtcctggagctctaccgggaggcacggggggcctcctcggatgtcaccaggctgctggagaccctctcccagatggagagataccagcaacattccatggtgtttctgggacggcgatcaaggaccaagagcgacctgagcctgaagatgtaccaggaggagatccaggagtggtatgaggagcatgccagggagcaagagcagcagcgacaactcagcagcagtgcagcccccgccgcccagcagcccccaggcagccgccagcgctcccagaccgttacctagcccagcgcccgaaagccgtctcttctatgcaataacacaatagtattactctactgcgatgtacggaactgcggtgtgtgtacacatactcacgtatatgcacatatttatatacaggaagaaaaaagacagacaagatggggcttggtttataaccaccttgccctgtcttccttaactccagaagccagtttggtgaggggtgggggtgcggccaccaggtctgagctcttcctactgtggaaggctccagaaggcccttcacaaggagacccctcacctggatccagtcgactgcggggcttgcccctcatgtgggctggcctccatcggccacgtccaaagctgtcactgctactgcttcaggctcacatccccccgacctgatggcgtgcccgccccctctccctgcggcccatgccacaggtttctgtgttttgctttagggacagaaccacttaggaaggaaagaactcccggtctccagggtggtatttcagtgtctgtgataatgtcacgcaacacctcttcggggaccagtgcccaggatctaatggaagcggaattggggcaactgggcccatgtggccagagctcagttagccagtgccgggcggccacagattacactgaccaatctcctcccttggctctgcaagcctcccacccagccttctctggcttaacccttgttggcgaaaactcttccacagtggcctccttggggacccagaacccggaggaaggggcatgaggcaggaagtggggccgatgtctgcaacccagaccacttcgtggaatgggctcttgaccaaatccctttttttgcgatttacccgttcaagcaaaacaacgttttggttaactaaggattgtgctaaagccgataccaggtccttcacacgctgtgagctctgtgggccctgggatgtgatctagctcagatgccctctcatccttgatgtcatagttgagtgcacccaagtggcacccactggcggccaggggcacagcctggtggtggtggcaatagaactgtgcccctcctcagctcctcgcttcccctcccacagccccagccttactccaccatgcggacaatcattttgtacggatcacgggagcaatgctgtacggttttgtacactggtggtttgtttcctagaaaacccattgtgtctctggatttctagcacattactaaaagagcctctgctttgtaaa

SEQ ID NO: 15744 - DNA, 2951 bp, Homo sapiens
  misc_feature (11)..(11): n is a, c, g, or t
gagctggcgcngtgccctggtggcagtggctgaagtggcggcggcttcggcggctgcggcggctgcaacagcttcgggctcggggttttggcggcggcgccggcgggctaggctgcgcggtgcggaccccggcgcgcggtccgggttgctggggcggcgcgtaagatgcctctaatggaggagtttctgagcagcacccctggcccagtggctttgaaagggagctcaaaccagagactatttcaagccctggatatcatatcctgagggccacaggagaagagaacatggctgtgagtttggatgacgacgtgccgctcatcctgaccttggatgagggtggcagtgccccactggctccctccaacggcctgggccaagaagagctacctagcaaaaatggcggcagctatgccatccacgactcccaggcccccagtctcagctctgggggtgagagttccccctccagccccgcacacaactgggagatgaattaccaagaggcagcaatctacctccaggaaggcgagaacaacgacaagttcttcacccaccccaaggatgccaaggcgctggcggcctacctctttgcacacaatcacctcttctacctgatggagctggccacggccctgctgctgctgctgctctccctgtgcgaggcccccgccgtccccgcactccggcttggcatctatgtccacgccaccctggagctgtttgccctgatggtggtagtgtttgaactctgcatgaagttacgctggctgggcctccacaccttcatccggcacaagcggaccatggtcaagacctcggtgctggtggtgcagtttgtcgaggccatcgtggtgttggtacggcagatgtcccatgtgcgggtgacccgagcactgcgctgcattttcctggtggactgtcggtattgcggtggcgtccggcgcaacctgcggcagatcttccagtccctgccgcccttcatggacatcctcctgctgctgctgttcttcatgatcatctttgccatcctcggtttctacttgttctcccctaacccttcagacccctacttcagcaccctggagaacagcatcgtcagtctgtttgtccttctgaccacagccaatttcccagatgtgatgatgccctcctactcccggaacccctggtcctgcgtcttcttcatcgtgtacctctccatcgagctgtatttcatcatgaacctgcttctggctgtggtgttcgacaccttcaatgacattgagaaacgcaagttcaagtctttgctactgcacaagcgaaccgctatccagcatgcctaccgcctgctcatcagccagaggaggcctgccggcatctcctacaggcagtttgaaggcctcatgcgcttctacaagccccggatgagtgccagggagcgctatcttaccttcaaggccctgaatcagaacaacacacccctgctcagcctaaaggacttttacgatatctacgaagttgctgctttgaagtggaaggccaagaaaaacagagagcactggtttgatgagcttcccaggacggcgctcctcatcttcaaaggtattaatatccttgtgaagtccaaggccttccagtatttcatgtacttggtggtggcagtcaacggggtctggatcctcgtggagacatttatgctgaaaggtgggaacttcttctccaagcacgtgccctggagttacctcgtctttctaactatctatggggtggagctgttcctgaaggttgccggcctgggccctgtggagtacttgtcttccggatggaacttgtttgacttctccgtgacagtgttcgccttcctgggactgctggcgctggccctcaacatggagcccttctatttcatcgtggtcctgcgccccctccagctgctgaggttgtttaagttgaaggagcgctaccgcaacgtgctggacaccatgttcgagctgctgccccggatggccagcctgggcctcaccctgctcatcttttactactccttcgccatcgtgggcatggagttcttctgcgggatcgtcttccccaactgctgcaacacgagtacagtggcagatgcctaccgctggcgcaaccacaccgtgggcaacaggaccgtggtggaggaaggctactattatctcaataattttgacaacatcctcaacagctttgtgaccctgtttgagctcacagttgtcaacaactggtacatcatcatggaaggcgtcacctctcagacctcccactggagccgcctctacttcatgaccttttacattgtgaccatggtggtgatgacgatcattgtcgcctttatcctcgaggccttcgtcttccgaatgaactacagccgcaagaaccaggactcggaaggtctgtgcagggatgatgccttgggcatttgatatctgccgcctacccagctctgtctgtctgtctgggtggctgtccagccagccatcaggctgtcatttttctgctgtctggctgtccagcttatctatctggcttgtctttctagatcttgtatttgcattgattttcaaatatttaatgtcagaaaacgtaatctaactttaaaataagacagagcatgtcatagttggagaaaaatcaagaagtagagaaaggcttatgtggcagcagcagcccctgccctgcctttccctcccgtcctccagaggcttctccttcttggctatttcttctgttagtcatctccacgtttctcaataataggttcacactacggttcttgatttaaatggtgtaaatattgcttatggcacaggcgaatcgtattcctgctgcaactggatggtgctggctttagtgactgcctcactcttcccagattgcacagctttctgtgtgctgacccccttcctacctccagaataaagaatctcaacctggaaaaaaaa

SEQ ID NO: 15745 - DNA, 1748 bp, Homo sapiens
  misc_feature (11)..(11): n is a, c, g, or t
gagctggcgcngtgccctggtggcagtggctgaagtggcggcggcttcggcggctgcggcggctgcaacagcttcgggctcggggttttggcggcggcgccggcgggctaggctgcgcggtgcggaccccggcgcgcggtccgggttgctggggcggcgcgtaagatgcctctaatggaggagtttctgagcagcacccctggcccagtggctttgaaagggagctcaaaccagagactatttcaagccctggatatcatatcctgagggccacaggagaagagaacatggctgtgagtttggatgacgacgtgccgctcatcctgaccttggatgagggtggcagtgccccactggctccctccaacggcctgggccaagaagagctacctagcaaaaatggcggcagctatgccatccacgactcccaggcccccagtctcagctctgggggtgagagttccccctccagccccgcacacaactgggagatgaattaccaagaggcagcaatctacctccaggaaggcgagaacaacgacaagttcttcacccaccccaaggatgccaaggcgctggcggcctacctctttgcacacaatcacctcttctacctgatggagctggccacggccctgctgctgctgctgctctccctgtgcgaggcccccgccgtccccgcactccggcttggcatctatgtccacgccaccctggagctgtttgccctgatggtggtagtgtttgaactctgcatgaagttacgctggctgggcctccacaccttcatccggcacaagcggaccatggtcaagacctcggtgctggtggtgcagtttgtcgaggccatcgtggtgttggtacggcagatgtcccatgtgcgggtgacccgagcactgcgctgcattttcctggtggactgtcggtattgcggtggcgtccggcgcaacctgcggcagatcttccagtccctgccgcccttcatggacatcctcctgctgctgctgttcttcatgatcatctttgccatcctcggtttctacttgttctcccctaacccttcagacccctacttcagcaccctggagaacagcatcgtcagtctgtttgtccttctgaccacagccaatttcccagatgtgatgatgccctcctactcccggaacccctggtcctgcgtcttcttcatcgtgtacctctccatcgagctgtatttcatcatgaacctgcttctggctgtggtgttcgacaccttcaatgacattgagaaacgcaagttcaagtctttgctactgcacaagcgaaccgctatccagcatgcctaccgcctgctcatcagccagaggaggcctgccggcatctcctacaggcagtttgaaggcctcatgcgcttctacaagccccggatgagtgccagggagcgctatcttaccttcaaggccctgaatcagaacaacacacccctgctcagcctaaaggacttttacgatatctacgaagttgctgctttgaagtggaaggccaagaaaaacagagagcactggtttgatgagcttcccaggacggcgctcctcatcttcaaaggtattaatatccttgtgaagtccaaggccttccagtatttcatgtgtaagtgtgaaatatctccactctaggccactttccccctgagtcctttgctgttctagaagcgggagaggcaagagattggtcctagagtcctgtgtttgactttttattgtggggaa

SEQ ID NO: 15746 - DNA, 340 bp, Homo sapiens
gggtctgcgaagagccggggccatggagcagcctgtgtagacggggacctgccctgcatgggcaccccctcactggctgcttcccttggtctccaggaaggcgtcacctctcagacctcccactggagccgcctctacttcatgaccttttacattgtgaccatggtaggtcccggaccacagaacgctctttgtccttcgtcttccacatcaccagctgcccctgctcttcagcctgcagcgtcagggagtggggctgggtcccatctggccggactctgttgggcgtgggctgcgcagccacggacacctacccaccctcctcccctgcctctgcccc

SEQ ID NO: 15747 - DNA, 391 bp, Homo sapiens
ggaatgttaattccagatttcactttctgatttttttacgtatttaaaattttgtttctttaaaaatagctttattgaggtataattcaagcaccgtacaattcacccattttgaaatgtacaattcagtggtttttagtatatttgcagagttgtgcaacaattgccacagccaattttagaacattttcatctccctaaaacgacactcgcgccctgtaatcctccagtttccggcctgcagcctctcctggggcggcagacacgggtccccgttctgtcgccggctgtgcctctcttgggcatttcgtgtcagtggaagcgtctggcccatggcctctgtgtgcgtggcctgttggttggcaccacattgtggatgctgtggtgtggg

SEQ ID NO: 15748 - DNA, 1166 bp, Homo sapiens
acctgagtgtggataacttttagtatctgtgggggatcctggaaccaattccctgccaatatagaaggacaactgtctacagtacttgaagtattattaactacattcgccatgctgtatgttagatccccagaacatatttatcctgcatatctaaaattttgatcattttacaaactttctattttttttgtcaattttctccagctagacacttgtgcaatacggctattatctgatctttgccttaaatgttgtgcttcttttccatatgcacgtattttgcaaaatataaagtgtgtagagctatatagcactcagccaagtggtgggtacctgcaggtgcttcagagaagtaaattgatgctgctaatatttgttgaatggcacgaatatgatgagcaatagcaggtggtgcccttcagccagaccatcgctccgtgcgtctgatgcatcttgccaaagagtagttctgggaggtggttgcctctagagaacacattcctcctattctggggtcccgtgagagaaagaaatgcttttgcttttgatgtgggactcttactaagcctttcttcagagaaaaggaagtgaaaaatgcaccccatgataatcagtttcttacaacatactgtgatagtaccggcttcgttgtttttagctggaatcattagcttccatttttagaataacagctattggctaaattaggctacagtaggccattaagatggatgttggaattaaaaacatttttggaaaaaagcctgctttgagcctttgttataagcccttgggtagagatctgggtcctgtttctgatttcttgtgagccttcactctgacagttttgtttccagaaacacactcttagcctgctcctgaaatgggaacagacaggccaacttcccctctccagtctcccctgcgggtcaaagctttactttcctgtcatgttaagaaagaatagatttaaccttgataatccatgtagtattctgtatttttaccttttccttatctgaaaaaaagtgtatatatggcatggaattgattgcacaggcacatggcatgttggcttgtgaaccaattgttaaaatttcaagttaatcattaaaataatatctttcaaattaagttatattaaaaacaaaggtaacattcta

SEQ ID NO: 15749 - DNA, 1475 bp, Homo sapiens
  misc_feature (1247)..(1248): n is a, c, g, or t
  misc_feature (1252)..(1252): n is a, c, g, or t
  misc_feature (1255)..(1255): n is a, c, g, or t
  misc_feature (1264)..(1264): n is a, c, g, or t
  misc_feature (1269)..(1269): n is a, c, g, or t
  misc_feature (1275)..(1275): n is a, c, g, or t
  misc_feature (1291)..(1291): n is a, c, g, or t
acctgagtgtggataacttttagtatctgtgggggatcctggaaccaattccctgccaatatagaaggacaactgtctacagtacttgaagtattattaactacattcgccatgctgtatgttagatccccagaacatatttatcctgcatatctaaaattttgatcattttacaaactttctattttttttgtcaattttctccagctagacacttgtgcaatacggctattatctgatctttgccttaaatgttgtgcttcttttccatatgcacgtattttgcaaaatataaagtgtgtagagctatatagcactcagccaagtggtgggtacctgcaggtgcttcagagaagtaaattgatgctgctaatatttgttgaatggcacgaatatgatgagcaatagcaggtggtgcccttcagccagaccatcgctccgtgcgtctgatgcatcttgccaaagagtagttctgggaggtggttgcctctagagaacacattcctcctattctggggtcccgtgagagaaagaaatgcttttgcttttgatgtgggactcttactaagcctttcttcagagaaaaggaagtgaaaaatgcaccccatgataatcagtttcttacaacatactgtgatagtaccggcttcgttgtttttagctggaatcattagcttccatttttagaataacagctattggctaaattaggctacagtaggccattaagatggatgttggaattaaaaacatttttggaaaaaagcctgctttgagcctttgttataagcccttgggtagagatctgggtcctgtttctgatttcttgtgagccttcactctgacagttttgtttccagaaacacactcttagcctgctcctgaaatgggaacagacaggccaacttcccctctccagtctcccctgcgggtcaaagctttactttcctgtcatgttaagaaagaatagatttaaccttgataatccatgtagtattctgtatttttaccttttccttatctgaaaaaaagtgtatatatggcatggaattgattgcacaggcacatggcatgttggcttgtgaaccaattgttaaaatttcaagttaatcattaaaataatatctttcaaattaagttatattaaaaacaaaggtaacattctaaatcattactttctaattatttcgcccttttttttgtcgttgattatttagacttaagaaagtgatgggaaaaacgttatnncagncanagtgtcggngcatncagggnttccacctgacctgangctcatattgacatatacttcaggggttgtcagatgtcatcagcagagacaagcgagggcacctgaatccaaggggggaaaggggggaagagaacagctgggtggggttttgttcgccccgtgtataaaaatcggccggcttgcggcggggcatcccccgggccttgggggggcctccccgacg

SEQ ID NO: 15750 - DNA, 1622 bp, Homo sapiens
acctgagtgtggataacttttagtatctgtgggggatcctggaaccaattccctgccaatatagaaggacaactgtctacagtacttgaagtattattaactacattcgccatgctgtatgttagatccccagaacatatttatcctgcatatctaaaattttgatcattttacaaactttctattttttttgtcaattttctccagctagacacttgtgcaatacggctattatctgatctttgccttaaatgttgtgcttcttttccatatgcacgtattttgcaaaatataaagtgtgtagagctatatagcactcagccaagtggtgggtacctgcaggtgcttcagagaagtaaattgatgctgctaatatttgttgaatggcacgaatatgatgagcaatagcaggtggtgcccttcagccagaccatcgctccgtgcgtctgatgcatcttgccaaagagtagttctgggaggtggttgcctctagagaacacattcctcctattctggggtcccgtgagagaaagaaatgcttttgcttttgatgtgggactcttactaagcctttcttcagagaaaaggaagtgaaaaatgcaccccatgataatcagtttcttacaacatactgtgatagtaccggcttcgttgtttttagctggaatcattagcttccatttttagaataacagctattggctaaattaggctacagtaggccattaagatggatgttggaattaaaaacatttttggaaaaaagcctgctttgagcctttgttataagcccttgggtagagatctgggtcctgtttctgatttcttgtgagccttcactctgacagttttgtttccagaaacacactcttagcctgctcctgaaatgggaacagacaggccaacttcccctctccagtctcccctgcgggtcaaagctttactttcctgtcatgttaagaaagaatagatttaaccttgataatccatgtagtattctgtatttttaccttttccttatctgaaaaaaagtgtatatatggcatggaattgattgcacaggcacatggcatgttggcttgtgaaccaattgttaaaatttcaagttaatcattaaaataatatctttcaaattaagttatattaaaaacaaaggtaacattctaaatcattactttctaattatttcgcccttttttttgtcgttgattatttagacttaagaaagtgatgggaaaaacgttaataacacagtacataagttgtttctgtagccattacactgtgattttcacaaacacttgaacacttgaatagtcttccattatttgaaaactattattcaacttatccaagtgaagtattggcatacaaagaagttgtttcatatttgcattgctcatgaatgtaaacaaaatgtcgatatgtgtgaactatacttgttgatcaattgcaaccataggttggctgcagatgcgagagcttggtaaacatcaacaaaagcattctctgagaatgaattgactatatggaatttgtaggaaagtgtattgtgtattttattattatttgtaaattgtgtattccacatcttttagattagtaaaatttatagtaaacat

SEQ ID NO: 15751 - DNA, 455 bp, Homo sapiens
tctggctctgggcagtaaagggacatggctgctgcttatttcaggaacttaggggcaagtgtcttcatgcctgtggaaacaggagccagctagtactatttccagcaagaaatttaagagaaaggagagatttttattatgattttgatttctttactacaacattgcatgtgtctggagtatagccattacactttatgaaaaaggcaaaatggtcatttggggtgttttaggaagtttgccaaaaggctcctttgtcattataatccttcctaagctgccatccacgggtttaggtcatggatatgaaaagtgaaagggtttagagatgaagtagtgtcccctgagtgcttaccaacctgttaatctttttgagatgttaattttttcatatagagccccctaaaatcttgatggctctagatcagtcaagcctaagagaagacgtatttatg

SEQ ID NO: 15752 - DNA, 504 bp, Homo sapiens
ctggctgatcattatatatagctttgagctttcaaaaaatactgatgccaagactctaccctgaaccaattaaattacagcctaaagtgcagctgagtttgagaatcatggcttaccttttcttgaactccttaagttagggaatacatactcccttcccagttttgtcaaattgattcaaatttgccaccttataaacatccagctattgcaaagagcctggtatatcgtagagtttcagtatatctatttcatagtttcccccctgtggtcttgcagaatggaattaacctgaattcaacaaaagaggtctttaaaattcataacagcaggtgtcgtctgtctttgaaattcccttgccaaaaaaggaaatgatttcttagtgatatgctttacttctgttgatcactatttgctcttttaaagtgtccaaagatgttttaatagatacttggtatttgttgttttctttaataaagtataatttacatgtagcacaggaat

SEQ ID NO: 15753 - DNA, 785 bp, Homo sapiens
gagcatgtctgacctgctcagacatgcagggtagttggcatctcaaaagagtagaagaaaggaatatttaaacaaatggctgagaacttttccaaaactcatgaaagatatcacaccaaaaattcaagaatccctcccacaaactccaagtgggataaataaaaacaacccacacctagaaacatcatagtaaaactgttgaagaccaaagaaaaataatattttagacctgctggggtgggagagggaatataaccattaaaggagcaataatattagactgacagctccttctcagcagaaacaatggaagacagtgaaatactgccttttatggttctgaaagaaaatgactgccaacctaaaaatttctaatcagggaaaatatcctgcaaaaatgaagaggatatgaagacatttttagagaaacagctagaagaattaatcagcacgcctaccctaaaggaaaatttaaaaggtgttttacaggcagaaggaaaataatcccaaacgtaaggacagagccctaggaaagattgaagagcaatgaaaatgacacataaatattgactacataaaacaataattatgtcttatggagttttaaatatatagagaaataaaatgtatgaaaatgaaaggatttatgtgggaattttaagtgttctaagacacttggcatcatccaagaagagagtaaaaattcatttaatattagtctttgataactcatgtatgcatgataatatttgagatatcaataaaagtgtatagctttccacata

SEQ ID NO: 15754 - DNA, 123 bp, Homo sapiens
ctgggaccaggaatttgggccgtttctaccatattctcagcagcctaaggtggtggcctgctgatgtggagactactcaccttgagccatgtggtccccaggacagaaatggcctttgttttg

SEQ ID NO: 15755 - DNA, 268 bp, Homo sapiens
catgatgcattgtgtaccaagtcttcatcatggttctgcctatggttcttggtcatcaatgtaatgaaagttctgatatcttataagatgggtggggactctcttatccctgaaaatatcattgtgaatacagtaagagatccaaaatcggccgggtatggtggctcacgcctgtagtcccagcactttgggaggccaaggtgggtggatcacgaggtcaggagatcgagaccatcctgggtaacacggtgaaaccccgtctctacta

SEQ ID NO: 15756 - DNA, 624 bp, Homo sapiens
tatttttctgcaatgtttattcttacatgtttacctctgtgcagtttcctattgactttactaggcaaaacttcaaaaaatcaaatctccaagttctctaaaaatgcattggtctctacttacaacactctcaacaacaatccctgtgatcattcttcttagttctgactgagtcagtaggaaagaaaagcctcttgtttggataatttttcttctatttattgttcatttgtattaacactttagtaagttgactatttaagtccttgcgctagccattgcttttcttctcattaattttaaaatcctcattacatattgaggatattaaccactggtctatcttatatgttataaatattttttcccagtctgtcatctgcctatcggtcttaccttattcttggtcatacgaaagctcctggtctttcatattcaaatcttttctcttttccttcatgatttctgcctatgatatgtgctatgcctcacaaatcctttttcacccccaaattatatagaactcacccatattttcttctagttttatttttgttattatttattttagttattttggagacaggatctcgctttgtgtccaggctggagtgtggtggcggg

SEQ ID NO: 15757 - DNA, 798 bp, Homo sapiens
agcgtggcttcgaagatgtttcagaagcgttgggcggcgggcgtccctgagagaaattagttcaagcgattctcgtgcctcagcctcccgagtagctgggattacaggaatctggaaactgttcttcaggaagaaacccattagtttggaactggagaattcctttgcatcagatactaaaatgaaagaaccacttttaggtggtgagtgtgacaaggcagtggcatcacagctggggctgctagatgaaattaagacagaacccgacaatgctcaagagtattgtcataggcaacagtccagaactcaggagaatgaactgaaaataaatgctgtgttttcagagagtgcttcacagttgactgcaggcattcagctttctctggcatcatctggcatgaataaaatgcttccttcagtttcaaccacagctattcaggtttcctgtgctggttgtaaaaaaattctccagaaggggcaaactgcttatcagaggaaaggatctgctcaacttttctgctccataccatgcatcactgaatacatttcatctgccagttcaccagttccttctaagagaacttgttcaaactgctcaaaagacattttaaatccaaaggatgtgattagtgtccagctggaagacactacctcttgcaaaactttttgcagcctatcttgtctttcatcatatgaagaaaaaagaaaaccatttgttaccatatgtactaatagcattttgaccaagtgcagcatgtgccagaagactgctattattcagtatgaagtaaaatacca

SEQ ID NO: 15758 - DNA, 889 bp, Homo sapiens
agcgtggcttcgaagatgtttcagaagcgttgggcggcgggcgtccctgagagaaattagagtattgtcataggcaacagtccagaactcaggagaatgaactgaaaataaatgctgtgttttcagagagtgcttcacagttgactgcaggcattcagctttctctggcatcatctggcatgaataaaatgcttccttcagtttcaaccacagctattcaggtttcctgtgctggttgtaaaaaaattctccagaaggggcaaactgcttatcagaggaaaggatctgctcaacttttctgctccataccatgcatcactgaatacatttcatctgccagttcaccagttccttctaagagaacttgttcaaactgctcaaaaaacctgccaaaccacttatatctgttccttgcaaaccattgaagccctcagatgaaatgattgagactacgagtgatttggggaagacagagcttttctgctctattaattgtttctctgcatacagtaaagctaagatggaatcttcttcaggtaatgtttgttctgtggtgcatgatacttccaacagaagcttcttttctccaaaggaaaagatacgactccggttatagcatatgtgtcgtggagacaccgatgtttgcgtgcctcatgaacctgatgtcttcacgatccgctcttcggtaacgcgacggcgtgttctgtgggccttctaaggttccctgggaccggtatgctgggctgtttcgtctcgcgcaccagcgtccccttctcggttccgccccgctgcccgccaagtcagcggtggcttggatgggttgcccgttccccgaggggcctatgctgggtgtggcgcacacagggttcgccatatggggcccacagtg

SEQ ID NO: 15759 - DNA, 815 bp, Homo sapiens
agacacagtctcactctgtcacccaggctggagtgcagtggctcaatgtccattcactgcgacctccacctcccaggttcaagcgattctcgtgcctcagcctcccgagtagctgggattacaggaatctggaaactgttcttcaggaagaaacccattagtttggaactggagaattcctttgcatcagatactaaaatgaaagaaccacttttaggtggtgagtgtgacaaggcagtggcatcacagctggggctgctagatgaaattaagacagaacccgacaatgctcaagagtattgtcataggcaacagtccagaactcaggagaatgaactgaaaataaatgctgtgttttcagagagtgcttcacagttgactgcaggcattcagctttctctggcatcatctggcatgaataaaatgcttccttcagtttcaaccacagctattcaggtttcctgtgctggttgtaaaaaaattctccagaaggggcaaactgcttatcagaggaaaggatctgctcaacttttctgctccataccatgcatcactgaatacatttcatctgccagttcaccagttccttctaagagaacttgttcaaactgctcaaaagacattttaaatccaaaggatgtgattagtgtccagctggaagacactacctcttgcaaaactttttgcagcctatcttgtctttcatcatatgaagaaaaaagaaaaccatttgttaccatatgtactaatagcattttgaccaagtgcagcatgtgccagaagactgctattattcagtatgaagtaaaatacca

SEQ ID NO: 15760 - DNA, 841 bp, Homo sapiens
atcagatcataaatatggtcataatgacatcataatgggagagacaagagatagagaacttctacaggtattcagagcattttttttcttttggacataaaatgaatccattgtacaagaatgccttctccccattctcagtgcagagacaaagctgacaagcttaaaagtgcatgtttaggattctagacttggtttaactcaaatggccttgattggatggggtccctctgcagtattaaaactgctctaattgcattcttcaagccagctgaaggctgacagcttccgctcccggctcattatcagagcacttcaaggggctccattatgagcagagcacctggtccaaatttatttcaacggcccagagcaaaatgggaaggtgcttaatgttcaaccacaatggtgacatttttatgagatatccaaggttcagaaacaaataaatgaaaggtttgaagggagcatgaacagaaactgtgacaataaaaattcaacattgatatatcaatttaaaaacatataccacccatacacttggggtaaggccaaaggttcaatgcaggctaaccagaaagaaaaagaagaaaaaaggtcaatactcaactcctcccatgactggctttgctaaaaaagactgatgaaattctaaaaatgtttaaggaaatcagaatgagatgcgaattctgaattccggttaggataacaattatgttatctatctgcaccaacatgagaacgaaagaaaatccaagtggaattcagagtgaatgctaaatgtattatgttcatagtttttctccggtttgcttacacaattgctgtctttctctctctc

SEQ ID NO: 15761 - DNA, 493 bp, Homo sapiens
gaagccctgtgggagtctgggttaggagcactccaggaagtggtccagaggttggagtttttactcccttcatgtgttcatatctgtctgcctgaagtcttaagctgcatagagaaattatgtgttagccaattggagtgttagtaccttgctaactctcctccccatgacgcagccaattccagttgctgggtactcctccccgggactcagtccctgtacagcttctgctctccaacttttctcgctcctagcagcctctggaaccagaatggacggtcctctagtaacgctggattctatgggttggaagtactgcagcggctggatcaggttccagtaaagttttgtaccttcaaatgtctctgttgttaaacagtgttgtagttatctttcccatgggcctagaaattaaggagacaaatgtctactgaacatgctgagtgcttgagaaagacactccagataaatacataaagacttgcttgtttga

SEQ ID NO: 15762 - DNA, 399 bp, Homo sapiens
cacctgtgggggaaaaacaaaaggtctaattttcatgtcattttggagtcccagaaagattggtaaagaaaaactgtttgaagaaataaagactcaaaaaaaatcacaaatttagtgaaaagagatcaatgtatagattcaagaagttcagcaaaccccaaagaagataaactcaaaaccacaatcaggaacgtgataatcaaagataaagaaaaaagtcttgcagtcagccagaggagaacagtacctcaccttcaggggaagcagttcgagccactgcacactcctcatcagaaaccgtgcaggccaggaggcagaaatgaccctgtgaaagcgccgaaggcaattcagttcagaatttaatatctagtgaaaatgctcttcaggaaaggcagtgaa

SEQ ID NO: 15763 - DNA, 989 bp, Homo sapiens
taagccttttaaaaaattttctttgaaagataaaatacatgagtttctaacaattagaaaggaaaaaattaaaatatgaaataacaaaagtaaacaaaagatactttcaaagcagtgaacaaaacattttgacataagccataatataaattataatataaaaacataaaaaccatagtataaattgtcagtctttgagttggccacaaattcaatttaatgaaagaagagaagggatgctggaggtaaataaattcttagagtttctatctcatagagtttgctcttctggttctctagactgccaaagaacataaagatgtacaaggggacctagctgtagtaaaagcatacctataacaacaaaaactctaaaacggtgcccctcacgattttctactgaaatttctctaatagtagaggtataaaataagaagttagagaataatacaaaaggggcccaccatagaaagcacatttcttttctcttaagactcatgtgatttttgcatcttactccataatgtattagtggttgcattaatatgacaatgtctgcaattaaacaccagtaagcaaaattgatacatcagaatgacttgcagggcttatcatgcagtttcatttacatccctaccccactgccatttacttgagcgtgaatgacacacgagagattctttgccttccataatgcaactttacacataaataacacaaggctaaagaaaaccagaactcaaattcaccatgcataggagtgataacaaaaatatttaacagtcagtatgggtgattactggccaatcagaatacgtcactgatatatcaaaatggatgcaggccactgtgactaacttgtgggtatcatttctatgatcaccctaaaacagagttgggaaaatatcaattaactggactctctggtttgaattctcaatatgtatcttaatatgaaatagctcattaaaacttcatgtgtaactatt

SEQ ID NO: 15764 - DNA, 1067 bp, Homo sapiens
  misc_feature (1056)..(1056): n is a, c, g, or t
  misc_feature (1062)..(1062): n is a, c, g, or t
taagccttttaaaaaattttctttgaaagataaaatacatgagtttctaacaattagaaaggaaaaaattaaaatatgaaataacaaaagtaaacaaaagatactttcaaagcagtgaacaaaacattttgacataagccataatataaattataatataaaaacataaaaaccatagtataaattgtcagtctttgagttggccacaaattcaatttaatgaaagaagagaagggatgctggaggtaaataaattcttagagtttctatctcatagagtttgctcttctggttctctagactgccaaagaacataaagatgtacaaggggacctagctgtagtaaaagcatacctataacaacaaaaactctaaaacggtgcccctcacgattttctactgaaatttctctaatagtagaggtataaaataagaagttagagaataatacaaaaggggcccaccatagaaagcacatttcttttctcttaagactcatgtgatttttgcatcttactccataatgtattagtggttgcattaatatgacaatgtctgcaattaaacaccagtaagcaaaattgatacatcagaatgacttgcagggcttatcatgcagtttcatttacatccctaccccactgccatttacttgagcgtgaatgacacacgagagattctttgccttccataatgcaactttacacataaataacacaaggctaaagaaaaccagaactcaaattcaccatgcataggagtgataacaaaaatatttaacagtcagtatgggtgattactggccaatcagaatacgtcactgatatatcaaaatggatgcaggccactgtgactaacttgtgggtatcatttctatgatcaccctaaaacagagttgggaaaatatcaattaactggactctctggtttgaattctcaatatgtatcttaatatgaaatagctcattaaaacttcatgtgtaactatttcagcattgttgtcagctactctttattccacttctatacagatcatgtcatcttcaaatagagacnctttcncttca

SEQ ID NO: 15765 - DNA, 834 bp, Homo sapiens
cagtgagcaacagtcttactgcaaagcaggagcacaacccgtctctttgtctccgtggtcaaatcaattacttcttagaaagtctaatttttttcaaaatgaccatgtacaagagcaaacgcagacatcagagatatatcaacatggcaggagagcccaaaccatacagaccaaaacctggaaacaagaggcccctttctgcactttacagacttgaatcaaaggaacctttcctgtctgttggcggttatgtctttgactatgattactacagagatgatttctacaatcggttatttgattaccacgggcgtgtgcctccacctccccgtgcagtaattccgctgaagcgtcccagagtggcagtcacaacgactcgcagggggaaaggagtcttttccatgaaaggtggatcgagatctactgccagtgggtcaacaggttctaaatgtaagtaatgtccttcattttatttctctttaaagaagggagtgattaactatcattgcacgaatgcctatattcaataaattaaccagatagttatgaaggacctgctatgtataaagtgttagaaaatcataagatggataaaaaatggtctctgctttccaccatactgtgttgcagtaggggagacaaacacaaaaatgtctaacaaaaatccaggaccaatttgaaaagtattttatcagagcaaataacactgtgctcttggcttagcttgtgatatattaaagtactgaaatataatatgttgcttttaatgaagaaataattttacttccaaagggagtgcataaactgtcttttcagagaaacatacaaaattag

SEQ ID NO: 15766 - DNA, 1688 bp, Homo sapiens
cagtgagcaacagtcttactgcaaagcaggagcacaacccgtctctttgtctccgtggtcaaatcaattacttcttagaaagtctaatttttttcaaaatgaccatgtacaagagcaaacgcagacatcagagatatatcaacatggcaggagagcccaaaccatacagaccaaaacctggaaacaagaggcccctttctgcactttacagacttgaatcaaaggaacctttcctgtctgttggcggttatgtctttgactatgattactacagagatgatttctacaatcggttatttgattaccacgggcgtgtgcctccacctccccgtgcagtaattccgctgaagcgtcccagagtggcagtcacaacgactcgcagggggaaaggagtcttttccatgaaaggtggatcgagatctactgccagtgggtcaacaggttctaaattgaaatcagatgagttacagaccatcaagaaagaattaacccagatcaaaactaaaattgactccttgctagggcgcctggagaagattgagaaacagcagaaggcggaggcagaagctcagaagaagcaattggaagagagtctagtgctgatccaagaggaatgtgtgtcagagattgcagatcactctacagaggagcctgctgaaggagggccagatgccgatggagaagagatgacagatgggatagaggaggacttcgatgaagatgggggtcatgagctgtttctacagataaagtgatctgaaataacgcatgatgccacaaagcagaaaagagaaactgtgacaacccccagaaatgtgaaaggaggtttcttactggacagcagcatctttggttcaatttatataaaaacccaaataaataaaatggacagtattgctcagttttagaaattccatttcttctatgttttaagctgtacaattgtcaggtttttatggtttaaattgtaaatgtgttttcccctttgctaattatgttttttttttcagtcttaaaatgtgaaaggcatttatgaatggtaagggaaacactatatacaaatgtatatttgtaaaagctatttttatgattagcatgtttcactgttgatcatatataaagtcaggtgatattgcaattctgtatttaaagcttatttccaacaatgtcatgtaagaaaagatgcatcttatgctagtttttataatttatttataatttatagtttaaagtacttcagatcataatgataaaatacttgaaaaagttatatttctgccctgtataagcaccctttttattaataaagaatgcagatatttcagatgtgatataatagttaaagaactgttggtttgatctgtgattaagttgagcatgctccgctctactgaactaaatgatccaattattacttcagtctgggtatgagattccatggacaagtaaggactagattgccaaggaaaagactgtcttgcccttggatccaaaagtttaaattagtgcatacatcatgtcatttcacctcctgttcctaggaactctccattcccaagcattgccagtgttttccagataatcttagctgttgtcttgtgctgtggaaatggaagaaaccatcttcacagactgtaggagaattcaacatataatttcttaataaatactgtttcttttaaaacaaa

SEQ ID NO: 15767 - DNA, 2121 bp, Homo sapiens
cgccgcgagctgccgctgccgctgctgccgccactggtgttgccgctctcaggcgccaggctccccgtcgccgccgccgccgcctcgccagccagagttgggctccgtgggcttcccccctcgcagcctcggtccttccccgctgcctgcaagtcagcctggctccgagtcacgtgtcagtgcctgaggcagagactgcgagaaaaaaacgcgcttcattccttcttccaccgccatactgtattttatactaaatctcatttttattccaacattttactcccgctcggattaaagcaaggagagccaatcatgactggcaaaacacagaccagcaacgtcaccaataagaatgaccccaagtccatcaactcccgtgttttcatcggcaatctaaatacggcaattgtcaagaaagttgacattgaagccattttttcaaagtatggaaaaatagttggatgttccgttcacaaaggttatgcatttgtacagtacatgagtgagcgacatgcaagagctgcagtggctggagaaaatgccagagtcatcgccggccaaccacttgatatcaacatggcaggagagcccaaaccatacagaccaaaacctggaaacaagaggcccctttctgcactttacagacttgaatcaaaggaacctttcctgtctgttggcggttatgtctttgactatgattactacagagatgatttctacaatcggttatttgattaccacgggcgtgtgcctccacctccccgtgcagtaattccgctgaagcgtcccagagtggcagtcacaacgactcgcagggggaaaggagtcttttccatgaaaggtggatcgagatctactgccagtgggtcaacaggttctaaattgaaatcagatgagttacagaccatcaagaaagaattaacccagatcaaaactaaaattgactccttgctagggcgcctggagaagattgagaaacagcagaaggcggaggcagaagctcagaagaagcaattggaagagagtctagtgctgatccaagaggaatgtgtgtcagagattgcagatcactctacagaggagcctgctgaaggagggccagatgccgatggagaagagatgacagatgggatagaggaggacttcgatgaagatgggggtcatgagctgtttctacagataaagtgatctgaaataacgcatgatgccacaaagcagaaaagagaaactgtgacaacccccagaaatgtgaaaggaggtttcttactggacagcagcatctttggttcaatttatataaaaacccaaataaataaaatggacagtattgctcagttttagaaattccatttcttctatgttttaagctgtacaattgtcaggtttttatggtttaaattgtaaatgtgttttcccctttgctaattatgttttttttttcagtcttaaaatgtgaaaggcatttatgaatggtaagggaaacactatatacaaatgtatatttgtaaaagctatttttatgattagcatgtttcactgttgatcatatataaagtcaggtgatattgcaattctgtatttaaagcttatttccaacaatgtcatgtaagaaaagatgcatcttatgctagtttttataatttatttataatttatagtttaaagtacttcagatcataatgataaaatacttgaaaaagttatatttctgccctgtataagcaccctttttattaataaagaatgcagatatttcagatgtgatataatagttaaagaactgttggtttgatctgtgattaagttgagcatgctccgctctactgaactaaatgatccaattattacttcagtctgggtatgagattccatggacaagtaaggactagattgccaaggaaaagactgtcttgcccttggatccaaaagtttaaattagtgcatacatcatgtcatttcacctcctgttcctaggaactctccattcccaagcattgccagtgttttccagataatcttagctgttgtcttgtgctgtggaaatggaagaaaccatcttcacagactgtaggagaattcaacatataatttcttaataaatactgtttcttttaaaacaaa

SEQ ID NO: 15768 - DNA, 1975 bp, Homo sapiens
agcggcagagaccgcatattccggaggggctggctccaggccacgcgagccggagctggagacatttccagagccttgaggatggcaccggccctcgcacgctcaactcctgctcctcctcttcgcaatgagtaaacgacgcagattaaagcaaggagagccaatcatgactggcaaaacacagaccagcaacgtcaccaataagaatgaccccaagtccatcaactcccgtgttttcatcggcaatctaaatacggcaattgtcaagaaagttgacattgaagccattttttcaaagtatggaaaaatagttggatgttccgttcacaaaggttatgcatttgtacagtacatgagtgagcgacatgcaagagctgcagtggctggagaaaatgccagagtcatcgccggccaaccacttgatatcaacatggcaggagagcccaaaccatacagaccaaaacctggaaacaagaggcccctttctgcactttacagacttgaatcaaaggaacctttcctgtctgttggcggttatgtctttgactatgattactacagagatgatttctacaatcggttatttgattaccacgggcgtgtgcctccacctccccgtgcagtaattccgctgaagcgtcccagagtggcagtcacaacgactcgcagggggaaaggagtcttttccatgaaaggtggatcgagatctactgccagtgggtcaacaggttctaaattgaaatcagatgagttacagaccatcaagaaagaattaacccagatcaaaactaaaattgactccttgctagggcgcctggagaagattgagaaacagcagaaggcggaggcagaagctcagaagaagcaattggaagagagtctagtgctgatccaagaggaatgtgtgtcagagattgcagatcactctacagaggagcctgctgaaggagggccagatgccgatggagaagagatgacagatgggatagaggaggacttcgatgaagatgggggtcatgagctgtttctacagataaagtgatctgaaataacgcatgatgccacaaagcagaaaagagaaactgtgacaacccccagaaatgtgaaaggaggtttcttactggacagcagcatctttggttcaatttatataaaaacccaaataaataaaatggacagtattgctcagttttagaaattccatttcttctatgttttaagctgtacaattgtcaggtttttatggtttaaattgtaaatgtgttttcccctttgctaattatgttttttttttcagtcttaaaatgtgaaaggcatttatgaatggtaagggaaacactatatacaaatgtatatttgtaaaagctatttttatgattagcatgtttcactgttgatcatatataaagtcaggtgatattgcaattctgtatttaaagcttatttccaacaatgtcatgtaagaaaagatgcatcttatgctagtttttataatttatttataatttatagtttaaagtacttcagatcataatgataaaatacttgaaaaagttatatttctgccctgtataagcaccctttttattaataaagaatgcagatatttcagatgtgatataatagttaaagaactgttggtttgatctgtgattaagttgagcatgctccgctctactgaactaaatgatccaattattacttcagtctgggtatgagattccatggacaagtaaggactagattgccaaggaaaagactgtcttgcccttggatccaaaagtttaaattagtgcatacatcatgtcatttcacctcctgttcctaggaactctccattcccaagcattgccagtgttttccagataatcttagctgttgtcttgtgctgtggaaatggaagaaaccatcttcacagactgtaggagaattcaacatataatttcttaataaatactgtttcttttaaaacaaa

SEQ ID NO: 15769 - DNA, 1877 bp, Homo sapiens
cagtgagcaacagtcttactgcaaagcaggagcacaacccgtctctttgtctccgtggtcaaatcaattacttcttagaaagtctaatttttttcaaaatgaccatgtacaagagcaaacgcagacatcagagatatatcaacatggcaggagagcccaaaccatacagaccaaaacctggaaacaagaggcccctttctgcactttacagacttgaatcaaaggaacctttcctgtctgttggcggttatgtctttgactatgattactacagagatgatttctacaatcggttatttgattaccacgggcgtgtgcctccacctccccgtgcagtaattccgctgaagcgtcccagagtggcagtcacaacgactcgcagggggaaaggagtcttttccatgaaaggtggatcgagatctactgccagtgggtcaacaggttctaaattgaaatcagatgagttacagaccatcaagaaagaattaacccagatcaaaactaaaattgactccttgctagggcgcctggagaagattgagaaacagcagaaggcggaggcagaagctcagaagaagcaattggaagagagtctagtgctgatccaagaggaatgtgtgtcagagattgcagatcactctacagaggagcctgctgaaggagggccagatgccgatggagaagagatgacagatgggatagaggaggacttcgatgaagatgggggtcatgagctgtttctacagataaagtgatctgaaataacgcatgatgccacaaagcagaaaagagaaactgtgacaacccccagaaatgtgaaaggaggtttcttactggacagcagcatctttggttcaatttatataaaaacccaaataaataaaatggacagtattgctcagttttagaaattccatttcttctatgttttaagctgtacaattgtcaggtttttatggtttaaattgtaaatgtgttttcccctttgctaattatgttttttttttcagtcttaaaatgtgaaaggcatttatgaatggtaagggaaacactatatacaaatgtatatttgtaaaagctatttttatgattagcatgtttcactgttgatcatatataaagtcaggtgatattgcaattctgtatttaaagcttatttccaacaatgtcatgtaagaaaagatgcatcttatgctagtttttataatttatttataatttatagtttaaagtacttcagatcataatgataaaatacttgaaaaagttatatttctgccctgtataagcaccctttttattaataaagaatgcagatatttcagatgtgatataatagttaaagaactgttggtttgatctgtgattaagttgagcatgctccgctctactgaactaaatgatccaattattacttcagtctgggtatgagattccatggacaagtaaggactagattgccaaggaaaagactgtcttgcccttggatccaaaagtttaaattagtgcatacatcatgtcatttcacctcctgttcctaggaactctccattcccaagcattgccagtgttttccagataatcttagctgttgtcttgtgctgtggaaatggaagaaaccatcttcacagactgtaggagaattcaacatataatttcttaataaatactgtttcttttaaaacaaaataaaaattaaacccccaaatccgttaattctttaaaaaccggtttcccatttttccaattttcaaaaggttattatcaatggtttgcagaaaactctaattaagttgatttaattttagacggagcagagcatttcaccggccccattatcgtgagctactttatttttccccgggcagggggccttg

SEQ ID NO: 15770 - DNA, 648 bp, Homo sapiens
tgcggccgctccaacatcagaattgttatatcacctgactttatatatgatcaacagtgaaacatgttgatcatatataaagtcaggtgatattgcaattctgtatttaaagcttatttccaacaatgtcatgtaagaaaagatgcatcttatgctagtttttataatttatttataatttatagtttaaagtacttcagatcataatgataaaatacttgaaaaagttatatttctgccctgtataagcaccctttttattaataaagaatgcagatatttcagatgtgatataatagttaaagaactgttggtttgatctgtgattaagttgagcatgctccgctctactgaactaaatgatccaattattacttcagtctgggtatgagattccatggacaagtaaggactagattgccaaggaaaagactgtcttgcccttggatccaaaagtttaaattagtgcatacatcatgtcatttcacctcctgttcctaggaactctccattcccaagcattgccagtgttttccagataatcttagctgttgtcttgtgctgtggaaatggaagaaaccatcttcacagactgtaggagaattcaacatataatttcttaataaatactgtttcttttaaaacaaa

SEQ ID NO: 15771 - DNA, 282 bp, Homo sapiens
aacaatgaaggcagagaagccagtggctgctttgacatgaggcttcccgtgtgggaggtgaaccagaagccaagcctggacggagactgtgccatcaagaggctctgtcacgagatgccaagatgagcacgcgtctccaaaacaacacaatctcaacatgcaaaatgatcaccaagcaagaggaaacagagtgagccctagaggtgaggaagttgcctgaattccatctgtgtgcccacatacacaaagctctgttacacaaaggagctactccagcgacta

SEQ ID NO: 15772 - DNA, 347 bp, Homo sapiens
caaactaaaattttgtaatagtttgtaaatggacactatatatagtgaatccataaggcgctcttaaaaattcagtatggaaaaggatctggcttcccaatagaaaaatggcaaaggatatgaacaactcacttaggaaaaataatttaccaaaaagcttctgggaaaaaaagcaggatgccaatctaaagggtattcaaataagcagacattaaatatacaatgaaaaattttaaatggcaaaaatttgaaagaaatctatgctagtaaacagtaaaatcctttctggagttaaaagcatgtgttcgtactctttaacccaataatttcacttaggcacttttcct

SEQ ID NO: 15773 - DNA, 383 bp, Homo sapiens
ggctctgggagtatcagatgcacaaagtacaggtgaacaggtaaccagattggtatctctgcaggtgccctgaggctgggaaacagcactggtggggtggagaggcagcctgcaactcggtgtccctcttgcctgaagcagccaacaggttaacccaggtctgttcctgcaggactgacatgcgctggttccagccgatgaaagcagatgcaaatcagtgcaatttcctctgcagcaataattaacccacgggaaccttgctggagcaggtagtttcaggagaatggcgctgaagatgttggagagagattagcatttttcagctctcatcgcagtgatttgcgctgcattttagtgtgtattcagttccaactcattaccat

SEQ ID NO: 15774 - DNA, 1329 bp, Homo sapiens
tgcgtcccggaaggagcgagcttgcggagcgtgaaccagtgagtgaaagcggcgccgcccgccggccgcaggtgcggcaaagccagtgtcatctgccggttctcttagggctcccggaaagaaggagggctagccgcgtgcgttcgcgccgcgcctccttgcgtttctgttccccaaatagggcctctccttctcccgccgcccaggcccctgcgtgggctggacgcgtcagccccacacattagcctcgctgcggcgcccagactctgctttgcctccccgtcccggtccctggcccctgccctgtcgcccgccgccggagcggtgaccgcccggcccgccgttcttctgctgccaccgctgtcggcaccatgggcagtgagcagagctccgaggccgagagccgacccaacgatctgaactcctcagtgactccttcaccagccaagcatagagccaagatggatgatattgtggttgtagctcagggctcccaggcctcacggaacgtcagcaacgatcccgatgtcatcaagttgcaagagattccaaccttccagccccttttgaaagggctattgagtggccagacttccccaacaaatgccaaattggagaaactggactctcagcaggtgttgcagctctgcctccgatatcaagatcacctgcatcagtgtgcagaggccgttgcttttgaccagaatgctttggttaaacgaatcaaagagatggatctgtctgtagaaactctgttcagcttcatgcaggagcgccagaaaagatacgccaagtatgccgagcagatccagaaagtgaacgagatgtccgccatcctccgccgcatacagatgggcatcgaccagactgtgcccctgctggacaggctcaacagcatgctgcccgagggcgagcggctggagcccttcagcatgaagcccgaccgcgagctcaggctgtagctgccgcccggcctgcctggggctgggagccccagacaccgacaccctgaggacgtgtggagctaaggtcatatcatctgaccaggtctggaggctggcgggaggctccctgaaagtgggtgcgaaggagtccggctggcatgaaaatctgactttgcccagctcttttccttgatgcagtttcccggtgtggaaggaacctaaccagttctcggtgataactgaagctggaacgtgtgaattattaggaattctttgaagaactctgcattgagaattatttttatttagttttttttttttttaattgagagtatatagtccagtccaggtaccggaataaaaatatggagacaaggggaaaata

SEQ ID NO: 15775 - DNA, 832 bp, Homo sapiens
cccagaacatagagccagggacagtcccctctcagttctcttctaaaggtggttctggcacaacagttgataaagctgtgtccctgaagggctttttagccctgggtgcttcctgtaaaacttgtcagcttccactggatctgcgggactgtgtccctcacaggctggacacccggccctgcggagaggacttgattaaacaaggtataatgtacttctctttcccatccacagatggatctgtctgtagaaactctgttcagcttcatgcaggagcgccagaaaagatacgccaagtatgccgagcagatccagaaagtgaacgagatgtccgccatcctccgccgcatacagatgggcatcgaccagactgtgcccctgctggacaggctcaacagcatgctgcccgagggcgagcggctggagcccttcagcatgaagcccgaccgcgagctcaggctgtagctgccgcccggcctgcctggggctgggagccccagacaccgacaccctgaggacgtgtggagctaaggtcatatcatctgaccaggtctggaggctggcgggaggctccctgaaagtgggtgcgaaggagtccggctggcatgaaaatctgactttgcccagctcttttccttgatgcagtttcccggtgtggaaggaacctaaccagttctcggtgataactgaagctggaacgtgtgaattattaggaattctttgaagaactctgcattgagaattatttttatttagttttttttttttttaattgagagtatatagtccagtccaggtaccggaataaaaatatggagacaaggggaaaata

SEQ ID NO: 15776 - DNA, 1588 bp, Homo sapiens
cccagaacatagagccagggacagtcccctctcagttctcttctaaaggtggttctggcacaacagttgataaagctgtgtccctgaagggctttttagccctgggtgcttcctgtaaaacttgtcagcttccactggatctgcgggactgtgtccctcacaggctggacacccggccctgcggagaggacttgattaaacaaggtataatgtacttctctttcccatccacagatggatctgtctgtagaaactctgttcagcttcatgcaggagcgccagaaaagatacgccaagtatgccgagcagatccagaaagtgaacgagatgtccgccatcctccgccgcatacagatgggcatcgaccagactgtgcccctgctggacaggctcaacagcatgctgcccgagggcgagcggctggagcccttcagcatgaagcccgaccgcgagctcaggctgtagctgccgcccggcctgcctggggctgggagccccagacaccgacaccctgaggacgtgtggagctaaggtcatatcatctgaccaggtctggaggctggcgggaggctccctgaaagtgggtgcgaaggagtccggctggcatgaaaatctgactttgcccagctcttttccttgatgcagtttcccggtgtggaaggaacctaaccagttctcggtgataactgaagctggaacgtgtgaattattaggaattctttgaagaactctgcattgagaattatttttatttagttttttttttttttaattgagagtatatagtccagtccaggtaccggaataaaaatatggagacaaggggaaaatattttacgaagctctgtgttctcaacgccctcatgaacttttcagtaggctgtctggtttatgtgtggtcaacttgaaaaactaattgaatctaggtctctgtattgttcctgtttctaccctgactgtttccgtcacaccaagcccttatctggggcgcgtcttcctgcccaggtggaacactggcattttgttgactgtcaggttaggtgtcccttagtcgtcatcagaagctgaagccttcctttccacaccctcatcagattcatctccactgataaccggtttccttgatgcagacatagtttagctttctttgactgcagagatgtctcattccacagacatttcttgaacccatttgatgtgtccaatattgtgccagggatacaaatatggccgtatagcctcaggccttcatttctgaaaagaaaaaagctcaaaaagctgctgaatttctctgggagtttaggaaaggaagttatttgagtaacaacaaaagtgcttagtgtcgtactttacacatcataggtgttctaatggaagcaaggactggagaagcaaagagtggaatgtgaggagcagacctaggcagacaccttgagactaaaagtcagagctgaagggagtcgctggggccaggacggcatgcaggcctgtaccctgttccctaagttcctgcaagcgtcgggaggtgtgttttcagataccagaaagagccttcagtagattcacaagattaaaattgatgcgctta

SEQ ID NO: 15777 - DNA, 1277 bp, Homo sapiens
tgcgtcccggaaggagcgagcttgcggagcgtgaaccagtgagtgaaagcggcgccgcccgccggccgcaggtgcggcaaagccagtgtcatctgccggttctcttagggctcccggaaagaaggagggctagccgcgtgcgttcgcgccgcgcctccttgcgtttctgttccccaaatagggcctctccttctcccgccgcccaggcccctgcgtgggctggacgcgtcagccccacacattagcctcgctgcggcgcccagactctgctttgcctccccgtcccggtccctggcccctgccctgtcgcccgccgccggagcggtgaccgcccggcccgccgttcttctgctgccaccgctgtcggcaccatgggcagtgagcagagctccgaggccgagagccgacccaacgatctgaactcctcagtgactccttcaccagccaagcatagagccaagatggatgatattgtggttgtagctcagggctcccaggcctcacggaacgtcagcaacgatcccgatgtcatcaagttgcaagagattccaaccttccagccccttttgaaagggctattgagtggccagacttccccaacaaatgccaaattggagaaactggactctcagcaggtgttgcagctctgcctccgatatcaagatcacctgcatcagtgtgcagaggccgttgcttttgaccagaatgctttggttaaacgaatcaaagagagatgaggactcagtgtgtcgtcgtggctgctcttgagttcctgggctcaagtggtcctcctacctcagcctcccaaagtactgagatgacaagcatgaaccaccgcacctggccagcattcctatctgtcagtataagattatattaactagtgttacagaaaccccaaatgatggtggcttatacaaaatgaaagtttattcatctctctcaggcctggtctcctcttacacataaacatcctcatggacccaggctgcttctagctcatgatctgccaactcaaagatgtaaccttcattattctcatggtctacatggggtgcacctgcatttcagcagcagcagagtggaggaggggacagtgaagaagagaagcaacaaagagtgcatgccggctgcctttccaggaaggtgcctggaagctgccaggagagacttctgcatgcacacaccactgattataacttggtcatgtgtcacggcaaggcgagggttttgaggcaagagttgtggagaataaagagttgttcactttctatttg

SEQ ID NO: 15778 - DNA, 2085 bp, Homo sapiens
tgcgtcccggaaggagcgagcttgcggagcgtgaaccagtgagtgaaagcggcgccgcccgccggccgcaggtgcggcaaagccagtgtcatctgccggttctcttagggctcccggaaagaaggagggctagccgcgtgcgttcgcgccgcgcctccttgcgtttctgttccccaaatagggcctctccttctcccgccgcccaggcccctgcgtgggctggacgcgtcagccccacacattagcctcgctgcggcgcccagactctgctttgcctccccgtcccggtccctggcccctgccctgtcgcccgccgccggagcggtgaccgcccggcccgccgttcttctgctgccaccgctgtcggcaccatgggcagtgagcagagctccgaggccgagagccgacccaacgatctgaactcctcagtgactccttcaccagccaagcatagagccaagatggatgatattgtggttgtagctcagggctcccaggcctcacggaacgtcagcaacgatcccgatgtcatcaagttgcaagagattccaaccttccagccccttttgaaagggctattgagtggccagacttccccaacaaatgccaaattggagaaactggactctcagcaggtgttgcagctctgcctccgatatcaagatcacctgcatcagtgtgcagaggccgttgcttttgaccagaatgctttggttaaacgaatcaaagagatggatctgtctgtagaaactctgttcagcttcatgcaggagcgccagaaaagatacgccaagtatgccgagcagatccagaaagtgaacgagatgtccgccatcctccgccgcatacagatgggcatcgaccagactgtgcccctgctggacaggctcaacagcatgctgcccgagggcgagcggctggagcccttcagcatgaagcccgaccgcgagctcaggctgtagctgccgcccggcctgcctggggctgggagccccagacaccgacaccctgaggacgtgtggagctaaggtcatatcatctgaccaggtctggaggctggcgggaggctccctgaaagtgggtgcgaaggagtccggctggcatgaaaatctgactttgcccagctcttttccttgatgcagtttcccggtgtggaaggaacctaaccagttctcggtgataactgaagctggaacgtgtgaattattaggaattctttgaagaactctgcattgagaattatttttatttagttttttttttttttaattgagagtatatagtccagtccaggtaccggaataaaaatatggagacaaggggaaaatattttacgaagctctgtgttctcaacgccctcatgaacttttcagtaggctgtctggtttatgtgtggtcaacttgaaaaactaattgaatctaggtctctgtattgttcctgtttctaccctgactgtttccgtcacaccaagcccttatctggggcgcgtcttcctgcccaggtggaacactggcattttgttgactgtcaggttaggtgtcccttagtcgtcatcagaagctgaagccttcctttccacaccctcatcagattcatctccactgataaccggtttccttgatgcagacatagtttagctttctttgactgcagagatgtctcattccacagacatttcttgaacccatttgatgtgtccaatattgtgccagggatacaaatatggccgtatagcctcaggccttcatttctgaaaagaaaaaagctcaaaaagctgctgaatttctctgggagtttaggaaaggaagttatttgagtaacaacaaaagtgcttagtgtcgtactttacacatcataggtgttctaatggaagcaaggactggagaagcaaagagtggaatgtgaggagcagacctaggcagacaccttgagactaaaagtcagagctgaagggagtcgctggggccaggacggcatgcaggcctgtaccctgttccctaagttcctgcaagcgtcgggaggtgtgttttcagataccagaaagagccttcagtagattcacaagattaaaattgatgcgctta

SEQ ID NO: 15779 - DNA, 1719 bp, Homo sapiens
tgcgtcccggaaggagcgagcttgcggagcgtgaaccagtgagtgaaagcggcgccgcccgccggccgcaggtgcggcaaagccagtgtcatctgccggttctcttagggctcccggaaagaaggagggctagccgcgtgcgttcgcgccgcgcctccttgcgtttctgttccccaaatagggcctctccttctcccgccgcccaggcccctgcgtgggctggacgcgtcagccccacacattagcctcgctgcggcgcccagactctgctttgcctccccgtcccggtccctggcccctgccctgtcgcccgccgccggagcggtgaccgcccggcccgccgttcttctgctgccaccgctgtcggcaccatgggcagtgagcagagctccgaggccgagagccgacccaacgatctgaactcctcagtgactccttcaccagccaagcatagagccaagatggatgatattgtggttgtagctcagggctcccaggcctcacggaacgtcagcaacgatcccgatgtcatcaagttgcaagagattccaaccttccagccccttttgaaagggctattgagtggccagacttccccaacaaatgccaaattggagaaactggactctcagcaggtgttgcagctctgcctccgatatcaagatcacctgcatcagtgtgcagaggccgttgcttttgaccagaatgctttggttaaacgaatcaaagagatggatctgtctgtagaaactctgttcagcttcatgcaggagcgccagaaaagatacgccaagtatgccgagcagatccagaaagtgaacgagatgtccgccatcctccgccgcatacagatgggcatcgaccagactgtgcccctgctggacaggctcaacagcatgctgcccgagggcgagcggctggagcccttcagcatgaagcccgaccgcgagctcaggctgtagctgccgcccggcctgcctggggctgggagccccagacaccgacaccctgaggacgtgtggagctaaggtcatatcatctgaccaggtctggaggctggcgggaggctccctgaaagtgggtgcgaaggagtccggctggcatgaaaatctgactttgcccagctcttttccttgatgcagtttcccggtgtggaaggaacctaaccagttctcggtgataactgaagctggaacgtgtgaattattaggaattctttgaagaactctgcattgagaattatttttatttagttttttttttttttaattgagagtatatagtccagtccaggtaccggaataaaaatatggagacaaggggaaaataaaaaaaaaaaaagaaatagaaaaagtagagaacaacacacaaacaggggggcgggcggcggtccaaaagaatgtactccccgcgagggggggcccccgaagtctacagcgggcgtaacccccacgctttctctgtgggaaccaagcgggggggcccccctaatgaggaggggcagccttataaaagagccgacgggccgacggtgccgggtaggtttaacaaaaaggtgggtgatgtgggggaacaacagtgtcaagccgtgggacatcattgtggagaagagaacacataaatttggagggggggtgaacattatgggggacatgattagcccacagagcatttaaaggctaagagggaaatattagcaatatgaagggataggggggt

SEQ ID NO: 15780 - DNA, 1185 bp, Homo sapiens
tgcgtcccggaaggagcgagcttgcggagcgtgaaccagtgagtgaaagcggcgccgcccgccggccgcaggtgcggcaaagccagtgtcatctgccggttctcttagggctcccggaaagaaggagggctagccgcgtgcgttcgcgccgcgcctccttgcgtttctgttccccaaatagggcctctccttctcccgccgcccaggcccctgcgtgggctggacgcgtcagccccacacattagcctcgctgcggcgcccagactctgctttgcctccccgtcccggtccctggcccctgccctgtcgcccgccgccggagcggtgaccgcccggcccgccgttcttctgctgccaccgctgtcggcaccatgggcagtgagcagagctccgaggccgagagccgacccaacgatctgaactcctcagggctattgagtggccagacttccccaacaaatgccaaattggagaaactggactctcagcaggtgttgcagctctgcctccgatatcaagatcacctgcatcagtgtgcagaggccgttgcttttgaccagaatgctttggttaaacgaatcaaagagatggatctgtctgtagaaactctgttcagcttcatgcaggagcgccagaaaagatacgccaagtatgccgagcagatccagaaagtgaacgagatgtccgccatcctccgccgcatacagatgggcatcgaccagactgtgcccctgctggacaggctcaacagcatgctgcccgagggcgagcggctggagcccttcagcatgaagcccgaccgcgagctcaggctgtagctgccgcccggcctgcctggggctgggagccccagacaccgacaccctgaggacgtgtggagctaaggtcatatcatctgaccaggtctggaggctggcgggaggctccctgaaagtgggtgcgaaggagtccggctggcatgaaaatctgactttgcccagctcttttccttgatgcagtttcccggtgtggaaggaacctaaccagttctcggtgataactgaagctggaacgtgtgaattattaggaattctttgaagaactctgcattgagaattatttttatttagttttttttttttttaattgagagtatatagtccagtccaggtaccggaataaaaatatggagacaaggggaaaata

SEQ ID NO: 15781 - DNA, 3032 bp, Homo sapiens
ccatcatgcatcttcaggtctgctagagcaaaccctgagggctgctttagagagggttatcaagggagacttcttggaggaggtggtttctgactgacttgaatgccaggactgtttgccctgccccctgccatctctccttcccagatggtgctccaagaggcagcttgtggacctggtgatggaaggggtgtggcaggagctgctggacagcgcccagattgagatctgtgtggctgactggtgagtgaggagcggcaccctgccccagagcagcaacaggcttggcagcggctctgcaacaggggctcatttcccgccccatcaaccccacgggtagcggctgtcactgtgcaccctttgtgatgaggctgagaggggaagtgatgcagagccggggaaggtagagctttggagaagccagagcccccactctgcactcctgcccaccctcatcccagcaggctggggtggtccacagggggccactgtggcttgatacccctctgaaacgagacacctcccctgaccaccttgtggatgcccagggtctgaaggggtgggagcatggtgccctgtgagctgaggctcagggagcatagttgggacaggactggcttcagagcctacaggcttaggatgaatgccttcttcccaaaacacccaggttctgccccaaagcattccagctcctccttcaggctgtggctcttccatagaaaatctggtctcttccctggggctctggctcttccctgaagtcatcaggcacctgccctgcattgtggttcttccccagagcatcctttcccgtcccccaactacctacccaaaagcctccagaatcaaccgcaggaccacccaggctcctcccccaggaccacccaggctcctcccctgctctggctccaccccaggaccacccagactcctcccccaggctctggctccaccccagggtcacccaggcttctcctccaggttctggttccaccccaggaccacccaggctcctcccccaggaccacccaggcccctcccccaggctctggttccaccccaggaccacccaggctcctcccccaggaccacccaggctcctcccctgctctggctccaccccaggaccacccagactcctcccccaggaccacccaggcccctcccccaggctctggctccactccaggaccacccagactcctcccccaggaccacccaggaccctcccccaggctctggctccaccccagggtcacccaggctcctcccccaggctctggctccaccccaggaccacccaggctcctcccccaggctctggctcctccccaggaccacccaggctcctcccccaggctctggttccaccccagaaccaccaaggctcctcccctagaggttcccaggccaggacgtctccaaatgtggtccagatgtgcaggaccttcatcaagatggagccagccctcagcctcccgccccgaaacccagagagctggctgggtgacgggggcatagaggctgactgctgcctggcaggtggggcgctcgagagaactgcggctgcgtctaccagctccgggtccgccttctggatgtgtatgaaaaggaagtggtcaagttctcagcctcacctgacccggtccttcagtggactgagaggggctgccgacaggtctcccacgtcttcaccaactttggcaagggcatccgctacgtatcttttgagcagtacgggagagacgtgagttcctgggtggggcactacggcgcccttgtgacccactccagtgtgagggtcaggatccgtctgtcctagcgactggactactgcctgacgttgtcagtcaagaccagccttgcagccaggtgcagtggctcacacctgtggaatcccagcacttcaggaggccgaggtgggaggatcacttggagctcgggagttcaagaccagcctgggcaacatagtgaaaccgtctccacaaataatttttaaaaaattagccaggcatggtggtgccgcctgtagtcccagctactcaggaggcttgggtgggaggattgcctgagaccaggaggttgaggctgcagtgagccgtgatttcaccaccactccagcctgggtgagaaagcaagaccctatatcaatgaaaaaaaaaaaaaaaaagaccagctttgcagccagaagccagaggatacccagggacagtagggctcccaggtggctggttctcagcacaccttccatgaatctgcttgctgctgcttcagtgtggtggccatcgtgctgtgtgacaaaccaggctgttcacagcttcctcagccccccagaaggggagtgtcaggaagagacatttagttcatttgcctgcaaattttcttctcctgcaaggatctcggtggactcagtcacaaaacaaaggctaaaccaggatttataagagagggcttataaatccctctgccgacgcagggagcagagacttgccggcatgttttgggggtaatgatcgtgggcagggagcagaggtccgctgaggcagtctgtccttgagactaacaaagtcatctgctgtttggggaaatctctggtgttgggaacaggcccccaaatctggccataaactggccccaaaactggccataaacaaaatctctgcagcactgtgacatgtttgtgatggccatgacccccaccctgaaggttgtgggtttactggaacgagggcgaggaacacctggcccacccagggcggaaaaccgcttaaaggggttcctgaaccacaaaccatagcataagtgatctgtgccttaacgacatgttcctgctgcagataactagccagacccatccctttatttcagcccatccctttatttcctgtaagaaatgtttttagttaatctataatctatagaaataatgcttatcactggcttgctgtcaataaatatgtgggtaaatctctgttcaaggctctcagctctgaaggccgtgagacccctgatttcccactccacaccctata

SEQ ID NO: 15782 - DNA, 2978 bp, Homo sapiens
ccatcatgcatcttcaggtctgctagagcaaaccctgagggctgctttagagagggttatcaagggagacttcttggaggaggtggtttctgactgacttgaatgccaggactgtttgccctgccccctgccatctctccttcccagatggtgctccaagaggcagcttgtggacctggtgatggaaggggtgtggcaggagctgctggacagcgcccagattgagatctgtgtggctgactggtgagtgaggagcggcaccctgccccagagcagcaacaggcttggcagcggctctgcaacaggggctcatttcccgccccatcaaccccacgggtagcggctgtcactgtgcaccctttgtgatgaggctgagaggggaagtgatgcagagccggggaaggtagagctttggagaagccagagcccccactctgcactcctgcccaccctcatcccagcaggctggggtggtccacagggggccactgtggcttgatacccctctgaaacgagacacctcccctgaccaccttgtggatgcccagggtctgaaggggtgggagcatggtgccctgtgagctgaggctcagggagcatagttgggacaggactggcttcagagcctacaggcttaggatgaatgccttcttcccaaaacacccaggttctgccccaaagcattccagctcctccttcaggctgtggctcttccatagaaaatctggtctcttccctggggctctggctcttccctgaagtcatcaggcacctgccctgcattgtggttcttccccagagcatcctttcccgtcccccaactacctacccaaaagcctccagaatcaaccgcaggaccacccaggctcctcccccaggaccacccaggctcctcccctgctctggctccaccccaggaccacccagactcctcccccaggctctggctccaccccagggtcacccaggcttctcctccaggttctggttccaccccaggaccacccaggctcctcccccaggaccacccaggcccctcccccaggctctggttccaccccaggaccacccaggctcctcccccaggaccacccaggctcctcccctgctctggctccaccccaggaccacccagactcctcccccaggaccacccaggcccctcccccaggctctggctccactccaggaccacccagactcctcccccaggaccacccaggaccctcccccaggctctggctccaccccagggtcacccaggctcctcccccaggctctggctccaccccaggaccacccaggctcctcccccaggctctggctcctccccaggaccacccaggctcctcccccaggctctggttccaccccagaaccaccaaggctcctcccctagaggttcccaggccaggacgtctccaaatgtggtccagatgtgcaggaccttcatcaagatggagccagccctcagcctcccgccccgaaacccagagagctggctgggtgacgggggcatagaggctgactgctgcctggcaggtggggcgctcgagagaactgcggctgcgtctaccagctccgggtccgccttctggatgtgtatgaaaaggaagtggtcaagttctcagcctcacctgacccggtccttcagtggactgagaggggctgccgacaggtctcccacgtcttcaccaactttggcaagggcatccgctacgtatcttttgagcagtacgggagagacgtgagttcctgggtggggcactacggcgcccttgtgacccactccagtgtgagggtcaggatccgtctgtcctagcgactggactactgcctgacgttgtcagtcaagaccagccttgcagccaggtgcagtggctcacacctgtggaatcccagcacttcaggaggccgaggtgggaggatcacttggagctcgggagttcaagaccagcctgggcaacatagtgaaaccgtctccacaaataatttttaaaaaattagccaggcatggtggtgccgcctgtagtcccagctactcaggaggcttgggtgggaggattgcctgagaccaggaggttgaggctgcagtgagccgtgatttcaccaccactccagcctgggtgagaaagcaagaccctatatcaatgaaaaaaaaaaaaaaaaagaccagctttgcagccagaagccagaggatacccagggacagtagggctcccaggtggctggttctcagcacaccttccatgaatctgcttgctgctgcttcagtgtggtggccatcgtgctgtgtgacaaaccaggctgttcacagcttcctcagccccccagaaggggagtgtcaggaagagacatttagttcatttgcctgcaaattttcttctcctgcaaggatctcggtggactcagtcacaagcagggagcagagacttgccggcatgttttgggggtaatgatcgtgggcagggagcagaggtccgctgaggcagtctgtccttgagactaacaaagtcatctgctgtttggggaaatctctggtgttgggaacaggcccccaaatctggccataaactggccccaaaactggccataaacaaaatctctgcagcactgtgacatgtttgtgatggccatgacccccaccctgaaggttgtgggtttactggaacgagggcgaggaacacctggcccacccagggcggaaaaccgcttaaaggggttcctgaaccacaaaccatagcataagtgatctgtgccttaacgacatgttcctgctgcagataactagccagacccatccctttatttcagcccatccctttatttcctgtaagaaatgtttttagttaatctataatctatagaaataatgcttatcactggcttgctgtcaataaatatgtgggtaaatctctgttcaaggctctcagctctgaaggccgtgagacccctgatttcccactccacaccctata

SEQ ID NO: 15783 - DNA, 2217 bp, Homo sapiens
ccgccacgccccgggagaggaccgaccgcccagaccgccggtcccggggccccctgggccacgccgatcacggggagcccctcgactgcctcccagaacaaagtgggaaagggaagcttagcccgccgctgccgcctccgagcagcccgccaggactctggctactggagatgggcgcccggctatcgcggcgacggctgccggcggacccatccctggccctggacgcgctgcccccggagctgctggtgcaggtgctgagccacgtgccgccacgctccttggtcacgcgatgccgcccagtgtgccgcgcctggcgcgacatagtggacgggcccactgtgtggctgctgcagctggcccgcgaccgcagcgccgagggccgcgcactctacgcagtggctcaacgctgcctgcccagcaacgaagacaaggaggagttcccgctgtgcgccctggcgcgctactgtctgcgcgcgcccttcggccgcaatctcatcttcaactcctgcggagagcagggcttcagaggctgggaggtggagcatggcgggaacggctgggccatagaaaagaacctaacaccggtgcctggggctccttcgcagacctgcttcgtgacctctttcgaatggtgctccaagaggcagcttgtggacctggtgatggaaggggtgtggcaggagctgctggacagcgcccagattgagatctgtgtggctgactggtggggcgctcgagagaactgcggctgcgtctaccagctccgggtccgccttctggatgtgtatgaaaaggaagtggtcaagttctcagcctcacctgacccggtccttcagtggactgagaggggctgccgacaggtctcccacgtcttcaccaactttggcaagggcatccgctacgtatcttttgagcagtacgggagagacgtgagttcctgggtggggcactacggcgcccttgtgacccactccagtgtgagggtcaggatccgtctgtcctagcgactggactactgcctgacgttgtcagtcaagaccagccttgcagccaggtgcagtggctcacacctgtggaatcccagcacttcaggaggccgaggtgggaggatcacttggagctcgggagttcaagaccagcctgggcaacatagtgaaaccgtctccacaaataatttttaaaaaattagccaggcatggtggtgccgcctgtagtcccagctactcaggaggcttgggtgggaggattgcctgagaccaggaggttgaggctgcagtgagccgtgatttcaccaccactccagcctgggtgagaaagcaagaccctatatcaatgaaaaaaaaaaaaaaaaagaccagctttgcagccagaagccagaggatacccagggacagtagggctcccaggtggctggttctcagcacaccttccatgaatctgcttgctgctgcttcagtgtggtggccatcgtgctgtgtgacaaaccaggctgttcacagcttcctcagccccccagaaggggagtgtcaggaagagacatttagttcatttgcctgcaaattttcttctcctgcaaggatctcggtggactcagtcacaaaacaaaggctaaaccaggatttataagagagggcttataaatccctctgccgacgcagggagcagagacttgccggcatgttttgggggtaatgatcgtgggcagggagcagaggtccgctgaggcagtctgtccttgagactaacaaagtcatctgctgtttggggaaatctctggtgttgggaacaggcccccaaatctggccataaactggccccaaaactggccataaacaaaatctctgcagcactgtgacatgtttgtgatggccatgacccccaccctgaaggttgtgggtttactggaacgagggcgaggaacacctggcccacccagggcggaaaaccgcttaaaggggttcctgaaccacaaaccatagcataagtgatctgtgccttaacgacatgttcctgctgcagataactagccagacccatccctttatttcagcccatccctttatttcctgtaagaaatgtttttagttaatctataatctatagaaataatgcttatcactggcttgctgtcaataaatatgtgggtaaatctctgttcaaggctctcagctctgaaggccgtgagacccctgatttcccactccacaccctata

SEQ ID NO: 15784 - DNA, 1104 bp, Homo sapiens
ccgccacgccccgggagaggaccgaccgcccagaccgccggtcccggggccccctgggccacgccgatcacggggagcccctcgactgcctcccagaacaaagtgggaaagggaagcttagcccgccgctgccgcctccgagcagcccgccaggactctggctactggagatgggcgcccggctatcgcggcgacggctgccggcggacccatccctggccctggacgcgctgcccccggagctgctggtgcaggtgctgagccacgtgccgccacgctccttggtcacgcgatgccgcccagtgtgccgcgcctggcgcgacatagtggacgggcccactgtgtggctgctgcagctggcccgcgaccgcagcgccgagggccgcgcactctacgcagtggctcaacgctgcctgcccagcaacgaagacaaggaggagttcccgctgtgcgccctggcgcgctactgtctgcgcgcgcccttcggccgcaatctcatcttcaactcctgcggagagcagggcttcagaggctgggaggtggagcatggcgggaacggctgggccatagaaaagaacctaacaccggtgcctggggctccttcgcagacctgcttcgtgacctctttcgaatggtgctccaagaggcagcttgtggacctggtgatggaaggggtgtggcaggagctgctggacagcgcccagattgagatctgtgtggctgactggtggggcgctcgagagaactgcggctgcgtctaccagctccgggtccgccttctggatgtgtatgaaaaggaagtggtcaagttctcagcctcacctgacccggtccttcagtggactgagaggggctgccgacaggtgggtccagactagcttccagctccccccgacccgctaaaggcacacacgcccagcctctcgtctgctcggtttcccttctgtcactcctggatatctataatcataacagctaagaagtatcgagcccttcttacatcccaagccctgtgtcaagacgcttacatatcgattcatttcattagcaaaaccccttaatgttcaacaaacactgattgagcacctactgtgtgctgggcac

SEQ ID NO: 15785 - DNA, 2403 bp, Homo sapiens
ccgccacgccccgggagaggaccgaccgcccagaccgccggtcccggggccccctgggccacgccgatcacggggagcccctcgactgcctcccagaacaaagtgggaaagggaagcttagcccgccgctgccgcctccgagcagcccgccaggactctggctactggagatgggcgcccggctatcgcggcgacggctgccggcggacccatccctggccctggacgcgctgcccccggagctgctggtgcaggtgctgagccacgtgccgccacgctccttggtcacgcgatgccgcccagtgtgccgcgcctggcgcgacatagtggacgggcccactgtgtggctgctgcagctggcccgcgaccgcagcgccgagggccgcgcactctacgcagtggctcaacgctgcctgcccagcaacgaagacaaggaggagttcccgctgtgcgccctggcgcgctactgtctgcgcgcgcccttcggccgcaatctcatcttcaactcctgcggagagcagggcttcagaggctgggaggtggagcatggcgggaacggctgggccatagaaaagaacctaacaccggtgcctggggctccttcgcagacctgcttcgtgacctctttcgaatggtgctccaagaggcagcttgtggacctggtgatggaaggggtgtggcaggagctgctggacagcgcccagattgagatctgtgtggctgactggtgagtgaggagcggcaccctgccccagagcagcaacaggcttggcagcggctctgcaacaggggctcatttcccgccccatcaaccccacgggtagcggctgtcactgtgcaccctttgtgatgaggctgagaggggaagtgatgcagagccggggaaggtagagctttggagaagccagagcccccactctgcactcctgcccaccctcatcccagcaggctggggtggtccacagggggccactgtggcttgatacccctctgaaacgagacacctcccctgaccaccttgtggatgcccagggtctgaaggggtgggagcatggtgccctgtgagctgaggctcagggagcatagttgggacaggactggcttcagagcctacaggcttaggatgaatgccttcttcccaaaacacccaggttctgccccaaagcattccagctcctccttcaggctgtggctcttccatagaaaatctggtctcttccctggggctctggctcttccctgaagtcatcaggcacctgccctgcattgtggttcttccccagagcatcctttcccgtcccccaactacctacccaaaagcctccagaatcaaccgcaggaccacccaggctcctcccccaggaccacccaggctcctcccctgctctggctccaccccaggaccacccagactcctcccccaggctctggctccaccccagggtcacccaggcttctcctccaggttctggttccaccccaggaccacccaggctcctcccccaggaccacccaggcccctcccccaggctctggttccaccccaggaccacccaggctcctcccccaggaccacccaggctcctcccctgctctggctccaccccaggaccacccagactcctcccccaggaccacccaggcccctcccccaggctctggctccactccaggaccacccagactcctcccccaggaccacccaggaccctcccccaggctctggctccaccccagggtcacccaggctcctcccccaggctctggctccaccccaggaccacccaggctcctcccccaggctctggctcctccccaggaccacccaggctcctcccccaggctctggttccaccccagaaccaccaaggctcctcccctagaggttcccaggccaggacgtctccaaatgtggtccagatgtgcaggaccttcatcaagatggagccagccctcagcctcccgccccgaaacccagagagctggctgggtgacgggggcatagaggctgactgctgcctggcaggtggggcgctcgagagaactgcggctgcgtctaccagctccgggtccgccttctggatgtgtatgaaaaggaagtggtcaagttctcagcctcacctgacccggtccttcagtggactgagaggggctgccgacaggtgggtccagactagcttccagctccccccgacccgctaaaggcacacacgcccagcctctcgtctgctcggtttcccttctgtcactcctggatatctataatcataacagctaagaagtatcgagcccttcttacatcccaagccctgtgtcaagacgcttacatatcgattcatttcattagcaaaaccccttaatgttcaacaaacactgattgagcacctactgtgtgctgggcac

SEQ ID NO: 15786 - DNA, 528 bp, Homo sapiens
tctcccatactaccttcatgcctgccccacattccctcagaggtgtcttccctgataaattatcttgtatgtctaatcccatcttggatgcatctcaattggtaaaaactaacataccaggcttgattctttgcacttagctttttttctttctctcccacaagtagtcagtagccatgttctagtgttctatgtgttacctctttttccatatgtatggaaaaaggaaggtactgttgaggtgcacttcctatgtgccaggccctgtgctcaatactttacctgtatctcatttaagccacacaataaccctgtcaggtagacattatttccattttggcaatgaaaagacagaagcttagcgtggtgtaaaatctttcctggtgtcatatggctagtgacaggtggatctgagatttgattctaggactatttgacctcaaggctaatgataatggtagtaatatggtagctgacattggttcctctgtgtgtggcatcttgtttcattgactgtattaaaccttt

SEQ ID NO: 15787 - DNA, 318 bp, Homo sapiens
tgtagataaaacatttcaagtagaaggaagaatcatgtagcttgctccatggtcaagtttgactctttaaacaaaataaattgttgactgcttccaatttttatcatatgtattgatgattgaataactgctttacatacaattacagtcatctttcttaccattttaaaatactattgcagattaagtctttgtttttaacatcagttcattggtatgcatttttaaaatagatatttcatttatttaaaaaatatttattgagtatcttctaggtatgagacactattcttggaactgagtatacagcagtgaaca

SEQ ID NO: 15788 - DNA, 1892 bp, Homo sapiens
gctcattttggaacatgaagttggcactctgaggagcctaaccttctgttaggcttcctttggggcagttggtttgcagtgatccttaataaaatagtttgcagtattttgtaggaaggatggctgtgtactcatgtgcagggaaaattaaactgctgcaagagtttggcaaaaccgccaccactttactattaatatgtctttactatttttatatgtgttttgtgggtcagcgtgttcaattttaaataggaatacactagccttacaacggaatttcttcttgtggaataaaaactgataataacctttcatcttcaagaatctgatgactgagttttgtaggaatgtacccaacagttggaccagagcctggccagttcccaccaattggagtaagctatttaattgagggttaagaagctcgatagttttttcaatctgttatcagaaaaatattatctaaagacactgatagcagctgactggtaaaactgaaagttggccttagtaaatggaactagtaaaaaatagataaaaatatgtaaaaccttttatgtcctgtcaaggaaaaaaaaataagcaaacttgatttgttttaaaattgtaaatattcattgcaaaacctaaattatacaaaatctatttcgatttgaatctcttaacatatgaaaagccacatcttaagtgcattatgctctgtaaggcatgttattagccagctttgctgaaaaatgtattcttctacagctcagaaagaggagtaaaattgctctagaaatttttgatctcagccactttgcatccaaagaggaacccaactccccactcacaatcccccacacacattttaattataagagttcaacattttccacagatatcattaagccaagcaaggaaactcctctctgtaaaaacaacaaaaaagttgcaatgtaaatagttattttagctattttctttgtgattagaggataagattttgttatttcttttggtacttagtcctttaactatctgaaaatggctcactttgacctgtttctttggtcagccaaactgaagtgaggggcctctgtttatatatagaatcttgtatatgtaactttacttatgtgggaccaatggccagtatattctaatggacacaaatctcccaatccttatgtaggattatctgttcaccttgccatgtccatcttgcaatgagacctaacttgcacctgcctgtttttctgcatgattggactccaaagactattaccaatgatgagaattgtcttgtgtcagtgtttataaaatggacttaaagcacacacacatgcatacccacattcacatgcacccttacagttctagatcaaccctggaaggcaaaaccatgtacgtccagtttctttgcaaggtctgagcagtgagaactaaattcagtcagtctaatgggtaaaatgcaacctcagtgatgcttaataaggatttgaaatcgttcaagtcatttctgtgttctttctcacaccctttcctttctattttgtcttcttttattttcaaaatgtctgtggaacaagaggatgaatcgggggagaacttctgcttcttttgactctttttaggtaatatggagtcaatatattatgatttctgtttcttatggattattaaaatcagaggaaatctgcttctctcaacataaaaccaaatccaaacccagacattgttggagtttgcctgttgacaatggttatgatgctgctcgttgtcttgagttgcatgtaacgacagtagctctgaagggtgtcatgatttcattttggcaactggtaaaagaaacttgtagtgtggtctgattgtgccagggaataaataagaaataaggaatgaactacttt

SEQ ID NO: 15789 - DNA, 448 bp, Homo sapiens
ctcagagcttcaccttctcatctctgaggccacagtggggtgggaccatggggttgggggagctgttcctgacttctgctgtcgtgacccagaaccccttggtctacagaagctttgaaatactgggagagaggaaataagaatgttgtaagctcaattaatgaggttagaaaaccatgagctagcctgggagtctccttcttttgaggcaatatgcatgtatgagaaaaaactgtgttcctaattccaaatgatttagaaacttattctttcatctagagattacctagcctctaaaatactgtaagttgggtacctgatgggtagattatcttttattagggcatttgacttgcacttctagtctttaattgcacgaaactgaagaacagattagccatttaagagttatgcagttcacattatattacactaaagtatttagctc

SEQ ID NO: 15790 - DNA, 5430 bp, Homo sapiens
gggtgtcggcgttggagttgtgaattcgctgcgtttccatgaaatcctgcggagtgtcgctcgctaccgccgccgctgccgccgccgctttcggtgatgaggaaaagaaaatggcggcgggaaaagcgagcggcgagagcgaggaggcgtcccccagcctgacagccgaggagagggaggcgctcggcggactggacagccgcctctttgggttcgtgagatttcatgaagatggcgccaggacgaaggccctactgggcaaggctgttcgctgctatgaatctctaatcttaaaagctgaaggaaaagtggagtctgatttcttttgtcaattaggtcacttcaacctcttattggaagattatccaaaagcattatctgcataccagaggtactacagtttacagtctgactactggaagaatgctgcctttttatatggtcttggtttggtctacttccattataatgcatttcagtgggcaattaaagcatttcaggaggtgctttatgttgatcccagcttttgtcgagccaaggaaattcatttacgagttgggcttatgttcaaagtgaacacagactatgagtctagtttaaagcattttcagttagctttggttgactgtaatccctgcactttgtccaatgctgaaattcaatttcacattgcccacttatatgaaacccagaggaaatatcattctgcaaaagaagcttatgaacaacttttgcagacagagaatctttctgcacaagtaaaagcaactgtcttacaacagttaggttggatgcatcacactgtagatctcctgggagataaagccaccaaggaaagctatgctattcagtatctccaaaagtccttggaagcagatcctaattctggccagtcctggtatttcctcggaaggtgctattcaagtattgggaaagttcaggatgcctttatatcttacaggcagtctattgataaatcagaagcaagtgcagatacatggtgttcaataggtgtgctatatcagcagcaaaatcagcccatggatgctttacaggcctatatttgtgctgtacaattggaccatggccatgctgcagcctggatggacctaggcactctctatgaatcctgcaaccagcctcaggatgccattaaatgctacttaaatgcaactagaagcaaaagttgtagtaatacctctgcacttgcagcacgaattaagtatttacaggctcagttgtgtaaccttccacaaggtagtctacagaataaaactaaattacttcctagtattgaggaggcgtggagcctaccaattcccgcagagcttacctccaggcagggtgccatgaacacagcacagcagaatacttctgacaattggagtggtggacatgctgtgtcacatcctccagtacagcaacaagctcattcatggtgtttgacaccacagaaattacagcatttggaacagctccgcgcaaatagaaataatttaaatccagcacagaaactgatgctggaacagctggaaagtcagtttgtcttaatgcaacaacaccaaatgagaccaacaggagttgcacaggtacgatctactggaattcctaatgggccaacagctgactcatcactgcctacaaactcagtctctggccagcagccacagcttgctctgaccagagtgcctagcgtctctcagcctggagtccgtcctgcctgccctgggcagcctttggccaatggacccttttctgcaggccatgttccctgtagcacatcaagaacgctgggaagtacagacactattttgataggcaataatcatataacaggaagtggaagtaatggaaacgtgccttacctgcagcgaaacgcactcactctacctcataaccgcacaaacctgaccagcagcgcaaaggagccgtggaaaaaccaactatctaactccactcaggggcttcacaaaggtcagagttcacattcggcaggtcctaatggtgaacgacctctctcttccactgggccttcccagcatctccaggcagctggctctggtattcagaatcagaacggacatcccaccctgcctagcaattcagtaacacagggggctgctctcaatcacctctcctctcacactgctacctcaggtggacaacaaggcattaccttaaccaaagagagcaagccttcaggaaacatattgacggtgcctgaaacaagcaggcacactggagagacacctaacagcactgccagtgtcgagggacttcctaatcatgtccatcagatgacggcagatgctgtttgcagtcctagccatggagattctaagtcaccaggtttactaagttcagacaatcctcagctctctgccttgttgatgggaaaagccaataacaatgtgggtactggaacctgtgacaaagtcaataacatccacccagctgttcatacaaagactgataactctgttgcctcttcaccatcttcagccatttcaacagcaacaccttctccaaaatccactgagcagacaaccacaaacagtgttaccagccttaacagccctcacagtgggctacacacaattaatggagaagggatggaagaatctcagagccccatgaaaacagatctgcttctggttaaccacaaacctagtccacagatcataccatcaatgtctgtgtccatataccccagctcagcagaagttctgaaggcatgcaggaatctaggtaaaaatggcttatctaacagtagcattttgttggataaatgtccacctccaagaccaccatcttcaccataccctcccttgccaaaggacaagttgaatccacctacacctagtatttacttggaaaataaacgtgatgctttctttcctccattacatcaattttgtacaaatccgaacaaccctgttacagtaatacgtggccttgctggagctcttaagttagacctgggacttttctctactaaaactttggtggaagctaacaatgaacatatggtagaagtgaggacacagttgttgcagccagcagatgaaaactgggatcccactggaacaaagaaaatctggcattgtgaaagtaatagatctcatactacaattgctaaatatgcacagtaccaggcctcctcattccaggaatcattgagagaagaaaatgaaaaaagaagtcatcataaagaccactcagatagtgaatctacatcgtcagataattctgggaggaggaggaaaggaccctttaaaaccataaagtttgggaccaatattgacctatctgatgacaaaaagtggaagttgcagctacatgagctgactaaacttcctgcttttgtgcgtgtcgtatcagcaggaaatcttctaagccatgttggtcataccatattgggcatgaacacagttcaactatacatgaaagttccagggagcagaacaccaggtcatcaggaaaataacaacttctgttcagttaacataaatattggcccaggtgactgtgaatggtttgttgttcctgaaggttactggggtgttctgaatgacttctgtgaaaaaaataatttgaatttcctaatgggttcttggtggcccaatcttgaagatctttatgaagcaaatgttccagtgtataggtttattcagcgacctggagatttggtctggataaatgcaggcactgttcattgggttcaggctattggctggtgcaacaacattgcttggaatgttggtccacttacagcctgccagtataaattggcagtggaacggtacgaatggaacaaattgcaaagtgtgaagtcaatagtacccatggttcatctttcctggaatatggcacgaaatatcaaggtctcagatccaaagctttttgaaatgattaagtattgtcttctaagaactctgaagcaatgtcagacattgagggaagctctcattgctgcaggaaaagagattatatggcatgggcggacaaaagaagaaccagctcattactgtagcatttgtgaagtggaggtttttgatctgctttttgtcactaatgagagtaattcacgaaagacctacatagtacattgccaagattgtgcacgaaaaacaagcggaaacttggaaaactttgtggtgctagaacagtacaaaatggaggacctgatgcaagtctatgaccaatttacattagctcctccattaccatccgcctcatcttgatattgttccatggacattaaatgagaccttttctgctattcaggaaataacccagttctgcaccactggtttttgtagctatctcgtaaggctgctggctgaaaactgtgtctatgcaaccttccaagtgcggagtgtcaaccaactggacgggagagagtactgctcctactccaggactctcacaaagctgatgagctgtacttcagaaaaaaataataatttccatgttttgtatatatctgacaaaactggcaacatcttacagactactgacttgaagacaacctcttttatatttctctatttctgggctgatgaatttgttttcatctgtcttttcccccttcagaattttccttggaaaaaaaatactagcctagctggtcatttctttgtaaggtagttagcaattttaagtctttctttggtcaacttttttttaatgtgaaaagttaggtaagacacttttttactgcttttatgtttttctgtcttgttttgagaccatgatggttacacttttggttcctaaataaaatttaaaaaattaacagccaagtcacaaaggtaatggattgcacatagactaaggaataaacttcagatttgtgatttttgtttctaatcttgatgtaaatttacactattataatacatatttattgcttgaaaatatttgtgaatggaatgctgttattttttccagatttacctgccattgaaattttaaggagttctgtaatttcaaacactactcctattacattttctatgtgtaaataaaactgcttagcattgtacagaaacttttattaaaattgtttaatgtttaaagagtttctattgtttgagtttaaaaaagactttatgtacagtgcccagttttgttcattttgaaatctgataaatatatttatatatacttatgtatgtatatataatatatatagaaatctggatatatatgtataaatctttagaacttaaatttttctcgtttagttcacatctatggtagatttttgaggtgtctactgtaaagtattgcttacaaaaagtatgattatttttaaagaaatatatatggtatgtatcctcaagacctaaaatgtcagactggtttattgttaagttgcaattactgcaatgacagaccaataaacaattgctgccaaaaaaaaaa

SEQ ID NO: 15791 - DNA, 5328 bp, Homo sapiens
gggtgtcggcgttggagttgtgaattcgctgcgtttccatgaaatcctgcggagtgtcgctcgctaccgccgccgctgccgccgccgctttcggtgatgaggaaaagaaaatggcggcgggaaaagcgagcggcgagagcgaggaggcgtcccccagcctgacagccgaggagagggaggcgctcggcggactggacagccgcctctttgggttcgtgagatttcatgaagatggcgccaggacgaaggccctactgggcaaggctgttcgctgctatgaatctctaatcttaaaagctgaaggaaaagtggagtctgatttcttttgtcaattaggtcacttcaacctcttattggaagattatccaaaagcattatctgcataccagaggtactacagtttacagtctgactactggaagaatgctgcctttttatatggtcttggtttggtctacttccattataatgcatttcagtgggcaattaaagcatttcaggaggtgctttatgttgatcccagcttttgtcgagccaaggaaattcatttacgagttgggcttatgttcaaagtgaacacagactatgagtctagtttaaagcattttcagttagctttggttgactgtaatccctgcactttgtccaatgctgaaattcaatttcacattgcccacttatatgaaacccagaggaaatatcattctgcaaaagaagcttatgaacaacttttgcagacagagaatctttctgcacaagtaaaagcaactgtcttacaacagttaggttggatgcatcacactgtagatctcctgggagataaagccaccaaggaaagctatgctattcagtatctccaaaagtccttggaagcagatcctaattctggccagtcctggtatttcctcggaaggtgctattcaagtattgggaaagttcaggatgcctttatatcttacaggcagtctattgataaatcagaagcaagtgcagatacatggtgttcaataggtgtgctatatcagcagcaaaatcagcccatggatgctttacaggcctatatttgtgctgtacaattggaccatggccatgctgcagcctggatggacctaggcactctctatgaatcctgcaaccagcctcaggatgccattaaatgctacttaaatgcaactagaagcaaaagttgtagtaatacctctgcacttgcagcacgaattaagtatttacaggctcagttgtgtaaccttccacaaggtagtctacagaataaaactaaattacttcctagtattgaggaggcgtggagcctaccaattcccgcagagcttacctccaggcagggtgccatgaacacagcacagcagaatacttctgacaattggagtggtggacatgctgtgtcacatcctccagtacagcaacaagctcattcatggtgtttgacaccacagaaattacagatgagaccaacaggagttgcacaggtacgatctactggaattcctaatgggccaacagctgactcatcactgcctacaaactcagtctctggccagcagccacagcttgctctgaccagagtgcctagcgtctctcagcctggagtccgtcctgcctgccctgggcagcctttggccaatggacccttttctgcaggccatgttccctgtagcacatcaagaacgctgggaagtacagacactattttgataggcaataatcatataacaggaagtggaagtaatggaaacgtgccttacctgcagcgaaacgcactcactctacctcataaccgcacaaacctgaccagcagcgcaaaggagccgtggaaaaaccaactatctaactccactcaggggcttcacaaaggtcagagttcacattcggcaggtcctaatggtgaacgacctctctcttccactgggccttcccagcatctccaggcagctggctctggtattcagaatcagaacggacatcccaccctgcctagcaattcagtaacacagggggctgctctcaatcacctctcctctcacactgctacctcaggtggacaacaaggcattaccttaaccaaagagagcaagccttcaggaaacatattgacggtgcctgaaacaagcaggcacactggagagacacctaacagcactgccagtgtcgagggacttcctaatcatgtccatcagatgacggcagatgctgtttgcagtcctagccatggagattctaagtcaccaggtttactaagttcagacaatcctcagctctctgccttgttgatgggaaaagccaataacaatgtgggtactggaacctgtgacaaagtcaataacatccacccagctgttcatacaaagactgataactctgttgcctcttcaccatcttcagccatttcaacagcaacaccttctccaaaatccactgagcagacaaccacaaacagtgttaccagccttaacagccctcacagtgggctacacacaattaatggagaagggatggaagaatctcagagccccatgaaaacagatctgcttctggttaaccacaaacctagtccacagatcataccatcaatgtctgtgtccatataccccagctcagcagaagttctgaaggcatgcaggaatctaggtaaaaatggcttatctaacagtagcattttgttggataaatgtccacctccaagaccaccatcttcaccataccctcccttgccaaaggacaagttgaatccacctacacctagtatttacttggaaaataaacgtgatgctttctttcctccattacatcaattttgtacaaatccgaacaaccctgttacagtaatacgtggccttgctggagctcttaagttagacctgggacttttctctactaaaactttggtggaagctaacaatgaacatatggtagaagtgaggacacagttgttgcagccagcagatgaaaactgggatcccactggaacaaagaaaatctggcattgtgaaagtaatagatctcatactacaattgctaaatatgcacagtaccaggcctcctcattccaggaatcattgagagaagaaaatgaaaaaagaagtcatcataaagaccactcagatagtgaatctacatcgtcagataattctgggaggaggaggaaaggaccctttaaaaccataaagtttgggaccaatattgacctatctgatgacaaaaagtggaagttgcagctacatgagctgactaaacttcctgcttttgtgcgtgtcgtatcagcaggaaatcttctaagccatgttggtcataccatattgggcatgaacacagttcaactatacatgaaagttccagggagcagaacaccaggtcatcaggaaaataacaacttctgttcagttaacataaatattggcccaggtgactgtgaatggtttgttgttcctgaaggttactggggtgttctgaatgacttctgtgaaaaaaataatttgaatttcctaatgggttcttggtggcccaatcttgaagatctttatgaagcaaatgttccagtgtataggtttattcagcgacctggagatttggtctggataaatgcaggcactgttcattgggttcaggctattggctggtgcaacaacattgcttggaatgttggtccacttacagcctgccagtataaattggcagtggaacggtacgaatggaacaaattgcaaagtgtgaagtcaatagtacccatggttcatctttcctggaatatggcacgaaatatcaaggtctcagatccaaagctttttgaaatgattaagtattgtcttctaagaactctgaagcaatgtcagacattgagggaagctctcattgctgcaggaaaagagattatatggcatgggcggacaaaagaagaaccagctcattactgtagcatttgtgaagtggaggtttttgatctgctttttgtcactaatgagagtaattcacgaaagacctacatagtacattgccaagattgtgcacgaaaaacaagcggaaacttggaaaactttgtggtgctagaacagtacaaaatggaggacctgatgcaagtctatgaccaatttacattagctcctccattaccatccgcctcatcttgatattgttccatggacattaaatgagaccttttctgctattcaggaaataacccagttctgcaccactggtttttgtagctatctcgtaaggctgctggctgaaaactgtgtctatgcaaccttccaagtgcggagtgtcaaccaactggacgggagagagtactgctcctactccaggactctcacaaagctgatgagctgtacttcagaaaaaaataataatttccatgttttgtatatatctgacaaaactggcaacatcttacagactactgacttgaagacaacctcttttatatttctctatttctgggctgatgaatttgttttcatctgtcttttcccccttcagaattttccttggaaaaaaaatactagcctagctggtcatttctttgtaaggtagttagcaattttaagtctttctttggtcaacttttttttaatgtgaaaagttaggtaagacacttttttactgcttttatgtttttctgtcttgttttgagaccatgatggttacacttttggttcctaaataaaatttaaaaaattaacagccaagtcacaaaggtaatggattgcacatagactaaggaataaacttcagatttgtgatttttgtttctaatcttgatgtaaatttacactattataatacatatttattgcttgaaaatatttgtgaatggaatgctgttattttttccagatttacctgccattgaaattttaaggagttctgtaatttcaaacactactcctattacattttctatgtgtaaataaaactgcttagcattgtacagaaacttttattaaaattgtttaatgtttaaagagtttctattgtttgagtttaaaaaagactttatgtacagtgcccagttttgttcattttgaaatctgataaatatatttatatatacttatgtatgtatatataatatatatagaaatctggatatatatgtataaatctttagaacttaaatttttctcgtttagttcacatctatggtagatttttgaggtgtctactgtaaagtattgcttacaaaaagtatgattatttttaaagaaatatatatggtatgtatcctcaagacctaaaatgtcagactggtttattgttaagttgcaattactgcaatgacagaccaataaacaattgctgccaaaaaaaaaa

SEQ ID NO: 15792 - DNA, 5237 bp, Homo sapiens
gggtgtcggcgttggagttgtgaattcgctgcgtttccatgaaatcctgcggagtgtcgctcgctaccgccgccgctgccgccgccgctttcggtgatgaggaaaagaaaatggcggcgggaaaagcgagcggcgagagcgaggaggcgtcccccagcctgacagccgaggagagggaggcgctcggcggactggacagccgcctctttgggttcgtgagatttcatgaagatggcgccaggacgaaggccctactgggcaaggctgttcgctgctatgaatctctaatcttaaaagctgaaggaaaagtggagtctgatttcttttgtcaattaggtcacttcaacctcttattggaagattatccaaaagcattatctgcataccagaggtactacagtttacagtctgactactggaagaatgctgcctttttatatggtcttggtttggtctacttccattataatgcatttcagtgggcaattaaagcatttcaggaggtgctttatgttgatcccagcttttgtcgagccaaggaaattcatttacgagttgggcttatgttcaaagtgaacacagactatgagtctagtttaaagcattttcagttagctttggttgactgtaatccctgcactttgtccaatgctgaaattcaatttcacattgcccacttatatgaaacccagaggaaatatcattctgcaaaagaagcttatgaacaacttttgcagacagagaatctttctgcacaagtaaaagcaactgtcttacaacagttaggttggatgcatcacactgtagatctcctgggagataaagccaccaaggaaagctatgctattcagtatctccaaaagtccttggaagcagatcctaattctggccagtcctggtatttcctcggaaggtgctattcaagtattgggaaagttcaggatgcctttatatcttacaggcagtctattgataaatcagaagcaagtgcagatacatggtgttcaataggtgtgctatatcagcagcaaaatcagcccatggatgctttacaggcctatatttgtgctgtacaattggaccatggccatgctgcagcctggatggacctaggcactctctatgaatcctgcaaccagcctcaggatgccattaaatgctacttaaatgcaactagaagcaaaagttgtagtaatacctctgcacttgcagcacgaattaagtatttacaggctcagttgtgtaaccttccacaaggtagtctacagaataaaactaaattacttcctagtattgaggaggcgtggagcctaccaattcccgcagagcttacctccaggcagggtgccatgaacacagcacagcagaatacttctgacaattggagtggtggacatgctgtgtcacatcctccagtacagcaacaagctcattcatggtgtttgacaccacagaaattacagatgagaccaacaggagttgcacaggtacgatctactggaattcctaatgggccaacagctgactcatcactgcctacaaactcagtctctggccagcagccacagcttgctctgaccagagtgcctagcgtctctcagcctggagtccgtcctgcctgccctgggcagcctttggccaatggacccttttctgcaggccatgttccctgtagcacatcaagaacgctgggaagtacagacactattttgataggcaataatcatataacaggaagtggaagtaatggaaacgtgccttacctgcagcgaaacgcactcactctacctcataaccgcacaaacctgaccagcagcgcaaaggagccgtggaaaaaccaactatctaactccactcaggggcttcacaaaggtcagagttcacattcggcaggtcctaatggtgaacgacctctctcttccactgggccttcccagcatctccaggcagctggctctggtattcagaatcagaacggacatcccaccctgcctagcaattcagtaacacagggggctgctctcaatcacctctcctctcacactgctacctcaggtggacaacaaggcattaccttaaccaaagagagcaagccttcaggaaacatattgacggtgcctgaaacaagcaggcacactggagagacacctaacagcactgccagtgtcgagggacttcctaatcatgtccatcagatgacggcagatgctgtttgcagtcctagccatggagattctaagtcaccaggtttactaagttcagacaatcctcagctctctgccttgttgatgggaaaagccaataacaatccatttcaacagcaacaccttctccaaaatccactgagcagacaaccacaaacagtgttaccagccttaacagccctcacagtgggctacacacaattaatggagaagggatggaagaatctcagagccccatgaaaacagatctgcttctggttaaccacaaacctagtccacagatcataccatcaatgtctgtgtccatataccccagctcagcagaagttctgaaggcatgcaggaatctaggtaaaaatggcttatctaacagtagcattttgttggataaatgtccacctccaagaccaccatcttcaccataccctcccttgccaaaggacaagttgaatccacctacacctagtatttacttggaaaataaacgtgatgctttctttcctccattacatcaattttgtacaaatccgaacaaccctgttacagtaatacgtggccttgctggagctcttaagttagacctgggacttttctctactaaaactttggtggaagctaacaatgaacatatggtagaagtgaggacacagttgttgcagccagcagatgaaaactgggatcccactggaacaaagaaaatctggcattgtgaaagtaatagatctcatactacaattgctaaatatgcacagtaccaggcctcctcattccaggaatcattgagagaagaaaatgaaaaaagaagtcatcataaagaccactcagatagtgaatctacatcgtcagataattctgggaggaggaggaaaggaccctttaaaaccataaagtttgggaccaatattgacctatctgatgacaaaaagtggaagttgcagctacatgagctgactaaacttcctgcttttgtgcgtgtcgtatcagcaggaaatcttctaagccatgttggtcataccatattgggcatgaacacagttcaactatacatgaaagttccagggagcagaacaccaggtcatcaggaaaataacaacttctgttcagttaacataaatattggcccaggtgactgtgaatggtttgttgttcctgaaggttactggggtgttctgaatgacttctgtgaaaaaaataatttgaatttcctaatgggttcttggtggcccaatcttgaagatctttatgaagcaaatgttccagtgtataggtttattcagcgacctggagatttggtctggataaatgcaggcactgttcattgggttcaggctattggctggtgcaacaacattgcttggaatgttggtccacttacagcctgccagtataaattggcagtggaacggtacgaatggaacaaattgcaaagtgtgaagtcaatagtacccatggttcatctttcctggaatatggcacgaaatatcaaggtctcagatccaaagctttttgaaatgattaagtattgtcttctaagaactctgaagcaatgtcagacattgagggaagctctcattgctgcaggaaaagagattatatggcatgggcggacaaaagaagaaccagctcattactgtagcatttgtgaagtggaggtttttgatctgctttttgtcactaatgagagtaattcacgaaagacctacatagtacattgccaagattgtgcacgaaaaacaagcggaaacttggaaaactttgtggtgctagaacagtacaaaatggaggacctgatgcaagtctatgaccaatttacattagctcctccattaccatccgcctcatcttgatattgttccatggacattaaatgagaccttttctgctattcaggaaataacccagttctgcaccactggtttttgtagctatctcgtaaggctgctggctgaaaactgtgtctatgcaaccttccaagtgcggagtgtcaaccaactggacgggagagagtactgctcctactccaggactctcacaaagctgatgagctgtacttcagaaaaaaataataatttccatgttttgtatatatctgacaaaactggcaacatcttacagactactgacttgaagacaacctcttttatatttctctatttctgggctgatgaatttgttttcatctgtcttttcccccttcagaattttccttggaaaaaaaatactagcctagctggtcatttctttgtaaggtagttagcaattttaagtctttctttggtcaacttttttttaatgtgaaaagttaggtaagacacttttttactgcttttatgtttttctgtcttgttttgagaccatgatggttacacttttggttcctaaataaaatttaaaaaattaacagccaagtcacaaaggtaatggattgcacatagactaaggaataaacttcagatttgtgatttttgtttctaatcttgatgtaaatttacactattataatacatatttattgcttgaaaatatttgtgaatggaatgctgttattttttccagatttacctgccattgaaattttaaggagttctgtaatttcaaacactactcctattacattttctatgtgtaaataaaactgcttagcattgtacagaaacttttattaaaattgtttaatgtttaaagagtttctattgtttgagtttaaaaaagactttatgtacagtgcccagttttgttcattttgaaatctgataaatatatttatatatacttatgtatgtatatataatatatatagaaatctggatatatatgtataaatctttagaacttaaatttttctcgtttagttcacatctatggtagatttttgaggtgtctactgtaaagtattgcttacaaaaagtatgattatttttaaagaaatatatatggtatgtatcctcaagacctaaaatgtcagactggtttattgttaagttgcaattactgcaatgacagaccaataaacaattgctgccaaaaaaaaaa

SEQ ID NO: 15793 - DNA, 2439 bp, Homo sapiens
ggtcgcaccactgcactccagcctggtcaacaggagtcaaaccttgtctcaaaaaattaaaaacatgaaacttagtttcaaaacacaaataatactattcaatctagatatgaactttttttcagttgtatggtggaaaggattgccagttgtagaacactaaactagactgctttttgcttaatctataggaagaaaatgaaaaaagaagtcatcataaagaccactcagatagtgaatctacatcgtcagataattctgggaggaggaggaaaggaccctttaaaaccataaagtttgggaccaatattgacctatctgatgacaaaaagtggaagttgcagctacatgagctgactaaacttcctgcttttgtgcgtgtcgtatcagcaggaaatcttctaagccatgttggtcataccatattgggcatgaacacagttcaactatacatgaaagttccagggagcagaacaccaggtcatcaggaaaataacaacttctgttcagttaacataaatattggcccaggtgactgtgaatggtttgttgttcctgaaggttactggggtgttctgaatgacttctgtgaaaaaaataatttgaatttcctaatgggttcttggtggcccaatcttgaagatctttatgaagcaaatgttccagtgtataggtttattcagcgacctggagatttggtctggataaatgcaggcactgttcattgggttcaggctattggctggtgcaacaacattgcttggaatgttggtccacttacagcctgccagtataaattggcagtggaacggtacgaatggaacaaattgcaaagtgtgaagtcaatagtacccatggttcatctttcctggaatatggcacgaaatatcaaggtctcagatccaaagctttttgaaatgattaagtattgtcttctaagaactctgaagcaatgtcagacattgagggaagctctcattgctgcaggaaaagagattatatggcatgggcggacaaaagaagaaccagctcattactgtagcatttgtgaagtggaggtttttgatctgctttttgtcactaatgagagtaattcacgaaagacctacatagtacattgccaagattgtgcacgaaaaacaagcggaaacttggaaaactttgtggtgctagaacagtacaaaatggaggacctgatgcaagtctatgaccaatttacattagctcctccattaccatccgcctcatcttgatattgttccatggacattaaatgagaccttttctgctattcaggaaataacccagttctgcaccactggtttttgtagctatctcgtaaggctgctggctgaaaactgtgtctatgcaaccttccaagtgcggagtgtcaaccaactggacgggagagagtactgctcctactccaggactctcacaaagctgatgagctgtacttcagaaaaaaataataatttccatgttttgtatatatctgacaaaactggcaacatcttacagactactgacttgaagacaacctcttttatatttctctatttctgggctgatgaatttgttttcatctgtcttttcccccttcagaattttccttggaaaaaaaatactagcctagctggtcatttctttgtaaggtagttagcaattttaagtctttctttggtcaacttttttttaatgtgaaaagttaggtaagacacttttttactgcttttatgtttttctgtcttgttttgagaccatgatggttacacttttggttcctaaataaaatttaaaaaattaacagccaagtcacaaaggtaatggattgcacatagactaaggaataaacttcagatttgtgatttttgtttctaatcttgatgtaaatttacactattataatacatatttattgcttgaaaatatttgtgaatggaatgctgttattttttccagatttacctgccattgaaattttaaggagttctgtaatttcaaacactactcctattacattttctatgtgtaaataaaactgcttagcattgtacagaaacttttattaaaattgtttaatgtttaaagagtttctattgtttgagtttaaaaaagactttatgtacagtgcccagttttgttcattttgaaatctgataaatatatttatatatacttatgtatgtatatataatatatatagaaatctggatatatatgtataaatctttagaacttaaatttttctcgtttagttcacatctatggtagatttttgaggtgtctactgtaaagtattgcttacaaaaagtatgattatttttaaagaaatatatatggtatgtatcctcaagacctaaaatgtcagactggtttattgttaagttgcaattactgcaatgacagaccaataaacaattgctgccaaaaaaaaaa

SEQ ID NO: 15794 - DNA, 2220 bp, Homo sapiens
gggtgtcggcgttggagttgtgaattcgctgcgtttccatgaaatcctgcggagtgtcgctcgctaccgccgccgctgccgccgccgctttcggtgatgaggaaaagaaaatggcggcgggaaaagcgagcggcgagagcgaggaggcgtcccccagcctgacagccgaggagagggaggcgctcggcggactggacagccgcctctttgggttcgtgagatttcatgaagatggcgccaggacgaaggccctactgggcaaggctgttcgctgctatgaatctctaatcttaaaagctgaaggaaaagtggagtctgatttcttttgtcaattaggtcacttcaacctcttattggaagattatccaaaagcattatctgcataccagaggtactacagtttacagtctgactactggaagaatgctgcctttttatatggtcttggtttggtctacttccattataatgcatttcagtgggcaattaaagcatttcaggaggtgctttatgttgatcccagcttttgtcgagccaaggaaattcatttacgagttgggcttatgttcaaagtgaacacagactatgagtctagtttaaagcattttcagttagctttggttgactgtaatccctgcactttgtccaatgctgaaattcaatttcacattgcccacttatatgaaacccagaggaaatatcattctgcaaaagaagcttatgaacaacttttgcagacagagaatctttctgcacaagtaaaagcaactgtcttacaacagttaggttggatgcatcacactgtagatctcctgggagataaagccaccaaggaaagctatgctattcagtatctccaaaagtccttggaagcagatcctaattctggccagtcctggtatttcctcggaaggtgctattcaagtattgggaaagttcaggatgcctttatatcttacaggcagtctattgataaatcagaagcaagtgcagatacatggtgttcaataggtgtgctatatcagcagcaaaatcagcccatggatgctttacaggcctatatttgtgctgtacaattggaccatggccatgctgcagcctggatggacctaggcactctctatgaatcctgcaaccagcctcaggatgccattaaatgctacttaaatgcaactagaagcaaaagttgtagtaatacctctgcacttgcagcacgaattaagtatttacaggctcagttgtgtaaccttccacaaggtagtctacagaataaaactaaattacttcctagtattgaggaggcgtggagcctaccaattcccgcagagcttacctccaggcagggtgccatgaacacagcacagcagaatacttctgacaattggagtggtggacatgctgtgtcacatcctccagtacagcaacaagctcattcatggtgtttgacaccacagaaattacagatgagaccaacaggagttgcacaggtacgatctactggaattcctaatgggccaacagctgactcatcactgcctacaaactcagtctctggccagcagccacagcttgctctgaccagagtgcctagcgtctctcagcctggagtccgtcctgcctgccctgggcagcctttggccaatggacccttttctgcaggccatgttccctgtagcacatcaagaacgctgggaagtacagacactattttgataggcaataatcatataacaggaagtggaagtaatggaaacgtgccttacctgcagcgaaacgcactcactctacctcataaccgcacaaacctgaccagcagcgcaaaggagccgtggaaaaaccaactatctaactccactcaggggcttcacaaaggtcagagttcacattcggcaggtcctaatggtgaacgacctctctcttccactgggccttcccagcatctccaggcagctggctctggtattcagaatcagaacggacatcccaccctgcctagcaattcagtaacacagggggctgctctcaatcacctctcctctcacactgctacctcaggtggacaacaaggattgccgagagcccccagaagctgggagaggggcctggaacagcttctcacccagaaaaagccaaccctgcatgacgggtggtgagcacctcgtccttggaggcatttaagcagagaggctggggggatgctgtggcaccgagccgtccacg

SEQ ID NO: 15795 - DNA, 510 bp, Homo sapiens
atgatgtgaatatattgttggtgatactggttactgacaatttggtggaggtttttaaatttagctattactttggtccgtttacataattgtgatttaggttaatagaaaaaatttgattataaaatgtaggtgaaatttgatgctactaataaatactatagccccataagtatttcctggcatctgcagaaattaaataaataagtgaaatttcagtcctttcacacttaattctttctcggatgggatgacatagcagttagattcagggcttcagcgtatggttctgcaaacttggcacatagctcaggttgtgcagaggccctagttttttatgggaactggatacagtgccgtaaaatgctttaccttcttcctttaaaaaaaaaaagcacttaaaatattatcccaaatataattttcattttttaactacatttatgtattcatgaagacctgggacttttctctactaaaactttggtggaagctaacaatgaacatatg

SEQ ID NO: 15796 - DNA, 116 bp, Homo sapiens
tcataaccgcacaaacctgaccagcagcgcaaaggagccgtggaaaaaccaactatctaactccactcaggtaataggaggactagcttccttgttggcttttcacataaatgttt

SEQ ID NO: 15797 - DNA, 386 bp, Homo sapiens
  misc_feature (172)..(172): n is a, c, g, or t
  misc_feature (203)..(203): n is a, c, g, or t
  misc_feature (258)..(258): n is a, c, g, or t
cctccaaatgtagaggtgctcttggagactctagcatattagtcttgttctcttacacgttttgtcttctatgaagatgggagccaattcccagggggcatggggcaataccagaaaattaccttgagggattttatgctaagaaggaaatgatgtcctgtgtcccttaaanccaagaggtcctagcaggcctggtggctgtnaagccaatgtttcaaaatgatgatttgacttgcttattcacaaaatttgtttggnatttgagacataattcatttaattagtagcaaacaggatggtaatttggaatatgtgaaagtgattggttctctctgaaacctcaaggaacagcatctttcactcaatgagaaggttaaaacaaaagc

SEQ ID NO: 15798 - DNA, 300 bp, Homo sapiens
acatagtgatgacaagaagaccaccagtagttggtacacttattctaggattctctgctgtccttaacctgtcatttttcttgcttgtgcctgggtgttctctttcattttcttttcttttgagacagagtcttgctctgtcacccaggctggagtgcagtggtgtgatctcggctcactgcaacctctgcctcccatgttcaggagaattacttgaacctgggaggcggaggttgcagtagaccgagattggccactgcactccagcctgggcgacaggagtcgtccccaccaaatgca

SEQ ID NO: 15799 - DNA, 251 bp, Homo sapiens
ggaaaattatttgaatatgagcttgtgtttttgtatatctatagactttaaaatctcattttaattaaaactagtaatgaatgccatgatattttaaatatagtccaaaatagagggcttagtgtatgtttcatttggttggcaaatgatgtttcttcaaagcctgaggaccaaaaaaacctgcaaaattctcagaggcatgagtgtctcacagagttaaaaagtttttagcacagccataataaagaatg

SEQ ID NO: 15800 - DNA, 401 bp, Homo sapiens
gcacgccagtgttcccagctactctggaggcttaagacaggagaatcacttgagccggagaggtggaggttgcagtgagctgaaattgtgccactgcactccagcctgggcgacagactgactctgtccccctgccagcgcccccaccaaaaatgactcatgtttatggtgaggctcttgtaggtcttagcagtcttgctgtatgatttttttctttccttattaagtcaagagcgttcactttttcacttaaaggaagcactttatggcttctctttggcatttctgaattggcagcaccactactcttgtggtttggagccattgttaaataaaatcagggtgacttgaacacaagcactgtaataatgtaacagttgatccacccctactccctcaaa

SEQ ID NO: 15801 - DNA, 399 bp, Homo sapiens
atacaactcagttacatttagtatattcacaatgttgtgtaaccatcactacttttctgtttccagaacgttttcaccccagacagaaactctgtaaccagccaggcgcagtggctcaggtctgtaatcctagcactttggaaggccgaggggggtggatcaactgaggtcaggagttcgagaccagtctagccaacatggtgaaccccgtctctactaaaaatacaaaaattagtcaggcgtggtggcgggtgcctgtagtcccactactcgggagcctgagccagaagaattgcttgaacccagggggcagaggttgcagtgagccaagatcgcgccactttactccagcctaggtgaaaaagcaagactctgtctcaaaaaaaaaaaaaaaagaaa

SEQ ID NO: 15802 - DNA, 376 bp, Homo sapiens
aaaatgaaaagcaagaagttaaaacatactaccacacaaagtccttatacacaaaaaagaaaggaagaaggtatatagaggacttacaaagtaaccacaaaacaaataacaaaacggcagttataaattcttacctattaattgcattgaatgtacatggactaaattctccaattaaaagacatgaaatagctgaatgggttaaaaaacaaggcccaactctaagttcctacaagtaattgtacttcacctgtaaaattacacctgcactagaaatgaatggagagaaaaaggtattccatgcaaacagagggcaaaaaagagcaggagctgctatggtgatatccaataaaatagatttcacatcaatactgta

SEQ ID NO: 15803 - DNA, 414 bp, Homo sapiens
gaaaaacatctgacaaattcaaattgagggacattctgtaaaatatctgaccagagtcttattaaaactgtcaagagaagtctgagaagctgacagtccagaaaaggctaaggagacatgatgacaaaatgtgatatggtatcctggataggatcttgggaagagaaaaggggcgttagggaaaaattaaaggggatcaagaaagaaggacagagtgagaccttacttctctaaaaaataataaatagtaagtaaaaattacctttgtaatattcttttttattagaatacgatgaacatctcttagtgtcaataaattcccatctacaacccagttgttaatgacttatcctattgtttggatatatgaaacttaaacggtctaattattagacctttgttaagtttccttta

SEQ ID NO: 15804 - DNA, 307 bp, Homo sapiens
gacaatatgtgattccttttatagcctgtgaacaaattgaaaataggagttatgtctcttacctggtacacaataagtacttcacttatgtttgttaaatgaataaattaatggcatataaatagctgtgcttccatattagaattagagcataaaataagacagtaaatgcctaactcctaggagatgtttcatttcaggaaaaatgttactgctgccttctgctagtccacaggagtgcctgattctaagtgaatgtgaattgtactggccaggacatagagaagcagaaggactctcaccactg

SEQ ID NO: 15805 - DNA, 445 bp, Homo sapiens
aacaactccaagttccattttagaatgttaaagatctaaaaaatgtttccaaattaatttttctctcaaaggtttgctgatgcgcaccagactgtaaataattgccctaactgatggccaggcccttattctcagaaggggatataggtgtctttgtgggatgggtatccttaagcaggatctgtgctcctaagaacagcagcaacaggcagtgcagggaccttctgttgaattctacctgtaaaccacagcctgtctggaaggtctgactccaggccactcagccttggcaagcatgtacttccgaaagcgcctggcagaaatgggagctgatagacaggcgcacatggcagggggagatccttgtgcagtggcttgacactaactagaccagagaccatttcccatgttctttttcataacaccagaagcaccaaggaaagag

SEQ ID NO: 15806 - DNA, 277 bp, Homo sapiens
tctgtggtggtctggctttgatgtatgtatatgtgggcaggaatgtgtgtgcgtgtgtgtgtgcatgtgtgagctcctgtgtgtgtgttcatcacgtatccattgtgtctccaaggtcttatcaacagcaacaaaaggcctcctttgagatcaatcacattcattcgatgtttgttttctactacctgatacttactgctttctctttgtcgccgttaattttgtttgtcatatgtcagaccaggatgagtggggcacatacagattcagctcattt

SEQ ID NO: 15807 - DNA, 410 bp, Homo sapiens
tcggcaggggctttttaatgacccaggcggtcccctactttgcagagggctccggggggccagtgcccactaccagcaccttgattcttcctccagagtacagttcttggggctacccctatgaggccccaccgtcttatgagcagagctgcggcggcgtggaacccagcctgacccctgagagctgaccccgtgctgccttctccaggcaggcctggcctctgccctgggactggggcgcccagggcctcgtgccttctctcttggcctagcctggcccactcaggacctgcccagcctctgccagctcctctggcatccgccctcttctccctggggctggggtgggggtggcagggagctgggacctggagagacaactcctgtaaataaaacactttatttgtaga

SEQ ID NO: 15808 - DNA, 565 bp, Homo sapiens
ctgctggccaccttgagttctgtgcctggtgcgccggagccctgccctcaggatggcagccctgcctcacacccgctgcaccctcccttgtgcatttcaacaggtgccactgtcccctactttgcagagggctccggggggccagtgcccactaccagcaccttgattcttcctccagagtacagttcttggggctacccctatggtgagtcgacagccagggcttggcagggaggggacgccaagagccccacgcagaccctgctttcttcccgcagaggccccaccgtcttatgagcagagctgcggcggcgtggaacccagcctgacccctgagagctgaccccgtgctgccttctccaggcaggcctggcctctgccctgggactggggcgcccagggcctcgtgccttctctcttggcctagcctggcccactcaggacctgcccagcctctgccagctcctctggcatccgccctcttctccctggggctggggtgggggtggcagggagctgggacctggagagacaactcctgtaaataaaacactttatttgtaga

SEQ ID NO: 15809 - DNA, 862 bp, Homo sapiens
agaaccagtcaggcaaggacaccagccctgtggtggccagtctgctgcagaaagtgtcctataaggccaagcgctggatccacgacgtacggaccattgcggaggtggagggtgcgggcgtcaaggcctggcggcgggcgcagtggcacgagcagatcctggtgcctgccttgccccagtcggccctgccgggctgcagcctcatccacatcgactactacttacaggtctctctgaaggcgccggaagctactgtgaccctcccggtcttcattggcaatattgctgtgaaccatgccccagtgagcccccggccaggcctggggctgcctcctggggccccacccctggtggtgccttccgcaccaccccaggaggaggctgaggctgaggctgcggctggcggcccccacttcttggaccccgtcttcctctccaccaagagccattcgcagcggcagcccctgctggccaccttgagttctgtgcctggtgcgccggagccctgccctcaggatggcagccctgcctcacacccgctgcaccctcccttgtgcatttcaacaggtgccactaggccccaccgtcttatgagcagagctgcggcggcgtggaacccagcctgacccctgagagctgaccccgtgctgccttctccaggcaggcctggcctctgccctgggactggggcgcccagggcctcgtgccttctctcttggcctagcctggcccactcaggacctgcccagcctctgccagctcctctggcatccgccctcttctccctggggctggggtgggggtggcagggagctgggacctggagagacaactcctgtaaataaaacactttatttgtaga

SEQ ID NO: 15810 - DNA, 926 bp, Homo sapiens
ggctggtccgtctgctgcagaaagtgtcctataaggccaagcgctggatccacgacgtacggaccattgcggaggtggagggtgcgggcgtcaaggcctggcggcgggcgcagtggcacgagcagatcctggtgcctgccttgccccagtcggccctgccgggctgcagcctcatccacatcgactactacttacaggtctctctgaaggcgccggaagctactgtgaccctcccggtcttcattggcaatattgctgtgaaccatgccccagtgagcccccggccaggcctggggctgcctcctggggccccacccctggtggtgccttccgcaccaccccaggaggaggctgaggctgaggctgcggctggcggcccccacttcttggaccccgtcttcctctccaccaagagccattcgcagcggcagcccctgctggccaccttgagttctgtgcctggtgcgccggagccctgccctcaggatggcagccctgcctcacacccgctgcaccctcccttgtgcatttcaacaggtgccactgtcccctactttgcagagggctccggggggccagtgcccactaccagcaccttgattcttcctccagagtacagttcttggggctacccctatgaggccccaccgtcttatgagcagagctgcggcggcgtggaacccagcctgacccctgagagctgaccccgtgctgccttctccaggcaggcctggcctctgccctgggactggggcgcccagggcctcgtgccttctctcttggcctagcctggcccactcaggacctgcccagcctctgccagctcctctggcatccgccctcttctccctggggctggggtgggggtggcagggagctgggacctggagagacaactcctgtaaataaaacactttatttgtaga

SEQ ID NO: 15811 - DNA, 563 bp, Homo sapiens
  misc_feature (18)..(18): n is a, c, g, or t
  misc_feature (62)..(62): n is a, c, g, or t
  misc_feature (67)..(67): n is a, c, g, or t
  misc_feature (80)..(80): n is a, c, g, or t
  misc_feature (82)..(82): n is a, c, g, or t
  misc_feature (92)..(92): n is a, c, g, or t
caccccaaggagacacantttcgacacgacggacagacaccactgacgtggacacaacactntgagnttactgatgacantnaaaaaagaangagagacacatgaccctacaggagtggacagacacactgacactaaacaacccgctgcaccctcccttgtgcatttcaacaggtgccactgtcccctactttgcagagggctccggggggccagtgcccactaccagcaccttgattcttcctccagagtacagttcttggggctacccctatgaggccccaccgtcttatgagcagagctgcggcggcgtggaacccagcctgacccctgagagctgaccccgtgctgccttctccaggcaggcctggcctctgccctgggactggggcgcccagggcctcgtgccttctctcttggcctagcctggcccactcaggacctgcccagcctctgccagctcctctggcatccgccctcttctccctggggctggggtgggggtggcagggagctgggacctggagagacaactcctgtaaataaaacactttatttgtaga

SEQ ID NO: 15812 - DNA, 715 bp, Homo sapiens
gtggagctgggaatgagggttggttcaggccaggtcctgaaggcctcggctgagctggtgtgtggcaaggagcagaaaatcctcaggttgtgagcctgccgtgtgagcgatctgggtttgatctgtttggagaaagaagtagattaaggctaataaactaatgaggggcctgatgtagtggtccaggcctcatgtccgtgtctagatggcagatggagaaggcagacactggggtggttgtgtggaacctgagaaagtgggccggcctgctgagagctggcatgatttgggggattgcccatagcccctttgactctcattttcctaataatttgtttccctgtgcccacaagggtgggcttgggggtgattgtgaatagcctagatgtgtgtaatgcattaaaaaaaaaaaaagccacctctatccaaattatcgacagcgtggtggagtaagagggaccctggccaggttctgggcatgtctgtcttctgctttgggccttagtttcccctttagtgaaaatggcagagggtaggggaacatcggaccagtgcctgaggtgtgctagcacgcccccgtgactgccgcctttgtttccaggagtttgaggatcaagcatgcagggcagggtggctccattcttggcaagtggagcggaaaataccagtgtcttgcagcaagtcccagagggtgtgggatgggtgtgtgtgtgta

SEQ ID NO: 15813 - DNA, 452 bp, Homo sapiens
gggtgtgagatgggcagtaccctgcaggtgtcatgtgctactgagttaccccgttatttaattaatgcagcctgaggccaaccccaaagcttctaaggcagcagggaaatcacctgtgctacagtctgttcctgaccctctgtcctgcttcatagatgaggtaacgaggcgcttggcccccctgacaagggttcggccatgacaccacgcatgttggctctggagggagcagccagaagagggtgtggtgggccacatgctgtcaggcgtccccaccaggccaggctggtgagcacagagggtgacagctggtcccaccgtgaagggacctagctggctctgcctgtctgcagccgacactcacctcctgggcccttgattggcttgtcagggcactgcaccccagctgctttctgtgttttttctcatcccccccacccagtccttgtgtt

SEQ ID NO: 15814 - DNA, 231 bp, Homo sapiens
cagcatccctggcctcccccgagccagatggtggggactgtccccgccctcagtggtgaggaccagaaatggctccagacattgcctcgtgccctggggaagattcacccaccacacttcctgtaaactggtcactcggcctggaggtggatttcgtaagccacttcctgttgcttcatccccagctgctttctgtgttttttctcatcccccccacccagtccttgtgtt

SEQ ID NO: 15815 - DNA, 521 bp, Homo sapiens
gaaacaaaatgatgcctatataattgcctcatggaaaagattccctatcatgttacagaaacatagtccactatgtaatgaccttggtggatgatagcgtccagattcctcttcagtatggtgtgtggttggttgttagtttgtacagaatgaatgatggcctctgtttgcctgccagccaaatgtgggacactcagaaaagcaaatttttcacatcagacagatctggattcagattttgggcttacttcattctgcctttgccactttggtcaatttaattacctttagttttatcacctgtaagatgggaatactgtttcttgattcataatgttattgtcaagatgaagtaaaagagttaatagaaaagacttccacgctgctggaaaaaatagtagtcactcaattctttgccattttcagcttgtcttattgttgagctaaacaaaattcccaaggagatttgtaaatttattgaacacattttattgaagaggtggtaggagctttggttcagc

SEQ ID NO: 15816 - DNA, 564 bp, Homo sapiens
ctaaaattccaatatgctacagtttctagaataaatagttggataatagataatgaatgaaaaatatcttaccagctttgttatgctatctcccacagtgcacaggtggaataaattcacaggaaacatggaaggagaaggaagcagaagggcttaaaatttaaagattgtttactcacaagtatttcttttagcagaattcatgccaagtgaagagtgagtttaagtcgaccaaaagtcatataactgatgtgatataattgcatagcatacatagtgagaatgaaggtattcagggaaattattcaggagtgccacaaataaaataaataaataaatctaatgcttgtagtttgtaagtgatctggtactatgtctactcagatatctggatatgaccagcctttgtttttgctgtcaagtgacagaaacatataaacatactatttttcctctctgatgtgtctgtactaaaaaattgggaatttttggaacatcttattgacctctgtgtctaaatgttatttataaataaaacacatacagctttgaaatatcttaagc

SEQ ID NO: 15817 - DNA, 524 bp, Homo sapiens
ttaaatactagggactgatatcactgttgatagtgcagagaaaccctccataattaagttttctgtaaaagccttcgtgttttctgagcagaatgtacgaggtgtgccatcccaaaaccagctgctaccctgtccttttaatgtaagtcactctcctttgctgtggccttgctgatgtctgataagtattgtcagtgtgcaaaaggctttatttcagaatgttttatttatagcaaaccaagtctgaaagttttaagaacacagtctttgtgggtggatgttattaactgtcattgttgttgcccagagccatgggttttttaaccccaaattatccacatggtgtgtatatgaattctttgaactcttaaggtttttgtgagaaaaggactgtgaaatcaaaacaatgaggcacttgtgggtgcactacatagattctgacagtgttgtgattctgataggatttttaaaaatgacaacattcacaaaacttactactttctaaaaagtaacatgtctgttaa

SEQ ID NO: 15818 - DNA, 328 bp, Homo sapiens
aggattattaactaaaatccatttaattagagcattggttgtttgaggaacttatgaccttaaggaagaaaaatagagttggaccacagttagtagtatttgtatcctttgtaggttttatttaactgtttactagaataaaacaataagacaatatgacaaataaagtgaaaatgattacacaatttaactgtgtgtttatcagtagcataacattacctttcttagacccgtttttggttctacatcccccaaattttaatgacatgttcctttcatttttcaaattaacatgattactaagggttttatgtgtatatgtgtgttg

SEQ ID NO: 15819 - DNA, 427 bp, Homo sapiens
gcccaaagtgagaacttacatccctgttttcccacttgaatgttgccttttccaaaaccacccatgacctgccccacccccacaacccatgcccatcaaaaccccaggctcagccagcagagagagagaagcagctggacatcagagagaagaggcttgacttcaggggaacagccttttcagctccctttcccgctgagagccactttcttcggcaataaaatcccccacatttaccatcttccattcgtttgtgcgaccccattcctcctggacactggacaagagcttgggtgccatgagtgcaagtgccaaagtctgtcacgctgacccaccactgggcggttaatacttgagctgtctggaccgcagagctacaagagtactgtaaaccttcctctgggtgacagagggagactgtctcaaa

SEQ ID NO: 15820 - DNA, 507 bp, Homo sapiens
gcctcagaatcccatgttttaaaaaagtttgtctcctacactgcatttatagttttattaatcaggcacatagaattaccatttcggagcttgtgatcaccatatgtagttatcactccaagctgcttaaattccagtctaaaacaaacaaaacattctaattattctgtgctaccctgacaggggtaagtgaaaactttccattcaggtttgtaagaacgagctcccagacctccacctcttccccttgctgcctctgaggactcttggaggtctagggaggccagtttgggttttcttgctcaagaaagtagccaccccacccaatttggaaggattaaagcttgtcctagttttgcttcattgttgtacttctagcatgctaaagagctaaaaaatgggaggaagaaaatacaacagaaggcaccattccagtaccaaactgaaaagaaacacaaaaacaagagagcagcatgtttttaacagcttgcgtggaaaaaatattga

SEQ ID NO: 15821 - DNA, 402 bp, Homo sapiens
atagagagtcctggaaagaatggtaaatgtcaaccaattcaaatagttttaacagatgaagaaacaagaccagagaggttacatgccttatccagggtcacacagatagtcaatgtcagagagagaacttagactcctggtttctcactcgtagcgcttaacttttctcatttctcactgtaaaaacatctcaaatagtctgccctttatttaaaaagagatgaagtgagcatctgtagaagcccagaaggttttagaacataaagcagatagaagatcaatttcctctctgacaatgattccttgcaaagagttgggattattttggttcaattaaaattactatgctccttttatgagaaatatattaagaaaggagataaattggtaccacatgagtaa

SEQ ID NO: 15822 - DNA, 335 bp, Homo sapiens
taaagttacccagtatgcattgggtagctgggtgacctcttatgtacccttggaggccagggccaagagaccatcccgtcatggggtgaagaggggccttggcagagaggttgcagaggaggctcctgggggaggactcctcttcccaagcttttcaggtcctgggatcctggggtccagggtgggcagcccaggccttaccttagccccagtcacccagtctacagagcgtcttacatgctgctgtgcatctgacatggttgtgggcaccctggagatcccagcagcattgcagacggcatccttgtccacaaggatattataatttgcgtaaa

SEQ ID NO: 15823 - DNA, 277 bp, Homo sapiens
ggttggtaaagatagtggtctgacttcctacaagtctgacttgtggatagtaggctggcttcctgtgctggttgctgctattgtgcgtcagagttctgtttttctacatggtctagccattgtctgtttgtatattcagcctctcccaggcaagggccactgtcagtcacttcacccctgatgtatatggaagccatttggtccttcactgtcaggtgtctctgctccaaagcagagtggaagagcctaggcaacacagggagaccctgtttctaca

SEQ ID NO: 15824 - DNA, 423 bp, Homo sapiens
gattgtatcagtaataaagtctcccagtaaagaaaacctcaggattgcacgggttttctactgaattctaccaaacctttaaagaactaacatgaattcttctcagacaattccaaaagactgaagagaaaggaattctccctaactcattctgtgaggcaagcagtatcttgataccaaaaccagataaggacacaataacagcaaaaaagaaaactacaggccaatctccctgatgaacatagatgcagaatcctcagaaacaaaacacacacacagacacacaaactagcaatctgaatccaatcgcacatcaaaaagataatacaccataatcaagtgggatttatcccagggattcaaggatggttcaacatatacaaatcaataaatgtgatacatcacattaacagaaggaaggac

SEQ ID NO: 15825 - DNA, 727 bp, Homo sapiens
aacatattccttcccatatctctcatgattgtccctctgtaatttcaaaatgaatgaaattcatgtgaatgtaggttgagagggcactgaagacctgaatctacactagtaatctcaagaaagattattcattctatctcagagttaccggcaagcatataaaatgctacttggataatatctacatgaatattgcatgctacatggttgataacactatttccattattgggcagaatctcagtgtttactttcaattcctaggatatgtgatcgtgaatcagatcacatataaaaagtctggattgtcagtagtattagatctgatcaaggtaggaattacaattgcatgcaggtagcaagcaagaaagcagaaactactgttccctttattttaacattgtacagacaatacagaaatgtacctgttggcggccgggtgcagtggctcacgcctgtaatcccagcacttcgggaggccgaggcgggtggatcacgaggtcaggagatcaagaccatcctggctaacacggtgaaaccccgtctctactaaaaaaaaagtacaaaaaattagccgggcgtggtggcgggcacctgtagtcccagctacacgggaggctgaggcaggagaatggcatgaacctgggaggcagagcttgcagtgagtggagatgcgccactgcactccagcctgggcgacagagcgagactccgcctcaaaaaaaaa

SEQ ID NO: 15826 - DNA, 159 bp, Homo sapiens
tctggcttctgccctgcaaatcccacacctcttgaccttcctgacctgcctgtctcctcaactcagtgaggctgctgactccgccttccctctgcttccaggccgttcactgggctctccttgttggtttctgttctcctagaaattattgtactgcat

SEQ ID NO: 15827 - DNA, 728 bp, Homo sapiens
gttaattggccaagaaattgcaagctgggggaaaaattataaatactgggaaataaaggattcttcatagggaacgaaacagggtttgttaatgatttatgggaattatgtgaagggccacattatgcatcaacaataccctccagcctatatttcaagcacatgcagttttttgccgcagtgcttctgctgcaaagacctacccccacttctcttagcctgtctgtccccactccatacccccgacctttcatccagctggcctgtgcttgctaaagctccctttatcctttcccagctccctttccatgttggagtaggttccccccttccatgctctcatagcaccctgcaaccttattaggctgtaattattacatagttagattgatctccaactagattgtcatctctttggtggagagattacgttcttgtgtatcttcagtgcctgacacagaagtgtttctaaaagtaacatctgcacacccctcaaacagaatcacaaggggcgaggccaagaaatctgctctccaagtgataacttaaactttttaacatgctcttcaggtgacacttaaacttgtttgaaaacctctgtgtcataaaactaaatattagctggatgaatgtatttgtatctttttctgtgttggcctttgtgaggagaaatgctgtctatgcaccaaatcagagctgaaaaattctagtgttttgttaaaaaaaaa

SEQ ID NO: 15828 - DNA, 1795 bp, Homo sapiens
attggaaacagtatgcatgaagacatgaaggcaagaaacagcaaaacaaatactgaagcatgaagattcctggggtggggggaaagcagcaagaaaaggtagagaggaaccagattggaagagggtcgtaaatgcatggctacagaattcagatttgttttgtaggacagtgtggttcccaaactggctgtataccacaaacaggtacggcattctgggccccggcccctaaaacattcattaagtctggggtgaagatttggaatcttgaatgcttataaaggttaccacatgactagggtacagccagatttggaaaccatagcttgaaggcagtgagggagccatgaaatggtttttaatagggggactccagatcagatgtgaacttaacctgtttctggctggctagccaaccagcatggaaaacagattaggttagatgttcatgctgtatgtgcccgtgcctgtagcttccctgttaatcagcttcttacactactatatttgcttattttgtctctgaataagctttaggcaccacaagggtgggcctggggatattttgcttaccagtatagcccctgcaaaaaagcacagtgcctgacacaaaacaggcacccagtaaagtttttgaatgaatgaatgcatgagtgaatccatttgtgagagagcgaatggagatgacaagattagctaggagactggaaaaagaccaggaggcctgcactagggcaaaggccagtaggaatagattggaggtgttaaggtgtgaactgttaaggtaagatgataacttaatgactgattattggatgtggagggtgactgagaggatagaatgagtacccatgaatagccatgattcctaccctgtcccagtcatctctttccttatccatctctgaaacaatctgcttacatcctcctcagcaactggaattcctcaagttagttagacattctgtgtgctgtgtggtctctcactgcccccccactccccacccctccacaagccattgattcattcatccagttcaataaatcttggctaagcacctccagtgtgcagtaaggctcttccaagccaggactctgactccctctttcctacctcaagagatgtttttgagggctttcccaggtaagagtcacatctcttatacaataacttatagtgagatacccagaatgtcagacttgtaagggaagactgcccaaaccccttctgaggtcctcagaggggaattaacttcctaaggtccgactgctaggaagtgttggagccagaaatggaacctaggtttcctttctatgtcatctctggagtcttgatcttgatctatcccattgtagatcaggacaggcagaggtggtcagggagaaggtgggacttaggttgaaccttgaaggtcaatgtattggacaggtcaaacaagatggttgccaattacactgcccccttctggaaacccttagcaaacctgccatgcttgcagtcccttctaaggggtttccttagcataagttgccatgctctgtaccatgtgacctcacaatcctggccacagatagctagatgtggatagtgtctggttcaagggcaaccaatctctaggctggccagtggcctgttagctggactggcataaggacttcaccttacaggggtggcatgtatcaaatggcaaatgtatgaaacaaccagatctttcagggaggcagaatgtgagctattcagaagaagtgaacgttaattagaatttaatgaggcattagtggtggtggatgaggg

SEQ ID NO: 15829 - DNA, 311 bp, Homo sapiens
gcccaaggggatggagagagatgtagcaatagctggttggtggagcattcagaacacacacaactttattgattaagttccacgtattatatgggtatggatagtggcaagtcaaatcaattacaatagtaacatcaaagatcactaaccacaggtcactatcacagatacaataacaatgaataagtctgaaatattgtgagaattagtaaaatgtgacacagagacataaagtgagcacatatttttgaaaaaatgatgtcaatagacttgtttgatgcaggattgccacaaacttccaatttgaaaac

SEQ ID NO: 15830 - DNA, 530 bp, Homo sapiens
ttggctttgaaaccaagcagacaggtgtttgaatccccactctgccaccttacagctgtgtggccttaggcaggtggttgtgagaatttaaatggcataagcatataaaagcatttggcgtagagtctggcacatagtagtgctcactaaatggtagtcattaaagatacaacctgggacagtggcagctagtttaacaaaccaccacaccccatagcacctctcacctgggtgcaagttccccaggccacactgcagtagctgctcgctgagggtgtccccggatatataagaagcctctctgagggccacagaggttttttgatggcagatggtttaaaacatcatttttatattaagttgtataaaatatactacgttataaaatgcaaagtttgcatcattttagagctaaaacttaaggccacaaaagaatctgctattttcttattaataaaaaatcctatttttatataatgcaaataatgaagatgaagtaacctattatttaattaaacatgtcttttttt

SEQ ID NO: 15831 - DNA, 390 bp, Homo sapiens
gtgctaatttgggaaacctttatctaaacaataattatcaatggccactcaagcagtaagataaaaaagaagtttgatggggatatttatgatgggtggaacaagctgttaacacctgaccgaaactcaacccactgattgaccttaaatgggaaactgatattaggtgcctcctgtggggatataataggaattacgtggtatcttcctgtgaaatatgccatcccaaatggtttagccagcatccatgaagcttctagatctaggccgggtgcagtggctcacgtctgtaatcccagcactttgggagtcctaggcaggcagggcagatcacaaggtcagaagatggagaccatcctggctaacacggtgaaatctcgtctctactaa

SEQ ID NO: 15832 - DNA, 367 bp, Homo sapiens
actttatgacagactaggggtacttaatgcctgagttgataatcacattattacttcttacactttgtttatagaatctagaaggagttaaacagaaaagtatttttctgttccttccttatgatttagaaaatagaaaaagtcttcgctaaagcctttaatagccttattcttagtgatgatgatgattatattaatagcaatgatggccagtatttgtcatgagctcactgttttgaatatttgactggcattatttaatcttcactacagttcttgaggtataatcagcccttcatatttgagagtcacacatttgcagattcagccaagcacagattggaaatattcaggaaaagaaaccaat

SEQ ID NO: 15833 - DNA, 462 bp, Homo sapiens
ttatcattttgttaattagccaagcttctgctgttgactccagataaagagagttaaagcacttggggtgaccacctaagtagattttttcatggtgaacaaatggaagcaacagaaacagctcagacttttgaaaagtgatgaaaaaggcccatgatgccctgctccttgaaaatgaagaagaggatgacttagccctgcagggcttttttctttgcatgttcttaccaaccctcaggggagattcagtctactagctggcttccccacgtggacctcacttctgtggcaagtaactgggagtaatttacctttctgggttctcttacaacccccttagctatgtaggtgatttcaggcccaagggggaagatatcagataagccagaacattttgattctactgaccgagtttcctcacctccctccctttgtttctgataaatacatacgttaaggtca

SEQ ID NO: 15834 - DNA, 1093 bp, Homo sapiens
ctgacctcaagtgatctgcctgccttggcctcccctagggctgggattataagaatgagccaccagaacccagccaaacttccccccaccccgcctttttgttttgttttggttttttctaatctcctgaagtcattctttgagttgtcatgtagattaatgggtttctcaaactactagaaaactagttgaagaaataaacaggcagtttgtgaatattaaacagaacagtggtgctgagcatggctaaagcatctctgcattcacagggagaggagcggaagaccttctggtgtgggctgggcagcaattcacttgaaggagaaacagcccgggtgtggagaggcggctgtccttggagggatcctttctaaggagctgagaaatcaacgtagagcttcctctatctgattctctaacaactgcagaccttccatgagtcaagctttgtgtcaaaaggacaaattaaaaggacctataaaaggcatcaccaagcccagtggacagatgccccaggctgcacattctgtcagtgctgttctggaaaaggcccaaacacatgctgaaacatggaagaactcatttatgtatctcatttgatctcatcacaacctgagacacaggtcataatagagacttcggggctcattttatacccggtgaaccagccaactttcatgcagttgagaaaagtataagaagccagccctcgggaaccaccaggagccaggagcaccccggccccgcagggccccaagttcagcctgccccaacccctctggtgcagagttcctgggacaccatctgcagccccgccacgcccctcaaagtcaagggcacaggcggctggggcttccccgcccgcccgacgacttcctgctgccccagcagccgccacagtcaccaccacggcccctggacgacccagagctcctgctgccgccccctgacttcatggaggcgccccaggacttcgtgccccctccccctgctgtcgccaagaggcctcctatgccccacccccacaagaggcacgaagcatcaatgttcagatgccgcaaatgaataaaataaatgaataaaagttcaacgt

SEQ ID NO: 15835 - DNA, 989 bp, Homo sapiens
ctgacctcaagtgatctgcctgccttggcctcccctagggctgggattataagaatgagccaccagaacccagccaaacttccccccaccccgcctttttgttttgttttggttttttctaatctcctgaagtcattctttgagttgtcatgtagattaatgggtttctcaaactactagaaaactagttgaagaaataaacaggcagtttgtgaatattaaacagaacagtggtgctgagcatggctaaagcatctctgcattcacagggagaggagcggaagaccttctggtgtgggctgggcagcaattcacttgaaggagaaacagcccgggtgtggagaggcggctgtccttggagggatcctttctaaggagctgagaaatcaacgtagagcttcctctatctgattctctaacaactgcagaccttccatgagtcaagctttgtgtcaaaaggacaaattaaaagaactcatttatgtatctcatttgatctcatcacaacctgagacacaggtcataatagagacttcggggctcattttatacccggtgaaccagccaactttcatgcagttgagaaaagtataagaagccagccctcgggaaccaccaggagccaggagcaccccggccccgcagggccccaagttcagcctgccccaacccctctggtgcagagttcctgggacaccatctgcagccccgccacgcccctcaaagtcaagggcacaggcggctggggcttccccgcccgcccgacgacttcctgctgccccagcagccgccacagtcaccaccacggcccctggacgacccagagctcctgctgccgccccctgacttcatggaggcgccccaggacttcgtgccccctccccctgctgtcgccaagaggcctcctatgccccacccccacaagaggcacgaagcatcaatgttcagatgccgcaaatgaataaaataaatgaataaaagttcaacgt

SEQ ID NO: 15836 - DNA, 438 bp, Homo sapiens
cctgctgtgtccagctggtttcttactttcctcctacctatgctatgcccagttctgtttcctcttcttcttcccccaggctggctgaaaactaagtttcaaaatacaaaatgcatgctacagatttcattgctgtagatgaaatgctgacagcttttctatttaaactctggttgttctcttcacatggaaggtaaaaccagcaagcagctgactacattccatccagccgtcccccaaaacccatgttctcaaccattcgcattgttccaataactgctcttttaaaaagagaaaacaggctaggtacggtggctcacgcctgtaatcccagcactttgggaggcttgagctccagagttccagacctgcctgggcaacagaacaagggctcatctctactagaagtcaaaaaattagccagctgtggtggcgtgc

SEQ ID NO: 15837 - DNA, 389 bp, Homo sapiens
gctactactactaaattcgcggccgtacgacggttatccagttttcccagcattatttatagaagagattgtccttttctcagaatatatggtctattctggagaatgttccatgtgctgaggaaaggaatgtgtattcttcagcagttggataaccatatgtagaagaatgaaactacataagtatctcttaccacatacaaaaaaaatcacatcaaaatggatttaaaaatctaagacctgaaactacaaaaagaaaacagtagagaaatactctaggacattggtctggggaaagtttttttttgtctaagatctcaaaagcagaggcaacaaaaacaaaaacagacaaatggaaccaggctaaaaagtttcagaagagtgtggtg

SEQ ID NO: 15838 - DNA, 409 bp, Homo sapiens
ccctgccacatcctcccctgaggttccttccatgctgcactgccttcctttagccagtgacagagcctggtgcccttcctggactgaaaccgatggaatccttccgaggggagtggcattcggcttgcctcctgcctaaatctgcttttatccatttgtagcaactttatgctgtaacaaaaggcggaaggaaaccaagagttctcttagcaagtcagactccttcccaagatggcaatcacagaacacctcgcaggatctcgcaggccacggtgaaggagaatgctttatgttgatgttgtccattctctctctcttctctttgcttttttttgacctaaataagctgcaaacatgttaatttaccaatattgataaaccacatgaagaaatcaggcattttacgtta

SEQ ID NO: 15839 - DNA, 331 bp, Homo sapiens
tttctggaatggggctctcataacctactgttcaacaagctactctttagaggtatgatggatctccccacaaagtctggttcaggtgtcaagacctacacaccaagaaatgatgagaagaattatcattcacatgagactttctggggcaagcagagtggctaccaaacaggtcttaaaatggcttgagaaatccagccaatattgaatgcacaagccacgaaccccattgccagactgcttgttacatggcaggtacacaattatatttataatataaaaaatgaatgattgagcaaataaaaataaaaacaactaagagtggagaatg

SEQ ID NO: 15840 - DNA, 506 bp, Homo sapiens
cagctggaagttgtttctggagatggagctttatgttttcccaaggttgtaacatggctgctgctctgcaagctcacatccactatccaggctgaagccagaagaagtgggaagagaaaaaccaaaggacagtgccctctgtaaaccacttttaaaaaacgtttctcagcagctactctttagaggtatgatggatctccccacaaagtctggttcaggtgtcaagacctacacaccaagaaatgatgagaagaattatcattcacatgagactttctggggcaagcagagtggctaccaaacaggtcttaaaatggcttgagaaatccagccaatattgagatttgaagttcaggatagaaaacagcatcaatattatcagaatgcacaagccacgaaccccattgccagactgcttgttacatggcaggtacacaattatatttataatataaaaaatgaatgattgagcaaataaaaataaaaacaactaagagtggagaatg

SEQ ID NO: 15841 - DNA, 536 bp, Homo sapiens
acacatttacctcgttttctttcaaggcaacaggcgctgtagatcttagtaccctgcccatagacccaagcacttttctcatttcttctgacagttcgagtcacttctcacagttgacttcctcaccaaataataagggggtgaagaagactcggcctacctactactcagtaatcctgctgtccagtcgactggagaagagagatttgttcacctctactagttttatttgttcttagtagttgtagaatttaaattggttttaatgaaatgttccttttatgaaattttaaataaaagccatttagtgtatatttagtatagcaagaagcatgtgaataagctccatataacctgacattgcgcatcttacagcatcctcttggtcagatgtctaataaaaagattgttattttcaaatttatcatagttcctgcaacttgcactttttaaagctgtgtttgtgagaatttatagactgcatatcgctatacttgatggaaattaaactatttttattttgaaagaaaaaaaaa

SEQ ID NO: 15842 - DNA, 528 bp, Homo sapiens
ttttgcgggggcagcatgagcagactcaggaagaaaatgctggccttgagatagatagctcttcagaggatccagattaaactaagttcgagtcacttctcacagttgacttcctcaccaaataataagggggtgaagaagactcggcctacctactactcagtaatcctgctgtccagtcgactggagaagagagatttgttcacctctactagttttatttgttcttagtagttgtagaatttaaattggttttaatgaaatgttccttttatgaaattttaaataaaagccatttagtgtatatttagtatagcaagaagcatgtgaataagctccatataacctgacattgcgcatcttacagcatcctcttggtcagatgtctaataaaaagattgttattttcaaatttatcatagttcctgcaacttgcactttttaaagctgtgtttgtgagaatttatagactgcatatcgctatacttgatggaaattaaactatttttattttgaaagaaaaaaaaa

SEQ ID NO: 15843 - DNA, 581 bp, Homo sapiens
catattgaaagtgtaaatccatacatttaagttaaattaaatagcaagttctgtactacttatgtaatttaactggtgacagaataatctattttcaataaaaataacttgttaaccctctgtctcacagtttgtgtcacaatgattatccttttatcagatctgagtagcaccaaaagactgacaagcctctggacacccaggacaacagggtcatatgcccatagcgaggttgaggtgcatgagatgatgaaatcgacccagtagatgaccacaaagaaactcactagcagcaggatggtctgagtggcacttttctctggggaaggtcttggggagaggctggtgctgtgaaagtatcagaatttcttctggtgcctgaacaaaaggaccactctgtatgcacttgaaagcagcattgttcctataagaaaaacatatctggagtaagaaacagagtaagaaacagtcttctgatgatggagttcatggtggaaaagtgaacagtctttactggtatgcagaagattgctcagggtcacattagaagaccccacagtgcacaagatgagattactact

SEQ ID NO: 15844 - DNA, 2129 bp, Homo sapiens
ccctccttccgggtgagcctctgaacagggctgtctccttctgggtgagcctctctgaaccgggctgcctccttccgggtgtgtctctctgaacggggctcactccttccagggtccctccttcccggtgagcctctctgactggggctgcctccttccgggtgagcctctctgactggggctgcctccttccgggtgagcctctctgactggggctgcctccttccgggtgagcctctctgaacagggcacgagagcagactctgaaccaggaagtagccgtgtctagcgctctacaagacacataggagaggtggcatccatggccctgaaacgacaagcccatgttgccagcgcattatcaccaagtcacttggcaagcgtttagcagactactggtgcctggatgatctgtaccgggagatggtgagatgctatgtggaaatcgttgagaagcttccagaacgccggccagacccagctaccattgaaggctgtgctcagctaaagcccaataactaccttctcgcctggcacacaccgttcaatgaaaaaggctcagggtttggagcggccaccaaggccatgtgcatcggcctgcggtactggaagcctgagcggctggagaccctcatcgaggtcagcgtggagtgcggccggatgacccacaaccatcccacaggcttcctgggctccctgtgcacggccctgtttgtgtcgttcgccgcacaaggaaagcccctggtccagtgggggagagacatgctgcgggcggtgcctctggcagaagagtactgcaggaagaccatccggcacacggcagaataccaggagcactggttttactttgaagctaaatggcaattttatttggaggagaggaaaatcagtaaagactcagaaaataaagccatcttccccgacaattatgatgcagaagagagggaaaagacctacaggaagtggagctcggaaggtcgagggggaagacgaggccacgatgcccccatgatagcctatgacgccctccttgcagcaggaaacagctggactgagctgtgtcaccgggccatgtttcatggaggggagagcgcggccacgggcaccattgcaggctgcctgttcgggttgctgtacggcctggacctcgttcccaaaggcttgtaccaggacctggaggacaaggagaagctggaggacctgggcgcggctctctaccgcctgtccacagaggagaagtaaagccatttctgccactttccccctagagagccgattccaccccggggcccgtagggccctctcgcagcccctgggtgagggtgtctctgtgaggctccactgcggtctgtgcctgactggccacatctaactctctgtttccaatttcagaatcctaactgttgcataaaatacattgtttgtcctgcgagaatattttccgtcctccaccatcaacattgacactgcgtagatttgccgcacttggacctccatgcgtggcactcacccgcagtctcctggacaggcgctgtattttattctgtcgcagagctaatgctgtttactcactcacttcaacaacactaactgcggtggtggcctccagcaggcccccccgctgcagaccctctgtcctgcctctgcctccaggcatgcgtttccccgtgaggccaatgcacctccccccaccccccaccctcccatgtccacagtgggtcgtgtgttcctggacagagaaacagtccacactggggcctgcgggacacatatagcagcatattttgctcttaaccccacccacctttttaatcacactagattttaagatcaatccctttttgaaacaactcacggagaaaaccagaacataaatggcctcctgccagctccggcgtctctctgtggtctgccttagtgggccaagtccaaatgcagagaaggcctttcccttccgcgcctgccccatcgggctcgctgacgaggaagcgctgtccctgtgatgaggttctctctcagagagtcttggaaaagagaccacttgctcttgtttaaaataaatttggacgtgatttttccatgcagcatctggtgtgaataaaacagcagttgactgatgtttaaaaaaa

SEQ ID NO: 15845 - DNA, 2713 bp, Homo sapiens
gggccggatgggaggttctagtgaagcctgcggtttgctgacgactttccccctcagtgcagtccaattatttgggagccgttaaacaccgcatgctgagaagacaccgtcattgttcacacaggagctagatagactttgttccctctacactgcattttttaaaagttttctatcaaaaacacatttcataatcgaaaagttttctaaatgataaaaccgcatgtcacagattaatctcaacattatgttgagtgaaggaagccagacaccgaaggccacacattgtatttgaaatgtccaggaaaggcagaactgtagagacagcagatgggttgttgcccgaggggtgagggcacgccccgcagcgggcggcagtgacaggcacgcctgcacacatctgctcccgcatcaccccacgccacacacggggaagtgtgcgcactccttccagggacagcgagaggagcccctgctctgtcaacgctctgaatgtgctgcggctgccggcagaagctagcaggctcctctgctgaggagctggtgcctgtccagacgcagaagaaaactgacacctcccacgtgggggacagaaaggtcctctcattggtgccacctgcagagatagacaaggagcgcctggccatcagaggacgctcctgacagtgacagcgtgactactataaaagtcaggcgggctgaggaggagacaaaggccaggacgctccgcagctgttggggaagaggagctgcctcctgggatggagaaatttaaggctgcgatgttgctggggagcgtcggcgatgctcttggctacagaaatgtctgcaaggagaacagcactgtaggcatgaagatccaggaggagctgcaacgttccgggggcctggaccacctcgtactctcgccaggagaatggcccgtgagtgacaacaccatcatgcacatcgcaaccgccgaggccctcaccacagactactggtgcctggatgatctgtaccgggagatggtgagatgctatgtggaaatcgttgagaagcttccagaacgccggccagacccagctaccattgaaggctgtgctcagctaaagcccaataactaccttctcgcctggcacacaccgttcaatgaaaaaggctcagggtttggagcggccaccaaggccatgtgcatcggcctgcggtactggaagcctgagcggctggagaccctcatcgaggtcagcgtggagtgcggccggatgacccacaaccatcccacaggcttcctgggctccctgtgcacggccctgtttgtgtcgttcgccgcacaaggaaagcccctggtccagtgggggagagacatgctgcgggcggtgcctctggcagaagagtactgcaggaagaccatccggcacacggcagaataccaggagcactggttttactttgaagctaaatggcaattttatttggaggagaggaaaatcagtaaagactcagaaaataaagccatcttccccgacaattatgatgcagaagagagggaaaagacctacaggaagtggagctcggaaggtcgagggggaagacgaggccacgatgcccccatgatagcctatgacgccctccttgcagcaggaaacagctggactgagctgtgtcaccgggccatgtttcatggaggggagagcgcggccacgggcaccattgcaggctgcctgttcgggttgctgtacggcctggacctcgttcccaaaggcttgtaccaggacctggaggacaaggagaagctggaggacctgggcgcggctctctaccgcctgtccacagaggagaagtaaagccatttctgccactttccccctagagagccgattccaccccggggcccgtagggccctctcgcagcccctgggtgagggtgtctctgtgaggctccactgcggtctgtgcctgactggccacatctaactctctgtttccaatttcagaatcctaactgttgcataaaatacattgtttgtcctgcgagaatattttccgtcctccaccatcaacattgacactgcgtagatttgccgcacttggacctccatgcgtggcactcacccgcagtctcctggacaggcgctgtattttattctgtcgcagagctaatgctgtttactcactcacttcaacaacactaactgcggtggtggcctccagcaggcccccccgctgcagaccctctgtcctgcctctgcctccaggcatgcgtttccccgtgaggccaatgcacctccccccaccccccaccctcccatgtccacagtgggtcgtgtgttcctggacagagaaacagtccacactggggcctgcgggacacatatagcagcatattttgctcttaaccccacccacctttttaatcacactagattttaagatcaatccctttttgaaacaactcacggagaaaaccagaacataaatggcctcctgccagctccggcgtctctctgtggtctgccttagtgggccaagtccaaatgcagagaaggcctttcccttccgcgcctgccccatcgggctcgctgacgaggaagcgctgtccctgtgatgaggttctctctcagagagtcttggaaaagagaccacttgctcttgtttaaaataaatttggacgtgatttttccatgcagcatctggtgtgaataaaacagcagttgactgatgtttaaaaaaa

SEQ ID NO: 15846 - DNA, 417 bp, Homo sapiens
ggttcacatttgactttacggtccttactctgttttccttgataaggttttaagcacctcaatctcaaaatctaaaggaagacttttagggattaaacaacctgagatggaaagagatggctgtgtcatttggggggaaattcaaagtaaagagcactttttcctaatttcatataagaaatgcttgagtagaggtaatcctcaaatgactcataacaaagcaagtccataatgtactatagctacagtccttactttagaaacatagggaacttctactataatttttacaattactgtacttggagtaattcctttcggaattgctacagttctaagacaaacaaatgaaaattaatttaaaagaaaaactggctagcttaataccataaataaaaagatgttcagcttttcctg

SEQ ID NO: 15847 - DNA, 3861 bp, Homo sapiens
  misc_feature (803)..(803): n is a, c, g, or t
  misc_feature (806)..(806): n is a, c, g, or t
  misc_feature (831)..(831): n is a, c, g, or t
  misc_feature (841)..(841): n is a, c, g, or t
  misc_feature (857)..(857): n is a, c, g, or t
  misc_feature (2154)..(2154): n is a, c, g, or t
  misc_feature (2309)..(2309): n is a, c, g, or t
  misc_feature (2566)..(2566): n is a, c, g, or t
  misc_feature (3084)..(3084): n is a, c, g, or t
  misc_feature (3312)..(3312): n is a, c, g, or t
  misc_feature (3557)..(3557): n is a, c, g, or t
  misc_feature (3759)..(3759): n is a, c, g, or t
aattcgcggccgcgcgacacggctgcgagaagcgacagaagggggaaaacggcgttgatacagtggaaggcttgtggtgttgctggcccttgatcgctggaaggattccgaggtgtagttttcgaagcgggagttttgttcgcattgggcgcttagcgtctgttactgtcgctaacgggagattgtcaacgtgtttgcattgggccatttgcatcagttgggaccgttgttactgacctcctaggttgtgtgttgcgtttacacgcttaaatccgggtttcacggtctcttagtactcgcgtatttaagctcatcgcgcgtaccttacttctacgcgttcacgtcggttcgtccgggcctatcagcgccgctgcttttaaattggccgtgtgcgctttacgtttgcacctttacgtcggatcactggggtccatcagcgccgtagtttttgagctggccgggcgtgctttcgagcgcttagttgctttcggtttcacttggttgcggcgtgacgatcattgcactcacttcagtcgccatcggtctccgtaatctgactgccctttgctattacttgcttcactcacatacgatatgcggacggtcctatttaagttgagcgcccatacttcactatcccaagtgggactgctttttcatttacgtgtctctatccgaggcagtataaacatctttccattcaagtttaccgcatgtgtttcactatcgagagtcggactgcttttggatttacgtggctttgtgggatgcggtatgaagatcgttgcattcaagtttaccgnctntacttcactgcagaatctgactgcngtcagatctntatgacagattgttgnattcgttttctgcgggtacgtcactatccagtctactttttccattgacgtggctgagtcatatgtagtatgactgtcagagacgttggaacctgaagcgaccccattttgagtgagggctagaaaaatgaggccgggacttacgggcctgcattctcagaaggatattcctagctttcagatgcttacggttaagggaacaaattaatgtttactgaagagacccgagcgtccagatagctggatatctggagaacaaaggcgttcctaattttgctttaaaggtagtaatagggattcttgcaaaatgtaataattaaagttaattctttatcacaaacccttgtagcagagcacctctccccatgtatacaagcattgtacctagggtggatacgttccttctcttagtttcgggaacgcccttctctgtctatggagtagctgttctttcaccactttactttcttgataaacttgcttttattttgcaccgcggactcgccctgagttatttcttgcgcgagacccaagaaccctctctttgggtctggatcggggcccttttcctgtgacgtatttctggccaccacagatgggactatagtgctttggggaagtgttggggtcctataacatatttctggcgaacgacggaaggggcgatactgaagaaactcccccaacccaaaggaagtagactgcagcactgattggacgactttgggtaagtggtggagtgcccgggtaaagaatgggattgggttagaggcccaacttaatggagttagagtctttcctaaaagagagtgggttagaggcccctcttaataaaaggcaaggacacttgaccgacctcgggttagaggcccgaccgaggagggttagaggcccctcccagtaaagcccctctcggctaaaaaacaggtttgacaccgcaggctatgctctttgtattagtctgcctcgtcctccttgtcttggttgctgtctccgtttcagtgtcattttcaggagacttcatttaactggtcttagggattttaactgattcttctcctatgtccctcccgatttctgtccgtttgcttgtgaaacactgggaaccaaaagcattggaggatccggctctaaaattgctgattgagatttgatatttaacagctatgagcagtaagattcgatagatgtggttgtgttttgttgctgctgtgctgagtgtgattgagaagcactaggatggaaatcaggggacttttctccttgctgttttgtttggttttgcacactaaaaaanctcctttgtagctaagtgcggtggctcacacctgtaatcccagcactttgggaggccgaggcaggcagatcacctgaaatcaggagttcgagaccatcctggccaacgtgttgaaaccccgtctctactaaaaatacaaacattacccgggtgtngtggcagacatctgtaatcccagcttcttgggatgctgagtcaggagaatcgctttaatctaggagtcagagtttgcagttagctgagattgcaccactgcactccagcagtcttctcaacagagcgagactctgtctcaaaagaaaataaaaaaactttcttttcttggattcgggcaaaccgtgtttgctttgcttttccaatcctcactgctgttattggttactctggttgttcccatctaaatcctcttcanttattttgccttattcgacatttttttcaaagtccatgttgtggtttatctaagattcatagctcagctcacttatgttatttggataatgtgaatcatgtttgatgagaggaaaagaagaaaaagatttagacatactaggtgatcctttaatgcaagccctgctgtggttcagcaggcatttttgggtggagcggaacccctttctgtcagctctgaaggttcgtatgtgtcagttctttctccctgtagtccacctgaaagttcttgagaacccttcgtcccttctccttacccagctagtcccactctgtacccaccattcccacaaagaacttagcccaccgagtactacttatagtgcagcctgctatcaacctccaaagggaaatctttgtccacttaggtggcaaatcgggaagagggcactgtgagagtacatgttcccttttctccgtctggtttgaccctatatatagagaaggttggtcatttctctgaagatccaggaaaatttntagatgagtttgagaaatcaactctgacctatagtttaacttgggaggatctgcatgttttgttgtctctgtgttgtacagtggaggagaaacaatgcattttggggacagctaggacccatgcagatgaggtattggctcgcaacccgtaccatactatgtatcaggcaggaagtatagcagttccagatcaagatgcagagtggaattatcaaaggcgcagtgagnacttggggaggagagatcatatggtcacttgttcgttggaagggatgaagaaatgtatgaaaaagcctgttatctatgaacaggttaaggaagattctcaggataaagatgagaatccaggtttgtttcaagggcatttagttgaagcaatcgggaagtataatatcactgatcctgcctcaaaggagagacaaacccttttgggaggacattttatgacccagtctgcccctgatatccccagnaaactacaaaaagcagctatgggagccgggcgtggtggctcaagcctgtaatcccagcactttgggaggctgaggggggtggatcacttgaggtcaggagttcaagaccagcctggccagcatggtgaaaccccttctctactaaaaatacaaaaattagctggggatggtgacaagtgcctgtaatctcacctacttgggnggctgaggcaggagaattgcttgaacccatgaggtggaagttgcagtgagcccagatcacgctattgcactccagcctgggtgacagagcgagactgtgtct

SEQ ID NO: 15848 - DNA, 3719 bp, Homo sapiens
  misc_feature (661)..(661): n is a, c, g, or t
  misc_feature (664)..(664): n is a, c, g, or t
  misc_feature (689)..(689): n is a, c, g, or t
  misc_feature (699)..(699): n is a, c, g, or t
  misc_feature (715)..(715): n is a, c, g, or t
  misc_feature (2012)..(2012): n is a, c, g, or t
  misc_feature (2167)..(2167): n is a, c, g, or t
  misc_feature (2424)..(2424): n is a, c, g, or t
  misc_feature (2942)..(2942): n is a, c, g, or t
  misc_feature (3170)..(3170): n is a, c, g, or t
  misc_feature (3415)..(3415): n is a, c, g, or t
  misc_feature (3617)..(3617): n is a, c, g, or t
aattcgcggccgcgcgacacggctgcgagaagcgacagaagggggggccatttgcatcagttgggaccgttgttactgacctcctaggttgtgtgttgcgtttacacgcttaaatccgggtttcacggtctcttagtactcgcgtatttaagctcatcgcgcgtaccttacttctacgcgttcacgtcggttcgtccgggcctatcagcgccgctgcttttaaattggccgtgtgcgctttacgtttgcacctttacgtcggatcactggggtccatcagcgccgtagtttttgagctggccgggcgtgctttcgagcgcttagttgctttcggtttcacttggttgcggcgtgacgatcattgagttaaaggttactgcactcacttcagtcgccatcggtctccgtaatctgactgccctttgctattacttgcttcactcacatacgatatgcggacggtcctatttaagttgagcgcccatacttcactatcccaagtgggactgctttttcatttacgtgtctctatccgaggcagtataaacatctttccattcaagtttaccgcatgtgtttcactatcgagagtcggactgcttttggatttacgtggctttgtgggatgcggtatgaagatcgttgcattcaagtttaccgnctntacttcactgcagaatctgactgcngtcagatctntatgacagattgttgnattcgttttctgcgggtacgtcactatccagtctactttttccattgacgtggctgagtcatatgtagtatgactgtcagagacgttggaacctgaagcgaccccattttgagtgagggctagaaaaatgaggccgggacttacgggcctgcattctcagaaggatattcctagctttcagatgcttacggttaagggaacaaattaatgtttactgaagagacccgagcgtccagatagctggatatctggagaacaaaggcgttcctaattttgctttaaaggtagtaatagggattcttgcaaaatgtaataattaaagttaattctttatcacaaacccttgtagcagagcacctctccccatgtatacaagcattgtacctagggtggatacgttccttctcttagtttcgggaacgcccttctctgtctatggagtagctgttctttcaccactttactttcttgataaacttgcttttattttgcaccgcggactcgccctgagttatttcttgcgcgagacccaagaaccctctctttgggtctggatcggggcccttttcctgtgacgtatttctggccaccacagatgggactatagtgctttggggaagtgttggggtcctataacatatttctggcgaacgacggaaggggcgatactgaagaaactcccccaacccaaaggaagtagactgcagcactgattggacgactttgggtaagtggtggagtgcccgggtaaagaatgggattgggttagaggcccaacttaatggagttagagtctttcctaaaagagagtgggttagaggcccctcttaataaaaggcaaggacacttgaccgacctcgggttagaggcccgaccgaggagggttagaggcccctcccagtaaagcccctctcggctaaaaaacaggtttgacaccgcaggctatgctctttgtattagtctgcctcgtcctccttgtcttggttgctgtctccgtttcagtgtcattttcaggagacttcatttaactggtcttagggattttaactgattcttctcctatgtccctcccgatttctgtccgtttgcttgtgaaacactgggaaccaaaagcattggaggatccggctctaaaattgctgattgagatttgatatttaacagctatgagcagtaagattcgatagatgtggttgtgttttgttgctgctgtgctgagtgtgattgagaagcactaggatggaaatcaggggacttttctccttgctgttttgtttggttttgcacactaaaaaanctcctttgtagctaagtgcggtggctcacacctgtaatcccagcactttgggaggccgaggcaggcagatcacctgaaatcaggagttcgagaccatcctggccaacgtgttgaaaccccgtctctactaaaaatacaaacattacccgggtgtngtggcagacatctgtaatcccagcttcttgggatgctgagtcaggagaatcgctttaatctaggagtcagagtttgcagttagctgagattgcaccactgcactccagcagtcttctcaacagagcgagactctgtctcaaaagaaaataaaaaaactttcttttcttggattcgggcaaaccgtgtttgctttgcttttccaatcctcactgctgttattggttactctggttgttcccatctaaatcctcttcanttattttgccttattcgacatttttttcaaagtccatgttgtggtttatctaagattcatagctcagctcacttatgttatttggataatgtgaatcatgtttgatgagaggaaaagaagaaaaagatttagacatactaggtgatcctttaatgcaagccctgctgtggttcagcaggcatttttgggtggagcggaacccctttctgtcagctctgaaggttcgtatgtgtcagttctttctccctgtagtccacctgaaagttcttgagaacccttcgtcccttctccttacccagctagtcccactctgtacccaccattcccacaaagaacttagcccaccgagtactacttatagtgcagcctgctatcaacctccaaagggaaatctttgtccacttaggtggcaaatcgggaagagggcactgtgagagtacatgttcccttttctccgtctggtttgaccctatatatagagaaggttggtcatttctctgaagatccaggaaaatttntagatgagtttgagaaatcaactctgacctatagtttaacttgggaggatctgcatgttttgttgtctctgtgttgtacagtggaggagaaacaatgcattttggggacagctaggacccatgcagatgaggtattggctcgcaacccgtaccatactatgtatcaggcaggaagtatagcagttccagatcaagatgcagagtggaattatcaaaggcgcagtgagnacttggggaggagagatcatatggtcacttgttcgttggaagggatgaagaaatgtatgaaaaagcctgttatctatgaacaggttaaggaagattctcaggataaagatgagaatccaggtttgtttcaagggcatttagttgaagcaatcgggaagtataatatcactgatcctgcctcaaaggagagacaaacccttttgggaggacattttatgacccagtctgcccctgatatccccagnaaactacaaaaagcagctatgggagccgggcgtggtggctcaagcctgtaatcccagcactttgggaggctgaggggggtggatcacttgaggtcaggagttcaagaccagcctggccagcatggtgaaaccccttctctactaaaaatacaaaaattagctggggatggtgacaagtgcctgtaatctcacctacttgggnggctgaggcaggagaattgcttgaacccatgaggtggaagttgcagtgagcccagatcacgctattgcactccagcctgggtgacagagcgagactgtgtct

SEQ ID NO: 15849 - DNA, 3876 bp, Homo sapiens
  misc_feature (818)..(818): n is a, c, g, or t
  misc_feature (821)..(821): n is a, c, g, or t
  misc_feature (846)..(846): n is a, c, g, or t
  misc_feature (856)..(856): n is a, c, g, or t
  misc_feature (872)..(872): n is a, c, g, or t
  misc_feature (2169)..(2169): n is a, c, g, or t
  misc_feature (2324)..(2324): n is a, c, g, or t
  misc_feature (2581)..(2581): n is a, c, g, or t
  misc_feature (3099)..(3099): n is a, c, g, or t
  misc_feature (3327)..(3327): n is a, c, g, or t
  misc_feature (3572)..(3572): n is a, c, g, or t
  misc_feature (3774)..(3774): n is a, c, g, or t
aattcgcggccgcgcgacacggctgcgagaagcgacagaagggggaaaacggcgttgatacagtggaaggcttgtggtgttgctggcccttgatcgctggaaggattccgaggtgtagttttcgaagcgggagttttgttcgcattgggcgcttagcgtctgttactgtcgctaacgggagattgtcaacgtgtttgcattgggccatttgcatcagttgggaccgttgttactgacctcctaggttgtgtgttgcgtttacacgcttaaatccgggtttcacggtctcttagtactcgcgtatttaagctcatcgcgcgtaccttacttctacgcgttcacgtcggttcgtccgggcctatcagcgccgctgcttttaaattggccgtgtgcgctttacgtttgcacctttacgtcggatcactggggtccatcagcgccgtagtttttgagctggccgggcgtgctttcgagcgcttagttgctttcggtttcacttggttgcggcgtgacgatcattgagttaaaggttactgcactcacttcagtcgccatcggtctccgtaatctgactgccctttgctattacttgcttcactcacatacgatatgcggacggtcctatttaagttgagcgcccatacttcactatcccaagtgggactgctttttcatttacgtgtctctatccgaggcagtataaacatctttccattcaagtttaccgcatgtgtttcactatcgagagtcggactgcttttggatttacgtggctttgtgggatgcggtatgaagatcgttgcattcaagtttaccgnctntacttcactgcagaatctgactgcngtcagatctntatgacagattgttgnattcgttttctgcgggtacgtcactatccagtctactttttccattgacgtggctgagtcatatgtagtatgactgtcagagacgttggaacctgaagcgaccccattttgagtgagggctagaaaaatgaggccgggacttacgggcctgcattctcagaaggatattcctagctttcagatgcttacggttaagggaacaaattaatgtttactgaagagacccgagcgtccagatagctggatatctggagaacaaaggcgttcctaattttgctttaaaggtagtaatagggattcttgcaaaatgtaataattaaagttaattctttatcacaaacccttgtagcagagcacctctccccatgtatacaagcattgtacctagggtggatacgttccttctcttagtttcgggaacgcccttctctgtctatggagtagctgttctttcaccactttactttcttgataaacttgcttttattttgcaccgcggactcgccctgagttatttcttgcgcgagacccaagaaccctctctttgggtctggatcggggcccttttcctgtgacgtatttctggccaccacagatgggactatagtgctttggggaagtgttggggtcctataacatatttctggcgaacgacggaaggggcgatactgaagaaactcccccaacccaaaggaagtagactgcagcactgattggacgactttgggtaagtggtggagtgcccgggtaaagaatgggattgggttagaggcccaacttaatggagttagagtctttcctaaaagagagtgggttagaggcccctcttaataaaaggcaaggacacttgaccgacctcgggttagaggcccgaccgaggagggttagaggcccctcccagtaaagcccctctcggctaaaaaacaggtttgacaccgcaggctatgctctttgtattagtctgcctcgtcctccttgtcttggttgctgtctccgtttcagtgtcattttcaggagacttcatttaactggtcttagggattttaactgattcttctcctatgtccctcccgatttctgtccgtttgcttgtgaaacactgggaaccaaaagcattggaggatccggctctaaaattgctgattgagatttgatatttaacagctatgagcagtaagattcgatagatgtggttgtgttttgttgctgctgtgctgagtgtgattgagaagcactaggatggaaatcaggggacttttctccttgctgttttgtttggttttgcacactaaaaaanctcctttgtagctaagtgcggtggctcacacctgtaatcccagcactttgggaggccgaggcaggcagatcacctgaaatcaggagttcgagaccatcctggccaacgtgttgaaaccccgtctctactaaaaatacaaacattacccgggtgtngtggcagacatctgtaatcccagcttcttgggatgctgagtcaggagaatcgctttaatctaggagtcagagtttgcagttagctgagattgcaccactgcactccagcagtcttctcaacagagcgagactctgtctcaaaagaaaataaaaaaactttcttttcttggattcgggcaaaccgtgtttgctttgcttttccaatcctcactgctgttattggttactctggttgttcccatctaaatcctcttcanttattttgccttattcgacatttttttcaaagtccatgttgtggtttatctaagattcatagctcagctcacttatgttatttggataatgtgaatcatgtttgatgagaggaaaagaagaaaaagatttagacatactaggtgatcctttaatgcaagccctgctgtggttcagcaggcatttttgggtggagcggaacccctttctgtcagctctgaaggttcgtatgtgtcagttctttctccctgtagtccacctgaaagttcttgagaacccttcgtcccttctccttacccagctagtcccactctgtacccaccattcccacaaagaacttagcccaccgagtactacttatagtgcagcctgctatcaacctccaaagggaaatctttgtccacttaggtggcaaatcgggaagagggcactgtgagagtacatgttcccttttctccgtctggtttgaccctatatatagagaaggttggtcatttctctgaagatccaggaaaatttntagatgagtttgagaaatcaactctgacctatagtttaacttgggaggatctgcatgttttgttgtctctgtgttgtacagtggaggagaaacaatgcattttggggacagctaggacccatgcagatgaggtattggctcgcaacccgtaccatactatgtatcaggcaggaagtatagcagttccagatcaagatgcagagtggaattatcaaaggcgcagtgagnacttggggaggagagatcatatggtcacttgttcgttggaagggatgaagaaatgtatgaaaaagcctgttatctatgaacaggttaaggaagattctcaggataaagatgagaatccaggtttgtttcaagggcatttagttgaagcaatcgggaagtataatatcactgatcctgcctcaaaggagagacaaacccttttgggaggacattttatgacccagtctgcccctgatatccccagnaaactacaaaaagcagctatgggagccgggcgtggtggctcaagcctgtaatcccagcactttgggaggctgaggggggtggatcacttgaggtcaggagttcaagaccagcctggccagcatggtgaaaccccttctctactaaaaatacaaaaattagctggggatggtgacaagtgcctgtaatctcacctacttgggnggctgaggcaggagaattgcttgaacccatgaggtggaagttgcagtgagcccagatcacgctattgcactccagcctgggtgacagagcgagactgtgtct

SEQ ID NO: 15850 - DNA, 642 bp, Homo sapiens
aattcgcggccgcgcgacacggctgcgagaagcgacagaagggggaaaacggcgttgatacagtggaaggcttgtggtgttgctggcccttgatcgctggaaggattccgaggtgtagttttcgaagcgggagttttgttcgcattgggcgcttagcgtctgttactgtcgctaacgggagattgtcaacgtgtttgcattgggccatttgcatcagttgggaccgttgttactgacctcctaggttgtgtgttgcgtttacacgcttaaatccgggtttcacggtctcttagtactcgcgtatttaagctcatcgcgcgtaccttacttctacgcgttcacgtcggttcgtccgggcctatcagcgccgctgcttttaaattggccgtgtgcgctttacgtttgcacctttacgtcggatcactggggtccatcagcgccgtagtttttgagctggccgggcgtgctttcgagcgcttagttgctaaaaaaaataacttcagccgtctttgccctggggacttaggattgcagccgcttttgaattctgccataattcagcatatttggccaaattccccattcgtttcgcattggccaattataggcccactgtttccatttctgggatcctttgtttcc

SEQ ID NO: 15851 - DNA, 177 bp, Homo sapiens
agataaaaacatcttagagttgcaacttccagttcatgatgattaagaaattatctatctaccttttttttttttaattgagttggagtcttgctcttttgcccaggctggagtgcagtgagccgagatcacgccattgcactccagccgggggagacaagagcgagacttcgtctt

SEQ ID NO: 15852 - DNA, 312 bp, Homo sapiens
atgtctgggcgcggcaaaggcgggaagggtctgggcaaaggaggcgctaagcgccaccgcaaagttctgcgcgacaacattcagggcatcaccaagcccgccatccgacgcctggcacggcgtggaggcgttaagcgcatctcaggccttatatacgaggagacacgcggagttcttaaagtgtttttggagaatgtaatccgcgatgcagttacctacacggagcacgccaaacgcaagacagtcacagccatggacgtggtttacgcgctcaagcgccagggccgcaccctgtatggctttggcggctga

SEQ ID NO: 15853 - DNA, 505 bp, Homo sapiens
aatctgatcctgtctttctcctcctaaaaccctccaacaggcctacagcttctgcctgcaaactcctgccccaagcatggcctcctagacaccctagaatccacccctgctggcccctcacaagatgcctctcctgtcccacctccccatcgcagcccaggctctcactgaacgtgcaccctggttagccctccatctcctcaactgcataaagaatttctggccaggcacggtggctcacgcctgtaatcccagcacttcgggaggccgaggcaggcggatcacaaggtcaggagattgagaccagcctgaccaacatgcagaaaccccggctttactaaaaatacaaaattagccgggcgtggtagcgggtgcctgtagtcccagctactcgggaggctgaggcaggagaatggcgtgaaactgggaggtggagcttgcagtgagccgagatcgtgccactgcactccactccagcctgggtgacagagtgagactcggtctc

SEQ ID NO: 15854 - DNA, 8014 bp, Homo sapiens
  misc_feature (4008)..(4008): n is a, c, g, or t
  misc_feature (4741)..(4741): n is a, c, g, or t
  misc_feature (4814)..(4814): n is a, c, g, or t
  misc_feature (4982)..(4982): n is a, c, g, or t
  misc_feature (8014)..(8014): n is a, c, g, or t
cgtaccggcgtctccatggcgaccgcgttggctgggtggcctccattgtcgggctgctgctctcagcggcggggctcgccagcgcttcagtgggcggggacgcggcaggtgactccagaccaaggaggatgagctgctgtccctggaagagaacggatggagggaagcagctcctacgaagttccctctgtggctgctgctgatctggaggagggtgctggtcagactaggagcttgcctgccaccccctccaaagatgttcacaagggtgttggaggcatcatcttttcctcctcaccgattttagacttgagtgaaagtggtctgtgccgtttggaggaggtctttagaatccccagccttcaacaattgcatctgcaaaggaatgccctgtgtgtgattcctcaagatttctttcagttgcttccgaacctgacttggctggacctccggtacaatagaattaaagcgcttccttctgggattggagctcaccagcatttgaaaactttgcttttagaaagaaatcctatcaaaatgttacctgtggagctggggagcgtaaccacgctgaaagcactgaacctaagacactgccctctggaattccctcctcagctcgttgtgcagaagggattggtggctatccagcgcttcctgcggatgtgggcagtagaacactctctccccagaaatccaacttctcaagaggctccaccggttagagagatgaccctccgtgacctcccgagcccaggactggagttgtctggagaccacgcgtctaaccaaggagctgtgaacgctcaggacccagagggggctgtgatgaaagagaaggccagctttctcccacctgtggaaaagccagacctgagtgaactcaggaagtctgcggactcctcagagaactggcccagcgaggaggagatcaggcgcttttggaagctgaggcaggagattgttgagcacgtgaaggcagacgttctgggagatcagctcttgacgagggaattacctccaaatctcaaggcggccttgaacattgagaaagaactaccaaagccaagacacgttttcagaaggaagacagcctcctccaggagcatcttacccgacctcttgtcaccgtaccaaatggcgatccgagcaaaaagactggaagagagccgagcggcggcgctccgagagctccaggagaagcaggctctgatggagcagcagagacgagagaaaagggcactgcaggagtggagagagcgagcccagaggatgaggaagaggaaggaagagctcagcaaactcctgcctccgcggaggagcatggtggcatcaaagattccctctgccacagatctgacagataacaggaaagtaccactgaatccgcctggaaaaatgaaaccaagcaaagagaaatcgccacaagcaagtaaagaaatgagtgccctgcaggagagaaatttagaagagaagataaaacagcacgtcctccaaatgcgtgagcaaagaagattccatggccaggccccactggaggagatgaggaaggctgccgaggatctggaaattgccacagagctacaggatgaagtattgaagctaaaattgggattaaccttgaacaaagatcgtcgacgggcggccctcactggaaacctttcgcttggcctgccggcagcacagcctcaaaatacattttttaacacaaaatatggagaatcaggaaatgttcgcagataccagtgacaccaggtggctggactgatggagacgtcttcagacaggagccgctcagtcttctttcccgggcgtcgcctcctgtgtggtgccggaagagcgccaggttcagtgttaccctgagggctgatttcgcgcagcctgttgttttccttagacaggtccacgtccctctcctgaggctgtggaagatttcagccgtattaaaagaaaggacactgtgagcacgtggtctcgccttcccttcttcctgcaggttcccgccaagccatgtgacagagtgctcacactcaggcacttgcctctctcctgtcctggagcccttgttacaaaagtactcacagctttccttcacttagttatttgagtgtgggagaggagaccaggtcacccgattcccgccaagccggaagtccctgcagcaccacctttggctaggagggaggggtgacagccaaaaagggcttcgggggagtggttaccctgctccctgcccagtgacaagccctcctttcccctgggggccctcctttcccctgctccctgcccagctacggggccctcctttcagccttgaccccttcctggttgctaccactcaggctgccactcagtggactccaccccagggacacggcagggtctgcagacctccccatgctagatcagccgtatttcatgctctgtctgcccaggctgtgtagattctgtgtgacttagtctcttgtgctgagtgtttgcttggatcttgaaaacatctttggtttgatttctttaacagaggtgagactattcagactttgtttatttttgtgttaattttggtaaatatggtttcagtgagtttcctcatttcatccaagttgtgcaatgtatcagcataaagttcctcttattttcagtatctttaggatccgtaataatgtcccctcttttattcttgacctggtgttcttcatcattcttgctatggatttatcaattttgttcctcttttccaaaagccccaggttttggcttcactggatttgctgtttgtcttctgtctcatgggtctctgcgccctgcacttcgtactttccgagagtttaactggtgcttagagagaaatgcatcacttccaaacccatgtattagagaagaagggcgtgaaatttatcacctaagctttccattcaggaagctagaaaaggtgtcagtgacctgttgcggcccagcggctggagcagcagacgtttgccatttctcacgcctgagggcaggcgttggagcagctcagccggcgttgctggtcagggtctcccgtgaggctggagtcagccgtgggttgagctgctctcctctgaaggtttaactgggcttggggctcagcttccaaggtgctcacctggttgttgatcagagagcgtgtccgttgtgatcccagtcctttgaaactgtgaagcctcgccccgcggcctgccgcaggatatgttttggtaaatgtagactgtgcacttgagaagaatgtattttgagttgttgggtacattgttttgtgtgtgtcaggtgacattgactaatcctgttgctcagagctcctgtacccttactgactgacttaagcctggtttctcagttactgagagaggcctgtgaacagttctagctatgatcatgaacatgtgttttcttcttagttatgtgagtttttgctatacgtgttttggggctattttgtcagatgcctacaaatttaggattgttttatcttcctgtcgaactgaccttgtcattattatgaactatttctcttcgcctctccttttcacttcttgccttctgtggattttgtctgatactaatccaggcacactgctgctgttttggtcagcgttttcataatgcatcttcttccctccttctactgtactggatttaaagcgcaccttatagagacatcatatactcgggactccttttctttctctagctgccagttctgtgtttcagttacagtgtttggccctcacatttaaggtgcgtgtgcgtacggcggattccgtgcccatctcatgtttttattccctttattcttcttttgctgctttctgatagtgatcaatttttttatttatatctcttgtattagagttttagtaatatcttttaatattattctcttgggtgttgccttagagatttcatacatgcccttgagttcattagcatttcctgaatgagccaatgaccctgagaaggtccctcccatctgccagttccctgccnttgatgctgttgctctcgtccgcctcccttccacaggtaagcacgcaagacacaggtaccgtgtgccccaacggtgtcttgactcgctgttcctagacatcagtgtttgcttcactttacccatcccgatgctcttccttcctgcagcttcatgctccaatgagggctgattttcatttagctaaataacttttttttaagtatttctttgtatcatggttatgctttgactggccgtaagttctctcagcttttgtttgtctgaaaataaatttagttcgcctttattctgcacaggacagaattctaggtggatgatttttgccattcccagaactttaaagatgggctccactgtcttctggctcccatgtgttttgttaaaaattcagtgttcaggccgggtgctgtggctcacgcctgtaatcccagcactttgggaggccgaggcgagtggatcacgaggtcaggagatcgagaccatcctggctaacacggtgaaaccccgtctctactaaaaaatacaaaaaattagccgggcgtggtggctgtagtcgcagctactcaggaggctgaggcgggagaatggcgtgaacccaggagacggagcttgcagtgagccgagatcgcgccactgcactccagcctgggcgacagagcgagactccgtctcaaaaaaaaaaaaaaaagattcaatgttcattgttatttgttgctcctttgaaggtaatgngtcttttttctttgtcttaaaattgtttctccttatctttggttttcagcagtctgtgctgtgcctggatgtnattttctttttacgtatttttcttggaatatacagaactcaaatctgggagttagcatctttcatcagttttggaaaattcttagccattttttttttttttactattttttcccctgttctccctcttctccctgagacttcagttttgtgtgtgtgtgcacatgtntgtatgcattcgtgcgtacgagtgtgtgcatgtgtgcgcccgtgtgtatgtgcatatgtgagtgtgtgtggctgtaacctgcacgtctcttctgtcatgtgttctatttttcattcctctctgtacatcaggctagatgcctcctgtctacgtggttttagatttacgaatcctgtcttctgttgtgtcccacagaaaaacccatgaggttttttaacattaaaaacagcagctttatgatagagaaaaaaacacaaacatagacgattgtaccattgcactcagaagaaacatcccaggccctgagcagcgtgtctttcctcggccgagtcaggcttcctggtgagcctcagggagtgcatggtctcagatgccatccttctcttctccagcatttccactcacctccgtgttcttggggagtgcgtggtgtcagatcccatcctgctcctctccagagtttccggtcacctccgtgttctcagggagtgcgtggtcttggatgccatcctgctcatctccagcatttcctctcacctccgtgttctcggggagtgcgtggtgtcagatcccatcctgctcatctccagcatttcctctcacctctgtgttctcggggagtgcgtggtgtcagatcccatcctgctcctctccagcatttcctctcacctccgtgttctcggggagtgcgtggtgtcagatcccatcctgctcctctccagagtttcctctcacctccgtgttctcggggagtgcgtggtctcagatcccatcctgctcctctccagagtttcctctcacctccgtgttctcagggagtgcgtggtcttggatgccatcctgctcatctccagcatttcctctcacctccgtgttctcggggagtgcgtggtgtcagatcccatcctgctcctctccagcatttcctctcacctccgagctctcggggagtgcgtggtctcagatcccatcctgctcctctccagagtttcctctcacctccgtgttctcgttctcatctctgccggaattccacatctgctcgtgcatgccatccaccttttccactagatccttttacatcatcattataatgatttttttttaataagtgttttctttcagttttaaatttcagatgttgtgtttttcaggtctaaggtgtctggtaattttttgtggatgccgattctctgttgaaattctccatcttttcatttcctttatatctcttttcttcttttttctataatatattacatttttctaataagtttttagtgagtgtccagcattgtataagttgacccttgaacaagagtttgaattataagggtccacttataagtggatttttaaaaaaatatatattgcaaaaatttttggaaatttgcaacaatttgaaaaactttgcagatgagccacatagcctagaaatatctgaaaaaagaaaaagttatgtcatgaatgcataaaatatacagaccatacatggaccattcacagtagagagaaatgtcgccgtaaagatgcagcattggccgagtgcagtggctcacgcctgtaatcccagcactttgggaggccgaggtgggcagatcacctaaggtcaggagttcaagaccagcctggccaacatggagaaaccccgtgactactaaaaataaaaaattagccaggcatggtggcacatgcctgtaactccagctacttgggaggctgaggcaggagaatcacttgaacccggaaggcagaggttgcagtgagccgagatcacgccattgcactccagcctgggcaacaagagcaaaactctgtctcaaaaaaaaaaaaatgcagcattaaattataactgcatgaaattaactgcagtccacagtgtgctgctggaataattacaaagccacctcctgttgctattgcagtgagcgcaagcatgtcaaggatccgcttaaaacatcgtgtggtgctaatctctgcacgagcggttcatgtcttcagtacattgtgtatcacggtaaaaagtgatctgttttaactggacatggtggcacacgcctgcagtcccagctactcaggaggctgaggcaggaggatcccttgagcccaggaggtcgaggctgcagtgagctgtgattgcaccactgcactcaagcctgggcaacagagtgagaccccaacttgaaaaaaaggggacatcgggatgttcttgtgtatttttcatgttgagcgcaatactgtaaaccttgaagaacactttgggacccatagagtgccaccagtcatgccaaagagctcctgagaagcagagaaaagtcatgacatttcaagaaaaagttgaatttcttgatatgttccgtagattgaggtttacagctgcggttgcctaccaattcaagataaatgaatccagcgtaaggaccatagtaaaaaaataaggaaatttgtgagcaggcacaaaagccttaacactttctgtgaaatacctttttatcttgtattgggaatgcagcttttatgtgggtataggattgctgtgtgtgatggttcatattaaatgtcaacttgattagattgaagaatgtaaagtattgtttctgggtgttgccagaagagattaacatttgagtcagtggactgggagaagacccaccacagtgtgggcaggcaccatccagtcggctgccagcatggctggaaaaagcaggcagaagaaggtggctgaagctgactggctgagtcttctggccttcatctctctcccatgctggatgcttcctgcccttgaacatcagactccaagttctttagcttttggactcttggacctacactggtgttttgccaggggctctcgggccttcggccacagactgaaggctgcactgtcggcttccctcctttagaggtttggggactcagactgagctactactggcttccttgcccctcagtttgcagacagcctattgtgggacttcaccctgtgatcctgtgcctcagttctccttaataaactccatttcatatgn

SEQ ID NO: 15855 - DNA, 7952 bp, Homo sapiens
  misc_feature (3946)..(3946): n is a, c, g, or t
  misc_feature (4679)..(4679): n is a, c, g, or t
  misc_feature (4752)..(4752): n is a, c, g, or t
  misc_feature (4920)..(4920): n is a, c, g, or t
  misc_feature (7952)..(7952): n is a, c, g, or t
cgtaccggcgtctccatggcgaccgcgttggctgggtggcctccattgtcgggctgctgctctcagcggcggggctcgccagcgcttcagtgggcggggacgcggcaggtgactccagaccaaggaggatgagctgctgtccctggaagagaacggatggagggaagcagctcctacgaagttccctctgtggctgctgctgatctggaggagggtgctggtcagactaggagcttgcctgccaccccctccaaagatgttcacaagggtgttggaggcatcatcttttcctcctcaccgattttagacttgagtgaaagtggtctgtgccgtttggaggaggtctttagaatccccagccttcaacaattgcatctgcaaaggaatgccctgtgtgtgattcctcaagatttctttcagttgcttccgaacctgacttggctggacctccggtacaatagaattaaagcgcttccttctgggattggagctcaccagcatttgaaaactttgcttttagaaagaaatcctatcaaaatgttacctgtggagctggctcgttgtgcagaagggattggtggctatccagcgcttcctgcggatgtgggcagtagaacactctctccccagaaatccaacttctcaagaggctccaccggttagagagatgaccctccgtgacctcccgagcccaggactggagttgtctggagaccacgcgtctaaccaaggagctgtgaacgctcaggacccagagggggctgtgatgaaagagaaggccagctttctcccacctgtggaaaagccagacctgagtgaactcaggaagtctgcggactcctcagagaactggcccagcgaggaggagatcaggcgcttttggaagctgaggcaggagattgttgagcacgtgaaggcagacgttctgggagatcagctcttgacgagggaattacctccaaatctcaaggcggccttgaacattgagaaagaactaccaaagccaagacacgttttcagaaggaagacagcctcctccaggagcatcttacccgacctcttgtcaccgtaccaaatggcgatccgagcaaaaagactggaagagagccgagcggcggcgctccgagagctccaggagaagcaggctctgatggagcagcagagacgagagaaaagggcactgcaggagtggagagagcgagcccagaggatgaggaagaggaaggaagagctcagcaaactcctgcctccgcggaggagcatggtggcatcaaagattccctctgccacagatctgacagataacaggaaagtaccactgaatccgcctggaaaaatgaaaccaagcaaagagaaatcgccacaagcaagtaaagaaatgagtgccctgcaggagagaaatttagaagagaagataaaacagcacgtcctccaaatgcgtgagcaaagaagattccatggccaggccccactggaggagatgaggaaggctgccgaggatctggaaattgccacagagctacaggatgaagtattgaagctaaaattgggattaaccttgaacaaagatcgtcgacgggcggccctcactggaaacctttcgcttggcctgccggcagcacagcctcaaaatacattttttaacacaaaatatggagaatcaggaaatgttcgcagataccagtgacaccaggtggctggactgatggagacgtcttcagacaggagccgctcagtcttctttcccgggcgtcgcctcctgtgtggtgccggaagagcgccaggttcagtgttaccctgagggctgatttcgcgcagcctgttgttttccttagacaggtccacgtccctctcctgaggctgtggaagatttcagccgtattaaaagaaaggacactgtgagcacgtggtctcgccttcccttcttcctgcaggttcccgccaagccatgtgacagagtgctcacactcaggcacttgcctctctcctgtcctggagcccttgttacaaaagtactcacagctttccttcacttagttatttgagtgtgggagaggagaccaggtcacccgattcccgccaagccggaagtccctgcagcaccacctttggctaggagggaggggtgacagccaaaaagggcttcgggggagtggttaccctgctccctgcccagtgacaagccctcctttcccctgggggccctcctttcccctgctccctgcccagctacggggccctcctttcagccttgaccccttcctggttgctaccactcaggctgccactcagtggactccaccccagggacacggcagggtctgcagacctccccatgctagatcagccgtatttcatgctctgtctgcccaggctgtgtagattctgtgtgacttagtctcttgtgctgagtgtttgcttggatcttgaaaacatctttggtttgatttctttaacagaggtgagactattcagactttgtttatttttgtgttaattttggtaaatatggtttcagtgagtttcctcatttcatccaagttgtgcaatgtatcagcataaagttcctcttattttcagtatctttaggatccgtaataatgtcccctcttttattcttgacctggtgttcttcatcattcttgctatggatttatcaattttgttcctcttttccaaaagccccaggttttggcttcactggatttgctgtttgtcttctgtctcatgggtctctgcgccctgcacttcgtactttccgagagtttaactggtgcttagagagaaatgcatcacttccaaacccatgtattagagaagaagggcgtgaaatttatcacctaagctttccattcaggaagctagaaaaggtgtcagtgacctgttgcggcccagcggctggagcagcagacgtttgccatttctcacgcctgagggcaggcgttggagcagctcagccggcgttgctggtcagggtctcccgtgaggctggagtcagccgtgggttgagctgctctcctctgaaggtttaactgggcttggggctcagcttccaaggtgctcacctggttgttgatcagagagcgtgtccgttgtgatcccagtcctttgaaactgtgaagcctcgccccgcggcctgccgcaggatatgttttggtaaatgtagactgtgcacttgagaagaatgtattttgagttgttgggtacattgttttgtgtgtgtcaggtgacattgactaatcctgttgctcagagctcctgtacccttactgactgacttaagcctggtttctcagttactgagagaggcctgtgaacagttctagctatgatcatgaacatgtgttttcttcttagttatgtgagtttttgctatacgtgttttggggctattttgtcagatgcctacaaatttaggattgttttatcttcctgtcgaactgaccttgtcattattatgaactatttctcttcgcctctccttttcacttcttgccttctgtggattttgtctgatactaatccaggcacactgctgctgttttggtcagcgttttcataatgcatcttcttccctccttctactgtactggatttaaagcgcaccttatagagacatcatatactcgggactccttttctttctctagctgccagttctgtgtttcagttacagtgtttggccctcacatttaaggtgcgtgtgcgtacggcggattccgtgcccatctcatgtttttattccctttattcttcttttgctgctttctgatagtgatcaatttttttatttatatctcttgtattagagttttagtaatatcttttaatattattctcttgggtgttgccttagagatttcatacatgcccttgagttcattagcatttcctgaatgagccaatgaccctgagaaggtccctcccatctgccagttccctgccnttgatgctgttgctctcgtccgcctcccttccacaggtaagcacgcaagacacaggtaccgtgtgccccaacggtgtcttgactcgctgttcctagacatcagtgtttgcttcactttacccatcccgatgctcttccttcctgcagcttcatgctccaatgagggctgattttcatttagctaaataacttttttttaagtatttctttgtatcatggttatgctttgactggccgtaagttctctcagcttttgtttgtctgaaaataaatttagttcgcctttattctgcacaggacagaattctaggtggatgatttttgccattcccagaactttaaagatgggctccactgtcttctggctcccatgtgttttgttaaaaattcagtgttcaggccgggtgctgtggctcacgcctgtaatcccagcactttgggaggccgaggcgagtggatcacgaggtcaggagatcgagaccatcctggctaacacggtgaaaccccgtctctactaaaaaatacaaaaaattagccgggcgtggtggctgtagtcgcagctactcaggaggctgaggcgggagaatggcgtgaacccaggagacggagcttgcagtgagccgagatcgcgccactgcactccagcctgggcgacagagcgagactccgtctcaaaaaaaaaaaaaaaagattcaatgttcattgttatttgttgctcctttgaaggtaatgngtcttttttctttgtcttaaaattgtttctccttatctttggttttcagcagtctgtgctgtgcctggatgtnattttctttttacgtatttttcttggaatatacagaactcaaatctgggagttagcatctttcatcagttttggaaaattcttagccattttttttttttttactattttttcccctgttctccctcttctccctgagacttcagttttgtgtgtgtgtgcacatgtntgtatgcattcgtgcgtacgagtgtgtgcatgtgtgcgcccgtgtgtatgtgcatatgtgagtgtgtgtggctgtaacctgcacgtctcttctgtcatgtgttctatttttcattcctctctgtacatcaggctagatgcctcctgtctacgtggttttagatttacgaatcctgtcttctgttgtgtcccacagaaaaacccatgaggttttttaacattaaaaacagcagctttatgatagagaaaaaaacacaaacatagacgattgtaccattgcactcagaagaaacatcccaggccctgagcagcgtgtctttcctcggccgagtcaggcttcctggtgagcctcagggagtgcatggtctcagatgccatccttctcttctccagcatttccactcacctccgtgttcttggggagtgcgtggtgtcagatcccatcctgctcctctccagagtttccggtcacctccgtgttctcagggagtgcgtggtcttggatgccatcctgctcatctccagcatttcctctcacctccgtgttctcggggagtgcgtggtgtcagatcccatcctgctcatctccagcatttcctctcacctctgtgttctcggggagtgcgtggtgtcagatcccatcctgctcctctccagcatttcctctcacctccgtgttctcggggagtgcgtggtgtcagatcccatcctgctcctctccagagtttcctctcacctccgtgttctcggggagtgcgtggtctcagatcccatcctgctcctctccagagtttcctctcacctccgtgttctcagggagtgcgtggtcttggatgccatcctgctcatctccagcatttcctctcacctccgtgttctcggggagtgcgtggtgtcagatcccatcctgctcctctccagcatttcctctcacctccgagctctcggggagtgcgtggtctcagatcccatcctgctcctctccagagtttcctctcacctccgtgttctcgttctcatctctgccggaattccacatctgctcgtgcatgccatccaccttttccactagatccttttacatcatcattataatgatttttttttaataagtgttttctttcagttttaaatttcagatgttgtgtttttcaggtctaaggtgtctggtaattttttgtggatgccgattctctgttgaaattctccatcttttcatttcctttatatctcttttcttcttttttctataatatattacatttttctaataagtttttagtgagtgtccagcattgtataagttgacccttgaacaagagtttgaattataagggtccacttataagtggatttttaaaaaaatatatattgcaaaaatttttggaaatttgcaacaatttgaaaaactttgcagatgagccacatagcctagaaatatctgaaaaaagaaaaagttatgtcatgaatgcataaaatatacagaccatacatggaccattcacagtagagagaaatgtcgccgtaaagatgcagcattggccgagtgcagtggctcacgcctgtaatcccagcactttgggaggccgaggtgggcagatcacctaaggtcaggagttcaagaccagcctggccaacatggagaaaccccgtgactactaaaaataaaaaattagccaggcatggtggcacatgcctgtaactccagctacttgggaggctgaggcaggagaatcacttgaacccggaaggcagaggttgcagtgagccgagatcacgccattgcactccagcctgggcaacaagagcaaaactctgtctcaaaaaaaaaaaaatgcagcattaaattataactgcatgaaattaactgcagtccacagtgtgctgctggaataattacaaagccacctcctgttgctattgcagtgagcgcaagcatgtcaaggatccgcttaaaacatcgtgtggtgctaatctctgcacgagcggttcatgtcttcagtacattgtgtatcacggtaaaaagtgatctgttttaactggacatggtggcacacgcctgcagtcccagctactcaggaggctgaggcaggaggatcccttgagcccaggaggtcgaggctgcagtgagctgtgattgcaccactgcactcaagcctgggcaacagagtgagaccccaacttgaaaaaaaggggacatcgggatgttcttgtgtatttttcatgttgagcgcaatactgtaaaccttgaagaacactttgggacccatagagtgccaccagtcatgccaaagagctcctgagaagcagagaaaagtcatgacatttcaagaaaaagttgaatttcttgatatgttccgtagattgaggtttacagctgcggttgcctaccaattcaagataaatgaatccagcgtaaggaccatagtaaaaaaataaggaaatttgtgagcaggcacaaaagccttaacactttctgtgaaatacctttttatcttgtattgggaatgcagcttttatgtgggtataggattgctgtgtgtgatggttcatattaaatgtcaacttgattagattgaagaatgtaaagtattgtttctgggtgttgccagaagagattaacatttgagtcagtggactgggagaagacccaccacagtgtgggcaggcaccatccagtcggctgccagcatggctggaaaaagcaggcagaagaaggtggctgaagctgactggctgagtcttctggccttcatctctctcccatgctggatgcttcctgcccttgaacatcagactccaagttctttagcttttggactcttggacctacactggtgttttgccaggggctctcgggccttcggccacagactgaaggctgcactgtcggcttccctcctttagaggtttggggactcagactgagctactactggcttccttgcccctcagtttgcagacagcctattgtgggacttcaccctgtgatcctgtgcctcagttctccttaataaactccatttcatatgn

SEQ ID NO: 15856 - DNA, 7932 bp, Homo sapiens
  misc_feature (3926)..(3926): n is a, c, g, or t
  misc_feature (4659)..(4659): n is a, c, g, or t
  misc_feature (4732)..(4732): n is a, c, g, or t
  misc_feature (4900)..(4900): n is a, c, g, or t
  misc_feature (7932)..(7932): n is a, c, g, or t
cccagaccagacatggctctggctatttgctcagtaagcaggcgatttcgggggctgccgagggccaggtgctgcggcaggcactggagaaacggccgagacactgagtgtggggccccggaattcagaccatgtcaaaggctttgggatagaaacagtggtgtgctgggtcagcagcagagtgccggctcttcaggaagtcagttccggctccaaaggccgccggaaggagtcctggttcttttctttctgattcttttgtctactgtttacatcttttaaggcaattgcatctgcaaaggaatgccctgtgtgtgattcctcaagatttctttcagttgcttccgaacctgacttggctggacctccggtacaatagaattaaagcgcttccttctgggattggagctcaccagcatttgaaaactttgcttttagaaagaaatcctatcaaaatgttacctgtggagctggggagcgtaaccacgctgaaagcactgaacctaagacactgccctctggaattccctcctcagctcgttgtgcagaagggattggtggctatccagcgcttcctgcggatgtgggcagtagaacactctctccccagaaatccaacttctcaagaggctccaccggttagagagatgaccctccgtgacctcccgagcccaggactggagttgtctggagaccacgcgtctaaccaaggagctgtgaacgctcaggacccagagggggctgtgatgaaagagaaggccagctttctcccacctgtggaaaagccagacctgagtgaactcaggaagtctgcggactcctcagagaactggcccagcgaggaggagatcaggcgcttttggaagctgaggcaggagattgttgagcacgtgaaggcagacgttctgggagatcagctcttgacgagggaattacctccaaatctcaaggcggccttgaacattgagaaagaactaccaaagccaagacacgttttcagaaggaagacagcctcctccaggagcatcttacccgacctcttgtcaccgtaccaaatggcgatccgagcaaaaagactggaagagagccgagcggcggcgctccgagagctccaggagaagcaggctctgatggagcagcagagacgagagaaaagggcactgcaggagtggagagagcgagcccagaggatgaggaagaggaaggaagagctcagcaaactcctgcctccgcggaggagcatggtggcatcaaagattccctctgccacagatctgacagataacaggaaagtaccactgaatccgcctggaaaaatgaaaccaagcaaagagaaatcgccacaagcaagtaaagaaatgagtgccctgcaggagagaaatttagaagagaagataaaacagcacgtcctccaaatgcgtgagcaaagaagattccatggccaggccccactggaggagatgaggaaggctgccgaggatctggaaattgccacagagctacaggatgaagtattgaagctaaaattgggattaaccttgaacaaagatcgtcgacgggcggccctcactggaaacctttcgcttggcctgccggcagcacagcctcaaaatacattttttaacacaaaatatggagaatcaggaaatgttcgcagataccagtgacaccaggtggctggactgatggagacgtcttcagacaggagccgctcagtcttctttcccgggcgtcgcctcctgtgtggtgccggaagagcgccaggttcagtgttaccctgagggctgatttcgcgcagcctgttgttttccttagacaggtccacgtccctctcctgaggctgtggaagatttcagccgtattaaaagaaaggacactgtgagcacgtggtctcgccttcccttcttcctgcaggttcccgccaagccatgtgacagagtgctcacactcaggcacttgcctctctcctgtcctggagcccttgttacaaaagtactcacagctttccttcacttagttatttgagtgtgggagaggagaccaggtcacccgattcccgccaagccggaagtccctgcagcaccacctttggctaggagggaggggtgacagccaaaaagggcttcgggggagtggttaccctgctccctgcccagtgacaagccctcctttcccctgggggccctcctttcccctgctccctgcccagctacggggccctcctttcagccttgaccccttcctggttgctaccactcaggctgccactcagtggactccaccccagggacacggcagggtctgcagacctccccatgctagatcagccgtatttcatgctctgtctgcccaggctgtgtagattctgtgtgacttagtctcttgtgctgagtgtttgcttggatcttgaaaacatctttggtttgatttctttaacagaggtgagactattcagactttgtttatttttgtgttaattttggtaaatatggtttcagtgagtttcctcatttcatccaagttgtgcaatgtatcagcataaagttcctcttattttcagtatctttaggatccgtaataatgtcccctcttttattcttgacctggtgttcttcatcattcttgctatggatttatcaattttgttcctcttttccaaaagccccaggttttggcttcactggatttgctgtttgtcttctgtctcatgggtctctgcgccctgcacttcgtactttccgagagtttaactggtgcttagagagaaatgcatcacttccaaacccatgtattagagaagaagggcgtgaaatttatcacctaagctttccattcaggaagctagaaaaggtgtcagtgacctgttgcggcccagcggctggagcagcagacgtttgccatttctcacgcctgagggcaggcgttggagcagctcagccggcgttgctggtcagggtctcccgtgaggctggagtcagccgtgggttgagctgctctcctctgaaggtttaactgggcttggggctcagcttccaaggtgctcacctggttgttgatcagagagcgtgtccgttgtgatcccagtcctttgaaactgtgaagcctcgccccgcggcctgccgcaggatatgttttggtaaatgtagactgtgcacttgagaagaatgtattttgagttgttgggtacattgttttgtgtgtgtcaggtgacattgactaatcctgttgctcagagctcctgtacccttactgactgacttaagcctggtttctcagttactgagagaggcctgtgaacagttctagctatgatcatgaacatgtgttttcttcttagttatgtgagtttttgctatacgtgttttggggctattttgtcagatgcctacaaatttaggattgttttatcttcctgtcgaactgaccttgtcattattatgaactatttctcttcgcctctccttttcacttcttgccttctgtggattttgtctgatactaatccaggcacactgctgctgttttggtcagcgttttcataatgcatcttcttccctccttctactgtactggatttaaagcgcaccttatagagacatcatatactcgggactccttttctttctctagctgccagttctgtgtttcagttacagtgtttggccctcacatttaaggtgcgtgtgcgtacggcggattccgtgcccatctcatgtttttattccctttattcttcttttgctgctttctgatagtgatcaatttttttatttatatctcttgtattagagttttagtaatatcttttaatattattctcttgggtgttgccttagagatttcatacatgcccttgagttcattagcatttcctgaatgagccaatgaccctgagaaggtccctcccatctgccagttccctgccnttgatgctgttgctctcgtccgcctcccttccacaggtaagcacgcaagacacaggtaccgtgtgccccaacggtgtcttgactcgctgttcctagacatcagtgtttgcttcactttacccatcccgatgctcttccttcctgcagcttcatgctccaatgagggctgattttcatttagctaaataacttttttttaagtatttctttgtatcatggttatgctttgactggccgtaagttctctcagcttttgtttgtctgaaaataaatttagttcgcctttattctgcacaggacagaattctaggtggatgatttttgccattcccagaactttaaagatgggctccactgtcttctggctcccatgtgttttgttaaaaattcagtgttcaggccgggtgctgtggctcacgcctgtaatcccagcactttgggaggccgaggcgagtggatcacgaggtcaggagatcgagaccatcctggctaacacggtgaaaccccgtctctactaaaaaatacaaaaaattagccgggcgtggtggctgtagtcgcagctactcaggaggctgaggcgggagaatggcgtgaacccaggagacggagcttgcagtgagccgagatcgcgccactgcactccagcctgggcgacagagcgagactccgtctcaaaaaaaaaaaaaaaagattcaatgttcattgttatttgttgctcctttgaaggtaatgngtcttttttctttgtcttaaaattgtttctccttatctttggttttcagcagtctgtgctgtgcctggatgtnattttctttttacgtatttttcttggaatatacagaactcaaatctgggagttagcatctttcatcagttttggaaaattcttagccattttttttttttttactattttttcccctgttctccctcttctccctgagacttcagttttgtgtgtgtgtgcacatgtntgtatgcattcgtgcgtacgagtgtgtgcatgtgtgcgcccgtgtgtatgtgcatatgtgagtgtgtgtggctgtaacctgcacgtctcttctgtcatgtgttctatttttcattcctctctgtacatcaggctagatgcctcctgtctacgtggttttagatttacgaatcctgtcttctgttgtgtcccacagaaaaacccatgaggttttttaacattaaaaacagcagctttatgatagagaaaaaaacacaaacatagacgattgtaccattgcactcagaagaaacatcccaggccctgagcagcgtgtctttcctcggccgagtcaggcttcctggtgagcctcagggagtgcatggtctcagatgccatccttctcttctccagcatttccactcacctccgtgttcttggggagtgcgtggtgtcagatcccatcctgctcctctccagagtttccggtcacctccgtgttctcagggagtgcgtggtcttggatgccatcctgctcatctccagcatttcctctcacctccgtgttctcggggagtgcgtggtgtcagatcccatcctgctcatctccagcatttcctctcacctctgtgttctcggggagtgcgtggtgtcagatcccatcctgctcctctccagcatttcctctcacctccgtgttctcggggagtgcgtggtgtcagatcccatcctgctcctctccagagtttcctctcacctccgtgttctcggggagtgcgtggtctcagatcccatcctgctcctctccagagtttcctctcacctccgtgttctcagggagtgcgtggtcttggatgccatcctgctcatctccagcatttcctctcacctccgtgttctcggggagtgcgtggtgtcagatcccatcctgctcctctccagcatttcctctcacctccgagctctcggggagtgcgtggtctcagatcccatcctgctcctctccagagtttcctctcacctccgtgttctcgttctcatctctgccggaattccacatctgctcgtgcatgccatccaccttttccactagatccttttacatcatcattataatgatttttttttaataagtgttttctttcagttttaaatttcagatgttgtgtttttcaggtctaaggtgtctggtaattttttgtggatgccgattctctgttgaaattctccatcttttcatttcctttatatctcttttcttcttttttctataatatattacatttttctaataagtttttagtgagtgtccagcattgtataagttgacccttgaacaagagtttgaattataagggtccacttataagtggatttttaaaaaaatatatattgcaaaaatttttggaaatttgcaacaatttgaaaaactttgcagatgagccacatagcctagaaatatctgaaaaaagaaaaagttatgtcatgaatgcataaaatatacagaccatacatggaccattcacagtagagagaaatgtcgccgtaaagatgcagcattggccgagtgcagtggctcacgcctgtaatcccagcactttgggaggccgaggtgggcagatcacctaaggtcaggagttcaagaccagcctggccaacatggagaaaccccgtgactactaaaaataaaaaattagccaggcatggtggcacatgcctgtaactccagctacttgggaggctgaggcaggagaatcacttgaacccggaaggcagaggttgcagtgagccgagatcacgccattgcactccagcctgggcaacaagagcaaaactctgtctcaaaaaaaaaaaaatgcagcattaaattataactgcatgaaattaactgcagtccacagtgtgctgctggaataattacaaagccacctcctgttgctattgcagtgagcgcaagcatgtcaaggatccgcttaaaacatcgtgtggtgctaatctctgcacgagcggttcatgtcttcagtacattgtgtatcacggtaaaaagtgatctgttttaactggacatggtggcacacgcctgcagtcccagctactcaggaggctgaggcaggaggatcccttgagcccaggaggtcgaggctgcagtgagctgtgattgcaccactgcactcaagcctgggcaacagagtgagaccccaacttgaaaaaaaggggacatcgggatgttcttgtgtatttttcatgttgagcgcaatactgtaaaccttgaagaacactttgggacccatagagtgccaccagtcatgccaaagagctcctgagaagcagagaaaagtcatgacatttcaagaaaaagttgaatttcttgatatgttccgtagattgaggtttacagctgcggttgcctaccaattcaagataaatgaatccagcgtaaggaccatagtaaaaaaataaggaaatttgtgagcaggcacaaaagccttaacactttctgtgaaatacctttttatcttgtattgggaatgcagcttttatgtgggtataggattgctgtgtgtgatggttcatattaaatgtcaacttgattagattgaagaatgtaaagtattgtttctgggtgttgccagaagagattaacatttgagtcagtggactgggagaagacccaccacagtgtgggcaggcaccatccagtcggctgccagcatggctggaaaaagcaggcagaagaaggtggctgaagctgactggctgagtcttctggccttcatctctctcccatgctggatgcttcctgcccttgaacatcagactccaagttctttagcttttggactcttggacctacactggtgttttgccaggggctctcgggccttcggccacagactgaaggctgcactgtcggcttccctcctttagaggtttggggactcagactgagctactactggcttccttgcccctcagtttgcagacagcctattgtgggacttcaccctgtgatcctgtgcctcagttctccttaataaactccatttcatatgn

SEQ ID NO: 15857 - DNA, 7955 bp, Homo sapiens
  misc_feature (3949)..(3949): n is a, c, g, or t
  misc_feature (4682)..(4682): n is a, c, g, or t
  misc_feature (4755)..(4755): n is a, c, g, or t
  misc_feature (4923)..(4923): n is a, c, g, or t
  misc_feature (7955)..(7955): n is a, c, g, or t
cgtaccggcgtctccatggcgaccgcgttggctgggtggcctccattgtcgggctgctgctctcagcggcggggctcgccagcgcttcagtgggcggggacgcggcaggtgactccagaccaaggaggatgagctgctgtccctggaagagaacggatggagggaagcagctcctacgaagttccctctgtggctgctgctgatctggaggagggtgctggtcagactaggagcttgcctgccaccccctccaaagatgttcacaagggtgttggaggcatcatcttttcctcctcaccgattttagacttgagtgaaagtggtctgtgccgtttggaggaggtctttagaatccccagccttcaacaattgcatctgcaaaggaatgccctgtgtgtgattcctcaagatttctttcagttgcttccgaacctgacttggctggacctccggtacaatagaattaaagcgcttccttctgggattggagctcaccaggagcgtaaccacgctgaaagcactgaacctaagacactgccctctggaattccctcctcagctcgttgtgcagaagggattggtggctatccagcgcttcctgcggatgtgggcagtagaacactctctccccagaaatccaacttctcaagaggctccaccggttagagagatgaccctccgtgacctcccgagcccaggactggagttgtctggagaccacgcgtctaaccaaggagctgtgaacgctcaggacccagagggggctgtgatgaaagagaaggccagctttctcccacctgtggaaaagccagacctgagtgaactcaggaagtctgcggactcctcagagaactggcccagcgaggaggagatcaggcgcttttggaagctgaggcaggagattgttgagcacgtgaaggcagacgttctgggagatcagctcttgacgagggaattacctccaaatctcaaggcggccttgaacattgagaaagaactaccaaagccaagacacgttttcagaaggaagacagcctcctccaggagcatcttacccgacctcttgtcaccgtaccaaatggcgatccgagcaaaaagactggaagagagccgagcggcggcgctccgagagctccaggagaagcaggctctgatggagcagcagagacgagagaaaagggcactgcaggagtggagagagcgagcccagaggatgaggaagaggaaggaagagctcagcaaactcctgcctccgcggaggagcatggtggcatcaaagattccctctgccacagatctgacagataacaggaaagtaccactgaatccgcctggaaaaatgaaaccaagcaaagagaaatcgccacaagcaagtaaagaaatgagtgccctgcaggagagaaatttagaagagaagataaaacagcacgtcctccaaatgcgtgagcaaagaagattccatggccaggccccactggaggagatgaggaaggctgccgaggatctggaaattgccacagagctacaggatgaagtattgaagctaaaattgggattaaccttgaacaaagatcgtcgacgggcggccctcactggaaacctttcgcttggcctgccggcagcacagcctcaaaatacattttttaacacaaaatatggagaatcaggaaatgttcgcagataccagtgacaccaggtggctggactgatggagacgtcttcagacaggagccgctcagtcttctttcccgggcgtcgcctcctgtgtggtgccggaagagcgccaggttcagtgttaccctgagggctgatttcgcgcagcctgttgttttccttagacaggtccacgtccctctcctgaggctgtggaagatttcagccgtattaaaagaaaggacactgtgagcacgtggtctcgccttcccttcttcctgcaggttcccgccaagccatgtgacagagtgctcacactcaggcacttgcctctctcctgtcctggagcccttgttacaaaagtactcacagctttccttcacttagttatttgagtgtgggagaggagaccaggtcacccgattcccgccaagccggaagtccctgcagcaccacctttggctaggagggaggggtgacagccaaaaagggcttcgggggagtggttaccctgctccctgcccagtgacaagccctcctttcccctgggggccctcctttcccctgctccctgcccagctacggggccctcctttcagccttgaccccttcctggttgctaccactcaggctgccactcagtggactccaccccagggacacggcagggtctgcagacctccccatgctagatcagccgtatttcatgctctgtctgcccaggctgtgtagattctgtgtgacttagtctcttgtgctgagtgtttgcttggatcttgaaaacatctttggtttgatttctttaacagaggtgagactattcagactttgtttatttttgtgttaattttggtaaatatggtttcagtgagtttcctcatttcatccaagttgtgcaatgtatcagcataaagttcctcttattttcagtatctttaggatccgtaataatgtcccctcttttattcttgacctggtgttcttcatcattcttgctatggatttatcaattttgttcctcttttccaaaagccccaggttttggcttcactggatttgctgtttgtcttctgtctcatgggtctctgcgccctgcacttcgtactttccgagagtttaactggtgcttagagagaaatgcatcacttccaaacccatgtattagagaagaagggcgtgaaatttatcacctaagctttccattcaggaagctagaaaaggtgtcagtgacctgttgcggcccagcggctggagcagcagacgtttgccatttctcacgcctgagggcaggcgttggagcagctcagccggcgttgctggtcagggtctcccgtgaggctggagtcagccgtgggttgagctgctctcctctgaaggtttaactgggcttggggctcagcttccaaggtgctcacctggttgttgatcagagagcgtgtccgttgtgatcccagtcctttgaaactgtgaagcctcgccccgcggcctgccgcaggatatgttttggtaaatgtagactgtgcacttgagaagaatgtattttgagttgttgggtacattgttttgtgtgtgtcaggtgacattgactaatcctgttgctcagagctcctgtacccttactgactgacttaagcctggtttctcagttactgagagaggcctgtgaacagttctagctatgatcatgaacatgtgttttcttcttagttatgtgagtttttgctatacgtgttttggggctattttgtcagatgcctacaaatttaggattgttttatcttcctgtcgaactgaccttgtcattattatgaactatttctcttcgcctctccttttcacttcttgccttctgtggattttgtctgatactaatccaggcacactgctgctgttttggtcagcgttttcataatgcatcttcttccctccttctactgtactggatttaaagcgcaccttatagagacatcatatactcgggactccttttctttctctagctgccagttctgtgtttcagttacagtgtttggccctcacatttaaggtgcgtgtgcgtacggcggattccgtgcccatctcatgtttttattccctttattcttcttttgctgctttctgatagtgatcaatttttttatttatatctcttgtattagagttttagtaatatcttttaatattattctcttgggtgttgccttagagatttcatacatgcccttgagttcattagcatttcctgaatgagccaatgaccctgagaaggtccctcccatctgccagttccctgccnttgatgctgttgctctcgtccgcctcccttccacaggtaagcacgcaagacacaggtaccgtgtgccccaacggtgtcttgactcgctgttcctagacatcagtgtttgcttcactttacccatcccgatgctcttccttcctgcagcttcatgctccaatgagggctgattttcatttagctaaataacttttttttaagtatttctttgtatcatggttatgctttgactggccgtaagttctctcagcttttgtttgtctgaaaataaatttagttcgcctttattctgcacaggacagaattctaggtggatgatttttgccattcccagaactttaaagatgggctccactgtcttctggctcccatgtgttttgttaaaaattcagtgttcaggccgggtgctgtggctcacgcctgtaatcccagcactttgggaggccgaggcgagtggatcacgaggtcaggagatcgagaccatcctggctaacacggtgaaaccccgtctctactaaaaaatacaaaaaattagccgggcgtggtggctgtagtcgcagctactcaggaggctgaggcgggagaatggcgtgaacccaggagacggagcttgcagtgagccgagatcgcgccactgcactccagcctgggcgacagagcgagactccgtctcaaaaaaaaaaaaaaaagattcaatgttcattgttatttgttgctcctttgaaggtaatgngtcttttttctttgtcttaaaattgtttctccttatctttggttttcagcagtctgtgctgtgcctggatgtnattttctttttacgtatttttcttggaatatacagaactcaaatctgggagttagcatctttcatcagttttggaaaattcttagccattttttttttttttactattttttcccctgttctccctcttctccctgagacttcagttttgtgtgtgtgtgcacatgtntgtatgcattcgtgcgtacgagtgtgtgcatgtgtgcgcccgtgtgtatgtgcatatgtgagtgtgtgtggctgtaacctgcacgtctcttctgtcatgtgttctatttttcattcctctctgtacatcaggctagatgcctcctgtctacgtggttttagatttacgaatcctgtcttctgttgtgtcccacagaaaaacccatgaggttttttaacattaaaaacagcagctttatgatagagaaaaaaacacaaacatagacgattgtaccattgcactcagaagaaacatcccaggccctgagcagcgtgtctttcctcggccgagtcaggcttcctggtgagcctcagggagtgcatggtctcagatgccatccttctcttctccagcatttccactcacctccgtgttcttggggagtgcgtggtgtcagatcccatcctgctcctctccagagtttccggtcacctccgtgttctcagggagtgcgtggtcttggatgccatcctgctcatctccagcatttcctctcacctccgtgttctcggggagtgcgtggtgtcagatcccatcctgctcatctccagcatttcctctcacctctgtgttctcggggagtgcgtggtgtcagatcccatcctgctcctctccagcatttcctctcacctccgtgttctcggggagtgcgtggtgtcagatcccatcctgctcctctccagagtttcctctcacctccgtgttctcggggagtgcgtggtctcagatcccatcctgctcctctccagagtttcctctcacctccgtgttctcagggagtgcgtggtcttggatgccatcctgctcatctccagcatttcctctcacctccgtgttctcggggagtgcgtggtgtcagatcccatcctgctcctctccagcatttcctctcacctccgagctctcggggagtgcgtggtctcagatcccatcctgctcctctccagagtttcctctcacctccgtgttctcgttctcatctctgccggaattccacatctgctcgtgcatgccatccaccttttccactagatccttttacatcatcattataatgatttttttttaataagtgttttctttcagttttaaatttcagatgttgtgtttttcaggtctaaggtgtctggtaattttttgtggatgccgattctctgttgaaattctccatcttttcatttcctttatatctcttttcttcttttttctataatatattacatttttctaataagtttttagtgagtgtccagcattgtataagttgacccttgaacaagagtttgaattataagggtccacttataagtggatttttaaaaaaatatatattgcaaaaatttttggaaatttgcaacaatttgaaaaactttgcagatgagccacatagcctagaaatatctgaaaaaagaaaaagttatgtcatgaatgcataaaatatacagaccatacatggaccattcacagtagagagaaatgtcgccgtaaagatgcagcattggccgagtgcagtggctcacgcctgtaatcccagcactttgggaggccgaggtgggcagatcacctaaggtcaggagttcaagaccagcctggccaacatggagaaaccccgtgactactaaaaataaaaaattagccaggcatggtggcacatgcctgtaactccagctacttgggaggctgaggcaggagaatcacttgaacccggaaggcagaggttgcagtgagccgagatcacgccattgcactccagcctgggcaacaagagcaaaactctgtctcaaaaaaaaaaaaatgcagcattaaattataactgcatgaaattaactgcagtccacagtgtgctgctggaataattacaaagccacctcctgttgctattgcagtgagcgcaagcatgtcaaggatccgcttaaaacatcgtgtggtgctaatctctgcacgagcggttcatgtcttcagtacattgtgtatcacggtaaaaagtgatctgttttaactggacatggtggcacacgcctgcagtcccagctactcaggaggctgaggcaggaggatcccttgagcccaggaggtcgaggctgcagtgagctgtgattgcaccactgcactcaagcctgggcaacagagtgagaccccaacttgaaaaaaaggggacatcgggatgttcttgtgtatttttcatgttgagcgcaatactgtaaaccttgaagaacactttgggacccatagagtgccaccagtcatgccaaagagctcctgagaagcagagaaaagtcatgacatttcaagaaaaagttgaatttcttgatatgttccgtagattgaggtttacagctgcggttgcctaccaattcaagataaatgaatccagcgtaaggaccatagtaaaaaaataaggaaatttgtgagcaggcacaaaagccttaacactttctgtgaaatacctttttatcttgtattgggaatgcagcttttatgtgggtataggattgctgtgtgtgatggttcatattaaatgtcaacttgattagattgaagaatgtaaagtattgtttctgggtgttgccagaagagattaacatttgagtcagtggactgggagaagacccaccacagtgtgggcaggcaccatccagtcggctgccagcatggctggaaaaagcaggcagaagaaggtggctgaagctgactggctgagtcttctggccttcatctctctcccatgctggatgcttcctgcccttgaacatcagactccaagttctttagcttttggactcttggacctacactggtgttttgccaggggctctcgggccttcggccacagactgaaggctgcactgtcggcttccctcctttagaggtttggggactcagactgagctactactggcttccttgcccctcagtttgcagacagcctattgtgggacttcaccctgtgatcctgtgcctcagttctccttaataaactccatttcatatgn

SEQ ID NO: 15858 - DNA, 1964 bp, Homo sapiens
cgtaccggcgtctccatggcgaccgcgttggctgggtggcctccattgtcgggctgctgctctcagcggcggggctcgccagcgcttcagtgggcggggacgcggcaggtgactccagaccaaggaggatgagctgctgtccctggaagagaacggatggagggaagcagctcctacgaagttccctctgtggctgctgctgatctggaggagggtgctggtcagactaggagcttgcctgccaccccctccaaagatgttcacaagggtgttggaggcatcatcttttcctcctcaccgattttagacttgagtgaaagtggtctgtgccgtttggaggaggtctttagaatccccagccttcaacaattgcatctgcaaaggaatgccctgtgtgtgattcctcaagatttctttcagttgcttccgaacctgacttggctggacctccggtacaatagaattaaagcgcttccttctgggattggagctcaccagcatttgaaaactttgcttttagaaagaaatcctatcaaaatgttacctgtggagctggggagcgtaaccacgctgaaagcactgaacctaagacactgccctctggaattccctcctcagctcgttgtgcagaagggattggtggctatccagcgcttcctgcggatgtgggcagtagaacactctctccccagaaatccaacttctcaagaggctccaccggttagagagatgaccctccgtgacctcccgagcccaggactggagttgtctggagaccacgcgtctaaccaaggagctgtgaacgctcaggacccagagggggctgtgatgaaagagaaggccagctttctcccacctgtggaaaagccagacctgagtgaactcaggaagtctgcggactcctcagagaactggcccagcgaggaggagatcaggcgcttttggaagctgaggcaggagattgttgagcacgtgaaggcagacgttctgggagatcagctcttgacgagggaattacctccaaatctcaaggcggccttgaacattgagaaagaactaccaaagccaagacacgttttcagaaggaagacagcctcctccaggagcatcttacccgacctcttgtcaccgtaccaaatggcgatccgagcaaaaagactggaagagagccgagcggcggcgctccgagagctccaggagaagcaggctctgatggagcagcagagacgagagaaaagggcactgcaggagtggagagagcgagcccagaggatgaggaagaggaaggaagagctcagcaaactcctgcctccgcggaggagcatggtggcatcaaagattccctctgccacagatctgacagataacaggaaagtaccactgaatccgcctggaaaaatgaaaccaagcaaagagaaatcgccacaagcaagtaaagaaatgagtgccctgcaggagagaaatttagaagagaagataaaacagcacgtcctccaaatgcgtgagcaaagaagattccatggccaggccccactggaggagatgaggaaggctgccgaggatctggaaattgccacagagctacaggatgaagtattgaagctaaaattgggattaaccttgaacaaagatcgtcgacgggcggccctcactggaaacctttcgcttggcctgccggcagcacagcctcaaaatacattttttaacacaaaatatggagaatcaggaaatgttcgcagataccagtgacaccaggtggctggactgatggagacgtcttcagacaggagccgctcagtcttctttcccgggcgtcgcctcctgtgtggtgccggaagagcgccaggttcagtgttaccctgagggctgatttcgcgcagcctgttgttttccttagacaggtccacgtccctctcctgaggctgtggaagatttcagccgtattaaaagaaaggacactgtga

SEQ ID NO: 15859 - DNA, 1791 bp, Homo sapiens
cgtaccggcgtctccatggcgaccgcgttggctgggtggcctccattgtcgggctgctgctctcagcggcggggctcgccagcgcttcagtgggcggggacgcggcaggtgactccagaccaaggaggatgagctgctgtccctggaagagaacggatggagggaagcagctcctacgaagttccctctgtggctgctgctgatctggaggagggtgctggtcagactaggagcttgcctgccaccccctccaaagatgttcacaagggtgttggaggcatcatcttttcctcctcaccgattttagacttgagtgaaagtggtctgtgccgtttggaggaggtctttagaatccccagccttcaacaattgcatctgcaaaggaatgccctgtgtgtgattcctcaagatttctttcagttgcttccgaacctgacttggctggacctccggtacaatagaattaaagcgcttccttctgggattggagctcaccagcatttgaaaactttgcttttagaaagaaatcctatcaaaatgttacctgtggagctggggagcgtaaccacgctgaaagcactgaacctaagacactgccctctggaattccctcctcagctcgttgtgcagaagggattggtggctatccagcgcttcctgcggatgtgggcagtagaacactctctccccagaaatccaacttctcaagaggctccaccggttagagagatgaccctccgtgacctcccgagcccaggactggagttgtctggagaccacgcgtctaaccaaggagctgtgaacgctcaggacccagagggggctgtgatgaaagagaaggccagctttctcccacctgtggaaaagccagacctgagtgaactcaggaagtctgcggactcctcagagaactggcccagcgaggaggagatcaggcgcttttggaagctgaggcaggagattgttgagcacgtgaaggcagacgttctgggagatcagctcttgacgagggaattacctccaaatctcaaggcggccttgaacattgagaaagaactaccaaagccaagacacgttttcagaaggaagacagcctcctccaggagcatcttacccgacctcttgtcaccgtaccaaatggcgatccgagcaaaaagactggaagagagccgagcggcggcgctccgagagctccaggagaagcaggctctgatggagcagcagagacgagagaaaagggcactgcaggagtggagagagcgagcccagaggatgaggaagaggaaggaagagctcagcaaactcctgcctccgcggaggagcatggtggcatcaaagattccctctgccacagatctgacagataacaggaaagtaccactgaatccgcctggaaaaatgaaaccaagcaaagagaaatcgccacaagcaagtaaagaaatgagtgccctgcaggagagaaatttagaagagaagataaaacagcacgtcctccaaatgcgtgagcaaagaagattccatggccaggccccactggaggagatgaggaaggctgccgaggatctggaaattccataaggattctggcctgtcctctcaagctacccaaggcccctggctggtggcctcttccagagccggagatgggagagaggaggcatgagggcaggatgtggagccacttcatggagaccccacccaacctgactcggaccccacttctgagactcttttcctcctcagcccaaggagtttgtatctgcctttagataaactcttattctttctaaa

SEQ ID NO: 15860 - DNA, 327 bp, Homo sapiens
gtcagtgtaccatgcccgaacacaggtcaggctggtgcgagctgcatcggggctgcccccagagcacgcagcactgtcacgggggaggaagcaaccctggccttcctgtccccacaccccatctgcaggctccattcccaccatttccgctgtttccctctctcctagagccggagatgggagagaggaggcatgagggcaggatgtggagccacttcatggagaccccacccaacctgactcggaccccacttctgagactcttttcctcctcagcccaaggagtttgtatctgcctttagataaactcttattctttctaaatcc

SEQ ID NO: 15861 - DNA, 778 bp, Homo sapiens
aacgtgattttcccccaaatactgaatagaatcatattttaaaatgtgaaaagttactattatttattcctcattttcatttcaagaatggtatatagaatgctgacagtttttttttcctccactgcagggagcgtaaccacgctgaaagcactgaacctaagacactgccctctggaattccctcctcagctcgttgtgcagaagggattggtggctatccagcgcttcctgcggatgtgggcagtagaacactctctccccagaaatccaacttctcaaggtttgtaggaggtgatttatgacaaatcacattaacgttgaagttacagctttttaaaatcagggcagaacctgtcttctctttaataacatcctgagaaatacaggagccatgggtcctctgctgagttgacacagtgtacactgatctcaggccgacccagtcatctctgtgacttttccttggttctataaatctgggcacattatagatcctggctcaagtggattttggtagaagtttattgtgatcaatcaaatgaaacagttatcacctccaagccacccgcaggcggctgcttcaggaatgacttgatgctgcattaggcagctattttaaaataagtacaatgaaatattccttattcctaacgaggtacaagaaattagcaggaaaatggccctgtagacatgttttatctaatcaccttgttggtgggtgctcactaacctgttccattctttcaacatactgaccagccaggtattttcagat

SEQ ID NO: 15862 - DNA, 361 bp, Homo sapiens
attgaggtaaatttcatctccttgggcaacacatgttactgagagactaaactaattcagctgagtgtatacgggggcgacggggttgagatgatgagtttgtttataaacctttatggtcacatgcccttagactcagctcctggggaaatcatacttctaaccattgtacaatgagggtatgtgcagcccaaacagggcttgtgtatgcaagcaccacctatatgctaataagcttattaaattttacttcctctactgttctatcaaacacctgagcagaaaccccacaccactgcaatcatttgcacattcttctcccactacaggctttttgagggttggaacccatgtctcttct

SEQ ID NO: 15863 - DNA, 503 bp, Homo sapiens
agctccttgtgttgctgtctccatcaccaccgcagtcaccactgcagggaaccgatattcttggtggcctcttggatccctcaaggaatcaagttgtaggaaccttgcagtcacaagtctaccttgttcttgggctctggtgtattgagagttggtctctgcctctaggtgatggtctccctgaagtgacagtgcttgtattaatttagagatttgtgggccgggtgtggtgaccaatgcctgtaaccctagcattttgggaggctgaggcaggtggatggcttgagtctagaattcaagttcagcctgggcaacatggtgaaaccccgtctctacaaagaatacaaaaattagccaggtgtggtggtgtgcacctgtggtcccagttgcttgggaggctgaggcgggaggatcacttgagcccaggaggtcaaggctgccggtgagctgagattgcaccattgcattcctacttgggcgagagagtgagaccttgtctaaaa

SEQ ID NO: 15864 - DNA, 474 bp, Homo sapiens
tctcaggaaccccagcagcctctgccaggaagcaccagtcccagctgttctcccacagatgctggctggaggtcacagagcagggctttcctgtctccctgggctgcatgtcatgtgaccctgcctcctttaccacagatgtgggcacatctggccactcatctcctgattagtctgtcatctctctggacactgttgatggttccaagcaaagccactcaggggcttttttaggagcaaacgtgggtgctttgatgatctaaaacctgagtcccacaaaactcaggaattgcagggggcatatggggtgagaagcctgagaattaagtcaataaagcagcagcagagtcaagagatagagagccagaagcgctggcttgtgcctgtaatgtcagctgcttgggaggctaaggtgggtcacttgaggccagttcagcctggacaacatagcaagacccctactcccttttctta

SEQ ID NO: 15865 - DNA, 334 bp, Homo sapiens
ttgcatcctcagggcccgcccggcaggacgactgagcaggccttggaagaccggagagattggagcgaatggggaggaattgaggggaaaatggagatagaacctgaaagagccccaaacgccagaacctgtagctccccaagaataagatcttccagaagaactagacccaaaactagccgttggggaacaccgaaatccttggaggagcaacatccgcatgaccctctgtgttcctttaggcaaaaggacttgcttccattgtttgttcaattgtttgtgtttgttaaataaataaaacgattttcatgtatctttgaaattactttggcgc

SEQ ID NO: 15866 - DNA, 1100 bp, Homo sapiens
ttgcatcctcagggcccgcccggcaggacgactgagcaggccttggaagaccggagagattggagcggtaagtcgcgctggtcacgttggacacctgcgcgttgggagattctggagccagaaggatagccgaatggccttcgcccgccctgcccctcacctgcttcagaaacccccggaaacgccccggttgagaccccggcccgaaccgcctgggggccctagggaggctgaacgcccggtggctcccgggatggctcttcccgttctttgcgccgccttcacccagtgagggagcctgtgccctccctgcccagtcgcttttggggccgctgcggagcttccgctgccatcttcggatcctgtgttccgcacgggggctccaccagggcagggatcgtggtgagggtggctcgtgggtccccctcgcggggagcagggtctggcactcaccagggcgcaggactaggacttgtcgaatgaatccatccttttagcttttagtcctttgaagagccttgagaagaaatcatgagagatttttccatggggaagttccttttacaaagcatttatttacgtggacttcttggcaccccgcggggcggcaacgggcagggcctccagtgccccttctgcgccgtggagccgcgggggctcagctgggcggtggtcgggtcctgaggccggagggcgggagcaggggaggggaaaagcaaaagcggggaaagaagccggggagcggtggaccagacgtccagacctcctgaaaggctggcggggaggcacaggcgggatcttccggaggtgagaatttttttttattatagcagaatggggaggaattgaggggaaaatggagatagaacctgaaagagccccaaacgccagaacctgtagctccccaagaataagatcttccagaagaactagacccaaaactagccgttggggaacaccgaaatccttggaggagcaacatccgcatgaccctctgtgttcctttaggcaaaaggacttgcttccattgtttgttcaattgtttgtgtttgttaaataaataaaacgattttcatgtatctttgaaattactttggcgc

SEQ ID NO: 15867 - DNA, 717 bp, Homo sapiens
taactgtccattagctctcatgccgggtcagcaaaatgctttaatttttaactgcagaacatgtgactcggttgagtcttttgtcttttttttttttaaataaacaatggggggaattaatgtgggcaagttgccttatgttagaatgactaagttaaacctcttaattggtatttgtccaaggcagacatgatataaggaatatgcactaccgtagtaactcccctggccgcagaaaccacactgcaagcctgtccggggtggggtgctgactgccatttgccacttttaaatgggcactgccgtggtaatgtgaatcccatcaatgcagtagatgggtggggaaatgaagatttccccccaaacctttaggcaaaagtgagtttttgtttggttgattttgggtttttttcccccctcctcttttggctttcacattttaaatcttaaatgttactattgcaggccgcaggcatgacaggcaatgagcaggtgaagaaccaatggaaaagtgttcaaaaactcctgtgttagctaacaggcttctgaatgtatcactgtggtccacagagaaggctggaggaggtagcaaggagatgctgtatcagctactacagccttaaaacaaagttggtgtctctttggactttaaaattgttcctatgcagcttattttatttttgtttaatcaaataaacgagggtttttccatggcta

SEQ ID NO: 15868 - DNA, 936 bp, Homo sapiens
taactgtccattagctctcatgccgggtcagcaaaatgctttaatttttaactgcagaacatgtgactcggttgagtcttttgtcttttttttttttaaataaacaatggggggaattaatgtgggcaagttgccttatgttagaatgactaagttaaacctcttaattggtatttgtccaaggcagacatgatataaggaatatgcactaccgtagtaactcccctggccgcagaaaccacactgcaagcctgtccggggtggggtgctgactgccatttgccacttttaaatgggcactgccgtggtaatgtgaatcccatcaatgcagtagatgggtggggaaatgaagatttccccccaaacctttaggcaaaagtgagtttttgtttggttgattttgggtttttttcccccctcctcttttggctttcacattttaaatcttaaatgttactattgcaggccgcaggcatgacaggcaatgagcaggtgaagaaccaatggaaaagtgttcaaaaactcctgtgttagctaacaggcttctgaatgtatcactgtggtccacagagaaggctggaggaggtagcaaggagatgctgtatcagctactacagccttaaaacaaagttggtgtctctttggactttaaaattgttcctatgcagcttattttatttttgtttaatcaaataaacgagggtttttccatggctaaaaaaaacaacaaaaaaaaacaggggggcgctttaaattccgcggggcaacatttggttccctttttttaaagggcccaagggacgttaaagaaaggggggcggtaaaacggtgggaaaactatgtggtgtggggcccactggggctatggcaccacagacgccgaacacgtttgtgccctctggtggtataattatagtatgattagatagtctggcc

SEQ ID NO: 15869 - DNA, 362 bp, Homo sapiens
tcacatctgaatcttaatcttttaccctttgtaaaatatggataagtacacttagttgtagaattgctgtgaggattaggtgaactgatgaatctgaaatgcatagcacaattctaacacagacttgtaactgcctaacaggttcaccttgcccactgcttagacacagccaatttatcaagacaggggaattgcaatagagaaagctattcatgcagagcctactgttagggagaccagagttttattattactcaaatcagtttttcagagtatttggggaatcagagtttttaaggatgatttggtgggtggggggaccagtgaatcaggagtactgattggagggttcagagatgaaa

SEQ ID NO: 15870 - DNA, 483 bp, Homo sapiens
atccaaccccaggcctgtctgatgtctgacgtgggagaatgaagcatacatgtttctcagagaatagacactttctgcattctgggtccaaacttaaaatctcgggcattttggatggcaactctcttaaatgcagccaaacttctccgacagatgttctgcaggacgagccatcgccccagctctgcctgcaccgttgccagctccgttcgtagccttgcaggctctgtgcgtaacggctggagtagcaagctcacccacggtggaagctgccccctcttccacacccacactgtgcactgcaggggcaaggtcctagtgttcccaaatctggagctaagtagagttcaataaaggtgtgctgggctgggtgcagtggctcaccctgtaattgcagcactttcggaggccgaggtgggcagatcacctgaggtcaggagttcaagaccagcccggccaacatggcaaaaccctgtctctact

SEQ ID NO: 15871 - DNA, 474 bp, Homo sapiens
gttgctgtcaacaaggatgtacaaatatctgttcgagtccctgctcttaattgttttgggtatacacccaacctacattaatctttaatcacttaagatgttggggtttgtgctgggaggtaaccaagtgactctggagcagcctcaccctagctacagagggaaactgactcttccctctctgcccaatcttttgccgcctgtcaggttcccaagctgtccataccttactgtgtgaagcgctttgggtataaactcccaaatagaggctcagccccttttcctttcccaagtccatcctgcaggttatagctcttcagaggaatctcttgaattctggcctggggatctgggattaaagtagaacccaggggtgtcccttggggccttaggcattagcccgttgtgggtggaacctggccattcagccccactggcactcagttggtcccctggtacttcaggacagtttct

SEQ ID NO: 15872 - DNA, 363 bp, Homo sapiens
tctgggagtctcataacatgtatttttatctctttttaaagatgaggaaaggactgatgcttagagacgttgaataacataaataaaatcccagcaaacatttagtatgccttggccgggtgcagtggctcacccctgtagtcccggcattttgggaggctgaggcaggtggctcgcttgaagtcaggagtttaagaccaagctaaccaacatggtgaaaccctgtctttactaaaaatacaaaaatcagcccggcatggtagtgggcgcctgtaatcccagctactcaggaggctgtctcagattaaaacatttacacagaacgttcacggttttgccctatagggagtcgtgtcgacgcgg

SEQ ID NO: 15873 - DNA, 406 bp, Homo sapiens
ttaagcagaaaatgaactaactgctaggctttaactatgtatattaggacattctgaaatgcaaacattaaacctaatcagaataattggttttaacattaactgttattcagaagtatctgagtagatgttaatgatggttaacctcacttaaactcacaaaatcgtgatctggacaaagcattaatatttttagaggggctgggcatggtgactccggcctgtaatcccagcactttgggaggccaaggtgggcggatcacctgaggttgggagttcgagaccagcctggccaacatggtgaaaccgcatctcttctaaaatacaaaaattagccgggcatggtggcaggcacttgtaattcctaggtacttgggaggctgaggcaggagaatctcttgaaccc

SEQ ID NO: 15874 - DNA, 430 bp, Homo sapiens
gattctaaaatttgtatgattaaaatttgtagagattttaaaatttgtatggaaatgcaaagaccctcatgcatggtttggcaggtcttagcaagccaactgcctgcttttggaaatggttttttaacattgccacacttagtgtgttgtgcgtattgtctgagcctgcttttgcagtaaaccagcagagttgagtagttgttacagacaccatatggtccacaaagcttaaaatattttacagaataaatttgctgaccctgccctagagtatttaaagcaattttgaaaaagatgaaaaaggctgggcacagtggctcatgcctgtaattccatcactttgggaggccgaggcggttggatcacttgaggtcaggagtttgagaccagcctggccaacatggtgaaaccccatctctactaaaaatac

SEQ ID NO: 15875 - DNA, 409 bp, Homo sapiens
ttagtggcttaaaccaacaaatgtattagctttataatgatttggatcagtgatgggggctgggcacggacaggcgattcttctgctgggcttggctgaactcaactatgtcttatggtcagagggcagtcaggggcttcgctcatgtctggtagttggctgttggctgagcccttggttctcctctggcttaggcttgttcacatggtggcctcggggctcccatggcagttagagaaatcaagcccaagtctcatatcacgttcactattctcccattgtccaaagcagaccacatggccaaggcccaagtctgtgtgaaaggatgtggatacagggaccccgaatgaaccagaggcaatactgctgcaagctaccacatagatgctgttcagagctttgcaggacc

SEQ ID NO: 15876 - DNA, 446 bp, Homo sapiens
gatatggactaataaaggtatgctgctgtgaacagtataaaattattcagaaacaaaaaataattaaacttaatctcaacctacatcatctctatattaataagtgtttgaccactcaatgaggaattgtagtgagcaaataaaatatctatcttctcaatagaataaagacgccatgtcagtgcactgccatttcttggctagtgtataaacatgtcagtagatgttaaaagtatttcacatcgtattttcatatctggtagtagccccagaaatgacttacaaagatagcaaaaatcctaattaattaggtttagaaggttgggcatggtggctcatgcctgtaatcccagcactttgagaggctgacgggggtggatcacctgaggtcaggagtccgtgaccaggctggccaacatggtgtaaccctgtgtgtactaaaaatc

SEQ ID NO: 15877 - DNA, 416 bp, Homo sapiens
ccggcctggggtgctagcccccaagtgtgagcctcatgctagtctcaggaaatgcaaccttttccggccagatccagtggagcccgggaggtcgctgccttgcccctggcccgtgggctacaggtctccaggatactctaggcctgcccgcccctccggccccagtcggagctggcattactgaacgccggcatcccaggaaatagaccgctcaggccgctgccttcagctgggaaagactcttgcatccgggtcatacgcggcactttgcctccttcctcccagtgtgaatccagcccaaggtggaagaggagcctgagaggaccctgaaagcgcagagagagctggctaggtagagctccagctctggcttctgagattcaagcagctgcggtcgctgcgggcagtggctgctc

SEQ ID NO: 15878 - DNA, 377 bp, Homo sapiens
ccggcctggggtgctagcccccaagtgtgagcctcatgctagtctcaggaaatgcaaccttttccggccagatccagtggagcccgggaggtcgctgccttgcccctggcccgtgggctacaggtctccaggatactctaggcctgcccgcccctccggccccagtcggagctggcattactgaacgccggcatcccaggaaatagaccgctcaggccgctgccttcagctgggaaagactcttgcatctcatcacgcggaggtgttcttgcccatcagcaccacagccttcccgcgaagggacatgcggatctgctgcatctgctggagcccacatagtcagctcccacaagggtacacctcggataatcaaccaa

SEQ ID NO: 15879 - DNA, 740 bp, Homo sapiens
gtaaacctaagactgaggagggctgtattgagaaggcatgagcttgcttgagtggcatgcttgcccatcatagtcccagctacaaaataaaatatgattaattctcattgtaagtatagctgtaggccatttggttttgtttatgccactagcaccatctgccaagacaccaaggaggattcataatgtcctgtgtctcaggtgaaaggactttagatgttgctcctctcagtgatctccgaattagccccttgcacacatctatcatgatgtggaagaaatcctgcacatgcaggaacccacagacagaaacgtccatctgtgcccctggatgtaggcttgccaatatttatttaatggtggatcttgacgtggcactataatctggctcccagtccatgaaactgaagtccagaagcagtttttcctaacctgggacctgccaaaaaacacactatatgtgcccctgtaggcatgctggctgactttattcccactgtgaatcttgaagcagtcctaaaacccagctccagtcccaaaacctacctccagtccctgtcaactaaagtctgggagcagtcctgcccacccaggaatctggagggagaaatgccatgaagccagaaacaaacctgaagactttggtctcagctgtgtatcctgaagcagccctatgaatcagttccacacccccattcccccactccagataaagcttcagttatatctcaaaaaaaaaa

SEQ ID NO: 15880 - DNA, 763 bp, Homo sapiens
tcagctgtgtatcctgaagcagccctatgaatcagttccacaccctctcagctgtgaccaagggtcagtacttctcatctaggaacctgtccaatgactgggttagaggatttccaaaaacccagcaagagccacacagcagaagccatacctgctcacatggattttatcagctctgtcatctgcctgtataaccagagactttttttcctcagcaccagtcttactgatcaagatcctgaagaaagttcagtcttcccagaaaatagaatccacaatggtctgatgccctaataacaggtctgccaagaatgaacttcactgtgatccagatccagtgcaccttactgcaatctcatcagcacagagatccaataggagaaaatatttacctccacaaactaatctataatgactgaaagacgtatttactccttcagatgcaaggacataaaaagaaggtatcacagatcatgaaggatcaggcaaacataacatcaccaaaggaaactaaaaatgctccagtaaccacttacagtaagacacagatctaaaaaatggccaagaattcaaaataattttcttaaagaatctcaatggatgcaaaaagaccacacattactaaattcttttgcaacaacgtatgaacaaaatcacaattataataaagagaacccattaaaagagaaccaaatagatatgctggagctgaagtacacaataggagatctaaaatatttaagagaaagctttaacaggagac

SEQ ID NO: 15881 - DNA, 211 bp, Homo sapiens
aaggtgcctaagtgctaaaagtgggtggtggttgtttccatgaagttgagtctcctgattctaaagctggtcaccttctcttctgccttagcttctggaaagggcctcctcacgctcatgcctaccaaggtttcagatagatgcccttttaatcccctgaaagattcaaggaagccccagctactggtcctggggcagttagggctgtgtt

SEQ ID NO: 15882 - DNA, 405 bp, Homo sapiens
tgcttttggcagtatggtcattttcacaatattgagtctacccatccatgagcatggaatgtgtttccttttgtttttgtcatctatgatttctttcaacagtgttttgtagttttccttgtaggggtctttcacctccttggttagttacattcgtaagtattttatttttacagctatcataaaagggtttgatttgattctcagcctggtagatgttggtgtatagcaccgctactgatatgtgtacatagattttgtatcctgataaatagattttttgtgtatttctaaatagcaataagatttgaaatattcccaacacaaagaaatgatcaatgtttgaggtgattaatatcctaaagaccctgatttgatcattacacattgcatgcatgtaccaga

SEQ ID NO: 15883 - DNA, 256 bp, Homo sapiens
caagggcacctttcatcctcaggcttaaagcattccatttggcaagatgggttgccatggctgcgtttgtgcttgataaacagaatgaacatgtttttattcatggagcaggagctggcaggaaggacaaaattggacacctgcacaaactgagaaaattactgtggtataaaatgaatggcctttgacaaactgtagtggcatgtgatcctggacctgagttggcggagtgtagacctgggactcagtcactcct

SEQ ID NO: 15884 - DNA, 438 bp, Homo sapiens
aatcacatagagatattggttcaatatggacatctaaactataatgctaaaagccaataattagaataagttcattttaagaaaagcattaataatattagctaacgtttagtacctgtgccaaacattctacctatgttaccttgattttcatagccagcctaagaggtactattatgtatccccattttacaggttaagaaacaggctcagaggagtttaggatcttttccaagattacatagccagtaagtggtggcactaggaaccaaattcagactctgaatcgcatgctgtttatattatattgcactcattctaaatatgtgggaatcagaatgaaggggcttgtatgacttttggctcattttttgatgcatgtgacctgggattataaatgtgaaattaggtttacgaaaggatccagtgtcattgtgc

SEQ ID NO: 15885 - DNA, 454 bp, Homo sapiens
cggcgctgggtagaaatgggcggttgggtgaacagagaagctaccctctcacctgcagggacaccgcgcgtgcccgaaaggcatgaaggacaaccttttgctaggaattgtggaggaatcttgattcagctgtattatccccaaaaggggagtttcctaagatgctcccttctctcttcttttattatacacatcttttccctcattgggtctctcctaggctccagtgtcagctcaggctgccagacaaaggcagcctccgctccaggccacagcctcccatagcttcctccttcctgtcttctcagaccagcaatgtttgcaactaaataacgacctggagaaggcaggaggaaccttgcatagcttggactacacacacaatcccacatccaacacatccagtaggaaaataaccccatgcctttaataaagaaacgagaagctcaaacag

SEQ ID NO: 15886 - DNA, 472 bp, Homo sapiens
tatttcaatggagaatgtcattggtattttgatagagatttcattaaatctgtagatccctttggttgttatggacatttttaacaatattaacccctccaagctacaaacatgggatatctttcatttatttgtgtcttcttcaatttatttcatcaatgttttacagttttctgtgtaagaattgtttacctttttgattaaatttattcctaggtattttatcattttatagctattgtaaatacaattgtgttcttgatttatttttcagatactttgctatattgcattttcaaagctatctttgagaatgttatattaatatttatacatattcatgcattttgtttttaaaaatggaatcatactcttataagacatcatgcttttctcaccaggcaatatattatgaatcttttcataaatataaataagcatttaaaatatattaaaaaagaaaaactactaa

SEQ ID NO: 15887 - DNA, 386 bp, Homo sapiens
aaagatataaagatatctttgccagcacatttgaaaatttagactaaatgaccaaatgccaggaaaaattgaacttagcaaagccagctaaatatgaaaaagaaaacctgagaaaaatgaggcagtaataaaaatttttcctacaaatttcaagcccagagatttatattggtaacttttggcaaatatacaaggagcaaataatttcaatcttacagacacaatttggaaatataaaagagagggaacaatcactcaacaacatatttaataaggttcacataactttatatcaaaactttacaagttaatacaggaaaagaaaagcttaggcctgtctcaatcctgaacatgtagaaaaattcctaaacataatcagaccaatc

SEQ ID NO: 15888 - DNA, 367 bp, Homo sapiens
  misc_feature (11)..(11): n is a, c, g, or t
agaagacgctnggcaaaggacagacagggctggttaaactcggggtccactgcatcacgggtcagaaggtcgccatcaagatcgtgaaccgggagaagctgtcggagtcggtgctgatgaaggtggagcgggagatcgccatcctgaagctcatcgaacacccacatgtcctcaagctccacgacgtctacgagaacaagaaatatttggtacctggttctggagcacgtctcggggggtgagctattcgactacctggtcctccccccacgaccttctgtacggatttgctctccggaaggaattctggtttcgcgtgatcctgcctgcgtccgtgtctctgattccgccggcggcaaaaaaaaaa

SEQ ID NO: 15889 - DNA, 2704 bp, Homo sapiens
  misc_feature (11)..(11): n is a, c, g, or t
agaagacgctnggcaaaggacagacagggctggttaaactcggggtccactgcatcacgggtcagaaggtcgccatcaagatcgtgaaccgggagaagctgtcggagtcggtgctgatgaaggtggagcgggagatcgccatcctgaagctcatcgaacacccacatgtcctcaagctccacgacgtctacgagaacaagaaatatttggtacctggttctggagcacgtctcggggggtgagctattcgactacctggtaaagaaggggagactgacgcccaaggaggcccgaaagttcttccgccagattgtgtctgcgctggacttctgccacagctactccatctgccacagagacctaaagcccgagaacctgcttttggatgagaaaaacaacatccgcattgcagacttcggcatggcgtccctgcaggtgggggacagcctcctggagaccagctgcgggtccccccattatgcgtgtccagaggtgattaagggggaaaaatatgatggccgccgggcagacatgtggagctgtggagtcatcctcttcgccctgctcgtgggggctctgccctttgatgacgacaacctccgccagctgctggagaaggtgaaacggggcgtcttccacatgccccacttcattcctccagattgccagagcctcctgaggggaatgatcgaagtggagcccgaaaaaaggctcagtctggagcaaattcagaaacatccttggtacctaggcgggaaacacgagccagacccgtgcctggagccagcccctggccgccgggtagccatgcggagcctgccatccaacggagagctggaccccgacgtcctagagagcatggcatcactgggctgcttcagggaccgcgagaggctgcatcgcgagctgcgcagtgaggaggagaaccaagaaaagatgatatattatctgcttttggatcggaaggagcggtatcccagctgtgaggaccaggacctgcctccccggaatgatgttgaccccccccggaagcgtgtggattctcccatgctgagccgtcacgggaagcggcgaccagagcggaagtccatggaagtcctgagcatcaccgatgccgggggtggtggctcccctgtacccacccgacgggccttggagatggcccagcacagccagagatcccgtagcgtcagtggagcctccacgggtctgtcctccagccctctaagcagcccaaggagtccggtcttttccttttcaccggagccgggggctggagatgaggctcgaggcgggggctccccgacttccaaaacgcagacgctgccttctcggggccccaggggtgggggcgccggggagcagcccccgccccccagtgcccgctccacacccctgcccggccccccaggctccccgcgctcctctggcgggacccccttgcactcgcctctgcacacgccccgggccagtcccaccgggaccccggggacaacaccaccccccagccccggcggtggcgtcgggggagccgcctggaggagtcgtctcaactccatccgcaacagcttcctgggctcccctcgctttcaccggcgcaagatgcaggtccctaccgctgaggagatgtccagcttgacgccagagtcctccccggagctggcaaaacgctcctggttcgggaacttcatctccttggacaaagaagaacaaatattcctcgtgctaaaggacaaacctctcagcagcatcaaagcagacatcgtccatgcctttctgtcgatccccagcctgagtcacagtgtgctgtcacagaccagcttcagggccgagtacaaggccagtggcggcccctccgtcttccaaaagcccgtccgcttccaggtggacatcagctcctctgagggtccagagccctccccgcgacgggacggcagcggaggtggtggcatctactccgtcaccttcactctcatctcgggtcccagccgtcggttcaagcgagtggtggagaccatccaggcacagctcctgagcactcatgaccagccctccgtgcaggccctggcagacgagaagaacggggcccagacccggcctgctggtgccccaccccgaagcctgcagcccccacccggccgcccagacccagagctgagcagctctccccgccgaggcccccccaaggacaagaagctcctggccaccaacgggacccctctgccctgaccccacggggccggggagggaggggacccccctccaccccccttccgtgccccccaactgtgaatctgtaaataaggcccaaggaacatgtcgggaggggggtggacacaaaaaccggccttgccctgcagggatggggctccacaggccgtgcccaactgggggtggttctaggggaacagggggcgggggagctgtttctattttatttattgattaatttattattttatttattgatcaatctctctgcggggtggggtgggggagggacgggagctggttggggtggcttagcagatccggacagggccctctgtccctgtgtcgtccccaaccccctcttcccgggcccctcctcccctggtcctccccccacgaccttctgtacggatttgctctccggaaggaattctggtttcgcgtgatcctgcctgcgtccgtgtctctgattccgccggcggcaaaaaaaaaa

SEQ ID NO: 15890 - DNA, 2496 bp, Homo sapiens
  misc_feature (11)..(11): n is a, c, g, or t
agaagacgctnggcaaaggacagacagggctggttaaactcggggtccactgcatcacgggtcagaaggtcgccatcaagatcgtgaaccgggagaagctgtcggagtcggtgctgatgaaggtggagcgggagatcgccatcctgaagctcatcgaacacccacatgtcctcaagctccacgacgtctacgagaacaagaaatatttggtttcaccacacgggaagctgtctgcccggcgctcatgggacctgctctcaggctttcccaggtacctggttctggagcacgtctcggggggtgagctattcgactacctggtaaagaaggggagactgacgcccaaggaggcccgaaagttcttccgccagattgtgtctgcgctggacttctgccacagctactccatctgccacagagacctaaagcccgagaacctgcttttggatgagaaaaacaacatccgcattgcagacttcggcatggcgtccctgcaggtgggggacagcctcctggagaccagctgcgggtccccccattatgcgtgtccagaggtgattaagggggaaaaatatgatggccgccgggcagacatgtggagctgtggagtcatcctcttcgccctgctcgtgggggctctgccctttgatgacgacaacctccgccagctgctggagaaggtgaaacggggcgtcttccacatgccccacttcattcctccagattgccagagcctcctgaggggaatgatcgaagtggagcccgaaaaaaggctcagtctggagcaaattcagaaacatccttggtacctaggcgggaaacacgagccagacccgtgcctggagccagcccctggccgccgggtagccatgcggagcctgccatccaacggagagctggaccccgacgtcctagagagcatggcatcactgggctgcttcagggaccgcgagaggctgcatcgcgagctgcgcagtgaggaggagaaccaagaaaagatgatatattatctgcttttggatcggaaggagcggtatcccagctgtgaggaccaggacctgcctccccggaatgatgttgaccccccccggaagcgtgtggattctcccatgctgagccgtcacgggaagcggcgaccagagcggaagtccatggaagtcctgagcatcaccgatgccgggggtggtggctcccctgtacccacccgacgggccttggagatggcccagcacagccagagatcccgtagcgtcagtggagcctccacgggtctgtcctccagccctctaagcagcccaaggagtccggtcttttccttttcaccggagccgggggctggagatgaggctcgaggcgggggctccccgacttccaaaacgcagacgctgccttctcggggccccaggggtgggggcgccggggagcagcccccgccccccagtgcccgctccacacccctgcccggccccccaggctccccgcgctcctctggcgggacccccttgcactcgcctctgcacacgccccgggccagtcccaccgggaccccggggacaacaccaccccccagccccggcggtggcgtcgggggagccgcctggaggagtcgtctcaactccatccgcaacagcttcctgggctcccctcgctttcaccggcgcaagatgcaggtccctaccgctgaggagatgtccagcttgacgccagagtcctccccggagctggcaaaacgctcctggttcgggaacttcatctccttggacaaagaagaacaaatattcctcgtgctaaaggacaaacctctcagcagcatcaaagcagacatcgtccatgcctttctgtcgatccccagcctgagtcacagtgtgctgtcacagaccagcttcagggccgagtacaaggccagtggcggcccctccgtcttccaaaagcccgtccgcttccaggtggacatcagctcctctgagggtccagagccctccccgcgacgggacggcagcggaggtggtggcatctactccgtcaccttcactctcatctcgggtcccagccgtcggttcaagcgagtggtggagaccatccaggcacagctcctgagcactcatgaccagccctccgtgcaggccctggcagacgagaagaacggggcccagacccggcctgctggtgccccaccccgaagcctgcagcccccacccggccgcccagacccagactgtttctattttatttattgattaatttattattttatttattgatcaatctctctgcggggtggggtgggggagggacgggagctggttggggtggcttagcagatccggacagggccctctgtccctgtgtcgtccccaaccccctcttcccgggcccctcctcccctggtcctccccccacgaccttctgtacggatttgctctccggaaggaattctggtttcgcgtgatcctgcctgcgtccgtgtctctgattccgccggcggcaaaaaaaaaa

SEQ ID NO: 15891 - DNA, 2533 bp, Homo sapiens
ctggacaccccaacaatgggccgccttaggaggtctgagtcactatctcaaagtcaatcacccgccaggaaggatgggggtgggggtccagctgtccagactccagagaatgggcctctttgtccaaactctggtgacccaaaggacagctgggctgggaagccggagaggggacagccctcgtgttcccccccggcacccagtcccccggatgaactgacatcaggtccgtcgatgctggcgcaggtttcaccacacgggaagctgtctgcccggcgctcatgggacctgctctcaggctttcccaggtacctggttctggagcacgtctcggggggtgagctattcgactacctggtaaagaaggggagactgacgcccaaggaggcccgaaagttcttccgccagattgtgtctgcgctggacttctgccacagctactccatctgccacagagacctaaagcccgagaacctgcttttggatgagaaaaacaacatccgcattgcagacttcggcatggcgtccctgcaggtgggggacagcctcctggagaccagctgcgggtccccccattatgcgtgtccagaggtgattaagggggaaaaatatgatggccgccgggcagacatgtggagctgtggagtcatcctcttcgccctgctcgtgggggctctgccctttgatgacgacaacctccgccagctgctggagaaggtgaaacggggcgtcttccacatgccccacttcattcctccagattgccagagcctcctgaggggaatgatcgaagtggagcccgaaaaaaggctcagtctggagcaaattcagaaacatccttggtacctaggcgggaaacacgagccagacccgtgcctggagccagcccctggccgccgggtagccatgcggagcctgccatccaacggagagctggaccccgacgtcctagagagcatggcatcactgggctgcttcagggaccgcgagaggctgcatcgcgagctgcgcagtgaggaggagaaccaagaaaagatgatatattatctgcttttggatcggaaggagcggtatcccagctgtgaggaccaggacctgcctccccggaatgatgttgaccccccccggaagcgtgtggattctcccatgctgagccgtcacgggaagcggcgaccagagcggaagtccatggaagtcctgagcatcaccgatgccgggggtggtggctcccctgtacccacccgacgggccttggagatggcccagcacagccagagatcccgtagcgtcagtggagcctccacgggtctgtcctccagccctctaagcagcccaaggagtccggtcttttccttttcaccggagccgggggctggagatgaggctcgaggcgggggctccccgacttccaaaacgcagacgctgccttctcggggccccaggggtgggggcgccggggagcagcccccgccccccagtgcccgctccacacccctgcccggccccccaggctccccgcgctcctctggcgggacccccttgcactcgcctctgcacacgccccgggccagtcccaccgggaccccggggacaacaccaccccccagccccggcggtggcgtcgggggagccgcctggaggagtcgtctcaactccatccgcaacagcttcctgggctcccctcgctttcaccggcgcaagatgcaggtccctaccgctgaggagatgtccagcttgacgccagagtcctccccggagctggcaaaacgctcctggttcgggaacttcatctccttggacaaagaagaacaaatattcctcgtgctaaaggacaaacctctcagcagcatcaaagcagacatcgtccatgcctttctgtcgatccccagcctgagtcacagtgtgctgtcacagaccagcttcagggccgagtacaaggccagtggcggcccctccgtcttccaaaagcccgtccgcttccaggtggacatcagctcctctgagggtccagagccctccccgcgacgggacggcagcggaggtggtggcatctactccgtcaccttcactctcatctcgggtcccagccgtcggttcaagcgagtggtggagaccatccaggcacagctcctgagcactcatgaccagccctccgtgcaggccctggcagacgagaagaacggggcccagacccggcctgctggtgccccaccccgaagcctgcagcccccacccggccgcccagacccagactgtttctattttatttattgattaatttattattttatttattgatcaatctctctgcggggtggggtgggggagggacgggagctggttggggtggcttagcagatccggacagggccctctgtccctgtgtcgtccccaaccccctcttcccgggcccctcctcccctggtcctccccccacgaccttctgtacggatttgctctccggaaggaattctggtttcgcgtgatcctgcctgcgtccgtgtctctgattccgccggcggcaaaaaaaaaa

SEQ ID NO: 15892 - DNA, 1846 bp, Homo sapiens
aaagcagtagaagcggctgggaggggtgggatgccagggttcctgagaggcaacgggctagggactcggacttatgggtcctgggggaagaggacacagctagagaaggagtctaggggtcagaggcaggaggggctaagctaggagtccaggactcccagaggcgggaaacacgagccagacccgtgcctggagccagcccctggccgccgggtagccatgcggagcctgccatccaacggagagctggaccccgacgtcctagagagcatggcatcactgggctgcttcagggaccgcgagaggctgcatcgcgagctgcgcagtgaggaggagaaccaagaaaagatgatatattatctgcttttggatcggaaggagcggtatcccagctgtgaggaccaggacctgcctccccggaatgatgttgaccccccccggaagcgtgtggattctcccatgctgagccgtcacgggaagcggcgaccagagcggaagtccatggaagtcctgagcatcaccgatgccgggggtggtggctcccctgtacccacccgacgggccttggagatggcccagcacagccagagatcccgtagcgtcagtggagcctccacgggtctgtcctccagccctctaagcagcccaaggagtccggtcttttccttttcaccggagccgggggctggagatgaggctcgaggcgggggctccccgacttccaaaacgcagacgctgccttctcggggccccaggggtgggggcgccggggagcagcccccgccccccagtgcccgctccacacccctgcccggccccccaggctccccgcgctcctctggcgggacccccttgcactcgcctctgcacacgccccgggccagtcccaccgggaccccggggacaacaccaccccccagccccggcggtggcgtcgggggagccgcctggaggagtcgtctcaactccatccgcaacagcttcctgggctcccctcgctttcaccggcgcaagatgcaggtccctaccgctgaggagatgtccagcttgacgccagagtcctccccggagctggcaaaacgctcctggttcgggaacttcatctccttggacaaagaagaacaaatattcctcgtgctaaaggacaaacctctcagcagcatcaaagcagacatcgtccatgcctttctgtcgatccccagcctgagtcacagtgtgctgtcacagaccagcttcagggccgagtacaaggccagtggcggcccctccgtcttccaaaagcccgtccgcttccaggtggacatcagctcctctgagggtccagagccctccccgcgacgggacggcagcggaggtggtggcatctactccgtcaccttcactctcatctcgggtcccagccgtcggttcaagcgagtggtggagaccatccaggcacagctcctgagcactcatgaccagccctccgtgcaggccctggcagacgagaagaacggggcccagacccggcctgctggtgccccaccccgaagcctgcagcccccacccggccgcccagacccagactgtttctattttatttattgattaatttattattttatttattgatcaatctctctgcggggtggggtgggggagggacgggagctggttggggtggcttagcagatccggacagggccctctgtccctgtgtcgtccccaaccccctcttcccgggcccctcctcccctggtcctccccccacgaccttctgtacggatttgctctccggaaggaattctggtttcgcgtgatcctgcctgcgtccgtgtctctgattccgccggcggcaaaaaaaaaa

SEQ ID NO: 15893 - DNA, 422 bp, Homo sapiens
gtgtggtggtagggaggggctattgtccggaccggtgcatggtcgctcccactccactcttggcgtagggaggcagggccatgggagtttatgcttcgggcaggaatcccagccatctaagagctcatagaaattgagcttttggggccaggcgcggtggctcatgcctgtaatctcaacactttgggaggccaagatgggcggatttcttgaagagctcgagaccagcctgagcaacatggcaaaaccccgtctctacaaaaaatacaaaaattagctgagtgtggtggtacacctgtagtcctacctacttgggaggctgaggtgggagaattgcttgaacctgggaggcagaggctgcagtgagccaagatcgtgccactgcattccagcgtgggcgacagagcaagactctgtctcaa

SEQ ID NO: 15894 - DNA, 554 bp, Homo sapiens
tacatgcaatatgacttaaagctcctgagacaccatctccagattcccatccacttccccaaggatttcttgtctgtgatgcttgaaaaaggaagtttgtctgccatgcgtttcctcaccgccgtgaacttggagcatccagagatgttggagaaagcgtcccgggagctgtggatgcgcgtctggtcaaggaatgaagacatcaccgagccgcagagcatcatggcggctgcagagaaggctggtatgtctgcagaacaagcccagggacttctggaaaagatcgcaacgccaaaggtgaagaaccagctcaaggagaccactgaggcagcctgcagatacggagcctttgggctgcccatcaccgtggcccatgtggatggccaaacccacatgttatttggctctgaccggatggagctcgtggcgcacctgctgggagagaagtggatgggccctatacctccaacctttacttctatgcctcacaagtgcctttcagagagccccaattctgctttcccacaaaataaacctaatgccatcaggcaaaa

SEQ ID NO: 15895 - DNA, 447 bp, Homo sapiens
aagtggtagggggtggggcgagggacgggttgcaaggggaggaaaagtcaggaaggctactgagagcatagagccgacttcagcctctgttgggaagggaaccagcagtcaagccaaatcctactacgggtgtagcaaaactcaacttctttcaatacgaatttgagatctaagagtagtttattctggtggagcaggcttacccatggtttcagaagttagagaggagactctgagagtcaagccctgggttgttcaagacccaaataaggcagggagaaagcaggacatagggcaggtttcccaaggaaaatgagcccattagcatttcaagccttcagttgacagggccaggtattaggtactcccagtcagttagttcccagctgagcccagtagttctagcccaagctccagatgtgagtttaggaatcaccaaataattcc

SEQ ID NO: 15896 - DNA, 4744 bp, Homo sapiens
agcactgctgggctggagacggcgggagccgctgctctccggctgagggaatcagagacagctccgtccctagtggagcgcaggggaggcagaagtcatgacaggcgaggtgggttctgaggttcacctagaaatcaatgacccaaacgtcatttcacaagaggaagcagatagtccttcagatagtggacagggcagctatgaaacaattggacccttgagtgaaggagattcagatgaagagatatttgtaagtaagaagttgaaaaacaggaaggttctacaagacagtgattccgaaacagaggacacaaatgcctctccagagaaaactacctatgacagtgccgaggaggaaaataaagagaatttatatgctgggaaaaatacaaaaatcaaaaggatttacaaaactgtggcagacagtgatgaaagttacatggaaaagtctttgtatcaggaaaatcttgaagcgcaagtgaaaccttgcttagagctgagtcttcagtctggaaactctacagactttaccactgacagaaagagttccaaaaagcacatacatgataaagaaggaactgcaggaaaagcaaaagtaaaatcaaaaagaagacttgagaaagaggagagaaaaatggaaaaaattagacagctaaaaaagaaggaaacaaaaaaccaggaagatgatgtagaacagccatttaatgacagtggctgtcttcttgtggataaagacctttttgaaactgggttggaggatgaaaataactctccattggaagatgaagagtcattagaatcaataagagcagctgtaaaaaacaaagtaaaaaagcacaagaaaaaagaaccatctttggagagtggggtccattcatttgaggaaggaagtgagttatcaaaaggaaccacgaggaaggaaagaaaggcagccagattaagtaaagaagcattaaaacaactgcatagtgagactcagcgccttattcgagagtctgcactgaaccttccatatcatatgcctgagaataaaaccattcatgatttcttcaaacgtaaaccccggcccacttgccacggaaatgccatggcactattgaagtcatctaaatatcagtcaagccatcacaaagaaatcatagacactgcaaatactactgaaatgaacagtgatcaccatagtaaaggttctgagcagacaacaggtgcagaaaatgaagtggaaactaatgcactccctgtagtttcaaaggaaacccagatcattactggatcagatgagtcttgcaggaaggatttggtaaaaaatgaagagctagaaattcaggagaaacagaagcagagtgacattagaccttcacctggggacagctcagtgttgcaacaggaatccaacttcctcgggaacaatcacagtgaggaatgtcaggttggagggcttgtagcatttgaacctcatgccctggagggtgaaggcccccaaaatccagaagaaacagatgagaaagtggaagagcctgagcagcaaaataaatcatcagcagttgggccacctgaaaaagtgagacggtttactctggatagacttaagcaactgggagtagatgtttccattaaaccacggctaggtgctgatgaagattcctttgtgatacttgaacctgaaaccaacagagaactggaagccttgaagcagcgtttctggaagcatgctaatccagcagccaaacccagggctggtcagacagtgaatgtgaacgtcatagtgaaagacatgggcactgatggaaaggaagagctaaaagcagatgtggtacctgtgactttagcacctaagaagttggatggagcaagccacacaaaaccaggtgaaaagcttcaggtgttaaaagctaaactgcaagaagcaatgaaactccgaaggtttgaggagcgccagaagcgccaagcactgtttaaattagataatgaagatgggtttgaggaagaggaggaggaagaggaagaaatgacagatgagtctgaggaagatggagaagagaaggtagagaaagaagagaaagaggaagaactagaggaagaggaggagaaagaagaggaggaggaagaagaaggaaatcaggagactgcagaattccttcttagtagtgaagaaatagaaacaaaagatgaaaaagaaatggataaagaaaataatgatggcagtagtgaaattggcaaggcagttggcttcctctctgttcccaagtctctctcatcagattctactttacttctgtttaaggacagctcttccaagatgggttactttcctactgaagaaaaatcagaaacagatgaaaactcaggcaagcagcctagcaaactggatgaggatgattcatgttcattgctaacaaaggagagcagccacaatagcagctttgagctgattggctccacgattccatcctatcagccttgcaacagacaaacaggccgtgggaccagttttttccctacagcaggaggattcagatctccttcccctgggctatttcgagccagtttggtcagctcagcttctaagagttcagggaaactgtctgagccttcacttcccatagaggattcccaggatctgtataacgcctccccagagcctaagacacttttcctaggagcaggagacttccagttctgtttagaagatgacactcagagccaactgttggatgcagatgggttcttaaatgttagaaaccacaggaatcagtaccaagctttgaagcctcgattgccattggccagtatggatgagaatgccatggatgccaacatggatgagctgttggatttgtgtactggaaagttcacatctcaggctgaaaaacatctacccaggaagagtgacaagaaagagaacatggaggaacttctgaacctttgttcaggaaaattcacttctcaggatgcctccactccagcctcatcagagttaaataaacaggagaaggagagcagcatgggtgatccaatggaagaagcacttgctctttgctcaggctcttttcccacagacaaggaagaggaagacgaggaggaggaatttggagactttcggcttgtttcaaatgataatgagtttgatagtgatgaggatgaacacagtgactctggtaatgatctggcactggaagaccatgaagatgatgatgaagaagaactcctgaagcgatctgagaagttgaaaaggcaaatgaggttgaggaaatacctggaggatgaggcagaggtgtcaggaagtgatgtgggaagcgaagatgagtatgatggggaagaaattgatgaatatgaagaggacgtaattgatgaagtacttccttctgatgaggaactgcagagtcaaatcaagaaaatacacatgaaaactatgttggatgatgataagcgacagctacgtttataccaagagaggtaccttgctgatggggatctgcacagcgatggtcctgggcgaatgaggaagtttcgatggaaaaacatagatgatgcttcccagatggacttgttccacagagactctgatgatgatcagactgaagaacagcttgatgagtcagaagccaggtggaggaaggagcgaattgaacgagagcagtggcttcgggacatggcacagcaggggaaaattacagctgaagaagaagaagaaattggggaggacagtcagtttatgatactggccaagaaagttacagccaaagcactgcagaagaatgccagtcgccctatggttattcaggaatcaaagtctttgctcagaaatccttttgaagccatcagaccaggaagtgctcaacaggtgaagacaggctcactgctaaaccagcccaaagctgtgcttcagaaactggctgctctctctgaccataaccccagtgctcctcgaaattcaagaaactttgtctttcatacactttctcctgtcaaggctgaggcggcaaaggaatcgtctaagtctcagaagatcccagagaaggactctgactggctcacctggagtggagctcctatccctggattcttcaggctttcatttgacccacatggttaagctgggagagacagagtccaaagagaggcggagaagggctattctgggcagaacaaacaattgatgactttatggctctgtggtctgggcagaactgcataaccctagatcaccaaagctgagagcctttaggagtgaggatttgggccgggcatggtggctcacgcctgtaatcccagcactttgggaggccgaggtgggtggatcacaaggtcaggagatcaagaccaacctgaccaacatggtgaggccccatctctactaaaaatacaaaaattagctgacgtgatgcatgcacctgtaatcccagctactcgggaggctgaggcgggagaatcgcttgaacccgggaggttggaggttgcggtgggccgagattgcgccactgcactccagcctgggcgacagagcgggactccatctcaaaaaaaaaaaaaaaaaagtgaggatttgggtcaccccaggctgaaggccaggggaacctgaatgataagggaagggaaaacttaggccacagtctgattagaaatggggctgaattccaccctgtttttcctttactggagattcaatttgaattactctgcctcccttcttattccttttcccttttaaaatagtcatcataatcataaaaatttcttttcc

SEQ ID NO: 15897 - DNA, 630 bp, Homo sapiens
ataccagatgactcttctttcctcaggtgaagacaggctcactgctaaaccagcccaaagctgtgcttcagaaactggctgctctctctgaccataaccccagtgctcctcgaaattcaagaaactttgtctttcatacactttctcctgtcaaggctgaggcggcaaaggaatcgtctaagtctcaggtaaagaaaaggggtccatctttcatgacttctccttcacctaagcacctcaaaacagatgatagcacttcaggattgacgcgaagcatcttcaaatatttggagagctaacaccatcaaaggtgccaaaatctacattgagactgctttgagaagtttctagcactgaaagttggaattgacactccagccaatgatccttccttctttcataatcaatgcaataagattgcagacagaaattccagtgatttctactgcacagctctggacatctcttttcctagtattattccctgaattggccactgatttcaattctgcagtatttacaacatcaacaactcatggaatacttgggtgaggtttcctttttttttttttttttaagatgggagtctcactctgttgcccagcttggagtgcagtggcgtgatctcgg

SEQ ID NO: 15898 - DNA, 418 bp, Homo sapiens
aagtatattgtcattttctaggttcacctagaaatcaatgacccaaacgtcatttcacaagaggaagcagatagtccttcagatagtggacagggcagctatgaaacaattggacccttgagtgaaggagattcagatgaagagatatttgtaagtaagaagttgaaaaacaggaaggttctacaagacagtgattccgaaacagaggacacaaatgcctctccagagaaaactacctatgacagtgccgaggaggaaaataaagagaatttatatgctgggaaaaatacataatcgtataaggggtcttgtcatggaactgatccaggttgagttctggtgttttagaaagcagtttcacataggcgccaccacattctattccattttggaaattaacctcatactgaacaatgag

SEQ ID NO: 15899 - DNA, 4585 bp, Homo sapiens
agcactgctgggctggagacggcgggagccgctgctctccggctgagggaatcagagacagctccgtccctagtggagcgcaggggaggcagaagtcatgacaggcgaggtgggttctgaggttcacctagaaatcaatgacccaaacgtcatttcacaagaggaagcagatagtccttcagatagtggacagggcagctatgaaacaattggacccttgagtgaaggagattcagatgaagagatatttgtaagtaagaagttgaaaaacaggaaggttctacaagacagtgattccgaaacagaggacacaaatgcctctccagagaaaactacctatgacagtgccgaggaggaaaataaagagaatttatatgctgggaaaaatacaaaaatcaaaaggatttacaaaactgtggcagacagtgatgaaagttacatggaaaagtctttgtatcaggaaaatcttgaagcgcaagtgaaaccttgcttagagctgagtcttcagtctggaaactctacagactttaccactgacagaaagagttccaaaaagcacatacatgataaagaaggaactgcaggaaaagcaaaagtaaaatcaaaaagaagacttgagaaagaggagagaaaaatggaaaaaattagacagctaaaaaagaaggaaacaaaaaaccaggaagatgatgtagaacagccatttaatgacagtggctgtcttcttgtggataaagacctttttgaaactgggttggaggatgaaaataactctccattggaagatgaagagtcattagaatcaataagagcagctgtaaaaaacaaagtaaaaaagcacaagaaaaaagaaccatctttggagagtggggtccattcatttgaggaaggaagtgagttatcaaaaggaaccacgaggaaggaaagaaaggcagccagattaagtaaagaagcattaaaacaactgcatagtgagactcagcgccttattcgagagtctgcactgaaccttccatatcatatgcctgagaataaaaccattcatgatttcttcaaacgtaaaccccggcccacttgccacggaaatgccatggcactattgaagtcatctaaatatcagtcaagccatcacaaagaaatcatagacactgcaaatactactgaaatgaacagtgatcaccatagtaaaggttctgagcagacaacaggtgcagaaaatgaagtggaaactaatgcactccctgtagtttcaaaggaaacccagatcattactggatcagatgagtcttgcaggaaggatttggtaaaaaatgaagagctagaaattcaggagaaacagaagcagagtgacattagaccttcacctggggacagctcagtgttgcaacaggaatccaacttcctcgggaacaatcacagtgaggaatgtcaggttggagggcttgtagcatttgaacctcatgccctggagggtgaaggcccccaaaatccagaagaaacagatgagaaagtggaagagcctgagcagcaaaataaatcatcagcagttgggccacctgaaaaagtgagacggtttactctggatagacttaagcaactgggagtagatgtttccattaaaccacggctaggtgctgatgaagattcctttgtgatacttgaacctgaaaccaacagagaactggaagccttgaagcagcgtttctggaagcatgctaatccagcagccaaacccagggctggtcagacagtgaatgtgaacgtcatagtgaaagacatgggcactgatggaaaggaagagctaaaagcagatgtggtacctgtgactttagcacctaagaagttggatggagcaagccacacaaaaccaggtgaaaagcttcaggtgttaaaagctaaactgcaagaagcaatgaaactccgaaggtttgaggagcgccagaagcgccaagcactgtttaaattagataatgaagatgggtttgaggaagaggaggaggaagaggaagaaatgacagatgagtctgaggaagatggagaagagaaggtagagaaagaagagaaagaggaagaactagaggaagaggaggagaaagaagaggaggaggaagaagaaggaaatcaggaggacagctcttccaagatgggttactttcctactgaagaaaaatcagaaacagatgaaaactcaggcaagcagcctagcaaactggatgaggatgattcatgttcattgctaacaaaggagagcagccacaatagcagctttgagctgattggctccacgattccatcctatcagccttgcaacagacaaacaggccgtgggaccagttttttccctacagcaggaggattcagatctccttcccctgggctatttcgagccagtttggtcagctcagcttctaagagttcagggaaactgtctgagccttcacttcccatagaggattcccaggatctgtataacgcctccccagagcctaagacacttttcctaggagcaggagacttccagttctgtttagaagatgacactcagagccaactgttggatgcagatgggttcttaaatgttagaaaccacaggaatcagtaccaagctttgaagcctcgattgccattggccagtatggatgagaatgccatggatgccaacatggatgagctgttggatttgtgtactggaaagttcacatctcaggctgaaaaacatctacccaggaagagtgacaagaaagagaacatggaggaacttctgaacctttgttcaggaaaattcacttctcaggatgcctccactccagcctcatcagagttaaataaacaggagaaggagagcagcatgggtgatccaatggaagaagcacttgctctttgctcaggctcttttcccacagacaaggaagaggaagacgaggaggaggaatttggagactttcggcttgtttcaaatgataatgagtttgatagtgatgaggatgaacacagtgactctggtaatgatctggcactggaagaccatgaagatgatgatgaagaagaactcctgaagcgatctgagaagttgaaaaggcaaatgaggttgaggaaatacctggaggatgaggcagaggtgtcaggaagtgatgtgggaagcgaagatgagtatgatggggaagaaattgatgaatatgaagaggacgtaattgatgaagtacttccttctgatgaggaactgcagagtcaaatcaagaaaatacacatgaaaactatgttggatgatgataagcgacagctacgtttataccaagagaggtaccttgctgatggggatctgcacagcgatggtcctgggcgaatgaggaagtttcgatggaaaaacatagatgatgcttcccagatggacttgttccacagagactctgatgatgatcagactgaagaacagcttgatgagtcagaagccaggtggaggaaggagcgaattgaacgagagcagtggcttcgggacatggcacagcaggggaaaattacagctgaagaagaagaagaaattggggaggacagtcagtttatgatactggccaagaaagttacagccaaagcactgcagaagaatgccagtcgccctatggttattcaggaatcaaagtctttgctcagaaatccttttgaagccatcagaccaggaagtgctcaacaggtgaagacaggctcactgctaaaccagcccaaagctgtgcttcagaaactggctgctctctctgaccataaccccagtgctcctcgaaattcaagaaactttgtctttcatacactttctcctgtcaaggctgaggcggcaaaggaatcgtctaagtctcagaagatcccagagaaggactctgactggctcacctggagtggagctcctatccctggattcttcaggctttcatttgacccacatggttaagctgggagagacagagtccaaagagaggcggagaagggctattctgggcagaacaaacaattgatgactttatggctctgtggtctgggcagaactgcataaccctagatcaccaaagctgagagcctttaggagtgaggatttgggccgggcatggtggctcacgcctgtaatcccagcactttgggaggccgaggtgggtggatcacaaggtcaggagatcaagaccaacctgaccaacatggtgaggccccatctctactaaaaatacaaaaattagctgacgtgatgcatgcacctgtaatcccagctactcgggaggctgaggcgggagaatcgcttgaacccgggaggttggaggttgcggtgggccgagattgcgccactgcactccagcctgggcgacagagcgggactccatctcaaaaaaaaaaaaaaaaaagtgaggatttgggtcaccccaggctgaaggccaggggaacctgaatgataagggaagggaaaacttaggccacagtctgattagaaatggggctgaattccaccctgtttttcctttactggagattcaatttgaattactctgcctcccttcttattccttttcccttttaaaatagtcatcataatcataaaaatttcttttcc

SEQ ID NO: 15900 - DNA, 3325 bp, Homo sapiens
atcccttgtctgctgcagggtataggatggaatcgtggagccaatcagctcaaagctgctagtgtggctgctctcctttgttaggggggacatgaatcatcctcatccagttgctaggctgctggcctgagttttcatctgttctgatttatcttcagtaggaaagtaacccatcttggaagagctgtccttaaacagaagtaaagtagaatctgatgaagattcctttgtgatacttgaacctgaaaccaacagagaactggaagccttgaagcagcgtttctggaagcatgctaatccagcagccaaacccagggctggtcagacagtgaatgtgaacgtcatagtgaaagacatgggcactgatggaaaggaagagctaaaagcagatgtggtacctgtgactttagcacctaagaagttggatggagcaagccacacaaaaccaggtgaaaagcttcaggtgttaaaagctaaactgcaagaagcaatgaaactccgaaggtttgaggagcgccagaagcgccaagcactgtttaaattagataatgaagatgggtttgaggaagaggaggaggaagaggaagaaatgacagatgagtctgaggaagatggagaagagaaggtagagaaagaagagaaagaggaagaactagaggaagaggaggagaaagaagaggaggaggaagaagaaggaaatcaggagactgcagaattccttcttagtagtgaagaaatagaaacaaaagatgaaaaagaaatggataaagaaaataatgatggcagtagtgaaattggcaaggcagttggcttcctctctgttcccaagtctctctcatcagattctactttacttctgtttaaggacagctcttccaagatgggttactttcctactgaagaaaaatcagaaacagatgaaaactcaggcaagcagcctagcaaactggatgaggatgattcatgttcattgctaacaaaggagagcagccacaatagcagctttgagctgattggctccacgattccatcctatcagccttgcaacagacaaacaggccgtgggaccagttttttccctacagcaggaggattcagatctccttcccctgggctatttcgagccagtttggtcagctcagcttctaagagttcagggaaactgtctgagccttcacttcccatagaggattcccaggatctgtataacgcctccccagagcctaagacacttttcctaggagcaggagacttccagttctgtttagaagatgacactcagagccaactgttggatgcagatgggttcttaaatgttagaaaccacaggaatcagtaccaagctttgaagcctcgattgccattggccagtatggatgagaatgccatggatgccaacatggatgagctgttggatttgtgtactggaaagttcacatctcaggctgaaaaacatctacccaggaagagtgacaagaaagagaacatggaggaacttctgaacctttgttcaggaaaattcacttctcaggatgcctccactccagcctcatcagagttaaataaacaggagaaggagagcagcatgggtgatccaatggaagaagcacttgctctttgctcaggctcttttcccacagacaaggaagaggaagacgaggaggaggaatttggagactttcggcttgtttcaaatgataatgagtttgatagtgatgaggatgaacacagtgactctggtaatgatctggcactggaagaccatgaagatgatgatgaagaagaactcctgaagcgatctgagaagttgaaaaggcaaatgaggttgaggaaatacctggaggatgaggcagaggtgtcaggaagtgatgtgggaagcgaagatgagtatgatggggaagaaattgatgaatatgaagaggacgtaattgatgaagtacttccttctgatgaggaactgcagagtcaaatcaagaaaatacacatgaaaactatgttggatgatgataagcgacagctacgtttataccaagagaggtaccttgctgatggggatctgcacagcgatggtcctgggcgaatgaggaagtttcgatggaaaaacatagatgatgcttcccagatggacttgttccacagagactctgatgatgatcagactgaagaacagcttgatgagtcagaagccaggtggaggaaggagcgaattgaacgagagcagtggcttcgggacatggcacagcaggggaaaattacagctgaagaagaagaagaaattggggaggacagtcagtttatgatactggccaagaaagttacagccaaagcactgcagaagaatgccagtcgccctatggttattcaggaatcaaagtctttgctcagaaatccttttgaagccatcagaccaggaagtgctcaacaggtgaagacaggctcactgctaaaccagcccaaagctgtgcttcagaaactggctgctctctctgaccataaccccagtgctcctcgaaattcaagaaactttgtctttcatacactttctcctgtcaaggctgaggcggcaaaggaatcgtctaagtctcagaagatcccagagaaggactctgactggctcacctggagtggagctcctatccctggattcttcaggctttcatttgacccacatggttaagctgggagagacagagtccaaagagaggcggagaagggctattctgggcagaacaaacaattgatgactttatggctctgtggtctgggcagaactgcataaccctagatcaccaaagctgagagcctttaggagtgaggatttgggccgggcatggtggctcacgcctgtaatcccagcactttgggaggccgaggtgggtggatcacaaggtcaggagatcaagaccaacctgaccaacatggtgaggccccatctctactaaaaatacaaaaattagctgacgtgatgcatgcacctgtaatcccagctactcgggaggctgaggcgggagaatcgcttgaacccgggaggttggaggttgcggtgggccgagattgcgccactgcactccagcctgggcgacagagcgggactccatctcaaaaaaaaaaaaaaaaaagtgaggatttgggtcaccccaggctgaaggccaggggaacctgaatgataagggaagggaaaacttaggccacagtctgattagaaatggggctgaattccaccctgtttttcctttactggagattcaatttgaattactctgcctcccttcttattccttttcccttttaaaatagtcatcataatcataaaaatttcttttcc

SEQ ID NO: 15901 - DNA, 2845 bp, Homo sapiens
cgcagtcttctcccatcagtcacagggatgaggctgacacaagtaaaatgaaagtttgtggtaagtactaacatgatctttattttacattccattatctctgatcaacctcatccttaagttcatatatacatgattattataggaaaataagtattggtaaggatgtggagaaatcagagccctcatacactgctgatgggagaagatgcgtcttctcccatcagctttacctacctgccttatttcaggtactctttacagtatgtattcaagtaagcaagctgaagcccagagaagatacaatggccacagggacaccacaggaggcacagctgatgggaccgcatctctctcatcagattctactttacttctgtttaaggacagctcttccaagatgggttactttcctactgaagaaaaatcagaaacagatgaaaactcaggcaagcagcctagcaaactggatgaggatgattcatgttcattgctaacaaaggagagcagccacaatagcagctttgagctgattggctccacgattccatcctatcagccttgcaacagacaaacaggccgtgggaccagttttttccctacagcaggaggattcagatctccttcccctgggctatttcgagccagtttggtcagctcagcttctaagagttcagggaaactgtctgagccttcacttcccatagaggattcccaggatctgtataacgcctccccagagcctaagacacttttcctaggagcaggagacttccagttctgtttagaagatgacactcagagccaactgttggatgcagatgggttcttaaatgttagaaaccacaggaatcagtaccaagctttgaagcctcgattgccattggccagtatggatgagaatgccatggatgccaacatggatgagctgttggatttgtgtactggaaagttcacatctcaggctgaaaaacatctacccaggaagagtgacaagaaagagaacatggaggaacttctgaacctttgttcaggaaaattcacttctcaggatgcctccactccagcctcatcagagttaaataaacaggagaaggagagcagcatgggtgatccaatggaagaagcacttgctctttgctcaggctcttttcccacagacaaggaagaggaagacgaggaggaggaatttggagactttcggcttgtttcaaatgataatgagtttgatagtgatgaggatgaacacagtgactctggtaatgatctggcactggaagaccatgaagatgatgatgaagaagaactcctgaagcgatctgagaagttgaaaaggcaaatgaggttgaggaaatacctggaggatgaggcagaggtgtcaggaagtgatgtgggaagcgaagatgagtatgatggggaagaaattgatgaatatgaagaggacgtaattgatgaagtacttccttctgatgaggaactgcagagtcaaatcaagaaaatacacatgaaaactatgttggatgatgataagcgacagctacgtttataccaagagaggtaccttgctgatggggatctgcacagcgatggtcctgggcgaatgaggaagtttcgatggaaaaacatagatgatgcttcccagatggacttgttccacagagactctgatgatgatcagactgaagaacagcttgatgagtcagaagccaggtggaggaaggagcgaattgaacgagagcagtggcttcgggacatggcacagcaggggaaaattacagctgaagaagaagaagaaattggggaggacagtcagtttatgatactggccaagaaagttacagccaaagcactgcagaagaatgccagtcgccctatggttattcaggaatcaaagtctttgctcagaaatccttttgaagccatcagaccaggaagtgctcaacaggtgaagacaggctcactgctaaaccagcccaaagctgtgcttcagaaactggctgctctctctgaccataaccccagtgctcctcgaaattcaagaaactttgtctttcatacactttctcctgtcaaggctgaggcggcaaaggaatcgtctaagtctcagaagatcccagagaaggactctgactggctcacctggagtggagctcctatccctggattcttcaggctttcatttgacccacatggttaagctgggagagacagagtccaaagagaggcggagaagggctattctgggcagaacaaacaattgatgactttatggctctgtggtctgggcagaactgcataaccctagatcaccaaagctgagagcctttaggagtgaggatttgggccgggcatggtggctcacgcctgtaatcccagcactttgggaggccgaggtgggtggatcacaaggtcaggagatcaagaccaacctgaccaacatggtgaggccccatctctactaaaaatacaaaaattagctgacgtgatgcatgcacctgtaatcccagctactcgggaggctgaggcgggagaatcgcttgaacccgggaggttggaggttgcggtgggccgagattgcgccactgcactccagcctgggcgacagagcgggactccatctcaaaaaaaaaaaaaaaaaagtgaggatttgggtcaccccaggctgaaggccaggggaacctgaatgataagggaagggaaaacttaggccacagtctgattagaaatggggctgaattccaccctgtttttcctttactggagattcaatttgaattactctgcctcccttcttattccttttcccttttaaaatagtcatcataatcataaaaatttcttttcc

SEQ ID NO: 15902 - DNA, 1915 bp, Homo sapiens
gctttcaacaacttatttattgattcattgatttacattttagggaagaggaagacgaggaggaggaatttggagactttcggcttgtttcaaatgataatgagtttgatagtgatgaggtgagtatgaagggaacaaagtaatcataactgagctccatgtattgctgccctcaagtgtttttttcccctcagttcttgagaattctaagtttggcatcttatcagaaacaatttcctagaatgaggtatttgggcagatgtttataaatccttttttcattgaggacgcattttattctgcttaatttggatatgatgctgattttgtaggatgaacacagtgactctggtaatgatctggcactggaagaccatgaagatgatgatgaagaagaactcctgaagcgatgaggttgaggaaatacctggaggatgaggcagaggtgtcaggaagtgatgtgggaagcgaagatgagtatgatggggaagaaattgatgaatatgaagaggacgtaattgatgaagtacttccttctgatgaggaactgcagagtcaaatcaagaaaatacacatgaaaactatgttggatgatgataagcgacagctacgtttataccaagagaggtaccttgctgatggggatctgcacagcgatggtcctgggcgaatgaggaagtttcgatggaaaaacatagatgatgcttcccagatggacttgttccacagagactctgatgatgatcagactgaagaacagcttgatgagtcagaagccaggtggaggaaggagcgaattgaacgagagcagtggcttcgggacatggcacagcaggggaaaattacagctgaagaagaagaagaaattggggaggacagtcagtttatgatactggccaagaaagttacagccaaagcactgcagaagaatgccagtcgccctatggttattcaggaatcaaagtctttgctcagaaatccttttgaagccatcagaccaggaagtgctcaacaggtgaagacaggctcactgctaaaccagcccaaagctgtgcttcagaaactggctgctctctctgaccataaccccagtgctcctcgaaattcaagaaactttgtctttcatacactttctcctgtcaaggctgaggcggcaaaggaatcgtctaagtctcagaagatcccagagaaggactctgactggctcacctggagtggagctcctatccctggattcttcaggctttcatttgacccacatggttaagctgggagagacagagtccaaagagaggcggagaagggctattctgggcagaacaaacaattgatgactttatggctctgtggtctgggcagaactgcataaccctagatcaccaaagctgagagcctttaggagtgaggatttgggccgggcatggtggctcacgcctgtaatcccagcactttgggaggccgaggtgggtggatcacaaggtcaggagatcaagaccaacctgaccaacatggtgaggccccatctctactaaaaatacaaaaattagctgacgtgatgcatgcacctgtaatcccagctactcgggaggctgaggcgggagaatcgcttgaacccgggaggttggaggttgcggtgggccgagattgcgccactgcactccagcctgggcgacagagcgggactccatctcaaaaaaaaaaaaaaaaaagtgaggatttgggtcaccccaggctgaaggccaggggaacctgaatgataagggaagggaaaacttaggccacagtctgattagaaatggggctgaattccaccctgtttttcctttactggagattcaatttgaattactctgcctcccttcttattccttttcccttttaaaatagtcatcataatcataaaaatttcttttcc

SEQ ID NO: 15903 - DNA, 522 bp, Homo sapiens
ttccatcgcttgaaaatttctgtaacgaaatattagagaaaaaaggtacccaaagccctgaagtacatgtgaaagtcacaactagtaacgtgataaaagtctttaaagtctgcgtgttgcattaaggctaggttgtgtttgtttttttttttcttgcaggttaagttcagtgaactaactgttgacatgttccggatgttacaagctctggaaagggagccaatgaatttagcttcccagatgaataaaccaggaatgcaggaatcagctgacaagcctactagacgagaaaacccccacaagtatctgctctacaaaccaaccttcagccagctatataccttcttagcagcgtcttttaaggagctgcctgccaatagcgtgcttctgatttacctgtcggccactggcgttttccccacaggtcgttctgatagtgaaggtccttatgattttggaggtgtacttactaatagtaaccgggatattattaatggagatgccatccacaaacgaaatcag

SEQ ID NO: 15904 - DNA, 2229 bp, Homo sapiens
agtgttgttcttatcttctggttctttgttgatcttctagttgttctatcccttattgaaagtggggtactggagtctccaactgacatacttttcttttagctttttattttggaaaatttcaaacatatatgaaagaagagataatgtacttactcatcacccagcttcaacatttatcaacatcttgccaatcttactgaatctatccttccttaccttttttaaaaatgtttcctagagtgtgtcaaagctcatcccagatgtcctaatgtttctagtaaatgcttctgcacaattctaaaagacaaggatgtttttaaacccagccccgacactatcatacctcacaagattcatgctaattcctcagtgtcttctagtcccaagtccatgctcaagtgtccccccctgtccaggcaccctcttcaggggtcctccatgtttcatagcgagaaggggccctgagagttgggcaccccgggcaggctggctggagggggctttggaaaggaaggctttggccagcgtgtgagggtgcaggtctcaccagctcctgtttggtctgtttcaggaacaaatgtggtatctggggctggcggtctgagaagatggaaactgttagcggctacgaggccaaggcaggagaggctaggggtggggggctgggggtaggagatgaggtccaggaactcagctcctctccacatccatcccagagtagcccctgggctctggaaaccctgagcatttgtgggaactcagcgggcctgagtgcccagcccctgcggagtacacagggctcacccacatcatgggcccctacccagggtaccgagatcaaaagaggagtgtgttcctcttgaccctggggctgcatctcctcgttggtgacttcctggggttcagaccctgccacctcctccattttggggagcaagatctcatctgtctctgggacaggaggacctgggttctgcactggtgaggctgagtgtggggagcaggctctgagcccccagctccccgtgtcccctgctccccaggtgtacagtgccaccaacgtggagctggtgacacgcacacgcacggagcacctctctgatcaggacaagtcgaggagcaaagcggggaagactccattccagtccttcctggggatggcgcagcagcattcctcccacaccggggcccccgtgcagcaggcagccagccccaccaaccccacagccatctcccctgaggagtacttcgaccccaacttcagcctggagtcacggaacattggccgccccatcgagatgtccagcaaagtacagaggttcaaggcaacactgtggctgagtgaagagcacccgctctccctgggtgaccaggtgacccccatcatcgacctaatggccatcagcaacgctcactttgccaagctgcgcgacttcatcactctgcgccttccacctggcttccccgtcaaaattgagattccccttttccacgtgctcaatgcccgcatcaccttcagcaacctgtgtggctgtgatgagcccctgagctccgtgtgggtgccggcccccagctctgctgtcgccgcatcagggaaccctttcccgtgcgaggtggaccccaccgtgtttgaagtgcccaacgggtacagcgtgctgggcatggagcgcaacgagcccctccgggacgaggacgatgacctcctgcagttcgccatccagcagagcctgcttgaagcgggcactgaggcggagcaggtgaccgtctgggaagccctgaccaacacccggcccggtgcccgccctcctccccaggccacggtttatgaggaacagcttcagctggagcgggccctccaggaaagcctgcagctgtccacagagcccaggggcccaggatcccctcccaggacacccccagcccccggtccacccagctttgaagagcagctgcgcctggccctggagttgtcttcacgggagcaggaggagcgggagcggcgcgggcagcaggaggaggaggacttacagcggatcctgcagctgtcactcactgagcactgagccatagccccgggagggctggccaggccactccctgcccgcttttgtaatttatttatttataaactctctgctgctgagcttggggcctggagccccaggaatgagcaggcaggggagactgagatggaaataaagagactgtcgcagcaaaacaaaaaag

SEQ ID NO: 15905 - DNA, 540 bp, Homo sapiens
gtgcatgagctgttctagagtatcatgagtcatcgcgcagtgggttgctgcagcccgtgtctcactcagactgccggggtggttgggctcctgtggccacctttgtggggaggggtcaggtcaagatgtccccagtttcttgacttctgacctcatatgttttcccattaagacaaagatttaggctgtggttcacggcagctctttgcaccaatgttggcttgtcattggtgcggctgtgttgggggcagaatcctttgtgggtagcctaggaacctgacccttccagcaagagtttctctgacaacacatgccccctcttgccttaacagtcagtggaaacacttaaaaaaaaaaacaaaaaacctttattgagatataatctcatataccatataagatcacccatttaaagcatacagttcaatgacttttagtatatttattcagagatttgtacatcaccacagtcaattttagaacatttttatcacctcaggaagaaaccccccaccctttagctaactcttcgccaaactt

SEQ ID NO: 15906 - DNA, 2016 bp, Homo sapiens
cgaggcggggccgggatgcggcgctgaggcccagcatggccggcccgggccccaccttcccgctgcaccggctcgtctgggcgaaccggcatcgcgaactggaggccgcactgcacagccaccagcacgacattgaacaggaggacccccgcgggcggaccccactggagctggccgtgtctctgggaaacctggagtctgtgagagtgctccttcgacacaatgccaacgtgggcaaagagaaccgccagggctgggcagtcctgcaggaggcagtcagcactggagaccccgagatggtgcagctggtgctccagtatcgggactaccagagggccacgcagaggctggcgggcattccggaactgctcaacaaacttcgccaggcccccgatttctacgttgagatgaagtgggagttcaccagctgggtgccccttgtgtctaagatgtgcccaagcgatgtgtaccgcgtgtggaagcggggtgagagcctgcgagtagacaccagtctcctgggcttcgagcacatgacctggcagcggggccggaggagcttcatcttcaagggccaggaggcaggagccctggtgatggaagtggaccatgaccggcaggtggtgcatgtggagacactggggctcactctgcaggagcccgaaacactgctggccgccatgcggcccagcgaggagcatgtggccagtcgcctcacctctcctatcgtctccacccacctggacactcgtaatgtggcctttgagaggaacaaatgtggtatctggggctggcggtctgagaagatggaaactgttagcggctacgaggccaaggtgtacagtgccaccaacgtggagctggtgacacgcacacgcacggagcacctctctgatcaggacaagtcgaggagcaaagcggggaagactccattccagtccttcctggggatggcgcagcagcattcctcccacaccggggcccccgtgcagcaggcagccagccccaccaaccccacagccatctcccctgaggagtacttcgaccccaacttcagcctggagtcacggaacattggccgccccatcgagatgtccagcaaagtacagaggttcaaggcaacactgtggctgagtgaagagcacccgctctccctgggtgaccaggtgacccccatcatcgacctaatggccatcagcaacgctcactttgccaagctgcgcgacttcatcactctgcgccttccacctggcttccccgtcaaaattgagattccccttttccacgtgctcaatgcccgcatcaccttcagcaacctgtgtggctgtgatgagcccctgagctccgtgtgggtgccggcccccagctctgctgtcgccgcatcagggaaccctttcccgtgcgaggtggaccccaccgtgtttgaagtgcccaacgggtacagcgtgctgggcatggagcgcaacgagcccctccgggacgaggacgatgacctcctgcagttcgccatccagcagagcctgcttgaagcgggcactgaggcggagcaggtgaccgtctgggaagccctgaccaacacccggcccggtgcccgccctcctccccaggccacggtttatgaggaacagcttcagctggagcgggccctccaggaaagcctgcagctgtccacagagcccaggggcccaggatcccctcccaggacacccccagcccccggtccacccagctttgaagagcagctgcgcctggccctggagttgtcttcacgggagcaggaggagcgggagcggcgcgggcagcaggaggaggaggacttacagcggatcctgcagctgtcactcactgagcactgagccatagccccgggagggctggccaggccactccctgcccgcttttgtaatttatttatttataaactctctgctgctgagcttggggcctggagccccaggaatgagcaggcaggggagactgagatggaaataaagagactgtcgcagcaaaacaaaaaag

SEQ ID NO: 15907 - DNA, 1385 bp, Homo sapiens
aaatggcaggctggtaccggccggagatttaggattgctggccgccatgcggcccagcgaggagcatgtggccagtcgcctcacctctcctatcgtctccacccacctggacactcgtaatgtggcctttgagaggaacaaatgtggtatctggggctggcggtctgagaagatggaaactgttagcggctacgaggccaaggtgtacagtgccaccaacgtggagctggtgacacgcacacgcacggagcacctctctgatcaggacaagtcgaggagcaaagcggggaagactccattccagtccttcctggggatggcgcagcagcattcctcccacaccggggcccccgtgcagcaggcagccagccccaccaaccccacagccatctcccctgaggagtacttcgaccccaacttcagcctggagtcacggaacattggccgccccatcgagatgtccagcaaagtacagaggttcaaggcaacactgtggctgagtgaagagcacccgctctccctgggtgaccaggtgacccccatcatcgacctaatggccatcagcaacgctcactttgccaagctgcgcgacttcatcactctgcgccttccacctggcttccccgtcaaaattgagattccccttttccacgtgctcaatgcccgcatcaccttcagcaacctgtgtggctgtgatgagcccctgagctccgtgtgggtgccggcccccagctctgctgtcgccgcatcagggaaccctttcccgtgcgaggtggaccccaccgtgtttgaagtgcccaacgggtacagcgtgctgggcatggagcgcaacgagcccctccgggacgaggacgatgacctcctgcagttcgccatccagcagagcctgcttgaagcgggcactgaggcggagcaggtgaccgtctgggaagccctgaccaacacccggcccggtgcccgccctcctccccaggccacggtttatgaggaacagcttcagctggagcgggccctccaggaaagcctgcagctgtccacagagcccaggggcccaggatcccctcccaggacacccccagcccccggtccacccagctttgaagagcagctgcgcctggccctggagttgtcttcacgggagcaggaggagcgggagcggcgcgggcagcaggaggaggaggacttacagcggatcctgcagctgtcactcactgagcactgagccatagccccgggagggctggccaggccactccctgcccgcttttgtaatttatttatttataaactctctgctgctgagcttggggcctggagccccaggaatgagcaggcaggggagactgagatggaaataaagagactgtcgcagcaaaacaaaaaag

SEQ ID NO: 15908 - DNA, 1209 bp, Homo sapiens
tacgatcctaatgactacgggggaaggtgtacagtgccaccaacgtggagctggtgacacgcacacgcacggagcacctctctgatcaggacaagtcgaggagcaaagcggggaagactccattccagtccttcctggggatggcgcagcagcattcctcccacaccggggcccccgtgcagcaggcagccagccccaccaaccccacagccatctcccctgaggagtacttcgaccccaacttcagcctggagtcacggaacattggccgccccatcgagatgtccagcaaagtacagaggttcaaggcaacactgtggctgagtgaagagcacccgctctccctgggtgaccaggtgacccccatcatcgacctaatggccatcagcaacgctcactttgccaagctgcgcgacttcatcactctgcgccttccacctggcttccccgtcaaaattgagattccccttttccacgtgctcaatgcccgcatcaccttcagcaacctgtgtggctgtgatgagcccctgagctccgtgtgggtgccggcccccagctctgctgtcgccgcatcagggaaccctttcccgtgcgaggtggaccccaccgtgtttgaagtgcccaacgggtacagcgtgctgggcatggagcgcaacgagcccctccgggacgaggacgatgacctcctgcagttcgccatccagcagagcctgcttgaagcgggcactgaggcggagcaggtgaccgtctgggaagccctgaccaacacccggcccggtgcccgccctcctccccaggccacggtttatgaggaacagcttcagctggagcgggccctccaggaaagcctgcagctgtccacagagcccaggggcccaggatcccctcccaggacacccccagcccccggtccacccagctttgaagagcagctgcgcctggccctggagttgtcttcacgggagcaggaggagcgggagcggcgcgggcagcaggaggaggaggacttacagcggatcctgcagctgtcactcactgagcactgagccatagccccgggagggctggccaggccactccctgcccgcttttgtaatttatttatttataaactctctgctgctgagcttggggcctggagccccaggaatgagcaggcaggggagactgagatggaaataaagagactgtcgcagcaaaacaaaaaag

SEQ ID NO: 15909 - DNA, 2392 bp, Homo sapiens
cgaggcggggccgggatgcggcgctgaggcccagcatggccggcccgggccccaccttcccgctgcaccggctcgtctgggcgaaccggcatcgcgaactggaggccgcactgcacagccaccagcacgacattgaacaggaggacccccgcgggcggaccccactggagctggccgtgtctctgggaaacctggagtctgtgagagtgctccttcgacacaatgccaacgtgggcaaagagaaccgccagggctgggcagtcctgcaggaggcagtcagcactggagaccccgagatggtgcagctggtgctccagtatcgggactaccagagggccacgcagaggctggcgggcattccggaactgctcaacaaacttcgccaggcccccgatttctacgttgagatgaagtgggagttcaccagctgggtgccccttgtgtctaagatgtgcccaagcgatgtgtaccgcgtgtggaagcggggtgagagcctgcgagtagacaccagtctcctgggcttcgagcacatgacctggcagcggggccggaggagcttcatcttcaagggccaggaggcaggagccctggtgatggaagtggaccatgaccggcaggtggtgcatgtggagacactggggctcactctgcaggagcccgaaacactgctggccgccatgcggcccagcgaggagcatgtggccagtcgcctcacctctcctatcgtctccacccacctggacactcgtaatgtggcctttgagaggaacaaatgtggtatctggggctggcggtctgagaagatggaaactgttagcggctacgaggccaaggtgtacagtgccaccaacgtggagctggtgacacgcacacgcacggagcacctctctgatcaggacaagtcgaggagcaaagcggggaagactccattccagtccttcctggggatggcgcagcagcattcctcccacaccggggcccccgtgcagcaggcagccagccccaccaaccccacagccatctcccctgaggagtacttcgaccccaacttcagcctggagtcacggaacattggccgccccatcgagatgtccagcaaagtacagaggtgaggtctgagagctggctggggacttgcctcgggacaagggctcttgcagacccctctctgggcctgtcatagttagggacccactccctcggctggcttctctctggactccactcctggagggcaggagtcatgtctgccttatccatggtcctcagcccttagcaaggggcttggcacagaaaaccggtagtttgtctttgatgaatggatggtgccacccatgtatggttttctattgaatttcatgagtacctgctggggccagcgtggcacagtgggaagggcccccagcgacgtggcctgggagtggagcgtctgccttggtggaacagaacagttacgctcttgcctcgtgaggagccttgagcaggttcaaggcaacactgtggctgagtgaagagcacccgctctccctgggtgaccaggtgacccccatcatcgacctaatggccatcagcaacgctcactttgccaagctgcgcgacttcatcactctgcgccttccacctggcttccccgtcaaaattgagattccccttttccacgtgctcaatgcccgcatcaccttcagcaacctgtgtggctgtgatgagcccctgagctccgtgtgggtgccggcccccagctctgctgtcgccgcatcagggaaccctttcccgtgcgaggtggaccccaccgtgtttgaagtgcccaacgggtacagcgtgctgggcatggagcgcaacgagcccctccgggacgaggacgatgacctcctgcagttcgccatccagcagagcctgcttgaagcgggcactgaggcggagcaggtgaccgtctgggaagccctgaccaacacccggcccggtgcccgccctcctccccaggccacggtttatgaggaacagcttcagctggagcgggccctccaggaaagcctgcagctgtccacagagcccaggggcccaggatcccctcccaggacacccccagcccccggtccacccagctttgaagagcagctgcgcctggccctggagttgtcttcacgggagcaggaggagcgggagcggcgcgggcagcaggaggaggaggacttacagcggatcctgcagctgtcactcactgagcactgagccatagccccgggagggctggccaggccactccctgcccgcttttgtaatttatttatttataaactctctgctgctgagcttggggcctggagccccaggaatgagcaggcaggggagactgagatggaaataaagagactgtcgcagcaaaacaaaaaag

SEQ ID NO: 15910 - DNA, 2105 bp, Homo sapiens
cgaggcggggccgggatgcggcgctgaggcccagcatggccggcccgggccccaccttcccgctgcaccggctcgtctgggcgaaccggcatcgcgaactggaggccgcactgcacagccaccagcacgacattgaacaggaggacccccgcgggcggaccccactggagctggccgtgtctctgggaaacctggagtctgtgagagtgctccttcgacacaatgccaacgtgggcaaagagaaccgccagggctgggcagtcctgcaggaggcagtcagcactggagaccccgagatggtgcagctggtgctccagtatcgggactaccagagggccacgcagaggctggcgggcattccggaactgctcaacaaacttcgccaggcccccgatttctacgttgagatgaagtgggagttcaccagctgggtgccccttgtgtctaagatgtgcccaagcgatgtgtaccgcgtgtggaagcggggtgagagcctgcgagtagacaccagtctcctgggcttcgagcacatgacctggcagcggggccggaggagcttcatcttcaagggccaggaggcaggagccctggtgatggaagtggaccatgaccggcaggtggtgcatgtggagacactggggctcactctgcaggagcccgaaacactgctggccgccatgcggcccagcgaggagcatgtggccagtcgcctcacctctcctatcgtctccacccacctggacactcgtaatgtggcctttgagaggaacaaatgtggtatctggggctggcggtctgagaagatggaaactgttagcggctacgaggccaaggtgtacagtgccaccaacgtggagctggtgacacgcacacgcacggagcacctctctgatcaggacaagtcgaggagcaaagcggggaagactccattccagtccttcctggggatggcgcagcagcattcctcccacaccggggcccccgtgcagcaggcagccagccccaccaaccccacagccatctcccctgaggagtacttcgaccccaacttcagcctggagtcacggaacattggccgccccatcgagatgtccagcaaagtacagaggttcaaggcaacactgtggctgagtgaagagcacccgctctccctgggtgaccaggtgacccccatcatcgacctaatggccatcagcaacgctcactttgccaagctgcgcgacttcatcactctgcgccttccacctggcttccccgtcaaaattgagattccccttttccacgtgctcaatgcccgcatcaccttcagcaacctgtgtggctgtgatgagcccctgagctccgtgtgggtgccggcccccagctctgctgtcgccgcatcaggtaccccaacgggaggaagagggagcctgcacagctttctggtcaccaagccccgcgggttgagcgtggcccctctgccacctgcctagggaaccctttcccgtgcgaggtggaccccaccgtgtttgaagtgcccaacgggtacagcgtgctgggcatggagcgcaacgagcccctccgggacgaggacgatgacctcctgcagttcgccatccagcagagcctgcttgaagcgggcactgaggcggagcaggtgaccgtctgggaagccctgaccaacacccggcccggtgcccgccctcctccccaggccacggtttatgaggaacagcttcagctggagcgggccctccaggaaagcctgcagctgtccacagagcccaggggcccaggatcccctcccaggacacccccagcccccggtccacccagctttgaagagcagctgcgcctggccctggagttgtcttcacgggagcaggaggagcgggagcggcgcgggcagcaggaggaggaggacttacagcggatcctgcagctgtcactcactgagcactgagccatagccccgggagggctggccaggccactccctgcccgcttttgtaatttatttatttataaactctctgctgctgagcttggggcctggagccccaggaatgagcaggcaggggagactgagatggaaataaagagactgtcgcagcaaaacaaaaaag

SEQ ID NO: 15911 - DNA, 1687 bp, Homo sapiens
cgaggcggggccgggatgcggcgctgaggcccagcatggccggcccgggccccaccttcccgctgcaccggctcgtctgggcgaaccggcatcgcgaactggaggccgcactgcacagccaccagcacgacattgaacaggaggacccccgcgggcggaccccactggagctggccgtgtctctgggaaacctggagtctgtgagagtgctccttcgacacaatgccaacgtgggcaaagagaaccgccagggctgggcagtcctgcaggaggcagtcagcactggagaccccgagatggtgcagctggtgctccagtatcgggactaccagagggccacgcagaggctggcgggcattccggaactgctcaacaaacttcgccaggcccccgatttctacgttgagatgaagtgggagttcaccagctgggtgccccttgtgtctaagatgtgcccaagcgatgtgtaccgcgtgtggaagcggggtgagagcctgcgagtagacaccagtctcctgggcttcgagcacatgacctggcagcggggccggaggagcttcatcttcaagggccaggaggcaggagccctggtgatggaagtggaccatgaccggcaggtggtgcatgtggagacactggggctcactctgcaggagcccgaaacactgctggccgccatgcggcccagcgaggagcatgtggccagtcgcctcacctctcctatcgtctccacccacctggacactcgtaatgtggcctttgagaggaacaaatgtggtatctggggctggcggtctgagaagatggaaactgttagcggctacgaggccaaggtgtacagtgccaccaacgtggagctggtgacacgcacacgcacggagcacctctctgatcaggacaagtcgaggagcaaagcggggaagactccattccagtccttcctggggatggcgcagcagcattcctcccacaccggggcccccgtgcagcaggcagccagccccaccaaccccacagccatctcccctgaggagtacttcgaccccaacttcagcctggagtcacggaacattggccgccccatcgagatgtccagcaaagtacagaggttcaaggcaacactgtggctgagtgaagagcacccgctctccctgggtgaccaggtgacccccatcatcgacctaatggccatcagcaacgctcactttgccaagctgcgcgacttcatcactctgcgccttccacctggcttccccgtcaaaattgagattccccttttccacgtgctcaatgcccgcatcaccttcagcaacctgtgtggctgtgatgagcccctgagctccgtgtgggtgccggcccccagctctgctgtcgccgcatcagggaaccctttcccgtgcgaggtggaccccaccgtgtttgaagtgcccaacgggtacagcgtgctgggcatggagcgcaacgagcccctccgggacgaaggacttacagcggatcctgcagctgtcactcactgagcactgagccatagccccgggagggctggccaggccactccctgcccgcttttgtaatttatttatttataaactctctgctgctgagcttggggcctggagccccaggaatgagcaggcaggggagactgagatggaaataaagagactgtcgcagcaaaacaaaaaag

SEQ ID NO: 15912 - DNA, 580 bp, Homo sapiens
acggggaagccaggtggaaggcgcagagtgatgaagtcgcgcagcttggcaaagtgagcgttgctgatggccattaggtcgatgatgggggtcacctggtcacccagggagagcgggtgctcttcactcagccacagtgttgccttgaacctgcccagccgaccacaggacatggtttatgaggaacagcttcagctggggcgggccctccaggaaagcctgcagctgtccacagagcccaggggcccaggatcccctcccaggacacccccagcccccggtccacccagctttgaagagcagctgcgcctggccctggagttgtcttcacgggagcaggaggagcgggagcggcgcgggcagcaggaggaggaggacttacagcggatcctgcagctgtcactcactgagcactgagccatagccccgggagggctggccaggccactccctgcccgcttttgtaatttatttatttataaactctctgctgctgagcttggggcctggagccccaggaatgagcaggcaggggagactgagatggaaataaagagactgtcgcagcaaaacaaaaaag

SEQ ID NO: 15913 - DNA, 1401 bp, Homo sapiens
cgaggcggggccgggatgcggcgctgaggcccagcatggccggcccgggccccaccttcccgctgcaccggctcgtctgggcgaaccggcatcgcgaactggaggccgcactgcacagccaccagcacgacattgaacaggaggacccccgcgggcggaccccactggagctggccgtgtctctgggaaacctggagtctgtgagagtgctccttcgacacaatgccaacgtgggcaaagagaaccgccagggctgggcagtcctgcaggaggcagtcagcactggagaccccgagatggtgcagctggtgctccagtatcgggactaccagagggccacgcagaggctggcgggcattccggaactgctcaacaaacttcgccaggcccccgatttctacgttgagatgaagtgggagttcaccagctgggtgccccttgtgtctaagatgtgcccaagcgatgtgtaccgcgtgtggaagcggggtgagagcctgcgagtagacaccagtctcctgggcttcgagcacatgacctggcagcggggccggaggagcttcatcttcaagggccaggaggcaggagccctggtgatggaagtggaccatgaccggcaggtggtgcatgtggagacactggggctcactctgcaggagcccgaaacactgctggccgccatgcggcccagcgaggagcatgtggccagtcgcctcacctctcctatcgtctccacccacctggacactcgtaatgtggcctttgagaggtcggtcgggtcctggcacaccgtgggtgggatggggacggatagcaagagccaccattaatgagggcagggcgatccttgaagatcctggttcaggcctctgggctcactcacaaggggctgctcaggggcaggtgggttgctgcagcccgtgtctcactcagactgccggggtggttgggctcctgtggccacctttgtggggaggggtcaggtcaagatgtccccagtttcttgacttctgacctcatatgttttcccattaagacaaagatttaggctgtggttcacggcagctctttgcaccaatgttggcttgtcattggtgcggctgtgttgggggcagaatcctttgtgggtagcctaggaacctgacccttccagcaagagtttctctgacaacacatgccccctcttgccttaacagtcagtggaaacacttaaaaaaaaaaacaaaaaacctttattgagatataatctcatataccatataagatcacccatttaaagcatacagttcaatgacttttagtatatttattcagagatttgtacatcaccacagtcaattttagaacatttttatcacctcaggaagaaaccccccaccctttagctaactcttcgccaaactt

SEQ ID NO: 15914 - DNA, 1358 bp, Homo sapiens
cgaggcggggccgggatgcggcgctgaggcccagcatggccggcccgggccccaccttcccgctgcaccggctcgtctgggcgaaccggcatcgcgaactggaggccgcactgcacagccaccagcacgacattgaacaggaggacccccgcgggcggaccccactggagctggccgtgtctctgggaaacctggagtctgtgagagtgctccttcgacacaatgccaacgtgggcaaagagaaccgccagggctgggcagtcctgcaggaggcagtcagcactggagaccccgagatggtgcagctggtgctccagtatcgggactaccagagggccacgcagaggctggcgggcattccggaactgctcaacaaacttcgccaggcccccgatttctacgttgagatgaagtgggagttcaccagctgggtgccccttgtgtctaagatgtgcccaagcgatgtgtaccgcgtgtggaagcggggtgagagcctgcgagtagacaccagtctcctgggcttcgagcacatgacctggcagcggggccggaggagcttcatcttcaagggccaggaggcaggagccctggtgatggaagtggaccatgaccggcaggtggtgcatgtggagacactggggctcactctgcaggagcccgaaacactgctggccgccatgcggcccagcgaggagcatgtggccagtcgcctcacctctcctatcgtctccacccacctggacactcgtaatgtggcctttgagaggaacaaatgtggtatctggggctggcggtctgagaagatggaaactgttagcggctacgaggccaaggtgtacagtgccaccaacgtggagctggtgacacgcacacgcacggagcacctctctgatcaggacaagtcgaggagcaaagcggggaagactccattccagtccttcctggggatggcgcagcagcattcctcccacaccggggcccccgtgcagcaggcagccagccccaccaaccccacagccatctcccctgaggagtacttcgaccccaacttcagcctggagtcacggaacattggccgccccatcgagatgtccagcaaagtacagaggtgaggtctgagagctggctggggacttgcctcgggacaagggctcttgcagacccctctctgggcctgtcatagttagggacccactccctcggctggcttctctctggactccactcctggagggcaggagtcatgtctgccttatccatggtcctcagcccttagcaaggggcttggcacagaaaaccggtagtttgtctttgatgaatggatggtgccgatgatagcgagtgacctctagaacagc

SEQ ID NO: 15915 - DNA, 571 bp, Homo sapiens
  misc_feature (20)..(20): n is a, c, g, or t
gacgtctatatttggaatanacagggaaaactaggaatttaatagctgagttcacgtcctgccaacaaaacttagaaggaatcaacaaacttcaagttcaggcgcatatgtggtaccctgtggcctagcgagaagatcgcagatgacatgggaggccttcatcttctgcatctgtccgaccttttcagctcctcttctggtcactctgtcaagggggcctggaactcctgagaagtgaaaggaccagccctatctcagatggtgcgggtttcttcgccctgacctctgccatgtttgcttggagccccagagctcatccttcaaggcctttttaaaaatagcacagcctctgtcaagccttcttgaaaaattaaattttttattgtaaaaactttcaaacatataaagaatgtgaaagaataggcaattatctgtatactcatcacccacattcaataattaacattttgccgtcttagcctcatctacctatttctactgaatcatatgaaactcacttgcagacattgtgatatagaacaccaaaatccataaacatgtgtcgcctaaa

SEQ ID NO: 15916 - DNA, 1631 bp, Homo sapiens
actatctgcttgttcatctgagtgtcggcacaaaccagcagaggcggtgacgatgctctcgggcatagaggcggcggcaggggaatatgaggactcggagctgcggtgccgcgtggctgtggaggagctgagcccgggcgggcagccgcgaaggcgccaggccctgcgcaccgcggagctgagcctgggtcgcaacgagcgccgcgagttgatgctgcggctgcaagcgccagggcccgcggggcggccgcgctgcttccctctgcgcgccgcgcgcctcttcacgcgtttcgccgaggccgggcgcagcaccctgcggctccccgcccacgacacccccggggccggcgcagtgcagctgctgctctcggactgccccccagaccgcctgcgccgcttcctgcgcacattgcgcctcaagctggctgcggccccgggtcccgggccggcctccgcccgagcgcagctgctgggcccgcggccccgcgacttcgtcaccatcagccctgtgcagcccgaggagcggcggctcagggcggccacccgggttccggacactacgctggtgaagcggcctgtggagccccaggctggggccgagcctagcacagaagccccaaggtggcccctgcctgtgaagaggctgagcttgccctccaccaagccacagctttctgaggaacaggctgctgtgctgagggccgtcctgaaaggccagagcatcttcttcactgggagtgcaggtagtgggggcagagaggaggtagggggacagtggtggggtgggatagaggaacagggagacctgtctaactttgcccctgtccaggaacagggaagtcatatctgctaaagcgaatcctgggctcactgccccccacaggcactgtggccactgccagcactggggtggcagcctgccacatcgggggcaccaccctccatgcctttgcaggtaagtaggaacccctagggcttgagctaagagcaagcccagcttctgggaagggagagaggggaggtctgcataaagagggagttttgggggctgggcgccgtggctcactcttgtaatcccaaaactttaggaggccaaggtgggaggatcgcttgagcccaggagtttgagaccagcctggccaacacagtaaaccctgtctccacaaaatttaaaaattagcggccgggcgcagtggctcacgcctgtaatcccagcactttgggaggccgaggcaggcggatcacaaggtcaggagatcaagactatcctggctaacacggtaaaaccctgtctctactaaaaatacaaaaaaattagccaggcatggtggcaagcgcctgtagtcccagctactctggaggctgaggcaggagaatggcgtgaacccaggaggcagagcttgcagtgagccgagatcacgccactgcacttgagcctgggcgacacagcgagactccatctcaaaacaaaacaaaacaaaattagctgagcatggtggtgtgtgcctgtagtcccagctactatggaggttgaggtgggaggatcgcttgagcccatgaggcccaggttacagtgagccaagatcgtgccactgcacttcagcctgggtgacagaaagagaccttctctc

SEQ ID NO: 15917 - DNA, 2739 bp, Homo sapiens
actatctgcttgttcatctgagtgtcggcacaaaccagcagaggcggtgacgatgctctcgggcatagaggcggcggcaggggaatatgaggactcggagctgcggtgccgcgtggctgtggaggagctgagcccgggcgggcagccgcgaaggcgccaggccctgcgcaccgcggagctgagcctgggtcgcaacgagcgccgcgagttgatgctgcggctgcaagcgccagggcccgcggggcggccgcgctgcttccctctgcgcgccgcgcgcctcttcacgcgtttcgccgaggccgggcgcagcaccctgcggctccccgcccacgacacccccggggccggcgcagtgcagctgctgctctcggactgccccccagaccgcctgcgccgcttcctgcgcacattgcgcctcaagctggctgcggccccgggtcccgggccggcctccgcccgagcgcagctgctgggcccgcggccccgcgacttcgtcaccatcagccctgtgcagcccgaggagcggcggctcagggcggccacccgggttccggacactacgctggtgaagcggcctgtggagccccaggctggggccgagcctagcacagaagccccaaggtggcccctgcctgtgaagaggctgagcttgccctccaccaagccacagctttctgaggaacaggctgctgtgctgagggccgtcctgaaaggccagagcatcttcttcactgggagtgcaggtagtgggggcagagaggaggtagggggacagtggtggggtgggatagaggaacagggagacctgtctaactttgcccctgtccaggaacagggaagtcatatctgctaaagcgaatcctgggctcactgccccccacaggcactgtggccactgccagcactggggtggcagcctgccacatcgggggcaccaccctccatgcctttgcaggcatcggctcaggccaggctcctctagcccagtgtgtggccctggcccaaaggccaggcgtgcggcagggctggctgaactgccagcggttggtcattgacgagatctcaatggtggaggcagacctgtttgacaaactggaggccgtggccagagctgtccggcagcagaacaagccattcggagggatccagctcatcatctgtggggactttctgcagctgccacctgtgaccaagggctcccagcccccacggttctgcttccagtccaagagctggaagaggtgtgtgccagtgaccctggagctgaccaaggtgtggaggcaggcagaccagaccttcatctctctactgcaggccgtgaggctaggcaggtgttcagatgaggtgacccgccagctccaggccacagcttcccacaaggtggggcgagatgggattgtggccacgaggctctgcacccaccaggatgatgtggccctcaccaacgagaggcggcttcaggagctgccaggtaaggtacacagatttgaggctatggacagcaaccctgagctggccagtaccctggatgcccagtgtcctgttagccagctccttcaactaaagctgggggcccaggtgatgctggtgaaaaacttatcggtgtctcggggcctggtgaatggtgcccgaggggtggtagttgggttcgaggcagaagggagagggctaccccaggtgcggttcctgtgtggagtcactgaggtcatccacgctgaccgctggacggtgcaggccaccgggggccagctcctcagtcggcagcagctgcccctccagctggcctgggcgatgtccatccacaagagccaaggcatgaccctggattgtgtggagatttctctgggccgtgtgtttgccagtggccaggcctatgtggccctttctcgggcccgcagcctgcagggcctacgtgtgctggactttgaccccatggcggttcgctgtgacccccgtgtgctgcacttctatgccaccctgcggcggggcaggagcctcagtctggagtccccagatgatgatgaggcagcctcagaccaggagaacatggacccaatcctctgagcctcacccacaaagagaagacaaagggtggcctgtgcctccccgtcctcctgctccctagtggcccagggccccagggaataactggagtaggcaggcagtgtccccttctgtattttttagggactctcagcctcctggcagggttaaagggagagtactttaaacccatataccagctgtgcttcagtttctctcactttgccctgggtaagctgctgtagggtcagaagtaaccctttctgtgccagttgagaatgagcctgtgtggtagctgatgtcagaggacaaagctctctgcaagggctggacacagagctgcagagtcctgaacatccctcctttcaggctgcagaagggagaggcaatgaagacaggtgctccggaagcagcatcagggctcttggaggggactggtggggactcaggctgggtgcagcctccaaacagagaacggaacttaggtgtgtctctacagctaggcccagcctagcccagcccagaacaaacacccttcagagcctaaccaaagaacataagctgcaaaatgtgcacccatattttaagctgctttttcaggggataaatagtgtttggggacattgaaatggatgttctcaggttgtatttatttcggacaaataaactagagaattgtgtaaaaaactaaaaatc

SEQ ID NO: 15918 - DNA, 762 bp, Homo sapiens
ctatagaggatcccctgttgctaggtggagtccccagatgatgatgaggcagcctcagaccaggagaacatggacccaatcctctgagcctcacccacaaagagaagacaaagggtggcctgtgcctccccgtcctcctgctccctagtggcccagggccccagggaataactggagtaggcaggcagtgtccccttctgtattttttagggactctcagcctcctggcagggttaaagggagagtactttaaacccatataccagctgtgcttcagtttctctcactttgccctgggtaagctgctgtagggtcagaagtaaccctttctgtgccagttgagaatgagcctgtgtggtagctgatgtcagaggacaaagctctctgcaagggctggacacagagctgcagagtcctgaacatccctcctttcaggctgcagaagggagaggcaatgaagacaggtgctccggaagcagcatcagggctcttggaggggactggtggggactcaggctgggtgcagcctccaaacagagaacggaacttaggtgtgtctctacagctaggcccagcctagcccagcccagaacaaacacccttcagagcctaaccaaagaacataagctgcaaaatgtgcacccatattttaagctgctttttcaggggataaatagtgtttggggacattgaaatggatgttctcaggttgtatttatttcggacaaataaactagagaattgtgtaaaaaactaaaaatc

SEQ ID NO: 15919 - DNA, 361 bp, Homo sapiens
gctggacacagagctgcagagtcctgaacatccctcctttcaggctgcagaagggagaggcaatgaagacaggtgctccggaagcagcatcagggctcttggaggggactggtggggactcaggctgggtgcagcctccaaacagagaacggaacttaggtgtgtctctacagctaggcccagcctagcccagcccagaacaaacacccttcagagcctaaccaaagaacataagctgcaaaatgtgcacccatattttaagctgctttttcaggggataaatagtgtttggggacattgaaatggatgttctcaggttgtatttatttcggacaaataaactagagaattgtgtaaaaaa

SEQ ID NO: 15920 - DNA, 502 bp, Homo sapiens
ctctgctggctcctttaggggtgagggcaaaaggaaagagatgctggcccccaggttatggtcctggggaacagcacaaacccatgactgggcttctctggctctgatccaggagtccccagatgatgatgaggcagcctcagaccaggagaacatggacccaatcctctgagcctcacccacaaagagaagacaaagggtggcctgtgcctccccgtcctcctgctccctagtggcccagggccccagggaataactggagtaggcaggcagtgtccccttctgtattttttagggactctcagcctcctggcagggttaaagggagagtactttaaacccatataccagctgtgcttcagtttctctcactttgccctgggtaagctgctgtagggtcagaagtaaccctttctgtgccagttgagaatgagcctgtgtggtagctgatgtcagaggacaaagctctctgcaagggctggacacagagctgcagagtcct

SEQ ID NO: 15921 - DNA, 2599 bp, Homo sapiens
actatctgcttgttcatctgagtgtcggcacaaaccagcagaggcggtgacgatgctctcgggcatagaggcggcggcaggggaatatgaggactcggagctgcggtgccgcgtggctgtggaggagctgagcccgggcgggcagccgcgaaggcgccaggccctgcgcaccgcggagctgagcctgggtcgcaacgagcgccgcgagttgatgctgcggctgcaagcgccagggcccgcggggcggccgcgctgcttccctctgcgcgccgcgcgcctcttcacgcgtttcgccgaggccgggcgcagcaccctgcggctccccgcccacgacacccccggggccggcgcagtgcagctgctgctctcggactgccccccagaccgcctgcgccgcttcctgcgcacattgcgcctcaagctggctgcggccccgggtcccgggccggcctccgcccgagcgcagctgctgggcccgcggccccgcgacttcgtcaccatcagccctgtgcagcccgaggagcggcggctcagggcggccacccgggttccggacactacgctggtgaagcggcctgtggagccccaggctggggccgagcctagcacagaagccccaaggtggcccctgcctgtgaagaggctgagcttgccctccaccaagccacagctttctgaggaacaggctgctgtgctgagggccgtcctgaaaggccagagcatcttcttcactgggagtgcaggtagtgggggcagagaggaggtagggggacagtggtggggtgggatagaggaacagggagacctgtctaactttgcccctgtccaggaacagggaagtcatatctgctaaagcgaatcctgggctcactgccccccacaggcactgtggccactgccagcactggggtggcagcctgccacatcgggggcaccaccctccatgcctttgcaggcatcggctcaggccaggctcctctagcccagtgtgtggccctggcccaaaggccaggcgtgcggcagggctggctgaactgccagcggttggtcattgacgagatctcaatggtggaggcagacctgtttgacaaactggaggccgtggccagagctgtccggcagcagaacaagccattcggagggatccagctcatcatctgtggggactttctgcagctgccacctgtgaccaagggctcccagcccccacggttctgcttccagtccaagagctggaagaggtgtgtgccagtgaccctggagctgaccaaggtgtggaggcaggcagaccagaccttcatctctctactgcaggccgtgaggctaggcaggtaaggtacacagatttgaggctatggacagcaaccctgagctggccagtaccctggatgcccagtgtcctgttagccagctccttcaactaaagctgggggcccaggtgatgctggtgaaaaacttatcggtgtctcggggcctggtgaatggtgcccgaggggtggtagttgggttcgaggcagaagggagagggctaccccaggtgcggttcctgtgtggagtcactgaggtcatccacgctgaccgctggacggtgcaggccaccgggggccagctcctcagtcggcagcagctgcccctccagctggcctgggcgatgtccatccacaagagccaaggcatgaccctggattgtgtggagatttctctgggccgtgtgtttgccagtggccaggcctatgtggccctttctcgggcccgcagcctgcagggcctacgtgtgctggactttgaccccatggcggttcgctgtgacccccgtgtgctgcacttctatgccaccctgcggcggggcaggagcctcagtctggagtccccagatgatgatgaggcagcctcagaccaggagaacatggacccaatcctctgagcctcacccacaaagagaagacaaagggtggcctgtgcctccccgtcctcctgctccctagtggcccagggccccagggaataactggagtaggcaggcagtgtccccttctgtattttttagggactctcagcctcctggcagggttaaagggagagtactttaaacccatataccagctgtgcttcagtttctctcactttgccctgggtaagctgctgtagggtcagaagtaaccctttctgtgccagttgagaatgagcctgtgtggtagctgatgtcagaggacaaagctctctgcaagggctggacacagagctgcagagtcctgaacatccctcctttcaggctgcagaagggagaggcaatgaagacaggtgctccggaagcagcatcagggctcttggaggggactggtggggactcaggctgggtgcagcctccaaacagagaacggaacttaggtgtgtctctacagctaggcccagcctagcccagcccagaacaaacacccttcagagcctaaccaaagaacataagctgcaaaatgtgcacccatattttaagctgctttttcaggggataaatagtgtttggggacattgaaatggatgttctcaggttgtatttatttcggacaaataaactagagaattgtgtaaaaaactaaaaatc

SEQ ID NO: 15922 - DNA, 1566 bp, Homo sapiens
actatctgcttgttcatctgagtgtcggcacaaaccagcagaggcggtgacgatgctctcgggcatagaggcggcggcaggggaatatgaggactcggagctgcggtgccgcgtggctgtggaggagctgagcccgggcgggcagccgcgaaggcgccaggccctgcgcaccgcggagctgagcctgggtcgcaacgagcgccgcgagttgatgctgcggctgcaagcgccagggcccgcggggcggccgcgctgcttccctctgcgcgccgcgcgcctcttcacgcgtttcgccgaggccgggcgcagcaccctgcggctccccgcccacgacacccccggggccggcgcagtgcagctgctgctctcggactgccccccagaccgcctgcgccgcttcctgcgcacattgcgcctcaagctggctgcggccccgggtcccgggccggcctccgcccgagcgcagctgctgggcccgcggccccgcgacttcgtcaccatcagccctgtgcagcccgaggagcggcggctcagggcggccacccgggttccggacactacgctggtgaagcggcctgtggagccccaggctggggccgagcctagcacagaagccccaaggtggcccctgcctgtgaagaggctgagcttgccctccaccaagccacagctttctgaggaacaggctgctgtgctgagggccgtcctgaaaggccagagcatcttcttcactgggagtgcaggtagtgggggcagagaggaggtagggggacagtggtggggtgggatagaggaacagggagacctgtctaactttgcccctgtccaggaacagggaagtcatatctgctaaagcgaatcctgggctcactgccccccacaggcactgtggccactgccagcactggggtggcagcctgccacatcgggggcaccaccctccatgcctttgcaggcatcggctcaggccaggctcctctagcccagtgtgtggccctggcccaaaggccaggcgtgcggcagggctggctgaactgccagcggttggtcattgacgagatctcaatggtggaggcagacctgtttgacaaactggaggccgtggccagagctgtccggcagcagaacaagccattcggagggatccagctcatcatctgtggggactttctgcagctgccacctgtgaccaaggggctggacacagagctgcagagtcctgaacatccctcctttcaggctgcagaagggagaggcaatgaagacaggtgctccggaagcagcatcagggctcttggaggggactggtggggactcaggctgggtgcagcctccaaacagagaacggaacttaggtgtgtctctacagctaggcccagcctagcccagcccagaacaaacacccttcagagcctaaccaaagaacataagctgcaaaatgtgcacccatattttaagctgctttttcaggggataaatagtgtttggggacattgaaatggatgttctcaggttgtatttatttcggacaaataaactagagaattgtgtaaaaaactaaaaatc

SEQ ID NO: 15923 - DNA, 299 bp, Homo sapiens
gaaataataagcataaaaagatgacaatgtgcaacaaagaaaatcctatccttgaagccaaaatacagccagcaccactgtttcaacgttctattccatttcagccctaggaggcatgaagggaaaaccaggaatgaccagcaacccagacctcttgctccatctgtcattttgtgtggatattgttaatttcttccccaaagaattttgcctcctatgtagagcatagaggtcatctgacaggaacaaacagctttaatgttccttcatttggcactgaggacacacagtcctcagtg

SEQ ID NO: 15924 - DNA, 324 bp, Homo sapiens
atataatatataggttaatgtaaatgggatgacaccatatatactattttgtacgttttctcactcaaatatatatagtatatatttttccatgtcaatattttggtgtctgtaatgtattctctcttaatctcttgtatatcttgtcttttctccatctattagctccctcccacttgatttttcttgctttcatattaatgacaacaaccattatcttactgtcaccctcaactgctttgcctccttattgaactgcccttcccacttagcaaaaccccaactctggattactctaactctctgccttattctcttttttta

SEQ ID NO: 15925 - DNA, 320 bp, Homo sapiens
gaacctaaggaagagatacccacattagaccctgagaggttcagggagtggaaaacaattaatgttctttgtcctttagatcccaaaccacagcttggcaaaacaatcattaagcagtagttgtgacttataactgacctactgctgggttatgaaaatagatgtaaagtcatgtggacgtgactagtcctgaaatgttctgatgcctcagaagccatcagtggtagctcctaacgtggagttccacatccctgccctatacatgtagaagatgtataggccagcactaacttgcttcaggctaatggatacaaatttat

SEQ ID NO: 15926 - DNA, 285 bp, Homo sapiens
cttcaaacaataatccactcagcagatatttagcaaacatctaccttatatgaaccactctcctgagcactggagctacgctggtgaacagagaataaacagcctcatctctcataactatcgtgtttggagcaagtaccaaatgccaagcactgtattatgcattctagaagccatctcatgcaatcctcacaaaaactcaaaaaggtggtgttttacagatgatgaaactgaggttaatcatttattcattcaataaaccgttattgagcacctactaggtgc

SEQ ID NO: 15927 - DNA, 439 bp, Homo sapiens
ggctctgtgctggcagtttcagggtcagtgtgctgctttcctagggacattagaagggcgcaggagtacatgtctgcccattcctttggagtatcgcagatgatgctatacgataccaagtgttaccgctcacagagactgggaaagggaaatgggagtaaccgaaagccagatggaacgaaagcaaacatggaaaccatgatcacggcaaagagccatccttgtatttaagaagtaactttggccaggtgtgatggctcacgccgtaaccccagcactttgggagaccaaggagggtggatcacgaggtcaggagatcaagaccatcctggctaacactgtgaaatgctgtctctactaaaaatacaaaaaattagccaggcgtggtggtgggcacctgtagtcccagctactcgggaggctgaggcaggagaatggc

SEQ ID NO: 15928 - DNA, 231 bp, Homo sapiens
gcgaagccccgtgcaagaaaatccaaaaaatgagacaagaagtgaagggagaaatattcaaggaaatagatagcttgaagaaaaaaacaataaaaaattcgggagactttggacacacttttagaaatgcaaaatgctctggaaaacctcagcaatagaattgaacaagtagaagaaagaaattcagagctcaaagacaaggtcttcgaattaacccaatccaacaaagac

SEQ ID NO: 15929 - DNA, 435 bp, Homo sapiens
aggagcacctgtttttctcccttgaactaagacttagctaatcttaatacattttcaagtgacatccagatttatcaacaacctaggacttgaatacagtcctctgtattcaacatggttatttctctcaaccatggctctttgcttttcatcatgctgcacatcaaggaaataaccctcattatgctctcatcttccatccctctgctttgtcgtcatgataaacaacaacttgataatatttaatcccagttcatcataggcttcatgcttttagtctgctcttgaatagtccacaactatttcaacatggtggctccattggacatatcatgcaccaaacacaagaggccattgtagatagagaaatcagggacttattaaaacctggagtctgaaaacctcatcttattctacccactagttaaaaaaaaa

SEQ ID NO: 15930 - DNA, 305 bp, Homo sapiens
ggtactgcttctaaggctcaaacagcttatttgctacaattccttgttctcatgatttttgagggggttctattacgggggtggggaattttcaacataaaccatacctttaaactgagattggaaaatcattagctgatgtttattgtgttagtctttaatgattttacagtataatctttgactcacacagttataaatcaaagaataccaagttcaaggatattgatgggaactagtttgcataatattgctttgtaaccttcacaaaaataaaatgtaattattaatgtcattattactga

SEQ ID NO: 15931 - DNA, 283 bp, Homo sapiens
atatatataatatcaaaagatgtaagttgctacatcaaaaataaaaagggtggaggaaataggaaaaatgtgtagagtttttttaatgcaaagttaaattgaagtcaactttatgaagcctcttgtaactctcatgtttatgtcagtctcatggtaaccattaagcaaagagctatagtagtacacaaaagaaaaatagtgagcaattatagcacaccactaaagaaaatcatctgatcacaatggcagacagcaagagaggatgaaagaaaaaaggaaatac

SEQ ID NO: 15932 - DNA, 271 bp, Homo sapiens
ggccactgccctgctggaacccccagggctcccctcacacgttgctccctcccctgtccagccctgtccctggctgccctggccccggccgctctctatccagggccgccaagcacagttccccagggcttctgcctgggcctccctgtcccagacctccccatggccatcagggcccagccagggcatggcctcctcagtgaggcgcacagaccactgcatctgagggttcccacctcaccccatccctctgctgccaccctgagaccgt

SEQ ID NO: 15933 - DNA, 787 bp, Homo sapiens
agagattctggccacatataatggcacatgccttggtctcattggtgtgccattcccacagatcagcgaaatactgcctgctacacccctgaacatttccactctgccattgctggcgaacccccactctcagagagcaggtggatttctgacatccaggaaaagctgtgacccagtgcagcgttgagtctcaggctcctgggtctctggggactggaagagaccagaagccttaacaattaccctaggaaaggagaatacaatccaggctcatctgctggagctgcacgcctgctccccccttccctgcaggggcctccccagctccaccaggcaacccgttgttctgcagctgataaccggattaggcagcagaatggggcagatgagtaccctgaggggccctgcctgggaacaggggctccctggcctggcgtgagggctgccactgtcaacaccctaagccgctgcctcctgcagggcatttgcatgtgtgtgcgccctactgtacgcgcccaagagccagtgggaaatgccggcggtggcagttcacacggggcactgctgcacaaagccccaaggccaagcggcacggtggccctggctggcgaatgtcgcgcacccagtctctcgcagcagcgcctggcgcgacgactgctggaagccgggccaaacgcagtctttgcatgagtgtggccctggctgtgggagccgaagcacagccaccacgcgcgccggagcgcagggagagtcgcctgcatcgtccaaccctcctcttaaaaaaaaa

SEQ ID NO: 15934 - DNA, 211 bp, Homo sapiens
atgacataatataattccaaagtatgtagtttacgtttaaaaatgcatttttgaaatagacctgattgctaacctagctaactaatgcagactctacttataatgtgcgactaagggttcaagatcatagaaataatatctgtaatttctattgatgttttgggattgaaaagctcagtcgaatataacaatagtagtaactttacttttg

SEQ ID NO: 15935 - DNA, 454 bp, Homo sapiens
taaatttattatatgctaaagaataaaactccagttagatttaaaaaaatcccatttacaagcattgcacctttaagaagaaaacaaatatgacagtatggtagctatacttgtgatgtctgacgcatgatggcctatggttttaaaaatagtattgtggaatatatttttgggtaataagaatggttgagtgcaacatcatgtattaatatcaaatgaaagacaagggtgctgtatctttgattatttatcaaaaaagtataaatcttttaaggaaaatgttagaattttaaagtttttttttgattgttgaagcatttatcttgttgatttcttacaaaagaaaaaggacgatgtcagtcaagcagcactttttcagaatatacagaacataaataatatgatgtggttgagtgttaacataataaatcatatacagtatgacattttaagg

SEQ ID NO: 15936 - DNA, 366 bp, Homo sapiens
gggaccaaggaatttggggtgaacttactatgcttttgggttgctctgtagagatctgcagggaccagcccagtgaaaacaaaaaggttcccctattccctccccagcagccctctctgtggcctggagggtttctctggaagagggcagtgcctggaggggagcctctggatagtgatgtggaaatattaacaacagagtcaaagcgggtattttggggtagtcggggagaaaactgtgacctctccccccaatgatgtaaaatctttatcaatgatggaaactgttgtgtctcattaaaagggttttgaggtggaaaagcagctgccgctggatcttaataataatatcaaactgctaacctca

SEQ ID NO: 15937 - DNA, 449 bp, Homo sapiens
gccaccctctgaacttaaccttctgtgttctcgctccactccttcaggctcagtcagctctgcaaaacccaatccactttccaaggaaacatttctggaaggcaacacggaattagttaatgtgatgagaggcagaacagagcagttaagatgcaggctctgcacataccacaacgtggatgaatctcacttaatgttgggtgagaagagccaggcccaaaagagcatctattgtgtgaatctactaactcgaagttcaagagcaggcaaaactaatctccggtgatggaagtctgaacagttacatctgctggtggtgttgcctggagacacgtttcagagaatagaaatgttctctgccttgatggtggtggtggttacggtggttgtaaacataatagacactcacaacactcacagagctatacacttaggattcgtcacctaaa

SEQ ID NO: 15938 - DNA, 1089 bp, Homo sapiens
gcatgtatacatgtgtgtgcataaggaacatccgtccatctctagctgtcatgtctgagaacattaataaaaggctcgacctcatgcgcctgcaagtgatcacaagacagttactgaagcattcaaagaagcaatgtctttgtcatctgactcattttgaaaacgcatgagaatgctttcccaaggcaatttcttacaaaatacaccgtgggacatttttcctatagtttattgttgttgatgatcatcgagaactttgtacccagagacactctacactgtgagtgtcccctgatattccctcccactcagcctgatcagtggtatctgacctccaactactcgctgcaacaacccgttctctagctgagtgggcctggactttgaacagaattaacagcctggaagtggagttctcaatctcaacagccccttaacctcatgcaaatttctttttgagctgaaaagaacaaacagaatgccaccttttaaaacaaccttcttcgaaacatggggggaaagtcaggttttatataaatcagagagatagaaataaggcccataataaaaaacttgaaatagatttgggaagtttccgaaacttccaaaaactagtggtccaaagtgggcaatattttttgtgtgcattgagaggcccttcctgtttccttggtccatgctggtgtcttgccccgttccaggaaccctgggctcccctgtgctgagcagcccccacacctcagcccaaagcctcaccccttgcctgaccacaccccatttcttttggcacagcttcccagacttacaagatgtcttgaagtgactgaatggagttagtgttcggcaggactggctaggtaactactgggacttggtgcagaatgtagatgtagggctccttgttcaaaaattaggaagaatttcaagatagccacagcagagcattaaaacaaacccaggttggctaggtgtggtggcacactcctgaaatcctagcactttgggaggacgaggcaggcggatcgcttgagctcaggagtttgagaccagcctgggcaacatgacgaaaccccatcgctactaaaaaaa

SEQ ID NO: 15939 - DNA, 502 bp, Homo sapiens
tttggataaaacatattgtgtagattgaactttgcaatattgttttattgtaggcattccattcatccacctggctgcagaaccagtttttatgggatttaaagcttccataaattggaggaatgctgtttgagaaaaataatacaaaattataaatataatatcagttatagggccttagaagggacagctgcaaatgagatactttgaagtttctgtttcattagctttggtgtaaatccacctctacctccactcattcattcatttgcttcattcaggctacagacacttattgagcatctactagatgccaaattctgtgctgctgctacaatccattgagactttaacacccacatggaatacgcaattgggagagagtgaaggagtactgaaggcaaactcaggggctacacttcacaaaaataggagatttggaatttacaaagaagaagaggagaaagaggaggaggaggggaaggaggaagaaaaagaagag

SEQ ID NO: 15940 - DNA, 314 bp, Homo sapiens
taatctgtgtgccacccacaggataatatctccatctgaaagtccttgaccctaattacatctgcaaaatccaatttgccatataagataacatagtcagaggtgtaagcgattagtgtgtggacatctttcaaggaaggatattattcggccaaccacagtgataaagatgcatcaataatttcatcagtatgaagcttcacaaaatagggccagacagggtggctgatgtctgtaattccaaagtgctgagattacagcatgagccaccgtgcccagccagaactctgtaatataataacacatattttgac

SEQ ID NO: 15941 - DNA, 1289 bp, Homo sapiens
taaaattatgaataatgctacatcaaaaagcaggttacaaattcatgtttactatataactatttaaagcaaatgaaacactaatagtcaaagtttaggatgaaaactaaatctaaaaggaaatataacaaaatgccaattatgcttggtttggggcattgatgacccttcttcccacttttctatattttccaagatttctttattgaatatgttttactataaatattttctaaactcatattttcactattaaaatttttttatttttccaaactttaaggcatatgctctttccacattcctcaacattatttgcaaacatcatgaaatgacacttccatcaacattcaatgaggaaagtagtgatatagatgagccaaaaagagttttatataaacttatacaatctaaactcttgctcttcctttctgactcctgagggtgagtgtgatggactagaagaggtagccttaaaataagtgagcagctagggaacatgctcaatgggcaagagaaaatgaccactgaccagtcaatacctgtgtcagggggagttaccagtacctatatttatttttaaagtaattaaaaagtagaacacttacaaattttccacctatacatgccatgtcttcctcggggacagtagccacatcttatatatttcccaccatgcataggacccagcacacagtgaagccagtaggcactcagtgttgaatgctcataccaggttttctgcttcctgtagttaccctgctgagcactgcttccatcacaggtgcactgggcctcaacacttctgccatttccccatttgtctcctccatggacactgtcaacaatggtctgtcaacacctgctctgtgccaaagccagggagtaggctggggggatacggaagagaatatctttctccttgatgcctgctgtgccaacagccccctttaagccttgttcacagcctttgctgaaacaagcatcttgaaagcaagccatgttatacaccgcatgaccttcatgctctgggcccagctgactgaactggggcaggccccagagtcatgggcagcctattgtcttgctaatggcctctgacttagcctggagtaaaacactgtccaaacaagactggtggttattcaagcataagaatttgaactaggaagccaagaatgaagcaaccggaccattaccatcaaaaaatgattaaaggatgaagaaggaagccaacattcagagagtatctggttcatgttaataatggtatcatattaaaaggaaga

SEQ ID NO: 15942 - DNA, 505 bp, Homo sapiens
aattgtcgtcctgactggttttgtgatggtcttcaccctctttctcctctatggcctgtctttggtgagttggttaatttcatctaagtcttttattctctttctctctctctactgccaataatttatcactaattctggtctcacctcttttgttctctttgtagtatttgcatgaaacagtgtctaggggtggaaaaatataaaatatacttttataatataaaattccttttttgtgctactgttctcacagaattatataccagctgaagtctttctcttttctcagataactttagctttcctgatgagtgtgttgataaagaaacctttccttacgggcttggttgtgtttctccttattgtcttttgggggatcctgggattcccagcattgtatacacatcttcctgcatttttggaatggactttgtgtcttcttagcccctctgccctcccttcattgtactttatcattaaaaatcaacttccaaaaaaaaaa

SEQ ID NO: 15943 - DNA, 449 bp, Homo sapiens
gtagcccccaggactgggaatgactaccacagcaagtcatagccaatctagattaacacgtacatctggctgggcgtggtggctcaaacctgtaatctcagcactttgggaggccaaggcaggaggatagcttgaggctgggagttcgagaccagcctgggcaacatagtgagaccctgtctctacaaacaaaaacaaaaacaaaaacactgcatacatcctcatgagtaaattttggtaatttgtgttttccctgaaaattatctatttcaggtagatttccaaatgcattggtgtacagttgtacttagcataatttaaaaatttctgtaatggtggatagaaacctctctctcatttgtagtcttgtgtgttttctcttcttattacttatttttatcggtattttcaaataaacagcacttggttttatcaattttacttcctct

SEQ ID NO: 15944 - DNA, 573 bp, Homo sapiens
gagactctaatgccacagctgatctgacaggaggcggagctcaggcgataatactccacctgcagctcacctcctgctgtgcggccgggtttctaacaggccacggaccagtaccagttgtggacccctgctctacagcaaattaacacaaatttagcagcttatcttacagtttctattggtcaggaatttgggtatggtttagctgggtctttcctcaggttctcactaggctgaaattaaggaatcagccggggctcctatctcttctgaggctctgggttctcctccaggctcaccggttgtgggaagagttcaattccttgttcttgtagatctgatgtccctgtttgcttgctggctgtcagccagggaccactttgagctccttagaggcccacccccgccaccatgttcttgccatgtggccaagttattatgttgtgtatgactaaggaagaaaaatgctggattaaaatataagacaaattcttactttatgtatgactaaggaagaaaaaatgttgaattaaaacatgatacaacacattattgcttggacagtgccttgca

SEQ ID NO: 15945 - DNA, 467 bp, Homo sapiens
taaatagaatcttgctcggctgtctaggctggagtgccatggcacaatctcagctcactgcaacttccgcctcctgggttcaagtgattctcctgccttagcctcctaagtagctaggacttagaggcacgtgccaccacacctagctaatttttgtacttacagtagagacggggtttcgccatgttggccaggctggtctcgaactcctggcctcgggtgatctgcccaccttgacctcccaaagtgctgcgattacaggcatgagcgtgagccactgtgtccagccagccaccgcgcccagcccacccagcctctttcaccaatgtttgatagtttaatatgtacagatctttgacctctttgattaaatttattccgaagtattttgtgttctattaaaaaatagaaatgggatagttttgttcattatctttttcagacagtttgctgttggtatatagaaa

SEQ ID NO: 15946 - DNA, 430 bp, Homo sapiens
ctcctgcatggggcttccacagattgggcaacccacgtggtgacgtgagtaaaggatgtaagaaggaaaacaaatcagcgagaagatactgccccttacccccgcttaaagaggagacacagatgccctgtgaacacctaccagttggctgacacctggggctcagataagtcctctctggccctagtttcatttctttgaatgaaacagctctatgagagctctcttcagagtttatatgttctcgacactgttcctagccagtggcaatgaataaatcaacctatactaattgaaaattagctgtgggcaaaccacagtatgaaacactcctgggcaccatggaggattccagaaaggcttggtccttgcctgtaagaaactaacaatcgaataatgaaaataaacagaaactcttaactcttaactg

SEQ ID NO: 15947 - DNA, 495 bp, Homo sapiens
ctcctgcatggggcttccacagattgggcaacccacgtggtgacgtgagtaaagtcaataagcactattcttagtattgggatacatcaatgaacaagagacactgtctataacctcaggatgtaagaaggaaaacaaatcagcgagaagatactgccccttacccccgcttaaagaggagacacagatgccctgtgaacacctaccagttggctgacacctggggctcagataagtcctctctggccctagtttcatttctttgaatgaaacagctctatgagagctctcttcagagtttatatgttctcgacactgttcctagccagtggcaatgaataaatcaacctatactaattgaaaattagctgtgggcaaaccacagtatgaaacactcctgggcaccatggaggattccagaaaggcttggtccttgcctgtaagaaactaacaatcgaataatgaaaataaacagaaactcttaactcttaactg

SEQ ID NO: 15948 - DNA, 465 bp, Homo sapiens
gcattattttgtgggacaaactcacctacccttaatggcatatgaggtcaagtttctctgctgaaaacaggtgcttgttgctggtgccattctgcaagggctggatgggacaagtctggggcattcccccttacccccgcttaaagaggagacacagatgccctgtgaacacctaccagttggctgacacctggggctcagataagtcctctctggccctagtttcatttctttgaatgaaacagctctatgagagctctcttcagagtttatatgttctcgacactgttcctagccagtggcaatgaataaatcaacctatactaattgaaaattagctgtgggcaaaccacagtatgaaacactcctgggcaccatggaggattccagaaaggcttggtccttgcctgtaagaaactaacaatcgaataatgaaaataaacagaaactcttaactcttaactg

SEQ ID NO: 15949 - DNA, 456 bp, Homo sapiens
ccagaggtcacagagctaggtacacagatacaagcggaacccggggcttctccatcccagcctagggttctgttagatactgccgtttttgcatcatggatttaagtaaccagatttagttccatgttttctttaaaaaaagaaaatgctaatcaagaataaagatgaggccggatgtggtggctcatgcctgtaatcccagcactttgagaggcagaggcgggcggatcacaaggtcaggggtttgagaccagcctcaccaacatggtgaaacctcgtctttactaaaaatacaaaatttatccaggtgtggtggcgggcacctgtaatcccagctacttgggaggctgaggcaggagaatcgcttgaaaccggaaggtggaggttgcaatgagctgagattgcaccaccacactccagcctgggcaacaagagtgaaactccatctcaaaaaaa

SEQ ID NO: 15950 - DNA, 2129 bp, Homo sapiens
  misc_feature (1867)..(1867): n is a, c, g, or t
  misc_feature (1939)..(1939): n is a, c, g, or t
  misc_feature (1965)..(1965): n is a, c, g, or t
  misc_feature (1968)..(1968): n is a, c, g, or t
  misc_feature (1977)..(1977): n is a, c, g, or t
  misc_feature (1993)..(1993): n is a, c, g, or t
  misc_feature (2009)..(2010): n is a, c, g, or t
  misc_feature (2050)..(2050): n is a, c, g, or t
  misc_feature (2065)..(2065): n is a, c, g, or t
  misc_feature (2128)..(2128): n is a, c, g, or t
atttttttctgtaattaaaataagtctgtatgaattagcatatgagtgatcagataatatctaaccagttgaagtttggaagttcctttcgtttaaacaaaaatagaatttcagcaccattttcatttattgattcttcttttcctgtatttcacagtttttaaaaatgtgtttgaagtcaccaaaaatatacttctaatgctgtgactaaatttgccacaattaagacacccaagagtccatcagggttaaagtaggctacaatatgtttacaaggacaggcaaaaggtgtcagtgtaattttattaggaaagtgaaaaagagaagtctatgggcagtcaggaacaagctgagttatttaccaaaaatatatggtaacttctcttttaggtgtgtagtgtgtatctcaaagaaacacatgttagttcacaaggatttatgattttttgattaatcagaaatccattcaaaaaatttatcagtatttctcaaagagaagtgctgtctgtagacaccatgggcacatgaagtaaaataatctgtgaaaattctttgtcttgtaaaaataggagtgccaatctgatcaatgtattgtgttataccagctgtgtgggtgttacagaatgaattttggtctcaattttgtaacttacagaaaagctataattgcagtctctcctgcccacttgtatggtcaactaattttaaccatctctaaaaggcacttgcaaaaagggaaaaatgcccaattcttgggtgcatgggcaaaatatacatatagaaatgatagttcatgaggaccagatattctgaaaaccttctcaccatggtagactagatgcagaatgagtcagagaaatgtattttataactatattgctgaacttgtaagagtagaggaaaatcctcaaggggcagaaagaccttataataatttgaaaccaaagaaatgtgctaaaggagaccaggactgtctcaatagcaatgcccatgtaaggaactcagaacttaaccactatggaaaaagatgactaggcctggggtttggttgcagttggaggacgaaactctttcacaaagctagcacattcaaaggggctaccccctcagagaaagtcagagctgaaaaaattagcctaccaagaaaggaagcagatgggaaaatgtgtctgcttttgccattgctctacatcaaggaaaaatagtagtcatcatagtcatcttctctcctctcctaaccatttgtgactataagcttaatgttggatgggcatgcagtataagtatacgctacttgccaggtcatggaaactacatttaaaaaatgtagataatttgtttccaaattggtggaactctgtggcatttggtagagataagcataaatctggagcaaagcattaacaaaatcgtgtcctaaggattcctacagattcaactgatatgaagtcatcataaatacttacacacacacacacacacacacacacacacacacacacacacgcactctctacatatcacacatacactctcagggaagcaatgaaaaattaccaaacagggaataacataagccaaaatttgcaagactcagcagaaacaagaaacacagatctacatcccccatgccttataacattggggtgcagaatactgcatatagaaaaatacatgtgagctatatagagaaaaacgttgagcaaagagtcagcaaccatcaaaaacaaccagaaagatctgaaaaataatagaataacaagaaatgaaaaatataatcattgcaattaaaatttcagtagataggttaaaagggtattacacataaatgaagagagagtaagtgggccaggaacagtggctcacncctgtaatcccagcactttgggaggtttgcagtgggtggatcacttgaggccaggagttcgaggacagcctngccaacatggtgaaaccccatctctnctnaaaatacanaaattagctgggcgtngtggtacgtgcctgtnnttccagctactaggaggctgaggtgggaggatcactttgngcccaggaagtggangttgcagtgagcctagatggtgccattgcacttcagcctgagtgacagaacgagagccttccnc

SEQ ID NO: 15951 - DNA, 224 bp, Homo sapiens
aaacatcaccaccaccaccaccaccaccaacaaaaaaacccgtagacttgtccctgttacaggcactaggaacacagcagggaacaatcaaaaagtccctggtctggccaggcaaggtggctcatgcctgtaatctcagtacttcaggaggccaaggcaggaggatcacttgagcccaggagttcgagactagcctgggcaacatagcaagacccccgtctcta

SEQ ID NO: 15952 - DNA, 665 bp, Homo sapiens
  misc_feature (1)..(3): n is a, c, g, or t
  misc_feature (6)..(7): n is a, c, g, or t
  misc_feature (9)..(9): n is a, c, g, or t
  misc_feature (143)..(143): n is a, c, g, or t
nnnggnncnagaagctgaaggttgccgccaggctgtagggcctgcttgttctatatggggccctatgaaagttgacagatgctgttaattgtatacagccttcagctgctctgataaggagcccattcatttcctaagccaanttaaactatgccttttggttatgttgccttcaaactctgttgaaatcctctggcagcattccaccagttgagaagcttcattgttttagattataagaataatttgaatgaatataacagaggcactgtagatagaatcccagatatttaaaggaaaacatgcctatattttaggaatatcttctgaagaacttcataattttatttgaagtgtttgtaaattttttaataaattatttaaatgtatcaatagtggatagttggaagaacgtctttgaggctaaaaagtagtactctgaaattctctcaagttatattatttgtctgttagaggtccacgaatgaaaatatatgtagctaaaggagtaaggtgctgcccaatttggaacccaactgacctctaggatctatgaagcagagaatattaccacaaacttctgaaagaagctgttgacctcgtttcttaatttaaaatatgttgccacataaatactaataaaacatagttgctcttcatctctt

SEQ ID NO: 15953 - DNA, 736 bp, Homo sapiens
  misc_feature (1)..(3): n is a, c, g, or t
  misc_feature (6)..(7): n is a, c, g, or t
  misc_feature (9)..(9): n is a, c, g, or t
  misc_feature (143)..(143): n is a, c, g, or t
nnnggnncnagaagctgaaggttgccgccaggctgtagggcctgcttgttctatatggggccctatgaaagttgacagatgctgttaattgtatacagccttcagctgctctgataaggagcccattcatttcctaagccaanttaaactatgccttttggttatgttgccttcaaactctgttgaaatcctctggcagcattccaccagttgagaagcttcattgttttagattataagaataatttgaatgaatataacagaggcactgtagatagaatcccagatatttaaaggaaaacatgcctatattttaggaatatcttctgaagaacttcataattttatttgaagtgtttgtaaattttttaataaattatttaaatgtatcaatagtggatagttggaagaacgtctttgaggctaaaaagtagtactctgaaattctctcaagttatattatttgtctgttagaggtccacgaatgaaaatatatgtagctaaaggagtaaggtgctgcccaatttggaacccaactgacctctaggatctatgaagcagagaatattaccacaaacttctgaaagaagctgttgacctcgtttcttaatttaaaatatgttgccacataaatactaataaaacatagttgctcttcatctcttaaatggatcattccaactggttttacatcgttgaatattatctagtatttttaataaatattttcataaat

SEQ ID NO: 15954 - DNA, 278 bp, Homo sapiens
tcttactaaatagtctgtcgtattaattagactgggtagtcctaactcaagaaagcatttggcaattaaaagatggaggactcagggtctgaccgttttccttggccttcatttggctttctctctcttttctcccctccttcttcccaggcctggctggctggtgcctggacaccatttggggctctgagagggttgtggctgccagcccccagtcgccaatgcctggtcaggcactcgtatcccctgtcctgttcaccatttctcctttctcattg

SEQ ID NO: 15955 - DNA, 420 bp, Homo sapiens
ttttgtcatggaggagctcgactcttcaggcaccagtctcaagagaaggtcactttgtctctttataggaggtgtggggcagggatccccgaagccaggacaagagtctccttcaggatctgctttgggttcaatcgagttgggcgagcaaggccccttgtgtctatggagtgatgggcggcctcaataattttagcatgggacaatgccaaagtgctcacttaagccatcaaagtgaattttcagtaaagcactcatggatagttcagttgtctgatgtactctttaaaaactgagtaggtgtctgaatgaggaaatgctgtgtagggtcatacttttaaagccggctggacagggagctgtcttccacaagcgatggctcttgctttaaagtaattgctctatagtcctgtttcattt

SEQ ID NO: 15956 - DNA, 130 bp, Homo sapiens
ccaccaaaatgacatattaaggtaaatagtgggacttttttcattggagaattttaagagaagatatcattgccttccaattatggtttcatatctgttctccccaaaggcatgtgtacttaaaacccct

SEQ ID NO: 15957 - DNA, 381 bp, Homo sapiens
ctccaaaagggtgcatccactctgttggctgcaaggctgccatctgttcacagctagcatgccagcaccggggagcagggcaatgggcatatccccaagttaaatctccaaagaccccattgtttttatctaaaatcagcagtttttcttggataaatgagtttgttcgttccctgcctttggttacttagttcaggaatggttgattttaatcgttttgccaatatgttaacctaattcctctctgtcattccagaagtcccacccccttatgtaaagtttcttgctcatttatctcaaatgttttcctataaaatttttatgcgctgacacaaaaacttttacatgattgtttattacagcattattcataatagccaa

SEQ ID NO: 15958 - DNA, 492 bp, Homo sapiens
gtctttatttaacaacatctcataaagtaagactttctggatagtatcaatgacattgactttttaaaagaagggatttcttctctcatttgggaggaacatgacatataaggtaaaaagtgtaaatgcctccacctgattgagatatgtgacgtcacattattcccatagctaaacatttaagagcctgggtacagtggctcacgcctgtaatcccaacaatttggaagcccagcaggaggactgcttgaggcctggaacccaagaccagcctgggtaacagagcaagaccttgtctctccaaaaaatttaaaaatttagccaggcgtggtggtgaccatctgtagtcccaggagctgagtcaggagaatcacttgagcccaggagttcaaagttacagtgagctatgatcatgccactgcactccaagcttgaatgacatagcaagacctcatcttctaaaaaggaaagtaaaaacaaacaaaaatattt

SEQ ID NO: 15959 - DNA, 190 bp, Homo sapiens
aaaaaaaaaaaaaaaaaaaaagaaagccagacatggtggtgaatgcttatagtcctagctactcagggggctgaggtgggagaatcacttgagcccaagagtttgaggctgcagtgagctatgatcaagtcaaaacacataatagataaaatgtaatattaaaaaatgttcaagtaacccaaaaggagat

SEQ ID NO: 15960 - DNA, 201 bp, Homo sapiens
catatgaactatcaggaaattatttggacattcaaaaatattaaattttctataatacaaccataaggacaccagtaagtgaacagagcataagattccaaaaagagaagtaagcagaagcatctgttttttagggttacatttttatgatttcagcaaataatatggtaagaagagtttcataggatatatattttttaa

SEQ ID NO: 15961 - DNA, 344 bp, Homo sapiens
tgccccaccaggccccacccgtctggcttgtggcctctggagaatccactcctaccccaacccccaccccatcccttcactgctcctggagacacctcactgctggatgtgggactttaggagttccacgtcccacggaaattggcattttaaacagagacaacgggaagggaatactaggaagacaaagaaactagtccataggacagatgttgagttctcatgcagtgacaccagcaccccaggtgctgatgaccaaccccacccgtgcctccactcggagcacatcaacactgcccagctttccagcccctgctgtcacctgccagagcccccagtgttca

SEQ ID NO: 15962 - DNA, 597 bp, Homo sapiens
attttggacaaaatcttaaatgatgagtagaatttagagacatagactgaaaaagcaaaggaggatggatagtccaagctaaatgagcatcatgaagaaaagtacaatatcaggatttagtttaatatgatagaacattattggtaaggaaggccggttacaactaaagaggaataattgaaaataggcttattggtaaagtggagtgagatgaaaacaagaagagtttaaactcagtgtagaagttgggtccactgttgatctctttccaaattctctcaccaggatcacctgttaatatttgagatttggaatgggggttcatacaaacagccattcaactcactccagagaatccatcatgatttcttagtttggtagcataccacagtggttttcagaggccttctgtatagccttaataattatatatcactgttagatttgtaaaaagtgggtcaacagggacaaaaatcaaaccaaaccaaacaataggctgaaatttattcccaaaaccatagctatgtaattaagagaaaaacacaagaggaatatgaagataatgaagacacccgtttttgtgtgtttttcacccca

SEQ ID NO: 15963 - DNA, 1361 bp, Homo sapiens
gtcgggcgccgcggggcggaagacgagggcggcgaggtcgggttccgggcgcttggagaagatggtgctgcggcggctgctggccgccctgctgcacagcccgcagctggtggaacgtctgtcagagtcgcggcctatccgacgtgcggcgcagctcacggccttcgcactgctgcaggcccagctgcggggccaggacgcggcccgccgcctgcaggacctcgcggctgggcccgtgggctccctgtgccgccgcgctgagcgatttagagacgccttcacccaggagctacgccgcggcctccgaggccgctcggggccaccaccaggtagccagaggggccctggcgcaaacatttaatcctgggctgtgcggggccgaggctgcttgcttttccttccgggctctacagtggcatcaatgtggaggggtcattccgggcactgcgcgcggcttcgaatcccgactgggattgttggcctgcagacatcccacgcataagagcctaggccagaccgcccgctccgttgaagtcttgtgattggacaagacacagtgtggagaaagacccctaagcctaacagagatgaaggtaggctgggtccagacacggcacctacggagagccacggaccgaagccagagagcctttcctctgcaagtgggactgaaactcttgacagatgctgctcaatctgactggtatagcaggacagttaattccagggacgatatggatgaaaagacaaccctacagctgccaaattcctttgattaaatgtgtgagctggttgataggcatgagtgtgatacttctcaggcaagatgtgttaagaataccggggactgtaggcctatggtaataataaacacgtattttatgaaatgagtcttctgtgctgggacttgctcattgcactctatgtgttatctcactccttacaacgacattcacatgaggaagcagattactttttggatttttttgtagagatggggtggtctcgaactcttgggcgcaagtgatcctcccgcctcagcctcccaaagtgctgggattataggcaagagccactgcgatggaaacagaggctgctgcttaagttgcccaaagtcttgcagagtgggatgtgagcagaggcatttgactccagggcctaagtccttaacacagctctgcagcatttaccctgatactcaaccccttccttccccaaccccccaccatcaggcattaagactactgcctaggggcagggcctggtggcagttgtgtcttatcccagccactgcagaggcaggaggatcgcatgagcctgagatgagaccagcctgggtagcatagcgagaacctttctca

SEQ ID NO: 15964 - DNA, 881 bp, Homo sapiens
gtcgggcgccgcggggcggaagacgagggcggcgaggtcgggttccgggcgcttggagaagatggtgctgcggcggctgctggccgccctgctgcacagcccgcagctggtggaacgtctgtcagagtcgcggcctatccgacgtgcggcgcagctcacggccttcgcactgctgcaggcccagctgcggggccaggacgcggcccgccgcctgcaggacctcgcggctgggcccgtgggctccctgtgccgccgcgctgagcgatttagagacgccttcacccaggagctacgccgcggcctccgaggccgctcggggccaccaccaggtagccagaggggccctggcgcaaacatttaatcctgggctgtgcggggccgaggctgcttgcttttccttccgggctctacagtggcatcaatgtggaggggtcattccgggcactgcgcgcggcttcgaatcccgactgggattgttggcctgcagacatcccacgcataagagcctaggccagaccgcccgctccgttgaagtcttgtgattggacaagacacagtgtggagaaagacccctaagcctaacagagatgaaggtaggctgggtccagacacggcacctacggagagccacggaccgaagccagagagcctttcctctgcaagtgggactgaaactcttgacagatgctgctcaatctgactggtatagcaggacagttaattccagggacgatatggatgaaaagacaaccctacagctgccaaattcctttgattaaatgtgtgagctggttgataggcatgagtgtgatacttctcaggcaagatgtgttaagaataccggggactgtaggcctatggtaataataaacacgtatttt

SEQ ID NO: 15965 - DNA, 961 bp, Homo sapiens
cttaggctagtagaggctggtttaatcggccgaggagaagatggtgctgcggcggctgctggccgccctgctgcacagcccgcagctggtggaacgtctgtcagagtcgcggcctatccgacgtgcggcgcagctcacggccttcgcactgctgcaggcccagctgcggggccaggacgcggcccgccgcctgcaggacctcgcggctgggcccgtgggctccctgtgccgccgcgctgagcgatttagagacgccttcacccaggagctacgccgcggcctccgaggccgctcggggccaccaccaggtagccagaggggccctggcgcaaacatttaatcctgggctgtgcggggccgaggctgcttgcttttccttccgggctctacagtggcatcaatgtggaggggtcattccgggcactgcgcgcggcttcgaatcccgactgggattgttggcctgcagacatcccacgcataagagcctaggccagaccgcccgctccgttgaagtcttgtgattggacaagacacagtgtggagaaagacccctaagcctaacagagatgaaggtaggctgggtccagacacggcacctacggagagccacggaccgaagccagagagcctttcctctgcaagtgggactgaaactcttgacagatgctgctcaatctgactggtatagcaggacagttaattccagggacgatatggatgaaaagacaaccctacagctgccaaattcctttgattaaatgtgtgagctggttgataggcatgagtgtgatacttctcaggcaagatgtgttaagaataccggggactgtaggcctatggtaataataaacacgtattttgaatgaacaaaaaaaaaaccgggcacaagcgggcgggaaaaggttaatggctgtttaatgtcggacattttgtcagggaaagggccaaaggagaaaaacaa

SEQ ID NO: 15966 - DNA, 831 bp, Homo sapiens
tatttccagcatttggtacagtatctcactgcctggtgcttactgtgtgctcaaatgtttattgattgaaagaaaactatattattgtaagttccttgaaggcagagacagtgtcttatctttgtatctctgatggttgctagtgaacattaagccctcaatatttgtttaatcagtgctatcaaagtggtttaaatggatgtagtctccaggggtctctgagctttttgatgttttaaaaatttgctatttaatttggagctaggaaaaaaaattaagtatatttagaatcattccggatgactaccattttataccaaatgttgccatgagatttcagtgcaagtacttgaatttgtgtcagatgtttatgttataaacacacagagaggtacagtttattgtgaagtttttctaaatccaaacctccaaaggaaaatctggctctatctattacaagggtttagacattacttgcttttgagagactgcttacatgaataaacactattcctgaagtctgacctttacatgctacttgaagattccacctgccatgttttcttgtctttttgcatatgcatggggtattgtcttcctccagcattactgggtttttcctatatgttatttgtagtaaatttcttttactagggtgataggttctgtctcctctagcaaaattagtgatttatttaaaacaggtgtcattgggcttgtacatagaaccactctattggaagtttgaattattgtgaactaaagttataaaacaatttttaaggagcttcagacagagtatttgtagttgtacttgagaacaaattctga

SEQ ID NO: 15967 - DNA, 426 bp, Homo sapiens
tttgtgcattcagggtaacctgtacgtccttccttcccagcaccaatctcctttctttttaatgtgttttaaggtatgtgcctctcattccaaattgtatctgacacagggcctggcacgcagtctaatttctcagtaaagatttattgaatttctgaatggatggataaatggtgggggcatagacaagtagacagcaaattatgatttaagacagaatgaaatgataattaccaccactaacattttttgaggacttactatatacaaatccaatgctagttcctttacatgcattctctcacatcattctcacagctacaacatgaggtacatagcatcgtgtctcttccagatgaggaaacagaggctcagagaggttaaatgacttgcccaagacaccaaggtcacctgaagacctgggaa

SEQ ID NO: 15968 - DNA, 520 bp, Homo sapiens
acaataactagatgatcattcattttacatttaatgagcaattgctaactgcttaggatataagtgaaacgaactccttgcccttaaacggttcactctctaggggagagacaaatatacacatgagcagattattatgtaagcttggaagaaagttgcttaacctggccagaagaaacaggaaaggcgtcttggagtaagatgtccaaatcataaggggcaagcatgttgagaatcacacctagcagggaggatattatgagcaaagacaagcaagtgaaagtgggatgtgtataagaattacaaagagtttggtattgctagagcaagataaagtcctgggcaggcgtcaagggtatggtacttggtagcagagaaacattttgtcaagaaaattctcctcctaggctgggcttggtggattacacctgtaatcccagcactttgggaagcagaggtgagaggatggcttgagcacaggagtttgagccaacagagcaagaccctgtctcaaaagaaa

SEQ ID NO: 15969 - DNA, 1083 bp, Homo sapiens
gaccacgccctgcctgcgctaaggcccgggtcggcgcagtagctggtgccttcccggaagggctcagaggcgggctcgggcaagcactttaaccttttaagcccaaccagatgagttgcctgcagttttggaggccttcagagcatttcactagacctctgtctgtgtcggtccagtgtctttagccaagctttgattaaagatgacttccttgtttgctcaagaaattcgcctttctaaaagacatgaagaaatagtatcacaaagattaatgttacttcaacaaatggagaataaattgggtgatcaacacacagaaaaggcatctcaactccaaactgttgagactgcttttaaaaggaaccttagtcttttaaaggatatagaagcagcagaaaagtcactacagaccaggattcacccacttccacggcctgaggtggtttctcttgagactcgttactgggcatcagtagaagaatatattcccaaatgggaacagtttcttttaggaagagcaccatatccttttgctgttgaaaatcaaaatgaagcagaaaataccattcaaaatgaggcacagcgataacttcttcacatgctatttcaaaaagcctgtttaataaagctgaatgttaaggtgtatgtaggttattgcaggaactttaggaattaaatatgttcatattcttcgattatctcctaagtgacagtgaagatatgagaatttactggcaagtcacatgttatcacctactactatttcaaggtcatgaatttgctttctaccaaacccatagatgtgttaaacacgaatattaaaaggtggactctttattaattaaattattgtcagtgttgtgagtgtgttgctttaaaaaaaaaaaaatttacaatcattctcctctaagcaggtatcttggttctggttttaagttaagttttttagaatccttactttttagggacaaggtataggatcaacatggttcttttttttttttaaaccattattgtttcttttaacaaattaaaagacaatgacacctaaactgctctagcaaaataacttatgagaaaata

SEQ ID NO: 15970 - DNA, 1067 bp, Homo sapiens
aactatataatttctttttatatttaactaaaggttttaagagggcttagtctctaaatcagtaacaattagtcataacaccatacaaacacatttaaatattcagaggcgggctcgggcaagcactttaaccttttaagcccaaccagatgagttgcctgcagttttggaggccttcagagcatttcactagacctctgtctgtgtcggtccagtgtctttagccaagctttgattaaagatgacttccttgtttgctcaagaaattcgcctttctaaaagacatgaagaaatagtatcacaaagattaatgttacttcaacaaatggagaataaattgggtgatcaacacacagaaaaggcatctcaactccaaactgttgagactgcttttaaaaggaaccttagtcttttaaaggatatagaagcagcagaaaagtcactacagaccaggattcacccacttccacggcctgaggtggtttctcttgagactcgttactgggcatcagtagaagaatatattcccaaatgggaacagtttcttttaggaagagcaccatatccttttgctgttgaaaatcaaaatgaagcagaaaataccattcaaaatgaggcacagcgataacttcttcacatgctatttcatttaggaattaaatatgttcatattcttcgattatctcctaagtgacagtgaagatatgagaatttactggcaagtcacatgttatcacctactactatttcaaggtcatgaatttgctttctaccaaacccatagatgtgttaaacacgaatattaaaaggtggactctttattaattaaattattgtcagtgttgtgagtgtgttgctttaaaaaaaaaaaaatttacaatcattctcctctaagcaggtatcttggttctggttttaagttaagttttttagaatccttactttttagggacaaggtataggatcaacatggttcttttttttttttaaaccattattgtttcttttaacaaattaaaagacaatgacacctaaactgctctagcaaaataacttatgagaaaata

SEQ ID NO: 15971 - DNA, 590 bp, Homo sapiens
gaccacgccctgcctgcgctaaggcccgggtcggcgcagtagctggtgccttcccggaagggctcagaggcgggctcgggcaagcactttaaccttttaagcccaaccagatgagttgcctgcagttttggaggccttcagagcatttcactagacctctgtctgtgtcggtccagtgtctttagccaagctttgattaaagatgacttccttgtttgctcaagaaattcgcctttctaaaagacatgaagaaatagtatcacaaagattaatgttacttcaacaaatggagaataaattgggtgatcaacacacagaaaaggcatctcaactccaaactgttgagactgcttttaaaaggaaccttagtcttttaaagtacttcaataaacatttattgagcatctattatatcacaaacacagtgcttgctgctagagatgctgcctcttctctttttttgcattctttgagtcattgcatatgcaatttttaaaatcctactttcctcgtatgtttttaaactttggaaagaattttagtggctctaccatagaagtcattatgaaagtaaaataaatgagacttag

SEQ ID NO: 15972 - DNA, 1260 bp, Homo sapiens
gaccacgccctgcctgcgctaaggcccgggtcggcgcagtagctggtgccttcccggaagggctcagaggcgggctcggtgagtggagtcggacagtgggtgggtgccctgactgcctgacggccgcgcagggccttgcaggaccgctggggaggatgttgttaacgtaaagagccaggctgatgaggaaggttcatgagtcctttgggtataagcgggagttggggcggccggagggcagatgactctgagaagggcaagcactttaaccttttaagcccaaccagatgagttgcctgcagttttggaggccttcagagcatttcactagacctctgtctgtgtcggtccagtgtctttagccaagctttgattaaagatgacttccttgtttgctcaagaaattcgcctttctaaaagacatgaagaaatagtatcacaaagattaatgttacttcaacaaatggagaataaattgggtgatcaacacacagaaaaggcatctcaactccaaactgttgagactgcttttaaaaggaaccttagtcttttaaaggatatagaagcagcagaaaagtcactacagaccaggattcacccacttccacggcctgaggtggtttctcttgagactcgttactgggcatcagtagaagaatatattcccaaatgggaacagtttcttttaggaagagcaccatatccttttgctgttgaaaatcaaaatgaagcagaaaataccattcaaaatgaggcacagcgataacttcttcacatgctatttcaaaaagcctgtttaataaagctgaatgttaaggtgtatgtaggttattgcaggaactttaggaattaaatatgttcatattcttcgattatctcctaagtgacagtgaagatatgagaatttactggcaagtcacatgttatcacctactactatttcaaggtcatgaatttgctttctaccaaacccatagatgtgttaaacacgaatattaaaaggtggactctttattaattaaattattgtcagtgttgtgagtgtgttgctttaaaaaaaaaaaaatttacaatcattctcctctaagcaggtatcttggttctggttttaagttaagttttttagaatccttactttttagggacaaggtataggatcaacatggttcttttttttttttaaaccattattgtttcttttaacaaattaaaagacaatgacacctaaactgctctagcaaaataacttatgagaaaata

SEQ ID NO: 15973 - DNA, 1122 bp, Homo sapiens
aactatataatttctttttatatttaactaaaggttttaagagggcttagtctctaaatcagtaacaattagtcataacaccatacaaacacatttaaatattcagaggcgggctcgggcaagcactttaaccttttaagcccaaccagatgagttgcctgcagttttggaggccttcagagcatttcactagacctctgtctgtgtcggtccagtgtctttagccaagctttgattaaagatgacttccttgtttgctcaagaaattcgcctttctaaaagacatgaagaaatagtatcacaaagattaatgttacttcaacaaatggagaataaattgggtgatcaacacacagaaaaggcatctcaactccaaactgttgagactgcttttaaaaggaaccttagtcttttaaaggatatagaagcagcagaaaagtcactacagaccaggattcacccacttccacggcctgaggtggtttctcttgagactcgttactgggcatcagtagaagaatatattcccaaatgggaacagtttcttttaggaagagcaccatatccttttgctgttgaaaatcaaaatgaagcagaaaataccattcaaaatgaggcacagcgataacttcttcacatgctatttcaaaaagcctgtttaataaagctgaatgttaaggtgtatgtaggttattgcaggaactttaggaattaaatatgttcatattcttcgattatctcctaagtgacagtgaagatatgagaatttactggcaagtcacatgttatcacctactactatttcaaggtcatgaatttgctttctaccaaacccatagatgtgttaaacacgaatattaaaaggtggactctttattaattaaattattgtcagtgttgtgagtgtgttgctttaaaaaaaaaaaaatttacaatcattctcctctaagcaggtatcttggttctggttttaagttaagttttttagaatccttactttttagggacaaggtataggatcaacatggttcttttttttttttaaaccattattgtttcttttaacaaattaaaagacaatgacacctaaactgctctagcaaaataacttatgagaaaata

SEQ ID NO: 15974 - DNA, 1212 bp, Homo sapiens
gaccacgccctgcctgcgctaaggcccgggtcggcgcagtagctggtgccttcccggaagggctcagaggcgggctcgtgctgatagtgggcctcacagaaaagttaccatgaaccgactttccgggattcccttggcgctgcattaattggcctcgttgcaaaaggaaaccgagaggaaggcggcaagacttggcctgcgggtgatggcaagcactttaaccttttaagcccaaccagatgagttgcctgcagttttggaggccttcagagcatttcactagacctctgtctgtgtcggtccagtgtctttagccaagctttgattaaagatgacttccttgtttgctcaagaaattcgcctttctaaaagacatgaagaaatagtatcacaaagattaatgttacttcaacaaatggagaataaattgggtgatcaacacacagaaaaggcatctcaactccaaactgttgagactgcttttaaaaggaaccttagtcttttaaaggatatagaagcagcagaaaagtcactacagaccaggattcacccacttccacggcctgaggtggtttctcttgagactcgttactgggcatcagtagaagaatatattcccaaatgggaacagtttcttttaggaagagcaccatatccttttgctgttgaaaatcaaaatgaagcagaaaataccattcaaaatgaggcacagcgataacttcttcacatgctatttcaaaaagcctgtttaataaagctgaatgttaaggtgtatgtaggttattgcaggaactttaggaattaaatatgttcatattcttcgattatctcctaagtgacagtgaagatatgagaatttactggcaagtcacatgttatcacctactactatttcaaggtcatgaatttgctttctaccaaacccatagatgtgttaaacacgaatattaaaaggtggactctttattaattaaattattgtcagtgttgtgagtgtgttgctttaaaaaaaaaaaaatttacaatcattctcctctaagcaggtatcttggttctggttttaagttaagttttttagaatccttactttttagggacaaggtataggatcaacatggttcttttttttttttaaaccattattgtttcttttaacaaattaaaagacaatgacacctaaactgctctagcaaaataacttatgagaaaata

SEQ ID NO: 15975 - DNA, 1036 bp, Homo sapiens
tgatgtaagagctaaattaatgcactgagcagtattataagacactcttggtgcatgaattactgacatttactagctattcaaaagtgaaaaggcagaacttagaagtaccacctcccccacccctatcaaaataagaaatgctgtattctttatctgaaatggattaattgaacaatgatcagttttcctaccatagtgtgcctccatccattcagattatatccagagaagagttgaggtgagagatttgggatacagatattgctagtacaggtgccatttgttttatgtaaatccactttaatataaaatgccgatatctgttacaggatatagaagcagcagaaaagtcactacagaccaggattcacccacttccacggcctgaggtggtttctcttgagactcgttactgggcatcagtagaagaatatattcccaaatgggaacagtttcttttaggaagagcaccatatccttttgctgttgaaaatcaaaatgaagcagaaaataccattcaaaatgaggcacagcgataacttcttcacatgctatttcaaaaagcctgtttaataaagctgaatgttaaggtgtatgtaggttattgcaggaactttaggaattaaatatgttcatattcttcgattatctcctaagtgacagtgaagatatgagaatttactggcaagtcacatgttatcacctactactatttcaaggtcatgaatttgctttctaccaaacccatagatgtgttaaacacgaatattaaaaggtggactctttattaattaaattattgtcagtgttgtgagtgtgttgctttaaaaaaaaaaaaatttacaatcattctcctctaagcaggtatcttggttctggttttaagttaagttttttagaatccttactttttagggacaaggtataggatcaacatggttcttttttttttttaaaccattattgtttcttttaacaaattaaaagacaatgacacctaaactgctctagcaaaataacttatgagaaaata

SEQ ID NO: 15976 - DNA, 186 bp, Homo sapiens
  misc_feature (182)..(182): n is a, c, g, or t
actgcaaccggcataggacagattttccagctggaagccacttgttcacagttggtaaattatttctgagtcccaagggctgggagtagctgcctgaaatgctgcgctgggaagtgttctgtggctccatctggcactgttgcaagtgtgtaagtaagtcctacgtatgtgaatatctcatnccaa

SEQ ID NO: 15977 - DNA, 454 bp, Homo sapiens
gggtctaatagccaccagtgacttggtacagcctctggggggatcagtttataatagtgatgtctactacagtcttaaatggaaataattcagcactttcattgtggtatatttattgtacagatctataagagaatatttatttctaaaatagcaagaaattctgggccgggcatggtggctcacacctctaatcccagcactttgggaggccaaagcaggtggattgcttgagcccaggatttcgagaccagcctgggcaatatagtgagacccccatctctgcaagaaattttaaaaattagccggatgtggtggtgtgcacctgttgttctagcttctcaggaggctgaggaggaaggatcacctgagcctgggaggttgagattgtggtgagctgtgatggcatcactgtactccagcctgggtgacagagtgagaccctgtctcaggg

SEQ ID NO: 15978 - DNA, 198 bp, Homo sapiens
cgaactccaattttgggaggttcccactacccagccctagaaaggctgggatccatagcaaagccttcccatcctgtaccttgggctccagctccctgacaacctatggctcctgtcatgtccttagtccaccgccacctaagtcccgacctccctttctccaggttgaatggtttattaaactgtaaagtctcctgt

SEQ ID NO: 15979 - DNA, 661 bp, Homo sapiens
aagggacttacatcctatctgtctgtcttccacaatcccacccacacacgtgtataaatatatacacatacaaatataaaggtatatagtatattaattctataattaatgatatatgaaaatataggaaaaatgtttcccagagggcctcacttggccagccataccctgggggatcttgtaaattccagactcctctgcaatggttttgcacaatgatgcccaaaccaaatatacatttggtagccagaaaagggggtggtagtggtgctagtgtagaacctaacagctcccaattacgtgttacctacttagtctacacgaccacttgcaaggtaagtattctcacgtcatatagatgaggaaacaggcttagatgttaaatatcttcacaatgccacatagacagtaagtgcatagctgagatcgagacctcagtcacaggttccaaactccatgttcttccactcaaagctataggttgaccctgatcctgacaacctgggccccacccagcacctgtgtatacctaccaatatattctcacaggccagtggcttacacctgtaatcccagcactttgggagaccaaagcaggtggattgtttcagcccaggagtgcgagactagcctgggcaacatggtgaaactccatctctac

SEQ ID NO: 15980 - DNA, 536 bp, Homo sapiens
ggaactggtgggttcttggtctcactgacttaagaaagaagccgcggaccctcggaaactcctggagggcagaggcatgctgcatcttcatcattgcattaccaccacccaacactatcgggggacctgccctgataatcagtctacaggtgtatccagcagctccagagagacagcgaccagcaagaaggggccatgatgatggaggtggttttgtcaaaacgaaaatggggatatgtagggaaaagaaagagagatcagactgttactgtgtctacatagaaagggaagacataagagactccattttgaaaaagacctgtactttaaacaattgctttgctgagatgttgttaatctgtagctttgccccagccactttgccccaaccactttgacccaatctggagctcataaaaacatgtgttgtatgaaatcaagggttaaggcatgtagggctgtgcaggacgtgccttgttaaccaaatgtttgcaagcagtatacttggtaaaagtcatcaccattctctcatctca

SEQ ID NO: 15981 - DNA, 391 bp, Homo sapiens
aaacaggagcgtagtatcttggaagttaacaaagggtcatatttcaagaagaatagatgtaaagtgtcaaatgctgctgaaaggtcaatggaactgaaccagaacagatgtgaagtatccctatcacgtgcagctttgctgacgtcattgagagataaattaggtacaagtgggcagagaattgtatgtgaggttagggagtttagactccatatttatttaatgctttcaggaagtttttctatgaaggtgagcagaggagggaaaaagccagtgttagaaggtcttttatgatgaaaaatgctagatgaaacaaatcaaggagtcgtggagcaatcacacatacaggcacacagacaaagccatctgagaaggtaggagatggtattca

SEQ ID NO: 15982 - DNA, 442 bp, Homo sapiens
ataagatgaaagcttccctccgtggcaccgttaattgaacatgtgaaatgagaggaagatcgttcaaaaacattgcaaagcatgtctttctaccgaatgggcatttaaaaaattgccaccaatgaccacacactgcaactgaccctaagacaacctgaattaatttgagaacatgtggttcacacctaagtgcaaggagtatccaacatagtggtactttgctatctcacaaaagacagactgtcttctgggggttcagtggaaagacttctagaatttaaatcaagaggtgtgttgttacccttaactatgcagcctgcgcaagtcacctctttgccccgccacgatcctcatttctgaatgagaatgtgggctgtggttgtctcaagagtactttccagctttcaaagtccataagttcatgccctccagtataaaactt

SEQ ID NO: 15983 - DNA, 435 bp, Homo sapiens
gccattaatctatattagaaaatgtagaggccccagtgttaaccttcctgaagcttgtctccccacccccaattctataggttctattatatctccgctggtttaaggcaactgctgtttcttttaggagttttcttttctttccttgctgaatatctgcacttagcaatactgcccaggcacatgggctgtggctcaagttttcagtgcaggacagtgtgtcattgcaggagaagacagaacccggccagatcctcccgctgccggcaagcggagtcagttactgggaagccataataattctttcttctagagaattttggcaaaaatgtgcctccatcttacatcaacaatttttcatctttctggaatttttatttccccttcccctcttgttcctttttatcctcctggtgaagtatctccttttcccta

SEQ ID NO: 15984 - DNA, 577 bp, Homo sapiens
aacaaacctgcacattctgcacatgcaccccagaacttacagtattaaaaaaaagaagaacagaaaccaaaatagatccatccttgtatggttaattaacatacagacaaaggtgccaaagcaatccaatgggaaaagaaagtctttttaacaaatggtgttgaacaactagacatcagtatggaaaataacaatgttgtctcctaccttataccatagacagaagttaatttgagttggcgatgtggtttggatttgtgtttccacccaaatatcatgtcaaattgtaatccccaatgttgcgggaggggcctgctgggaggtaattggatcatggaagcacatttcccactagctgttctcatgatagtgagttctcacgagatctgattgtttaaaagtgtgtagcacctcccacttcactctcttcctcctgctccagccatgtaagatgtgcttgcttccctttctaccatgactgaaaatttcctgaggcatgcccagggatgcttcctgtatagcctgtggaaccatgaaccaattcaaaataaaaaaaaaaaaaaacaaaaaaacaaac

SEQ ID NO: 15985 - DNA, 580 bp, Homo sapiens
gaaaatgctgtttctgtacctaaagtgttgggattttcagattgttttcatgagttacagacacacggagcagcatgcttgaacttagaccctttctgcaaatgtcaggctgtatgataattgagccagaatgttactcgagctttctgacacattttttgagacctcccatccagtattctcatacagaaatatggctcctccaggtgtgcacttaacactcgcttctttgcagccaggggaacctttagctaaggaaaaaaaagccctcctacccttggtttcaaaaggttttgaaatgctaattcacaaccatgaagtattctgacagcctggaatgttattcagggcaatcaggcaccttgattattacagaagtgtgaaaggtaaattgctgctacccaagaagtcacccagcttttcaagagaaagctcagaaaaatagcacataaaattatgttcggggattacacttcatgtatcgtgtgatggggtgctctgacacccagcgtgtctgtaggtgtcacaacgtcagctcgtagtagaaatgtaacagcatttgccagcgtcgcccttaagt

SEQ ID NO: 15986 - DNA, 397 bp, Homo sapiens
ctgagtcaggcatggttttccctttaaacataccagtcagctctttccctggaagggtttgtatgttgatatttattaattttaccttttattatagattttatgagctcattcagtgtggagtagtcactggcctgcccatatgtcttgttaccactttcagttgacctaataaaattgatgtggtcatgatacactttgcacagttttctttaatgcattctgataatcctctgctacaggaggttgttatggactaaggaaattgagtttaaattttactattgtcttgggaggctgaggcaggagaattgcttgaacctgggaggcggaggttgcagtgagctgagatcgcaccactgcactccagcctgggcgacagagtgaaactccattt

SEQ ID NO: 15987 - DNA, 1074 bp, Homo sapiens
ggatctctctgtattattatttacaactacatgtgaatctacagttatctcagttttttagaaaaataacttacctagaaaaaaatttttcttgatcgctctttcacatacatttatgtacttctgttttcttgtctttctaactgtttcctcctcctgggacccataaattccacatgtggaattttgagtcaaaattaggatgtttgttaagggcccgcactatgccacaccctgtgacgttagtacttgggaatgaggagcgtgactaacggggcataactgctgcctgcacattgtttacaatccagcaagcaaggggcaccgaacagcagctcgggcagcctgtgctgtggcctgcagagaattccaggtgacgccccagagggcctaggagaggatacccttctgagaacagccgtggctcgcccggcatcaccccactcaagaggccagacggggtcccagctggggtgacacagcgccagtcacatccactcatggacactcagtaggccacactcccgatcacccagccacagtcctagatcagtcactgactcacagtctgccacttgtatttccattgtctctgggcttcctctgccttcaccttccaacagtgtggtacctgcctgagagcagcggcccccagtgggacatgagagccaggaccctgtcattaactgaaccaacacaaagggcacagccattgtcatagataagtgttcaagccggacgtgttctccgtaccggctcctgtgtcacagtaacgggaagcctcaggagtgggagtccttgtggagggagaggtgactaacttggtaggtgagtgtcgggagcatcacgtgttctagaatccagtaaatacacgttagtccccaagaactctgaaactcacaaatgccagtgtcctctccattcggattggtttcggctgtggcctggggacaggcgtgccctggagggtatttgctaatgcagcctgtgctccagaaagaccctaggttctcattcttcctttcccctaggctggcatccttcagaaaaagcatcctgagggggaaaaaaaaa

SEQ ID NO: 15988 - DNA, 464 bp, Homo sapiens
gcttctatccctcacctacaagggccttcccttggaagagacagacctatctcatcagtagggcttggatgaagactcagctgcatggggggccttttttggagaggcagattttctcttcctacttgtgtgggaaatctgggatgccaagcctgcctgtgactggaaaggtgagtgtctaaagcccatctggtcacaaatctaagacatgtgctctgatcagctatatcagtaataaagctgatattcaggccatcaattgtctgacttctggctccttccttaattggatctgaattcagaaggttaaaaagtagctattactcaactctctttcttcccaaatgaaaccccaaacatgcaatacagtgcaaaacaaataattctttgatccccttacaagaggtttaataagaactggaagtaccatctttctccaaggggaggtgtacaaaaaaaaaaaa

SEQ ID NO: 15989 - DNA, 127 bp, Homo sapiens
ttcaccagcacaccaataataattaatgccaatatgagtttgtgaaacttttgcaatgaaactttaattgggattgatctagagggaaaaggaaatgtaagagaaaaatttcaactctagatttttt

SEQ ID NO: 15990 - DNA, 869 bp, Homo sapiens
tatttccttcattgtaactcaaattagtaatttaaaggaaactgcactcagttatttgtccttgtataaagttattttgagcattttttattttaaggagctgcttaattttctgtcatcatttaaggagaaaaatattcagttatctgccatcatattacttgcctggtgttatatcctctttttaatgttctactaacataaaacagttttaaagtaaaaggagtgtagtttcttaaatgttcagttttaaagggaaagataaattaatatagacgaactctgtgttgtctgataaaagagataaaggtcagtagagaaattatggtttatgatggtagtcagctccttcttccccctcaagccacgacactgaatttagcctcagtttgttgttgccattcagtctagctagagcttacaaaaaatacaaaacccccaaatttggattcaaatttcaattcttgtacccatcaccagacacacccccacatggtgattactaatgattattaaaatactctttgggcccagtatgcaaaaaggacatctttttcctgggaccagcacaatctttagcctgtaggagaagcctctgtttaatgcagagctgtggaaggtttacaattaaatgatggtaggtgttattatattcatttattgaaaaggaagccttgtgggattaagcttagaggaaagaatttttgttgttgctgttcagcccagtctttttcataaaaaatgcttgtggcagggtacagtggctcacaccagtaatcccagcactttgggaggccaaggcaggagcatagcttgaccccaggagttcaagaccagcctgggtaacatagtgagaccctgtctctaaa

SEQ ID NO: 15991 - DNA, 670 bp, Homo sapiens
tgtcaaccagtataaacatacttggaaggttaacccaggagttagtaccaggatgtgaaatgcttagaggtgaaactgaccagagggaggaggtgatgttgccacagtttcatctggctgtagtctcctctggctgtacagtggagaacagactgtggggttgagagaggaggaaataagatgagagttgaggcttttgccgtaatccaagtgagggttaacagactaagattcatggctaaggagatgtggctggattcaaagttgatattttgttacagcatctaggtttcctaatacacaaagtaagggcatgaagagagcaatcaggatcccgaggtttttggtcttagtagctgtagctatggaagctgcatcagctgagatgagcatgttggtaataaacataattagaatattatgcaaatatcaggatgactgttatggccatatgaagagtcagagacgaataagtgtaggcatcaaatggctatggacatgcaggttggggtatctggaaagggattgacactggagacatctaatatatggtagctaatgtgtatgctatggtgagtgagccatgggtcacattaaggagaacacacttcagattctggtggtaaatcttttaggggaccagaaagcagtggttgaatgatgaggactg

SEQ ID NO: 15992 - DNA, 453 bp, Homo sapiens
aagatcatctctggatggattgaatgggggtggtgtgggagatagaggcattaagaatgtcccccagtttgggaacatgagtaaatgaaaacgagttttgccttcattgagatcaagaagtgaaataaggaacaagttgatggaaggatcagaagtgatgatagatagatagatagatagatagatagatagatagatagatagatagatagagatggataatttaagttagtgtcattgctacataaatagtatttgaaacaatgggaataaaatatatcaccttgagaacagaaaagtattgagcactgagctatgagaaatttcatcagtcagtagttaaataaagaattagataggaaagaaagaaaaaggtggagggataggagaaggtaaatagcagatggtggagtgggcaaagctaaagagaaaaaagagggataggcaagagac

SEQ ID NO: 15993 - DNA, 1084 bp, Homo sapiens
gaagcagtaccccgtctcgctcggttccgcggcggccacgctccgggagacttccggcagggcgggcgcggggtcttggcgaacggtcttcggaagcggcggcggcgcgatgaccacgctacgggcctttacctgcgacgacctgttccgcttcaacaacattaacttggatccacttacagaaacttatgggattcctttctacctacaatacctcgcccactggccagagtatttcattgttgcagaggcacctggtggagaattaatgggttatattatgggtaaagcagaaggctcagtagctagggaagaatggcacgggcacgtcacagctctgtctgttgccccagaatttcgacgccttggtttggctgctaaacttatggagttactagaggagatttcagaaagaaagggtggattttttgtggatctctttgtaagagtatctaaccaagttgcagttaacatgtacaagcagttgggctacagtgtatataggacggtcatagagtactattcggccagcaacggggagcctgatgaggacgcttatgatatgaggaaagcactttccagggatactgagaagaaatccatcataccattacctcatcctgtgaggcctgaagacattgaataaccctgggcagtggttcttaggcagatactctagatgctttatggacaatattattttcattggatgattctggagctctattaggagaaaagtaatcattttaggtcttaaagacttcaagaaaatacaggttatcaatttattttaaatctcattgtttccagttagcaatatcatacctattaaagctgttcattgtaacaaaattcaatcaaaaaggcagctaggtcagaaggaaacataccactctcatggttcatagtattcactgtatgtatgctagggaaaagacttgctccagtctcctcctcagttctgtgcctgagaaccactgctgcatatatttgtttttaaattttgtattgaactgttaattgaagctttaaaagcatatatgaaatgtataaatctaagatgtataatacattattgactcta

SEQ ID NO: 15994 - DNA, 797 bp, Homo sapiens
  misc_feature (119)..(119): n is a, c, g, or t
  misc_feature (123)..(124): n is a, c, g, or t
  misc_feature (126)..(126): n is a, c, g, or t
tctccctactgtatcctagcaaatcttattaaatattaaagtgaactactgattagaatagtgcctgtcaatggtgactcaataatgatttcttgaatgataaatacctttacctgcgncacnngntccgcttcaacaacattaacttggatccacttacagaaacttatgggattcctttctacctacaatacctcgcccactggccagagtatttcattgttgcagaggcacctggtggagaattaatgggttatattatgggtaaagcagaaggctcagtagctagggaagaatggcacgggcacgtcacagctctgtctgttgccccagaatttcgacgccttggtttggctgctaaacttatggagttactagaggagatttcagaaagaaagggtggattttttgtggatctctttgtaagagtatctaaccaagttgcagttaacatgtacaagcagttgggctacagtgtatataggacggtcatagagtactattcggccagcaacggggagcctgatgaggacgcttatggtaagctcccttccatggcagtatccccaagaagtcgaaacagttacattctttctacagattgtagtatttgattattttaataaatgtagaatatttgactttaaaatttaaatttccctcaacctacctttatcaacctattagtagtagtaattaacttacctattaactaaccaatgggttaatttctgtaccttactgtttcactctgttacatacatattattttgctaacagggaaacgtgtattgtga

SEQ ID NO: 15995 - DNA, 334 bp, Homo sapiens
gaagcagtaccccgtctcgctcggttccgcggcggccacgctccgggagacttccggcagggcgggcgcggggtcttggcgaacggtcttcggaagcggcggcggcgcgatgaccacgctacgggcctttacctgcgacgacctgttccgcttcaacaacattaacttggatccacttacagaaacttatgggattcctttctacctacaatacctcgcccactggactgctgcatatatttgtttttaaattttgtattgaactgttaattgaagctttaaaagcatatatgaaatgtataaatctaagatgtataatacattattgactcta

SEQ ID NO: 15996 - DNA, 222 bp, Homo sapiens
tttaaaaaaacaacagggcggtatgtgaaaactaaggacaaagtggttccgattcaagtgtcaggaagatggaaagaactatgggataagatggctgggaacatttcaaagagggggtgagccttgaagatggataacacattgtaacttggatccacttacagaaacttatccttttttacaaaaaaaaaaaagttgaatgaagatttactgagaataaag

SEQ ID NO: 15997 - DNA, 1280 bp, Homo sapiens
gaagcagtaccccgtctcgctcggttccgcggcggccacgctccgggagacttccggcagggcgggcgcggggtcttggcgaacggtcttcggaagcggcggcggcgcgatgaccacgctacgggcctttacctgcgacgacctgttccgcttcaacaacattaacttggatccacttacagaaacttatgggattcctttctacctacaatacctcgcccactggccagagtatttcattgttgcagaggcacctggtggagaattaatgggttatattatgggtaaagcagaaggctcagtagctagggaagaatggcacgggcacgtcacagctctgtctgttgccccagaatttcgacgccttggtttggctgctaaacttatggagttactagaggagatttcagaaagaaagggtggattttttgtggatctctttgtaagagtatctaaccaagttgcagttaacatgtacaagcagttgggctacagtgtatataggacggtcatagagtactattcggccagcaacggggagcctgatgaggacgcttatgatatgaggaaagcactttccagggatactgagaagaaatccatcataccattacctcatcctgtgaggcctgaagacattgaataaccctgggcagtggttcttaggcagatactctagatgctttatggacaatattattttcattggatgattctggagctctattaggagaaaagtaatcattttaggtcttaaagacttcaagaaaatacaggttatcaatttattttaaatctcattgtttccagttagcaatatcatacctattaaagctgttcattgtaacaaaattcaatcaaaaaggcagctaggtcagaaggaaacataccactctcatggttcatagtattcactgtatgtatgctagggaaaagacttgctccagtctcctcctcagttctgtgcctgagaaccactgctgcatatatttgtttttaaattttgtattgaactgttaattgaagctttaaaagcatatatgaaatgtataaatctaagatgtataatacattattgactctaaaaaaaaaaaaggggggggggttaaagaattccttgagggccaggttaggttaccagtttttggacaaggggcctaaggggaggttaaagaaggagggggggtaaaggtcggtgggaagggtggattgggagaagcttgggggaattgagccaaggaaagccggaaaagttagggaagtcgggaggcgtaaaaagc

SEQ ID NO: 15998 - DNA, 1684 bp, Homo sapiens
  misc_feature (1684)..(1684): n is a, c, g, or t
gaagcagtaccccgtctcgctcggttccgcggcggccacgctccgggagacttccggcagggcgggcgcggggtcttggcgaacggtcttcggaagcggcggcggcgcgatgaccacgctacgggcctttacctgcgacgacctgttccgcttcaacaacattaacttggatccacttacagaaacttatgggattcctttctacctacaatacctcgcccactggccagagtatttcattgttgcagaggcacctggtggagaattaatgggttatattatgggtaaagcagaaggctcagtagctagggaagaatggcacgggcacgtcacagctctgtctgttgccccagaatttcgacgccttggtttggctgctaaacttatggagttactagaggagatttcagaaagaaagggtggattttttgtggatctctttgtaagagtatctaaccaagttgcagttaacatgtacaagcagttgggctacagtgtatataggacggtcatagagtactattcggccagcaacggggagcctgatgaggacgcttatgatatgaggaaagcactttccagggatactgagaagaaatccatcataccattacctcatcctgtgaggcctgaagacattgaataaccctgggcagtggttcttaggcagatactctagatgctttatggacaatattattttcattggatgattctggagctctattaggagaaaagtaatcattttaggtcttaaagacttcaagaaaatacaggttatcaatttattttaaatctcattgtttccagttagcaatatcatacctattaaagctgttcattgtaacaaaattcaatcaaaaaggcagctaggtcagaaggaaacataccactctcatggttcatagtattcactgtatgtatgctagggaaaagacttgctccagtctcctcctcagttctgtgcctgagaaccactgctgcatatatttgtttttaaattttgtattgaactgttaattgaagctttaaaagcatatatgaaatgtataaatctaagatgtataatacattattgactctaaaaaaaaaaaaaacaaaagaaaaaaaaaaactgtggggcgcccgccttgggccctggaaaggttttaaacacaattccggctgggggcggggggccccattaggtagggggaaacggggcccaaggcggctcccaaaggagacccgggcagtggacttaggggcgtgggttccacccaataataaaaagcggcggcgggacccgcgcttctggaacacactcaagtggggtccgcagccagcgcggggcctaatccacagggagtccagaggcgccggttaaatttccggcccggccgacgggtggagaaataagaacagaacgaagaagaaacacaaacgagacacgcagagacgaacacgagaggacaaacgaagcacaagagcgagacacagaaacgacaatgatacaaagaacgaagcgacacagcgatgaagagaagacagacgacagacgaacaaacacaaaaaaggaaataaagacgagaaagcaagaaggaatagagagagaaaaaagtgaaaaaagaaacaacgcaacaaacaacgacatcacgaaagtaagaaacaagacgaaggaagaagcatgagaaggacgcagaan

SEQ ID NO: 15999 - DNA, 1646 bp, Homo sapiens
gaagcagtaccccgtctcgctcggttccgcggcggccacgctccgggagacttccggcagggcgggcgcggggtcttggcgaacggtcttcggaagcggcggcggcgcgatgaccacgctacgggcctttacctgcgacgacctgttccgcttcaacaacattaacttggatccacttacagaaacttatgggattcctttctacctacaatacctcgcccactggccagagtatttcattgttgcagaggcacctggtggagaattaatgggttatattatgggtaaagcagaaggctcagtagctagggaagaatggcacgggcacgtcacagctctgtctgttgccccagaatttcgacgccttggtttggctgctaaacttatggagttactagaggagatttcagaaagaaagggtggattttttgtggatctctttgtaagagtatctaaccaagttgcagttaacatgtacaagcagttgggctacagtgtatataggacggtcatagagtactattcggccagcaacggggagcctgatgaggacgcttatgatatgaggaaagcactttccagggatactgagaagaaatccatcataccattacctcatcctgtgaggcctgaagacattgaataaccctgggcagtggttcttaggcagatactctagatgctttatggacaatattattttcattggatgattctggagctctattaggagaaaagtaatcattttaggtcttaaagacttcaagaaaatacaggttatcaatttattttaaatctcattgtttccagttagcaatatcatacctattaaagctgttcattgtaacaaaattcaatcaaaaaggcagctaggtcagaaggaaacataccactctcatggttcatagtattcactgtatgtatgctagggaaaagacttgctccagtctcctcctcagttctgtgcctgagaaccactgctgcatatatttgtttttaaattttgtattgaactgttaattgaagctttaaaagcatatatgaaatgtataaatctaagatgtataatacattattgactctaactctatgaatgttttctgaagtttgttagtcatttgtaaaactaaatcagattgtaatcccagtactttgggaggccaaggcaggctgattgcttgaggtcaggagtttgagaccagcctggccaaaatctatactaaaaaaaatacaaaaattagctgggcatcccagctatgcagaagctgaagcacaagaattgcttgaaccctggaggtggaggttgcagtgagctgagatcgtcccactgcactccagcccgggcaacagagtaagaccctgcctcaagaaaaaaaaaaaaaaaaaaaatcaggattgtgaaaggtcatcatcatttaagatacgtttaattaaattgtgacttccatacgtagtattttaaaaatgcacacttgaagcaatcactgtccagcatacttaagaagctcccttcttatcgtgtagtaaattcttcccagtcacctgcgttcataccattatactgtttgtttgttagtcctagatcttttctcctcttcacaatgctttgcttaaatcctgcccttctaaaaagccaaaaaaaaaaa

SEQ ID NO: 16000 - DNA, 1157 bp, Homo sapiens
tgggcttctcgccctgccctactgcttgctggttcgtggccgggccgcgcctcttctgggcagagggcaccgccgacggccaggccgcagagggggcttgcgaggatcggaagctggtcagcagctgttgggatgtgtacatcgtgaagcccacctggtggccgtggttaaattgtatccaaatgaaatgacactgatcactgcgtcccctgcagcagatgctgtctcagtcatgtaacttggatccacttacagaaacttatgggattcctttctacctacaatacctcgcccactggccagagtatttcattgttgcagaggcacctggtggagaattaatgggttatattatgggtaaagcagaaggctcagtagctagggaagaatggcacgggcacgtcacagctctgtctgttgccccagaatttcgacgccttggtttggctgctaaacttatggagttactagaggagatttcagaaagaaagggtggattttttgtggatctctttgtaagagtatctaaccaagttgcagttaacatgtacaagcagttgggctacagtgtatataggacggtcatagagtactattcggccagcaacggggagcctgatgaggacgcttatgatatgaggaaagcactttccagggatactgagaagaaatccatcataccattacctcatcctgtgaggcctgaagacattgaataaccctgggcagtggttcttaggcagatactctagatgctttatggacaatattattttcattggatgattctggagctctattaggagaaaagtaatcattttaggtcttaaagacttcaagaaaatacaggttatcaatttattttaaatctcattgtttccagttagcaatatcatacctattaaagctgttcattgtaacaaaattcaatcaaaaaggcagctaggtcagaaggaaacataccactctcatggttcatagtattcactgtatgtatgctagggaaaagacttgctccagtctcctcctcagttctgtgcctgagaaccactgctgcatatatttgtttttaaattttgtattgaactgttaattgaagctttaaaagcatatatgaaatgtataaatctaagatgtataatacattattgactcta

SEQ ID NO: 16001 - DNA, 1064 bp, Homo sapiens
  misc_feature (119)..(119): n is a, c, g, or t
  misc_feature (123)..(124): n is a, c, g, or t
  misc_feature (126)..(126): n is a, c, g, or t
tctccctactgtatcctagcaaatcttattaaatattaaagtgaactactgattagaatagtgcctgtcaatggtgactcaataatgatttcttgaatgataaatacctttacctgcgncacnngntccgcttcaacaacattaacttggatccacttacagaaacttatgggattcctttctacctacaatacctcgcccactggccagagtatttcattgttgcagaggcacctggtggagaattaatgggttatattatgggtaaagcagaaggctcagtagctagggaagaatggcacgggcacgtcacagctctgtctgttgccccagaatttcgacgccttggtttggctgctaaacttatggagttactagaggagatttcagaaagaaagggtggattttttgtggatctctttgtaagagtatctaaccaagttgcagttaacatgtacaagcagttgggctacagtgtatataggacggtcatagagtactattcggccagcaacggggagcctgatgaggacgcttatgatatgaggaaagcactttccagggatactgagaagaaatccatcataccattacctcatcctgtgaggcctgaagacattgaataaccctgggcagtggttcttaggcagatactctagatgctttatggacaatattattttcattggatgattctggagctctattaggagaaaagtaatcattttaggtcttaaagacttcaagaaaatacaggttatcaatttattttaaatctcattgtttccagttagcaatatcatacctattaaagctgttcattgtaacaaaattcaatcaaaaaggcagctaggtcagaaggaaacataccactctcatggttcatagtattcactgtatgtatgctagggaaaagacttgctccagtctcctcctcagttctgtgcctgagaaccactgctgcatatatttgtttttaaattttgtattgaactgttaattgaagctttaaaagcatatatgaaatgtataaatctaagatgtataatacattattgactcta

SEQ ID NO: 16002 - DNA, 1077 bp, Homo sapiens
gaagcagtaccccgtctcgctcggttccgcggcggccacgctccgggagacttccggcagggcgggcgcggggtcttggcgaacggtcttcggaagcggcggcggcgcgatgaccacgctacgggcctttacctgcgacgacctgttccgcttcaacaacattccttaacaggactctagtatgggattcctttctacctacaatacctcgcccactggccagagtatttcattgttgcagaggcacctggtggagaattaatgggttatattatgggtaaagcagaaggctcagtagctagggaagaatggcacgggcacgtcacagctctgtctgttgccccagaatttcgacgccttggtttggctgctaaacttatggagttactagaggagatttcagaaagaaagggtggattttttgtggatctctttgtaagagtatctaaccaagttgcagttaacatgtacaagcagttgggctacagtgtatataggacggtcatagagtactattcggccagcaacggggagcctgatgaggacgcttatgatatgaggaaagcactttccagggatactgagaagaaatccatcataccattacctcatcctgtgaggcctgaagacattgaataaccctgggcagtggttcttaggcagatactctagatgctttatggacaatattattttcattggatgattctggagctctattaggagaaaagtaatcattttaggtcttaaagacttcaagaaaatacaggttatcaatttattttaaatctcattgtttccagttagcaatatcatacctattaaagctgttcattgtaacaaaattcaatcaaaaaggcagctaggtcagaaggaaacataccactctcatggttcatagtattcactgtatgtatgctagggaaaagacttgctccagtctcctcctcagttctgtgcctgagaaccactgctgcatatatttgtttttaaattttgtattgaactgttaattgaagctttaaaagcatatatgaaatgtataaatctaagatgtataatacattattgactcta

SEQ ID NO: 16003 - DNA, 1045 bp, Homo sapiens
gaagcagtaccccgtctcgctcggttccgcggcggccacgctccgggagacttccggcagggcgggcgcggggtcttggcgaacggtcttcggaagcggcggcggcgcgatgaccacgctacgggcctttacctgcgacgacctgttccgcttcaacaacattaacttggatccacttacagaaactccagagtatttcattgttgcagaggcacctggtggagaattaatgggttatattatgggtaaagcagaaggctcagtagctagggaagaatggcacgggcacgtcacagctctgtctgttgccccagaatttcgacgccttggtttggctgctaaacttatggagttactagaggagatttcagaaagaaagggtggattttttgtggatctctttgtaagagtatctaaccaagttgcagttaacatgtacaagcagttgggctacagtgtatataggacggtcatagagtactattcggccagcaacggggagcctgatgaggacgcttatgatatgaggaaagcactttccagggatactgagaagaaatccatcataccattacctcatcctgtgaggcctgaagacattgaataaccctgggcagtggttcttaggcagatactctagatgctttatggacaatattattttcattggatgattctggagctctattaggagaaaagtaatcattttaggtcttaaagacttcaagaaaatacaggttatcaatttattttaaatctcattgtttccagttagcaatatcatacctattaaagctgttcattgtaacaaaattcaatcaaaaaggcagctaggtcagaaggaaacataccactctcatggttcatagtattcactgtatgtatgctagggaaaagacttgctccagtctcctcctcagttctgtgcctgagaaccactgctgcatatatttgtttttaaattttgtattgaactgttaattgaagctttaaaagcatatatgaaatgtataaatctaagatgtataatacattattgactcta

SEQ ID NO: 16004 - DNA, 1021 bp, Homo sapiens
tgggcttctcgccctgccctactgcttgctggttcgtggccgggccgcgcctcttctgggcagagggcaccgccgacggccaggccgcagagggggcttgcgaggatcggaagctggtcagcagctgttgggatgtgtacatcgtgaagcccacctggtggccgtggttaaattgtatccaaatgaaatgacactgatcactgcgtcccctgcagcagatgctgtctcagtcatgtaacttggatccacttacagaaacttatgggattcctttctacctacaatacctcgcccactggccagagtatttcattgttgcagaggcacctggtggagaattaatgggttataaaagggtggattttttgtggatctctttgtaagagtatctaaccaagttgcagttaacatgtacaagcagttgggctacagtgtatataggacggtcatagagtactattcggccagcaacggggagcctgatgaggacgcttatgatatgaggaaagcactttccagggatactgagaagaaatccatcataccattacctcatcctgtgaggcctgaagacattgaataaccctgggcagtggttcttaggcagatactctagatgctttatggacaatattattttcattggatgattctggagctctattaggagaaaagtaatcattttaggtcttaaagacttcaagaaaatacaggttatcaatttattttaaatctcattgtttccagttagcaatatcatacctattaaagctgttcattgtaacaaaattcaatcaaaaaggcagctaggtcagaaggaaacataccactctcatggttcatagtattcactgtatgtatgctagggaaaagacttgctccagtctcctcctcagttctgtgcctgagaaccactgctgcatatatttgtttttaaattttgtattgaactgttaattgaagctttaaaagcatatatgaaatgtataaatctaagatgtataatacattattgactcta

SEQ ID NO: 16005 - DNA, 715 bp, Homo sapiens
gacttcaaatgattacttttctcctaatagagctccagaatcatccaatgaaaataatattgtccataaagcatctagagtatctaaccaagttgcagttaacatgtacaagcagttgggctacagtgtatataggacggtcatagagtactattcggccagcaacggggagcctgatgaggacgcttatgatatgaggaaagcactttccagggatactgagaagaaatccatcataccattacctcatcctgtgaggcctgaagacattgaataaccctgggcagtggttcttaggcagatactctagatgctttatggacaatattattttcattggatgattctggagctctattaggagaaaagtaatcattttaggtcttaaagacttcaagaaaatacaggttatcaatttattttaaatctcattgtttccagttagcaatatcatacctattaaagctgttcattgtaacaaaattcaatcaaaaaggcagctaggtcagaaggaaacataccactctcatggttcatagtattcactgtatgtatgctagggaaaagacttgctccagtctcctcctcagttctgtgcctgagaaccactgctgcatatatttgtttttaaattttgtattgaactgttaattgaagctttaaaagcatatatgaaatgtataaatctaagatgtataatacattattgactcta

SEQ ID NO: 16006 - DNA, 938 bp, Homo sapiens
gaagcagtaccccgtctcgctcggttccgcggcggccacgctccgggagacttccggcagggcgggcgcggggtcttggcgaacggtcttcggaagcggcggcggcgcgatgaccacgctacgggcctttacctgcgacgacctgttccgcttcaacaacattaacttggatccacttacagaaacttatgggattcctttctacctacaatacctcgcccactggccagagtatttcattgttgcagaggcacctggtggagaattaatgggttatattatgggtaaagcagaaggctcagtagctagggaagaatggcacgggcacgtcacagctctgtctgttgccccagaatttcgacgccttggtttggctgctaaacttatggagttactagaggagatttcagaaagatatgaggaaagcactttccagggatactgagaagaaatccatcataccattacctcatcctgtgaggcctgaagacattgaataaccctgggcagtggttcttaggcagatactctagatgctttatggacaatattattttcattggatgattctggagctctattaggagaaaagtaatcattttaggtcttaaagacttcaagaaaatacaggttatcaatttattttaaatctcattgtttccagttagcaatatcatacctattaaagctgttcattgtaacaaaattcaatcaaaaaggcagctaggtcagaaggaaacataccactctcatggttcatagtattcactgtatgtatgctagggaaaagacttgctccagtctcctcctcagttctgtgcctgagaaccactgctgcatatatttgtttttaaattttgtattgaactgttaattgaagctttaaaagcatatatgaaatgtataaatctaagatgtataatacattattgactcta

SEQ ID NO: 16007 - DNA, 701 bp, Homo sapiens
aggtctggttagcatctggtacacttggcaattgggagacatttataaatacattttgcttagaatatggtgaagtgggggtagggataaaacctcttatgggaactttacctatacactttacatttgatataatacattttttgggtgtttatattaaactttgcttctttacagatatgaggaaagcactttccagggatactgagaagaaatccatcataccattacctcatcctgtgaggcctgaagacattgaataaccctgggcagtggttcttaggcagatactctagatgctttatggacaatattattttcattggatgattctggagctctattaggagaaaagtaatcattttaggtcttaaagacttcaagaaaatacaggttatcaatttattttaaatctcattgtttccagttagcaatatcatacctattaaagctgttcattgtaacaaaattcaatcaaaaaggcagctaggtcagaaggaaacataccactctcatggttcatagtattcactgtatgtatgctagggaaaagacttgctccagtctcctcctcagttctgtgcctgagaaccactgctgcatatatttgtttttaaattttgtattgaactgttaattgaagctttaaaagcatatatgaaatgtataaatctaagatgtataatacattattgactcta

SEQ ID NO: 16008 - DNA, 756 bp, Homo sapiens
gaagcagtaccccgtctcgctcggttccgcggcggccacgctccgggagacttccggcagggcgggcgcggggtcttggcgaacggtcttcggaagcggcggcggcgcgatgaccacgctacgggcctttacctgcgacgacctgttccgcttcaacaacattaacttggatccacttacagaaacttatgggattcctttctacctacaatacctcgcccactggccagagtatttcattgttgcagaggcacctggtggagaattaatgggttatattatgggtaaagcagaaggctcagtagctagggaagaatggcacgggcacgtcacagctctgtctgttgccccagaatttcgacgccttggtttggctgctaaacttatggagttactagaggagatttcagaaagaaagggtggattttttgtggatctctttgtaagagtatctaaccaagttgcagttaacatgtacaagcagttgggctacagtgtatataggacggtcatagagtactattcggccagcaacggggagcctgatgaggacgcttatgatatgaggaaagcactttccagggatactgagaagaaatccatcataccattacctcatcctgtgaggcctgaagacattgaataaccactgctgcatatatttgtttttaaattttgtattgaactgttaattgaagctttaaaagcatatatgaaatgtataaatctaagatgtataatacattattgactcta

SEQ ID NO: 16009 - DNA, 817 bp, Homo sapiens
gaagcagtaccccgtctcgctcggttccgcggcggccacgctccgggagacttccggcagggcgggcgcggggtcttggcgaacggtcttcggaagcggcggcggcgcgatgaccacgctacgggcctttacctgcgacgacctgttccgcttcaacaacattaacttggatccacttacagaaacttatgggattcctttctacctacaatacctcgcccactggccagagtatttcattgttgcagaggcacctggtggagaattaatgggttatattatgggtaaagcagaaggctcagtagctagggaagaatggcacgggcacgtcacagctctgtctgttgccccagaatttcgacgccttggtttggctgctaaacttatggagttactagaggagatttcagaaagaaagggtggattttttgtggatctctttgtaagagtatctaaccaagttgcagttaacatgtacaagcagttgggctacagtgtatataggacggtcatagagtactattcggccagcaacggggagcctgatgaggacgcttatggtaagctcccttccatggcagtatccccaagaagtcgaaacagttacattctttctacagattgtagtatttgattattttaataaatgtagaatatttgactttaaaatttaaatttccctcaacctacctttatcaacctattagtagtagtaattaacttacctattaactaaccaatgggttaatttctgtaccttactgtttcactctgttacatacatattattttgctaacagggaaacgtgtattgtga

SEQ ID NO: 16010 - DNA, 332 bp, Homo sapiens
ctccagttccattagcaatttattgccacttagaaaacacaagatgtagatttattaacttgaattttaaagaagcaagtagcagttaagtgaaaaaatatgtaaacaccttaatagtggctgtgacagcttattatggctattaggtagattaaatcatctgcctcagccctaaagttggccttaaagttgttgatgaaacatgttttgttttccttgtggcatattactgttagctttagcaggcttatttcaactggttattgtaaacgctgcttactagagacatttctcttgtttctttcagtaacttggatccacttacagaaact

SEQ ID NO: 16011 - DNA, 455 bp, Homo sapiens
caaaattagttgtgttttaagtatatcgttcttttttgttctaattctgattttagaactattctaaatgtaacagatagtgttacatttacaagtgaatttcaaataaaagcactaactgttagctggatgacctcaggtggtacttaaaaacttctttattagtttcctttgtaataaaaacatactgaacagtaattctatatttatgtgtaaatcaatgtctagttactgaatgtgatttttgttgttgttggcagttatgggtaaagcagaaggctcagtagctagggaagaatggcacgggcacgtcacagctctgtctgttgccccagaatttcgacgccttggtttggctgctaaacttatggagttactagaggagatttcagaaaggtgagattcagtttttcaaatacacttagtgatttgtggacccctaaccattttcttcc

SEQ ID NO: 16012 - DNA, 3369 bp, Homo sapiens
cgccgccgccgacttaaactttggagggggaaaaagagctactggcgcctggcgaccctccctgccccccacccaaccccgctccggcaacgcccccttcctcacggctcccgaccgaacttttctccaacttctgcgactcgtgagattcccttctacccactccggccctcgggacccctctgcccatcccctggccggtcgggtccctgcgaacccctttatctctggaatccactcggtccccgactcagagactcctgccctccacccccaaggaccccgccatcctcaggtcccctccgcctgccagatcttttctcggatccccgctctcccaccacctgctcacgagatcccgcggatctagaacccagggtcccccggggccccccggccgggtcccgggtgggctccaggcggccggtccccggcctccccccatggccaccgccccctcttatcccgccgggctccctggctctcccgggccggggtctcctccgccccccggcggcctagagctgcagtcgccgccaccgctactgccccagatcccggccccgggttccggggtctcctttcacatccagatcgggctgacccgcgagttcgtgctgttgcccgccgcctccgagctggctcatgtgaagcagctggcctgttccatcgtggaccagaagttccctgagtgtggcttctacggcctttacgacaagatcctgcttttcaaacatgaccccacgtcggccaacctcctgcagctggtgcgctcgtccggagacatccaggagggcgacctggtggaggtggtgctgtcggcctcggccaccttcgaggacttccagatccgcccgcacgccctcacggtgcactcctatcgggcgcctgccttctgtgatcactgcggggagatgctcttcggcctagtgcgccagggcctcaagtgcgatggctgcgggctgaactaccacaagcgctgtgccttcagcatccccaacaactgtagtggggcccgcaaacggcgcctgtcatccacgtctctggccagtggccactcggtgcgcctcggcacctccgagtccctgccctgcacggctgaagagctgagccgtagcaccaccgaactcctgcctcgccgtcccccgtcatcctcttcctcctcttctgcctcatcgtatacgggccgccccattgagctggacaagatgctgctctccaaggtcaaggtgccgcacaccttcctcatccacagctatacacggcccaccgtttgccaggcttgcaagaaactcctcaagggcctcttccggcagggcctgcaatgcaaagactgcaagtttaactgtcacaaacgctgcgccacccgcgtccctaatgactgcctgggggaggcccttatcaatggagatgtgccgatggaggaggccaccgatttcagcgaggctgacaagagcgccctcatggatgagtcagaggactccggtgtcatccctggctcccactcagagaatgcgctccacgccagtgaggaggaggaaggcgagggaggcaaggcccagagctccctggggtacatccccctaatgagggtggtgcaatcggtgcgacacacgacgcggaaatccagcaccacgctgcgggagggttgggtggttcattacagcaacaaggacacgctgagaaagcggcactattggcgcctggactgcaagtgtatcacgctcttccagaacaacacgaccaacagatactataaggaaattccgctgtcagaaatcctcacggtggagtccgcccagaacttcagccttgtgccgccgggcaccaacccacactgctttgagatcgtcactgccaatgccacctacttcgtgggcgagatgcctggcgggactccgggtgggccaagtgggcagggggctgaggccgcccggggctgggagacagccatccgccaggccctgatgcccgtcatccttcaggacgcacccagcgccccaggccacgcgccccacagacaagcttctctgagcatctctgtgtccaacagtcagatccaagagaatgtggacattgccactgtctaccagatcttccctgacgaagtgctgggctcagggcagtttggagtggtctatggaggaaaacaccggaagacaggccgggacgtggcagttaaggtcattgacaaactgcgcttccctaccaagcaggagagccagctccggaatgaagtggccattctgcagagcctgcggcatcccgggatcgtgaacctggagtgcatgttcgagacgcctgagaaagtgtttgtggtgatggagaagctgcatggggacatgttggagatgatcctgtccagtgagaagggccggctgcctgagcgcctcaccaagttcctcatcacccagatcctggtggctttgagacaccttcacttcaagaacattgtccactgtgacttgaaaccagaaaacgtgttgctggcatcagcagacccatttcctcaggtgaagctgtgtgactttggctttgctcgcatcatcggcgagaagtcgttccgccgctcagtggtgggcacgccggcctacctggcacccgaggtgctgctcaaccagggctacaaccgctcgctggacatgtggtcagtgggcgtgatcatgtacgtcagcctcagcggcaccttccctttcaacgaggatgaggacatcaatgaccagatccagaacgccgccttcatgtacccggccagcccctggagccacatctcagctggagccattgacctcatcaacaacctgctgcaggtgaagatgcgcaaacgctacagcgtggacaaatctctcagccacccctggttacaggagtaccagacgtggctggacctccgagagctggaggggaagatgggagagcgatacatcacgcatgagagtgacgacgcgcgctgggagcagtttgcagcagagcatccgctgcctgggtctgggctgcccacggacagggatctcggtggggcctgtccaccacaggaccacgacatgcaggggctggcggagcgcatcagtgttctctgaggtcctgtgccctcgtccagctgctgccctccacagcggttcttcacaggatcccagcaatgaactgttctagggaaagtggcttcctgcccaaactggatgggacacgtggggagtggggtggggggagctatttccaaggcccctccctgtttccccagcaattaaaacggactcatctctggccccatggccttgatctcagcacacggcactctcgaatcattactctgttgtaccaacatggagttcatctggaaggaggactgcctgaaaagaggaaggatgg

SEQ ID NO: 16013 - DNA, 3005 bp, Homo sapiens
attcagcatcccctcccacctccgccaggttccggaaaattcgaggtgtccacgctcccggagccactctccctcccaccccagctcccccttccagccaccaaacccacgccggcgccccctccccgtacaattggggcgctggcatcctgcccggctcgcgctggggttgggagggggcaggcaggaagcgagggcctgcggggtctctgcgtttccgggggaaacagccggccctgccctgggagggtcacagtccgcccgctgctgaaggcggctctgagcttttccgtcgccacatccctctcccgcccctcagttccctgagtgtggcttctacggcctttacgacaagatcctgcttttcaaacatgaccccacgtcggccaacctcctgcagctggtgcgctcgtccggagacatccaggagggcgacctggtggaggtggtgctgtcggcctcggccaccttcgaggacttccagatccgcccgcacgccctcacggtgcactcctatcgggcgcctgccttctgtgatcactgcggggagatgctcttcggcctagtgcgccagggcctcaagtgcgatggctgcgggctgaactaccacaagcgctgtgccttcagcatccccaacaactgtagtggggcccgcaaacggcgcctgtcatccacgtctctggccagtggccactcggtgcgcctcggcacctccgagtccctgccctgcacggctgaagagctgagccgtagcaccaccgaactcctgcctcgccgtcccccgtcatcctcttcctcctcttctgcctcatcgtatacgggccgccccattgagctggacaagatgctgctctccaaggtcaaggtgccgcacaccttcctcatccacagctatacacggcccaccgtttgccaggcttgcaagaaactcctcaagggcctcttccggcagggcctgcaatgcaaagactgcaagtttaactgtcacaaacgctgcgccacccgcgtccctaatgactgcctgggggaggcccttatcaatggagatgtgccgatggaggaggccaccgatttcagcgaggctgacaagagcgccctcatggatgagtcagaggactccggtgtcatccctggctcccactcagagaatgcgctccacgccagtgaggaggaggaaggcgagggaggcaaggcccagagctccctggggtacatccccctaatgagggtggtgcaatcggtgcgacacacgacgcggaaatccagcaccacgctgcgggagggttgggtggttcattacagcaacaaggacacgctgagaaagcggcactattggcgcctggactgcaagtgtatcacgctcttccagaacaacacgaccaacagatactataaggaaattccgctgtcagaaatcctcacggtggagtccgcccagaacttcagccttgtgccgccgggcaccaacccacactgctttgagatcgtcactgccaatgccacctacttcgtgggcgagatgcctggcgggactccgggtgggccaagtgggcagggggctgaggccgcccggggctgggagacagccatccgccaggccctgatgcccgtcatccttcaggacgcacccagcgccccaggccacgcgccccacagacaagcttctctgagcatctctgtgtccaacagtcagatccaagagaatgtggacattgccactgtctaccagatcttccctgacgaagtgctgggctcagggcagtttggagtggtctatggaggaaaacaccggaagacaggccgggacgtggcagttaaggtcattgacaaactgcgcttccctaccaagcaggagagccagctccggaatgaagtggccattctgcagagcctgcggcatcccgggatcgtgaacctggagtgcatgttcgagacgcctgagaaagtgtttgtggtgatggagaagctgcatggggacatgttggagatgatcctgtccagtgagaagggccggctgcctgagcgcctcaccaagttcctcatcacccagatcctggtggctttgagacaccttcacttcaagaacattgtccactgtgacttgaaaccagaaaacgtgttgctggcatcagcagacccatttcctcaggtgaagctgtgtgactttggctttgctcgcatcatcggcgagaagtcgttccgccgctcagtggtgggcacgccggcctacctggcacccgaggtgctgctcaaccagggctacaaccgctcgctggacatgtggtcagtgggcgtgatcatgtacgtcagcctcagcggcaccttccctttcaacgaggatgaggacatcaatgaccagatccagaacgccgccttcatgtacccggccagcccctggagccacatctcagctggagccattgacctcatcaacaacctgctgcaggtgaagatgcgcaaacgctacagcgtggacaaatctctcagccacccctggttacaggagtaccagacgtggctggacctccgagagctggaggggaagatgggagagcgatacatcacgcatgagagtgacgacgcgcgctgggagcagtttgcagcagagcatccgctgcctgggtctgggctgcccacggacagggatctcggtggggcctgtccaccacaggaccacgacatgcaggggctggcggagcgcatcagtgttctctgaggtcctgtgccctcgtccagctgctgccctccacagcggttcttcacaggatcccagcaatgaactgttctagggaaagtggcttcctgcccaaactggatgggacacgtggggagtggggtggggggagctatttccaaggcccctccctgtttccccagcaattaaaacggactcatctctggccccatggccttgatctcagcacacggcactctcgaatcattactctgttgtaccaacatggagttcatctggaaggaggactgcctgaaaagaggaaggatgg

SEQ ID NO: 16014 - DNA, 3347 bp, Homo sapiens
cgccgccgccgacttaaactttggagggggaaaaagagctactggcgcctggcgaccctccctgccccccacccaaccccgctccggcaacgcccccttcctcacggctcccgaccgaacttttctccaacttctgcgactcgtgagattcccttctacccactccggccctcgggacccctctgcccatcccctggccggtcgggtccctgcgaacccctttatctctggaatccactcggtccccgactcagagactcctgccctccacccccaaggaccccgccatcctcaggtcccctccgcctgccagatcttttctcggatccccgctctcccaccacctgctcacgagatcccgcggatctagaacccagggtcccccggggccccccggccgggtcccgggtgggctccaggcggccggtccccggcctccccccatggccaccgccccctcttatcccgccgggctccctggctctcccgggccggggtctcctccgccccccggcggcctagagctgcagtcgccgccaccgctactgccccagatcccggccccgggttccggggtctcctttcacatccagatcgggctgacccgcgagttcgtgctgttgcccgccgcctccgagctggctcatgtgaagcagctggcctgttccatcgtggaccagaagttccctgagtgtggcttctacggcctttacgacaagatcctgcttttcaaacatgaccccacgtcggccaacctcctgcagctggtgcgctcgtccggagacatccaggagggcgacctggtggaggtggtgctgtcggcctcggccaccttcgaggacttccagatccgcccgcacgccctcacggtgcactcctatcgggcgcctgccttctgtgatcactgcggggagatgctcttcggcctagtgcgccagggcctcaagtgcgatggctgcgggctgaactaccacaagcgctgtgccttcagcatccccaacaactgtagtggggcccgcaaacggcgcctgtcatccacgtctctggccagtggccactcggtgcgcctcggcacctccgagtccctgccctgcacggctgaagagctgagccgtagcaccaccgaactcctgcctcgccgtcccccgtcatcctcttcctcctcttctgcctcatcgtatacgggccgccccattgagctggacaagatgctgctctccaaggtcaaggtgccgcacaccttcctcatccacagctatacacggcccaccgtttgccaggcttgcaagaaactcctcaagggcctcttccggcagggcctgcaatgcaaagactgcaagtttaactgtcacaaacgctgcgccacccgcgtccctaatgactgcctgggggaggcccttatcaatggagcgatttcagcgaggctgacaagagcgccctcatggatgagtcagaggactccggtgtcatccctggctcccactcagagaatgcgctccacgccagtgaggaggaggaaggcgagggaggcaaggcccagagctccctggggtacatccccctaatgagggtggtgcaatcggtgcgacacacgacgcggaaatccagcaccacgctgcgggagggttgggtggttcattacagcaacaaggacacgctgagaaagcggcactattggcgcctggactgcaagtgtatcacgctcttccagaacaacacgaccaacagatactataaggaaattccgctgtcagaaatcctcacggtggagtccgcccagaacttcagccttgtgccgccgggcaccaacccacactgctttgagatcgtcactgccaatgccacctacttcgtgggcgagatgcctggcgggactccgggtgggccaagtgggcagggggctgaggccgcccggggctgggagacagccatccgccaggccctgatgcccgtcatccttcaggacgcacccagcgccccaggccacgcgccccacagacaagcttctctgagcatctctgtgtccaacagtcagatccaagagaatgtggacattgccactgtctaccagatcttccctgacgaagtgctgggctcagggcagtttggagtggtctatggaggaaaacaccggaagacaggccgggacgtggcagttaaggtcattgacaaactgcgcttccctaccaagcaggagagccagctccggaatgaagtggccattctgcagagcctgcggcatcccgggatcgtgaacctggagtgcatgttcgagacgcctgagaaagtgtttgtggtgatggagaagctgcatggggacatgttggagatgatcctgtccagtgagaagggccggctgcctgagcgcctcaccaagttcctcatcacccagatcctggtggctttgagacaccttcacttcaagaacattgtccactgtgacttgaaaccagaaaacgtgttgctggcatcagcagacccatttcctcaggtgaagctgtgtgactttggctttgctcgcatcatcggcgagaagtcgttccgccgctcagtggtgggcacgccggcctacctggcacccgaggtgctgctcaaccagggctacaaccgctcgctggacatgtggtcagtgggcgtgatcatgtacgtcagcctcagcggcaccttccctttcaacgaggatgaggacatcaatgaccagatccagaacgccgccttcatgtacccggccagcccctggagccacatctcagctggagccattgacctcatcaacaacctgctgcaggtgaagatgcgcaaacgctacagcgtggacaaatctctcagccacccctggttacaggagtaccagacgtggctggacctccgagagctggaggggaagatgggagagcgatacatcacgcatgagagtgacgacgcgcgctgggagcagtttgcagcagagcatccgctgcctgggtctgggctgcccacggacagggatctcggtggggcctgtccaccacaggaccacgacatgcaggggctggcggagcgcatcagtgttctctgaggtcctgtgccctcgtccagctgctgccctccacagcggttcttcacaggatcccagcaatgaactgttctagggaaagtggcttcctgcccaaactggatgggacacgtggggagtggggtggggggagctatttccaaggcccctccctgtttccccagcaattaaaacggactcatctctggccccatggccttgatctcagcacacggcactctcgaatcattactctgttgtaccaacatggagttcatctggaaggaggactgcctgaaaagaggaaggatgg

SEQ ID NO: 16015 - DNA, 2157 bp, Homo sapiens
acaaacaaacagaaaaccaaccctaaattttcccactgagtctatcctggaggctacagtgttacccagggccccaaaaaacccacataatgaatattttattactattacacaattcagtttccttaagttcaccaatatcattatacatcctgtgcaatcaagaaattcactccaggcacattctccaatattggaatgtgccgatggaggaggccaccgatttcagcgaggctgacaagagcgccctcatggatgagtcagaggactccggtgtcatccctggctcccactcagagaatgcgctccacgccagtgaggaggaggaaggcgagggaggcaaggcccagagctccctggggtacatccccctaatgagggtggtgcaatcggtgcgacacacgacgcggaaatccagcaccacgctgcgggagggttgggtggttcattacagcaacaaggacacgctgagaaagcggcactattggcgcctggactgcaagtgtatcacgctcttccagaacaacacgaccaacagatactataaggaaattccgctgtcagaaatcctcacggtggagtccgcccagaacttcagccttgtgccgccgggcaccaacccacactgctttgagatcgtcactgccaatgccacctacttcgtgggcgagatgcctggcgggactccgggtgggccaagtgggcagggggctgaggccgcccggggctgggagacagccatccgccaggccctgatgcccgtcatccttcaggacgcacccagcgccccaggccacgcgccccacagacaagcttctctgagcatctctgtgtccaacagtcagatccaagagaatgtggacattgccactgtctaccagatcttccctgacgaagtgctgggctcagggcagtttggagtggtctatggaggaaaacaccggaagacaggccgggacgtggcagttaaggtcattgacaaactgcgcttccctaccaagcaggagagccagctccggaatgaagtggccattctgcagagcctgcggcatcccgggatcgtgaacctggagtgcatgttcgagacgcctgagaaagtgtttgtggtgatggagaagctgcatggggacatgttggagatgatcctgtccagtgagaagggccggctgcctgagcgcctcaccaagttcctcatcacccagatcctggtggctttgagacaccttcacttcaagaacattgtccactgtgacttgaaaccagaaaacgtgttgctggcatcagcagacccatttcctcaggtgaagctgtgtgactttggctttgctcgcatcatcggcgagaagtcgttccgccgctcagtggtgggcacgccggcctacctggcacccgaggtgctgctcaaccagggctacaaccgctcgctggacatgtggtcagtgggcgtgatcatgtacgtcagcctcagcggcaccttccctttcaacgaggatgaggacatcaatgaccagatccagaacgccgccttcatgtacccggccagcccctggagccacatctcagctggagccattgacctcatcaacaacctgctgcaggtgaagatgcgcaaacgctacagcgtggacaaatctctcagccacccctggttacaggagtaccagacgtggctggacctccgagagctggaggggaagatgggagagcgatacatcacgcatgagagtgacgacgcgcgctgggagcagtttgcagcagagcatccgctgcctgggtctgggctgcccacggacagggatctcggtggggcctgtccaccacaggaccacgacatgcaggggctggcggagcgcatcagtgttctctgaggtcctgtgccctcgtccagctgctgccctccacagcggttcttcacaggatcccagcaatgaactgttctagggaaagtggcttcctgcccaaactggatgggacacgtggggagtggggtggggggagctatttccaaggcccctccctgtttccccagcaattaaaacggactcatctctggccccatggccttgatctcagcacacggcactctcgaatcattactctgttgtaccaacatggagttcatctggaaggaggactgcctgaaaagaggaaggatgg

SEQ ID NO: 16016 - DNA, 3422 bp, Homo sapiens
cgccgccgccgacttaaactttggagggggaaaaagagctactggcgcctggcgaccctccctgccccccacccaaccccgctccggcaacgcccccttcctcacggctcccgaccgaacttttctccaacttctgcgactcgtgagattcccttctacccactccggccctcgggacccctctgcccatcccctggccggtcgggtccctgcgaacccctttatctctggaatccactcggtccccgactcagagactcctgccctccacccccaaggaccccgccatcctcaggtcccctccgcctgccagatcttttctcggatccccgctctcccaccacctgctcacgagatcccgcggatctagaacccagggtcccccggggccccccggccgggtcccgggtgggctccaggcggccggtccccggcctccccccatggccaccgccccctcttatcccgccgggctccctggctctcccgggccggggtctcctccgccccccggcggcctagagctgcagtcgccgccaccgctactgccccagatcccggccccgggttccggggtctcctttcacatccagatcgggctgacccgcgagttcgtgctgttgcccgccgcctccgagctggctcatgtgaagcagctggcctgttccatcgtggaccagaagttccctgagtgtggcttctacggcctttacgacaagatcctgcttttcaaacatgaccccacgtcggccaacctcctgcagctggtgcgctcgtccggagacatccaggagggcgacctggtggaggtggtgctgtcggcctcggccaccttcgaggacttccagatccgcccgcacgccctcacggtgcactcctatcgggcgcctgccttctgtgatcactgcggggagatgctcttcggcctagtgcgccagggcctcaagtgcgatggctgcgggctgaactaccacaagcgctgtgccttcagcatccccaacaactgtagtggggcccgcaaacggcgcctgtcatccacgtctctggccagtggccactcggtgcgcctcggcacctccgagtccctgccctgcacggctgaagagctgagccgtagcaccaccgaactcctgcctcgccgtcccccgtcatcctcttcctcctcttctgcctcatcgtatacgggccgccccattgagctggacaagatgctgctctccaaggtcaaggtgccgcacaccttcctcatccacagctatacacggcccaccgtttgccaggcttgcaagaaactcctcaagggcctcttccggcagggcctgcaatgcaaagactgcaagtttaactgtcacaaacgctgcgccacccgcgtccctaatgactgcctgggggaggcccttatcaatggagatgtgccgatggaggaggccaccgatttcagcgaggctgacaagagcgccctcatggatgagtcagaggactccggtgtcatccctggctcccactcagagaatgcgctccacgccagtgaggaggaggaaggcgagggaggcaaggcccagagctccctggggtacatccccctaatgagggtggtgcaatcggtgcgacacacgacgcggaaatccagcaccacgctgcgggagggttgggtggttcattacagcaacaaggacacgctgagaaagcggcactattggcgcctggactgcaagtgtatcacgctcttccagaacaacacgaccaacagatactataaggaaattccgctgtcagaaatcctcacggtggagtccgcccagaacttcagccttgtgccgccgggcaccaacccacactgctttgagatcgtcactgccaatgccacctacttcgtgggcgagatgcctggcgggactccgggtgggccaagtgggcagggggctgaggccgcccggggctgggagacagccatccgcaggcctgatgcccgtcatccttcagggcctggcggatggctgtctcccagccccaggccctgatgcccgtcatccttcaggacgcacccagcgccccaggccacgcgccccacagacaagcttctctgagcatctctgtgtccaacagtcagatccaagagaatgtggacattgccactgtctaccagatcttccctgacgaagtgctgggctcagggcagtttggagtggtctatggaggaaaacaccggaagacaggccgggacgtggcagttaaggtcattgacaaactgcgcttccctaccaagcaggagagccagctccggaatgaagtggccattctgcagagcctgcggcatcccgggatcgtgaacctggagtgcatgttcgagacgcctgagaaagtgtttgtggtgatggagaagctgcatggggacatgttggagatgatcctgtccagtgagaagggccggctgcctgagcgcctcaccaagttcctcatcacccagatcctggtggctttgagacaccttcacttcaagaacattgtccactgtgacttgaaaccagaaaacgtgttgctggcatcagcagacccatttcctcaggtgaagctgtgtgactttggctttgctcgcatcatcggcgagaagtcgttccgccgctcagtggtgggcacgccggcctacctggcacccgaggtgctgctcaaccagggctacaaccgctcgctggacatgtggtcagtgggcgtgatcatgtacgtcagcctcagcggcaccttccctttcaacgaggatgaggacatcaatgaccagatccagaacgccgccttcatgtacccggccagcccctggagccacatctcagctggagccattgacctcatcaacaacctgctgcaggtgaagatgcgcaaacgctacagcgtggacaaatctctcagccacccctggttacaggagtaccagacgtggctggacctccgagagctggaggggaagatgggagagcgatacatcacgcatgagagtgacgacgcgcgctgggagcagtttgcagcagagcatccgctgcctgggtctgggctgcccacggacagggatctcggtggggcctgtccaccacaggaccacgacatgcaggggctggcggagcgcatcagtgttctctgaggtcctgtgccctcgtccagctgctgccctccacagcggttcttcacaggatcccagcaatgaactgttctagggaaagtggcttcctgcccaaactggatgggacacgtggggagtggggtggggggagctatttccaaggcccctccctgtttccccagcaattaaaacggactcatctctggccccatggccttgatctcagcacacggcactctcgaatcattactctgttgtaccaacatggagttcatctggaaggaggactgcctgaaaagaggaaggatgg

SEQ ID NO: 16017 - DNA, 3266 bp, Homo sapiens
cgccgccgccgacttaaactttggagggggaaaaagagctactggcgcctggcgaccctccctgccccccacccaaccccgctccggcaacgcccccttcctcacggctcccgaccgaacttttctccaacttctgcgactcgtgagattcccttctacccactccggccctcgggacccctctgcccatcccctggccggtcgggtccctgcgaacccctttatctctggaatccactcggtccccgactcagagactcctgccctccacccccaaggaccccgccatcctcaggtcccctccgcctgccagatcttttctcggatccccgctctcccaccacctgctcacgagatcccgcggatctagaacccagggtcccccggggccccccggccgggtcccgggtgggctccaggcggccggtccccggcctccccccatggccaccgccccctcttatcccgccgggctccctggctctcccgggccggggtctcctccgccccccggcggcctagagctgcagtcgccgccaccgctactgccccagatcccggccccgggttccggggtctcctttcacatccagatcgggctgacccgcgagttcgtgctgttgcccgccgcctccgagctggctcatgtgaagcagctggcctgttccatcgtggaccagaagttccctgagtgtggcttctacggcctttacgacaagatcctgcttttcaaacatgaccccacgtcggccaacctcctgcagctggtgcgctcgtccggagacatccaggagggcgacctggtggaggtggtgctgtcggcctcggccaccttcgaggacttccagatccgcccgcacgccctcacggtgcactcctatcgggcgcctgccttctgtgatcactgcggggagatgctcttcggcctagtgcgccagggcctcaagtgcgatggctgcgggctgaactaccacaagcgctgtgccttcagcatccccaacaactgtagtggggcccgcaaacggcgcctgtcatccacgtctctggccagtggccactcggtgcgcctcggcacctccgagtccctgccctgcacggctgaagagctgagccgtagcaccaccgaactcctgcctcgccgtcccccgtcatcctcttcctcctcttctgcctcatcgtatacgggccgccccattgagctggacaagatgctgctctccaaggtcaaggtgccgcacaccttcctcatccacagctatacacggcccaccgtttgccaggcttgcaagaaactcctcaagggcctcttccggcagggcctgcaatgcaaagactgcaagtttaactgtcacaaacgctgcgccacccgcgtccctaatgactgcctgggggaggcccttatcaatggagatgtgccgatggaggaggccaccgatttcagcgaggctgacaagagcgccctcatggatgagtcagaggactccggtgtcatccctggctcccactcagagaatgcgctccacgccagtgaggaggaggaaggcgagggaggcaaggcccagagctccctggggtacatccccctaatgagggtggtgcaatcggtgcgacacacgacgcggaaatccagcaccacgctgcgggagggttgggtggttcattacagcaacaaggacacgctgagaaagcggcactattggcgcctggactgcaagtgtatcacgctcttccagaacaacacgaccaacagatactataaggaaattccgctgtcagaaatcctcacggtggagtccgcccagaacttcagccttgtgccgccgggcaccaacccacactgctttgagatcgtcactgccaatgccacctacttcgtgggcgagatgcctggcgggactccgggtgggccaagtgggcagggggctgaggccgcccggggctgggagacagccatccgccaggccctgatgcccgtcatccttcaggacgcacccagcgccccaggccacgcgccccacagacaagcttctctgagcatctctgtgtccaacagtcagatccaagagaatgtggacattgccactgtctaccagatcttccctgacgaagtgctgggctcagggcagtttggagtggtctatggaggaaaacaccggaagacaggccgggacgtggcagttaaggtcattgacaaactgcgcttccctaccaagcaggagagccagctccggaatgaagtggccattctgcagagcctgcggcatcccgggatcgtgaacctggagtgcatgttcgagacgcctgagaaagtgtttgtggtgatggagaagctgcatggggacatgttggagatgatcctgtccagtgagaagggccggctgcctgagcgcctcaccaagttcctcatcacccagatcctggtggctttgagacaccttcacttcaagaacattgtccactgtgacttgaaaccagaaaacgtgttgctggcatcagcagacccatttcctcaggtgaagctgtgtgactttggctttgctcgcatcatcggcgagaagtcgttccgccgctcagtggtgggcacgccggcctacctggcacccgaggtgctgctcaaccagggctacaaccgctcgctggacatgtggtcagtgggcgtgatcatgtacgtcagcctcagcggcaccttccctttcaacgaggatgaggacatcaatgaccagatccagaacgccgccttcatgtacccggccagcccctggagccacatctcagctggagccattgacctcatcaacaacctgctgcaggtgaagatgcgcaaacgctacagcgtggacaaatctctcagccacccctggttacaggagtaccagacgtggctggacctccgagagctggaggggaagatgggagagcgatacatcacgcatgagagtgacgacgcgcgctgggagcagtttgcagcagagcatccgctgcctgggtctgggctgcccacggacagggatctcggtggggcctgtccaccacaggaccacgacatgcaggggctggcggagcgcatcagtgttctctgaggtcctgtgccctcgtccagctgctgccctccacagcggttcttcacaggatcccagcaatgaactgttctagggaaagtggcttcctgcccaaactggatgggacacgtggggagtggggtggggggagctatttccaaggcccctccctgtttccccagcaattaaaacggactcatctctggc

SEQ ID NO: 16018 - DNA, 1835 bp, Homo sapiens
ggtggggtggggttacggcgtagggtaggtgctagagttacggcgtgcacgtggtgctccaggcacctggagccccaagcagctccacgggatagggactgggcaggaaagtctggcggttcacgtgactcttcaaacatctctgcagagaaagcggcactattggcgcctggactgcaagtgtatcacgctcttccagaacaacacgaccaacagatactataaggaaattccgctgtcagaaatcctcacggtggagtccgcccagaacttcagccttgtgccgccgggcaccaacccacactgctttgagatcgtcactgccaatgccacctacttcgtgggcgagatgcctggcgggactccgggtgggccaagtgggcagggggctgaggccgcccggggctgggagacagccatccgccaggccctgatgcccgtcatccttcaggacgcacccagcgccccaggccacgcgccccacagacaagcttctctgagcatctctgtgtccaacagtcagatccaagagaatgtggacattgccactgtctaccagatcttccctgacgaagtgctgggctcagggcagtttggagtggtctatggaggaaaacaccggaagacaggccgggacgtggcagttaaggtcattgacaaactgcgcttccctaccaagcaggagagccagctccggaatgaagtggccattctgcagagcctgcggcatcccgggatcgtgaacctggagtgcatgttcgagacgcctgagaaagtgtttgtggtgatggagaagctgcatggggacatgttggagatgatcctgtccagtgagaagggccggctgcctgagcgcctcaccaagttcctcatcacccagatcctggtggctttgagacaccttcacttcaagaacattgtccactgtgacttgaaaccagaaaacgtgttgctggcatcagcagacccatttcctcaggtgaagctgtgtgactttggctttgctcgcatcatcggcgagaagtcgttccgccgctcagtggtgggcacgccggcctacctggcacccgaggtgctgctcaaccagggctacaaccgctcgctggacatgtggtcagtgggcgtgatcatgtacgtcagcctcagcggcaccttccctttcaacgaggatgaggacatcaatgaccagatccagaacgccgccttcatgtacccggccagcccctggagccacatctcagctggagccattgacctcatcaacaacctgctgcaggtgaagatgcgcaaacgctacagcgtggacaaatctctcagccacccctggttacaggagtaccagacgtggctggacctccgagagctggaggggaagatgggagagcgatacatcacgcatgagagtgacgacgcgcgctgggagcagtttgcagcagagcatccgctgcctgggtctgggctgcccacggacagggatctcggtggggcctgtccaccacaggaccacgacatgcaggggctggcggagcgcatcagtgttctctgaggtcctgtgccctcgtccagctgctgccctccacagcggttcttcacaggatcccagcaatgaactgttctagggaaagtggcttcctgcccaaactggatgggacacgtggggagtggggtggggggagctatttccaaggcccctccctgtttccccagcaattaaaacggactcatctctggccccatggccttgatctcagcacacggcactctcgaatcattactctgttgtaccaacatggagttcatctggaaggaggactgcctgaaaagaggaaggatgg

SEQ ID NO: 16019 - DNA, 3315 bp, Homo sapiens
cgccgccgccgacttaaactttggagggggaaaaagagctactggcgcctggcgaccctccctgccccccacccaaccccgctccggcaacgcccccttcctcacggctcccgaccgaacttttctccaacttctgcgactcgtgagattcccttctacccactccggccctcgggacccctctgcccatcccctggccggtcgggtccctgcgaacccctttatctctggaatccactcggtccccgactcagagactcctgccctccacccccaaggaccccgccatcctcaggtcccctccgcctgccagatcttttctcggatccccgctctcccaccacctgctcacgagatcccgcggatctagaacccagggtcccccggggccccccggccgggtcccgggtgggctccaggcggccggtccccggcctccccccatggccaccgccccctcttatcccgccgggctccctggctctcccgggccggggtctcctccgccccccggcggcctagagctgcagtcgccgccaccgctactgccccagatcccggccccgggttccggggtctcctttcacatccagatcgggctgacccgcgagttcgtgctgttgcccgccgcctccgagctggctcatgtgaagcagctggcctgttccatcgtggaccagaagttccctgagtgtggcttctacggcctttacgacaagatcctgcttttcaaacatgaccccacgtcggccaacctcctgcagctggtgcgctcgtccggagacatccaggagggcgacctggtggaggtggtgctgtcggcctcggccaccttcgaggacttccagatccgcccgcacgccctcacggtgcactcctatcgggcgcctgccttctgtgatcactgcggggagatgctcttcggcctagtgcgccagggcctcaagtgcgatggctgcgggctgaactaccacaagcgctgtgccttcagcatccccaacaactgtagtggggcccgcaaacggcgcctgtcatccacgtctctggccagtggccactcggtgcgcctcggcacctccgagtccctgccctgcacggctgaagagctgagccgtagcaccaccgaactcctgcctcgccgtcccccgtcatcctcttcctcctcttctgcctcatcgtatacgggccgccccattgagctggacaagatgctgctctccaaggtcaaggtgccgcacaccttcctcatccacagctatacacggcccaccgtttgccaggcttgcaagaaactcctcaagggcctcttccggcagggcctgcaatgcaaagactgcaagtttaactgtcacaaacgctgcgccacccgcgtccctaatgactgcctgggggaggcccttatcaatggagatgtgccgatggaggaggccaccgatttcagcgaggctgacaagagcgccctcatggatgagtcagaggactccggtgtcatccctggctcccactcagagaatgcgctccacgccagtgaggaggaggaaggcgagggaggcaaggcccagagctccctggggtacatccccctaatgagggtggtgcaatcggtgcgacacacgacgcggaaatccagcaccacgctgcgggagggttgggtggttcattacagcaacaaggacacgctgagaaagcggcactattggcgcctggactgcaagtgtatcacgctcttccagaacaacacgaccaacagatactataaggaaattccgctgtcagaaatcctcacggtggagtccgcccagaacttcagccttgtgccgccgggcaccaacccacactgctttgagatcgtcactgccaatgccacctacttcgtgggcgagatgcctggcgggactccgggtgggccaagtgggcagggggctgaggccgcccggggctgggagacagccatccgccaggccctgatgcccgtcatccttcaggacgcacccagcgccccaggccacgcgccccacagacaagcttctctgagcatctctgtgtccaacagtcagatccaagagaatgtggacattgccactgtctaccagatcttccctgacgaagtgctgggctcagggcagtttggagtggtctatggaggcttccctaccaagcaggagagccagctccggaatgaagtggccattctgcagagcctgcggcatcccgggatcgtgaacctggagtgcatgttcgagacgcctgagaaagtgtttgtggtgatggagaagctgcatggggacatgttggagatgatcctgtccagtgagaagggccggctgcctgagcgcctcaccaagttcctcatcacccagatcctggtggctttgagacaccttcacttcaagaacattgtccactgtgacttgaaaccagaaaacgtgttgctggcatcagcagacccatttcctcaggtgaagctgtgtgactttggctttgctcgcatcatcggcgagaagtcgttccgccgctcagtggtgggcacgccggcctacctggcacccgaggtgctgctcaaccagggctacaaccgctcgctggacatgtggtcagtgggcgtgatcatgtacgtcagcctcagcggcaccttccctttcaacgaggatgaggacatcaatgaccagatccagaacgccgccttcatgtacccggccagcccctggagccacatctcagctggagccattgacctcatcaacaacctgctgcaggtgaagatgcgcaaacgctacagcgtggacaaatctctcagccacccctggttacaggagtaccagacgtggctggacctccgagagctggaggggaagatgggagagcgatacatcacgcatgagagtgacgacgcgcgctgggagcagtttgcagcagagcatccgctgcctgggtctgggctgcccacggacagggatctcggtggggcctgtccaccacaggaccacgacatgcaggggctggcggagcgcatcagtgttctctgaggtcctgtgccctcgtccagctgctgccctccacagcggttcttcacaggatcccagcaatgaactgttctagggaaagtggcttcctgcccaaactggatgggacacgtggggagtggggtggggggagctatttccaaggcccctccctgtttccccagcaattaaaacggactcatctctggccccatggccttgatctcagcacacggcactctcgaatcattactctgttgtaccaacatggagttcatctggaaggaggactgcctgaaaagaggaaggatgg

SEQ ID NO: 16020 - DNA, 1341 bp, Homo sapiens
catttccatttgcacccctgacctgccctgtcttcaccctgtaggacattgccactgtctaccagatcttccctgacgaagtgctgggctcagggcagtttggagtggtctatggaggaaaacaccggaagacaggccgggacgtggcagttaaggtcattgacaaactgcgcttccctaccaagcaggagagccagctccggaatgaagtggccattctgcagagcctgcggcatcccgggatcgtgaacctggagtgcatgttcgagacgcctgagaaagtgtttgtggtgatggagaagctgcatggggacatgttggagatgatcctgtccagtgagaagggccggctgcctgagcgcctcaccaagttcctcatcacccagatcctggtggctttgagacaccttcacttcaagaacattgtccactgtgacttgaaaccagaaaacgtgttgctggcatcagcagacccatttcctcaggtgaagctgtgtgactttggctttgctcgcatcatcggcgagaagtcgttccgccgctcagtggtgggcacgccggcctacctggcacccgaggtgctgctcaaccagggctacaaccgctcgctggacatgtggtcagtgggcgtgatcatgtacgtcagcctcagcggcaccttccctttcaacgaggatgaggacatcaatgaccagatccagaacgccgccttcatgtacccggccagcccctggagccacatctcagctggagccattgacctcatcaacaacctgctgcaggtgaagatgcgcaaacgctacagcgtggacaaatctctcagccacccctggttacaggagtaccagacgtggctggacctccgagagctggaggggaagatgggagagcgatacatcacgcatgagagtgacgacgcgcgctgggagcagtttgcagcagagcatccgctgcctgggtctgggctgcccacggacagggatctcggtggggcctgtccaccacaggaccacgacatgcaggggctggcggagcgcatcagtgttctctgaggtcctgtgccctcgtccagctgctgccctccacagcggttcttcacaggatcccagcaatgaactgttctagggaaagtggcttcctgcccaaactggatgggacacgtggggagtggggtggggggagctatttccaaggcccctccctgtttccccagcaattaaaacggactcatctctggccccatggccttgatctcagcacacggcactctcgaatcattactctgttgtaccaacatggagttcatctggaaggaggactgcctgaaaagaggaaggatgg

SEQ ID NO: 16021 - DNA, 3821 bp, Homo sapiens
  misc_feature (3212)..(3212): n is a, c, g, or t
  misc_feature (3243)..(3243): n is a, c, g, or t
cgccgccgccgacttaaactttggagggggaaaaagagctactggcgcctggcgaccctccctgccccccacccaaccccgctccggcaacgcccccttcctcacggctcccgaccgaacttttctccaacttctgcgactcgtgagattcccttctacccactccggccctcgggacccctctgcccatcccctggccggtcgggtccctgcgaacccctttatctctggaatccactcggtccccgactcagagactcctgccctccacccccaaggaccccgccatcctcaggtcccctccgcctgccagatcttttctcggatccccgctctcccaccacctgctcacgagatcccgcggatctagaacccagggtcccccggggccccccggccgggtcccgggtgggctccaggcggccggtccccggcctccccccatggccaccgccccctcttatcccgccgggctccctggctctcccgggccggggtctcctccgccccccggcggcctagagctgcagtcgccgccaccgctactgccccagatcccggccccgggttccggggtctcctttcacatccagatcgggctgacccgcgagttcgtgctgttgcccgccgcctccgagctggctcatgtgaagcagctggcctgttccatcgtggaccagaagttccctgagtgtggcttctacggcctttacgacaagatcctgcttttcaaacatgaccccacgtcggccaacctcctgcagctggtgcgctcgtccggagacatccaggagggcgacctggtggaggtggtgctgtcggcctcggccaccttcgaggacttccagatccgcccgcacgccctcacggtgcactcctatcgggcgcctgccttctgtgatcactgcggggagatgctcttcggcctagtgcgccagggcctcaagtgcgatggctgcgggctgaactaccacaagcgctgtgccttcagcatccccaacaactgtagtggggcccgcaaacggcgcctgtcatccacgtctctggccagtggccactcggtgcgcctcggcacctccgagtccctgccctgcacggctgaagagctgagccgtagcaccaccgaactcctgcctcgccgtcccccgtcatcctcttcctcctcttctgcctcatcgtatacgggccgccccattgagctggacaagatgctgctctccaaggtcaaggtgccgcacaccttcctcatccacagctatacacggcccaccgtttgccaggcttgcaagaaactcctcaagggcctcttccggcagggcctgcaatgcaaagactgcaagtttaactgtcacaaacgctgcgccacccgcgtccctaatgactgcctgggggaggcccttatcaatggagatgtgccgatggaggaggccaccgatttcagcgaggctgacaagagcgccctcatggatgagtcagaggactccggtgtcatccctggctcccactcagagaatgcgctccacgccagtgaggaggaggaaggcgagggaggcaaggcccagagctccctggggtacatccccctaatgagggtggtgcaatcggtgcgacacacgacgcggaaatccagcaccacgctgcgggagggttgggtggttcattacagcaacaaggacacgctgagaaagcggcactattggcgcctggactgcaagtgtatcacgctcttccagaacaacacgaccaacagatactataaggaaattccgctgtcagaaatcctcacggtggagtccgcccagaacttcagccttgtgccgccgggcaccaacccacactgctttgagatcgtcactgccaatgccacctacttcgtgggcgagatgcctggcgggactccgggtgggccaagtgggcagggggctgaggccgcccggggctgggagacagccatccgccaggccctgatgcccgtcatccttcaggacgcacccagcgccccaggccacgcgccccacagacaagcttctctgagcatctctgtgtccaacagtcagatccaagagaatgtggacattgccactgtctaccagatcttccctgacgaagtgctgggctcagggcagtttggagtggtctatggaggaaaacaccggaagacaggccgggacgtggcagttaaggtcattgacaaactgcgcttccctaccaagcaggagagccagctccggaatgaagtggccattctgcagagcctgcggcatcccgggatcgtgaacctggagtgcatgttcgagacgcctgagaaagtgtttgtggtgatggagaagctgcatggggacatgttggagatgatcctgtccagtgagaagggccggctgcctgagcgcctcaccaagttcctcatcacccagatcctggtggctttgagacaccttcacttcaagaacattgtccactgtgacttgaaaccagaaaacgtgttgctggcatcagcagacccatttcctcaggtgaagctgtgtgactttggctttgctcgcatcatcggcgagaagtcgttccgccgctcagtggtgggcacgccggcctacctggcacccgaggtgctgctcaaccagggctacaaccgctcgctggacatgtggtcagtgggcgtgatcatgtacgtcagcctcagcggcaccttccctttcaacgaggatgaggacatcaatgaccagatccagaacgccgccttcatgtacccggccagcccctggagccacatctcagctggagccattgacctcatcaacaacctgctgcaggtgaagatgcgcaaacgctacagcgtggacaaatctctcagccacccctggttacaggagtaccagacgtggctggacctccgagagctggaggggaagatgggagagcgatacatcacgcatgagagtgacgacgcgcgctgggagcagtttgcagcagagcatccgctgcctgggtctgggctgcccacggacagggatctcggtggggcctgtccaccacaggaccacgacatgcaggggctggcggagcgcatcagtgttctctgaggtcctgtgccctcgtccagctgctgccctccacagcggttcttcacaggatcccagcaatgaactgttctagggaaagtggcttcctgcccaaactggatgggacacgtggggagtggggtggggggggtngggggcgagctattttccaaaggggcccccncccccccccaacccccccccggcccccccccccccgtttttttttttttttcccccccgccccccccccctttttgggggatttttttcaccccccaatggccaaaattttaaaaagaccggtgacctccaattctgtcccgttggggggcccccccccccaattttggggggccccttttttggaaaacacaaaaaacacgagtacaacaaacaacaagaacatataattatagtattaaacaacaagaagaagaggcgcggcgcggcgcggcggcgctcctcctattaaagaggaagaagttattattctctctctcttcggagaggggggggggcccccccaagagcttcttttgatgcagcgcgcgtttttctcccccgagggctctttttctcttgttggtttcccaacacgggtggtgggtggggttctcccccttttatttgaggtgatgagagctctgcggtatattattatttagcgccctatgagggcacccgcgtgggccgcccgctctgctgttttttttaccacacacgcgctcttccgtgtgacatgcgtggggggacaacaaa

SEQ ID NO: 16022 - DNA, 1252 bp, Homo sapiens
ggtggggtggggttacggcgtagggtaggtgctagagttacggcgtgcacgtggtgctccaggcacctggagccccaagcagctccacgggatagggactgggcaggaaagtctggcggttcacgtgactcttcaaacatctctgcagagaaagcggcactattggcgcctggactgcaagtgtatcacgctcttccagaacaacacgaccaacagatactataaggaaattccgctgtcagaaatcctcacggtggagtccgcccagaacttcagccttgtgccgccgggcaccaacccacactgctttgagatcaccttcacttcaagaacattgtccactgtgacttgaaaccagaaaacgtgttgctggcatcagcagacccatttcctcaggtgaagctgtgtgactttggctttgctcgcatcatcggcgagaagtcgttccgccgctcagtggtgggcacgccggcctacctggcacccgaggtgctgctcaaccagggctacaaccgctcgctggacatgtggtcagtgggcgtgatcatgtacgtcagcctcagcggcaccttccctttcaacgaggatgaggacatcaatgaccagatccagaacgccgccttcatgtacccggccagcccctggagccacatctcagctggagccattgacctcatcaacaacctgctgcaggtgaagatgcgcaaacgctacagcgtggacaaatctctcagccacccctggttacaggagtaccagacgtggctggacctccgagagctggaggggaagatgggagagcgatacatcacgcatgagagtgacgacgcgcgctgggagcagtttgcagcagagcatccgctgcctgggtctgggctgcccacggacagggatctcggtggggcctgtccaccacaggaccacgacatgcaggggctggcggagcgcatcagtgttctctgaggtcctgtgccctcgtccagctgctgccctccacagcggttcttcacaggatcccagcaatgaactgttctagggaaagtggcttcctgcccaaactggatgggacacgtggggagtggggtggggggagctatttccaaggcccctccctgtttccccagcaattaaaacggactcatctctggccccatggccttgatctcagcacacggcactctcgaatcattactctgttgtaccaacatggagttcatctggaaggaggactgcctgaaaagaggaaggatgg

SEQ ID NO: 16023 - DNA, 1097 bp, Homo sapiens
aaaaaaaaaaaaagaaaattttcaaaaaaaaaaaaaaaaaaaaaaaaaaaagtatggatgggtttggagggctggctgctgaggttgggatttggctgagtacctatctacctttcttactgggcccatctgctcccctcagatcctggtggctttgagacaccttcacttcaagaacattgtccactgtgacttgaaaccagaaaacgtgttgctggcatcagcagacccatttcctcaggtgaagctgtgtgactttggctttgctcgcatcatcggcgagaagtcgttccgccgctcagtggtgggcacgccggcctacctggcacccgaggtgctgctcaaccagggctacaaccgctcgctggacatgtggtcagtgggcgtgatcatgtacgtcagcctcagcggcaccttccctttcaacgaggatgaggacatcaatgaccagatccagaacgccgccttcatgtacccggccagcccctggagccacatctcagctggagccattgacctcatcaacaacctgctgcaggtgaagatgcgcaaacgctacagcgtggacaaatctctcagccacccctggttacaggagtaccagacgtggctggacctccgagagctggaggggaagatgggagagcgatacatcacgcatgagagtgacgacgcgcgctgggagcagtttgcagcagagcatccgctgcctgggtctgggctgcccacggacagggatctcggtggggcctgtccaccacaggaccacgacatgcaggggctggcggagcgcatcagtgttctctgaggtcctgtgccctcgtccagctgctgccctccacagcggttcttcacaggatcccagcaatgaactgttctagggaaagtggcttcctgcccaaactggatgggacacgtggggagtggggtggggggagctatttccaaggcccctccctgtttccccagcaattaaaacggactcatctctggccccatggccttgatctcagcacacggcactctcgaatcattactctgttgtaccaacatggagttcatctggaaggaggactgcctgaaaagaggaaggatgg

SEQ ID NO: 16024 - DNA, 2871 bp, Homo sapiens
cgccgccgccgacttaaactttggagggggaaaaagagctactggcgcctggcgaccctccctgccccccacccaaccccgctccggcaacgcccccttcctcacggctcccgaccgaacttttctccaacttctgcgactcgtgagattcccttctacccactccggccctcgggacccctctgcccatcccctggccggtcgggtccctgcgaacccctttatctctggaatccactcggtccccgactcagagactcctgccctccacccccaaggaccccgccatcctcaggtcccctccgcctgccagatcttttctcggatccccgctctcccaccacctgctcacgagatcccgcggatctagaacccagggtcccccggggccccccggccgggtcccgggtgggctccaggcggccggtccccggcctccccccatggccaccgccccctcttatcccgccgggctccctggctctcccgggccggggtctcctccgccccccggcggcctagagctgcagtcgccgccaccgctactgccccagatcccggccccgggttccggggtctcctttcacatccagatcgggctgacccgcgagttcgtgctgttgcccgccgcctccgagctggctcatgtgaagcagctggcctgttccatcgtggaccagaagttccctgagtgtggcttctacggcctttacgacaagatcctgcttttcaaacatgaccccacgtcggccaacctcctgcagctggtgcgctcgtccggagacatccaggagggcgacctggtggaggtggtgctgtcggcctcggccaccttcgaggacttccagatccgcccgcacgccctcacggtgcactcctatcgggcgcctgccttctgtgatcactgcggggagatgctcttcggcctagtgcgccagggcctcaagtgcgatggctgcgggctgaactaccacaagcgctgtgccttcagcatccccaacaactgtagtggggcccgcaaacggcgcctgtcatccacgtctctggccagtggccactcggtgcgcctcggcacctccgagtccctgccctgcacggctgaagagctgagccgtagcaccaccgaactcctgcctcgccgtcccccgtcatcctcttcctcctcttctgcctcatcgtatacgggccgccccattgagctggacaagatgctgctctccaaggtcaaggtgccgcacaccttcctcatccacagctatacacggcccaccgtttgccaggcttgcaagaaactcctcaagggcctcttccggcagggcctgcaatgcaaagactgcaagtttaactgtcacaaacgctgcgccacccgcgtccctaatgactgcctgggggaggcccttatcaatggagatgtgccgatggaggaggccaccgatttcagcgaggctgacaagagcgccctcatggatgagtcagaggactccggtgtcatccctggctcccactcagagaatgcgctccacgccagtgaggaggaggaaggcgagggaggcaaggcccagagctccctggggtacatccccctaatgagggtggtgcaatcggtgcgacacacgacgcggaaatccagcaccacgctgcgggagggttgggtggttcattacagcaacaaggacacgctgagaaagcggcactattggcgcctggactgcaagtgtatcacgctcttccagaacaacacgaccaacagatactataaggaaattccgctgtcagaaatcctcacggtggagtccgcccagaacttcagccttgtgccgccgggcaccaacccacactgctttgagatcgtcactgccaatgccacctacttcgtgggcgagatgcctggcgggactccgggtgggccaagtgggcagggggctgaggccgcccggggctgggagacagccatccgccaggccctgatgcccgtcatccttcaggacgcacccagcgccccaggccacgcgccccacagacaagcttctctgagcatctctgtgtccaacagtcagatccaagagaatgtggacattgccactgtctaccagatcttccctgacgaagtgctgggctcagggcagtttggagtggtctatggaggaaaacaccggaagacaggccgggacgtggcagttaaggtcattgacaaactgcgcttccctaccaagcaggagagccagctccggaatgaagtggccattctgcagagcctgcggcatcccgggatcgtgaacctggagtgcatgttcgagacgcctgagaaagtgtttgtggtgatggagaagctgcatggggacatgttggagatgatcctgtccagtgagaagggccggctgcctgagcgcctcaccaagttcctcatcacccagatcctggtggctttgagacaccttcacttcaagaacattgtccactgtgacttgaaaccagaaaacgtgttgctggcatcagcagacccatttcctcaggtgaagctgtgtgactttggctttgctcgcatcatcggcgagaagtcgttccgccgctcagtggtgggcacgccggcctacctggcacccgaggtgctgctcaaccagggctacaaccgctcgctggacatgtggtcagtgggcgtgatcatgtacgtcagcctcagcggcaccttccctttcaacgaggatgaggacatcaatgaccagatccagaacgccgccttcatgtacccggccagcccctggagccacatctcagctggagccagggctggccgggtacatgaaggggccaagccccctgggaagcccacattctccaagcttggaagcccatttggaccttcattcaaca

SEQ ID NO: 16025 - DNA, 2725 bp, Homo sapiens
cgccgccgccgacttaaactttggagggggaaaaagagctactggcgcctggcgaccctccctgccccccacccaaccccgctccggcaacgcccccttcctcacggctcccgaccgaacttttctccaacttctgcgactcgtgagattcccttctacccactccggccctcgggacccctctgcccatcccctggccggtcgggtccctgcgaacccctttatctctggaatccactcggtccccgactcagagactcctgccctccacccccaaggaccccgccatcctcaggtcccctccgcctgccagatcttttctcggatccccgctctcccaccacctgctcacgagatcccgcggatctagaacccagggtcccccggggccccccggccgggtcccgggtgggctccaggcggccggtccccggcctccccccatggccaccgccccctcttatcccgccgggctccctggctctcccgggccggggtctcctccgccccccggcggcctagagctgcagtcgccgccaccgctactgccccagatcccggccccgggttccggggtctcctttcacatccagatcgggctgacccgcgagttcgtgctgttgcccgccgcctccgagctggctcatgtgaagcagctggcctgttccatcgtggaccagaagttccctgagtgtggcttctacggcctttacgacaagatcctgcttttcaaacatgaccccacgtcggccaacctcctgcagctggtgcgctcgtccggagacatccaggagggcgacctggtggaggtggtgctgtcggcctcggccaccttcgaggacttccagatccgcccgcacgccctcacggtgcactcctatcgggcgcctgccttctgtgatcactgcggggagatgctcttcggcctagtgcgccagggcctcaagtgcgatggctgcgggctgaactaccacaagcgctgtgccttcagcatccccaacaactgtagtggggcccgcaaacggcgcctgtcatccacgtctctggccagtggccactcggtgcgcctcggcacctccgagtccctgccctgcacggctgaagagctgagccgtagcaccaccgaactcctgcctcgccgtcccccgtcatcctcttcctcctcttctgcctcatcgtatacgggccgccccattgagctggacaagatgctgctctccaaggtcaaggtgccgcacaccttcctcatccacagctatacacggcccaccgtttgccaggcttgcaagaaactcctcaagggcctcttccggcagggcctgcaatgcaaagactgcaagtttaactgtcacaaacgctgcgccacccgcgtccctaatgactgcctgggggaggcccttatcaatggagatgtgccgatggaggaggccaccgatttcagcgaggctgacaagagcgccctcatggatgagtcagaggactccggtgtcatccctggctcccactcagagaatgcgctccacgccagtgaggaggaggaaggcgagggaggcaaggcccagagctccctggggtacatccccctaatgagggtggtgcaatcggtgcgacacacgacgcggaaatccagcaccacgctgcgggagggttgggtggttcattacagcaacaaggacacgctgagaaagcggcactattggcgcctggactgcaagtgtatcacgctcttccagaacaacacgaccaacagatactataaggaaattccgctgtcagaaatcctcacggtggagtccgcccagaacttcagccttgtgccgccgggcaccaacccacactgctttgagatcgtcactgccaatgccacctacttcgtgggcgagatgcctggcgggactccgggtgggccaagtgggcagggggctgaggccgcccggggctgggagacagccatccgccaggccctgatgcccgtcatccttcaggacgcacccagcgccccaggccacgcgccccacagacaagcttctctgagcatctctgtgtccaacagtcagatccaagagaatgtggacattgccactgtctaccagatcttccctgacgaagtgctgggctcagggcagtttggagtggtctatggaggaaaacaccggaagacaggccgggacgtggcagttaaggtcattgacaaactgcgcttccctaccaagcaggagagccagctccggaatgaagtggccattctgcagagcctgcggcatcccgggatcgtgaacctggagtgcatgttcgagacgcctgagaaagtgtttgtggtgatggagaagctgcatggggacatgttggagatgatcctgtccagtgagaagggccggctgcctgagcgcctcaccaagttcctcatcacccagatcctggtggctttgagacaccttcacttcaagaacattgtccactgtgacttgaaaccagaaaacgtgttgctggcatcagcagacccatttcctcaggtcagttatgtcccctcctgatttggggaaatccaggcaacactgatggccggggtgggggtggggaaggggattatactaatcaagatgtgggggcgaggcacagtggctcttgcctgtaatcagcattttgagaggctgaggcaggaggatcatttgagcccaagagtttgagaccagcctgggcaacatagcgagacctcatctataca

SEQ ID NO: 16026 - DNA, 2498 bp, Homo sapiens
cgccgccgccgacttaaactttggagggggaaaaagagctactggcgcctggcgaccctccctgccccccacccaaccccgctccggcaacgcccccttcctcacggctcccgaccgaacttttctccaacttctgcgactcgtgagattcccttctacccactccggccctcgggacccctctgcccatcccctggccggtcgggtccctgcgaacccctttatctctggaatccactcggtccccgactcagagactcctgccctccacccccaaggaccccgccatcctcaggtcccctccgcctgccagatcttttctcggatccccgctctcccaccacctgctcacgagatcccgcggatctagaacccagggtcccccggggccccccggccgggtcccgggtgggctccaggcggccggtccccggcctccccccatggccaccgccccctcttatcccgccgggctccctggctctcccgggccggggtctcctccgccccccggcggcctagagctgcagtcgccgccaccgctactgccccagatcccggccccgggttccggggtctcctttcacatccagatcgggctgacccgcgagttcgtgctgttgcccgccgcctccgagctggctcatgtgaagcagctggcctgttccatcgtggaccagaagttccctgagtgtggcttctacggcctttacgacaagatcctgcttttcaaacatgaccccacgtcggccaacctcctgcagctggtgcgctcgtccggagacatccaggagggcgacctggtggaggtggtgctgtcggcctcggccaccttcgaggacttccagatccgcccgcacgccctcacggtgcactcctatcgggcgcctgccttctgtgatcactgcggggagatgctcttcggcctagtgcgccagggcctcaagtgcgatggctgcgggctgaactaccacaagcgctgtgccttcagcatccccaacaactgtagtggggcccgcaaacggcgcctgtcatccacgtctctggccagtggccactcggtgcgcctcggcacctccgagtccctgccctgcacggctgaagagctgagccgtagcaccaccgaactcctgcctcgccgtcccccgtcatcctcttcctcctcttctgcctcatcgtatacgggccgccccattgagctggacaagatgctgctctccaaggtcaaggtgccgcacaccttcctcatccacagctatacacggcccaccgtttgccaggcttgcaagaaactcctcaagggcctcttccggcagggcctgcaatgcaaagactgcaagtttaactgtcacaaacgctgcgccacccgcgtccctaatgactgcctgggggaggcccttatcaatggagatgtgccgatggaggaggccaccgatttcagcgaggctgacaagagcgccctcatggatgagtcagaggactccggtgtcatccctggctcccactcagagaatgcgctccacgccagtgaggaggaggaaggcgagggaggcaaggcccagagctccctggggtacatccccctaatgagggtggtgcaatcggtgcgacacacgacgcggaaatccagcaccacgctgcgggagggttgggtggttcattacagcaacaaggacacgctgagaaagcggcactattggcgcctggactgcaagtgtatcacgctcttccagaacaacacgaccaacagatactataaggaaattccgctgtcagaaatcctcacggtggagtccgcccagaacttcagccttgtgccgccgggcaccaacccacactgctttgagatcgtcactgccaatgccacctacttcgtgggcgagatgcctggcgggactccgggtgggccaagtgggcagggggctgaggccgcccggggctgggagacagccatccgccaggccctgatgcccgtcatccttcaggacgcacccagcgccccaggccacgcgccccacagacaagcttctctgagcatctctgtgtccaacagtcagatccaagagaatgtggacattgccactgtctaccagatcttccctgacgaagtgctgggtctgggctgcccacggacagggatctcggtggggcctgtccaccacaggaccacgacatgcaggggctggcggagcgcatcagtgttctctgaggtcctgtgccctcgtccagctgctgccctccacagcggttcttcacaggatcccagcaatgaactgttctagggaaagtggcttcctgcccaaactggatgggacacgtggggagtggggtggggggagctatttccaaggcccctccctgtttccccagcaattaaaacggactcatctctggccccatggccttgatctcagcacacggcactctcgaatcattactctgttgtaccaacatggagttcatctggaaggaggactgcctgaaaagaggaaggatgg

SEQ ID NO: 16027 - DNA, 1997 bp, Homo sapiens
cgccgccgccgacttaaactttggagggggaaaaagagctactggcgcctggcgaccctccctgccccccacccaaccccgctccggcaacgcccccttcctcacggctcccgaccgaacttttctccaacttctgcgactcgtgagattcccttctacccactccggccctcgggacccctctgcccatcccctggccggtcgggtccctgcgaacccctttatctctggaatccactcggtccccgactcagagactcctgccctccacccccaaggaccccgccatcctcaggtcccctccgcctgccagatcttttctcggatccccgctctcccaccacctgctcacgagatcccgcggatctagaacccagggtcccccggggccccccggccgggtcccgggtgggctccaggcggccggtccccggcctccccccatggccaccgccccctcttatcccgccgggctccctggctctcccgggccggggtctcctccgccccccggcggcctagagctgcagtcgccgccaccgctactgccccagatcccggccccgggttccggggtctcctttcacatccagatcgggctgacccgcgagttcgtgctgttgcccgccgcctccgagctggctcatgtgaagcagctggcctgttccatcgtggaccagaagttccctgagtgtggcttctacggcctttacgacaagatcctgcttttcaaacatgaccccacgtcggccaacctcctgcagctggtgcgctcgtccggagacatccaggagggcgacctggtggaggtggtgctgtcggcctcggccaccttcgaggacttccagatccgcccgcacgccctcacggtgcactcctatcgggcgcctgccttctgtgatcactgcggggagatgctcttcggcctagtgcgccagggcctcaagtgcgatggctgcgggctgaactaccacaagcgctgtgccttcagcatccccaacaactgtagtggggcccgcaaacggcgcctgtcatccacgtctctggccagtggccactcggtgcgcctcggcacctccgagtccctgccctgcacggctgaagagctgagccgtagcaccaccgaactcctgcctcgccgtcccccgtcatcctcttcctcctcttctgcctcatcgtatacgggccgccccattgagctggacaagatgctgctctccaaggtcaaggtgccgcacaccttcctcatccacagctatacacggcccaccgtttgccaggcttgcaagaaactcctcaagggcctcttccggcagggcctgcaatgcaaagactgcaagtttaactgtcacaaacgctgcgccacccgcgtccctaatgactgcctgggggaggcccttatcaatggagatgtgccgatggaggaggccaccgatttcagcgaggctgacaagagcgccctcatggatgagtcagaggactccggtgtcatccctggctcccactcagagaatgcgctccacgccagtgaggaggaggaaggcgagggaggcaaggcccagagctccctggggtacatccccctaatgagggtggtgcaatcggtgcgacacacgacgcggaaatccagcaccacgctgcgggagggttgggtggttcattacagcaacaaggacacgctgagaaagcggcactattggcgcctggactgcaagtgtatcacgctcttccagaacaacacgaccaacagatactataaggaaattccgctgtcagaaatcctcacggtggagtccgcccagaatggatgggacacgtggggagtggggtggggggagctatttccaaggcccctccctgtttccccagcaattaaaacggactcatctctggccccatggccttgatctcagcacacggcactctcgaatcattactctgttgtaccaacatggagttcatctggaaggaggactgcctgaaaagaggaaggatgg

SEQ ID NO: 16028 - DNA, 1894 bp, Homo sapiens
cgccgccgccgacttaaactttggagggggaaaaagagctactggcgcctggcgaccctccctgccccccacccaaccccgctccggcaacgcccccttcctcacggctcccgaccgaacttttctccaacttctgcgactcgtgagattcccttctacccactccggccctcgggacccctctgcccatcccctggccggtcgggtccctgcgaacccctttatctctggaatccactcggtccccgactcagagactcctgccctccacccccaaggaccccgccatcctcaggtcccctccgcctgccagatcttttctcggatccccgctctcccaccacctgctcacgagatcccgcggatctagaacccagggtcccccggggccccccggccgggtcccgggtgggctccaggcggccggtccccggcctccccccatggccaccgccccctcttatcccgccgggctccctggctctcccgggccggggtctcctccgccccccggcggcctagagctgcagtcgccgccaccgctactgccccagatcccggccccgggttccggggtctcctttcacatccagatcgggctgacccgcgagttcgtgctgttgcccgccgcctccgagctggctcatgtgaagcagctggcctgttccatcgtggaccagaagttccctgagtgtggcttctacggcctttacgacaagatcctgcttttcaaacatgaccccacgtcggccaacctcctgcagctggtgcgctcgtccggagacatccaggagggcgacctggtggaggtggtgctgtcggcctcggccaccttcgaggacttccagatccgcccgcacgccctcacggtgcactcctatcgggcgcctgccttctgtgatcactgcggggagatgctcttcggcctagtgcgccagggcctcaagtgcgatggctgcgggctgaactaccacaagcgctgtgccttcagcatccccaacaactgtagtggggcccgcaaacggcgcctgtcatccacgtctctggccagtggccactcggtgcgcctcggcacctccgagtccctgccctgcacggctgaagagctgagccgtagcaccaccgaactcctgcctcgccgtcccccgtcatcctcttcctcctcttctgcctcatcgtatacgggccgccccattgagctggacaagatgctgctctccaaggtcaaggtgccgcacaccttcctcatccacagctatacacggcccaccgtttgccaggcttgcaagaaactcctcaagggcctcttccggcagggcctgcaatgcaaagactgcaagtttaactgtcacaaacgctgcgccacccgcgtccctaatgactgcctgggggaggcccttatcaatggagatgtgccgatggaggaggccaccgatttcagcgaggctgacaagagcgccctcatggatgagtcagaggactccggtgtcatccctggctcccactcagagaatgcgctccacgccagtgaggaggaggaaggcgagggaggcaaggcccagagctccctggggtacatccccctaatgagggtggtgcaatcggtgcgacacacgacgcggaaatccagcaccacgctgcgggagggttgggtggttcattacagcaacaaggacacgctgagaaagcggcactattggcgcctggactgcaagtgtatcacgctcttccagaacaacacgaccaacagatactataaggaaattccgctgtcagaaatcctcacggtggagtccgcccagaatggatgggacacgtggggagtggggtggggggagctatttccaaggcccctccctgtttccccagcaattaaaacggactcatctctggc

SEQ ID NO: 16029 - DNA, 1975 bp, Homo sapiens
cgccgccgccgacttaaactttggagggggaaaaagagctactggcgcctggcgaccctccctgccccccacccaaccccgctccggcaacgcccccttcctcacggctcccgaccgaacttttctccaacttctgcgactcgtgagattcccttctacccactccggccctcgggacccctctgcccatcccctggccggtcgggtccctgcgaacccctttatctctggaatccactcggtccccgactcagagactcctgccctccacccccaaggaccccgccatcctcaggtcccctccgcctgccagatcttttctcggatccccgctctcccaccacctgctcacgagatcccgcggatctagaacccagggtcccccggggccccccggccgggtcccgggtgggctccaggcggccggtccccggcctccccccatggccaccgccccctcttatcccgccgggctccctggctctcccgggccggggtctcctccgccccccggcggcctagagctgcagtcgccgccaccgctactgccccagatcccggccccgggttccggggtctcctttcacatccagatcgggctgacccgcgagttcgtgctgttgcccgccgcctccgagctggctcatgtgaagcagctggcctgttccatcgtggaccagaagttccctgagtgtggcttctacggcctttacgacaagatcctgcttttcaaacatgaccccacgtcggccaacctcctgcagctggtgcgctcgtccggagacatccaggagggcgacctggtggaggtggtgctgtcggcctcggccaccttcgaggacttccagatccgcccgcacgccctcacggtgcactcctatcgggcgcctgccttctgtgatcactgcggggagatgctcttcggcctagtgcgccagggcctcaagtgcgatggctgcgggctgaactaccacaagcgctgtgccttcagcatccccaacaactgtagtggggcccgcaaacggcgcctgtcatccacgtctctggccagtggccactcggtgcgcctcggcacctccgagtccctgccctgcacggctgaagagctgagccgtagcaccaccgaactcctgcctcgccgtcccccgtcatcctcttcctcctcttctgcctcatcgtatacgggccgccccattgagctggacaagatgctgctctccaaggtcaaggtgccgcacaccttcctcatccacagctatacacggcccaccgtttgccaggcttgcaagaaactcctcaagggcctcttccggcagggcctgcaatgcaaagactgcaagtttaactgtcacaaacgctgcgccacccgcgtccctaatgactgcctgggggaggcccttatcaatggagcgatttcagcgaggctgacaagagcgccctcatggatgagtcagaggactccggtgtcatccctggctcccactcagagaatgcgctccacgccagtgaggaggaggaaggcgagggaggcaaggcccagagctccctggggtacatccccctaatgagggtggtgcaatcggtgcgacacacgacgcggaaatccagcaccacgctgcgggagggttgggtggttcattacagcaacaaggacacgctgagaaagcggcactattggcgcctggactgcaagtgtatcacgctcttccagaacaacacgaccaacagatactataaggaaattccgctgtcagaaatcctcacggtggagtccgcccagaatggatgggacacgtggggagtggggtggggggagctatttccaaggcccctccctgtttccccagcaattaaaacggactcatctctggccccatggccttgatctcagcacacggcactctcgaatcattactctgttgtaccaacatggagttcatctggaaggaggactgcctgaaaagaggaaggatgg

SEQ ID NO: 16030 - DNA, 457 bp, Homo sapiens
cgaacccctttatctctggaatccactcggtccccgactcagagactcctgccctccacccccaaggtgaattcccccgggccgccttctgagtgggatcctcttcttggagcactggatcctgggattccctctgcccccttctcaatccctcctctagggaaggggcctttgaatcgcgggctctcctgatccctgtgaccccgacctactagatttcctctcaggcttcttggaatctcaatcgctgggacctccaacccactacttttctcctttctgatcttctgggagccctggattccgggcctctgacccactatagtgcctttctctccttcccaggaccccgccatcctcaggtcccctccgcctgccagatcttttctcggatccccgctctcccaccacctgctcacgagatcccgcggatctagaacccagggtcccccggggc

SEQ ID NO: 16031 - DNA, 2699 bp, Homo sapiens
actcagcccagtggccctctgagctgttccttcttgaccggcacacacagctcgcttcttcactttcttttccatccactgccggacccaagccagccttccagggagcagccatgccttacctctaccgggccccagggcctcaggcacacccggttcccaaggacgcccggatcacccactcctcaggccagagctttgagcaaatgaggcaggagtgcctgcagagaggcaccctgtttgaggatgcagacttcccagccagcaattcctccctgttctacagtgagaggccgcagatcccctttgtgtggaaacgaccaggggaaatcgtgaaaaacccagaattcattcttggaggggccaccaggactgatatctgccagggagagctgggagactgctggctattagccgccatcgcctcccttacgcttaatcaaaaagcactggccagagtcatcccccaggaccaaagctttggccctggttatgccgggatattccatttccagttctggcagcacagtgagtggctggacgtggtgatcgatgaccgcctgcccaccttcagggaccgcttggttttcctccactctgccgaccacaacgagttctggagcgccttgctggaaaaagcctacgccaagctaaatgggagctatgaagctctgaagggaggcagcgccatcgaggccatggaagacttcactgggggtgtggcagagaccttccaaactaaagaggcccccgagaacttctatgagattctagagaaggctttgaagagaggctccctgctgggctgcttcattgataccagaagtgctgcagaatctgaggcccggacgccgtttggtcttattaagggtcatgcctacagtgtaacgggaattgaccaggtaagcttccgaggccagagaatcgagctcatccgaatccggaacccttggggccaggttgagtggaacgggtcgtggagcgacagttctccggagtggcgttctgttggtccagctgagcagaagcgtctgtgtcacactgctctggatgatggggaattctggatggcatttaaggacttcaaggcccactttgataaagtggagatctgcaacctcactcccgatgccctggaggaagacgcgatccacaaatgggaggtgacggtccatcagggaagctgggttcgcggctccacggctgggggctgccgcaatttcctggataccttttggaccaatccacaaataaaattgtctctgactgagaaagatgaggggcaggaggagtgtagtttccttgtagccctgatgcagaaagatagaaggaaactcaagagatttggtgccaatgtgctgacaatcggctatgccatttatgagtgccctgacaaagacgaacacctgaacaaagacttcttcagataccacgcttctcgggccagaagcaagacgttcatcaacctgagagaagtctccgaccggttcaagctgccccctggggagtacatcctgattcccagcacttttgagccccaccaggaagctgatttctgtctgagaatcttttcagagaaaaaagccattacccgggatatggatggaaatgtagacattgaccttcctgagcctccaaagccaactccacctgaccaggagacagaggaggagcagcggtttcgggctctgtttgaacaagtcgctggtgaggacatggaggtgacagcagaggaacttgagtatgttttaaatgctgtgctgcaaaagaaaaaggacatcaaattcaagaagctaagcctgatctcctgtaaaaacatcatttccctgatggacaccagcggcaatgggaagctggagtttgatgaattcaaagtgttctgggacaagctgaagcagtggattaaccttttccttcggtttgatgctgacaagtccggcaccatgtctacctatgaactacggactgcactgaaagctgcaggctttcagctgagcagccacctcctgcagctgattgtgctcaggtatgcggatgaggagctccagctggacttcgatgacttcctcaactgcctggtccggctggagaatgcgagccgggtgttccaggctctcagtacaaagaacaaggagttcattcatctcaatataaatgagttcatccatttgacaatgaacatctgaggctgccttgtagagatgcagcctgcccagctgaatcttggcttctggaccttgaccttcagaacttctcttggtgtggaaccattacgcccagggttcactcccctctcatcgtccggccttctcccttcatcttgatctgggaagaatgaaatgaactcagctacactctctgattttgtgctactcctttgtaaagtcactgccttaagggggctgatggcgccacctgtgccttacatccaggttcaggcatcactagctttcccacactctactttccttatttccttccattaagaattactcagagttctaacgcacagaatcctgacttccatgtagctccagtcattgtgatcagacatcctttataaaacatgtttttataaatgtgtatgtggaataagatgaggaggaaaaggagtgaggtcataatttagcatttctgcatcataagtgtgcttccttatcagggaagacatcaggtagttccgataattggacaagagt

SEQ ID NO: 16032 - DNA, 2621 bp, Homo sapiens
actcagcccagtggccctctgagctgttccttcttgaccggcacacacagctcgcttcttcactttcttttccatccactgccggacccaagccagccttccagggagcagccatgccttacctctaccgggccccagggcctcaggcacacccggttcccaaggacgcccggatcacccactcctcaggccagagctttgagcaaatgaggcaggagtgcctgcagagaggcaccctgtttgaggatgcagacttcccagccagcaattcctccctgttctacagtgagaggccgcagatcccctttgtgtggaaacgaccaggggaaatcgtgaaaaacccagaattcattcttggaggggccaccaggactgatatctgccagggagagctgggagactgctggctattagccgccatcgcctcccttacgcttaatcaaaaagcactggccagagtcatcccccaggaccaaagctttggccctggttatgccgggatattccatttccagttctggcagcacagtgagtggctggacgtggtgatcgatgaccgcctgcccaccttcagggaccgcttggttttcctccactctgccgaccacaacgagttctggagcgccttgctggaaaaagcctacgccaagctaaatgggagctatgaagctctgaagggaggcagcgccatcgaggccatggaagacttcactgggggtgtggcagagaccttccaaactaaagaggcccccgagaacttctatgagattctagagaaggctttgaagagaggctccctgctgggctgcttcattgataccagaagtgctgcagaatctgaggcccggacgccgtttggtcttattaagggtcatgcctacagtgtaacgggaattgaccaggtaagcttccgaggccagagaatcgagctcatccgaatccggaacccttggggccaggttgagtggaacgggtcgtggagcgacaggatggcatttaaggacttcaaggcccactttgataaagtggagatctgcaacctcactcccgatgccctggaggaagacgcgatccacaaatgggaggtgacggtccatcagggaagctgggttcgcggctccacggctgggggctgccgcaatttcctggataccttttggaccaatccacaaataaaattgtctctgactgagaaagatgaggggcaggaggagtgtagtttccttgtagccctgatgcagaaagatagaaggaaactcaagagatttggtgccaatgtgctgacaatcggctatgccatttatgagtgccctgacaaagacgaacacctgaacaaagacttcttcagataccacgcttctcgggccagaagcaagacgttcatcaacctgagagaagtctccgaccggttcaagctgccccctggggagtacatcctgattcccagcacttttgagccccaccaggaagctgatttctgtctgagaatcttttcagagaaaaaagccattacccgggatatggatggaaatgtagacattgaccttcctgagcctccaaagccaactccacctgaccaggagacagaggaggagcagcggtttcgggctctgtttgaacaagtcgctggtgaggacatggaggtgacagcagaggaacttgagtatgttttaaatgctgtgctgcaaaagaaaaaggacatcaaattcaagaagctaagcctgatctcctgtaaaaacatcatttccctgatggacaccagcggcaatgggaagctggagtttgatgaattcaaagtgttctgggacaagctgaagcagtggattaaccttttccttcggtttgatgctgacaagtccggcaccatgtctacctatgaactacggactgcactgaaagctgcaggctttcagctgagcagccacctcctgcagctgattgtgctcaggtatgcggatgaggagctccagctggacttcgatgacttcctcaactgcctggtccggctggagaatgcgagccgggtgttccaggctctcagtacaaagaacaaggagttcattcatctcaatataaatgagttcatccatttgacaatgaacatctgaggctgccttgtagagatgcagcctgcccagctgaatcttggcttctggaccttgaccttcagaacttctcttggtgtggaaccattacgcccagggttcactcccctctcatcgtccggccttctcccttcatcttgatctgggaagaatgaaatgaactcagctacactctctgattttgtgctactcctttgtaaagtcactgccttaagggggctgatggcgccacctgtgccttacatccaggttcaggcatcactagctttcccacactctactttccttatttccttccattaagaattactcagagttctaacgcacagaatcctgacttccatgtagctccagtcattgtgatcagacatcctttataaaacatgtttttataaatgtgtatgtggaataagatgaggaggaaaaggagtgaggtcataatttagcatttctgcatcataagtgtgcttccttatcagggaagacatcaggtagttccgataattggacaagagt

SEQ ID NO: 16033 - DNA, 525 bp, Homo sapiens
  misc_feature (68)..(68): n is a, c, g, or t
  misc_feature (89)..(89): n is a, c, g, or t
  misc_feature (133)..(133): n is a, c, g, or t
acagtactctcatttgatgacgaggtgaagggtgtatgtacacccgtcacctgcaccagccacccagncaggaggcagaggatggtggncctcaggctcacaccgcaggagccatctcagactggggtgctcnttccgcataccctcggggctcggatacagcgagtcctgggtctcctcctttgtccccacaggctttcagctgagcagccacctcctgcagctgattgtgctcaggtatgcggatgaggagctccagctggacttcgatgacttcctcaactgcctggtccggctggagaatgcgagccgtaagtgtccagcgaggctgagggtgcacctcggggtggcatcttcagtcaccctccatgagcgcatgagaaacagcctggttaaagtaatggcaaagatagaccacagagagccatggtctgatgtgtgtggacccatgggcctgtgcggttagctaaggagcagaatgtgccagcctcccctgcagcacgtttcttagcatcgcctttcttt

SEQ ID NO: 16034 - DNA, 2373 bp, Homo sapiens
actcagcccagtggccctctgagctgttccttcttgaccggcacacacagctcgcttcttcactttcttttccatccactgccggacccaagccagccttccagggagcagccatgccttacctctaccgggccccagggcctcaggcacacccggttcccaaggacgcccggatcacccactcctcaggccagagctttgagcaaatgaggcaggagtgcctgcagagaggcaccctgtttgaggatgcagacttcccagccagcaattcctccctgttctacagtgagaggccgcagatcccctttgtgtggaaacgaccagggttctggcagcacagtgagtggctggacgtggtgatcgatgaccgcctgcccaccttcagggaccgcttggttttcctccactctgccgaccacaacgagttctggagcgccttgctggaaaaagcctacgccaagctaaatgggagctatgaagctctgaagggaggcagcgccatcgaggccatggaagacttcactgggggtgtggcagagaccttccaaactaaagaggcccccgagaacttctatgagattctagagaaggctttgaagagaggctccctgctgggctgcttcattgataccagaagtgctgcagaatctgaggcccggacgccgtttggtcttattaagggtcatgcctacagtgtaacgggaattgaccaggtaagcttccgaggccagagaatcgagctcatccgaatccggaacccttggggccaggttgagtggaacgggtcgtggagcgacaggatggcatttaaggacttcaaggcccactttgataaagtggagatctgcaacctcactcccgatgccctggaggaagacgcgatccacaaatgggaggtgacggtccatcagggaagctgggttcgcggctccacggctgggggctgccgcaatttcctggataccttttggaccaatccacaaataaaattgtctctgactgagaaagatgaggggcaggaggagtgtagtttccttgtagccctgatgcagaaagatagaaggaaactcaagagatttggtgccaatgtgctgacaatcggctatgccatttatgagtgccctgacaaagacgaacacctgaacaaagacttcttcagataccacgcttctcgggccagaagcaagacgttcatcaacctgagagaagtctccgaccggttcaagctgccccctggggagtacatcctgattcccagcacttttgagccccaccaggaagctgatttctgtctgagaatcttttcagagaaaaaagccattacccgggatatggatggaaatgtagacattgaccttcctgagcctccaaagccaactccacctgaccaggagacagaggaggagcagcggtttcgggctctgtttgaacaagtcgctggtgaggacatggaggtgacagcagaggaacttgagtatgttttaaatgctgtgctgcaaaagaaaaaggacatcaaattcaagaagctaagcctgatctcctgtaaaaacatcatttccctgatggacaccagcggcaatgggaagctggagtttgatgaattcaaagtgttctgggacaagctgaagcagtggattaaccttttccttcggtttgatgctgacaagtccggcaccatgtctacctatgaactacggactgcactgaaagctgcaggctttcagctgagcagccacctcctgcagctgattgtgctcaggtatgcggatgaggagctccagctggacttcgatgacttcctcaactgcctggtccggctggagaatgcgagccttcatccatttgacaatgaacatctgaggctgccttgtagagatgcagcctgcccagctgaatcttggcttctggaccttgaccttcagaacttctcttggtgtggaaccattacgcccagggttcactcccctctcatcgtccggccttctcccttcatcttgatctgggaagaatgaaatgaactcagctacactctctgattttgtgctactcctttgtaaagtcactgccttaagggggctgatggcgccacctgtgccttacatccaggttcaggcatcactagctttcccacactctactttccttatttccttccattaagaattactcagagttctaacgcacagaatcctgacttccatgtagctccagtcattgtgatcagacatcctttataaaacatgtttttataaatgtgtatgtggaataagatgaggaggaaaaggagtgaggtcataatttagcatttctgcatcataagtgtgcttccttatcagggaagacatcaggtagttccgataattggacaagagt

SEQ ID NO: 16035 - DNA, 2047 bp, Homo sapiens
actcagcccagtggccctctgagctgttccttcttgaccggcacacacagctcgcttcttcactttcttttccatccactgccggacccaagccagccttccagggagcagccatgccttacctctaccgggccccagggcctcaggcacacccggttcccaaggacgcccggatcacccactcctcaggccagagctttgagcaaatgaggcaggagtgcctgcagagaggcaccctgtttgaggatgcagacttcccagccagcaattcctccctgttctacagtgagaggccgcagatcccctttgtgtggaaacgaccagggttctggcagcacagtgagtggctggacgtggtgatcgatgaccgcctgcccaccttcagggaccgcttggttttcctccactctgccgaccacaacgagttctggagcgccttgctggaaaaagcctacgccaagctaaatgggagctatgaagctctgaagggaggcagcgccatcgaggccatggaagacttcactgggggtgtggcagagaccttccaaactaaagaggcccccgagaacttctatgagattctagagaaggctttgaagagaggctccctgctgggctgcttcattgataccagaagtgctgcagaatctgaggcccggacgccgtttggtcttattaagggtcatgcctacagtgtaacgggaattgaccaggtaagcttccgaggccagagaatcgagctcatccgaatccggaacccttggggccaggttgagtggaacgggtcgtggagcgacaggatggcatttaaggacttcaaggcccactttgataaagtggagatctgcaacctcactcccgatgccctggaggaagacgcgatccacaaatgggaggtgacggtccatcagggaagctgggttcgcggctccacggctgggggctgccgcaatttcctggataccttttggaccaatccacaaataaaattgtctctgactgagaaagatgaggggcaggaggagtgtagtttccttgtagccctgatgcagaaagatagaaggaaactcaagagatttggtgccaatgtgctgacaatcggctatgccatttatgagtgccctgacaaagacgaacacctgaacaaagacttcttcagataccacgcttctcgggccagaagcaagacgttcatcaacctgagagaagtctccgaccggttcaagctgccccctggggagtacatcctgattcccagcacttttgagccccaccaggaagctgatttctgtctgagaatcttttcagagaaaaaagccattacccgggatatggatggaaatgtagacattgaccttcctgagcctccaaagccaactccacctgaccaggagacagaggaggagcagcggtttcgggctctgtttgaacaagtcgctggtgaggacatggaggtgacagcagaggaacttgagtatgttttaaatgctgtgctgcaaaagaaaaaggacatcaaattcaagaagctaagcctgatctcctgtaaaaacatcatttccctgatggacaccagcggcaatgggaagctggagtttgatgaattcaaagtgttctgggacaagctgaagcagtggattaaccttttccttcggtttgatgctgacaagtccggcaccatgtctacctatgaactacggactgcactgaaagctgcaggctttcagctgagcagccacctcctgcagctgattgtgctcaggtatgcggatgaggagctccagctggacttcgatgacttcctcaactgcctggtccggctggagaatgcgagccgtaagtgtccagcgaggctgagggtgcacctcggggtggcatcttcagtcaccctccatgagcgcatgagaaacagcctggttaaagtaatggcaaagatagaccacagagagccatggtctgatgtgtgtggacccatgggcctgtgcggttagctaaggagcagaatgtgccagcctcccctgcagcacgtttcttagcatcgcctttcttt

SEQ ID NO: 16036 - DNA, 837 bp, Homo sapiens
acactttccatatagaccctgttgtccatcctatcttaggaagacaatgcactcaagaggaaggtaacatctaccttcggactccagaggctccaaggagcctctctctctcttcaagacaggcttcacctccaccttcatacagtggtactgggagatgaacaggggtagggcgatcaagatttagttcaacctgtagttccagtcgggtggtgcttggtagttgactcattttggtcccatttgatatttgcagccacctgctgggataggtgtaactgttgctcctatttcacagattaggacaggatagtttgctagaggtcagaggacgagttgcgggagggaatggttgtcagttaggtttttaaccttagagcctcatgttttcttaggatcttgcagggagaccttgggcaaattccttttcctcttggggggtcttcattacctttttgtaagttaaagagttctgcccagtttgtgattctctgtactttaatgttcaaacttatcacttggataggttttttaaaatggggattctgggtacccccaatatatttaatttctctggggtgaggccgagattcatcttcgctgagctacatctgtagagattctgttttgataccattggttggactgtggctcggtaatttgcatttctccaaagtgagtccagtcagctggtcaaccgccccgcctgtctctctgtgaccccttccgggcgtccgctctgcttctgtacttgcatcctgtgggaatgagattggcgcaagcagccctcttttagtaccgccgggggcacgctagccaagcctttaaaaaccacgc

SEQ ID NO: 16037 - DNA, 485 bp, Homo sapiens
tcatgttactcttttagtgcacattttcagataatgctctttttatttttgctgactttccaaagataattttctctttaaccttttttaatatgaaaaaatttaaccatatgtacagagagtagtaaaataacactccagtgttcccgtgtctcatctttaactgttatcaacagcctgccacttcttgttttatctgtcctccccgccccccgtataattattttctgtagtattttaaagcaaatcttgaattcagatgattcttaaagaaaaacatttacagaattaggtcattgttacatttcagaagccaagcagcagtgtgtctgcctctgtcagaactgtcttaataattgtgtctttacctgggctgcagctttgaagaggcttattccaggtgcttattttactgagtggatgggaaatgctaagataaccataaggccctcctactggagtttatcttctcctaagcctagaaa

SEQ ID NO: 16038 - DNA, 327 bp, Homo sapiens
caactggtcacctaaggttgctgagttattatttattactctgaaaattgataagagggaaagaatcaaacatttcttcttcctgtcctatacaggccatgattgagggtaattcagcagttgatgaagtagtgtagttctttgtataggaaaatcacagctaataaatgcaaaagaaatgattgaatcagaaagtcaccattttgcagcctcttatgaaatagtggatctagacctgtcgttttttaaccagggatgatgccatccccctccccgaagggacagatatctagagacagttatggttgtcacaactggtgggggcag

SEQ ID NO: 16039 - DNA, 600 bp, Homo sapiens
agagaaggaaaccactgcagattacccaatgtcacgcaattaaaaagtggtgaaggggatttgaacctagtctatgcatctgcagaacgcacactcttgggctgcccaccccgacacctctgagggcagtgatgaagaatcccacctcacagaggagacggaggccaggagtgaggccctgccggagcctgagcccaagccttctagctctgaggccactgctctcccttcaaccctgttgctgccccgcaacagaaagtttgtcattggtccctcacagccacaccacagccctttgggcaaaatcagccccttcccagcctggccagttctgggggaaaatgacacctgacacctgacacctatccatttttttttttttttttgaaatgaggtctccctctgtcaaccaggctggagtgcagtgactcttctcaattgactgcaacctctgcttcccaggctcaagtgatccttccacctcagctacttgggaggttgaggcgggagaatcgcttgaacctgggaggtggaggttgcagtgagccaagatcacaccactgcactccagcttgggctacagagtgagactccatctga

SEQ ID NO: 16040 - DNA, 539 bp, Homo sapiens
cttgatctcctgaccttgtgatctgcccaacttggcctcccaaagtgctgggattacaggcatgagccactgcgcccggctcccactgtcattctttattgccattgcctttaagttttctccttagcttttattaccacttgcacattatgtatttgttttatgtaaattccttgagagcggggactttcttttgctctctgctgtatccttaggctttggaacagtccccagcccatagtagcacgaggctggtagttttgaatggatggatggatggatgaccttctaactggatagctgccattgactcccacttggcctccttcttgcctcttcctggtgtgcctctgctgtacctggctagtactcagcgagtattcagcatggtgattcctccgaaacatctgtttgccctgacagttccttgcagagaagcacctcatatgactcttgactgccccaccggtccccttctcagccttactgaatgtccttcattttttgactatgccaccatgttgctccctcttttctct

SEQ ID NO: 16041 - DNA, 657 bp, Homo sapiens
tgatggaaactacagagctgtttgggagctctgagaatgtgggggggagtcttccgtaggctttaggcctcactgtaggataatctggatgagctcttcagttgggaactttccaacattggtatcgtagagtctttcttcctgagatggtaaaataacttagaaaaagactcttctaatcttcatgtagcgtaaaggcctggctgccagaattatagaagctgagtgtggaaagaaggcataggaatctacatatattcttgtaatcttactttttttttagtatattgtcacttcctgcatctatgcctctgttttaccctcttcaaagattaaacctccagcgtttcccttagtgagattggggcacttctcaactcaaagtgggaagagactcttgaggatctgaatgtttgctaaaaagactttcaacagacttcttatttcagccaccttccttccacttcaccctccacttccagatttcctaaatccttagactttgaggaattctgcagtgcaaatctgattggttctcagctttccctgctgcttatttaggcttccattttctcctgtctggtaagtcacttatcactcatctatatgtcatcacatttaccttattcccacaaaatattccattattgggaagat

SEQ ID NO: 16042 - DNA, 598 bp, Homo sapiens
gatgagagtacatacctcctgggatggtcgtgggattaaagaagataccatattgtattgattctaagatgcatcctccaaaacacacatactcttgagcatttgtgaatcaggatcttacaatcgatgctgtgtcagaggttaactcgcagctttttctttcttggtggtacattcaataatggtgcatcttaaaatcgatggcatcttaggttagataatatactgtaaaaagtaggtagcacttaacacagtgcctggcaggaaataaatgttcaggagggttagttgttactgctttatcaatgtggttatcatcatcaaggaaggagattagctaacattcatttggtgttttctgtgtttcagtatctaattcttagaacccacaagacaaagatttttatccccattttacaaatgagaaaactgaggttcaggaagttcaggcaattcccctccacccatagagctggtaaggggcaggcctgagggtccatccaggagtctaagcccccgcctactggccaaagccagctgcctgttttcatagccgcctgcaagctatgaatggtttttacatttttaaacagttgag

SEQ ID NO: 16043 - DNA, 528 bp, Homo sapiens
caaagctttcctttggtgtctgcttctgtattctaaactggaagtagacatcatatcccagctaaacagggaaagttttagaactttgggaatagtttgtctatgcatgtataatgctgagaagggtctgcagtgaagaagataagatagacttctccagcacaactattactcatttgataattcagtttcatttttgctcacataatctaagtaaagccatatcagaaaccaagtttttctgtatgttacactaaattttaagaacaaagtctatatttaaaataatccaaaccccaaatttgctcatccaaattatgtcttggccagcaagttttacattagaagttttgagacttccatttatttgtgtcttttacagaattgtgtgacaatgacttttggacatttgttctttcggctttggaatatttacacaagaatggagaaggaacatccaactggagcataattgtcaaggcaatagagaatttagagaaataaaatagctgcatatctcaaaagagt

SEQ ID NO: 16044 - DNA, 242 bp, Homo sapiens
tttccagttccaagatggtcgaataggaacagctccagtctgcagctcccagcatgattgacacagaagacggtgatttctgcatttccaactgagaattgtgtgacaatgacttttggacatttgttctttcggctttggaatatttacacaagaatggagaaggaacatccaactggagcataattgtcaaggcaatagagaatttagagaaataaaatagctgcatatctcaaaagagt

SEQ ID NO: 16045 - DNA, 202 bp, Homo sapiens
gtaaccagggcacagagaagttaagaaacccaccaaaaccacggagccctacacgacagtcagcgttttggatgactcagccgtacgtgcccctgtgatcacactccatttccggatagtcacatttcatgtttttcaccgggaggaatggtccggggataatttcttctcattcctttctttaaaaatagtacaaaaggat

SEQ ID NO: 16046 - DNA, 788 bp, Homo sapiens
gcctgttgtgatgggtttattgttgcatcttctgaaaaactttgtgagttcccgaaggcctctccacgtcttgagtcatggctgtgctgctttgcgaagctgtgtgcatgtctgtggtgtagcctgtgtacagcctgtgatgcgtcgcagcggaagggtagggggctgcccagggaagacagatgcgccaggttccgctccacggagctcagctaccagccctggtggagagcgcagatggggccgatttgtcatttgtctgcgcttgagcccagcagctgtgtggcctccctggggcaagtcattcaccctctctgtgcctcagtgtctctgtgaagtggggggaagtttttggaagattaagtgggctaatacgcgtcaaatgctagaacacactggcacttggtaaatgctatataagtgttatcatttttgtttgtttattatttatttatccatgtcatggatttaaggcagtctaatctcagtgcctggtggagacccgggcgccacccccccaggttgtcaagtggtccctgtgcctcccactatcgtccccagcacggtgccgtgtccgggcgtgcgtgaagggccagctcacctcacagctctgcttcccaggttagctcccatccaccctccccctacctgtttcctcaccgaaggaaggggcagaaagatgccctccatgccccttccgactgttgcagagggatggaggactatggtacatacacacatatacacgcacacacccaccacacacacaccatgcacatgcacatcac

SEQ ID NO: 16047 - DNA, 504 bp, Homo sapiens
cttgttgatggacatttagattgccagtattttgtgataatgcacaaaatcagtgctacagtaaatgttggtgttgtctgtcttattgggtttctgtgttgaagttactctaggtgctgtaaatagaagtggtatcattgcttatagggtatccgcatctttgacgttatcagttactattaaattgctcctcgagctgttttttttattcttttatagtttcacctgctttggttttatgcaattagacataatggactttccaaagcagaaaatatgacatgaaaatctcattttaccacagaaaaacggaaagttggttgattagattcttgataaatttgttcatatttaaaaaatcttcttggctgggcgcggtggctcatgcctgtaattctagcactttgggaggccaaggtgggcggatcacctgaggtcagtagttcgagaccagcctgaccaacatggcgaaaccccgtctctactaaaaatacaaaattagct

SEQ ID NO: 16048 - DNA, 270 bp, Homo sapiens
gaagcagtaaaaagagaaatgtgaatcccctcttcttacctcctataacatgctaattaacatcactgcaattaaccaccattcacagctcttcagctgctctgtggaacctcagcccactctgaaatgaacagccgcagtggcaggggttacagaatgggctgggagtggcaatgtagatttatctcttcacacactctatgccctctatcaaaaatgcctcaggctgtgtaaaattccacaaataataaagagattttaaaaatgtga

SEQ ID NO: 16049 - DNA, 447 bp, Homo sapiens
ttaaaagtcctgttacacccatatcagatagcatcaagagagttttattcacttctggaaaacacagtattcaaaggctgtaatgtgaaaggacatagccgcaaaggagagaccaaggctgcagtcccaggtagcctcatttcagtgtgaggaagacctctgacaatggaaaaagaaatggattgcctgtgagatggtgaggtctatatccacctccaccctgccccccctgcaatgagaactttgaggtagatgaggagaaggggtcatgtgtttggtgagtgagctctcttgtgagtgggaaaatggttgaagccctttggtttcacttgataattagattttaaaggttggtatttcagttaggtaaaagactgaagtgccaatacatgaatggtaaagccgcatactgtataatgtagaggagcttaggaaaaaaatgaaact

SEQ ID NO: 16050 - DNA, 418 bp, Homo sapiens
acatcccgaaagtgggggttgggagagcaggatagcagagacctgccactggcaatgcagggctctcagtggagtgtcctggcagactgtgagggcagggaggaatctgttgtttgacagcagtgaagggggcaataccccttttattgtaattatccagtggctgacaaaggaaggttttcttgactcatgtgaacccaggaaatagggccttcgagtcctttgcctggcgtggcagggcagtggcacaggttctgcacaaggcaggaaaatgggacctgatgccactgcctgtcacatccgtgctaaagaaaggcacaatgctcaaggcccatcgcacgtgatgcccatttctgcaccattactacccacccctcctataccctgcaagactcatgggatggaccttttagggagt

SEQ ID NO: 16051 - DNA, 390 bp, Homo sapiens
tgaggcagagtcccactgtgtcacccagactggagtgcagtggtctggtctcggctcacccaacctccgcctcccaggctcaagcgattcttctgcctcagcctcccaagtagcgggattacaggagcgtgccaccatgcccagttaatttttgtatttttagtagagatagggtttcaccatattggccaggctggtgttgaactcctgacctcaaatgatccacttgcctcagcctcccaaagtgttgggattacaggcattagccaccgagcccagccagagaccccatctgtaaaaaaattttttaaacattagctgtagtggcacgtgcctgtaatctccgctgcttaggaggctggtgctggaagatcacttgaactcaggagt

SEQ ID NO: 16052 - DNA, 1191 bp, Homo sapiens
gaagaaagctacctgtacagacaggaacctgccttcccatacagatttgttaggttgttaagtctcctgaaggaaactagacacatgcattgtttttgtagtttttctccagaaaaacagaatagtaaaggcttttttccctcagattgttgctaagagaggaaatccctacaaatttaatatatatactatttttaaaattgattagatttgattttgcagctttgaaagttttctattgttgttcagttgaatagttgtctgactgcctcattgtggactcatgtctggaataggaaagcttataaatactaagtagatgttatttaaaaggatagtacagattatattattgttatctttcagtggtttttttcaaactgatgctagatgtccttttgaactgaacaaatgatgcactgagactttcattaatcagaaccattttgatggttcaatctgattcaatatgaagtatatagtgagaacactgtgaagcaataattacatcattcattcacttttttgctgatgataatatgttttgtagtgttcatgttttaatagtgttcctaaattttttaaatctaatttcctttgtatgtggtaactacatacattttaaggtttttgttttttcttttagagatggggtcttactatgttgcccaggctggtctcaaactcctaggctcaagtgatccgtcctgcctcagcatcccaaagtgctaggattacaggcgcgagctactgcacctggctgaccattttaagtttgaatgctaacagtgaccttataaattcatatcacctagactcaagagagatgcatccctgctattaaatgcctgtaattataagatggtagcaactagctttgttctgcacgtctttttaaaaccaaattttttttactttcaaaaaaattactttttaatttacctagcttctttcccaagtagttttgtgcctggatattatcaagaaggctttttgttcttacctcttttatatgattgctaatactaccaatctcttcattatataattttccacttataactaacctttctcatagcctttactaatgaagttttttttttgctataaatcatacttcagtaaatttaaggatacaaaagaagagagccatcaagcagtcacaataccagcattaacctaagtctatag

SEQ ID NO: 16053 - DNA, 1991 bp, Homo sapiens
ccacgcgtccgggaaggggtgagtctgggtctggaaaaaactgatccaaaggcagaaagggaggggcgaaatggaggagggtaccgtgaacagagtaagggggctgggagaggaaattagaggggaggcgctggccagcaggcaaggcctgagccctctcccccggcggtggttggggggggggccgtgtccatataaagcgggtcggcggcccctgcggtcccggagccgcgcgggcaggggctgccgcagccgatggcggggcgcagcgacatggatccgcccgccgcgttctctggcttccctgccctgccagcggtcgcgccgtcggggccgccgccgtcgccgctcgcaggagccgagccagggcgggagccagaggaggcggcggctggccgcggagaggcggcccccacgcccgcgcccggcccggggcggcggcggcggcggcccctgcagcgcgggaagccgccctactcgtacatcgcgctcatcgccatggctctggcgcacgccccgggccgccgcctcacgctggccgccatctaccgcttcatcaccgaacgctttgccttctaccgcgacagcccgcgcaagtggcagaacagcatccgccacaatctcacgctcaacgactgcttcgtcaaggtgccccgcgagccgggcaacccgggcaagggcaactactggacgctggaccccgcggccgcagacatgttcgacaacggcagcttcctgcggcgccgcaagcgcttcaagcgcgccgagctgcccgcgcacgcggccgcggcgccagggccgccgctccccttcccctacgcgccctacgcgcccgcgcccggccccgcgctgctggtgccgccgccttctgccggaccgggcccctcgccgcccgcgcgtctgttcagcgtcgacagcctggtgaacctgcagccggagctagcggggctgggcgcccccgagccgccctgctgcgccgcgcccgacgccgcagccgcagccttcccgccctgcgctgccgccgcctccccgccactctactcgcaggtccccgaccgcctggtactgcccgcgacgcgccccggccccggcccgctgcccgctgagcccctcctggccttggccgggccggcagccgctctcggcccgctcagccctggggaggcctacctgaggcagccgggcttcgcgtcggggctggagcgctacctgtgagcctgcgccgcgcgggcaggcacctgtgcgacctgtgccccggacctgcggcgccgccctcgagcgccccatctctgccccccaccctggcttggagcacaccctgcgcctctcgtcgtggcctcctggactcaaactcctgctacatccttctccgtcccccatccctggggaggctcccaccatctcgccactggacagaagcgtcccctttgacctgccagcctctcatttcttctccctccacttgtgagcgcccccagctttgcggcgccccccaccccagcgctgtctgtgggtcccttgccccggagctgactcgcctccagtgagtccataccccaggtttcctggtgagttccaagcctttggaagccagatctgtgatcccaagccgcctcctccaccgactgtacttcatcaaccttctctcatgtttttccgacactcctgggtcagactcctgggttcatgacttacttgctagcgtcccttcattttcccacaagtttgccccccacctccacttacctgtctgccctcagcttcttcctgggagagagcccccctttcacgtagacacacctggctgccttcttcacgccctgaggacacttcttggagatttcagacaggcagcaccagggctcctgactgaaaggggagttggtgggcctttaggtctgccccatcccctggaaaacttaggacttattgggttattattatttttaattaaagctggtttaattaaaaagaaagaaacttttttctgg

SEQ ID NO: 16054 - DNA, 1838 bp, Homo sapiens
cacccagctctctacggcaggtccgggagggctggggcttcggggagccctacccgccaaacctgctgttggcccgggagagccccagaggctcccggagactgcagcctcctgtggttgggctgggagccggcagggtttggggtgtgggcgtccccaccacgcatagcaggaatggcaggaagggacaaaagcctgttccagagaccctgggaggaccccaggcagggagagcccgcctgcctccaccctttccaacaagccatcttggtaactgggaacaaacacaccccaccccgtttttccttaaaagaggccttaatccccgagcccccgctgccagggcagagggaggagggggcacagctgtgccaagcccggccccactggtgtgtcctcacaatgtgaccccagaaatgccagcagggaacggaggctgctgcagagacgcagccccaggcagccggggctcctaggctggtgcagatggtggggttaaacgggctgagcgttccaggtaaactgaggctcggggaggggaaggacaggctggcctctccttcactgtccacagggccttgggttccctgagctgtccagaccccaccatctcccggaccccagggaggtggccattgccagaagcctgtgggtttctttctagcttgggggattaaaaaaaaaattctccacttttttttttcttgagtagacttcagtgaccacactgtggaaaatacctttgcagacgtggcacccgagtgcacacaccgaccgccacatgtgcttttctgccgggaatccctggggtgaacgcatgttttatgggcgtttccaggagcgcgcgtgcacctccagacggggagctggcgggcgggggtggcagcagcagctctagccttggggggacaagcctctctcagctacgccaggggaaaagagagttaaggacactcacccccacccacgcacacacacaaggcagcgtcgggtgggagagagaaggccgtttctccttctgtagcctgggtctcccacgggccttccccgctgctgagcgagacaccagtagccaggtgaagggccacagcgggccaggccccgaccctgttgtgacccacctgggcaccttcccggaccagctccgcctcccctgccctcctctctccaggaaggagccagaaccctcacccctctcccaccctccccaggggtaaccccaggccaagcacagatagctcagctgcgacctctggcctctggggacataaacggggcggctgggccagggcggaaggtgctcctgtttccctccttctgcgtggtccctttgacgggccggccaccgtgtccgaggcgcaacgctaggcctccaggccacgcatccatctccaagttaacagcccgtcctgcccaagttctggggcaggtaggagagggccgtcacacacctgtccgcccgtgagtgacccgggggggcttccgggtggaggtggagccaccacgcccttcctcaaggggtcacttattaaaaagtccacggcctgaggccaggccctctgcacagaagccatatgccggccagccgcgcctcctcctctgtccacggaaccgctgcccatctaaccttcgtaaagacctgtctcctgtttccagccgccgcctgtggttctagcaggttctatgccatctgcattgggatgtctggttgtttttatttctgacttttttaaaattccaggtgtgccgcacccactttctcgcagtgttttaatattgtgtggagttgtcgataccacgtgaattcatacacaataaaaagcctcactctccctttt

SEQ ID NO: 16055 - DNA, 2070 bp, Homo sapiens
  misc_feature (1844)..(1844): n is a, c, g, or t
  misc_feature (1847)..(1847): n is a, c, g, or t
cacccagctctctacggcaggtccgggagggctggggcttcggggagccctacccgccaaacctgctgttggcccgggagagccccagaggctcccggagactgcagcctcctgtggttgggctgggagccggcagggtttggggtgtgggcgtccccaccacgcatagcaggaatggcaggaagggacaaaagcctgttccagagaccctgggaggaccccaggcagggagagcccgcctgcctccaccctttccaacaagccatcttggtaactgggaacaaacacaccccaccccgtttttccttaaaagaggccttaatccccgagcccccgctgccagggcagagggaggagggggcacagctgtgccaagcccggccccactggtgtgtcctcacaatgtgaccccagaaatgccagcagggaacggaggctgctgcagagacgcagccccaggcagccggggctcctaggctggtgcagatggtggggttaaacgggctgagcgttccaggtaaactgaggctcggggaggggaaggacaggctggcctctccttcactgtccacagggccttgggttccctgagctgtccagaccccaccatctcccggaccccagggaggtggccattgccagaagcctgtgggtttctttctagcttgggggattaaaaaaaaaattctccacttttttttttcttgagtagacttcagtgaccacactgtggaaaatacctttgcagacgtggcacccgagtgcacacaccgaccgccacatgtgcttttctgccgggaatccctggggtgaacgcatgttttatgggcgtttccaggagcgcgcgtgcacctccagacggggagctggcgggcgggggtggcagcagcagctctagccttggggggacaagcctctctcagctacgccaggggaaaagagagttaaggacactcacccccacccacgcacacacacaaggcagcgtcgggtgggagagagaaggccgtttctccttctgtagcctgggtctcccacgggccttccccgctgctgagcgagacaccagtagccaggtgaagggccacagcgggccaggccccgaccctgttgtgacccacctgggcaccttcccggaccagctccgcctcccctgccctcctctctccaggaaggagccagaaccctcacccctctcccaccctccccaggggtaaccccaggccaagcacagatagctcagctgcgacctctggcctctggggacataaacggggcggctgggccagggcggaaggtgctcctgtttccctccttctgcgtggtccctttgacgggccggccaccgtgtccgaggcgcaacgctaggcctccaggccacgcatccatctccaagttaacagcccgtcctgcccaagttctggggcaggtaggagagggccgtcacacacctgtccgcccgtgagtgacccgggggggcttccgggtggaggtggagccaccacgcccttcctcaaggggtcacttattaaaaagtccacggcctgaggccaggccctctgcacagaagccatatgccggccagccgcgcctcctcctctgtccacggaaccgctgcccatctaaccttcgtaaagacctgtctcctgtttccagccgccgcctgtggttctagcaggttctatgccatctgcattgggatgtctggttgtttttatttctgacttttttaaaattccaggtgtgccgcacccactttctcgcagtgttttaatattgtgtggagttgtcgataccacgtgaattcatacacaataaaaagcctcactctcccttttaaaaanacnaaacaaacaacacaacaaaacacacacaaacaacaaaaacacacaacaaacaatacaacaaaacagacagcgaacgagcaaccaacaccagacacaaacacagacgaataagaacaaacaacacgcagaagaaaaaaggagagacaatgacagaaaagaaaacacaacaaagaaaacaacaacaagacacagaaaaacaaccaaacaaagaagaagacgaacg

SEQ ID NO: 16056 - DNA, 831 bp, Homo sapiens
tcttctatttttagaaaaacctattttaaattcagttggacagagttgtcttagcgctaatcggacttgagtctctgaactgtacacaactagaaaaaaacaaagaaaggaaatgtccataagacagtcattcaatagccacaaatctgcctgtgaaaatagctacctagggacatgatgatttttttttccatcagtgtgatagtgtgaaaccaacaagcccatttttttttttttttttttggttaatttgtgataaattagcacttgaaattaaccaggttcttcacatcagaagttctaagtagtaaatatttttgcaactgtaaaagagatgtttctccactacaaaacttcaaaccttattcttacataaggatcaaaatgacttttagaaacttttaaggacagagcagatgctccctggtttggatggcttggaacaaagctagaaattgctggggtcaaatagtctatcagagttggccaatggagagagggtgacattgttccacggcctcaaagctggccttgggctcactcttattagttttacttcctgccatgttcccatgagtaagtttactgtggctcattcctcctccttggtcatgctttctccttggcccctaatccccaatttctggttttcagtattggtctggtgcctggaaactttgagcttggatggaacctcactgagacccttcttgggacctaaattattcttttagttgttggcattgagctgtttcctttatcgtgctgaattatgtagccatcagcattgtactaatattgtcacccatgccgagccttatgcagtctgtg

SEQ ID NO: 16057 - DNA, 254 bp, Homo sapiens
gtgtttttacattcaaaacatagaagtgcaatgcttgtcagcaggctttgtggtcgtgtagtagttaatacttgtagttgtggttgccacaacctgggttctaatctgagtcacagtagtgttttctaacctgcaactgtggctaatagacctgtcgtttgctttgcctttaatcctagcagcctccagagagcagagtaaacctctggccccgaagggcgccagcttctggagtttagcccacagcgcagaaa

SEQ ID NO: 16058 - DNA, 153 bp, Homo sapiens
tctcatagggattgtgatgagcaaactaaaatcagttctgaattgtcaaacgtgaaataaaaattcatttttattagtataggcatgtgactgagactgggccaaggaatgggaataaaagtgatgtatatttcttcctttggtctggttatg

SEQ ID NO: 16059 - DNA, 419 bp, Homo sapiens
aattttgtgacaaggatgtatagtccattaaggaatatatacaacagaagaagcatttaagtggacttgaggtttgtgaatctgaactagtttctatcgactttcacatcagcagctcctattctggggaaagagaatggaggctgggagtgatcctgacaaaccttgatgtgcaggcttgtggagaaactggattcacacccaggctcgtggagtgtgggagaggctggcctgtcacaatatcaggacagcctctcttaataacactgcagaaggaatcgagggccctgtggtttgcggtcagtgtgcctcttgtgccaactttggcactacaatgtcttcaatcacattatcttccaaaccggctcttcatcctatgtccttatttctgctaatggtattcatttctcttattcatg

SEQ ID NO: 16060 - DNA, 191 bp, Homo sapiens
cgtctttgcaagccatgggccggctcccctcaaccccacaactgacacctaaattaagctgtggttggaaccagcatttacatggctaaataaggcctttaactccttccctccctagtcagctgttgcccttatctactccccatcccttaaggtaggaaaaaaaccaaccaaatcaaacctgtggcatt

SEQ ID NO: 16061 - DNA, 371 bp, Homo sapiens
gtctgagcacatctggacttaagatgtcttatgattcttcaagtttacagtgggtttgttgcagggtgtaaccccttgtaagtcgaggaacatctgtacatggtaatatgaaagagaatgggaggctggtgcggtggttcatgcttgtaatcccagcgctttgggaggcctaggcaggcgaatcacttgaggtccggagtttgagaccagcctggccaacatggtgaaaccctgtctctactaaaaatacaaaaattagccaggcatggtagcacacccctgtaatcccagctactcaggaggctgaggcaggataattgcttgaagccaggaggcggaggttgcagtaagtggagctcgcgccactacac

SEQ ID NO: 16062 - DNA, 290 bp, Homo sapiens
atagcctgaattttaattaaattctatatttcttcatgaagtttgtcatgttccttttcaattgaaccccaaatcatcagggctgattccaagggtgtaattcgttcatcattttcaaactgtacatcaagggtttttcctgctgcaatgcttgtcaaaaactgacatatgcatattgttctcaactggtaagctgttagactggatagtccatgaataatagcctctgcgctgttgcgggtccggcagaagtcctcagggcggccgtcgcggaaagctcagcaaagaga

SEQ ID NO: 16063 - DNA, 558 bp, Homo sapiens
gcggccgccggctgaatgaagcctgggacgcgggagccgcgccgcgcgcagtgtctgcagtgccggaggtctgggaggctccgggcgaagcctccctgctgcaggttatgatgatgtcagacaatgctaaaggcagagcagctcattcatggaagaaaagagggagtatttcttctctaagtaatcatgaattttggcgaaaggaaattcatgggcgcatcaaagaccctggaagtctgtggattacacatacaatgccttttacaggtgggaaactgactataaaggagtagcaatcccagcacatgtcagaagtaaagctaatttgagttttgtaccacctcttcttctccatgaatttttaatatggtgttcagtagaaaagaaattgagtttttatgaataccttctgtattatgcaattctatgagtactgtgtcttatatggaagaacccagtcagcgtgatgatatctctcgccttacagttcagatggaaaacacctatcagttgggtgtgttcttttatctctcactcctattttaaacttctaaattg

SEQ ID NO: 16064 - DNA, 2244 bp, Homo sapiens
gcggccgccggctgaatgaagcctgggacgcgggagccgcgccgcgcgcagtgtctgcagtgccggaggtctgggaggctccgggcgaagcctccctgctgcaggttatgatgatgtcagacaatgctaaaggcagagcagctcattcatggaagaaaagagggagtatttcttctctaagtaatcatgaattttggcgaaaggaaattcatgggcgcatcaaagattctatgagtactgtgtcttatatggaagaacccagtcagcgtgatgatatctctcgccttacagttcagatggaaaacacctatcagttgggtcctcccaaacattttcctgtggtcaccgtcaatcatattttgaaagatgtagtaaccagctatctacaagtagaagaatatgaaccagagctctgtagacagatgactaaaaccatttctgaggttattaaagcccaggtcaaggacttgatgattccacggtataaactaattgtgattgttcacattggacaactgaacaggcagagcatacttattggaagcagatgcctctgggatcctaaaagtgataccttttcatcttatgttttcagaaattcttctctcttcgctcttgcaaatgtctatgcagtttaccttgagtgattgaaaataagaaatctagctcttacttttgaaaattctgaggcaggctgtatgtctgtacacaaaagttttactgccaaaaactttgagaaagaaacaacactgatatttcaagcaactggaagcttttgaattttttcatattctagtaaagatttggggaggggagggtagccacagaaagaatcttgtttatctaaagcaggaacttgatcttggttttgctggattgctttccatagacatagattcttattaaatatttgttttggtactaattattttaattattctttaattagagtgttacaatttcctgcattgttttttaataaaaagaagctttagaaaaactatggctatataccctgaccaataaatgatagtagaatattcaacatggtatacacaaatgataaataatgtgcctcagtgctgcatataaaagaatactggttttcattttgtacttaataaattgagcagcattcattaagtgcaattattgttacatgtacctgacagttgaaactgctgaggtagaattaatggcttcataacaattatcgtggtcccacgggctgcaagctaaaactagaagctcttgtggcttgcctgcactttacacaattgtgggagaaccgaaagttggctcttcagtaatggaaactataaagtgaataaaggctttttgggacactgaagtagacattgtgatattaaatatacatgatgcttaatactaaatgtgtctgtaacacataaaatcatttattggaaagagacattgcttttaaatatcctaggctaacaaactttttcacaaaatatatggctggcaccttaacaaataaagcatgtgtagttaccattttactcctatgaatttaatactaaagtgacccagtgaggtttttgaatagacgggtgctaaaatttacagggctgaaatagcttattattctgctggttaatgtatcttacgccacggatcatttatttttatgaagctttcaagtctttgtgtgcaagtaaaatgatgttgtggcgttgttcttggatggtaagtggactgcctagaggacatttgttaaaggtcaaagacaaattgtacacatatggagaaaattagcaatgctgtagtcttaaggaaaaaatgatttatcattcatatcaaaaagagtttagcaaatggaaaaccagttaatgctttaattttaaaatgttttggtgtcttacttttccctaaaaatgacatgtagtaaaaaatggatacttttaaaatcccttcccttctgctattttctggcttttaaagtgattattcaaaatgaatttgtcaattttcacttttttttttctgttagtgcattagtgggaatatgtctatgtaataatttatcacaaccaatatttgtcaatctccatagaacagttttcaatctggattagattacacgtataacaagtaaatgagcttcatattttcattacacattggtgaacatctcccttcgtggaacaacagcgggggtaatcatatcactaattttgtatgaataaatgaaaatgaagaaacttctttaacatatacaaa

SEQ ID NO: 16065 - DNA, 1928 bp, Homo sapiens
gcggccgccggctgaatgaagcctgggacgcgggagccgcgccgcgcgcagtgtctgcagtgccggaggtctgggaggctccgggcgaagcctccctgctgcaggttatgatgatgtcagacaatgctaaaggcagagcagctcattcatggaagaaaagagggagtatttcttctctaagtaatcatgaattttggcgaaaggaaattcatgggcgcatcaaagattctatgagtactgtgtcttatatggaagaacccagtcagcgtgatgatatctctcgccttacagttcagatggaaaacacctatcagttgggtcctcccaaacattttcctgtggtcaccgtcaatcatattttgaaagatgtagtaaccagctatctacaagtagaagaatatgaaccagagctctgtagacagatgactaaaaccatttctgaggttattaaagcccaggtcaaggacttgatgattccacggtataaactaattgtgattgttcacattggacaactgaacaggcagagcatacttattggaagcagatgcctctgggatcctaaaagtgataccttttcatcttatgttttcagaaattcttctctcttcgctcttgcaaatgtctatgcagtttaccttgagtgattgaaaataagaaatctagctcttacttttgaaaattctgaggcaggctgtatgtctgtacacaaaagttttactgccaaaaactttgagaaagaaacaacactgatatttcaagcaactggaagcttttgaattttttcatattctagtaaagatttggggaggggagggtagccacagaaagaatcttgtttatctaaagcaggaacttgatcttggttttgctggattgctttccatagacatagattcttattaaatatttgttttggtactaattattttaattattctttaattagagtgttacaatttcctgcattgttttttaataaaaagaagctttagaaaaactatggctatataccctgaccaataaatgatagtagaatattcaacatggtatacacaaatgataaataatgtgcctcagtgctgcatataaaagaatactggttttcattttgtacttaataaattgagcagcattcattaagtgcaattattgttacatgtacctgacagttgaaactgctgaggtagaattaatggcttcataacaattatcgtggtcccacgggctgcaagctaaaactagaagctcttgtggcttgcctgcactttacacaattgtgggagaaccgaaagttggctcttcagtaatggaaactataaagtgaataaaggctttttgggacactgaagtagacattgtgatattaaatatacatgatgcttaatactaaatgtgtctgtaacacataaaatcatttattggaaagagacattgcttttaaatatcctaggctaacaaactttttcacaaaatatatggctggcaccttaacaaataaagcatgtgtagttaccattttactcctatgaatttaatactaaagtgacccagtgaggtttttgaatagacgggtgctaaaatttacagggctgaaatagcttattattctgctggttaatgtatcttacgccacggatcatttatttttatgaagctttcaagtctttgtgtgcaagtaaaatgatgttgtggcgttgttcttggatggtaagtggactgcctagaggacatttgttaaaggtcaaagacaaattgtacacatatggagaaaattagcaatgctgtagtcttaaggaaaaaatgatttatcattcatatcaaaaagagtttagcaaatggaaaaccagttaatgctttaattttaaaatgttttggtgtcttacttttccctaaaaatgacatgtagtaaaaaatggatactttta

SEQ ID NO: 16066 - DNA, 2119 bp, Homo sapiens
gcggccgccggctgaatgaagcctgggacgcgggagccgcgccgcgcgcagtgtctgcagtgccggaggtctgggaggctccgggcgaagcctccctgctgcaggttatgatgatgtcagacaatgctaaaggcagagcagctcattcatggaagaaaagagggagtatttcttctctaagtaatcatgaattttggcgaaaggaaattcatgggcgcatcaaagattctatgagtactgtgtcttatatggaagaacccagtcagcgtgatgatatctctcgccttacagttcagatggaaaacacctatcagttgggttattaaagcccaggtcaaggacttgatgattccacggtataaactaattgtgattgttcacattggacaactgaacaggcagagcatacttattggaagcagatgcctctgggatcctaaaagtgataccttttcatcttatgttttcagaaattcttctctcttcgctcttgcaaatgtctatgcagtttaccttgagtgattgaaaataagaaatctagctcttacttttgaaaattctgaggcaggctgtatgtctgtacacaaaagttttactgccaaaaactttgagaaagaaacaacactgatatttcaagcaactggaagcttttgaattttttcatattctagtaaagatttggggaggggagggtagccacagaaagaatcttgtttatctaaagcaggaacttgatcttggttttgctggattgctttccatagacatagattcttattaaatatttgttttggtactaattattttaattattctttaattagagtgttacaatttcctgcattgttttttaataaaaagaagctttagaaaaactatggctatataccctgaccaataaatgatagtagaatattcaacatggtatacacaaatgataaataatgtgcctcagtgctgcatataaaagaatactggttttcattttgtacttaataaattgagcagcattcattaagtgcaattattgttacatgtacctgacagttgaaactgctgaggtagaattaatggcttcataacaattatcgtggtcccacgggctgcaagctaaaactagaagctcttgtggcttgcctgcactttacacaattgtgggagaaccgaaagttggctcttcagtaatggaaactataaagtgaataaaggctttttgggacactgaagtagacattgtgatattaaatatacatgatgcttaatactaaatgtgtctgtaacacataaaatcatttattggaaagagacattgcttttaaatatcctaggctaacaaactttttcacaaaatatatggctggcaccttaacaaataaagcatgtgtagttaccattttactcctatgaatttaatactaaagtgacccagtgaggtttttgaatagacgggtgctaaaatttacagggctgaaatagcttattattctgctggttaatgtatcttacgccacggatcatttatttttatgaagctttcaagtctttgtgtgcaagtaaaatgatgttgtggcgttgttcttggatggtaagtggactgcctagaggacatttgttaaaggtcaaagacaaattgtacacatatggagaaaattagcaatgctgtagtcttaaggaaaaaatgatttatcattcatatcaaaaagagtttagcaaatggaaaaccagttaatgctttaattttaaaatgttttggtgtcttacttttccctaaaaatgacatgtagtaaaaaatggatacttttaaaatcccttcccttctgctattttctggcttttaaagtgattattcaaaatgaatttgtcaattttcacttttttttttctgttagtgcattagtgggaatatgtctatgtaataatttatcacaaccaatatttgtcaatctccatagaacagttttcaatctggattagattacacgtataacaagtaaatgagcttcatattttcattacacattggtgaacatctcccttcgtggaacaacagcgggggtaatcatatcactaattttgtatgaataaatgaaaatgaagaaacttctttaacatatacaaa

SEQ ID NO: 16067 - DNA, 1952 bp, Homo sapiens
gaaataaattttatgtgtattttcaggtcctcccaaacattttcctgtggtcaccgtcaatcatattttgaaagatgtagtaaccagctatctacaagtagaagaatatgaaccagagctctgtagacagatgactaaaaccatttctgaggttattaaagcccaggtcaaggacttgatgattccacggtataaactaattgtgattgttcacattggacaactgaacaggcagagcatacttattggaagcagatgcctctgggatcctaaaagtgataccttttcatcttatgttttcagaaattcttctctcttcgctcttgcaaatgtctatgcagtttaccttgagtgattgaaaataagaaatctagctcttacttttgaaaattctgaggcaggctgtatgtctgtacacaaaagttttactgccaaaaactttgagaaagaaacaacactgatatttcaagcaactggaagcttttgaattttttcatattctagtaaagatttggggaggggagggtagccacagaaagaatcttgtttatctaaagcaggaacttgatcttggttttgctggattgctttccatagacatagattcttattaaatatttgttttggtactaattattttaattattctttaattagagtgttacaatttcctgcattgttttttaataaaaagaagctttagaaaaactatggctatataccctgaccaataaatgatagtagaatattcaacatggtatacacaaatgataaataatgtgcctcagtgctgcatataaaagaatactggttttcattttgtacttaataaattgagcagcattcattaagtgcaattattgttacatgtacctgacagttgaaactgctgaggtagaattaatggcttcataacaattatcgtggtcccacgggctgcaagctaaaactagaagctcttgtggcttgcctgcactttacacaattgtgggagaaccgaaagttggctcttcagtaatggaaactataaagtgaataaaggctttttgggacactgaagtagacattgtgatattaaatatacatgatgcttaatactaaatgtgtctgtaacacataaaatcatttattggaaagagacattgcttttaaatatcctaggctaacaaactttttcacaaaatatatggctggcaccttaacaaataaagcatgtgtagttaccattttactcctatgaatttaatactaaagtgacccagtgaggtttttgaatagacgggtgctaaaatttacagggctgaaatagcttattattctgctggttaatgtatcttacgccacggatcatttatttttatgaagctttcaagtctttgtgtgcaagtaaaatgatgttgtggcgttgttcttggatggtaagtggactgcctagaggacatttgttaaaggtcaaagacaaattgtacacatatggagaaaattagcaatgctgtagtcttaaggaaaaaatgatttatcattcatatcaaaaagagtttagcaaatggaaaaccagttaatgctttaattttaaaatgttttggtgtcttacttttccctaaaaatgacatgtagtaaaaaatggatacttttaaaatcccttcccttctgctattttctggcttttaaagtgattattcaaaatgaatttgtcaattttcacttttttttttctgttagtgcattagtgggaatatgtctatgtaataatttatcacaaccaatatttgtcaatctccatagaacagttttcaatctggattagattacacgtataacaagtaaatgagcttcatattttcattacacattggtgaacatctcccttcgtggaacaacagcgggggtaatcatatcactaattttgtatgaataaatgaaaatgaagaaacttctttaacatatacaaa

SEQ ID NO: 16068 - DNA, 1125 bp, Homo sapiens
agtgcactcccggcgccttgctagggaagtatacgtgcagcggagtagatatatataggcgtcttcatatacacaattattatgcggggtgcccaacagcggctcgtgaagcgtcataaactatgaaagctcttgtggcttgcctgcactttacacaattgtgggagaaccgaaagttggctcttcagtaatggaaactataaagtgaataaaggctttttgggacactgaagtagacattgtgatattaaatatacatgatgcttaatactaaatgtgtctgtaacacataaaatcatttattggaaagagacattgcttttaaatatcctaggctaacaaactttttcacaaaatatatggctggcaccttaacaaataaagcatgtgtagttaccattttactcctatgaatttaatactaaagtgacccagtgaggtttttgaatagacgggtgctaaaatttacagggctgaaatagcttattattctgctggttaatgtatcttacgccacggatcatttatttttatgaagctttcaagtctttgtgtgcaagtaaaatgatgttgtggcgttgttcttggatggtaagtggactgcctagaggacatttgttaaaggtcaaagacaaattgtacacatatggagaaaattagcaatgctgtagtcttaaggaaaaaatgatttatcattcatatcaaaaagagtttagcaaatggaaaaccagttaatgctttaattttaaaatgttttggtgtcttacttttccctaaaaatgacatgtagtaaaaaatggatacttttaaaatcccttcccttctgctattttctggcttttaaagtgattattcaaaatgaatttgtcaattttcacttttttttttctgttagtgcattagtgggaatatgtctatgtaataatttatcacaaccaatatttgtcaatctccatagaacagttttcaatctggattagattacacgtataacaagtaaatgagcttcatattttcattacacattggtgaacatctcccttcgtggaacaacagcgggggtaatcatatcactaattttgtatgaataaatgaaaatgaagaaacttctttaacatatacaaa

SEQ ID NO: 16069 - DNA, 1349 bp, Homo sapiens
gagttctttgcgaaatgttttgaactgaattttaggtcattaaattgtgagttttggaatatagtggaagggacatgtgagtgttttagattagtagaatgacaatcatttcaatttctatggtatttaatatttttaagtgctcaaatatatttatcttcatcctactccacattattttggctacatagtatttcaagtttggctgcaacactgtgccaaaaaataattgagtgatagaaaagtattattttaaaaggtccactttgaaagggcttatcagaatctctgcattgaacaagggcatatggacagtctttattcaacagacacttcctaaactgttctaaaatttgtctgcaaatgggaaaagtcaagatactaatttgggtgagaggaaaagattcctcttaggtgtagatgaatgaatcatgcagtgagattccaggctaactgtagtttcttgaatcttatttgttaatctgactcacagctgaaaagtaacctgatgaataacagactgatctttaattagagagaaatgtttttaggagtcagttttttcattgcctaaaatgttaagttgaaatttaatgaaataaaagtaaacaaactgcagagtgactgcagaataaagctgtattaaaattccagctgttctgttgaaatccttataatgtttgcagtaatgatctctgtccttcagtcctgatttttcactcttactctaagtaaatactatttatgaatgccaactgtgttagagcttgggagcacaggatttaataagtgaactagatgtacctctgcaattaaataactggatattctggagccagctagattccctgacattttaggctgccaaagagcagaacctgatttgaatgtagattgagtccatacgttatataaataagaatgtaagacatttatcaactgttacgtgtctcagagagtttctacagaaagtcaacccttgaaaataaatcttttccttttattttggatgtttaaaattttacaggtgaaaaaaattctttgaaatataatttcaggccgggcacggtaggctcacgccagtaatcccagcactttgggaggccgaggcgggtggatcacttgaggtcacgtgtttgagaccaccctgaccaatgttgcgaaactccatctccactaaaaaaaaaatagaaaattagctgggcgtggtggtgtgcgcctgtaatcctagctactctggaggttgaggcagaagaatcgcttgaacctgggaggcagaggttgcagtgagccgagatcacgccactgcactccagcctgggcaacaagagcgaaactccatctcaaaa

SEQ ID NO: 16070 - DNA, 649 bp, Homo sapiens
attgtatgggtgccttctgctgtgggccacctgtttccagtctctgttctagaggctacctagttatggaagtcacctgtaactgtccctatttgttctggaaggaagagtggacacttgtaggaaaaagcccagactcctagcctgacatggaagacctttgcctacttctctagacttttctttttgtgctgtgctcataccttgtgccccagccctgctgagctaactgtagcttgcctaatgtgcgtggaacagagattcaatcccaatcttcacctaaacacttcacctaaagaaaatggaaaatggagtttcagtgtaaggctgagctgagattgtgtggaagtttaaaaatatgtccacatcttttttactttctttccattaggaggtgggcttgaaggctgggcacggtggctcatgcctgtaatcccagcactttgggaggctgaggcgggcagatcacctgaggtcaggagtttgagaccagcctcaacatggagaaaccccgtctctactaaaaatacaaaattagccgggtgtgtggtgcatgcctgtaatcccagctatttgggaggctgaggcaggagaattgcttgaacctgggaggcggaggttgctgtgagccgagatcgtgccattgcac

SEQ ID NO: 16071 - DNA, 797 bp, Homo sapiens
  misc_feature (570)..(570): n is a, c, g, or t
  misc_feature (603)..(603): n is a, c, g, or t
  misc_feature (777)..(778): n is a, c, g, or t
ctgatactcaaacagtgatgccaatgactggcctagtttgtggtgaaacccatcgtgccttctgctgcaatctgttggagggaacggttgtctgagaatccatgtgggtgtatctatcactttgtaaagaggaactccagctctgggaagccttaaaagtcccaggatgagggagtagtagaaaaggagaagagggacatgagacccagggtagaaaggatggttatggggtgtgaagaatggaggatgtaggaaggagaaaatgattagaggaatccttacttaagaaggcaaaacagtttgtgaaatcaatggatctccacccctttgcagaagccaggcagccttggctggggcccacctcaggcccttgttatgctggtagctttcacttcttctttgtgtgtgtgtgtgtctgcgtgtgtgtgtgtgtgtgtgtgtgtgtgtggtggtggtggtggtggagtatagatgcagagggatcttagtttggttgccttccaggtctatctgtaggtaggcaggttatccatgtgtattgaaagtatgttgtcgggcctaatcccagcnctttgggaggctgaggtgggtgataacctgagntcaggagttcgagaccagcctgatcaacatggtgaaaccccgtctctactaaaaatacaaaatagccatgcgtggtggcacatgcctgtgatcccagctacttgggttgctgaggcatgagaatagcttgaacctgggaggtggaagttgcagttagccgagatcatgagatcnngccattgcactccaggctg

SEQ ID NO: 16072 - DNA, 394 bp, Homo sapiens
gacctctctattctgcaacaaagggggcttctttggcttgtttcatgggaagatgggaggtgagggagcagtagtttccagctgaagtgctttcatcgccctgtggccaggtaaccacagtctctgtcgaaaaagaaggcattactggccagtgcatctgaaggtcaaaagtacttgaacatctttcctgaaggacggaaaagcagtgaaaggagtcagacttggctgctgcctggccttgcttttatgggaaaaacagaagttatgggatgggaggagcgtgaagagtgggtgttgccggccctcctggcatcacagcttgtgaaccatagcagtgatgggcagtcgctgtcttcactggccctgccaggtccggagatccctgcaggggcac

SEQ ID NO: 16073 - DNA, 796 bp, Homo sapiens
ataattccacccacttaaaccattcttcatggctcttgttttccaggggcctaataattttcactgctgtaatgtttctcagcttcacacttagtttagttgcccaaacaatgttggtgccttactcacattggtgccttgtgaagacgaggctcaggatggggattatggggaaattcttgcacacccagctcctcttaccacttaaaaatataatggcacttttacaaaatgatatgtcacctatattcattgagaattatttgactaccacatttttcccctgatgatagtcatctatcataacttgtgtttgttttcctcctgagatcaaacacttggtgcttattcctgatgtatactctgagaccagctcttaccttctgagtggcagctacccctccctcccaattttagatcctatttttacacatctctatagatatcacctttatttcatgactcacaatattaaatggtacagacttcagtttaaccactggtgtggtaacagcagtagttgctaagtaccaccttcccattgctgtttgagggctaatttgcaaagacatttgaatctcccagtgaagatgtctggggaattttggccagttgtcttccctcttgcccttttgttctttaaaattcagcttggaccatagacacctccaggatcttgtttatgttctgctctcaattgaccaagcactgcgttttgcacaatcagaagtctcacaaaagcaaacagttatgactgcatatctgatgtttatatcctataaaatttcaggaagat

SEQ ID NO: 16074 - DNA, 310 bp, Homo sapiens
aacagtgtcccctaataggatgagttttgggctttaaaatttaaaaaaaaaaaaatgggggcattgatgagtctcgttggcaccttttggcttgtggaggctcgtgatctaatattggtctctgctgtatacccagcacactacctgccacttagccattccataaatatcgttaaataagtgaattaggccgagtgccatggctgacacttgtaatcccagcacttacagaggccgaggtgggaggatcgccttgagcccaggagtttgagaccagcctgggcaacatagcgagaccgcgtctctattt

SEQ ID NO: 16075 - DNA, 2754 bp, Homo sapiens
ctcgggggtggagccgggaccgcagcgcctgccgctcgctcggcgctgtagccgccgctgccgccgctgctcttggctcggggacgcgggcgggcgctccgagaggctctggtgcctgcggctgctgctctcctccgacgcccggggctgcggcgctccgggtcccggcccctgtcccggcatctctcgggtccctgagccccggccccgggtcccgcgtccggccggagagaacgcactcagctgctcgagccgccccgggctcgcgcccccgggccatgaagaggggcccgtgaggcgcgcgcggagtcggaggaagaggagggaggagggaggccgaggaggagggcgcgggaggcggaggatgccgccgcggctgctgccgccgccgccacccgcgggtccccggcgaccctgactccagacccgaggatggagccggcgctgggcgctgcagctgctcccggcgcgtccccgaccaggtagctggtgtcacttcggtgtggttggaagaagactttctccccagctgcattcccggaggcgccctttcgacctggaggccgggtctgctggccacagggctgccgcactggctgggactgccagctgggcctggagacgctggtggctgtggactccccagcttggagcagtccctctttgacctcaccccttggagaagcagccccatgaaggtgcccagccatgcaatgttcctggaaggccgtcctcctccttgccctggcctccattgccatccagtacacggccatccgcaccttcaccgccaagtcctttcacacctgccccgggctggcagaggccgggctggccgagcgactgtgcgaggagagccccaccttcgcctacaacctctcccgcaagacccacatcctcatcctggccaccacgcgcagcggctcctccttcgtgggccagctcttcaaccagcacctggacgtcttctacctgtttgagcccctctaccacgtccagaacacgctcatcccccgcttcacccagggcaagagcccggccgaccggcgggtcatgctaggcgccagccgcgacctcctgcggagcctctacgactgcgacctctacttcctggagaactacatcaagccgccgccggtcaaccacaccaccgacaggatcttccgccgcggggccagccgggtcctctgctcccggcctgtgtgcgaccctccggggccagccgacctggtcctggaggagggggactgtgtgcgcaagtgcgggctactcaacctgaccgtggcggccgaggcgtgccgcgagcgcagccacgtggccatcaagacggtgcgcgtgcccgaggtgaacgacctgcgcgccctggtggaagacccgcgattaaacctcaaggtcatccagctggtccgagacccccgcggcattctggcttcgcgcagcgagaccttccgcgacacgtaccggctctggcggctctggtacggcaccgggaggaaaccctacaacctggacgtgacgcagctgaccacggtgtgcgaggacttctccaactccgtgtccaccggcctcatgcggcccccgtggctcaagggcaagtacatgttggtgcgctacgaggacctggctcggaaccctatgaagaagaccgaggagatctacgggttcctgggcatcccgctggacagccacgtggcccgctggatccagaacaacacgcggggcgaccccaccctgggcaagcacaaatacggcaccgtgcgaaactcggcggccacggccgagaagtggcgcttccgcctctcctacgacatcgtggcctttgcccagaacgcctgccagcaggtgctggcccagctgggctacaagatcgccgcctcggaggaggagctgaagaacccctcggtcagcctggtggaggagcgggacttccgccccttctcgtgacccgggcggtgcgggtgggggcgggaggcgcaaggtgtcggttttgataaaatggaccgtttttaactgttgccttattaacccctccctctcccacctcatcttcgtgtccttcctgcccccagctcaccccactcccttctgccccttttttgtctctgaaatttgcactacgtcttggacgggaatcactggggcagagggcgcctgaagtagggtcccgccccccccaccccattcagacacatggatgttgggtctctgtgcggacggtgacaatgtttacaagcaccacatttacacatccacacacgcacacgggcactcgcgaggcgacttctcaagcttttgaatgggtgagtggtcgggtatctagtttttgcactgtcttactattcaaggtaagaggatacaaacaagaggaccacttgtctctaatttatgaatggtgtccatcctttccccatccctgcctcctgcccctgacgcccatttccccccttagagcagcgaaactgccccctcctgcccgcccttgcctgtcggtgaggcaggtttttactgtgaggtgaacgtggacctgtttctgtttccagtctgtggtgatgctgtctgtctgtctgagtctcgtggccgcccctggaccagtgatgactgatgaatcttatgagcttctgattgatctcggggtccatctgtgatatttctttgtgccaaaaagaaaaaaaaagagtggatcagtttgctaaatgaacattgaaattgaaatgctttatctgtgttttctgtaaataaaagagtgcaataatc

SEQ ID NO: 16076 - DNA, 2305 bp, Homo sapiens
gtatccaggaatccgcagcacgacgtgtaactggatgtcacaccggagttggtaagcatgaatgcacttctcccccgtgtggtttcccggaggtcgcgctatcgaagctcaagacctggtctgctggccacagggctgccgcactggctgggactgccagctgggcctggagacgctggtggctgtggactccccagcttggagcagtccctctttgacctcaccccttggagaagcagccccatgaaggtgcccagccatgcaatgttcctggaaggccgtcctcctccttgccctggcctccattgccatccagtacacggccatccgcaccttcaccgccaagtcctttcacacctgccccgggctggcagaggccgggctggccgagcgactgtgcgaggagagccccaccttcgcctacaacctctcccgcaagacccacatcctcatcctggccaccacgcgcagcggctcctccttcgtgggccagctcttcaaccagcacctggacgtcttctacctgtttgagcccctctaccacgtccagaacacgctcatcccccgcttcacccagggcaagagcccggccgaccggcgggtcatgctaggcgccagccgcgacctcctgcggagcctctacgactgcgacctctacttcctggagaactacatcaagccgccgccggtcaaccacaccaccgacaggatcttccgccgcggggccagccgggtcctctgctcccggcctgtgtgcgaccctccggggccagccgacctggtcctggaggagggggactgtgtgcgcaagtgcgggctactcaacctgaccgtggcggccgaggcgtgccgcgagcgcagccacgtggccatcaagacggtgcgcgtgcccgaggtgaacgacctgcgcgccctggtggaagacccgcgattaaacctcaaggtcatccagctggtccgagacccccgcggcattctggcttcgcgcagcgagaccttccgcgacacgtaccggctctggcggctctggtacggcaccgggaggaaaccctacaacctggacgtgacgcagctgaccacggtgtgcgaggacttctccaactccgtgtccaccggcctcatgcggcccccgtggctcaagggcaagtacatgttggtgcgctacgaggacctggctcggaaccctatgaagaagaccgaggagatctacgggttcctgggcatcccgctggacagccacgtggcccgctggatccagaacaacacgcggggcgaccccaccctgggcaagcacaaatacggcaccgtgcgaaactcggcggccacggccgagaagtggcgcttccgcctctcctacgacatcgtggcctttgcccagaacgcctgccagcaggtgctggcccagctgggctacaagatcgccgcctcggaggaggagctgaagaacccctcggtcagcctggtggaggagcgggacttccgccccttctcgtgacccgggcggtgcgggtgggggcgggaggcgcaaggtgtcggttttgataaaatggaccgtttttaactgttgccttattaacccctccctctcccacctcatcttcgtgtccttcctgcccccagctcaccccactcccttctgccccttttttgtctctgaaatttgcactacgtcttggacgggaatcactggggcagagggcgcctgaagtagggtcccgccccccccaccccattcagacacatggatgttgggtctctgtgcggacggtgacaatgtttacaagcaccacatttacacatccacacacgcacacgggcactcgcgaggcgacttctcaagcttttgaatgggtgagtggtcgggtatctagtttttgcactgtcttactattcaaggtaagaggatacaaacaagaggaccacttgtctctaatttatgaatggtgtccatcctttccccatccctgcctcctgcccctgacgcccatttccccccttagagcagcgaaactgccccctcctgcccgcccttgcctgtcggtgaggcaggtttttactgtgaggtgaacgtggacctgtttctgtttccagtctgtggtgatgctgtctgtctgtctgagtctcgtggccgcccctggaccagtgatgactgatgaatcttatgagcttctgattgatctcggggtccatctgtgatatttctttgtgccaaaaagaaaaaaaaagagtggatcagtttgctaaatgaacattgaaattgaaatgctttatctgtgttttctgtaaataaaagagtgcaataatc

SEQ ID NO: 16077 - DNA, 2514 bp, Homo sapiens
ctcgggggtggagccgggaccgcagcgcctgccgctcgctcggcgctgtagccgccgctgccgccgctgctcttggctcggggacgcgggcgggcgctccgagaggctctggtgcctgcggctgctgctctcctccgacgcccggggctgcggcgctccgggtcccggcccctgtcccggcatctctcgggtccctgagccccggccccgggtcccgcgtccggccggagagaacgcactcagctgctcgagccgccccgggctcgcgcccccgggccatgaagaggggcccgtgaggcgcgcgcggagtcggaggaagaggagggaggagggaggccgaggaggagggcgcgggaggcggaggatgccgccgcggctgctgccgccgccgccacccgcgggtccccggcgaccctgactccagacccgaggatggagccggcgctgggcgctgcagctgctcccggcgcgtccccgaccaggtagctggtgtcacttcggtgtggttggaagaagactttctccccagctgcattcccggaggcgccctttcgacctggaggccgggtctgctggccacagggctgccgcactggctgggactgccagctgggcctggagacgctggtggctgtggactccccagcttggagcagtccctctttgacctcaccccttggagaagcagccccatgaaggtgcccagccatgcaatgttcctggaaggccgtcctcctccttgccctggcctccattgccatccagtacacggccatccgcaccttcaccgccaagtcctttcacacctgccccgggctggcagaggccgggctggccgagcgactgtgcgaggagagccccaccttcgcctacaacctctcccgcaagacccacatcctcatcctggccaccacgcgcagcggctcctccttcgtgggccagctcttcaaccagcacctggacgtcttctacctgtttgagcccctctaccacgtccagaacacgctcatcccccgcttcacccagggcaagagcccggccgaccggcgggtcatgctaggcgccagccgcgacctcctgcggagcctctacgactgcgacctctacttcctggagaactacatcaagccgccgccggtcaaccacaccaccgacaggatcttccgccgcggggccagccgggtcctctgctcccggcctgtgtgcgaccctccggggccagccgacctggtcctggaggagggggactgtgtgcgcaagtgcgggctactcaacctgaccgtggcggccgaggcgtgccgcgagcgcagccacgtggccatcaagacggtgcgcgtgcccgaggtgaacgacctgcgcgccctggtggaagacccgcgattaaacctcaaggtcatccagctggtccgagacccccgcggcattctggcttcgcgcagcgagaccttccgcgacacgtaccggctctggcggctctggtacggcaccgggaggaaaccctacaacctggacgtgacgcagctgaccacggtgtgcgaggacttctccaactccgtgtccaccggcctcatgcggcccccgtggctcaagggcaagtacatgttggtgcgctacgaggacctggctcggaaccctatgaagaagaccgaggagatctacgggttcctgggcatcccgctggacagccacgtggcccgctggatccagaacaacacgcggggcgaccccaccctgggcaagcacaaatacggcaccgtgcgaaactcggcggccacggccgagaagtggcgcttccgcctctcctacgacatcgtggcctttgcccagaacgcctgccagcaggtgctggcccagctgggctacaagatcgccgcctcggaggaggagctgaagaacccctcggtcagcctggtggaggagcgggacttccgccccttctcgtgacccgggcggtgcgggtgggggcgggaggcgcaaggtgtcggttttgataaaatggaccgtttttaactgttgccttattaacccctccctctcccacctcatcttcgtgtccttcctgcccccagctcaccccactcccttctgccccttttttgtctctgaaatttgcactacgtcttggacgggaatcactggggcagagggcgcctgaagtagggtcccgccccccccaccccattcagacacatggatgttgggtctctgtgcggacggtgacaatgtttacaagcaccacatttacacatccacacacgcacacgggcactcgcgaggcgacttctcaagcttttgaatggtctgtggtgatgctgtctgtctgtctgagtctcgtggccgcccctggaccagtgatgactgatgaatcttatgagcttctgattgatctcggggtccatctgtgatatttctttgtgccaaaaagaaaaaaaaagagtggatcagtttgctaaatgaacattgaaattgaaatgctttatctgtgttttctgtaaataaaagagtgcaataatc

SEQ ID NO: 16078 - DNA, 605 bp, Homo sapiens
aggctgacttagaggaccccccgactagcccgacaggacacatggatgttgggtctctgtgcggacggtgacaatgtttacaagcaccacatttacacatccacacacgcacacgggcactcgcgaggcgacttctcaagcttttgaatgggtgagtggtcgggtatctagtttttgcactgtcttactattcaaggtaagaggatacaaacaagaggaccacttgtctctaatttatgaatggtgtccatcctttccccatccctgcctcctgcccctgacgcccatttccccccttagagcagcgaaactgccccctcctgcccgcccttgcctgtcggtgaggcaggtttttactgtgaggtgaacgtggacctgtttctgtttccagtctgtggtgatgctgtctgtctgtctgagtctcgtggccgcccctggaccagtgatgactgatgaatcttatgagcttctgattgatctcggggtccatctgtgatatttctttgtgccaaaaagaaaaaaaaagagtggatcagtttgctaaatgaacattgaaattgaaatgctttatctgtgttttctgtaaataaaagagtgcaataatc

SEQ ID NO: 16079 - DNA, 249 bp, Homo sapiens
ggcgatcttggtgttttaattcagactctatgaggtgcatcgaggtcaggaatgctccctggtccactttcgctttgagtttcaggtagctggtgtcacttcggtgtggttggaagaagactttctccccagctgcattcccggaggcgccctttcgacctggaggccggggtaagcccccctgcccttgctgacttctgctaacccacttcctggggaatcgctgcacaagttgaattttaaagggtt

SEQ ID NO: 16080 - DNA, 552 bp, Homo sapiens
ctgcgttcatcagataatggacgccaggctgcagagatagaacagctgatgggagcaagactgggaagataaacacgcacacccacccagctctcaggttacacatcaatagggaaccatctacgaaataataagagagaaaaattctcataatataaaaaaaaattcaggacacaataaaaatcacttataagacaaaagaactaggaaatcataacctgatgggagcaagatgcgacaccaacacagacataaaaaaggggttggggctgggcgcagtggctcacacctgtaatcccagcactgtgggaggccaagatgggtggatcacttgaggtcaggagttcaagaccagcctgtccaacatggtgaaaccccgcctctactaaaaatataaaaagttagctgggtgcattggcacatgcctgtaatcccagctacttgggaggctgaggcaggagaatcacttgaacctgggagatggaggttgcagtgagccaagatcataccgctgcactccagcctgggtaacagagtgagactgtttcagac

SEQ ID NO: 16081 - DNA, 347 bp, Homo sapiens
ctgcgttcatcagataatggacgccaggctgcagagatagaacagctgatgggagcaagactgggaagataaacacgcacacccacccagctctcaggttacacatcaatagggaaccatctacgaaataataagagagaaaaattctcataatataaaaaaaaattcaggacacaataaaaatcacttataagacaaaagaactaggaaatcataacctgatgggagcagatggccatcttgctcccatcagtcattctgtgacacgtcgttggactgctgttttgataaccaacaagaggtcaatgtatagaatccgctgatgggagaagactgcggaccgaggc

SEQ ID NO: 16082 - DNA, 443 bp, Homo sapiens
gacaatcaaaaatgcctctagacattgctatgtgatccctgtgggtggggggaatggttaaagtgctctgacagagaactactgggtataatgggaagtcactgggggcttttaagcaggggaaggacaagaacagatttatgtctataaaaggtggctctgggttgggcatggtggctcacacctgtaatcctagcagtttgggaggctgagacgggtggatcgcttgaggccaggagtttgagaccagcctggctaacatggcaaaaccctgtctctactaaaaatacaaaaattagctgggcgtggtgatgcacgcctgtaatctctgctacttgggaggctgaggcacgagaattgcttgaacgcaggaagcgaaagttgcaatgagcccagatcgggccactgcactccagcctgggcagcagagtgagactctggag

SEQ ID NO: 16083 - DNA, 689 bp, Homo sapiens
actcccggctagtttttgtatttttaatagagatggagtttcgccatgttggtcaagctgatctcgaactcctggcctcaggtgatctgcctgcctcggcctcccgaagtgctgggattacaggcgtgagccactgcgcctggatgtagctgactcctttaatacattttgttgttataaaaggaaaataacaaagaatcaaaataagcatcgagaacagattatttccctgattttattacttttttcccttttgaataaaatgaaggatatgaatagttacatgtttagatataccttaatttattaacaataaagttttgttgggtgtggtggctcacacctgtaatcgcagcacaggttggccaagtcaggcagattgcttgaacctgggagttcgagaccagccagggaaacatggtgaaaccctgtctccacaaaaaaaaaaaaaaaaacttagctgggcctggtggcatgtgcctgtagtcccagctgctcaagagactgaggtaggaggatttcttgagcccagaaggtcgaggctgcagtgagcagtaattgtgccattgcactccaacctgggtgacagtgagaccttgtctctaaaaataaaaaagtttgttttttctttttgcatatgattatataaaccatgcttatttccatatcaaatatttcttcctttttta

SEQ ID NO: 16084 - DNA, 389 bp, Homo sapiens
attctggcatcatcggcacctgaaaggagatgaaggggatccaagatcagaaaactctgactgccagggttaaataagaaaattcataaaactaggccaggtgcagtggctcacgcctgtaatcccagcactttgggagaccgaggcaggtggatcacctgaggttgggagttcgaggccagcctgaccaatatggagaaaccccgtctctactaaaaacacaaagttagccagacctggtggcacatgcctgttatcccagctactcaggaggctgacacaggagaattgctcgaacccaggaggtggagattgcggtgagccaagatcgcaccactgcactccagcctgggcaacaagagcaaaactctgtctcaaaacaaaaacaa

SEQ ID NO: 16085 - DNA, 763 bp, Homo sapiens
aaatgtaactttttaagggagaaaaaaagaataaagaatccatgacaacccagatttgaaattcttaggtatcacagaaatttaaaacaaggcctttttaggtaacaacaactagagctcagtggtacaacctttgcctctcaagctggtcttagaacatgaagggaaaaaaaaaaactgaacaaatactacctgaattcaactactacctgaaaggtaccagctgccttgcattcacttgtcatcaagatgacttaaggaatactgcggtgtgtgcccctaactaatgaaggctttatctccacattacagttacgatactgaagagacgtaacctgaccaaggccacagagctggaaaaagaagcaaagccaagccgtttttctcatgcactgctcacaacaagcccctccttccactgactcatgaaaaacacactcataatgcccagcccgcaccctaatgaacagccctcttaagagtggtcatcagacttcaatttcacagactagaattgagaaatggaacaaaaccttgggataccagccttccattttggtagggatcatttaaaaaatggtagggatcatttaaaaaatgtgttggtgtctgaaacttactttgaagtggttaaaaaacataaaatgtatagattgtaacaagcaaatatgttaaaatgtactgtacaattctttctttacaattttatggatgttcgaaatttaaaaaatactaaaaagagaatggtcttatttaaaagaaa

SEQ ID NO: 16086 - DNA, 3711 bp, Homo sapiens
ccttgtgaagccccttcaatttagccttcctcttatataagctaaatacttctaaggcctggggatgtttccatctgggggcacaaagctttgctttggataaattagtaactgtgtaaacagtgaacattactgtattctggccttgcatgtttgtgaaagaaacgagggagttgatggattgagaaacacattctatttgtacttaggtgcaaatttgatgacatgtagttttggtttaagataagctttttatccagacccggtctaatctcttcctttcttttacatacctcccttactggcaatacaagtgcattttagtattatttggaacacagcataatcatttacctctagaaatccagacatttttactgtttgcaaataaaccattctgataaattatttttgttgcttaaaataagaggaggaaccgctgtgtgttagcaagaatgtccatacctgatatgaaagagtcatgttggcttcagttcctactgccctgtggacttcccattccctccttacttgagtcaaccatccactcagtactttccacaaatctaataatgaggtgctctctgtaggtaaatcctttcactatggcttgtcctcaaacctcccaagaaaaggttcaactgctcaatctcttaacctttttaattccattcccttgcaggtatcccggccctgcataacaagatgatcccaactcaaggaaaggggtttagcagtgttggatcttggcgtatgtgggatttaaccaggcagaaaggcagacaagagtaagattctaggcagagagagcaaatgcgtcgagcatgggtatgaacatgtgagggatagagaataattctgcaggaagtttgctggatggaagggccttatagggttagaaaagctggtgtcagattgtcaaggactttgaatgtcatggggcttctcttccaggaacacatgggatcaggcttagattaacccaaatgtaattgtcagagcccagagatatttcatggtccagtcctagcactgtgcagctgccaaaagtcaaagccattcaaatctgtactgaaaactgtggaaaagcaaaggagcacttaagtctctttccccatgtcttgcattctcactctcttttgcttcaaagatctgtctttacctgcccctgtccccagtcctaacaaaaagcactcccctaaatcaactcttaagttcctctcccttctcactcctttcttagtctcctctttctgtaagaagttcttgctcctgttgttaatggaagttaattaaagtagtatttcaccttgtaaggctgtaattcttggcacttgttatcctcattttctacatccaaagaccatggaccagaatatctcttaggaggtaagggagagtgaggctatcagccaaagaaaaagtctccagggggaaggggagaatcacttataatttaatactttgtggaaaaaacatctctgccacctatggccctccaataacaatggaagacagaatcaacaggtgagaaccttgggacaaaaataagttacaaagctgttgtaatccaggtaagagctattaagtttccaaacgaaggctgactgtgaggataagtgatactgatttcagaaatctttaaaaagtagaaccaacaagccttgaggtctaactctgttcaacattaaagggaagagtgagtctaagaagacttcaggtttctagcttggccaaaccaattgagctttaagtgaaatgtgcgatatggtaacagagaaggaaaaagacataacgatagatttgagctgctggtgggaaattctggtttagtgcccagctggctgtacaggctggttggactttaggagggaggtttgagctggaaaataaagatggagagttgtctttcagttttagatcatcagtgaggtcataagggtagatggagtttacctgggaaaattaagtagctattcgatttggcttattattatgttaaaataatacttctctagtgaagtacttaatatgccagatactgtgccaagcattttatatacatcctctcttttactaagccctcatagggcaggtattttgattccaatcatactgattggaactcctaagaaggtatcttgcttaaggtcccacaacgaataggtggcagatccagggtaattcaggtctgtcagaacagtgattcttaattttttccctcctcagactccaggagtcacatgaagttatgcatcctgtctgaccgaggcacaggcacaccacatttttatattccgcttccaggatatcacaaacctgaagcccatcctccatggcccagagagaaaacccaggacaaaaccttggagaagactattttcatgaagacaaatggagaaggagcagtagagtaaaaagagaggtaagggaaggcattgagatggtttacagggttagatgttttgagtcaatcccattataattaccaatgctatctacctatttagttaacgttttattgccctgctgttttctccaggataattggaacagcatgtattggttgggtggaaaagatagaacttgagcagggagattgccaaagagtgaagatgtggctgagtgattgatgatggtctgaactgggtattcagggaagagaactagaagccaaccatgtagaatctatgcaggtgctcttaagacattggtttgactggaattatcttcttgttaggtcttaggaatctccttccaggtaactttttctatgattagacaattgatttgttcagggtcacagagcaaagtccacatttaattccacatggccaataaaagtgaggggctacaaggtgagatccaggggccagagttatcaaagtgatacagcacttttaggaataggacagggaatggaggaattggaattccagtattactttcaaaagcagaactggccagaggaattggaattccagtattattttcaaaagcagaactggccagaggtgcttgtgattcctgggtggaaaccatggcagtggacagaagcagcatggaggaaaagagcactggaattcaggctgaggaactgtgaagccaagggtgttgtataggttgtccatttcaaattagggttgcttggttctgggatgatttgcatggaagaggggagagtgacttggagatgtgtgattgaggacagtgagcacagtgagttgatggtgttgctgggttataagcagcttcaaagagaaggcattttgaatgaaggtggaaacataatggccaggagaacaagcaaaggactaggaaacagtgaacttcatcttggcctcaagttcctgaggtgcatatgaataaacagtctctaacccagagggtttcaagaaaagcagagtcctcaaaatccaaaggtagagtttccccacattgatattatactaattacacgtataacagtactttggaaaagcacaggtctctggtcacctctaaaaggcaaggttggtaaggaggtcagggtgtcacctgttggtagtcttaactaaatggtctcttcaagggatctaaggatggaaaggggatatataatggttggattaaaggctcatcattgattagcaaattgtcccttttgtttcttaaacccaatttgtacagggaaagttatgccactgtaagatatttttaaatggggaaaaa

SEQ ID NO: 16087 - DNA, 2943 bp, Homo sapiens
ccttgtgaagccccttcaatttagccttcctcttatataagctaaatacttctaaggcctggggatgtttccatctgggggcacaaagctttgctttggataaattagtaactgtgtaaacagtgaacattactgtattctggccttgcatgtttgtgaaagaaacgagggagttgatggattgagaaacacattctatttgtacttaggtgcaaatttgatgacatgtagttttggtttaagataagctttttatccagacccggtctaatctcttcctttcttttacatacctcccttactggcaatacaagtgcattttagtattatttggaacacagcataatcatttacctctagaaatccagacatttttactgtttgcaaataaaccattctgataaattatttttgttgcttaaaataagaggaggaaccgctgtgtgttagcaagaatgtccatacctgatatgaaagagtcatgttggcttcagttcctactgccctgtggacttcccattccctccttacttgagtcaaccatccactcagtactttccacaaatctaataatgaggtgctctctgtaggtaaatcctttcactatggcttgtcctcaaacctcccaagaaaaggttcaactgctcaatctcttaacctttttaattccattcccttgcaggtatcccggccctgcataacaagatgatcccaactcaaggaaaggggtttagcagtgttggatcttggcgtatgtgggatttaaccaggcagaaaggcagacaagagtaagattctaggcagagagagcaaatgcgtcgagcatgggtatgaacatgtgagggatagagaataattctgcaggaagtttgctggatggaagggccttatagggttagaaaagctggtgtcagattgtcaaggactttgaatgtcatggggcttctcttccaggaacacatgggatcaggcttagattaacccaaatgtaattgtcagagcccagagatatttcatggtccagtcctagcactgtgcagctgccaaaagtcaaagccattcaaatctgtactgaaaactgtggaaaagcaaaggagcacttaagtctctttccccatgtcttgcattctcactctcttttgcttcaaagatctgtctttacctgcccctgtccccagtcctaacaaaaagcactcccctaaatcaactcttaagttcctctcccttctcactcctttcttagtctcctctttctgtaagaagttcttgctcctgttgttaatggaagttaattaaagtagtatttcaccttgtaaggctgtaattcttggcacttgttatcctcattttctacatccaaagaccatggaccagaatatctcttaggaggtaagggagagtgaggctatcagccaaagaaaaagtctccagggggaaggggagaatcacttataatttaatactttgtggaaaaaacatctctgccacctatggccctccaataacaatggaagacagaatcaacaggtgagaaccttgggacaaaaataagttacaaagctgttgtaatccaggtaagagctattaagtttccaaacgaaggctgactgtgaggataagtgatactgatttcagaaatctttaaaaagtagaaccaacaagccttgaggtctaactctgttcaacattaaagggaagagtgagtctaagaagacttcaggtttctagcttggccaaaccaattgagctttaagtgaaatgtgcgatatggtaacagagaaggaaaaagacataacgatagatttgagctgctggtgggaaattctggtttagtgcccagctggctgtacaggctggttggactttaggagggaggtttgagctggaaaataaagatggagagttgtctttcagttttagatcatcagtgaggtcataagggtagatggagtttacctgggaaaattaagtagctattcgatttggcttattattatgttaaaataatacttctctagtgaagtacttaatatgccagatactgtgccaagcattttatatacatcctctcttttactaagccctcatagggcaggtattttgattccaatcatactgattggaactcctaagaaggtatcttgcttaaggtcccacaacgaataggtggcagatccagggtaattcaggtctgtcagaacagtgattcttaattttttccctcctcagactccaggagtcacatgaagttatgcatcctgtctgaccgaggcacaggcacaccacatttttatattccgcttccaggatatcacaaacctgaagcccatcctccatggcccagagagaaaacccaggacaaaaccttggagaagactattttcatgaagacaaatggagaaggagcagtagagtaaaaagagaggtaagggaagcaaatccagctgcctgtacaatccatgccaccgaatgccgtaagtgagacgtaaaagttacgatactgaagagacgtaacctgaccaaggccacagagctggaaaaagaagcaaagccaagccgtttttctcatgcactgctcacaacaagcccctccttccactgactcatgaaaaacacactcataatgcccagcccgcaccctaatgaacagccctcttaagagtggtcatcagacttcaatttcacagactagaattgagaaatggaacaaaaccttgggataccagccttccattttggtagggatcatttaaaaaatggtagggatcatttaaaaaatgtgttggtgtctgaaacttactttgaagtggttaaaaaacataaaatgtatagattgtaacaagcaaatatgttaaaatgtactgtacaattctttctttacaattttatggatgttcgaaatttaaaaaatactaaaaagagaatggtcttatttaaaagaaa

SEQ ID NO: 16088 - DNA, 3658 bp, Homo sapiens
ccttgtgaagccccttcaatttagccttcctcttatataagctaaatacttctaaggcctggggatgtttccatctgggggcacaaagctttgctttggataaattagtaactgtgtaaacagtgaacattactgtattctggccttgcatgtttgtgaaagaaacgagggagttgatggattgagaaacacattctatttgtacttaggtgcaaatttgatgacatgtagttttggtttaagataagctttttatccagacccggtctaatctcttcctttcttttacatacctcccttactggcaatacaagtgcattttagtattatttggaacacagcataatcatttacctctagaaatccagacatttttactgtttgcaaataaaccattctgataaattatttttgttgcttaaaataagaggaggaaccgctgtgtgttagcaagaatgtccatacctgatatgaaagagtcatgttggcttcagttcctactgccctgtggacttcccattccctccttacttgagtcaaccatccactcagtactttccacaaatctaataatgaggtgctctctgtaggtaaatcctttcactatggcttgtcctcaaacctcccaagaaaaggttcaactgctcaatctcttaacctttttaattccattcccttgcaggtatcccggccctgcataacaagatgatcccaactcaaggaaaggggtttagcagtgttggatcttggcgtatgtgggatttaaccaggcagaaaggcagacaagagtaagattctaggcagagagagcaaatgcgtcgagcatgggtatgaacatgtgagggatagagaataattctgcaggaagtttgctggatggaagggccttatagggttagaaaagctggtgtcagattgtcaaggactttgaatgtcatggggcttctcttccaggaacacatgggatcaggcttagattaacccaaatgtaattgtcagagcccagagatatttcatggtccagtcctagcactgtgcagctgccaaaagtcaaagccattcaaatctgtactgaaaactgtggaaaagcaaaggagcacttaagtctctttccccatgtcttgcattctcactctcttttgcttcaaagatctgtctttacctgcccctgtccccagtcctaacaaaaagcactcccctaaatcaactcttaagttcctctcccttctcactcctttcttagtctcctctttctgtaagaagttcttgctcctgttgttaatggaagttaattaaagtagtatttcaccttgtaaggctgtaattcttggcacttgttatcctcattttctacatccaaagaccatggaccagaatatctcttaggaggtaagggagagtgaggctatcagccaaagaaaaagtctccagggggaaggggagaatcacttataatttaatactttgtggaaaaaacatctctgccacctatggccctccaataacaatggaagacagaatcaacaggtgagaaccttgggacaaaaataagttacaaagctgttgtaatccaggtaagagctattaagtttccaaacgaaggctgactgtgaggataagtgatactgatttcagaaatctttaaaaagtagaaccaacaagccttgaggtctaactctgttcaacattaaagggaagagtgagtctaagaagacttcaggtttctagcttggccaaaccaattgagctttaagtgaaatgtgcgatatggtaacagagaaggaaaaagacataacgatagatttgagctgctggtgggaaattctggtttagtgcccagctggctgtacaggctggttggactttaggagggaggtttgagctggaaaataaagatggagagttgtctttcagttttagatcatcagtgaggtcataagggtagatggagtttacctgggaaaattaagtagctattcgatttggcttattattatgttaaaataatacttctctagtgaagtacttaatatgccagatactgtgccaagcattttatatacatcctctcttttactaagccctcatagggcaggtattttgattccaatcatactgattggaactcctaagaaggtatcttgcttaaggtcccacaacgaataggtggcagatccagggtaattcaggtctgtcagaacagtgattcttaattttttccctcctcagactccaggagtcacatgaagttatgcatcctgtctgaccgaggcacaggcacaccacatttttatattccgcttccaggatatcacaaacctgaagcccatcctccatggcccagagagaaaacccaggacaaaaccttggagaagactattttcatgaagacaaatggagaaggagcagtagagtaaaaagagaggtaagggaaggcattgagatggtttacagggttagatgttttgagtcaatcccattataattaccaatgctatctacctatttagttaacgttttattgccctgctgttttctccaggataattggaacagcatgtattggttgggtggaaaagatagaacttgagcagggagattgccaaagagtgaagatgtggctgagtgattgatgatggtctgaactgggtattcagggaagagaactagaagccaaccatgtagaatctatgcaggtgctcttaagacattggtttgactggaattatcttcttgttaggtcttaggaatctccttccaggtaactttttctatgattagacaattgatttgttcagggtcacagagcaaagtccacatttaattccacatggccaataaaagtgaggggctacaaggtgagatccaggggccagagttatcaaagtgatacagcacttttaggaataggacagggaatggaggaattggaattccagtattactttcaaaagcagaactggccagaggaattggaattccagtattattttctggacagaagcagcatggaggaaaagagcactggaattcaggctgaggaactgtgaagccaagggtgttgtataggttgtccatttcaaattagggttgcttggttctgggatgatttgcatggaagaggggagagtgacttggagatgtgtgattgaggacagtgagcacagtgagttgatggtgttgctgggttataagcagcttcaaagagaaggcattttgaatgaaggtggaaacataatggccaggagaacaagcaaaggactaggaaacagtgaacttcatcttggcctcaagttcctgaggtgcatatgaataaacagtctctaacccagagggtttcaagaaaagcagagtcctcaaaatccaaaggtagagtttccccacattgatattatactaattacacgtataacagtactttggaaaagcacaggtctctggtcacctctaaaaggcaaggttggtaaggaggtcagggtgtcacctgttggtagtcttaactaaatggtctcttcaagggatctaaggatggaaaggggatatataatggttggattaaaggctcatcattgattagcaaattgtcccttttgtttcttaaacccaatttgtacagggaaagttatgccactgtaagatatttttaaatggggaaaaa

SEQ ID NO: 16089 - DNA, 1331 bp, Homo sapiens
  misc_feature (10)..(10): n is a, c, g, or t
  misc_feature (51)..(51): n is a, c, g, or t
  misc_feature (54)..(54): n is a, c, g, or t
ccgggcgggnggtgcgggcggggggggggggcaacgtcctcgccttcttanggntgcattgagatggtttacagggttagatgttttgagtcaatcccattataattaccaatgctatctacctatttagttaacgttttattgccctgctgttttctccaggataattggaacagcatgtattggttgggtggaaaagatagaacttgagcagggagattgccaaagagtgaagatgtggctgagtgattgatgatggtctgaactgggtattcagggaagagaactagaagccaaccatgtagaatctatgcaggtgctcttaagacattggtttgactggaattatcttcttgttaggtcttaggaatctccttccaggtaactttttctatgattagacaattgatttgttcagggtcacagagcaaagtccacatttaattccacatggccaataaaagtgaggggctacaaggtgagatccaggggccagagttatcaaagtgatacagcacttttaggaataggacagggaatggaggaattggaattccagtattactttcaaaagcagaactggccagaggaattggaattccagtattattttcaaaagcagaactggccagaggtgcttgtgattcctgggtggaaaccatggcagtggacagaagcagcatggaggaaaagagcactggaattcaggctgaggaactgtgaagccaagggtgttgtataggttgtccatttcaaattagggttgcttggttctgggatgatttgcatggaagaggggagagtgacttggagatgtgtgattgaggacagtgagcacagtgagttgatggtgttgctgggttataagcagcttcaaagagaaggcattttgaatgaaggtggaaacataatggccaggagaacaagcaaaggactaggaaacagtgaacttcatcttggcctcaagttcctgaggtgcatatgaataaacagtctctaacccagagggtttcaagaaaagcagagtcctcaaaatccaaaggtagagtttccccacattgatattatactaattacacgtataacagtactttggaaaagcacaggtctctggtcacctctaaaaggcaaggttggtaaggaggtcagggtgtcacctgttggtagtcttaactaaatggtctcttcaagggatctaaggatggaaaggggatatataatggttggattaaaggctcatcattgattagcaaattgtcccttttgtttcttaaacccaatttgtacagggaaagttatgccactgtaagatatttttaaatggggaaaaa

SEQ ID NO: 16090 - DNA, 330 bp, Homo sapiens
caggagactgtccctagaaaaaaaaatttttttgaggaaatattctaatatttgaaaaactattacccagtttagcaaagaagttgctcaaaacatgtttcatgtttgtatattggaacttacacctggagagccactgagtctctaaccccgaagctcatggactactccatgatctatgaagtttgccagatagaaaagtagagaaatggctaggtgcagtggctcatgcccgtaatcctcgcactttggggaggctgcagcaagagaatcacttgaacccaggagtttgagaccagcctaggcaacataatgaaatcctgcctctac

SEQ ID NO: 16091 - DNA, 330 bp, Homo sapiens
caggagactgtccctagaaaaaaaaatttttttgaggaaatattctaatatttgaaaaactattacccagtttagcaaagaagttgctcaaaacatgtttcatgtttgtatattggaacttacacctggagagccactgagtctctaaccccgaagctcatggactactccatgatctatgaagtttgccagatagaaaagtagagaaatggctaggtgcagtggctcatgcccgtaatcctcgcactttggggaggctgcagcaagagaatcacttgaacccaggagtttgagaccagcctaggcaacataattgaatccgtgctctac

SEQ ID NO: 16092 - DNA, 408 bp, Homo sapiens
gtaaaaatggattcatttattaaatcccaacatactatttctttgtaaaaacaaaacaaaatttgacaaaactatagtccatgttatcgtgtctaaagatggcccagtgttcattccggtgtttattatgtttctgtgatgacttaggcagcacctgcctgagtaccagaattccaatttggacacctgggatttagtgctttgcttactgtgtccctcccgacagtgccgacagtacgctctcctgcattcacagtcctgaatgatctgggtaccatatgtcttttctattagatcctttttaatcatcttcaacatcctattcttacatctagtctagtgttttccatagaagacatggagtataccgtcagtaaagaaaaatactcttctttcatgcaagccctt

SEQ ID NO: 16093 - DNA, 767 bp, Homo sapiens
tctcaagtagctgggactacaactgcgccactacacccagcccattgttttaattaatttttttttgaagtttttgtacagatagggtcttgctatgttgcccaggcttgtctcgaactcagcctcaaatgatcttcctgctttggtctcccaaagtgctgggattacaggcgtgagccactgcacccggccccgcttctctctcttttgaaatatagtctgtatcggatgctgtaatcctaaacccagacctcagttgtgacaggtgaaggttggatgaaataggagttagggagaagtaacatttagtttctaaaaaatgcagtttggtcgttttggggtttgctggcccagccttctcccttcaccctctccatttccagcatcactacttttatgtgtacaaggatgtttgcattcagtaacccctgtgtgtttactttgatgtcccagcactaagaaaagggggtggggtaggtgttggtgctgtttgtttgtgcaggcctgaactttagtcactctagtgtgagctactggactaaatcagctgctccattggattataaattatccttgactctggaagacttatgtctgtggagacagtgtgttggagaaaccaggtggtacagattgctggtaaggccctgctgatgcttagtggctacatatgtcctgtgtgttgtaagagctagtttttgttgttggtgttttgttttaagacagagtcactccagcctgggcaacagggcgagactccatctcaa

SEQ ID NO: 16094 - DNA, 413 bp, Homo sapiens
gctgtcgcctactactactaaattaaaaaccgctcgacgaatattttaagttaaaaatgaaaaagcttttaattgctttgtgtgtgttttaatggagccccattttagaattattttttccgtctccctttaccaacaaaaggaacaatgccaccgtgaatggaatagtttggggaaagctttgccaaacacaaccctgatttcagagcaggaacatggtttggatagatcttcagttccgcttgaattattctgttactgcgctgtcattttcagaagatttccattcctttgcagatgctgttgggagttcgggattatgttcatttcttctgttttaatggcattcagtactaattttataagtgcatcttgtgtgaatctcaataaattcagttttgtaatctttttta

SEQ ID NO: 16095 - DNA, 2178 bp, Homo sapiens
agcgggctcccaccgccccagctggtggtggtctcgacaccacgctcgttgcggggtcacacgccagagctggaaaggggaggtccagccccaagtaaagcgacaaaagctttcattgttgaggttcctcagtgctgaactaacaagagggtacttccttgaacataatgaggccaagtatacagaaagaagagaaagagtatacacttgtttgcgaataccaagagaattggaaaagctgatggtttttggaatctttctgtgcctggatgcgtttttgtatgtgttcaccctgcttcctttaagagttttcctggcactattcaggctcctcactttgccttgctatggcttaagggacagacgtttgcttcagcctgcccaggtgtgtgacattttgaagggtgtcattttggtaatctgctattttatgatgcactatgttgactactccatgatgtaccacctgataagggggcagtccgtcatcaagctctacatcatctacaacatgctggaggtagctgatcgtctgttttcatcttttggacaagacatattagatgctctctattggacagcaacagagcctaaagaaagaaacaagagcccacattggggtgattcctcactttttcatggctgttctctatgtctttttgcatgcaattcttataatggttcaagcaacaactctcaatgtagcttttaactcacacaacaagtctttgcttactatcatgatgtctaataattttgttgaaattaaaggaagtgttttcaagaagtttgaaaagaacaatctctttcaaatgtcaaatagcgatattaaggaacgattcacaaattatgtgcttttactgatagtgtgtctaagaaacatggaacagttttcttggaatccagatcatctctgggtgttgtttccagatgtctgtatggtaattgcatcagaaattgccgtggatattgtaaaacatgcctttattactaaattcaatgacattactgcagatgtctacagtgaatatagagccagtcttgcttttgaccttgttagcagccgacagaaaaatgcatacactgattacagtgactctgtagcacggaggatgggctttattcctctcccactagctgttttactcatcagagttgtaacaagctcaattaaagtgcaaggaatcctgtcttatgcctgtgtcatactcttctattttgggttgatatccctgaaagtacttaatagcatcgtgctgttggggaaatcgtgccagtatgtgaaggaagccaaaatggaagagaagctgtcgaatcctcccgcaacctgcactccaggcaagccgtccagtaaatcacagaacaaatgtaaaccctctcaaggcctttccacagaagaaaacctgtctgcctccatcaccaaacaacctattcatcaaaaggaaaatatcataccattacttgtgacaagcaattctgatcagtttttgacaactccagatggtgacgagaaggacataacgcaggacaattctgaattaaaacacagatcctcaaagaaagatttgttagagatagacaggttcacaatttgtggaaaccgaattgactgaatctgtggcttcatgcgctgaagaagctgggtcctggggcaacaagtgctgtgttgccaggacaaatagatgctaaacatggcacttaaatatttatttaaaaacttaaattattattggcaagcaaatcttagtatctttcttccagtaatatggcctggctgagggtcagaccacaggacaggagcgacctccggccttgactgtctgggaagcttgatggattataaaacttcctcctgcctggccaagcagcagcatcatttccaggacccaacaaaggcaacatcaaaatctgttttgctttgtcagtctgggcttccagaatgttgaatttgcctcaaggcctcttcagtataaggaaatacctggaaaactgtgaaacttttaccacgacgtaatctttccagtctcatactattttcacaaacagttttcaaacgttacttcatctgccaaagcattaaaaaaattaaacataagtcaagataaatgttcttaccaccagaataacccttaaagatgtatcttaattaatcagaataaaaggctaccttaaataaga

SEQ ID NO: 16096 - DNA, 4427 bp, Homo sapiens
agcgggctcccaccgccccagctggtggtggtctcgacaccacgctcgttgcggggtcacacgccagagctggaaaggggaggtccagccccaagtaaagcgacaaaagctttcattgttgaggttcctcagtgctgaactaacaagagggtacttccttgaacataatgaggccaagtatacagaaagaagagaaagagtatacacttgtttgcgaataccaagagaattggaaaagctgatggtttttggaatctttctgtgcctggatgcgtttttgtatgtgttcaccctgcttcctttaagagttttcctggcactattcaggctcctcactttgccttgctatggcttaagggacagacgtttgcttcagcctgcccaggtgtgtgacattttgaagggtgtcattttggtaatctgctattttatgatgcactatgttgactactccatgatgtaccacctgataagggggcagtccgtcatcaagctctacatcatctacaacatgctggaggtagctgatcgtctgttttcatcttttggacaagacatattagatgctctctattggacagcaacagagcctaaagaaagaaacaagagcccacattggggtgattcctcactttttcatggctgttctctatgtctttttgcatgcaattcttataatggttcaagcaacaactctcaatgtagcttttaactcacacaacaagtctttgcttactatcatgatgtctaataattttgttgaaattaaaggaagtgttttcaagaagtttgaaaagaacaatctctttcaaatgtcaaatagcgatattaaggaacgattcacaaattatgtgcttttactgatagtgtgtctaagaaacatggaacagttttcttggaatccagatcatctctgggtgttgtttccagatgtctgtatggtaattgcatcagaaattgccgtggatattgtaaaacatgcctttattactaaattcaatgacattactgcagatgtctacagtgaatatagagccagtcttgcttttgaccttgttagcagccgacagaaaaatgcatacactgattacagtgactctgtagcacggaggatgggctttattcctctcccactagctgttttactcatcagagttgtaacaagctcaattaaagtgcaaggaatcctgtcttatgcctgtgtcatactcttctattttgggttgatatccctgaaagtacttaatagcatcgtgctgttggggaaatcgtgccagtatgtgaaggaagccaaaatggaagagaagctgtcgaatcctcccgcaacctgcactccaggcaagccgtccagtaaatcacagaacaaatgtaaaccctctcaaggcctttccacagaagaaaacctgtctgcctccatcaccaaacaacctattcatcaaaaggaaaatatcataccattacttgtgacaagcaattctgatcagtttttgacaactccagatggtgacgagaaggacataacgcaggacaattctgaattaaaacacagatcctcaaagaaagatttgttagagatagacaggttcacaatttgtggaaaccgaattgactgaatctgtggcttcatgcgctgaagaagctgggtcctggggcaacaagtgctgtgttgccaggacaaatagatgctaaacatggcacttaaatatttatttaaaaacttaaattattattggcaagcaaatcttagtatctttcttccagtaatatggcctggctgagggtcagaccacaggacaggagcgacctccggccttgactgtctgggaagcttgatggattataaaacttcctcctgcctggccaagcagcagcatcatttccaggacccaacaaaggcaacatcaaaatctgttttgctttgtcagtctgggcttccagaatgttgaatttgcctcaaggcctcttcagtataaggaaatacctggaaaactgtgaaacttttaccacgacgtaatctttccagtctcatactattttcacaaacagttttcaaacgttacttcatctgccaaagcattaaaaaaattaaacataagtcaagataaatgttcttaccaccagaataacccttaaagatgtatcttaattaatcagaataaaaggctaccttaaataagaaaatgatgaatagtagcattttgtagggttaaaaaaaaaatgctaaactagtttatttattaaaaaaataattaatgaaggctatgcattactgggaaaaatccttcataatttttcagtttactctttaaagcaaaatgtgagctgtatgtcatttaattggtggataaaacaaatttccttacaaaagggcactttttacaccaaggaagcagagcagtgttaactttaaggtatacttaactgattttgctttaaaactaattacttcataaattattacagctaaaaggattcgatgttgaacaggctgaaaaattgtcaatgtacaaaattcaaaactgtcaactttaactgtaaagtaaatgctccaagtgtgttagacagcatcatcttgcttgggcttaccaaatgcattagtctttgtgtttgggtcgacagcgagtgtgcctgtgctggggcagggtgtgtgttctgtgggagggtgtctgtggggatgtgactatcagggtgggcctgtgctggggatggggcaggcctgggtctggagaggattttgtgtgaaagtaaatggggtgtttgaggcgtatgggtggctgttggtgtggggaggcatctgtgtatggctgttgggaacagcaaccaaaaggtgctttttggttttatttgagatcaagattgtgtttccgcttaattactagtttgtggtctatatcatagaagttatttcccaccccattttatcttgacaaccgtgtttgcatttctgtaaaacttctacaacttctggtgtcagaactgtccagaagatggtactgttaactgttatttcctttgatgttttgattttgaagtttagctctcatgcaaatgtttcaggcgtacatacataggcagaaagcaatttttaggtgatttgtctgtttcttggatgaaatataaagcaagctttaatgttctgacttgttcatttgaaatacaaaaaagtaagtgaattttaatgttttgcattaactaaagaaatctgaagattaatgttgaggaaattgtatggacatgcctttgtgaaaccaggaagtattttaagttaaaaatgaaaaagcttttaattgctttgtgtgtgttttaatggagccccattttagaattattttttccgtctccctttaccaacaaaaggaacaatgccaccgtgaatggaatagtttggggaaagctttgccaaacacaaccctgatttcagagcaggaacatggtttggatagatcttcagttccgcttgaattattctgttactgcgctgtcattttcagaagatttccattcctttgcagatgctgttgggagttcgggattatgttcatttcttctgttttaatggcattcagtactaattttataagtgcatcttgtgtgaatctcaataaattcagttttgtaatcttttttaaaaaggtcactgaatttattttaatatttactattgtatttggtagagtgaatttcccactgtataataagtatttatttgtaattcacaagtgatagagctatcttaatttgaattattgctttggtcttaatggtggcaaaatgtttaattttgtctttggaaaaaataggctcggccttgattatagaccatttaatatttctcagcaaatgaaggtatttgcattttacaagtgttttgaatgtcacacaaaatatttttcacatctgggagtcaagttcaagacagtgctttggttttaaaaaaatctaatgaaggcacaggataggccagacccttattaggttttcctttagaataagtgtaaagaccaagtgtcactgatacgcttgtccagattttcttgtggactttggccagtatttagagtttatattcatgttacataaagtgaaagaaacttgctataattaggccatcaaaatatatcctgccactcctggtaactcagcagaggaggagataaatttacaaaataatgtaatatctctacattgttacatgttttcaactattttttatcaacaaagatttgttaatcacttcctatgtgtcagaaactgttctaagtggtgggatcagcaatgagcaagataagtccctgttcgtctgtggaagactgataggaacaagtcgatgaaataatgtctgctggtcacagagtgtccactgaccaaatgatctctcaggcttatttcagctctaaaatatagttctttaaaacgttaaaaaaagt

SEQ ID NO: 16097 - DNA, 3628 bp, Homo sapiens
agcgggctcccaccgccccagctggtggtggtctcgacaccacgctcgttgcggggtcacacgccagagctggaaaggggaggtccagccccaagtaaagcgacaaaagctttcattgttgaggttcctcagtgctgaactaacaagagggtacttccttgaacataatgaggccaagtatacagaaagaagagaaagagtatacacttgtttgcgaataccaagagaattggaaaagctgatggtttttggaatctttctgtgcctggatgcgtttttgtatgtgttcaccctgcttcctttaagagttttcctggcactattcaggctcctcactttgccttgctatggcttaagggacagacgtttgcttcagcctgcccaggtgtgtgacattttgaagggtgtcattttggtaatctgctattttatgatgcactatgttgactactccatgatgtaccacctgataagggggcagtccgtcatcaagctctacatcatctacaacatgctggaggtagctgatcgtctgttttcatcttttggacaagacatattagatgctctctattggacagcaacagagcctaaagaaagaaacaagagcccacattggggtgattcctcactttttcatggctgttctctatgtctttttgcatgcaattcttataatggttcaagcaacaactctcaatgtagcttttaactcacacaacaagtctttgcttactatcatgatgtctaataattttgttgaaattaaaggaagtgttttcaagaagtttgaaaagaacaatctctttcaaatgtcaaatagcgatattaaggaacgattcacaaattatgtgcttttactgatagtgtgtctaagaaacatggaacagttttcttggaatccagatcatctctgggtgttgtttccagatgtctgtatggtaattgcatcagaaattgccgtggatattgtaaaacatgcctttattactaaattcaatgacattactgcagatgtctacagtgaatatagagccagtcttgcttttgaccttgttagcagccgacagaaaaatgcatacactgattacagtgactctgtagcacggaggatgggctttattcctctcccactagctgttttactcatcagagttgtaacaagctcaattaaagtgcaaggaatcctgtcttatgcctgtgtcatactcttctattttgggttgatatccctgaaagtacttaatagcatcgtgctgttggggaaatcgtgccagtatgtgaaggaagccaaaatggaagagaagctgtcgaatcctcccgcaacctgcactccaggcaagccgtccagtaaatcacagaacaaatgtaaaccctctcaaggcctttccacagaagaaaacctgtctgcctccatcaccaaacaacctattcatcaaaaggaaaatatcataccattacttgtgacaagcaattctgatcagtttttgacaactccagatggtgacgagaaggacataacgcaggacaattctgaattaaaacacagatcctcaaagaaagatttgttagagatagacaggttcacaatttgtggaaaccgaattgactgaatctgtggcttcatgcgctgaagaagctgggtcctggggcaacaagtgctgtgttgccaggacaaatagatgctaaacatggcacttaaatatttatttaaaaacttaaattattattggcaagcaaatcttagtatctttcttccagtaatatggcctggctgagggtcagaccacaggacaggagcgacctccggccttgactgtctgggaagcttgatggattataaaacttcctcctgcctggccaagcagcagcatcatttccaggacccaacaaaggcaacatcaaaatctgttttgctttgtcagtctgggcttccagaatgttgaatttgcctcaaggcctcttcagtataaggaaatacctggaaaactgtgaaacttttaccacgacgtaatctttccagtctcatactattttcacaaacagttttcaaacgttacttcatctgccaaagcattaaaaaaattaaacataagtcaagataaatgttcttaccaccagaataacccttaaagatgtatcttaattaatcagaataaaaggctaccttaaataagaaaatgatgaatagtagcattttgtagggttaaaaaaaaaatgctaaactagtttatttattaaaaaaataattaatgaaggctatgcattactgggaaaaatccttcataatttttcagtttactctttaaagcaaaatgtgagctgtatgtcatttaattggtggataaaacaaatttccttacaaaagggcactttttacaccaaggaagcagagcagtgttaactttaaggtatacttaactgattttgctttaaaactaattacttcataaattattacagctaaaaggattcgatgttgaacaggctgaaaaattgtcaatgtacaaaattcaaaactgtcaactttaactgtaaagtaaatgctccaagtgtgttagacagcatcatcttgcttgggcttaccaaatgcattagtctttgtgtttgggtcgacagcgagtgtgcctgtgctggggcagggtgtgtgttctgtgggagggtgtctgtggggatgtgactatcagggtgggcctgtgctggggatggggcaggcctgggtctggagaggattttgtgtgaaagtaaatggggtgtttgaggcgtatgggtggctgttggtgtggggaggcatctgtgtatggctgttgggaacagcaaccaaaaggtgctttttggttttatttgagatcaagattgtgtttccgcttaattactagtttgtggtctatatcatagaagttatttcccaccccattttatcttgacaaccgtgtttgcatttctgtaaaacttctacaacttctggtgtcagaactgtccagaagatggtactgttaactgttatttcctttgatgttttgattttgaagtttagctctcatgcaaatgtttcaggcgtacatacataggcagaaagcaatttttaggtgatttgtctgtttcttggatgaaatataaagcaagctttaatgttctgacttgttcatttgaaatacaaaaaagtaagtgaattttaatgttttgcattaactaaagaaatctgaagattaatgttgaggaaattgtatggacatgcctttgtgaaaccaggaagtattttaagttaaaaatgaaaaagcttttaattgctttgtgtgtgttttaatggagccccattttagaattattttttccgtctccctttaccaacaaaaggaacaatgccaccgtgaatggaatagtttggggaaagctttgccaaacacaaccctgatttcagagcaggaacatggtttggatagatcttcagttccgcttgaattattctgttactgcgctgtcattttcagaagatttccattcctttgcagatgctgttgggagttcgggattatgttcatttcttctgttttaatggcattcagtactaattttataagtgcatcttgtgtgaatctcaataaattcagttttgtaatctttttta

SEQ ID NO: 16098 - DNA, 4373 bp, Homo sapiens
agcgggctcccaccgccccagctggtggtggtctcgacaccacgctcgttgcggggtcacacgccagagctggaaaggggaggtccagccccaagtaaagcgacaaaagctttcattgttgaggttcctcagtgctgaactaacaagagggtacttccttgaacataatgaggccaagtatacagaaagaagagaaagagtatacacttgtttgcgaataccaagagaattggaaaagctgatggtttttggaatctttctgtgcctggatgcgtttttgtatgtgttcaccctgcttcctttaagagttttcctggcactattcaggctcctcactttgccttgctatggcttaagggacagacgtttgcttcagcctgcccaggtgtgtgacattttgaagggtgtcattttggtaatctgctattttatgatgcactatgttgactactccatgatgtaccacctgataagggggcagtccgtcatcaagctctacatcatctacaacatgctggaggtagctgatcgtctgttttcatcttttggacaagacatattagatgctctctattggacagcaacagagcctaaagaaagaaacaagagcccacattggggtgattcctcactttttcatggctgttctctatgtctttttgcatgcaattcttataatggttcaagcaacaactctcaatgtagcttttaactcacacaacaagtctttgcttactatcatgatgtctaataattttgttgaaattaaaggaagtgttttcaagaagtttgaaaagaacaatctctttcaaatgtcaaatagcgatattaaggaacgattcacaaattatgtgcttttactgatagtgtgtctaagaaacatggaacagttttcttggaatccagatcatctctgggtgttgtttccagatgtctgtatggtaattgcatcagaaattgccgtggatattgtaaaacatgcctttattactaaattcaatgacattactgcagatgtctacagtgaatatagagccagtcttgcttttgaccttgttagcagccgacagaaaaatgcatacactgattacagtgactctgtagcacggaggatgggctttattcctctcccactagctgttttactcatcagagttgtaacaagctcaattaaagtgcaaggaatcctgtcttatgcctgtgtcatactcttctattttgggttgatatccctgaaagtacttaatagcatcgtgctgttggggaaatcgtgccagtatgtgaaggaagccaaaatggaagagaagctgtcgaatcctcccgcaacctgcactccaggcaagccgtccagtaaatcacagaacaaatgtaaaccctctcaaggcctttccacagaagaaaacctgtctgcctccatcaccaaacaacctattcatcaaaaggaaaatatcataccattacttgtgacaagcaattctgatcagtttttgacaactccagatggtgacgagaaggacataacgcaggacaattctgaattaaaacacagatcctcaaagaaagatttgttagagatagacaggttcacaatttgtggaaaccgaattgactgaatctgtggcttcatgcgctgaagaagctgggtcctggggcaacaagtgctgtgttgccaggacaaatagatgctaaacatggcacttaaatatttatttaaaaacttaaattattattggcaagcaaatcttagtatctttcttccagtaatatggcctggctgagggtcagaccacaggacaggagcgacctccggccttgactgtctgggaagcttgatggattataaaacttcctcctgcctggccaagcagcagcatcatttccaggacccaacaaaggcaacatcaaaatctgttttgctttgtcagtctgggcttccagaatgttgaatttgcctcaaggcctcttcagtataaggaaatacctggaaaactgtgaaacttttaccacgacgtaatctttccagtctcatactattttcacaaacagttttcaaacgttacttcatctgccaaagcattaaaaaaattaaacataagtcaagataaatgttcttaccaccagaataacccttaaagatgtatcttaattaatcagaataaaaggctaccttaaataagaaaatgatgaatagtagcattttgtagggttaaaaaaaaaatgctaaactagtttatttattaaaaaaataattaatgaaggctatgcattactgggaaaaatccttcataatttttcagtttactctttaaagcaaaatgtgagctgtatgtcatttaattggtggataaaacaaatttccttacaaaagggcactttttacaccaaggaagcagagcagtgttaactttaaggtatacttaactgattttgctttaaaactaattacttcataaattattacagctaaaaggattcgatgttgaacaggctgaaaaattgtcaatgtacaaaattcaaaactgtcaactttaactgtaaagtaaatgctccaagtgtgttagacagcatcatcttgcttgggcttaccaaatgcattagtctttgtgtttgggtcgacagcgagtgtgcctgtgctggggcagggtgtgtgttctgtgggagggtgtctgtggggatgtgactatcagggtgggcctgtgctggggatggggcaggcctgggtctggagaggattttgtgtgaaagtaaatggggtgtttgaggcgtatgggtggctgttggtgtggggaggcatctgtgtatggctgttgggaacagcaaccaaaaggtgctttttggttttatttgagatcaagattgtgtttccgcttaattactagtttgtggtctatatcatagaagttatttcccaccccattttatcttgacaaccgtgtttgcatttctgtaaaacttctacaacttctggtgtcagaactgtccagaagatggtactgttaactgttatttcctttgatgttttgattttgaagtttagctctcatgcaaatgtttcaggcgtacatacataggcagaaagcaatttttaggtgatttgtctgtttcttggatgaaatataaagcaagctttaatgttctgacttgttcatttgaaatacaagttgaggaaattgtatggacatgcctttgtgaaaccaggaagtattttaagttaaaaatgaaaaagcttttaattgctttgtgtgtgttttaatggagccccattttagaattattttttccgtctccctttaccaacaaaaggaacaatgccaccgtgaatggaatagtttggggaaagctttgccaaacacaaccctgatttcagagcaggaacatggtttggatagatcttcagttccgcttgaattattctgttactgcgctgtcattttcagaagatttccattcctttgcagatgctgttgggagttcgggattatgttcatttcttctgttttaatggcattcagtactaattttataagtgcatcttgtgtgaatctcaataaattcagttttgtaatcttttttaaaaaggtcactgaatttattttaatatttactattgtatttggtagagtgaatttcccactgtataataagtatttatttgtaattcacaagtgatagagctatcttaatttgaattattgctttggtcttaatggtggcaaaatgtttaattttgtctttggaaaaaataggctcggccttgattatagaccatttaatatttctcagcaaatgaaggtatttgcattttacaagtgttttgaatgtcacacaaaatatttttcacatctgggagtcaagttcaagacagtgctttggttttaaaaaaatctaatgaaggcacaggataggccagacccttattaggttttcctttagaataagtgtaaagaccaagtgtcactgatacgcttgtccagattttcttgtggactttggccagtatttagagtttatattcatgttacataaagtgaaagaaacttgctataattaggccatcaaaatatatcctgccactcctggtaactcagcagaggaggagataaatttacaaaataatgtaatatctctacattgttacatgttttcaactattttttatcaacaaagatttgttaatcacttcctatgtgtcagaaactgttctaagtggtgggatcagcaatgagcaagataagtccctgttcgtctgtggaagactgataggaacaagtcgatgaaataatgtctgctggtcacagagtgtccactgaccaaatgatctctcaggcttatttcagctctaaaatatagttctttaaaacgttaaaaaaagt

SEQ ID NO: 16099 - DNA, 3560 bp, Homo sapiens
agcgggctcccaccgccccagctggtggtggtctcgacaccacgctcgttgcggggtcacacgccagagctggaaaggggaggtccagccccaagtaaagcgacaaaagctttcattgttgaggttcctcagtgctgaactaacaagagggtacttccttgaacataatgaggccaagtatacagaaagaagagaaagagtatacacttgtttgcgaataccaagagaattggaaaagctgatggtttttggaatctttctgtgcctggatgcgtttttgtatgtgttcaccctgcttcctttaagagttttcctggcactattcaggctcctcactttgccttgctatggcttaagggacagacgtttgcttcagcctgcccaggtgtgtgacattttgaagggtgtcattttggtaatctgctattttatgatgcactatgttgactactccatgatgtaccacctgataagggggcagtccgtcatcaagctctacatcatctacaacatgctggaggtagctgatcgtctgttttcatcttttggacaagacatattagatgctctctattggacagcaacagagcctaaagaaagaaacaagagcccacattggggtgattcctcactttttcatggctgttctctatgtctttttgcatgcaattcttataatggttcaagcaacaactctcaatgtagcttttaactcacacaacaagtctttgcttactatcatgatgtctaataattttgttgaaattaaaggaagtgttttcaagaagtttgaaaagaacaatctctttcaaatgtcaaatagcgatattaaggaacgattcacaaattatgtgcttttactgatagtgtgtctaagaaacatggaacagttttcttggaatccagatcatctctgggtgttgtttccagatgtctgtatggtaattgcatcagaaattgccgtggatattgtaaaacatgcctttattactaaattcaatgacattactgcagatgtctacagtgaatatagagccagtcttgcttttgaccttgttagcagccgacagaaaaatgcatacactgattacagtgactctgtagcacggaggatgggctttattcctctcccactagctgttttactcatcagagttgtaacaagctcaattaaagtgcaaggaatcctgtcttatgcctgtgtcatactcttctattttgggttgatatccctgaaagtacttaatagcatcgtgctgttggggaaatcgtgccagtatgtgaaggaagccaaaatggaagagaagctgtcgaatcctcccgcaacctgcactccaggcaagccgtccagtaaatcacagaacaaatgtaaaccctctcaaggcctttccacagaagaaaacctgtctgcctccatcaccaaacaacctattcatcaaaaggaaaatatcataccattacttgtgacaagcaattctgatcagtttttgacaactccagatggtgacgagaaggacataacgcaggacaattctgaattaaaacacagatcctcaaagaaagatttgttagagatagacaggttcacaatttgtggaaaccgaattgactgaatctgtggcttcatgcgctgaagaagctgggtcctggggcaacaagtgctgtgttgccaggacaaatagatgctaaacatggcacttaaatatttatttaaaaacttaaattattattggcaagcaaatcttagtatctttcttccagtaatatggcctggctgagggtcagaccacaggacaggagcgacctccggccttgactgtctgggaagcttgatggattataaaacttcctcctgcctggccaagcagcagcatcatttccaggacccaacaaaggcaacatcaaaatctgttttgctttgtcagtctgggcttccagaatgttgaatttgcctcaaggcctcttcagtataaggaaatacctggaaaactgtgaaacttttaccacgacgtaatctttccagtctcatactattttcacaaacagttttcaaacgttacttcatctgccaaagcattaaaaaaattaaacataagtcaagataaatgttcttaccaccagaataacccttaaagatgtatcttaattaatcagaataaaaggctaccttaaataagaaaatgatgaatagtagcattttgtagggttaaaaaaaaaatgctaaactagtttatttattaaaaaaataattaatgaaggctatgcattactgggaaaaatccttcataatttttcagtttactctttaaagcaaaatgtgagctgtatgtcatttaattggtggataaaacaaatttccttacaaaagggcactttttacaccaaggaagcagagcagtgttaactttaaggtatacttaactgattttgctttaaaactaattacttcataaattattacagctaaaaggattcgatgttgaacaggctgaaaaattgtcaatgtacaaaattcaaaactgtcaactttaactgtaaagtaaatgctccaagtgtgttagacagcatcatcttgcttgggcttaccaaatgcattagtctttgtgtttgggtcgacagcgagtgtgcctgtgctggggcagggtgtgtgttctgtgggagggtgtctgtggggatgtgactatcagggtgggcctgtgctggggatggggcaggcctgggtctggagaggattttgtgtgaaagtaaatggggtgtttgaggcgtatgggtggctgttggtgtggggaggcatctgtgtatggctgttgggaacagcaaccaaaaggtgctttttggttttatttgagatcaagattgtgtttccgcttaattactagtttgtggtctatatcatagaagttatttcccaccccattttatcttgacaaccgtgtttgcatttctgtaaaacttctacaacttctggtgtcagaactgtccagaagatggtactgttaactgttatttcctttgatgttttgattttgaagtttagctctcatgcaaatgtttcaggcgtacatacataggcagaaagcaatttttaggtgatttgtctgtttcttggatgaaatataaagcaagctttaatgttctgacttgttcatttgaaatacaaaaaagtaagtgaattttaatgttttgcattaactaaagaaatctgaagattaatgttgaggaaattgtatggacatgcctttgtgaaaccaggaagtattttaagttaaaaatgaaaaagcttttaattgctttgtgtgtgttttaatggagccccattttagaattattttttccgtctcccctgatttcagagcaggaacatggtttggatagatcttcagttccgcttgaattattctgttactgcgctgtcattttcagaagatttccattcctttgcagatgctgttgggagttcgggattatgttcatttcttctgttttaatggcattcagtactaattttataagtgcatcttgtgtgaatctcaataaattcagttttgtaatctttttta

SEQ ID NO: 16100 - DNA, 843 bp, Homo sapiens
aacaattaggtttgtcttcaacactgcacggacagaaggggccccttagcctttccacagaagaaaacctgtctgcctccatcaccaaacaacctattcatcaaaaggaaaatatcataccattacttgtgacaagcaattctgatcagtttttgacaactccagatggtgacgagaaggacataacgcaggacaattctgaattaaaacacagatcctcaaagaaagatttgttagagatagacaggttcacaatttgtggaaaccgaattgactgaatctgtggcttcatgcgctgaagaagctgggtcctggggcaacaagtgctgtgttgccaggacaaatagatgctaaacatggcacttaaatatttatttaaaaacttaaattattattggcaagcaaatcttagtatctttcttccagtaatatggcctggctgagggtcagaccacaggacaggagcgacctccggccttgactgtctgggaagcttgatggattataaaacttcctcctgcctggccaagcagcagcatcatttccaggacccaacaaaggcaacatcaaaatctgttttgctttgtcagtctgggcttccagaatgttgaatttgcctcaaggcctcttcagtataaggaaatacctggaaaactgtgaaacttttaccacgacgtaatctttccagtctcatactattttcacaaacagttttcaaacgttacttcatctgccaaagcattaaaaaaattaaacataagtcaagataaatgttcttaccaccagaataacccttaaagatgtatcttaattaatcagaataaaaggctaccttaaataaga

SEQ ID NO: 16101 - DNA, 1002 bp, Homo sapiens
agcgggctcccaccgccccagctggtggtggtctcgacaccacgctcgttgcggggtcacacgccagagctggaaaggggaggtccagccccaagtaaagcgacaaaagctttcattgttgaggttcctcagtgctgaactaacaagagggtacttccttgaacataatgaggccaagtatacagaaagaagagaaagagtatacacttgtttgcgaataccaagagaattggaaaagctgatggtttttggaatctttctgtgcctggatgcgtttttgtatgtgttcaccctgcttcctttaagagttttcctggcactattcaggctcctcactttgccttgctatggcttaagggacagacgtttgcttcagcctgcccaggtgtgtgacattttgaagggtgtcattttggtaatctgctattttatgatgcactatgttgactactccatgatgtaccacctgataagggggcagtccgtcatcaagctctacatcatctacaacatgctggaggtagctgatcgtctgttttcatcttttggacaagacatattagatgctctctattggacagcaacagagcctaaagaaagaaacaagagcccacattggggtgattcctcactttttcatggctgttctctatgtctttttgcatgcaattcttataatggttcaagcaacaactctcaatgtagcttttaactcacacaacaagtctttgcttactatcatgatgtctaataattttgttgaaattaaaggaagtgttttcaagaagtttgaaaagaacaatctctttcaaatgtcaaatagcgatattaaggaacgattcacaaattatgtgcttttactgatagtgtgtctaagaaacatggaacagttttcttggaatccaggtaactcactcttaacaaaacagtgtcttataattttacttctaagccaaaatcattcttttacatggaataaaatgaatattgcagaaaactcca

SEQ ID NO: 16102 - DNA, 419 bp, Homo sapiens
ctggaatttccatactagaattatgttggcaaaagaagtcaatggcttaccatggtagcaccagcctatatatacacacacacacacacacacacacatatatatatatataaagttgtatatttatagacatttatacatcgtctaataatttcatcatgttctggctaaaataattatatatgtactttattatgttgtttatatacactacagtacttatgttgattttttttcttttagatattaaggaacgattcacaaattatgtgcttttactgatagtgtgtctaagaaacatggaacagttttcttggaatccaggtaactcactcttaacaaaacagtgtcttataattttacttctaagccaaaatcattcttttacatggaataaaatgaatattgcagaaaactcc

SEQ ID NO: 16103 - DNA, 873 bp, Homo sapiens
gagccgcgggcggagagtctgaggcgtggcccttcgagccagctccgccccgttgttcctggcttgagtagggcagagagcaccgcccagcagccagtgggttcccgcgcgtgccgagactctgaggccttgcacccccacgatcccgtacgatggccgtcaagaagatcgcgatcttcggcgccactggccagaccgggctcaccaccctggcgcaggcggtgcaagcaggttacgaagtgacagtgctggtgcgggactcctccaggctgccatcagaggggccccggccggcccacgtggtagtgggagatgttctgcaggcagccgatgtggacaagaccgtggctgggcaggacgctgtcatcgtgctgctgggcacccgcaatgacctcagtcccacgacagtgatgtccgagggcgcccggaacattgtggcagccatgaaggctcatggtgtggacaaggtcgtggcctgcacctcggctttcctgctctgggaccctaccaaggtgcccccacgactgcaggctgtgactgatgaccacatccggatgcacaaggtgctgcgggaatcaggcctgaagtacgtggctgtgatgccgccacacataggagaccagccactaactggggcgtacacagtgaccctggatggacgagggccctcaagggtcatctccaaacatgacctgggccatttcatgctgcgctgcctcaccaccgatgagtacgacggacacagcacctacccctcccaccagtaccagtagcactctgtccccatctgggagggtggcattctgggacatgaggagcaaaggaagggggcaataaatgttgagccaagagcttcaaattactctagaaaaa

SEQ ID NO: 16104 - DNA, 830 bp, Homo sapiens
gaattcgaatgccaccctcccagatgggggcagagagcaccgcccagcagccagtgggttcccgcgcgtgccgagactctgaggccttgcacccccacgatcccgtacgatggccgtcaagaagatcgcgatcttcggcgccactggccagaccgggctcaccaccctggcgcaggcggtgcaagcaggttacgaagtgacagtgctggtgcgggactcctccaggctgccatcagaggggccccggccggcccacgtggtagtgggagatgttctgcaggcagccgatgtggacaagaccgtggctgggcaggacgctgtcatcgtgctgctgggcacccgcaatgacctcagtcccacgacagtgatgtccgagggcgcccggaacattgtggcagccatgaaggctcatggtgtggacaaggtcgtggcctgcacctcggctttcctgctctgggaccctaccaaggtgcccccacgactgcaggctgtgactgatgaccacatccggatgcacaaggtgctgcgggaatcaggcctgaagtacgtggctgtgatgccgccacacataggagaccagccactaactggggcgtacacagtgaccctggatggacgagggccctcaagggtcatctccaaacatgacctgggccatttcatgctgcgctgcctcaccaccgatgagtacgacggacacagcacctacccctcccaccagtaccagtagcactctgtccccatctgggagggtggcattctgggacatgaggagcaaaggaagggggcaataaatgttgagccaagagcttcaaattactctagaaaaa

SEQ ID NO: 16105 - DNA, 732 bp, Homo sapiens
tgagagttcatggtggcttctaggacccagctcctggagcccaagagtgccagcccactgaccaggctctctgctcctctttgcccacaggttacgaagtgacagtgctggtgcgggactcctccaggctgccatcagaggggccccggccggcccacgtggtagtgggagatgttctgcaggcagccgatgtggacaagaccgtggctgggcaggacgctgtcatcgtgctgctgggcacccgcaatgacctcagtcccacgacagtgatgtccgagggcgcccggaacattgtggcagccatgaaggctcatggtgtggacaaggtcgtggcctgcacctcggctttcctgctctgggaccctaccaaggtgcccccacgactgcaggctgtgactgatgaccacatccggatgcacaaggtgctgcgggaatcaggcctgaagtacgtggctgtgatgccgccacacataggagaccagccactaactggggcgtacacagtgaccctggatggacgagggccctcaagggtcatctccaaacatgacctgggccatttcatgctgcgctgcctcaccaccgatgagtacgacggacacagcacctacccctcccaccagtaccagtagcactctgtccccatctgggagggtggcattctgggacatgaggagcaaaggaagggggcaataaatgttgagccaagagcttcaaattactctagaaaaa

SEQ ID NO: 16106 - DNA, 825 bp, Homo sapiens
acccacgcgtcgcggacgcgtgggtcgacccacgcgtccggactagttctagatcgccgcgcgtgccgagactctgaggccttgcacccccacgatcccgtacgatggccgtcaagaagatcgcgatcttcggcgccactggccagaccgggctcaccaccctggcgcaggcggtgcaagcaggttacgaagtgacagtgctggtgcgggactcctccaggctgccatcagaggggccccggccggcccacgtggtagtgggagatgttctgcaggcagccgatgtggacaagaccgtggctgggcaggacgctgtcatcgtgctgctgggcacccgcaatgacctcagtcccacgacagtgatgtccgagggcgcccggaacattgtggcagccatgaaggctcatggtgtggacaaggtcgtggcctgcacctcggctttcctgctctgggaccctaccaaggtgcccccacgactgcaggctgtgactgatgaccacatccggatgcacaaggtgctgcgggaatcaggcctgaagtacgtggctgtgatgccgccacacataggagaccagccactaactggggcgtacacagtgaccctggatggacgagggccctcaagggtcatctccaaacatgacctgggccatttcatgctgcgctgcctcaccaccgatgagtacgacggacacagcacctacccctcccaccagtaccagtagcactctgtccccatctgggagggtggcattctgggacatgaggagcaaaggaagggggcaataaatgttgagccaagagcttcaaattactctagaaaaa

SEQ ID NO: 16107 - DNA, 920 bp, Homo sapiens
gagccgcgggcggagagtctgaggcgtggcccttcgagccagctccgccccgttgttcctggcttgagtagggcagagagcaccgcccagcagccagtgggttcccgcgcgtgccgagactctgaggccttgcacccccacgatcccgtacgatggccgtcaagaagatcgcgatcttcggcgccactggccagaccgggctcaccaccctggcgcaggcggtgcaagcaggttacgaagtgacagtgctggtgcgggactcctccaggctgccatcagaggggccccggccggcccacgtggtagtgggagatgttctgcaggcagccgatgtggacaagaccgtggctgggcaggacgctgtcatcgtgctgctgggcacccgcaatgacctcagtcccacgacagtgatgtccgagggcgcccggaacattgtggcagccatgaaggctcatggtgtggacaaggtcgtggcctgcacctcggctttcctgctctgggaccctaccaaggtgcccccacgactgcaggctgtgactgatgaccacatccggatgcacaaggtgctgcgggaatcaggcctgaagtacgtggctgtgatgccgccacacataggagaccagccactaactggggcgtacacagtgaccctggatggacgagggccctcaagggtcatctccaaacatgacctgggccatttcatgctgcgctgcctcaccaccgatgagtacgacggacacagcacctacccctcccaccagtaccagtagcactctgtccccatctgggagggtggcattctgggacatgaggagcaaaggaagggggcaataaatgttgagccaagagcttcaaattactctagaaaaaaaacaaaaaatctcgggcctactaatcggcgggaaaaacggtcgcca

SEQ ID NO: 16108 - DNA, 781 bp, Homo sapiens
tttttagagtaatttgaagctcttggctcaacatttcttgcacccccacgatcccgtacgatggccgtcaagaagatcgcgatcttcggcgccactggccagaccgggctcaccaccctggcgcaggcggtgcaagcaggttacgaagtgacagtgctggtgcgggactcctccaggctgccatcagaggggccccggccggcccacgtggtagtgggagatgttctgcaggcagccgatgtggacaagaccgtggctgggcaggacgctgtcatcgtgctgctgggcacccgcaatgacctcagtcccacgacagtgatgtccgagggcgcccggaacattgtggcagccatgaaggctcatggtgtggacaaggtcgtggcctgcacctcggctttcctgctctgggaccctaccaaggtgcccccacgactgcaggctgtgactgatgaccacatccggatgcacaaggtgctgcgggaatcaggcctgaagtacgtggctgtgatgccgccacacataggagaccagccactaactggggcgtacacagtgaccctggatggacgagggccctcaagggtcatctccaaacatgacctgggccatttcatgctgcgctgcctcaccaccgatgagtacgacggacacagcacctacccctcccaccagtaccagtagcactctgtccccatctgggagggtggcattctgggacatgaggagcaaaggaagggggcaataaatgttgagccaagagcttcaaattactctagaaaaa

SEQ ID NO: 16109 - DNA, 785 bp, Homo sapiens
gagagagagagcagagagagagagatgagagacgagagcagcagacagcaaagaccagtaacagatggccgtcaagaagatcgcgatcttcggcgccactggccagaccgggctcaccaccctggcgcaggcggtgcaagcaggttacgaagtgacagtgctggtgcgggactcctccaggctgccatcagaggggccccggccggcccacgtggtagtgggagatgttctgcaggcagccgatgtggacaagaccgtggctgggcaggacgctgtcatcgtgctgctgggcacccgcaatgacctcagtcccacgacagtgatgtccgagggcgcccggaacattgtggcagccatgaaggctcatggtgtggacaaggtcgtggcctgcacctcggctttcctgctctgggaccctaccaaggtgcccccacgactgcaggctgtgactgatgaccacatccggatgcacaaggtgctgcgggaatcaggcctgaagtacgtggctgtgatgccgccacacataggagaccagccactaactggggcgtacacagtgaccctggatggacgagggccctcaagggtcatctccaaacatgacctgggccatttcatgctgcgctgcctcaccaccgatgagtacgacggacacagcacctacccctcccaccagtaccagtagcactctgtccccatctgggagggtggcattctgggacatgaggagcaaaggaagggggcaataaatgttgagccaagagcttcaaattactctagaaaaa

SEQ ID NO: 16110 - DNA, 905 bp, Homo sapiens
gagccgcgggcggagagtctgaggcgtggcccttcgagccagctccgccccgttgttcctggcttgagtagggcagagagcaccgcccagcagccagtgggttcccgcgcgtgccgagactctgaggccttgcacccccacgatcccgtacgatggccgtcaagaagatcgcgatcttcggcgccactggccagaccgggctcaccaccctggcgcaggcggtgcaagcaggttacgaagtgacagtgctggtgcgggactcctccaggctgccatcagaggggccccggccggcccacgtggtagtgggagatgttctgcaggcagccgatgtggacaagaccgtggctgggcaggacgctgtcatcgtgctgctgggcacccgcaatgacctcagtcccacgacagtgatgtccgagggcgcccggaacattgtggcagccatgaaggctcatggtgtggacaaggtcgtggcctgcacctcggctttcctgctctgggaccctaccaaggtgcccccacgactgcaggctgtgactgatgaccacatccggatgcacaaggtgctgcgggaatcaggcctgaagtacgtggctgtgatgccgccacacataggagaccagccactaactggggcgtacacagtgaccctggatggacgagggccctcaagggtcatctccaaacatgacctgggccatttcatgctgcgctgcctcaccaccgatgagtacgacggacacagcacctacccctcccaccagtaccagtagcactctgtccccatctgggagggtggcattctgggacatgaggagcaaaggaagggggcaataaatgttgagccaagagcttcaaattactctagaaaaagaaaccgactgtatgactctccactctctctg

SEQ ID NO: 16111 - DNA, 468 bp, Homo sapiens
tagtcccacacctgcaccggtagtcccacacctgcaccggtagtcccacacctgcaccggagtcccacacctgcacctcggctttcctgctctgggaccctaccaaggtgcccccacgactgcaggctgtgactgatgaccacatccggatgcacaaggtgctgcgggaatcaggcctgaagtacgtggctgtgatgccgccacacataggagaccagccactaactggggcgtacacagtgaccctggatggacgagggccctcaagggtcatctccaaacatgacctgggccatttcatgctgcgctgcctcaccaccgatgagtacgacggacacagcacctacccctcccaccagtaccagtagcactctgtccccatctgggagggtggcattctgggacatgaggagcaaaggaagggggcaataaatgttgagccaagagcttcaaattactctagaaaaa

SEQ ID NO: 16112 - DNA, 776 bp, Homo sapiens
gagccgcgggcggagagtctgaggcgtggcccttcgagccagctccgccccgttgttcctggcttgagtagggcagagagcaccgcccagcagccagtgggttcccgcgcgtgccgagactctgaggccttgcacccccacgatcccgtacgatggccgtcaagaagatcgcgatcttcggcgccactggccagaccgggctcaccaccctggcgcaggcggtgcaagcaggttacgaagtgacagtgctggtgcgggactcctccaggctgccatcagaggggccccggccggcccacgtggtagtgggagatgttctgcaggcagccgatgtggacaagaccgtggctgggcaggacgctgtcatcgtgctgctgggcacccgcaatgacctcagtcccacgacagtgatgtccgagggcgcccggaacattgtggcagccatgaaggctcatggtgtggacaaggtcgtggcctgcacctcgggagaccagccactaactggggcgtacacagtgaccctggatggacgagggccctcaagggtcatctccaaacatgacctgggccatttcatgctgcgctgcctcaccaccgatgagtacgacggacacagcacctacccctcccaccagtaccagtagcactctgtccccatctgggagggtggcattctgggacatgaggagcaaaggaagggggcaataaatgttgagccaagagcttcaaattactctagaaaaagaaaccgactgtatgactctccactctctctg

SEQ ID NO: 16113 - DNA, 639 bp, Homo sapiens
gaattcgaatgccaccctcccagatgggggcagagagcaccgcccagcagccagtgggttcccgcgtggtagtgggagatgttctgcaggcagccgatgtggacaagaccgtggctgggcaggacgctgtcatcgtgctgctgggcacccgcaatgacctcagtcccacgacagtgatgtccgagggcgcccggaacattgtggcagccatgaaggctcatggtgtggacaaggtcgtggcctgcacctcggctttcctgctctgggaccctaccaaggtgcccccacgactgcaggctgtgactgatgaccacatccggatgcacaaggtgctgcgggaatcaggcctgaagtacgtggctgtgatgccgccacacataggagaccagccactaactggggcgtacacagtgaccctggatggacgagggccctcaagggtcatctccaaacatgacctgggccatttcatgctgcgctgcctcaccaccgatgagtacgacggacacagcacctacccctcccaccagtaccagtagcactctgtccccatctgggagggtggcattctgggacatgaggagcaaaggaagggggcaataaatgttgagccaagagcttcaaattactctagaaaaa

SEQ ID NO: 16114 - DNA, 810 bp, Homo sapiens
gagccgcgggcggagagtctgaggcgtggcccttcgagccagctccgccccgttgttcctggcttgagtagggcagagagcaccgcccagcagccagtgggttcccgcgcgtgccgagactctgaggccttgcacccccacgatcccgtacgatggccgtcaagaagatcgcgatcttcggcgccactggccagaccgggctcaccaccctggcgcaggcggtgcaagcaggttacgaagtgacagtgctggtgcgggactcctccaggctgccatcagaggggccccggccggcccacgtggtagtgggagatgttctgcaggcagccgatgtggacaagaccgtggctgggcaggacgctgtcatcgtgctgctgggcacccgcaatgacctcagtcccacgacagtgatgtccgagggcgcccggaacattgtggcagccatgaaggctcatggtgtggacaaggtcgtggcctgcacctcggctttcctgctctgggaccctaccaaggtgcccccacgactgcaggctgtgactgatgaccacatccggatgcacaaggtgctgcgggaatcaggcctgaacctggatggacgagggccctcaagggtcatctccaaacatgacctgggccatttcatgctgcgctgcctcaccaccgatgagtacgacggacacagcacctacccctcccaccagtaccagtagcactctgtccccatctgggagggtggcattctgggacatgaggagcaaaggaagggggcaataaatgttgagccaagagcttcaaattactctagaaaaa

SEQ ID NO: 16115 - DNA, 434 bp, Homo sapiens
gagccgcgggcggagagtctgaggcgtggcccttcgagccagctccgccccgttgttcctggcttgagtagggcagagagcaccgcccagcagccagtgggttcccgcgcgtgccgagactctgaggccttgcacccccacgatcccgtacgatggccgtcaagaagatcgcgatcttcggcgccactggccagaccgggctcaccaccctggcgcaggcggtgcaagcaggttacgaagtgacagtgctggtgcgggactcctccaggctgccatcagaggggccccggccggcccacgtggtagtgggagatgttctgcaggcagccgatgtggacaagaccgtggctgggcaggacgctgtcatcgtgctgctgggcacccgcaatgacctcagtactgagccccccctctgcccacggccctcccctaca

SEQ ID NO: 16116 - DNA, 166 bp, Homo sapiens
gaccactatgaagaaagcttctgaggacaaaggcagctggggagatcccaagaggagaccaaataaggaaaaatgcagttggctagagaaatcggtgagaatcaagactctatgggttgaaacctggctctacttactggctatataaacttcaagcaacttgttt

SEQ ID NO: 16117 - DNA, 547 bp, Homo sapiens
aagtttatgaggcaatataaagttatttgaaaagggcacatttccatcagctcttatagatctgctgcagtggtgtacaaatgcccctcttatcaatgtggaaattgtgctaactcctggggtctttcttttcctacccattctccctaacaaagcatcactggaacaataactgtcatgataaaagacccactgcatacgtcttggcacaggagttgaagcaccattgtgaaaccatttgtgcctggagtgctttttcttttcttagcactggctcatgacatgcttcagattggtcaaagaaagagattttatcaagtgttcccttctcaagatgtgtgataagtgctagcagagtgtgctggtagcagatctttagagattgaaaaagagaaggggaaatttcagaagtggggggaaaaagctaaaccttattttgaatattgtgggttctagggtctttgtatgtgaatcagtgatgataaatttcacattaggaatgacataaaagtaacaaaatattatattctgttctttgttgtgcatg

SEQ ID NO: 16118 - DNA, 749 bp, Homo sapiens
cataacaattccttttatgttccatgggctagaattgaataatatgggcataatagctgcagaagaaaaggaaaatactgtcttttagttgaatgcattgctactttgaaaaaaactgaagttctgtttctgaggaagcgtgagagaacatgctactagatggcatctagaagtctttgcctaagattaagagctgatgtatactcaccaatgatgtatgaaaatacagttttatagtattattgttttgttattttttagcaaacctacataactgaatttttataaagattttgttttttgccttaactttattttttaaaatatttttaaattttttttcaagatctcatgaggttgcatttccttcactttaatatctaactccagcataagtcagtataagtgactctgtgatgagtcacatctcatttaaaattgagagttaaggctgagagtggtggctcacgcctataatcccagcactttgagaggcagtaggatcacttgagactagaatttcgagaccagcctgggcaacaaaacgagacctcatctcttaaaaaaaaatatatacatatatatatttttatattttagctggttgtggtggcgtgcacctgtagtcccagctgctctggaggctgaggtgggaggatcacttgagctcaggagttcaaggctgcagtgagctaagatcacatcactgcactccagcctgggtgacaccccatgaccttgtcgctctc

SEQ ID NO: 16119 - DNA, 183 bp, Homo sapiens
actactgtgtttagtttatgatccattaaaacaatgtatgtattggaaattgtagactgccaggcaattgttttcattatttattaaatgttgtttccctcacttttcaaatggtagccctttgaaatatgccaggctttccagcagggggtttttttaaaaacctatgaccctcttattcct

SEQ ID NO: 16120 - DNA, 442 bp, Homo sapiens
atttccttagacacttttctaagttagaactctctatgtccctcgtccccttctctcctcgctttccttttcctcgggtgaaatggttcttggcatatttctcacgcatgtctattgcgccttcgcctctgcaaagccaccgctgggttgctgagacccgctctgccaacccggctactggaggggtttccttgaacttgaagaaaggtacatcaaaacccactagtgttaactgccacgtcaagtttgatgctaataatgtgcagattatgacgaaaattgccaatcatgctctctgatggacctcctttgaatgtggaattggagaaaagttccccgcacggagacctgctgtcaagtactaacaacccgctaagggaagtcattaggagagacggataagagactcggtacataaaacattgttcttggtgcatagaat

SEQ ID NO: 16121 - DNA, 451 bp, Homo sapiens
tcatttatctgttcctctatcatctttatttcctgtaaggtgggaattatagcaaaggccttgctcagactcagattaaacatgtttttttgcaaaaatatattgcaaaaaacttttcatacagcatcacataaggagaaacatgtcaggtgatttctcccttgtctaatacagcttttccccttcgcagttaacaaaaagtcaggaggcagtatttgtagttggaatattctattgttactgttggagggtgtccaggttcttggcttcttaagcaaataacttgataaaacacacaaagcaaggaaagaatgaagcaacaaggccgggtgcagtggctcacacctgtaatcctagcattttgggaggccgaggctggtggatcatgaggtcaggagatcaagaccatcctggctaacacgatgaaaccctgtctctactaaaaatagga

SEQ ID NO: 16122 - DNA, 972 bp, Homo sapiens
agattctaaaacaaatccttgcctataaattaccagtgtccccaaagttaccctgttctgaaagtattgagtgtagcttatgtgtataaggacacctcttttttatgcagtgataaggatgtgtgtatgtgtctgtgtgtatacctatgtgtcagtgtgttttaaggctgacatcctgtaatttgacatgctttccttggcaatatggaatcttactaacctgctggagaatcttcttaagtattcttttttctatttttaaaataccagaaaataaggtcaataacaaacatcagcaaaagtcccccaccaaattacattataccacttggtttatgttttagagcacgattttaaaataaggtgggttcctatttttatttttggaagctgaaatggaagctgtcttatgaagacatatgctcaactctatacttactcaaatcttaggaattctaatcttgttttaaagggaagatgttaatgttatggtgccaccagatgctgttgctactaccactggcaaagtttaagggtaaaatagcataaagtttctgtgtggttctggcttatgtaatggtatgtgccaggcagaaaggcttgcttttctaacactcacaaactcatttatatttgtccttggttgctgccaaggcagtttcttaatggggaatactagcagggtacaggggaattttttttccactttctctcttctatctgccactactatcctgccaaaggtctgccatggaaggcaggtatgtgccccaccaggtattgcaaggcagcccagggaacaggaaggaaaagagagatgtagctcgcatgcttcttagtccttctggaagaggaaggctaaggaaggtcatcttcagcactcattttctcatcttcccagggatgttgattagtttcttctacagtaagtctggcaagacctgcctgtgaatacgaggatattctgagtta

SEQ ID NO: 16123 - DNA, 449 bp, Homo sapiens
ttttctcattcccgttgaactaaacctgacagcatttccctcctgcaagtacttctcctgttttcctagtctcccagtgccagacattcccttactctcctgtcgcatggcagtagaggtggctgagaccccacccacaagcttctggggtggacgaggaaacctggttgcagcaccacagctggtgggcagagagctggtgcatgtgcttggtgagagtgtagaacagcaggaaagatttgatattcacacagatattgggaattgactgtatttgcttgattgactcattagtttggataattgtcaaatggcttcaactaggggtgtggatatagaaaagatgaaagataatttcccatactggtggtcttgtgcaggccacatgaccttttctgtgattaagtctcttggtctcctaaaaaggttttttctatgcatatactttc

SEQ ID NO: 16124 - DNA, 379 bp, Homo sapiens
agtgagaatctactttttgaaacaagttgaaaaaaagcatttgtctacaaaagaacatcagatactgcactttttacaaattgaatgtttgtggcaagcctgcatcgagaaagtccattgatgccatttttttcaaacagaaaagtaaagatgtttctggaaggcaccaggagtcctgtctgcactgagcaccatgaagttcacctgcattgagttctttccctttgtacaacacttactcccagaccaaaaaataactccttctctccaatctgtgttccaggcaaaccaatagactccagttgtctcccgaaatgcttaaagtgcttttccaatatccactatgtttgggcaacatattaaaaatatacaacaaaaa

SEQ ID NO: 16125 - DNA, 469 bp, Homo sapiens
attaggcaaattgatagccctacaatggcctctaagtgttcacgtgaaaagaagaatcacagacctctcatttgaaattcatgttgttttcatgcctgctaacacaacatccattctgcagcgcatggatcaagggttaattttgattttcaatgttattatttaaatatatttcataatgctatggctgccatagatagtgattccattaatggatctgaaattgaaggaaaagtaaagatgtttctggaaggcaccaggagtcctgtctgcactgagcaccatgaagttcacctgcattgagttctttccctttgtacaacacttactcccagaccaaaaaataactccttctctccaatctgtgttccaggcaaaccaatagactccagttgtctcccgaaatgcttaaagtgcttttccaatatccactatgtttgggcaacatattaaaaatatacaacaaaaa

SEQ ID NO: 16126 - DNA, 368 bp, Homo sapiens
tcatccctcccagaccccttcttcctcatttcaggtctgggttcaagtctcaacatcttcttcataactcagcagctgctagagggaatttttctaataccatacaattgtctgattgtgttctctgtggctcttgttgatttggatcattttaaggctatccctctcagtcatgcctgggaataaagtatattagattatggaatcatattagtgatattgaacaaattcagccattcagtacacagtggatgaaataatgactccaaactataaaataatttgcatctgctgatggaactagggaatagaaaaatcaggattcaaattcaggccgtttgtctttcatctggtactcttggactagc

SEQ ID NO: 16127 - DNA, 446 bp, Homo sapiens
atttatgaagtattttccatacttctctcatatgactcatgattaccttatgaggtaggttttattactgccatttacatttgaaaatattgaggctcaagaggctgttaattcttcagagccatagctaggatccagtaactgctgtgcacattgctgtcatgttttatgtatccatctatatgtactaactatgttaatggaataataattctatcaaatataatacattatttttatattcacattatttcttggtttgtctaaatattgtcattcattgattctagtacttatggtgtatttacctgtgaaagaaaatgattagagattaacttaaaatgttcaacacagaatgtgcataaatggttgactgtctaattttgccttgtgaaataaaatccagcttcacaaaataaaggccaaaattaccagccctatgacca

SEQ ID NO: 16128 - DNA, 444 bp, Homo sapiens
ccttggcctcccaaagtgctgggattacaggcatgagccgcggagcctggcctagaaaggaaaatttaagtaagataccagcttcagaataggagctagggtctagagaaatggagcacattgtaactggctgacaacagtggcccaggaaaaccacagtaacttaatttgaaacttaatttgcttcccttgttttaatgactttttaatatttaaagatgttttctaaacctctaatcctcaaaacaaaaattggaagtaaactgattttcattcagtgaactgccatttagaagtgataggggtttacatactttgtaccattagttaacgcctaagctaaaagtataatatccagtttccctatgatctcaagtttatggaaagtagcctttcttttggcagtgtaaacaagcagttacattaaatacgtaaagataatgc

SEQ ID NO: 16129 - DNA, 320 bp, Homo sapiens
tttagctaatccctttcccacatttaacacctgaaatgtggactaattaaaatacccgtcatttttgaaatgggaaagtgtattgtgaatcacctcgataggcaggatccatgattgctgtatgtgcacagtagggattcatcattcccaaagaactgggcttcattagtgggacatggtggggcttctctgatggagcacaaatttagaaagcattgtagaatgcatattcttgctgtgaagtgctggtgacattcctcatttaggtgatcccagacaggacagtggagttttacttgttttaactgactgctgtctaa

SEQ ID NO: 16130 - DNA, 319 bp, Homo sapiens
ggctgtggccccacttctgtggtgcgggagctgcacggcccagcccaagcctataggaaacagcaggggcaactccacctccccgctacactccctgcctcctcctgcacccctggccgccagatgcagcctctccctccctccctcacacaccaagagcgcggcctcagactccccaggagccgggcaactttcgaaactttagttcctggaacctgggagccctgggcctgtgcacgttctcaaggggctacggggggaggcgacaggccctggccagagtcacctccgccccagactccccacggctccgtcttgc

SEQ ID NO: 16131 - DNA, 299 bp, Homo sapiens
gtctacaagaacaaacaactcggtttctgcaacaaataaattgcaaggaaaaaaaaaaaggtgagaacaccctagattaaaataaactttgcagtacagcctgggcaacacggcaagaccctatctctacaaaaaatagaaaaaattagccaggcttctggtgcatgtctgtagtcccaactacttgggaggctgaggttggaggattgtttgagcctggagttcaaggttgcagtgagctgtgattgtgccactgcactccagcctgggcaatagagagagactctgtctcaaaagga

SEQ ID NO: 16132 - DNA, 818 bp, Homo sapiens
  misc_feature (19)..(19): n is a, c, g, or t
atccttaattaaattaatntctccccccccccccgtgtaaagggtcttctgagctgcagtggcaattagaccagaagatccccgctcctgtctctaaagaggggaaagggcaaggatggtggaggctttctgtgctacctggaagctgaccaacagtcagaactttgatgagtacatgaaggctctaggcgtgggctttgccactaggcaggtgggaaatgtgaccaaaccaacggtaattatcagtcaagaaggagacaaagtggtcatcaggactctcagcacattcaagaacacggagattagtttccagctgggagaagagtttgatgaaaccactgcagatgatagaaactgtaagtctgttgttagcctggatggagacaaacttgttcacatacagaaatgggatggcaaagaaacaaattttgtaagagaaattaaggatggcaaaatggttatgacccttacttttggtgatgtggttgctgttcgccactatgagaaggcataaaaatgttcctggtcggggcttggaagagctcttcagtttttctgtttcctcaagtctcagtgctatcctattacaacatggctgatcattaattagaaggttatccttggtgtggaggtggaaaatggtgatttaaaaacttgttactccaagcaacttgcccaattttaatctgaaaatttatcatgttttataatttgaattaaagttttgtccccccccccttttttttataaacaagtgaatacattttataatttcttttggaatgtaaatcaaatttgaataaaaatcttacacgtga

SEQ ID NO: 16133 - DNA, 574 bp, Homo sapiens
aattaactgatcatgatttattcaattatacaactctttcaaaaatcacatcgtcttccgtatcagaaatctgaattgtatttattgctatgttctgcattttgttgttggtctcagtctgttgttagcctggatggagacaaacttgttcacatacagaaatgggatggcaaagaaacaaattttgtaagagaaattaaggatggcaaaatggttatgacccttacttttggtgatgtggttgctgttcgccactatgagaaggcataaaaatgttcctggtcggggcttggaagagctcttcagtttttctgtttcctcaagtctcagtgctatcctattacaacatggctgatcattaattagaaggttatccttggtgtggaggtggaaaatggtgatttaaaaacttgttactccaagcaacttgcccaattttaatctgaaaatttatcatgttttataatttgaattaaagttttgtccccccccccttttttttataaacaagtgaatacattttataatttcttttggaatgtaaatcaaatttgaataaaaatcttacacgtga

SEQ ID NO: 16134 - DNA, 386 bp, Homo sapiens
aaaacataactatctcatataagaaaaaaaaacccttacttttggtgatgtggttgctgttcgccactatgagaaggcataaaaatgttcctggtcggggcttggaagagctcttcagtttttctgtttcctcaagtctcagtgctatcctattacaacatggctgatcattaattagaaggttatccttggtgtggaggtggaaaatggtgatttaaaaacttgttactccaagcaacttgcccaattttaatctgaaaatttatcatgttttataatttgaattaaagttttgtccccccccccttttttttataaacaagtgaatacattttataatttcttttggaatgtaaatcaaatttgaataaaaatcttacacgtga

SEQ ID NO: 16135 - DNA, 1001 bp, Homo sapiens
  misc_feature (19)..(19): n is a, c, g, or t
atccttaattaaattaatntctccccccccccccctttctcaggcataagggctgtagtgtgaggattgggaggaactcgacctactccgctaacccagtggcctgagccaatcacaaagaggattggagcctcactcgagcgctccttcccttctcctctctctgtgacagcctcttggaaagagggacactggaggggtgtgtttgcaatttaaatcactggatttttgcccaccctctttccaaataagaaggcaggagctgcttgctgaggtgtaaagggtcttctgagctgcagtggcaattagaccagaagatccccgctcctgtctctaaagaggggaaagggcaaggatggtggaggctttctgtgctacctggaagctgaccaacagtcagaactttgatgagtacatgaaggctctaggcgtgggctttgccactaggcaggtgggaaatgtgaccaaaccaacggtaattatcagtcaagaaggagacaaagtggtcatcaggactctcagcacattcaagaacacggagattagtttccagctgggagaagagtttgatgaaaccactgcagatgatagaaactgtaagtctgttgttagcctggatggagacaaacttgttcacatacagaaatgggatggcaaagaaacaaattttgtaagagaaattaaggatggcaaaatggttatgacccttacttttggtgatgtggttgctgttcgccactatgagaaggcataaaaatgttcctggtcggggcttggaagagctcttcagtttttctgtttcctcaagtctcagtgctatcctattacaacatggctgatcattaattagaaggttatccttggtgtggaggtggaaaatggtgatttaaaaacttgttactccaagcaacttgcccaattttaatctgataaacaagtgaatacattttataatttcttttggaatgtaaatcaaatttgaataaaaatcttacacgtga

SEQ ID NO: 16136 - DNA, 1058 bp, Homo sapiens
  misc_feature (19)..(19): n is a, c, g, or t
atccttaattaaattaatntctccccccccccccctttctcaggcataagggctgtagtgtgaggattgggaggaactcgacctactccgctaacccagtggcctgagccaatcacaaagaggattggagcctcactcgagcgctccttcccttctcctctctctgtgacagcctcttggaaagagggacactggaggggtgtgtttgcaatttaaatcactggatttttgcccaccctctttccaaataagaaggcaggagctgcttgctgaggtgtaaagggtcttctgagctgcagtggcaattagaccagaagatccccgctcctgtctctaaagaggggaaagggcaaggatggtggaggctttctgtgctacctggaagctgaccaacagtcagaactttgatgagtacatgaaggctctaggcgtgggctttgccactaggcaggtgggaaatgtgaccaaaccaacggtaattatcagtcaagaaggagacaaagtggtcatcaggactctcagcacattcaagaacacggagattagtttccagctgggagaagagtttgatgaaaccactgcagatgatagaaactgtaagtctgttgttagcctggatggagacaaacttgttcacatacagaaatgggatggcaaagaaacaaattttgtaagagaaattaaggatggcaaaatggttatgacccttacttttggtgatgtggttgctgttcgccactatgagaaggcataaaaatgttcctggtcggggcttggaagagctcttcagtttttctgtttcctcaagtctcagtgctatcctattacaacatggctgatcattaattagaaggttatccttggtgtggaggtggaaaatggtgatttaaaaacttgttactccaagcaacttgcccaattttaatctgaaaatttatcatgttttataatttgaattaaagttttgtccccccccccttttttttataaacaagtgaatacattttataatttcttttggaatgtaaatcaaatttgaataaaaatcttacacgtga

SEQ ID NO: 16137 - DNA, 2401 bp, Homo sapiens
  misc_feature (19)..(19): n is a, c, g, or t
  misc_feature (1317)..(1317): n is a, c, g, or t
  misc_feature (2393)..(2393): n is a, c, g, or t
atccttaattaaattaatntctccccccccccccctttctcaggcataagggctgtagtgtgaggattgggaggaactcgacctactccgctaacccagtggcctgagccaatcacaaagaggattggagcctcactcgagcgctccttcccttctcctctctctgtgacagcctcttggaaagagggacactggaggggtgtgtttgcaatttaaatcactggatttttgcccaccctctttccaaataagaaggcaggagctgcttgctgaggtgtaaagggtcttctgagctgcagtggcaattagaccagaagatccccgctcctgtctctaaagaggggaaagggcaaggatggtggaggctttctgtgctacctggaagctgaccaacagtcagaactttgatgagtacatgaaggctctaggcgtgggctttgccactaggcaggtgggaaatgtgaccaaaccaacggtaattatcagtcaagaaggagacaaagtggtcatcaggactctcagcacattcaagaacacggagattagtttccagctgggagaagagtttgatgaaaccactgcagatgatagaaactgtaagtctgttgttagcctggatggagacaaacttgttcacatacagaaatgggatggcaaagaaacaaattttgtaagagaaattaaggatggcaaaatggttatggtaagtaatgacaattctccattcttccttgtttttttctcctctccgcacacctctcacctccttccttcttcttccctcctccttccattcttcctccttccttccttctttaataatacatcactggcaaggttctttaactatatgtaaaacaggggaaacaaaaagatcccagttaattttcttcttcagctcaacttctttgattgtagaaaaagagaaaaattcatgtgtagttaaaaaaataaaagttgccattgatttgcctaaaactgtgtcaaaagattttttgtaggataactatggatgtctctcaaataaaatttaatataaagcccataatcactgaaatatataaagataattgctattataagagaatctcagacagatgactttatagctcctgtaataagagatctttaaacagtttatattttaatttataaagttacacaagttctgggcagataatttagaatataacagaaaagtataacaaaaaaattaaaatcccctctgatttctcatcagtgataacccttttttttttttttttttgagataaagtcttgctgtgtcacccagactggagtgcagggggtgcattnttggctcactgcaacctctgcttcatgggctcaagcgattctacaacctcagcctcctaagtagctgggaccacaggtgcaagccaccaacgccgggctaatttttttgtatttttgtagagatgggatttcgccatgttgcccaggctggcctacagctcttgagctcaaagtgatgctcccgcctgctgcctcggcctcccagagtgctgggattacaggcctgagccaaggctcccagcccccaaagagaaccattttgatgttacttctttccagtttttttctcgaatgcataatatgccttttaaacatatatattcaatactaggtagacatgaaaaatatttttttcaatcagcctcttcttacttactaggaattatctgtaaaagaggatttattagtgtcctaaggctgccacaacaaagtaccacaaacttggtggcttaaaacaacagaaatgaattttctcagttctgaaagctggacgcctgagatcaaggcgaccctagtgttgccatccttctgcgggccccctcccttgcttcttcctacttcccggatggctcctggcaatcattgaggttgttgggcttacagttgttattactctgatccatttctgactccatctttacaagactttttcctctgtttttgtcctaaattgatcaaatataaaataattaacaaataatttatctaatgatggagtagtatcacaaactaggagaaatattatgccttcaccaagccttcctcagacactttttgtgtgacctgcaatggtatattgatgatactgacataggtgggtaggctcattcaattttggaggagggtgtgagaatgctttacatagtccttgtacgatgacagcagagaaagttttgttgtttaagaatggggactcatgtttccttctccccttgactactgcaatcagcactgttctgcattgagatattcatgtttctgtggagatggaggtggggagcagagggacagttttcctttcatgttaaaggatatttgctcacatttttttggcaacaatcaataaaagaaaggantcatttct

SEQ ID NO: 16138 - DNA, 824 bp, Homo sapiens
tgccaaattccaaaattgtgtatagttctatagttgtctggtggagtcaatggaactttagttaccagtctaagaatgtgtctttgagattgtccagttaattctctatttccagtagctgtaataaatggtgaaaaggtttctgactcctggagaaagtttctaactccttatgactaatattcataacagacttgtgagttccttgaacatggatacacctatatgcaagagtgtattccaaagctaactcagtgatctttccatttatctattcttggattagtggtgcctttgctctttccttctgtaaatgtgaatagttaagagttgactgcagaagtgtttacactttggcttccatgcctctggaatgtttgtgctttggtggtgagatgtgagactatatttgtatagtctgcatctctcaggctgccccagaatgttgtacagtgcagtgctgaagaaagcagcaggtacacacagaaatgcagcctttcctggttaaccctgcttggatctgagttacactttgtttcctgacttcttgggacttaggtaatcagtttgccttctactctatctcattttgtactcgcttacatactacattcttgtttgggctttcgtttcttcttgtaagcagagattttttaaaatccaatatgtgaaaatacggatgcactacaattaaataaataaaatgctgttgtgtttgttttgctttaaaattgtaaaggataaacaataagatagttttatctatgtggttttcccgatgcagttaaaataaaacctaatctgctaaaattgaatttacactc

SEQ ID NO: 16139 - DNA, 310 bp, Homo sapiens
atgaggatacatctctgtgatttaaggatagtaccatgtataaaatagacactgaatttaaatgaaaaaatacagaagataataagaatgcagtttatgttagcatgtgtgccaaaattcttgtcctgccttggctacagccacattcaagccctagctttcacatgaaagagacaaacagacatataaaaataaataataaaaataaattttgagaaaataataagagaaataatcatgaacagaaataataaaggaagtaatcattaaagcaaaagtgctatcagaattgagtagaaaaaaatagact

SEQ ID NO: 16140 - DNA, 359 bp, Homo sapiens
gtggcactatcatctggctcccagtccatgaaaccaaagtccagaagcagtttttcctaacctgggacctgccaaaaaacacacctatatgtgcccctgtaggcatgctggctgactttattcccactgtgaatcttgaagcagtcctaaaacccagctccagtcccaaaacctacctccagtccctgtcaactaaagtctgggagcagtcctgcccacccaggaatctggagggagaaatgccgtgaacccagaaacaaacctgaagactttggtctcagctgtgtatcctgaagcagccctatgaatcagttccacacccccattcccccactccagataaagcttcagttatatct

SEQ ID NO: 16141 - DNA, 532 bp, Homo sapiens
atttaacaaatgaagctaaaggagctgaagatgcaccagatgctgatacagccattatcaatgctgaaggcagccaagtcaatgctgaagagaaaaaagagtatttcatttaagatgcaggccaagattctgagttttactaccaggctgaatgctggagaaaactggctatcatctttcagaagtcatttctaccatcgtctgctacccttattaactcccatactgtactgctatcagtagccagtgtataccaacaatcagctgttgaaagcatcattctttaattactgtaccatccataatgcaggacatttcttactgcctaaatttcacaccattgctcttttaacatacagtgcttgaatatacagccttaacaatgttaatcatctccttggatcattatattgagtggtttttatacattaaaaaatgtatgcagagtttttttcccccattttttcccctttaagtcatagaccttatcagtttgccattggacagctttcacaagtaacaggattaggga

SEQ ID NO: 16142 - DNA, 235 bp, Homo sapiens
aaaatttatgtcaaatcaggacacttcttacaaatcccttcaatagtgtcttgctcagagccaaaatctgttatcacagttttcaagtcccgcagtcggctgcatcccctccccaactcactgggtttcaaacactctggctttcttgctgttatctgaatgctgccaaagatactcttaccttagggccttcatacttactactacttttaccaagaatgctttcttttataga

SEQ ID NO: 16143 - DNA, 157 bp, Homo sapiens
ggaaattcttagccattacttttttgactagtgtttttttttctattctttaaaaaaatttattttgaaattatttaaacttatggaaaagtttaaagcatatatatatagaatggagtattatatatataatatatatattatatatatatataaa

SEQ ID NO: 16144 - DNA, 123 bp, Homo sapiens
gtgagcttgggtaagtggctcagcctctctgagcttcagcttcttcatctgcacaagggaacaatagtaccggcccccaggtctcttcacagcagcattaaataaaaatggtacactcacccc

SEQ ID NO: 16145 - DNA, 173 bp, Homo sapiens
cattctcaaatgtaggaaatgaggacagcttcctctctccaatttacaacactatcaactatttgtcctttattgtacatttcaaacacagtgttttaattgttaatcatgtttttacacagcagtgaatggcaggtttttaaagatttgttttctgtctgtaaacattttct

SEQ ID NO: 16146 - DNA, 504 bp, Homo sapiens
gcggccgcagtgctcgggcgcgacaagccatgagcagcgaccccgcgggcgacgccgccgtccctggcagccgctgagcccgacccccaggcagctcgccgctccctagcaccttctccagtcgacactctcgcgcccggagaaacatgattcccgtgacagaattccggcagttctctgagcagcagcctgccttccgagtgctgaagccatggtgggatgtgtttaccgattacctctcagtagccatgctcatgatcggcgtgtttggatgtactttacaggcagtttctctgaagctaagtggttttattttgttttaacctcagccctttggtgtctcattcatgcaaatgtggtaccttttcaactagttatcacaggctgctgttacaaagatatggcaaaaacactgtttaaccttttgaagaagaagaagaagatgacgaagaagaagacaaagaagaagaagctgcctgccttattttttttcttatttttctc

SEQ ID NO: 16147 - DNA, 2737 bp, Homo sapiens
gcggccgcagtgctcgggcgcgacaagccatgagcagcgaccccgcgggcgacgccgccgtccctggcagccgctgagcccgacccccaggcagctcgccgctccctagcaccttctccagtcgacactctcgcgcccggagaaacatgattcccgtgacagaattccggcagttctctgagcagcagcctgccttccgagtgctgaagccatggtgggatgtgtttaccgattacctctcagtagccatgctcatgatcggcgtgtttggatgtactttacaggtcatgcaagacaagataatctgccttccgaaaagagtgcagcctgctcagaaccactcttccctttcgaatgtctctcaagcagttgccagtaccactccactgcctccacctaaaccatctcctgctaaccccatcactgtggaaatgaaaggcctgaagacagatttggaccttcagcagtacagctttataaatcagatgtgttatgagcgagccctccactggtatgccaagtatttcccttaccttgtcctcatccataccctggtctttatgctctgcagtaacttttggttcaaattccctggttccagctccaaaatagaacatttcatctccattctggggaagtgttttgactctccttggaccacacgggctttatctgaagtgtctggggaggactcagaagaaaaggacaacaggaagaacaacatgaacaggtccaacaccatccaatctggtccagaaggcagcctggtcaactctcagtctttaaagtccattcctgagaagtttgtagttgataaatccactgcaggggctctggataaaaaggaaggtgagcaggctaaggccttatttgagaaggtgaagaagttcaggctgcatgtggaagaaggtgatattctatatgccatgtatgttcgccagactgtacttaaagttatcaaattcctaatcatcattgcatataatagtgctctggtttccaaggtccagtttacagtggactgtaatgtggacattcaggacatgactggatataaaaacttttcttgcaatcataccatggcacacttgttctcaaaactgtccttttgctatctgtgctttgttagtatctatggattgacgtgcctttataccttatactggctgttctaccgttctctacgggaatattcctttgagtatgtccgtcaggagactggaattgatgatattccagatgtgaaaaatgactttgcttttatgcttcatatgatagatcagtatgaccctctctattccaagagatttgcagtgttcctgtctgaagtcagtgaaaacaaattaaagcagctgaacttaaataacgaatggactcctgataaactgaggcagaagctacagacaaatgcccataatcgactggaattgcctcttatcatgctctctggccttccagacactgtttttgaaatcacagagttgcaatctctaaaacttgaaatcattaagaacgtaatgataccagccaccattgcacagctagacaatcttcaagagctctctctgcaccagtgttctgtcaaaatccacagtgcggcgctctctttcctgaaggaaaacctcaaggtcttgagcgtcaagtttgatgacatgagggaactccccccctggatgtatgggctccgaaatctggaagagctgtacctagttggctctctaagtcatgatatttccagaaatgtcacccttgagtctctgcgggatctcaaaagccttaaaattctctctatcaaaagcaacgtttccaaaatccctcaggcagtggttgatgtttccagccatctccagaagatgtgcatacataatgatggcaccaagctggtgatgctcaacaacttaaagaagatgaccaatctgacagagctggagctggtccactgtgacctggagcgtattcctcatgctgtgttcagcctactcagcctccaggaattggacctgaaggaaaacaatctgaaatctatagaagaaatcgttagctttcagcacttaagaaagttgacagtgctaaaactgtggcataacagcatcacctacatcccagagcatataaagaaactcaccagcctggaacgcctgtcctttagtcacaataaaatagaggtgctgccttcccacctcttcctatgcaacaagatccgatacttggacttatcgtacaatgacattcgatttatcccccctgaaattggagttctacaaagtttacagtatttttccatcacatgtaacaaagtggaaagccttccagatgaactctacttctgcaagaaacttaaaactctgaagattggaaaaaacagcctatctgtactttcaccgaaaattggaaatttgctatttctttcctacttagatgtaaaaggtaatcactttgaaatcctccctcctgaactgggtgactgtcgggctctgaagcgagctggtttagttgtagaagatgctctgtttgaaactctgccttctgacgtccgggagcaaatgaaaacagaataacttatttttcgttaaagtttgactgaaacacgcttctaccaaatacagtataaataattaggtagtcttaatgcctttcctatttttttttccttttcacacaaaatgtacacaaagatcgcgtaaggagtatgtatttttaataaaaatttaattgtattttttcaatattaaaattt

SEQ ID NO: 16148 - DNA, 456 bp, Homo sapiens
gtctctttctcaatagttccaacaagatctgtaggccaaagttcactgaaccattttgaaacaggtaaccatccctagaccagtcacttagccaaaggaatgtagcatgctttagccaggccaaggaacatgcgcacccttggagctcagatatatatgttgaggggaagaggaagtagtatcagctcccgcttgaattccatggattgagagttgggggatgaggagtttgccaaaacaacagtgctaggattaaaagaagtagaagcagatgctggggaagcaaaatcttccagaagacctaagatacatggggcctgggtcagcctggcaacatgaggtctccaggccaatgtagcaggccctggaggtgggaggagagacacgtaatttctaagcagctcttcaggttacagttcttgctttgtctgcctgtcattaagtggattaccacaa

SEQ ID NO: 16149 - DNA, 319 bp, Homo sapiens
acacggctgtgcagaagtgcgatcttaggacacttagcttgagcagtttccagggatgggcacttagccccatcactggacactggcacaagataggcttagattatgtggttcccttcttcactgtacctcagttgctgtaactagattgtccacactacacctttttttttcttttgagaccaagtttcgctcttattgcccaaactggagtgccatgatgcgatcttgactcactgcaacctctgcctcccgggttcaagtgattctcctgcctcagcgtcctaagtaactgggattacaagggcacgccaccatg

SEQ ID NO: 16150 - DNA, 476 bp, Homo sapiens
gtacttttttattctggtaacaatatgcagtttctgaggattctgtggatctccgtcatatttttcatgatctgcaagtgaaggctgaaacgctttatatggaattcttgacctggtaaatttgtgatgaatccaatctatgtaaacgagagacttcacaccttttgtcccagtctgtagttcattttgcctcttgagctactgacagcaaagtccctgccataagtgtggtggctgttctctttagagagagcgcctgctaaatattcagcatgaaccttcccaccagcagaagctgaggactcactgcttccattattacttacagatcacctttttgtatctgaaaaattttaccttaagtaattctctcttcctttcttccttttatttccctgaatggagtagggattagagaatggctagaaggggcagaggcttggagcttaataccttatggtgttttagcccattag

SEQ ID NO: 16151 - DNA, 459 bp, Homo sapiens
aactgcctaagcccagccagcccttctttgaaaagccctgtggaactaggtcatcaggttgttggatggttcttacacagactgtgctgtgctgcaacttttaatgtgcactgtctatggaataccaaacttgtttccaaactaaatagtttccaatgaggatttaatgggagtttttcatttgaaatggattgaaaacaagccatttcctactcccatttcaagcaaattttggtccaattattttcctttttttaacataaagttaaatggactattctgcccatccctgactgagctgaaccgtgatttctcttgattatgcttttacactgcgaatcgcgaggctccagagacataatgggcgtctgtgggagagtggcagcaatttttaaaatcctgccagtgcttgtcagcttccactctggtgtctgctgtgcgggaagaaagcaccctacc

SEQ ID NO: 16152 - DNA, 519 bp, Homo sapiens
gatagatctggtggcttttccccaatagtcaccatgtggaaactatgcaactaaattcaatggaaatgaaagatacaatataaaatagcgggtcatggccataagctgtgtcctgaactaaccaactccaagctgaaggagggtgtgtactttccgaaacttcgaggccatcttagtaattattttagcaataattactaaaatgtacatggggtgggggagctcagctaaaatatccttactttggtgcaataatgatctaggttctttttcctaggcctaggcctccaccttgaaagacaggaacagaagttcactgtgatgtgtgaccctggacagagatcaaacagctcctttctagacccagatgacccagaacgcagaagcctagtagttggtatcaccagtgtctcttcaaaagggccccacaaaaggctgtccattaatttgtttcatacagtaagcgagcttttactgaatactccctctgttaggtagcatgcagagtgctagggctgg

SEQ ID NO: 16153 - DNA, 249 bp, Homo sapiens
tccacttaaggctcctgtattttcaagaaacagtgctcgggtttccactgttagggcggcggtttgaatttcttagtaatttcttgaatatcagtcagtgtcaaggtatttttaaagaaacacggatctatcagaacctttttggagatttatttaaaatatttccatttgtctagaaaaggggaacaactttagactccttgcccatgttcacttgttgaattaaaccttgtggggttttacaggcaa

SEQ ID NO: 16154 - DNA, 977 bp, Homo sapiens
atcttcacacatcctgtttcacctatgtggaatagtttctctctttactcttccctttactaaatcctattctctttttgaaggtgccagcttaaatatctgttcctcagaaaagtctcttttgatttttcaagcaatattaggtcttattttcatatactttatgctttttctttatagcttttatcagaattatggttaaatagttaacttacgtagttgtctctcctagactgtaatttccatgaaagcagggtcttgtttattgctgcattcctgaacctagtacagtatctggcctataagaggtacatagtcaatgtttgttcatttacacatttaaccgataggcaatgttttgagtgttagggatttaacagtgaaccaacaaaaaaatgaatgaacacatagagttaggttttatggctcagtaaagtggtagttaaggccaatatcttcttattgaaagagataatgctgtataatacattattaccatatttactttaaaattcattagtacatttcttaatcagagaaaagaaatataatagcttcatatctaactcatactatcaagcttacaaaaaacttctgaaattttaaagtgtttataacacataatgctaaatttagtagattgctgagatctttatccgattttgccttatcattacatgttagcagcttaatgtatatcattactaaggaacaaaaattatatttatttatttaaaacatttattttttgcagggaatgagttaaatttgatttctgtataaagtaggaacaatacttagattgtgtccagctttgaaattttcttataagatgtaactaacatgtttaagtgaccctacataaacaagtactgtagttgttgtctactggcctaaacaggatttataagacttctgtaggaaagaagacgagcgtagaaaatcggttagatgatagttctactcctggagggaga

SEQ ID NO: 16155 - DNA, 482 bp, Homo sapiens
ttaggaaacctacaatgattctagattcctttgcaggctcctacaatcacaccctatcaaagctagaatgactttaggagattgtggccaacattctacttttccacagagaaggaatgtttgcccaagtggcagggcctgaaaatagaagccagagagtttgacccagagctgaggactatttcaatcatatccctctgtatgcttcactaaagatggggcagaagctacttttgactgctttttttctaatgcatgaccttttatttgagtatgctaaaaattaatctgccagtttttgcttactcacatggcataatgggtgctttcaataatttctcactaccaccttgacatgagcaagttacttaatctctctaacctttgtttctctctctgtaaagtgggaatgataatacgaacctacccttaaaaagtgtgttgtaagaaataaatgagatgacttgtttatcatgatcata

SEQ ID NO: 16156 - DNA, 744 bp, Homo sapiens
cgcccctatgggcaaggaccaatggtctctctctgggcggggctgctgttggacggcctgggccaatccgaggcgccggaggccaatcagttggcggagcggcgcgtgcgcgggcgaggaactgcccgggcgcggtagcgtacgggaagaccggagaggagctgcgtctctgccccgtgggagccggcggggcggcggggcggcggctgcagctgcagctccggcgcgagggctcccttgccgggccctcttccccgacccctggggcgctccgacaaggaagagccgtccagcgcgcgtccgtcctgagcgtgggcctagaaccaattacagagtcaaacccaagagccgaagaaagtgaagactcgcagcttgccgcagccccctcctcggcctgcgcacctcccattgagggcgtcctgatttaaacgcgtgcctcctgcatttctgcttctgccccaggctagagcggcgaccaggaacgctggacccacagagatctgtggcaatgtctgtcgaaccatggtgttctttggggcatctgactagagtattgtttgataaccagaaagaaatcaaaaattggtgatcacaaggctaatgtcacttttgctgcagtggaaaatcatgatcattctgtttaaatctgagtcagttttgagacctagagcccattaattgacaaggaggcttggttcctctcaggaaggatcttacaataccagcatctgagcatataccaag

SEQ ID NO: 16157 - DNA, 1533 bp, Homo sapiens
cgcccctatgggcaaggaccaatggtctctctctgggcggggctgctgttggacggcctgggccaatccgaggcgccggaggccaatcagttggcggagcggcgcgtgcgcgggcgaggaactgcccgggcgcggtagcgtacgggaagaccggagaggagctgcgtctctgccccgtgggagccggcggggcggcggggcggcggctgcagctgcagctccggcgcgagggctcccttgccgggccctcttccccgacccctggggcgctccgacaaggaagagccgtccagcgcgcgtccgtcctgagcgtggggtcccaggccagcatcactatccaggagcttcaggcatgctccgtgtaccaacatgggatcacgaatcacatcgcctcaggccaagaaagccattttatagcgaaagagccttaggatctgctggattagagcctgtttcccaggtaggaacgcttccacgagggcactcctgctggttgcaggaaggatacctctgctgagcctgaatctgcaaagaccaccaggttactctcagctcctcatactggtggaccagcaggccacaaaggaggggatacttgatcctgataaacggttatgcttgtttgctgatggaaatgatccagaagagaaggacaagttgacgattgagagggttaatgtcaggtaagaaacttgagtggacattgaggaaagagcgaggttcagtggactggaggtttgtggtggtttcatgacacgtggactggagatttgcagtggttttatgacacatggactggaggtttgtggtggtttcatgacacatggactgcagatttgcagtggttttatgacacagctcctaagttctttgacactcttcccatggaggggtagggtctgtgacccccctcttgaagctgggtaggcttgcaactgctttggccaatagtcacagcagcagtgatgctgtaggacttacaaggttagaccagaaaagggcatgccctccaaggatccttactctgatgggaaccagccatcatgtagaaactctacccttggctgggtgcggtggctcacgcctgtagtcctagcattttgggaggccgaggttgggcggatcacctgaggtcaggagttcccagaccagcctggcccaacatggcgaagacccgcctccttactaaaaataccaaaaaaaaatgagctgggcgtgcttggcaggcacctataatcccagctactcgggaggctgaggtaggagaatcacttgaacccaggaggtggaggttgcagtgagccaagatcacaccactgcactccaacctgggtgacagagcgagactcttgtctccaaaaaaaaaaagaaaagaaaagaaactaccctgagaccacgatgcaggagagcccagtggatatgctggtgacagccgcagcagagcccccagctcacactcagcatccactgccaaccttctgaatgaaccatctcagacctcgagccaggcttacctccaactgcaaccaaacc

SEQ ID NO: 16158 - DNA, 833 bp, Homo sapiens
cgcccctatgggcaaggaccaatggtctctctctgggcggggctgctgttggacggcctgggccaatccgaggcgccggaggccaatcagttggcggagcggcgcgtgcgcgggcgaggaactgcccgggcgcggtagcgtacgggaagaccggagaggagctgcgtctctgccccgtgggagccggcggggcggcggggcggcggctgcagctgcagctccggcgcgagggctcccttgccgggccctcttccccgacccctggggcgctccgacaaggaagagccgtccagcgcgcgtccgtcctgagcgtgggcctagaaccaattacagagtcaaacccaagagccgaagaaagtgaagactcgcagcttgccgcagccccctcctcggcctgcgcacctcccattgagggcgtcctgatttaaacgcgtgcctcctgcatttctgcttctgccccaggctagagcggcgaccaggaacgctggacccacagagatctgtggcaatgtctgtcgaaccatggtgttctttggggcatctgactagagtattgtttgataaccagaaagccctttaacgacaatgttcatgctaagaacaaccaatcaggcccttaaggccaaaatgctctttcttggggccccacactaggataaacatccatttcagaattccttactttgaattaagaccctgagccggcttgaccatatcgtcttcaaatgttctggcaaataccgccaagatttctaaacctcggcaaggaaaacctggctttcacccttaatgactggttcaaaaaaccctcgcgtaacatgcggaaaatatca

SEQ ID NO: 16159 - DNA, 596 bp, Homo sapiens
aaccatttgcattctaacagtctttggcaccagggaaaactgtcaactgtgtcacgtgtaaatagaaatctgctccccgcttttggtgcgttttttcataatttcccttgccactctaattatcaaagatatttttattttaaacaaaaattgtctcccacgcaggcctcatctttctgcggtgaagtggaaacgatgaattagaatattctaatcacttctccaacaaccactatggaggttataaacacaagattatcctagcaaagaaaagtaaattgtttgggcacagaacaggccaggaaaaaattcagtaggccgggcccggtgctcacacatgtaatcctacactttgggaggctgaggagggttgatcacctgaggtcaggagttcaagaccagcctggccaacatggtgaaaccccgtctctactaaaaatacaaaaattagccgggcatggtgatggatgcctgtaatcccagctactcaggaggctgaggcaggaggatcgcttgaacccagaaggtgaaggttgcagtgagctgagatcgcgccattgcactccagcctgggcaacagagtgagactctgtctc

SEQ ID NO: 16160 - DNA, 310 bp, Homo sapiens
gtaatgatgcaacacaggatcatcgtgtgatcagatggaaattggcatctgattttaccccagatctgaagctgttactgcattgtgtcattttatcaacaaagacttctgccacaatatttacttttaaaagaatttgtccctttcaatagcatcttccctatcaagagttcaaggcactttgcagaagagcttcagatttctaactctagttcccacagtcacccgttgaggctggtgtcatacaatctatgaacaacaaccttgcagcaggactgccaccattcagcagtgcagacagcacagctca

SEQ ID NO: 16161 - DNA, 568 bp, Homo sapiens
ctggtagcaataaaaaggcaaatgatgagcaggctttcaacaaacagccctttattggtgccaatgctaccctggactaactccaccctaaatcgttgtggcatacaactatagaaactcaaaaaggtttgaataataacaggaactccaaagtaacaaaacagctagtgtaccccaatgtcctctggcattactatcctgtgaggacaaattaggtcactttaatgcctgcttacactgaactcatctgatcaggaggacctcaacccccaacaagtgtttctgggatgctataaacagggtggttcttcaatgctactctccaagcaagttcaactcagttcttcctgtgctacttgagtgtcccattatccatgtcctctacttgaggcagcctcaccacagccctttctgatagtatacatcaaactgctaacgtatatgcttaaggtgctacctttcactgatcccaaggctgccagttttccagatgtttaagtggccttggattctctgcaaaggttgaaaaaatgcttagctctcttgggccctttcccttaaaaaaaaa

SEQ ID NO: 16162 - DNA, 153 bp, Homo sapiens
ccattcacattgtttcagtgaactcataatgctctggaaggtgaaaaattaggacagctgacatcaactataagtttctgatcttcttaaacttatctattattttttcctcatcttgtataacgtcccttctctatttaaaaaggctttaat

SEQ ID NO: 16163 - DNA, 473 bp, Homo sapiens
gggctgtgagcacgcgtgtccgagtctgcatgcggaacgtgggctgtgagcacgcgtgtctgagtctgcgtgcggacgtgggctgtgagcacgcgtgtccgagtctgcgtgcggacgtgggctgtgatgtctattgctgcacacctgggggtggaaccactgtgtcccgtggcgactgtgtgttgaacgtcggaggaaccgccagcctgttttccgtggcggctgtggccacttgacctttgcacaagttgtgtgtttggattcgcatctccacctccctacccttgttactgtctctttgatcacagccatcccggtgggtctgattttctttgtacaatgcgagccccccctcaatgaatttttgcttaaaaaaaagcaatttgttgtttttaattgaaatgaaaggaagcattctttcctatgcatgtgttttttttaaagcaaacaaaattaaaatcataagtaagtaa

SEQ ID NO: 16164 - DNA, 329 bp, Homo sapiens
tggtcgaatgaatgaattcagtctgtatcctcaacacccaatgccgcgcctggcaccataggcgttcacatgcagccgtgccgaaagactgagtgaatgctggactgaatgaatgactgcctgtaaaatatctacaggaaagccctgcaggaaatgccctccataaattctagtccccttctccttcctaaccaaatcctcccctccttctgcttccatcacttcctagctgtgtaacttaggcaaagtggtttacctctctgtgtctaatttcggcaaaggtaaaatggggaagtgaacctcatctggttctggtgagcttccacggg

SEQ ID NO: 16165 - DNA, 702 bp, Homo sapiens
cctgggaaacagtgagacactgtctcaaaaaaaaaatttttttaataatcaaaaaaagaaagaaaaatacttgtcaacacagaattttatgtgaggaaaaatatttttcaaaaatgaaggcaatcgaaagatcaatatcattaatataaataatgttctccgtatcaaagtaaacatattgttagatatttttattcaaaactcaataaacatagccaaagtgatatttgtccttgaaatgaggtttaaaaactgagagattcaaacattttccttaacattcaaataaaaatttatcattttctaaacaccattctaaaaaaatcctccctgttaattcagatactgcttgtccatctatagcttggaatgctctggaggagcattttgttgctttaattaaagcaacaaaaagaaaattaaataagcctaggaaaaaatgctgaattaaaaaaagaaaaggttctttctgaatagtgaaattagggtttgtctcttcatagcttttatttgtttttgaaacagagtcttgctctgtcacccaggctagagtgcagtggtgctcaccagagcctggatttcttgggctcaactgatcctcccacctcagcctcccaagtattatagctaggaccacaggcatatgccaccacaccaagcatattttttatttttttgtagagatggggtgtcactatgttg

SEQ ID NO: 16166 - DNA, 252 bp, Homo sapiens
tacccttcttaactgttatattcttatttattaaactgatcatttcacctagaacctaactcactaaaggaagaaagcattgaaaatctagtaaagctttagatttgtaaaagttgttaaaaatgaaaattcagggtcaggcgcgatggctcatgcctgtaatccctgcactttgggaggccgaggtgagtggatcatgaggtcaggagatcgagaccatcctggctaacacggtgaaaccccgtctctact

SEQ ID NO: 16167 - DNA, 2220 bp, Homo sapiens
cgcacctcgctcgcgccagcccttcccgctcttctgttctcgctctatttgccccgctgactgctggcctcgccagctttgccagtcttacgtctctgccgcccccactcccgcccgcgccccatcttcttgcgcgactcgcgcccgctggtccccccctcctcctcccgcgtcctgcctgccccctcctcctgctctcgcaggctccttggcacccaggccgggaggcgacgcgcccagccgtctaaacgggaacagccctggctgagggagctgcagcgcagcagagtatctgacggcgccaggttgcgtaggtgcggcacgaggagttttcccggcagcgaggaggtcctgagcagcatggcccggaggagcgccttccctgccgccgcgctctggctctggagcatcctcctgtgcctgctggcactgcgggcggaggccgggccgccgcaggaggagagcctgtacctatggatcgatgctcaccaggcaagagtactcataggatttgaagaagatatcctgattgtttcagaggggaaaatggcaccttttacacatgatttcagaaaagcgcaacagagaatgccagctattcctgtcaatatccattccatgaattttacctggcaagctgcagggcaggcagaatacttctatgaattcctgtccttgcgctccctggataaaggcatcatggcagatccaaccgtcaatgtccctctgctgggaacagtgcctcacaaggcatcagttgttcaagttggtttcccatgtcttggaaaacaggatggggtggcagcatttgaagtggatgtgattgttatgaattctgaaggcaacaccattctccaaacacctcaaaatgctatcttctttaaaacatgtcaacaagctgagtgcccaggcgggtgccgaaatggaggcttttgtaatgaaagacgcatctgcgagtgtcctgatgggttccacggacctcactgtgagaaagccctttgtaccccacgatgtatgaatggtggactttgtgtgactcctggtttctgcatctgcccacctggattctatggagtgaactgtgacaaagcaaactgctcaaccacctgctttaatggagggacctgtttctaccctggaaaatgtatttgccctccaggactagagggagagcagtgtgaaatcagcaaatgcccacaaccctgtcgaaatggaggtaaatgcattggtaaaagcaaatgtaagtgttccaaaggttaccagggagacctctgttcaaagcctgtctgcgagcctggctgtggtgcacatggaacctgccatgaacccaacaaatgccaatgtcaagaaggttggcatggaagacactgcaataaaaggtacgaagccagcctcatacatgccctgaggccagcaggcgcccagctcaggcagcacacgccttcacttaaaaaggccgaggagcggcgggatccacctgaatccaattacatctggtgaactccgacatctgaaacgttttaagttacaccaagttcatagcctttgttaacctttcatgtgttgaatgttcaaataatgttcattacacttaagaatactggcctgaattttattagcttcattataaatcactgagctgatatttactcttccttttaagttttctaagtacgtctgtagcatgatggtatagattttcttgtttcagtgctttgggacagattttatattatgtcaattgatcaggttaaaattttcagtgtgtagttggcagatattttcaaaattacaatgcatttatggtgtctgggggcaggggaacatcagaaaggttaaattgggcaaaaatgcgtaagtcacaagaatttggatggtgcagttaatgttgaagttacagcatttcagattttattgtcagatatttagatgtttgttacatttttaaaaattgctcttaatttttaaactctcaatacaatatattttgaccttaccattattccagagattcagtattaaaaaaaaaaaaattacactgtggtagtggcatttaaacaatataatatattctaaacacaatgaaatagggaatataatgtatgaactttttgcattggcttgaagcaatataatatattgtaaacaaaacacagctcttacctaataaacattttatactgtttgtatgtataaaataaaggtgctgctttagttttc

SEQ ID NO: 16168 - DNA, 403 bp, Homo sapiens
attttattttattttttatttatttttgagacagagtctcgctctgttgcccaggctggagtgcattaatgttgaagttacagcatttcagattttattgtcagatatttagatgtttgttacatttttaaaaattgctcttaatttttaaactctcaatacaatatattttgaccttaccattattccagagattcagtattaaaaaaaaaaaaattacactgtggtagtggcatttaaacaatataatatattctaaacacaatgaaatagggaatataatgtatgaactttttgcattggcttgaagcaatataatatattgtaaacaaaacacagctcttacctaataaacattttatactgtttgtatgtataaaataaaggtgctgctttagttttc

SEQ ID NO: 16169 - DNA, 2288 bp, Homo sapiens
cgcacctcgctcgcgccagcccttcccgctcttctgttctcgctctatttgccccgctgactgctggcctcgccagctttgccagtcttacgtctctgccgcccccactcccgcccgcgccccatcttcttgcgcgactcgcgcccgctggtccccccctcctcctcccgcgtcctgcctgccccctcctcctgctctcgcaggctccttggcacccaggccgggaggcgacgcgcccagccgtctaaacgggaacagccctggctgagggagctgcagcgcagcagagtatctgacggcgccaggttgcgtaggtgcggcacgaggagttttcccggcagcgaggaggtcctgagcagcatggcccggaggagcgccttccctgccgccgcgctctggctctggagcatcctcctgtgcctgctggcactgcgggcggaggccgggccgccgcaggaggagagcctgtacctatggatcgatgctcaccaggcaagagtactcataggatttgaagaagatatcctgattgtttcagaggggaaaatggcaccttttacacatgatttcagaaaagcgcaacagagaatgccagctattcctgtcaatatccattccatgaattttacctggcaagctgcagggcaggcagaatacttctatgaattcctgtccttgcgctccctggataaaggcatcatggcagatccaaccgtcaatgtccctctgctgggaacagtgcctcacaaggcatcagttgttcaagttggtttcccatgtcttggaaaacaggatggggtggcagcatttgaagtggatgtgattgttatgaattctgaaggcaacaccattctccaaacacctcaaaatgctatcttctttaaaacatgtcaacaagctgagtgcccaggcgggtgccgaaatggaggcttttgtaatgaaagacgcatctgcgagtgtcctgatgggttccacggacctcactgtgagaaagccctttgtaccccacgatgtatgaatggtggactttgtgtgactcctggtttctgcatctgcccacctggattctatggagtgaactgtgacaaagcaaactgctcaaccacctgctttaatggagggacctgtttctaccctggaaaatgtatttgccctccaggactagagggagagcagtgtgaaatcagcaaatgcccacaaccctgtcgaaatggaggtaaatgcattggtaaaagcaaatgtaagtgttccaaaggttaccagggagacctctgttcaaagcctgtctgcgagcctggctgtggtgcacatggaacctgccatgaacccaacaaatgccaatgtcaagaaggttggcatggaagacactgcaataaaaggtacgaagccagcctcatacatgccctgaggccagcaggcgcccagctcaggcagcacacgccttcacttaaaaaggccgaggagcggcgggatccacctgaatccaattacatctggtgaactccgacatctgaaacgttttaagttacaccaagttcatagcctttgttaacctttcatgtgttgaatgttcaaataatgttcattacacttaagaatactggcctgaattttattagcttcattataaatcactgagctgatatttactcttccttttaagttttctaagtacgtctgtagcatgatggtatagattttcttgtttcagtgctttgggacagattttatattatgtcaattgatcaggttaaaattttcagtgtgtagttggcagatattttcaaaattacaatgcatttatggtgtctgggggcaggggaacatcagaaaggttaaattgggcaaaaatgcgtaagtcacaagaatttggatggtgcagttaatgttgaagttacagcatttcagattttattgtcagatatttagatgtttgttacatttttaaaaattgctcttaatttttaaactctcaatacaatatattttgaccttaccattattccagagattcagtattaaaaaaaaaaaaattacactgtggtagtggcatttaaacaatataatatattctaaacacaatgaaatagggaatataatgtatgaactttttgcattggcttgaagcaatataatatattgtaaacaaaacacagctcttacctaataaacattttatactgtttgtatgtataaaataaaggtgctgctttagttttctgagcattgtgtggaggtgatctttgcacatgctatcttatgaaaataaaattggttgcaatttagtg

SEQ ID NO: 16170 - DNA, 2037 bp, Homo sapiens
cgcacctcgctcgcgccagcccttcccgctcttctgttctcgctctatttgccccgctgactgctggcctcgccagctttgccagtcttacgtctctgccgcccccactcccgcccgcgccccatcttcttgcgcgactcgcgcccgctggtccccccctcctcctcccgcgtcctgcctgccccctcctcctgctctcgcaggctccttggcacccaggccgggaggcgacgcgcccagccgtctaaacgggaacagccctggctgagggagctgcagcgcagcagagtatctgacggcgccaggttgcgtaggtgcggcacgaggagttttcccggcagcgaggaggtcctgagcagcatggcccggaggagcgccttccctgccgccgcgctctggctctggagcatcctcctgtgcctgctggcactgcgggcggaggccgggccgccgcaggaggagagcctgtacctatggatcgatgctcaccaggcaagagtactcataggatttgaagaagatatcctgattgtttcagaggggaaaatggcaccttttacacatgatttcagaaaagcgcaacagagaatgccagctattcctgtcaatatccattccatgaattttacctggcaagctgcagggcaggcagaatacttctatgaattcctgtccttgcgctccctggataaaggcatcatggcagatccaaccgtcaatgtccctctgctgggaacagtgcctcacaaggcatcagttgttcaagttggtttcccatgtcttggaaaacaggatggggtggcagcatttgaagtggatgtgattgttatgaattctgaaggcaacaccattctccaaacacctcaaaatgctatcttctttaaaacatgtcaacaagctgagtgcccaggcgggtgccgaaatggaggcttttgtaatgaaagacgcatctgcgagtgtcctgatgggttccacggacctcactgtgagaaagccctttgtaccccacgatgtatgaatggtggactttgtgtgactcctggtttctgcatctgcccacctggattctatggagtgaactgtgacaaagcaaactgctcaaccacctgctttaatggagggacctgtttctaccctggaaaatgtatttgccctccaggactagagggagagcagtgtgaaatcagcaaatgcccacaaccctgtcgaaatggaggtaaatgcattggtaaaagcaaatgtaagtgttccaaaggttaccagggagacctctgttcaaagcctgtctgcgagcctggctgtggtgcacatggaacctgccatgaacccaacaaatgccaatgtcaagaaggttggcatggaagacactgcaataaaaggtacgaagccagcctcatacatgccctgaggccagcaggcgcccagctcaggcagcacacgccttcacttaaaaaggccgaggagcggcgggatccacctgaatccaattacatctggtgaactccgacatctgaaacgttttaagttacaccaagttcatagcctttgttaacctttcatgtgttgaatgttcaaataatgttcattacacttaagaatactggcctgaattttattagcttcattataaatcactgagctgatatttactcttccttttaagttttctaagtacgtctgtagcatgatggtatagattttcttgtttcagtgctttgggacagattttatattatgtcaattgatcaggttaaaattttcagtgtgtagttggcagatattttcaaaattacaatgcatttatggtgtctgggggcaggggaacatcagaaaggttaaattgggcaaaaatgcgtaagtcacaagaatttggatggtgcagttaatgttgaagttacagcatttcagattttattgtcagatatttagatgtttgttacatttttaaaaattgctcttaatttttaaactctcaatacaatatattttgaccttaccattattccagagattcaggtggtgtggggtgaccgagct

SEQ ID NO: 16171 - DNA, 1912 bp, Homo sapiens
cgcacctcgctcgcgccagcccttcccgctcttctgttctcgctctatttgccccgctgactgctggcctcgccagctttgccagtcttacgtctctgccgcccccactcccgcccgcgccccatcttcttgcgcgactcgcgcccgctggtccccccctcctcctcccgcgtcctgcctgccccctcctcctgctctcgcaggctccttggcacccaggccgggaggcgacgcgcccagccgtctaaacgggaacagccctggctgagggagctgcagcgcagcagagtatctgacggcgccaggttgcgtaggtgcggcacgaggagttttcccggcagcgaggaggtcctgagcagcatggcccggaggagcgccttccctgccgccgcgctctggctctggagcatcctcctgtgcctgctggcactgcgggcggaggccgggccgccgcaggaggagagcctgtacctatggatcgatgctcaccaggcaagagtactcataggatttgaagaagatatcctgattgtttcagaggggaaaatggcaccttttacacatgatttcagaaaagcgcaacagagaatgccagctattcctgtcaatatccattccatgaattttacctggcaagctgcagggcaggcagaatacttctatgaattcctgtccttgcgctccctggataaaggcatcatggcagatccaaccgtcaatgtccctctgctgggaacagtgcctcacaaggcatcagttgttcaagttggtttcccatgtcttggaaaacaggatggggtggcagcatttgaagtggatgtgattgttatgaattctgaaggcaacaccattctccaaacacctcaaaatgctatcttctttaaaacatgtcaacaagctgagtgcccaggcgggtgccgaaatggaggcttttgtaatgaaagacgcatctgcgagtgtcctgatgggttccacggacctcactgtgagaaagccctttgtaccccacgatgtatgaatggtggactttgtgtgactcctggtttctgcatctgcccacctggattctatggagtgaactgtgacaaagcaaactgctcaaccacctgctttaatggagggacctgtttctaccctggaaaatgtatttgccctccaggactagagggagagcagtgtgaaatcagcaaatgcccacaaccctgtcgaaatggaggtaaatgcattggtaaaagcaaatgtaagtgttccaaaggttaccagggagacctctgttcaaagcctgtctgcgagcctggctgtggtgcacatggaacctgccatgaacccaacaaatgccaatgtcaagaaggttggcatggaagacactgcaataaaaggtacgaagccagcctcatacatgccctgaggccagcaggcgcccagctcaggcagcacacgccttcacttaaaaaggccgaggagcggcgggatccacctgaatccaattacatctggtgaactccgacatctgaaacgttttaagttacaccaagttcatagcctttgttaacctttcatgtgttgaatgttcaaataatgttcattacacttaagaatactggcctgaattttattagcttcattataaatcactgagctgatatttactcttccttttaagttttctaagtacgtctgtagcatgatggtatagattttcttgtttcagtgctttgggacagattttatattatgtcaattgatcaggttaaaattttcagtgtgtagttggcagatattttcaaaattacaatgcatttatggtgtctgggggcaggggaacatcagaaaggttaaattgggcaaagggtagtccagaatgggggcgtaaggtgagtacgattcaatttagcgttgtttgtcctttcgg

SEQ ID NO: 16172 - DNA, 1129 bp, Homo sapiens
  misc_feature (19)..(19): n is a, c, g, or t
gaaggggggaagacaattntgaatcaagcaaatgcccacaaccctgtcgaaatggaggtaaatgcattggtaaaagcaaatgtaagtgttccaaaggttaccagggagacctctgttcaaagcctgtctgcgagcctggctgtggtgcacatggaacctgccatgaacccaacaaatgccaatgtcaagaaggttggcatggaagacactgcaataaaaggtacgaagccagcctcatacatgccctgaggccagcaggcgcccagctcaggcagcacacgccttcacttaaaaaggccgaggagcggcgggatccacctgaatccaattacatctggtgaactccgacatctgaaacgttttaagttacaccaagttcatagcctttgttaacctttcatgtgttgaatgttcaaataatgttcattacacttaagaatactggcctgaattttattagcttcattataaatcactgagctgatatttactcttccttttaagttttctaagtacgtctgtagcatgatggtatagattttcttgtttcagtgctttgggacagattttatattatgtcaattgatcaggttaaaattttcagtgtgtagttggcagatattttcaaaattacaatgcatttatggtgtctgggggcaggggaacatcagaaaggttaaattgggcaaaaatgcgtaagtcacaagaatttggatggtgcagttaatgttgaagttacagcatttcagattttattgtcagatatttagatgtttgttacatttttaaaaattgctcttaatttttaaactctcaatacaatatattttgaccttaccattattccagagattcagtattaaaaaaaaaaaaattacactgtggtagtggcatttaaacaatataatatattctaaacacaatgaaatagggaatataatgtatgaactttttgcattggcttgaagcaatataatatattgtaaacaaaacacagctcttacctaataaacattttatactgtttgtatgtataaaataaaggtgctgctttagttttctgagcattgtgtggaggtgatctttgcacatgctatcttatgaaaataaaattggttgcaatttagtg

SEQ ID NO: 16173 - DNA, 1187 bp, Homo sapiens
  misc_feature (3)..(3): n is a, c, g, or t
  misc_feature (15)..(15): n is a, c, g, or t
atntcggaacgaggngtgaactgtgacaaagcaaactgctcaaccacctgctttaatggagggacctgtttctaccctggaaaatgtatttgccctccaggactagagggagagcagtgtgaaatcagcaaatgcccacaaccctgtcgaaatggaggtaaatgcattggtaaaagcaaatctgtctgcgagcctggctgtggtgcacatggaacctgccatgaacccaacaaatgccaatgtcaagaaggttggcatggaagacactgcaataaaaggtacgaagccagcctcatacatgccctgaggccagcaggcgcccagctcaggcagcacacgccttcacttaaaaaggccgaggagcggcgggatccacctgaatccaattacatctggtgaactccgacatctgaaacgttttaagttacaccaagttcatagcctttgttaacctttcatgtgttgaatgttcaaataatgttcattacacttaagaatactggcctgaattttattagcttcattataaatcactgagctgatatttactcttccttttaagttttctaagtacgtctgtagcatgatggtatagattttcttgtttcagtgctttgggacagattttatattatgtcaattgatcaggttaaaattttcagtgtgtagttggcagatattttcaaaattacaatgcatttatggtgtctgggggcaggggaacatcagaaaggttaaattgggcaaaaatgcgtaagtcacaagaatttggatggtgcagttaatgttgaagttacagcatttcagattttattgtcagatatttagatgtttgttacatttttaaaaattgctcttaatttttaaactctcaatacaatatattttgaccttaccattattccagagattcagtattaaaaaaaaaaaaattacactgtggtagtggcatttaaacaatataatatattctaaacacaatgaaatagggaatataatgtatgaactttttgcattggcttgaagcaatataatatattgtaaacaaaacacagctcttacctaataaacattttatactgtttgtatgtataaaataaaggtgctgctttagttttctgagcattgtgtggaggtgatctttgcacatgctatcttatgaaaataaaattggttgcaatttagtg

SEQ ID NO: 16174 - DNA, 957 bp, Homo sapiens
cctatctcaacattcctccttattttcttcccactctcatcctcttaggtacgaagccagcctcatacatgccctgaggccagcaggcgcccagctcaggcagcacacgccttcacttaaaaaggccgaggagcggcgggatccacctgaatccaattacatctggtgaactccgacatctgaaacgttttaagttacaccaagttcatagcctttgttaacctttcatgtgttgaatgttcaaataatgttcattacacttaagaatactggcctgaattttattagcttcattataaatcactgagctgatatttactcttccttttaagttttctaagtacgtctgtagcatgatggtatagattttcttgtttcagtgctttgggacagattttatattatgtcaattgatcaggttaaaattttcagtgtgtagttggcagatattttcaaaattacaatgcatttatggtgtctgggggcaggggaacatcagaaaggttaaattgggcaaaaatgcgtaagtcacaagaatttggatggtgcagttaatgttgaagttacagcatttcagattttattgtcagatatttagatgtttgttacatttttaaaaattgctcttaatttttaaactctcaatacaatatattttgaccttaccattattccagagattcagtattaaaaaaaaaaaaattacactgtggtagtggcatttaaacaatataatatattctaaacacaatgaaatagggaatataatgtatgaactttttgcattggcttgaagcaatataatatattgtaaacaaaacacagctcttacctaataaacattttatactgtttgtatgtataaaataaaggtgctgctttagttttctgagcattgtgtggaggtgatctttgcacatgctatcttatgaaaataaaattggttgcaatttagtg

SEQ ID NO: 16175 - DNA, 1378 bp, Homo sapiens
  misc_feature (1304)..(1304): n is a, c, g, or t
  misc_feature (1308)..(1308): n is a, c, g, or t
  misc_feature (1311)..(1311): n is a, c, g, or t
  misc_feature (1361)..(1361): n is a, c, g, or t
  misc_feature (1363)..(1363): n is a, c, g, or t
cgcacctcgctcgcgccagcccttcccgctcttctgttctcgctctatttgccccgctgactgctggcctcgccagctttgccagtcttacgtctctgccgcccccactcccgcccgcgccccatcttcttgcgcgactcgcgcccgctggtccccccctcctcctcccgcgtcctgcctgccccctcctcctgctctcgcaggctccttggcacccaggccgggaggcgacgcgcccagccgtctaaacgggaacagccctggctgagggagctgcagcgcagcagagtatctgacggcgccaggttgcgtaggtgcggcacgaggagttttcccggcagcgaggaggtcctgagcagcatggcccggaggagcgccttccctgccgccgcgctctggctctggagcatcctcctgtgcctgctggcactgcgggcggaggccgggccgccgcaggaggagagcctgtacctatggatcgatgctcaccaggcaagagtactcataggatttgaagaagatatcctgattgtttcagaggggaaaatggcaccttttacacatgatttcagaaaagcgcaacagagaatgccagctattcctgtcaatatccattccatgaattttacctggcaagctgcagggcaggcagaatacttctatgaattcctgtccttgcgctccctggataaaggcatcatggcagatccaaccgtcaatgtccctctgctgggaacagtgcctcacaaggcatcagttgttcaagttggtttcccatgtcttggaaaacaggatggggtggcagcatttgaagtggatgtgattgttatgaattctgaaggcaacaccattctccaaacacctcaaaatgctatcttctttaaaacatgtcaacaagctgagtgcccaggcgggtgccgaaatggaggcttttgtaatgaaagacgcatctgcgagtgtcctgatgggttccacggacctcactgtgagaaagccctttgtaccccacgatgtatgaatggtggactttgtgtgactcctggtttctgcatctgcccacctggattctatggagtgaactgtgacaaagcaaactgctcaaccacctgctttaatggagggacctgtttctaccctggaaaatgtatttgccctccaggactagagggagagcagtgtgaaatcagcaaatgcccacaaccctgtcgaaatggaggtaaatgcattggtaaaagcaaatgtaagtgttccaaaggttaccagggagacctctgttcaaagctgtttggagcctgggttggggngaanatngaacctgcatgaaccccacaattgcaattttaagagggtggaatggaggnanttgaataagggtcga

SEQ ID NO: 16176 - DNA, 913 bp, Homo sapiens
ctaggtgagatactcgctaccttttaagagccttcttgacatgtttttttctcaggcagcacacgccttcacttaaaaaggccgaggagcggcgggatccacctgaatccaattacatctggtgaactccgacatctgaaacgttttaagttacaccaagttcatagcctttgttaacctttcatgtgttgaatgttcaaataatgttcattacacttaagaatactggcctgaattttattagcttcattataaatcactgagctgatatttactcttccttttaagttttctaagtacgtctgtagcatgatggtatagattttcttgtttcagtgctttgggacagattttatattatgtcaattgatcaggttaaaattttcagtgtgtagttggcagatattttcaaaattacaatgcatttatggtgtctgggggcaggggaacatcagaaaggttaaattgggcaaaaatgcgtaagtcacaagaatttggatggtgcagttaatgttgaagttacagcatttcagattttattgtcagatatttagatgtttgttacatttttaaaaattgctcttaatttttaaactctcaatacaatatattttgaccttaccattattccagagattcagtattaaaaaaaaaaaaattacactgtggtagtggcatttaaacaatataatatattctaaacacaatgaaatagggaatataatgtatgaactttttgcattggcttgaagcaatataatatattgtaaacaaaacacagctcttacctaataaacattttatactgtttgtatgtataaaataaaggtgctgctttagttttctgagcattgtgtggaggtgatctttgcacatgctatcttatgaaaataaaattggttgcaatttagtg

SEQ ID NO: 16177 - DNA, 840 bp, Homo sapiens
  misc_feature (2)..(2): n is a, c, g, or t
gncctgatgtcctgctgtcatatcaaccaacaccttttctgggatctggtgaactccgacatctgaaacgttttaagttacaccaagttcatagcctttgttaacctttcatgtgttgaatgttcaaataatgttcattacacttaagaatactggcctgaattttattagcttcattataaatcactgagctgatatttactcttccttttaagttttctaagtacgtctgtagcatgatggtatagattttcttgtttcagtgctttgggacagattttatattatgtcaattgatcaggttaaaattttcagtgtgtagttggcagatattttcaaaattacaatgcatttatggtgtctgggggcaggggaacatcagaaaggttaaattgggcaaaaatgcgtaagtcacaagaatttggatggtgcagttaatgttgaagttacagcatttcagattttattgtcagatatttagatgtttgttacatttttaaaaattgctcttaatttttaaactctcaatacaatatattttgaccttaccattattccagagattcagtattaaaaaaaaaaaaattacactgtggtagtggcatttaaacaatataatatattctaaacacaatgaaatagggaatataatgtatgaactttttgcattggcttgaagcaatataatatattgtaaacaaaacacagctcttacctaataaacattttatactgtttgtatgtataaaataaaggtgctgctttagttttctgagcattgtgtggaggtgatctttgcacatgctatcttatgaaaataaaattggttgcaatttagtg

SEQ ID NO: 16178 - DNA, 804 bp, Homo sapiens
ggccggtaccggcgttgcgtggcacttacgtgaaacgttagttacaccaagttcatagcctttgttaacctttcatgtgttgaatgttcaaataatgttcattacacttaagaatactggcctgaattttattagcttcattataaatcactgagctgatatttactcttccttttaagttttctaagtacgtctgtagcatgatggtatagattttcttgtttcagtgctttgggacagattttatattatgtcaattgatcaggttaaaattttcagtgtgtagttggcagatattttcaaaattacaatgcatttatggtgtctgggggcaggggaacatcagaaaggttaaattgggcaaaaatgcgtaagtcacaagaatttggatggtgcagttaatgttgaagttacagcatttcagattttattgtcagatatttagatgtttgttacatttttaaaaattgctcttaatttttaaactctcaatacaatatattttgaccttaccattattccagagattcagtattaaaaaaaaaaaaattacactgtggtagtggcatttaaacaatataatatattctaaacacaatgaaatagggaatataatgtatgaactttttgcattggcttgaagcaatataatatattgtaaacaaaacacagctcttacctaataaacattttatactgtttgtatgtataaaataaaggtgctgctttagttttctgagcattgtgtggaggtgatctttgcacatgctatcttatgaaaataaaattggttgcaatttagtg

SEQ ID NO: 16179 - DNA, 471 bp, Homo sapiens
attttattttattttttatttatttttgagacagagtctcgctctgttgcccaggctggagtgcattaatgttgaagttacagcatttcagattttattgtcagatatttagatgtttgttacatttttaaaaattgctcttaatttttaaactctcaatacaatatattttgaccttaccattattccagagattcagtattaaaaaaaaaaaaattacactgtggtagtggcatttaaacaatataatatattctaaacacaatgaaatagggaatataatgtatgaactttttgcattggcttgaagcaatataatatattgtaaacaaaacacagctcttacctaataaacattttatactgtttgtatgtataaaataaaggtgctgctttagttttctgagcattgtgtggaggtgatctttgcacatgctatcttatgaaaataaaattggttgcaatttagtg

SEQ ID NO: 16180 - DNA, 454 bp, Homo sapiens
actaacagatgaaggaggagaatccctaaaaacagagcattgggtagctagtccaccagcggtctgatgctttcattgatctcaaaactgtctctgagtaactctaccaggaaagttgtctggagggttaacatttctgaaaccatttttatctttgccttcattcttgaatgataattagtctcgaatgtttggatcacaatccattgaaagactaggctattttttcactgtcctcagacatttactgagtccagtttggactttattttattttattttttttgaaacaagatctcgctctgttgctcaggctgaagtgcaatagcgcaaactcggctcactgcaacctcccaggttcaagcaattctcgtgcctcagccatccctataggcatgcgccaccacactttgctaatcttgtatttttggtagagacggggtttgcaccatgt

SEQ ID NO: 16181 - DNA, 843 bp, Homo sapiens
ttcttttagcttcagcctttaaaatactagtcattatttattatttcttcaaaagcccatctctaattgtctccttagggagtttttgagttcacattgacattaattgtcactaactgtcagcagttggcattaaccagactctattttaggattaaatccacctgatccacctgcactatcagaacattcaggacgcgactcaggctgcagctcagagggctccaccggtggccctagacttgcatcaagctgctgccattgccactgcaccagcttgtatgccaggttaccacatagtcctatgtaaccatgtgggctgctgtagagtaattcccctacttttgtcccccacttcctcaggtagaggctcgtagacattacattggatgagcaggcagctcagcttggtcagagccagccgtctgctccacccactttgtcctatcacagacccagtcgcagacataaattctcaagctcatgtgcttgtctccttcccacccccagcccgtcatcaatgcctagtttggcctaatgcatcagctgcaccaaggcaaaatcatttttgccaaccagcccagctgcagtttggtttctggtcaagtccaatttatggacagcggagaggagtggacagcttctctcagcataagtttgtctccagctttcatcccttcccacgggggaagatttcgaagccaaaaggttaacatgagatcaacttcccatgagtattcacggataaagtgctaggttttagcattatcaagaaagtaatgaaattaaagtaataatacgtattttcagtgtgtaataggttgaagatgcaagttgcaatct

SEQ ID NO: 16182 - DNA, 885 bp, Homo sapiens
agaaaaaagtatcaagttaaattttgattaattctactgttagcgggcattagttgatttacactgtgtgtagaattggttgtgtggtgaaatacaatactgtttgtcttatctattattcaggatttatttttctagaattctgatttcctccccttcttcatgttatcagtagaggatgacatttttaatttgcatgtagcaggttaatttttaaaaaccaccttgtcttttagtgttatcttacctgattttttttctggcatacctttctttttatttgcaacattttcaactttcttttagtgctgttcttttcaagcaatatgtagcttttaatttttgatgcaatatgaaaatttctgtctcttaatgagaaaattcaatccattgatgtttactttgatgactgaaaaacttgtttttatttattccaacttaccatttattgttttagaaaattgctgctgttgcttttttttcttattgtatttctttccatctttgtacatgatcatttgaaagttgtgctttttgaattcatcatggtttctattctttccttagtctttcaataaccctactgtttaaatatggtaccagctattttgcaaattaagatgcactgtatctctacactgatgctcctttctccctacttctcttgccctcctaaatccaattgatacaactttaagagacacgacacgttatttccttttttttgttgttgttgctgttgttgttgagactctgtcacccaggctggagtgcagtggcacaatctcggctcactgcaacttctgcttcccaggtttcaagcaattctcctgcctcagcctcccgagtagctgggagacagagtgagactctgtctcaaaaaaa

SEQ ID NO: 16183 - DNA, 647 bp, Homo sapiens
aggctgtacgcctcggattacgggattggctcactatgcatttgactgggactcccccatggagagaagtcctcccaggtcctctgcaaggggcatctgttccttggctatggacatgccctaaagtgccaggtggacggaagagctcctgggaccagcaggttgggagcatcaattcacgttggctagaaatgtgacttctttagtatttaccattttaacaaaatccatgataagggatttggaaggtcccatggaaaggatgaaatgacacctctctgctacccagtttctttaagacctctacggttgagaagagaggacaaaggaacacccccacctctgccatcctccgagggatttttcacagcaattccagtgctgctcagtggaaagctctgcaagtcaactgcaaacccccagccccagatgttaggcatttacaaactttgttgctgatttatcagcgctcctctgcaattttggggacaggagcaaacacaagcttaagtcaccacgcaggctgcaacccttacccaaagatgggggaaaaactccaaaggagatgcaggagggagcctcagcagtcactgtgagagcacaaagaggccaagacccaggtaggcaaaggaaggtgagaggcacca

SEQ ID NO: 16184 - DNA, 516 bp, Homo sapiens
cttatttacaaacactttaattcttcacaggttgggagcatcaattcacgttggctagaaatgtgacttctttagtatttaccattttaacaaaatccatgataagggatttggaaggtcccatggaaaggatgaaatgacacctctctgctacccagtttctttaagacctctacggttgagaagagaggacaaaggaacacccccacctctgccatcctccgagggatttttcacagcaattccagtgctgctcagtggaaagctctgcaagtcaactgcaaacccccagccccagatgttaggcatttacaaactttgttgctgatttatcagcgctcctctgcaattttggggacaggagcaaacacaagcttaagtcaccacgcaggctgcaacccttacccaaagatgggggaaaaactccaaaggagatgcaggagggagcctcagcagtcactgtgagagcacaaagaggccaagacccaggtaggcaaaggaaggtgagaggcacca

SEQ ID NO: 16185 - DNA, 365 bp, Homo sapiens
ccagaggaggagctggagggagaagtgtgctccgaggagtgctaagtcaccaaagaatggaaagtcatagtgtgtggaaggaggtgggggaggagggaactttctggaatccgaaaaagtgtacacctgcacaaaaaccaaagtgaacaaacatcatgaagaaatgagagggctgtgtgatggctggcacaggaggtcaacttaccacgctgaggaggtcagacagatgcgaggctgtggtgttgagtggctttggatgtcaccttggaaggaataaaactttgagatagatggaaagactaatctctgcaccactcacagtatttaaaacagtgccttgcacttaataaatattgcataagttg

SEQ ID NO: 16186 - DNA, 669 bp, Homo sapiens
gtttcatggaagcaatgtatatgacagaaggaacaccagaggggagtgttgtggagagtgttgtggtgacttggtaagttgcttacacattgggggtcttggctgtctcatctctaagtgaaggggttagatatgaatgattaataagatccctttcaggtctatgcttctagcactcccttttgtcgggtgaggagccctttttgtattgtgtatactcacccagcactttatctgcctctttgttgttagctgatgatctttgtgtgtctgattttttttttttaagagtaaggatgtcatgcactcttattcaaagtgtagagtttattctcccattcataggaatgcaaaatgagaagttttaaatacacggattcacttcctaacccagtttctcagaagattaatgaatagtcatcctgttgacccatctgcttctcttcttcacatcgttttgtgcggatgaggcacacacagacacagagttctcacttgcagcagtccggcacatacagcctcacacgcgccacaccagggggtgtccccaggagaggtagaacaggtgccagatgttgcagcagtacactcctccctgatcctccttctcatcccccaccccttttctgaatctcctgcacagtcactgaagtcccatttttatatgca

SEQ ID NO: 16187 - DNA, 2208 bp, Homo sapiens
caggacctgtctttgtccctcctcttaacatacttgcagctaaaactaaatattgctgcttggggacctccttctagccttaaatttcagctcatcaccttcacctgccttggtcatggctctgctattctccttgatccttgccatttgcaccagacctggattcctagcgtctccatctggagtgcggctggtggggggcctccaccgctgtgaagggcgggtggaggtggaacagaaaggccagtggggcaccgtgtgtgatgacggctgggacattaaggacgtggctgtgttgtgccgggagctgggctgtggagctgccagcggaacccctagtggtattttgtatgagccaccagcagaaaaagagcaaaaggtcctcatccaatcagtcagttgcacaggaacagaagatacattggctcagtgtgagcaagaagaagtttatgattgttcacatgatgaagatgctggggcatcgtgtgagaacccagagagctctttctccccagtcccagagggtgtcaggctggctgacggccctgggcattgcaagggacgcgtggaagtgaagcaccagaaccagtggtataccgtgtgccagacaggctggagcctccgggccgcaaaggtggtgtgccggcagctgggatgtgggagggctgtactgactcaaaaacgctgcaacaagcatgcctatggccgaaaacccatctggctgagccagatgtcatgctcaggacgagaagcaacccttcaggattgcccttctgggccttgggggaagaacacctgcaaccatgatgaagacacgtgggtcgaatgtgaagatccctttgacttgagactagtaggaggagacaacctctgctctgggcgactggaggtgctgcacaagggcgtatggggctctgtctgtgatgacaactggggagaaaaggaggaccaggtggtatgcaagcaactgggctgtgggaagtccctctctccctccttcagagaccggaaatgctatggccctggggttggccgcatctggctggataatgttcgttgctcaggggaggagcagtccctggagcagtgccagcacagattttgggggtttcacgactgcacccaccaggaagatgtggctgtcatctgctcaggatagtatcctggtgttgcttgacctggcccccctggccccgcctgccctctgcttgttctcctgagccctgattatcctcatactcattctggggctcaggcttgagccactactccctcatcccctcaggagtctgaacactgggcttatgccttactctcagggacaagcagcccccattgctgcctgtagatgtgagctgttgagttccctcttgctggggaagatgagcttccatgtatcctgtgctcaaccctgaccctttgacactggttctggcctttcctgccttttctcaagctgcctggaatcctcaaacctgtcactttggtcagatgtgcagaccattactaaggtctatgtctgcaaacattactaatctaggtcctattactaatctatgtctgcaaacattaaaggaatgaaacaatgaaaggaacatttgaaagaaaatgtgggtagacaatttcttgcaacttgggggaaagtttagaattcttttgattggactactttttttttttttcctcaagcttcaggtgaccacaatagcaacacctccctattctgttatttcttagtgtaggtagacaattctttcaggagcagagcagcgtcctataatcctagaccttttcatgacgtgtaaaaaatgatgtttcatcctctgattgccccaataaaaatctttgttgtccatccctatacaacctgccaacatggttgacatttaatgagaggaatgtcaaaaatacattttactttattcaaagaaaaatatattggttactgggaaaaggtcaagaaagaggcagaaagagatcagggagggctaaagttgtgtcttatgccaagcggaagtggaaaatatcacttttcactttatcaactgagactttggggcctgtaagcttgaggcaagacagaaataagagaatcaagacttgattgtaaaaattgacaactttagattctgaggctaggctgagtacttattatacggctacatttacacatttacacttatctaataaatcagatttcacagtctc

SEQ ID NO: 16188 - DNA, 1942 bp, Homo sapiens
caggacctgtctttgtccctcctcttaacatacttgcagctaaaactaaatattgctgcttggggacctccttctagccttaaatttcagctcatcaccttcacctgccttggtcatggctctgctattctccttgatccttgccatttgcaccagacctggattcctagcgtctccatctggagtgcggctggtggggggcctccaccgctgtgaagggcgggtggaggtggaacagaaaggccagtggggcaccgtgtgtgatgacggctgggacattaaggacgtggctgtgttgtgccgggagctgggctgtggagctgccagcggaacccctagtggtattttgtatgagccaccagcagaaaaagagcaaaaggtcctcatccaatcagtcagttgcacaggaacagaagatacattggctcagtgtgagcaagaagaagtttatgattgttcacatgatgaagatgctggggcatcgtgtgagaacccagagagctctttctccccagtcccagagggtgtcaggctggctgacggccctgggcattgcaagggacgcgtggaagtgaagcaccagaaccagtggtataccgtgtgccagacaggctggagcctccgggccgcaaaggtggtgtgccggcagctgggatgtgggagggctgtactgactcaaaaacgctgcaacaagcatgcctatggccgaaaacccatctggctgagccagatgtcatgctcaggacgagaagcaacccttcaggattgcccttctgggccttgggggaagaacacctgcaaccatgatgaagacacgtgggtcgaatgtgaagatccctttgacttgagactagtaggaggagacaacctctgctctgggcgactggaggtgctgcacaagggcgtatggggctctgtctgtgatgacaactggggagaaaaggaggaccaggtggtatgcaagcaactgggctgtgggaagtccctctctccctccttcagagaccggaaatgctatggccctggggttggccgcatctggctggataatgttcgttgctcaggggaggagcagtccctggagcagtgccagcacagattttgggggtttcacgactgcacccaccaggaagatgtggctgtcatctgctcaggatagtatcctggtgttgcttgacctggcccccctggccccgcctgccctctgcttgttctcctgagccctgattatcctcatactcattctggggctcaggcttgagccactactccctcatcccctcaggagtctgaacactgggcttatgccttactctcagggacaagcagcccccattgctgcctgtagatgtgagctgttgagttccctcttgctggggaagatgagcttccatgtatcctgtgctcaaccctgaccctttgacactggttctggcctttcctgccttttctcaagctgcctggaatcctcaaacctgtcactttggtcagatgtgcagaccattactaaggtctatgtctgcaaacattactaatctaggtcctattactaatctatgtctgcaaacattaaaggaatgaaacaatgaaaggaacatttgaaagaaacaaaaaaaaaaaaaaaaaaaaaaaaaaaaaaaaaaaaaaaaaaaaaaaaaaaaaaaaaaaaaaaaacagacaaaaaggaggggcgcgccgcccgctaaagagatccctccccaggggggagcgcatcattcttgcgcagccccagcggttttttgacagcgaggggcggcccacctagtaggggcgcgcgcatattataccgagcagcgcagggcggccggttattaaaccacacgcctcggcacggggacaacagcgtgatcacgaggagcgactttgcgggggggagcgaccccacatccgcgggcgggcaccaaattggcaaccaaccatg

SEQ ID NO: 16189 - DNA, 2105 bp, Homo sapiens
tcctgccatggttctgaggcctccccagccatgtggaactccatttgcaccagacctggattcctagcgtctccatctggagtgcggctggtggggggcctccaccgctgtgaagggcgggtggaggtggaacagaaaggccagtggggcaccgtgtgtgatgacggctgggacattaaggacgtggctgtgttgtgccgggagctgggctgtggagctgccagcggaacccctagtggtattttgtatgagccaccagcagaaaaagagcaaaaggtcctcatccaatcagtcagttgcacaggaacagaagatacattggctcagtgtgagcaagaagaagtttatgattgttcacatgatgaagatgctggggcatcgtgtgagaacccagagagctctttctccccagtcccagagggtgtcaggctggctgacggccctgggcattgcaagggacgcgtggaagtgaagcaccagaaccagtggtataccgtgtgccagacaggctggagcctccgggccgcaaaggtggtgtgccggcagctgggatgtgggagggctgtactgactcaaaaacgctgcaacaagcatgcctatggccgaaaacccatctggctgagccagatgtcatgctcaggacgagaagcaacccttcaggattgcccttctgggccttgggggaagaacacctgcaaccatgatgaagacacgtgggtcgaatgtgaagatccctttgacttgagactagtaggaggagacaacctctgctctgggcgactggaggtgctgcacaagggcgtatggggctctgtctgtgatgacaactggggagaaaaggaggaccaggtggtatgcaagcaactgggctgtgggaagtccctctctccctccttcagagaccggaaatgctatggccctggggttggccgcatctggctggataatgttcgttgctcaggggaggagcagtccctggagcagtgccagcacagattttgggggtttcacgactgcacccaccaggaagatgtggctgtcatctgctcaggatagtatcctggtgttgcttgacctggcccccctggccccgcctgccctctgcttgttctcctgagccctgattatcctcatactcattctggggctcaggcttgagccactactccctcatcccctcaggagtctgaacactgggcttatgccttactctcagggacaagcagcccccattgctgcctgtagatgtgagctgttgagttccctcttgctggggaagatgagcttccatgtatcctgtgctcaaccctgaccctttgacactggttctggcctttcctgccttttctcaagctgcctggaatcctcaaacctgtcactttggtcagatgtgcagaccattactaaggtctatgtctgcaaacattactaatctaggtcctattactaatctatgtctgcaaacattaaaggaatgaaacaatgaaaggaacatttgaaagaaaatgtgggtagacaatttcttgcaacttgggggaaagtttagaattcttttgattggactactttttttttttttcctcaagcttcaggtgaccacaatagcaacacctccctattctgttatttcttagtgtaggtagacaattctttcaggagcagagcagcgtcctataatcctagaccttttcatgacgtgtaaaaaatgatgtttcatcctctgattgccccaataaaaatctttgttgtccatccctatacaacctgccaacatggttgacatttaatgagaggaatgtcaaaaatacattttactttattcaaagaaaaatatattggttactgggaaaaggtcaagaaagaggcagaaagagatcagggagggctaaagttgtgtcttatgccaagcggaagtggaaaatatcacttttcactttatcaactgagactttggggcctgtaagcttgaggcaagacagaaataagagaatcaagacttgattgtaaaaattgacaactttagattctgaggctaggctgagtacttattatacggctacatttacacatttacacttatctaataaatcagatttcacagtctc

SEQ ID NO: 16190 - DNA, 1475 bp, Homo sapiens
agcagttagtgcccagagaagaataaatacagctgcaggaggctagggtttgagccaggctgctgctactttgaagctgtgtaatgttagtcacttaactcctcagaacctaagtgtttccatgggtagaaatagaaagacacttgtccggtttacctcaaagactttgtgattgtgtgaggataagatatgttgatagatgtcagtactgtttgtgactcacatggagctagttgagtaagtccctgggatactgcacaaggttctggcctggctcacatcagtgtgggatctgtacatggcttagctctttttcctatgttgagccccagtcttctcccttagctaatgtgagtttcaactgaataattccttcctggactatacccatccttactgcattttcctcttctctttataggatagtatcctggtgttgcttgacctggcccccctggccccgcctgccctctgcttgttctcctgagccctgattatcctcatactcattctggggctcaggcttgagccactactccctcatcccctcaggagtctgaacactgggcttatgccttactctcagggacaagcagcccccattgctgcctgtagatgtgagctgttgagttccctcttgctggggaagatgagcttccatgtatcctgtgctcaaccctgaccctttgacactggttctggcctttcctgccttttctcaagctgcctggaatcctcaaacctgtcactttggtcagatgtgcagaccattactaaggtctatgtctgcaaacattactaatctaggtcctattactaatctatgtctgcaaacattaaaggaatgaaacaatgaaaggaacatttgaaagaaaatgtgggtagacaatttcttgcaacttgggggaaagtttagaattcttttgattggactactttttttttttttcctcaagcttcaggtgaccacaatagcaacacctccctattctgttatttcttagtgtaggtagacaattctttcaggagcagagcagcgtcctataatcctagaccttttcatgacgtgtaaaaaatgatgtttcatcctctgattgccccaataaaaatctttgttgtccatccctatacaacctgccaacatggttgacatttaatgagaggaatgtcaaaaatacattttactttattcaaagaaaaatatattggttactgggaaaaggtcaagaaagaggcagaaagagatcagggagggctaaagttgtgtcttatgccaagcggaagtggaaaatatcacttttcactttatcaactgagactttggggcctgtaagcttgaggcaagacagaaataagagaatcaagacttgattgtaaaaattgacaactttagattctgaggctaggctgagtacttattatacggctacatttacacatttacacttatctaataaatcagatttcacagtctc

SEQ ID NO: 16191 - DNA, 391 bp, Homo sapiens
ccggcagctgggatgtgggagggctgtactgactcaaaaacgctgcaacaagcatgcctatggccgaaaacccatctggctgagccagatgtcatgctcaggacgagaagcaacccttcaggattgcccttctgggccttgggggaagaacacctgcaaccatgatgaagacacgtgggtcgaatgtgaaggtaatgcctgtgcgtccaaagactaggtttattcatggatttaattatgtggaatctcattcaaacagtatttacaaagagctactaacgcaccaaaggaccattgcaaacttatttaactgggcagataattaattcctttgtttttcaaatggagataataatacccaactttgtatctgaaaatgcttttaatatta

SEQ ID NO: 16192 - DNA, 530 bp, Homo sapiens
agaaggtggcgtcagccttgggaataggaattgccattggagtggttggtggcgtgttggtgaggattgtcctctgtgcgctaagggggggcctgcagcagtgacagcttcaagaacttaacagccttgctcctgaagaactggctgcccaggaagccaagctagctttttaggggagtgttccagctgctggtagtggatcagcttagagggaacactcccacagccaaaagaatgagtgggagaaatggaggggacaatctcctgggagctatgcgcagtaacctaacttccttatgtcccatggatctcttcctgatcttccctgcccattgggtacccaggaaactgcaagcattgcctgtgttcctgggaagagttctaagaagcttgcattcattttctaccctttatgacttggatgcctccccacctccatttcccctcttctgagctgtgtattcatgtagagggatgtattcagcctttttagtgaacattttttttcaataaaagtaattcacagtaaa

SEQ ID NO: 16193 - DNA, 383 bp, Homo sapiens
ggctgagaacagtcggtgcctgcggggtcgggggccgtgagaggagcggctttgggggcgggggcggggaggagcgggtccttagagtgggtggcagaagcggtggggtggaaccaggcagagcctgtagggtacagacgcgagatgggcggagctgggaagtggccttgtgggcggagctaagaggggcggggtcttatggggcggggcttgtggggcttttccagacagaagcacgtgggtccacacggtcagtgctagaccaacctttgaagctccagctgtgagtgggagccagcgttttctcaggagcattcctcagggaggaatcagggcttggaggcaaatcactgttgatctcatccggcctgactggcctctga

SEQ ID NO: 16194 - DNA, 933 bp, Homo sapiens
attgccatctgcaaatgagaaagccttcagccgacaccagactgccagtgcctttgatattggactttcagtccccagatctgtgaaaaattaatttatgttgtttaagacacctagcctgtggtattttgttatcgcaatcaaaactgactgagacaggcagtaaggagagaacagaggttccagcctgcttcaggtccaggcagttctgccattgcccctaactcctcagtgccagtcatgggccaggcccctgggggacttggaatgagtaaaacatgcacctattgttaaggttcacctggtccagaaggggaggcagacccacctgcccaccatgacccggacagaggcaataaatacggagcacctcatggccagggcctggaggattcccaccataccctacccagcgccaataacagagggaccctggagttgtgtacacaagatagcagttcagtgcttgcacacatactagttgagaagggaaatcagggctaatgaaacagctcaactgtctggcagagccaggctccttctgccatgatacagtttggatgtttgtccctttctaatcttatatggaaatttgatccccagtgttgaaggtggggcctggtgggagatgttcctgttatcgggatggatccttcatgaatagcctggtgccatctttgtggtaacaagtgagttctcacttgattagtttctgtgagaactgtttgttaaaaagagcctggtggcacctccctcccttcttcctccttctcttgctatgtgatgctgctgccctttgccttccgtcatgagtggaagctccctgaagcccccaccagaagcaaatgctggcaccatgctgcttgtacagcctgcagaactgtgagccaaataaacctcttttctttataaattactcagcctcaggtgtta

SEQ ID NO: 16195 - DNA, 4239 bp, Homo sapiens
gggaagcgctccgagggcgtccccgtgtcaggccccatgctcatcgagaaggccaaggacttctacgagcagatgcagctcactgagccctgcgtgttctccggagggtggctttggcgctttaaggccagacacggcattaaaaagctagatgcatccagtgaaaagcagtcagccgaccaccaggccgcggagcagttctgtgcgtttttcaggagcttggctgctgagcacgggctgtccgccgagcaggtttacaacgctgatgagaccggccttttctggcggtgcctgccaaatcccactccggaaggcggggctgtgcctggccccaagcagggcaaggaccggctgaccgtgctgatgtgtgccaacgccacgggctcccacaggctcaagcccttggccatcgggaagtgcagcggtcccagggctttcaaaggcatccagcacctgcccgtcgcctataaggcccaggggaatgcctgggtggacaaggagattttttccgattggttccatcatatctttgtgccctcggtgagagagcacttcagaaccataggtttgccggaagacagcaaagccgttctcttgctggacagctcccgggctcacccgcaggaggccgagctggtgtccagtaacgttttcaccatcttcctgcctgccagcgtggcctcattggtgcagcccatggagcagggcattcggagagatttcatgaggaacttcattaaccctccggtccccctgcagggcccccacgcccgctacaacatgaacgatgccatattcagcgtggcctgtgcctggaacgcagtccctagccacgtcttcaggcgggcctggaggaagctgtggccgtcggttgcgtttgccgaaggctcctcctctgaggaggagttggaggcagagtgcttcccagtgaagccccacaacaagtcctttgcacacatcctggagcttgtgaaggaaggctcctcctgcccgggccagcttcgccagcgccaggccgccagctggggggtagcgggaagggaggcagaagggggacggccccctgctgccacgtcgccagcagaggttgtgtggagttcagaaaagactccgaaagctgaccaggacggcggaggagatcctggtgagggcgaggaggtggcctgggagcaggcggccgtggcctttgacgcagtcctgcgctttgcggagcggcagccatgcttcagtgcgcaggaagtggggcagctgcgggcgctgcgtgccgtgttccggagccagcagcaggtgaggaggcggcgtggtgccctcggggctgtggtcaaggttgaagccctccaggagggccctggtggctgtggggccacagctcagtctcgcttgccctgctcatccacagcaggtgacaactgatggcttctctgccctgccctggccactggccctgtttctccccacaccctggagtggcatggtcctgtgccccgaccccacctgaggcaggagggcatgtgcagacactcaagagcccttccaggagtgggtcgcccacgggtgtggctcgggtgcccaggacggtctgtgcccgaggttcctgtcaatacaggttttattttatcacttgccgtgtcatccgaaagtgaggaaatgttttggaagggtccaccctagcctagaacaagccagagccgcaccctggctggaatgggggccaggctgagccgatctggtctcgtgttcgctggctgatcattgcagtatcagagggtggagatgtcagtctgtccacgtggagagaagttgccctccaggccgacaggaggccatgcccaccgcccctggacaggcttcgtctcagaaggctctatctgctgggctggcggccatccccgtgttgggtggaccccgagcacggttgcctgaggtccgatggcccgagagctgggactcagttcttggcctgctagcggctgaacaggccgcacatctcacttcagttgtggcctcattcagcagaatgactctggaaccatcctctgttacccgcagatcctgtcccatgggctctggccccaagatgttggggggccccacggagagttgacttggtagagttcctttctgggaagaaagtaggagtggctgaccaggccctgctcatcacccggatagaggacacggaccctgtgtggtattttggcattttggctcagagtccaatgtaccatgttgcccagaatttcatacttatggcctttacatgaatacgtcttgatcagacattcagagattagtcttaggtttgcacgtaagtcactgaaaacagtaaaacaggctgcttagatttctagcagtatgtgtgctcttatccccagctgttagcacgttagtaatacttttggggaggagttgtctgtcctggtcagttttcacagaggcggttgtaagaggatgtggttattttctccatgtctgtagttgctttgcggcatctccatttcacgggcaacactcactgcctgcagctgagattccagaacgccctgtgtccacagtgattagcctcgtctttcagcgagcataaaataggtgcattgtccttttcttttcttgaggcagggtctcactctgttgaccaggctggagtgaagtggtgtgatcccagctcactgcagcctcgacctccctggcttgagtgatcctcccgccccagcctcctgagtagctgggactagaggcacgcaccaccgcgcctacctttttattttttttgtagagacagggtctcactgtgttgcccaggctggtcttgaactcttggcctcaagcgatcctccttcctcatccttctaaagtgctgggattacaggtgtgagccacagcactcggcctaaataggtttttcttgctatgttattttcagtgctttgcccttgaattcttttcctctcttaaattcatatcatttggccgagtcagcacgtagtttgcattccagcgtctgctgttgattccactgaaacctctgttctcatgaaggagaggatttggctcgctgtggtttctcgtactttcacatctctgtagatacaggggcaaaagtcattgctgacagagccctatctatgtcctggaagtgtgtgtttcttgctttgaatgcatgtgtgaagattataaaagccaaatagtttttaaagatctcggtgctgaacgacagtcccagttcccatttgtgtcccacacaggcgaggatcgttgggcctccttagtagccaaaggaactgaggtccagagcagggaatgtgttgcccagtgtcagcatggtctgctctggggtcaggcgtcttgccctggtcctaagccaccccaagccaaggcatgtccctgggcccatttcctctctcgaggtcttgggttccctatttctgatgtgtgtgaaaggaaggcctgtcctctggggtgaccatgaggctcagtgggaggagctgccaggcttgagctgggacttggcacctggccagccttttttctatttcattgtaccttgatgggctgtcagttctgaagagaaaaaatacactaggaatccattcttcctccaccattctccctggcagagggaagtgactacacccctatggtgtggacatactgacgctcctccatgaagcagcaaagttctgttgtttcaggagactgtgggccttgaggatgtggtagtgacctcaccagaggagttggcaattcctaagtgctgcctggaggcctctacagagacataatgttggagaacttctgccacatggcagtgctgggtaagacccctctgtccccaccagtgcccttgaggttatgggtgttggtaggtctgtggcctccatttccatgacgatggtgttaaggactgcatgtttgtgtccccccccaaagtttatatgttgaaaccctgacccccaggagggtggtattaggaggtggggcctttgggaggtgactaggcttaggtgagatcgtgagggtggggctcgccgatgagatcgagtccttataagaaaaggaaggaactagagcgaggtcactttgtgctgtgtgagcatacaagaaaactgccatcttcaagctgggtgcagtggctcacgcctgtaatcccagcactggaaggccaaggcattaggattgcatgagtccaggagttcgagaccagcctaggcatgataagaccttattgctaaaaaaaaa

SEQ ID NO: 16196 - DNA, 1834 bp, Homo sapiens
gggaagcgctccgagggcgtccccgtgtcaggccccatgctcatcgagaaggccaaggacttctacgagcagatgcagctcactgagccctgcgtgttctccggagggtggctttggcgctttaaggccagacacggcattaaaaagctagatgcatccagtgaaaagcagtcagccgaccaccaggccgcggagcagttctgtgcgtttttcaggagcttggctgctgagcacgggctgtccgccgagcaggtttacaacgctgatgagaccggccttttctggcggtgcctgccaaatcccactccggaaggcggggctgtgcctggccccaagcagggcaaggaccggctgaccgtgctgatgtgtgccaacgccacgggctcccacaggctcaagcccttggccatcgggaagtgcagcggtcccagggctttcaaaggcatccagcacctgcccgtcgcctataaggcccaggggaatgcctgggtggacaaggagattttttccgattggttccatcatatctttgtgccctcggtgagagagcacttcagaaccataggtttgccggaagacagcaaagccgttctcttgctggacagctcccgggctcacccgcaggaggccgagctggtgtccagtaacgttttcaccatcttcctgcctgccagcgtggcctcattggtgcagcccatggagcagggcattcggagagatttcatgaggaacttcattaaccctccggtccccctgcagggcccccacgcccgctacaacatgaacgatgccatattcagcgtggcctgtgcctggaacgcagtccctagccacgtcttcaggcgggcctggaggaagctgtggccgtcggttgcgtttgccgaaggctcctcctctgaggaggagttggaggcagagtgcttcccagtgaagccccacaacaagtcctttgcacacatcctggagcttgtgaaggaaggctcctcctgcccgggccagcttcgccagcgccaggccgccagctggggggtagcgggaagggaggcagaagggggacggccccctgctgccacgtcgccagcagaggttgtgtggagttcagaaaagactccgaaagctgaccaggacggcggaggagatcctggtgagggcgaggaggtggcctgggagcaggcggccgtggcctttgacgcagtcctgcgctttgcggagcggcagccatgcttcagtgcgcaggaagtggggcagctgcgggcgctgcgtgccgtgttccggagccagcagcaggagactgtgggccttgaggatgtggtagtgacctcaccagaggagttggcaattcctaagtgctgcctggaggcctctacagagacataatgttggagaacttctgccacatggcagtgctgggtaagacccctctgtccccaccagtgcccttgaggttatgggtgttggtaggtctgtggcctccatttccatgacgatggtgttaaggactgcatgtttgtgtccccccccaaagtttatatgttgaaaccctgacccccaggagggtggtattaggaggtggggcctttgggaggtgactaggcttaggtgagatcgtgagggtggggctcgccgatgagatcgagtccttataagaaaaggaaggaactagagcgaggtcactttgtgctgtgtgagcatacaagaaaactgccatcttcaagctgggtgcagtggctcacgcctgtaatcccagcactggaaggccaaggcattaggattgcatgagtccaggagttcgagaccagcctaggcatgataagaccttattgctaaaaaaaaa

SEQ ID NO: 16197 - DNA, 7371 bp, Homo sapiens
gggaagcgctccgagggcgtccccgtgtcaggccccatgctcatcgagaaggccaaggacttctacgagcagatgcagctcactgagccctgcgtgttctccggagggtggctttggcgctttaaggccagacacggcattaaaaagctagatgcatccagtgaaaagcagtcagccgaccaccaggccgcggagcagttctgtgcgtttttcaggagcttggctgctgagcacgggctgtccgccgagcaggtttacaacgctgatgagaccggccttttctggcggtgcctgccaaatcccactccggaaggcggggctgtgcctggccccaagcagggcaaggaccggctgaccgtgctgatgtgtgccaacgccacgggctcccacaggctcaagcccttggccatcgggaagtgcagcggtcccagggctttcaaaggcatccagcacctgcccgtcgcctataaggcccaggggaatgcctgggtggacaaggagattttttccgattggttccatcatatctttgtgccctcggtgagagagcacttcagaaccataggtttgccggaagacagcaaagccgttctcttgctggacagctcccgggctcacccgcaggaggccgagctggtgtccagtaacgttttcaccatcttcctgcctgccagcgtggcctcattggtgcagcccatggagcagggcattcggagagatttcatgaggaacttcattaaccctccggtccccctgcagggcccccacgcccgctacaacatgaacgatgccatattcagcgtggcctgtgcctggaacgcagtccctagccacgtcttcaggcgggcctggaggaagctgtggccgtcggttgcgtttgccgaaggctcctcctctgaggaggagttggaggcagagtgcttcccagtgaagccccacaacaagtcctttgcacacatcctggagcttgtgaaggaaggctcctcctgcccgggccagcttcgccagcgccaggccgccagctggggggtagcgggaagggaggcagaagggggacggccccctgctgccacgtcgccagcagaggttgtgtggagttcagaaaagactccgaaagctgaccaggacggcggaggagatcctggtgagggcgaggaggtggcctgggagcaggcggccgtggcctttgacgcagtcctgcgctttgcggagcggcagccatgcttcagtgcgcaggaagtggggcagctgcgggcgctgcgtgccgtgttccggagccagcagcaggtgaggaggcggcgtggtgccctcggggctgtggtcaaggttgaagccctccaggagggccctggtggctgtggggccacagctcagtctcgcttgccctgctcatccacagcaggtgacaactgatggcttctctgccctgccctggccactggccctgtttctccccacaccctggagtggcatggtcctgtgccccgaccccacctgaggcaggagggcatgtgcagacactcaagagcccttccaggagtgggtcgcccacgggtgtggctcgggtgcccaggacggtctgtgcccgaggttcctgtcaatacaggttttattttatcacttgccgtgtcatccgaaagtgaggaaatgttttggaagggtccaccctagcctagaacaagccagagccgcaccctggctggaatgggggccaggctgagccgatctggtctcgtgttcgctggctgatcattgcagtatcagagggtggagatgtcagtctgtccacgtggagagaagttgccctccaggccgacaggaggccatgcccaccgcccctggacaggcttcgtctcagaaggctctatctgctgggctggcggccatccccgtgttgggtggaccccgagcacggttgcctgaggtccgatggcccgagagctgggactcagttcttggcctgctagcggctgaacaggccgcacatctcacttcagttgtggcctcattcagcagaatgactctggaaccatcctctgttacccgcagatcctgtcccatgggctctggccccaagatgttggggggccccacggagagttgacttggtagagttcctttctgggaagaaagtaggagtggctgaccaggccctgctcatcacccggatagaggacacggaccctgtgtggtattttggcattttggctcagagtccaatgtaccatgttgcccagaatttcatacttatggcctttacatgaatacgtcttgatcagacattcagagattagtcttaggtttgcacgtaagtcactgaaaacagtaaaacaggctgcttagatttctagcagtatgtgtgctcttatccccagctgttagcacgttagtaatacttttggggaggagttgtctgtcctggtcagttttcacagaggcggttgtaagaggatgtggttattttctccatgtctgtagttgctttgcggcatctccatttcacgggcaacactcactgcctgcagctgagattccagaacgccctgtgtccacagtgattagcctcgtctttcagcgagcataaaataggtgcattgtccttttcttttcttgaggcagggtctcactctgttgaccaggctggagtgaagtggtgtgatcccagctcactgcagcctcgacctccctggcttgagtgatcctcccgccccagcctcctgagtagctgggactagaggcacgcaccaccgcgcctacctttttattttttttgtagagacagggtctcactgtgttgcccaggctggtcttgaactcttggcctcaagcgatcctccttcctcatccttctaaagtgctgggattacaggtgtgagccacagcactcggcctaaataggtttttcttgctatgttattttcagtgctttgcccttgaattcttttcctctcttaaattcatatcatttggccgagtcagcacgtagtttgcattccagcgtctgctgttgattccactgaaacctctgttctcatgaaggagaggatttggctcgctgtggtttctcgtactttcacatctctgtagatacaggggcaaaagtcattgctgacagagccctatctatgtcctggaagtgtgtgtttcttgctttgaatgcatgtgtgaagattataaaagccaaatagtttttaaagatctcggtgctgaacgacagtcccagttcccatttgtgtcccattgtctttgtggtgtcacccgcactgtttgcttcattgtctggggaacttctgcacatcatgtactttgtgccatttctgggctcacgtgtcactcctaatagagcctcttaaccaagactgctggattgcagctgcttgaggcaacacaggaggttagaacatgtcccgagggctctgaaacagtaggacatcctgggtgggtggagctggggagggcatgggcaggccagctggccgagctcctggctggctctcctgagtcctctggacatggcttgtccctgtcagactgtagctcttcaggacctgagctcttcccgttcttgacctgctcttgtgctgactgtgctgggctgatgggtaggcgcttgtccccagtgagtggctgtgtcctcagggtgcccctcttccagaccaactgcagcaaggcctggagcctgactctaggtgcagcccttgtggctggaatcccttgtgccacccaggggactcgggccctgctcctcctgcagcccctcctcacctgggctcgctgctggagtgaggtttttagggagcccagagcgtactcatctctgagctgctgggcccagctgcctggtgcatacctcttgcctcggtcctgtcccccagaacgctttatggagactgccgtgtcctccgagcactttgttttcacttcctgacccgtctcagaagctcaagtggttgaatgttttagcctcagaatctttttccccaagccctctcaggtggagccccgctgtaccagacaccacagcacagctctgtgaggctgtgtctcttcactctgtttctggggctgctgaggcccctgggaagccctggagcttgccagagcagagcgagaaagtctctggtcctgtttaaatgcctccgcgttttatctgtgagcaccaggctggagccactccctgtcttctcacagtgcccctgcaagttgcagcctcagttttccagtggctcgtggggtagcaggtgctgcgtcatatggtttgggacctctgtggctgcttccagcctgctaatagaacctctttccaccactgccttcatctttggggtggcacccctgagtgctcaggcctgagggcgctcctgtgtcctcactcgggacaggcagcctccactctgggagctcccatccctcgggatgcccaggagaggccatactttcagggtggcatggtgaattcaggggttaggatgggtaggtggtctttcagccccttctacgttggggttggtttacagaacacctgtcctgcctgtgccagcctggccttctgcgagcaccccaggcacgctgtcctggaagttgtctgtctcctgcataggagggtctagagcagaccttgccctgggcctgtctgtgcgtgacttccatatgcttcattcgtgctcagccatggctgagcatgcgatggagagcacctggactgcccctgacgtcgcaggccactgttcttatccagtgggccaagtgattgattgctagtggtggggttgattggaagaaaggaagtcgcagcccctgcccacggcttccccagctcgctggggttggaggactgtcatcagttgtccccagttaaagtccatttggaggaggttcagggtcccagtggctggatgtgcttgtggagggacacggtttgaggcaggggtttgcagaaggtgtagactgcatccattcttgggaggctgtggcacagggcagcgacaacttgggacaaatcaagacccgtccacactgcacctcagggacctcacctcacgccccacataaatgtgcttattggggatccgggtgtggtggcttctgcctgaaatcccagtactctggaaggccacggcaggaggatcactttagttcaggagtttgaaaccagcctgggcaacatagggagaccccatctctacagaaagtaaaagaaaatgagccaggtgtggtggcatgtgcctgtaaccccagctactcaggaggccgaggcgggaggatccccaagcccaggagtttgaggctgcagtgagttatggcctctgcactccagcctgggtgacagagtgagagacctaatctctaaaaacaaaaaataacaaaatgtgctttggggtcaggtgtggagatcagggtcggggaggtcatgaggtaggtaggggtcaggatgtggacagtcatgggctggtgggtgtggcagccgtgaggggtgggtggtggcctgggaggcagggcctgggcagggcttctgcacttctgctgcttacccagccccctctgggttcgaggactctccttgacaagggctgagctctcgggcactgcgttggactcagctgcctactgggaggctggggagaatggacctgtgagaccttgtttgtcctcttccctgcccagctcttgtagaccccaggcctggctgtccgcagggccaggagctgcagccatggcagccaccagcctcccacatgagccccagctcccagccccacacgcccactcctttgcccatgtggtgtcagctctggcctccgcttccacacatggaccctcagaccttgcacatctgttgtttcccttgcagggcagtgatgatgacatgaaatgaggtggggtcactcctgtttagggatgagactggggcccagggaggggcaggtgtgaagttgctgagggcagagggagacccagggctacctgctcctaatgaccagcctcacgttctccactgctcactccctgccgttcaccagctgcatgaccttgagcagtgcactcaactgtaaacagaggtgaaaacactcctttaccaactgttttaggggccactcttgtttgaggccttgaacctcctttcagttccgtggtggtcctgagcctctgaatctgggtatggcccctgctgggtcctggtctcttaggcagcacgatggcctccctgctcaaggccctgcacccaggggcagattgtgggaggcccactggccatggctgggccctatcgcagagagcctgtcagcacggccatttccacacccaggctggctgggaagcaagctacgaggtgctcaaaggccctctatgtctgcaggtagccccgtcccacacaggcgaggatcgttgggcctccttagtagccaaaggaactgaggtccagagcagggaatgtgttgcccagtgtcagcatggtctgctctggggtcaggcgtcttgccctggtcctaagccaccccaagccaaggcatgtccctgggcccatttcctctctcgaggtcttgggttccctatttctgatgtgtgtgaaaggaaggcctgtcctctggggtgaccatgaggctcagtgggaggagctgccaggcttgagctgggacttggcacctggccagccttttttctatttcattgtaccttgatgggctgtcagttctgaagagaaaaaatacactaggaatccattcttcctccaccattctccctggcagagggaagtgactacacccctatggtgtggacatactgacgctcctccatgaagcagcaaagttctgttgtttcaggagactgtgggccttgaggatgtggtagtgacctcaccagaggagttggcaattcctaagtgctgcctggaggcctctacagagacataatgttggagaacttctgccacatggcagtgctgggtaagacccctctgtccccaccagtgcccttgaggttatgggtgttggtaggtctgtggcctccatttccatgacgatggtgttaaggactgcatgtttgtgtccccccccaaagtttatatgttgaaaccctgacccccaggagggtggtattaggaggtggggcctttgggaggtgactaggcttaggtgagatcgtgagggtggggctcgccgatgagatcgagtccttataagaaaaggaaggaactagagcgaggtcactttgtgctgtgtgagcatacaagaaaactgccatcttcaagctgggtgcagtggctcacgcctgtaatcccagcactggaaggccaaggcattaggattgcatgagtccaggagttcgagaccagcctaggcatgataagaccttattgctaaaaaaaaa

SEQ ID NO: 16198 - DNA, 6155 bp, Homo sapiens
taggctaggtacgaggcctggtgttaatcggccgaggggcgctgcgtgccgtgttccggagccagcagcaggtgaggaggcggcgtggtgccctcggggctgtggtcaaggttgaagccctccaggagggccctggtggctgtggggccacagctcagtctcgcttgccctgctcatccacagcaggtgacaactgatggcttctctgccctgccctggccactggccctgtttctccccacaccctggagtggcatggtcctgtgccccgaccccacctgaggcaggagggcatgtgcagacactcaagagcccttccaggagtgggtcgcccacgggtgtggctcgggtgcccaggacggtctgtgcccgaggttcctgtcaatacaggttttattttatcacttgccgtgtcatccgaaagtgaggaaatgttttggaagggtccaccctagcctagaacaagccagagccgcaccctggctggaatgggggccaggctgagccgatctggtctcgtgttcgctggctgatcattgcagtatcagagggtggagatgtcagtctgtccacgtggagagaagttgccctccaggccgacaggaggccatgcccaccgcccctggacaggcttcgtctcagaaggctctatctgctgggctggcggccatccccgtgttgggtggaccccgagcacggttgcctgaggtccgatggcccgagagctgggactcagttcttggcctgctagcggctgaacaggccgcacatctcacttcagttgtggcctcattcagcagaatgactctggaaccatcctctgttacccgcagatcctgtcccatgggctctggccccaagatgttggggggccccacggagagttgacttggtagagttcctttctgggaagaaagtaggagtggctgaccaggccctgctcatcacccggatagaggacacggaccctgtgtggtattttggcattttggctcagagtccaatgtaccatgttgcccagaatttcatacttatggcctttacatgaatacgtcttgatcagacattcagagattagtcttaggtttgcacgtaagtcactgaaaacagtaaaacaggctgcttagatttctagcagtatgtgtgctcttatccccagctgttagcacgttagtaatacttttggggaggagttgtctgtcctggtcagttttcacagaggcggttgtaagaggatgtggttattttctccatgtctgtagttgctttgcggcatctccatttcacgggcaacactcactgcctgcagctgagattccagaacgccctgtgtccacagtgattagcctcgtctttcagcgagcataaaataggtgcattgtccttttcttttcttgaggcagggtctcactctgttgaccaggctggagtgaagtggtgtgatcccagctcactgcagcctcgacctccctggcttgagtgatcctcccgccccagcctcctgagtagctgggactagaggcacgcaccaccgcgcctacctttttattttttttgtagagacagggtctcactgtgttgcccaggctggtcttgaactcttggcctcaagcgatcctccttcctcatccttctaaagtgctgggattacaggtgtgagccacagcactcggcctaaataggtttttcttgctatgttattttcagtgctttgcccttgaattcttttcctctcttaaattcatatcatttggccgagtcagcacgtagtttgcattccagcgtctgctgttgattccactgaaacctctgttctcatgaaggagaggatttggctcgctgtggtttctcgtactttcacatctctgtagatacaggggcaaaagtcattgctgacagagccctatctatgtcctggaagtgtgtgtttcttgctttgaatgcatgtgtgaagattataaaagccaaatagtttttaaagatctcggtgctgaacgacagtcccagttcccatttgtgtcccattgtctttgtggtgtcacccgcactgtttgcttcattgtctggggaacttctgcacatcatgtactttgtgccatttctgggctcacgtgtcactcctaatagagcctcttaaccaagactgctggattgcagctgcttgaggcaacacaggaggttagaacatgtcccgagggctctgaaacagtaggacatcctgggtgggtggagctggggagggcatgggcaggccagctggccgagctcctggctggctctcctgagtcctctggacatggcttgtccctgtcagactgtagctcttcaggacctgagctcttcccgttcttgacctgctcttgtgctgactgtgctgggctgatgggtaggcgcttgtccccagtgagtggctgtgtcctcagggtgcccctcttccagaccaactgcagcaaggcctggagcctgactctaggtgcagcccttgtggctggaatcccttgtgccacccaggggactcgggccctgctcctcctgcagcccctcctcacctgggctcgctgctggagtgaggtttttagggagcccagagcgtactcatctctgagctgctgggcccagctgcctggtgcatacctcttgcctcggtcctgtcccccagaacgctttatggagactgccgtgtcctccgagcactttgttttcacttcctgacccgtctcagaagctcaagtggttgaatgttttagcctcagaatctttttccccaagccctctcaggtggagccccgctgtaccagacaccacagcacagctctgtgaggctgtgtctcttcactctgtttctggggctgctgaggcccctgggaagccctggagcttgccagagcagagcgagaaagtctctggtcctgtttaaatgcctccgcgttttatctgtgagcaccaggctggagccactccctgtcttctcacagtgcccctgcaagttgcagcctcagttttccagtggctcgtggggtagcaggtgctgcgtcatatggtttgggacctctgtggctgcttccagcctgctaatagaacctctttccaccactgccttcatctttggggtggcacccctgagtgctcaggcctgagggcgctcctgtgtcctcactcgggacaggcagcctccactctgggagctcccatccctcgggatgcccaggagaggccatactttcagggtggcatggtgaattcaggggttaggatgggtaggtggtctttcagccccttctacgttggggttggtttacagaacacctgtcctgcctgtgccagcctggccttctgcgagcaccccaggcacgctgtcctggaagttgtctgtctcctgcataggagggtctagagcagaccttgccctgggcctgtctgtgcgtgacttccatatgcttcattcgtgctcagccatggctgagcatgcgatggagagcacctggactgcccctgacgtcgcaggccactgttcttatccagtgggccaagtgattgattgctagtggtggggttgattggaagaaaggaagtcgcagcccctgcccacggcttccccagctcgctggggttggaggactgtcatcagttgtccccagttaaagtccatttggaggaggttcagggtcccagtggctggatgtgcttgtggagggacacggtttgaggcaggggtttgcagaaggtgtagactgcatccattcttgggaggctgtggcacagggcagcgacaacttgggacaaatcaagacccgtccacactgcacctcagggacctcacctcacgccccacataaatgtgcttattggggatccgggtgtggtggcttctgcctgaaatcccagtactctggaaggccacggcaggaggatcactttagttcaggagtttgaaaccagcctgggcaacatagggagaccccatctctacagaaagtaaaagaaaatgagccaggtgtggtggcatgtgcctgtaaccccagctactcaggaggccgaggcgggaggatccccaagcccaggagtttgaggctgcagtgagttatggcctctgcactccagcctgggtgacagagtgagagacctaatctctaaaaacaaaaaataacaaaatgtgctttggggtcaggtgtggagatcagggtcggggaggtcatgaggtaggtaggggtcaggatgtggacagtcatgggctggtgggtgtggcagccgtgaggggtgggtggtggcctgggaggcagggcctgggcagggcttctgcacttctgctgcttacccagccccctctgggttcgaggactctccttgacaagggctgagctctcgggcactgcgttggactcagctgcctactgggaggctggggagaatggacctgtgagaccttgtttgtcctcttccctgcccagctcttgtagaccccaggcctggctgtccgcagggccaggagctgcagccatggcagccaccagcctcccacatgagccccagctcccagccccacacgcccactcctttgcccatgtggtgtcagctctggcctccgcttccacacatggaccctcagaccttgcacatctgttgtttcccttgcagggcagtgatgatgacatgaaatgaggtggggtcactcctgtttagggatgagactggggcccagggaggggcaggtgtgaagttgctgagggcagagggagacccagggctacctgctcctaatgaccagcctcacgttctccactgctcactccctgccgttcaccagctgcatgaccttgagcagtgcactcaactgtaaacagaggtgaaaacactcctttaccaactgttttaggggccactcttgtttgaggccttgaacctcctttcagttccgtggtggtcctgagcctctgaatctgggtatggcccctgctgggtcctggtctcttaggcagcacgatggcctccctgctcaaggccctgcacccaggggcagattgtgggaggcccactggccatggctgggccctatcgcagagagcctgtcagcacggccatttccacacccaggctggctgggaagcaagctacgaggtgctcaaaggccctctatgtctgcaggtagccccgtcccacacaggcgaggatcgttgggcctccttagtagccaaaggaactgaggtccagagcagggaatgtgttgcccagtgtcagcatggtctgctctggggtcaggcgtcttgccctggtcctaagccaccccaagccaaggcatgtccctgggcccatttcctctctcgaggtcttgggttccctatttctgatgtgtgtgaaaggaaggcctgtcctctggggtgaccatgaggctcagtgggaggagctgccaggcttgagctgggacttggcacctggccagccttttttctatttcattgtaccttgatgggctgtcagttctgaagagaaaaaatacactaggaatccattcttcctccaccattctccctggcagagggaagtgactacacccctatggtgtggacatactgacgctcctccatgaagcagcaaagttctgttgtttcaggagactgtgggccttgaggatgtggtagtgacctcaccagaggagttggcaattcctaagtgctgcctggaggcctctacagagacataatgttggagaacttctgccacatggcagtgctgggtaagacccctctgtccccaccagtgcccttgaggttatgggtgttggtaggtctgtggcctccatttccatgacgatggtgttaaggactgcatgtttgtgtccccccccaaagtttatatgttgaaaccctgacccccaggagggtggtattaggaggtggggcctttgggaggtgactaggcttaggtgagatcgtgagggtggggctcgccgatgagatcgagtccttataagaaaaggaaggaactagagcgaggtcactttgtgctgtgtgagcatacaagaaaactgccatcttcaagctgggtgcagtggctcacgcctgtaatcccagcactggaaggccaaggcattaggattgcatgagtccaggagttcgagaccagcctaggcatgataagaccttattgctaaaaaaaaa

SEQ ID NO: 16199 - DNA, 7585 bp, Homo sapiens
gggaagcgctccgagggcgtccccgtgtcaggccccatgctcatcgagaaggccaaggacttctacgagcagatgcagctcactgagccctgcgtgttctccggagggtggctttggcgctttaaggccagacacggcattaaaaagctagatgcatccagtgaaaagcagtcagccgaccaccaggccgcggagcagttctgtgcgtttttcaggagcttggctgctgagcacgggctgtccgccgagcaggtttacaacgctgatgagaccggccttttctggcggtgcctgccaaatcccactccggaaggcggggctgtgcctggccccaagcagggcaaggaccggctgaccgtgctgatgtgtgccaacgccacgggctcccacaggctcaagcccttggccatcgggaagtgcagcggtcccagggctttcaaaggcatccagcacctgcccgtcgcctataaggcccaggggaatgcctgggtggacaaggagattttttccgattggttccatcatatctttgtgccctcggtgagagagcacttcagaaccataggtttgccggaagacagcaaagccgttctcttgctggacagctcccgggctcacccgcaggaggccgagctggtgtccagtaacgttttcaccatcttcctgcctgccagcgtggcctcattggtgcagcccatggagcagggcattcggagagatttcatgaggaacttcattaaccctccggtccccctgcagggcccccacgcccgctacaacatgaacgatgccatattcagcgtggcctgtgcctggaacgcagtccctagccacgtcttcaggcgggcctggaggaagctgtggccgtcggttgcgtttgccgaaggctcctcctctgaggaggagttggaggcagagtgcttcccagtgaagccccacaacaagtcctttgcacacatcctggagcttgtgaaggaaggctcctcctgcccgggccagcttcgccagcgccaggccgccagctggggggtagcgggaagggaggcagaagggggacggccccctgctgccacgtcgccagcagaggttgtgtggagttcagaaaagactccgaaagctgaccaggacggcggaggagatcctggtgagggcgaggaggtggcctgggagcaggcggccgtggcctttgacgcagtcctgcgctttgcggagcggcagccatgcttcagtgcgcaggaagtggggcagctgcgggcgctgcgtgccgtgttccggagccagcagcaggtgaggaggcggcgtggtgccctcggggctgtggtcaaggttgaagccctccaggagggccctggtggctgtggggccacagctcagtctcgcttgccctgctcatccacagcaggtgacaactgatggcttctctgccctgccctggccactggccctgtttctccccacaccctggagtggcatggtcctgtgccccgaccccacctgaggcaggagggcatgtgcagacactcaagagcccttccaggagtgggtcgcccacgggtgtggctcgggtgcccaggacggtctgtgcccgaggttcctgtcaatacaggttttattttatcacttgccgtgtcatccgaaagtgaggaaatgttttggaagggtccaccctagcctagaacaagccagagccgcaccctggctggaatgggggccaggctgagccgatctggtctcgtgttcgctggctgatcattgcagtatcagagggtggagatgtcagtctgtccacgtggagagaagttgccctccaggccgacaggaggccatgcccaccgcccctggacaggcttcgtctcagaaggctctatctgctgggctggcggccatccccgtgttgggtggaccccgagcacggttgcctgaggtccgatggcccgagagctgggactcagttcttggcctgctagcggctgaacaggccgcacatctcacttcagttgtggcctcattcagcagaatgactctggaaccatcctctgttacccgcagatcctgtcccatgggctctggccccaagatgttggggggccccacggagagttgacttggtagagttcctttctgggaagaaagtaggagtggctgaccaggccctgctcatcacccggatagaggacacggaccctgtgtggtattttggcattttggctcagagtccaatgtaccatgttgcccagaatttcatacttatggcctttacatgaatacgtcttgatcagacattcagagattagtcttaggtttgcacgtaagtcactgaaaacagtaaaacaggctgcttagatttctagcagtatgtgtgctcttatccccagctgttagcacgttagtaatacttttggggaggagttgtctgtcctggtcagttttcacagaggcggttgtaagaggatgtggttattttctccatgtctgtagttgctttgcggcatctccatttcacgggcaacactcactgcctgcagctgagattccagaacgccctgtgtccacagtgattagcctcgtctttcagcgagcataaaataggtgcattgtccttttcttttcttgaggcagggtctcactctgttgaccaggctggagtgaagtggtgtgatcccagctcactgcagcctcgacctccctggcttgagtgatcctcccgccccagcctcctgagtagctgggactagaggcacgcaccaccgcgcctacctttttattttttttgtagagacagggtctcactgtgttgcccaggctggtcttgaactcttggcctcaagcgatcctccttcctcatccttctaaagtgctgggattacaggtgtgagccacagcactcggcctaaataggtttttcttgctatgttattttcagtgctttgcccttgaattcttttcctctcttaaattcatatcatttggccgagtcagcacgtagtttgcattccagcgtctgctgttgattccactgaaacctctgttctcatgaaggagaggatttggctcgctgtggtttctcgtactttcacatctctgtagatacaggggcaaaagtcattgctgacagagccctatctatgtcctggaagtgtgtgtttcttgctttgaatgcatgtgtgaagattataaaagccaaatagtttttaaagatctcggtgctgaacgacagtcccagttcccatttgtgtcccattgtctttgtggtgtcacccgcactgtttgcttcattgtctggggaacttctgcacatcatgtactttgtgccatttctgggctcacgtgtcactcctaatagagcctcttaaccaagactgctggattgcagctgcttgaggcaacacaggaggttagaacatgtcccgagggctctgaaacagtaggacatcctgggtgggtggagctggggagggcatgggcaggccagctggccgagctcctggctggctctcctgagtcctctggacatggcttgtccctgtcagactgtagctcttcaggacctgagctcttcccgttcttgacctgctcttgtgctgactgtgctgggctgatgggtaggcgcttgtccccagtgagtggctgtgtcctcagggtgcccctcttccagaccaactgcagcaaggcctggagcctgactctaggtgcagcccttgtggctggaatcccttgtgccacccaggggactcgggccctgctcctcctgcagcccctcctcacctgggctcgctgctggagtgaggtttttagggagcccagagcgtactcatctctgagctgctgggcccagctgcctggtgcatacctcttgcctcggtcctgtcccccagaacgctttatggagactgccgtgtcctccgagcactttgttttcacttcctgacccgtctcagaagctcaagtggttgaatgttttagcctcagaatctttttccccaagccctctcaggtggagccccgctgtaccagacaccacagcacagctctgtgaggctgtgtctcttcactctgtttctggggctgctgaggcccctgggaagccctggagcttgccagagcagagcgagaaagtctctggtcctgtttaaatgcctccgcgttttatctgtgagcaccaggctggagccactccctgtcttctcacagtgcccctgcaagttgcagcctcagttttccagtggctcgtggggtagcaggtgctgcgtcatatggtttgggacctctgtggctgcttccagcctgctaatagaacctctttccaccactgccttcatctttggggtggcacccctgagtgctcaggcctgagggcgctcctgtgtcctcactcgggacaggcagcctccactctgggagctcccatccctcgggatgcccaggagaggccatactttcagggtggcatggtgaattcaggggttaggatgggtaggtggtctttcagccccttctacgttggggttggtttacagaacacctgtcctgcctgtgccagcctggccttctgcgagcaccccaggcacgctgtcctggaagttgtctgtctcctgcataggagggtctagagcagaccttgccctgggcctgtctgtgcgtgacttccatatgcttcattcgtgctcagccatggctgagcatgcgatggagagcacctggactgcccctgacgtcgcaggccactgttcttatccagtgggccaagtgattgattgctagtggtggggttgattggaagaaaggaagtcgcagcccctgcccacggcttccccagctcgctggggttggaggactgtcatcagttgtccccagttaaagtccatttggaggaggttcagggtcccagtggctggatgtgcttgtggagggacacggtttgaggcaggggtttgcagaaggtgtagactgcatccattcttgggaggctgtggcacagggcagcgacaacttgggacaaatcaagacccgtccacactgcacctcagggacctcacctcacgccccacataaatgtgcttattggggatccgggtgtggtggcttctgcctgaaatcccagtactctggaaggccacggcaggaggatcactttagttcaggagtttgaaaccagcctgggcaacatagggagaccccatctctacagaaagtaaaagaaaatgagccaggtgtggtggcatgtgcctgtaaccccagctactcaggaggccgaggcgggaggatccccaagcccaggagtttgaggctgcagtgagttatggcctctgcactccagcctgggtgacagagtgagagacctaatctctaaaaacaaaaaataacaaaatgtgctttggggtcaggtgtggagatcagggtcggggaggtcatgaggtaggtaggggtcaggatgtggacagtcatgggctggtgggtgtggcagccgtgaggggtgggtggtggcctgggaggcagggcctgggcagggcttctgcacttctgctgcttacccagccccctctgggttcgaggactctccttgacaagggctgagctctcgggcactgcgttggactcagctgcctactgggaggctggggagaatggacctgtgagaccttgtttgtcctcttccctgcccagctcttgtagaccccaggcctggctgtccgcagggccaggagctgcagccatggcagccaccagcctcccacatgagccccagctcccagccccacacgcccactcctttgcccatgtggtgtcagctctggcctccgcttccacacatggaccctcagaccttgcacatctgttgtttcccttgcagggcagtgatgatgacatgaaatgaggtggggtcactcctgtttagggatgagactggggcccagggaggggcaggtgtgaagttgctgagggcagagggagacccagggctacctgctcctaatgaccagcctcacgttctccactgctcactccctgccgttcaccagctgcatgaccttgagcagtgcactcaactgtaaacagaggtgaaaacactcctttaccaactgttttaggggccactcttgtttgaggccttgaacctcctttcagttccgtggtggtcctgagcctctgaatctgggtatggcccctgctgggtcctggtctcttaggcagcacgatggcctccctgctcaaggccctgcacccaggggcagattgtgggaggcccactggccatggctgggccctatcgcagagagcctgtcagcacggccatttccacacccaggctggctgggaagcaagctacgaggtgctcaaaggccctctatgtctgcaggtagccccgtcccacacaggcgaggatcgttgggcctccttagtagccaaaggaactgaggtccagagcagggaatgtgttgcccagtgtcagcatggtctgctctggggtcaggcgtcttgccctggtcctaagccaccccaagccaaggcatgtccctgggcccatttcctctctcgaggtcttgggttccctatttctgatgtgtgtgaaaggaaggcctgtcctctggggtgaccatgaggctcagtgggaggagctgccaggcttgagctgggacttggcacctggccagccttttttctatttcattgtaccttgatgggctgtcagttctgaagagaaaaaatacactaggaatccattcttcctccaccattctccctggcagagggaagtgactacacccctatggtgtggacatactgacgctcctccatgaagcagcaaagttctgttgtttcaggagactgtgggccttgaggatgtggtagtgacctcaccagaggagttggcaattcctaagtgctgcctggaggcctctacagagacataatgttggagaacttctgccacatggcagtgctgggttcacctggtccagaaggggaggcagacccacctgcccaccatgacccggacagaggcaataaatacggagcacctcatggccagggcctggaggattcccaccataccctacccagcgccaataacagagggaccctggagttgtgtacacaagatagcagttcagtgcttgcacacatactagttgagaagggaaatcagggctaatgaaacagctcaactgtctggcagagccaggctccttctgccatgatacagtttggatgtttgtccctttctaatcttatatggaaatttgatccccagtgttgaaggtggggcctggtgggagatgttcctgttatcgggatggatccttcatgaatagcctggtgccatctttgtggtaacaagtgagttctcacttgattagtttctgtgagaactgtttgttaaaaagagcctggtggcacctccctcccttcttcctccttctcttgctatgtgatgctgctgccctttgccttccgtcatgagtggaagctccctgaagcccccaccagaagcaaatgctggcaccatgctgcttgtacagcctgcagaactgtgagccaaataaacctcttttctttataaattactcagcctcaggtgtta

SEQ ID NO: 16200 - DNA, 5188 bp, Homo sapiens
gggaagcgctccgagggcgtccccgtgtcaggccccatgctcatcgagaaggccaaggacttctacgagcagatgcagctcactgagccctgcgtgttctccggagggtggctttggcgctttaaggccagacacggcattaaaaagctagatgcatccagtgaaaagcagtcagccgaccaccaggccgcggagcagttctgtgcgtttttcaggagcttggctgctgagcacgggctgtccgccgagcaggtttacaacgctgatgagaccggccttttctggcggtgcctgccaaatcccactccggaaggcggggctgtgcctggccccaagcagggcaaggaccggctgaccgtgctgatgtgtgccaacgccacgggctcccacaggctcaagcccttggccatcgggaagtgcagcggtcccagggctttcaaaggcatccagcacctgcccgtcgcctataaggcccaggggaatgcctgggtggacaaggagattttttccgattggttccatcatatctttgtgccctcggtgagagagcacttcagaaccataggtttgccggaagacagcaaagccgttctcttgctggacagctcccgggctcacccgcaggaggccgagctggtgtccagtaacgttttcaccatcttcctgcctgccagcgtggcctcattggtgcagcccatggagcagggcattcggagagatttcatgaggaacttcattaaccctccggtccccctgcagggcccccacgcccgctacaacatgaacgatgccatattcagcgtggcctgtgcctggaacgcagtccctagccacgtcttcaggcgggcctggaggaagctgtggccgtcggttgcgtttgccgaaggctcctcctctgaggaggagttggaggcagagtgcttcccagtgaagccccacaacaagtcctttgcacacatcctggagcttgtgaaggaaggctcctcctgcccgggccagcttcgccagcgccaggccgccagctggggggtagcgggaagggaggcagaagggggacggccccctgctgccacgtcgccagcagaggttgtgtggagttcagaaaagactccgaaagctgaccaggacggcggaggagatcctggtgagggcgaggaggtggcctgggagcaggcggccgtggcctttgacgcagtcctgcgctttgcggagcggcagccatgcttcagtgcgcaggaagtggggcagctgcgggcgctgcgtgccgtgttccggagccagcagcaggtgaggaggcggcgtggtgccctcggggctgtggtcaaggttgaagccctccaggagggccctggtggctgtggggccacagctcagtctcgcttgccctgctcatccacagcaggtgacaactgatggcttctctgccctgccctggccactggccctgtttctccccacaccctggagtggcatggtcctgtgccccgaccccacctgaggcaggagggcatgtgcagacactcaagagcccttccaggagtgggtcgcccacgggtgtggctcgggtgcccaggacggtctgtgcccgaggttcctgtcaatacaggttttattttatcacttgccgtgtcatccgaaagtgaggaaatgttttggaagggtccaccctagcctagaacaagccagagccgcaccctggctggaatgggggccaggctgagccgatctggtctcgtgttcgctggctgatcattgcagtatcagagggtggagatgtcagtctgtccacgtggagagaagttgccctccaggccgacaggaggccatgcccaccgcccctggacaggcttcgtctcagaaggctctatctgctgggctggcggccatccccgtgttgggtggaccccgagcacggttgcctgaggtccgatggcccgagagctgggactcagttcttggcctgctagcggctgaacaggccgcacatctcacttcagttgtggcctcattcagcagaatgactctggaaccatcctctgttacccgcagatcctgtcccatgggctctggccccaagatgttggggggccccacggagagttgacttggtagagttcctttctgggaagaaagtaggagtggctgaccaggccctgctcatcacccggatagaggacacggaccctgtgtggtattttggcattttggctcagagtccaatgtaccatgttgcccagaatttcatacttatggcctttacatgaatacgtcttgatcagacattcagagattagtcttaggtttgcacgtaagtcactgaaaacagtaaaacaggctgcttagatttctagcagtatgtgtgctcttatccccagctgttagcacgttagtaatacttttggggaggagttgtctgtcctggtcagttttcacagaggcggttgtaagaggatgtggttattttctccatgtctgtagttgctttgcggcatctccatttcacgggcaacactcactgcctgcagctgagattccagaacgccctgtgtccacagtgattagcctcgtctttcagcgagcataaaataggtgcattgtccttttcttttcttgaggcagggtctcactctgttgaccaggctggagtgaagtggtgtgatcccagctcactgcagcctcgacctccctggcttgagtgatcctcccgccccagcctcctgagtagctgggactagaggcacgcaccaccgcgcctacctttttattttttttgtagagacagggtctcactgtgttgcccaggctggtcttgaactcttggcctcaagcgatcctccttcctcatccttctaaagtgctgggattacaggtgtgagccacagcactcggcctaaataggtttttcttgctatgttattttcagtgctttgcccttgaattcttttcctctcttaaattcatatcatttggccgagtcagcacgtagtttgcattccagcgtctgctgttgattccactgaaacctctgttctcatgaaggagaggatttggctcgctgtggtttctcgtactttcacatctctgtagatacaggggcaaaagtcattgctgacagagccctatctatgtcctggaagtgtgtgtttcttgctttgaatgcatgtgtgaagattataaaagccaaatagtttttaaagatctcggtgctgaacgacagtcccagttcccatttgtgtcccattgtctttgtggtgtcacccgcactgtttgcttcattgtctggggaacttctgcacatcatgtactttgtgccatttctgggctcacgtgtcactcctaatagagcctcttaaccaagactgctggattgcagctgcttgaggcaacacaggaggttagaacatgtcccgagggctctgaaacagtaggacatcctgggtgggtggagctggggagggcatgggcaggccagctggccgagctcctggctggctctcctgagtcctctggacatggcttgtccctgtcagactgtagctcttcaggacctgagctcttcccgttcttgacctgctcttgtgctgactgtgctgggctgatgggtaggcgcttgtccccagtgagtggctgtgtcctcagggtgcccctcttccagaccaactgcagcaaggcctggagcctgactctaggtgcagcccttgtggctggaatcccttgtgccacccaggggactcgggccctgctcctcctgcagcccctcctcacctgggctcgctgctggagtgaggtttttagggagcccagagcgtactcatctctgagctgctgggcccagctgcctggtgcatacctcttgcctcggtcctgtcccccagaacgctttatggagactgccgtgtcctccgagcactttgttttcacttcctgacccgtctcagaagctcaagtggttgaatgttttagcctcagaatctttttccccaagccctctcaggtggagccccgctgtaccagacaccacagcacagctctgtgaggctgtgtctcttcactctgtttctggggctgctgaggcccctgggaagccctggagcttgccagagcagagcgagaaagtctctggtcctgtttaaatgcctccgcgttttatctgtgagcaccaggctggagccactccctgtcttctcacagtgcccctgcaagttgcagcctcagttttccagtggctcgtggggtagcaggtgctgcgtcatatggtttgggacctctgtggctgcttccagcctgctaatagaacctctttccaccactgccttcatctttggggtggcacccctgagtgctcaggcctgagggcgctcctgtgtcctcactcgggacaggcagcctccactctgggagctcccatccctcgggatgcccaggagaggccatactttcagggtggcatggtgaattcaggggttaggatgggtaggtggtctttcagccccttctacgttggggttggtttacagaacacctgtcctgcctgtgccagcctggccttctgcgagcaccccaggcacgctgtcctggaagttgtctgtctcctgcataggagggtctagagcagaccttgccctgggcctgtctgtgcgtgacttccatatgcttcattcgtgctcagccatggctgagcatgcgatggagagcacctggactgcccctgacgtcgcaggccactgttcttatccagtgggccaagtgattgattgctagtggtggggttgattggaagaaaggaagtcgcagcccctgcccacggcttccccagctcgctggggttggaggactgtcatcagttgtccccagttaaagtccatttggaggaggttcagggtcccagtggctggatgtgcttgtggagggacacggtttgaggcaggggtttgcagaaggtgtagactgcatccattcttgggaggctgtggcacagggcagcgacaacttgggacaaatcaagacccgtccacactgcacctcagggacctcacctcacgccccacataaatgtgcttattggggatccgggtgtggtggcttctgcctgtaatcccagcactggaaggccaaggcattaggattgcatgagtccaggagttcgagaccagcctaggcatgataagaccttattgctaaaaaaaaa

SEQ ID NO: 16201 - DNA, 3215 bp, Homo sapiens
gggaagcgctccgagggcgtccccgtgtcaggccccatgctcatcgagaaggccaaggacttctacgagcagatgcagctcactgagccctgcgtgttctccggagggtggctttggcgctttaaggccagacacggcattaaaaagctagatgcatccagtgaaaagcagtcagccgaccaccaggccgcggagcagttctgtgcgtttttcaggagcttggctgctgagcacgggctgtccgccgagcaggtttacaacgctgatgagaccggccttttctggcggtgcctgccaaatcccactccggaaggcggggctgtgcctggccccaagcagggcaaggaccggctgaccgtgctgatgtgtgccaacgccacgggctcccacaggctcaagcccttggccatcgggaagtgcagcggtcccagggctttcaaaggcatccagcacctgcccgtcgcctataaggcccaggggaatgcctgggtggacaaggagattttttccgattggttccatcatatctttgtgccctcggtgagagagcacttcagaaccataggtttgccggaagacagcaaagccgttctcttgctggacagctcccgggctcacccgcaggaggccgagctggtgtccagtaacgttttcaccatcttcctgcctgccagcgtggcctcattggtgcagcccatggagcagggcattcggagagatttcatgaggaacttcattaaccctccggtccccctgcagggcccccacgcccgctacaacatgaacgatgccatattcagcgtggcctgtgcctggaacgcagtccctagccacgtcttcaggcgggcctggaggaagctgtggccgtcggttgcgtttgccgaaggctcctcctctgaggaggagttggaggcagagtgcttcccagtgaagccccacaacaagtcctttgcacacatcctggagcttgtgaaggaaggctcctcctgcccgggccagcttcgccagcgccaggccgccagctggggggtagcgggaagggaggcagaagggggacggccccctgctgccacgtcgccagcagaggttgtgtggagttcagaaaagactccgaaagctgaccaggacggcggaggagatcctggtgagggcgaggaggtggcctgggagcaggcggccgtggcctttgacgcagtcctgcgctttgcggagcggcagccatgcttcagtgcgcaggaagtggggcagctgcgggcgctgcgtgccgtgttccggagccagcagcaggtgaggaggcggcgtggtgccctcggggctgtggtcaaggttgaagccctccaggagggccctggtggctgtggggccacagctcagtctcgcttgccctgctcatccacagcaggtgacaactgatggcttctctgccctgccctggccactggccctgtttctccccacaccctggagtggcatggtcctgtgccccgaccccacctgaggcaggagggcatgtgcagacactcaagagcccttccaggagtgggtcgcccacgggtgtggctcgggtgcccaggacggtctgtgcccgaggttcctgtcaatacaggttttattttatcacttgccgtgtcatccgaaagtgaggaaatgttttggaagggtccaccctagcctagaacaagccagagccgcaccctggctggaatgggggccaggctgagccgatctggtctcgtgttcgctggctgatcattgcagtatcagagggtggagatgtcagtctgtccacgtggagagaagttgccctccaggccgacaggaggccatgcccaccgcccctggacaggcttcgtctcagaaggctctatctgctgggctggcggccatccccgtgttgggtggaccccgagcacggttgcctgaggtccgatggcccgagagctgggactcagttcttggcctgctagcggctgaacaggccgcacatctcacttcagttgtggcctcattcagcagaatgactctggaaccatcctctgttacccgcagatcctgtcccatgggctctggccccaagatgttggggggccccacggagagttgacttggtagagttcctttctgggaagaaagtaggagtggctgaccaggccctgctcatcacccggatagaggacacggaccctgtgtggtattttggcattttggctcagagtccaatgtaccatgttgcccagaatttcatacttatggcctttacatgaatacgtcttgatcagacattcagagattagtcttaggtttgcacgtaagtcactgaaaacagtaaaacaggctgcttagatttctagcagtatgtgtgctcttatccccagctgttagcacgttagtaatacttttggggaggagttgtctgtcctggtcagttttcacagaggcggttgtaagaggatgtggttattttctccatgtctgtagttgctttgcggcatctccatttcacgggcaacactcactgcctgcagctgagattccagaacgccctgtgtccacagtgattagcctcgtctttcagcgagcataaaataggtgcattgtccttttcttttcttgaggcagggtctcactctgttgaccaggctggagtgaagtggtgtgatcccagctcactgcagcctcgacctccctggcttgagtgatcctcccgccccagcctcctgagtagctgggactagaggcacgcaccaccgcgcctacctttttattttttttgtagagacagggtctcactgtgttgcccaggctggtcttgaactcttggcctcaagcgatcctccttcctcatccttctaaagtgctgggattacaggtgtgagccacagcactcggcctaaataggtttttcttgctatgttattttcagtgctttgcccttgaattcttttcctctcttaaattcatatcatttggccgagtcagcacgtagtttgcattccagcgtctgctgttgattccactgaaacctctgttctcatgaaggagaggatttggctcgctgtggtttctcgtactttcacatctctgtagatacaggggcaaaagtcattgctgacagagccctatctatgtcctggaagtgtgtgtttcttgctttgaatgcatgtgtgaagattataaaagccgtattgtgtgaaaagacccccggggtgttccac

SEQ ID NO: 16202 - DNA, 1620 bp, Homo sapiens
tacccgccccccgtccgggacgcgacaataataaccaagtgggaaaaacagaagtaaaggttgataaggaaaaagctatatgagggtggaggagggcagagttgacacctgaggagaggaacctgcagccgggctcctctcaggctgtaggggaaacaagtttaacaggacttagccctgaaggaacaacagttgctgaaatgggcggcggagggagaccatatgggttcgtctgcagaatagggaggtacggcgcagggcaggactacaaatggagtgacactacgggaccggattattggcgagttgccccgctttagatcctcagcggttggacgagtttaattagaatactaagtaggtccgcccagaagctttcaccctgccctctgaccctagggcccagcccgaggaggcactcagggttaggaggtctgggcgagaagcaactagggccctcatcacttcgccgccgaatccccggcgccgcccagcggggcagagccaggccagggccgcccgcccaacctggtccgctgcctcttcggccatggaagctgccggcagccctgcggctacggagacaggcaagtatatcgcgtcaacacagcgacctgacgggacctggcgcaagcagcggagggtgaaagaaggatatgtgccccaggaggaggtcccagtatatgaaaacaagtatgtgaagtttttcaagagtaaaccagagttgcccccagggctaagccctgaggccactgctcctgtcaccccatccaggcctgaaggtggtgaaccaggcctctccaagacagccaaacgtaacctgaagcgaaaggagaagaggcggcagcagcaagagaaaggagaggcagaggccttgagcaggactcttgataaggtgtccctggaagagacagcccaactccccagtgctccacagggctctcgggcagcccccacagctgcatctgaccagcctgactcagctgccaccactgagaaagccaagaagataaagaacctaaagaagaaactccggcaggtggaagagctgcagcagcggatccaggctggggaagtcagccagcccagcaaagagcagctagaaaagctagcaaggaggagggcgctagaagaggagttagaggacttggagttaggcctctgaggcctttggggaatagggaatggactgcagaacaaaccgtggggctctctggggtctgggggaatacgggcaacagcagtcaggaggggtaccccccatactggcttccacctcctgcggcccagctctgtcctccagagcctagcgtctccctcaatccttcccttttcttcccaacttctactttttggactttccccctcccattcccagtgttcaaaatctcagtgactaccccaggtacctttgctgctgatttgggtgtcttgtttaaaagaaaatcaggtgggtgggaatctcttggagaactgaggctgagggtagagggagtatgcccaagtcttggagtcttggttcctgttcgcggtgtttatgggttatttccctctccatccctcattttttttttttttttaaaaaaagcaaaaatgagaataaacacaagtagacatgtc

SEQ ID NO: 16203 - DNA, 2392 bp, Homo sapiens
  misc_feature (12)..(12): n is a, c, g, or t
  misc_feature (185)..(185): n is a, c, g, or t
  misc_feature (233)..(233): n is a, c, g, or t
  misc_feature (280)..(280): n is a, c, g, or t
gagacggggtcncactctgtcgtccaagctggagtgcagtggagcgatcttggctcactgcaacctccgcctcccagattcaagaaattctctgcctcagcctcccgagtagctgagattacaggcacccgccaccacgcccggctaatttttttgtatttttagtagagacggggtttcgccancttggccaggttggtcttgaactccggacctcgtgatccacccgcctnggcctcccaaagtgctgggattacaggcgtgagcaaccgcgcctggnttttgttttgttttttaaatgggacatgctgcctagtgttggaggtagtcaccaatacttacctcctgcctcctccctggttccaggggtactgctggacattaaactaagccaaagtggggatataagcaggaaggtaaaagggttgataaggaaaaagctatatgagggtggaggagggcagagttgacacctgaggagaggaacctgcagccgggctcctctcaggctgtaggggaaacaagtttaacaggacttagccctgaaggaacaacagttgctgaaatgggcggcggagggagaccatatgggttcgtctgcagaatagggaggtacggcgcagggcaggactacaaatggagtgacactacgggaccggattattggcgagttgccccgctttagatcctcagcggttggacgagtttaattagaatactaagtaggtccgcccagaagctttcaccctgccctctgaccctagggcccagcccgaggaggcactcagggttaggaggtctgggcgagaagcaactagggccctcatcacttcgccgccgaatccccggcgccgcccagcggggcagagccaggccagggccgcccgcccaacctggtccgctgcctcttcggccatggaagctgccggcagccctgcggctacggagacaggtgaccgacccgcggcgccctccgccttgcacgcccctcccgcgggtctctggtggttgagtgggttggccgacagcaatcggcacacgaattcgacctccccaccttcttagggttagatagggtctccaaccgtccctagaaacacttgtgcgccccagtgcgttcctggagtttgtctgctccacgtcaccaagccgctctgagatctgggtgcaggccagagcctggatattcttcctttcttcatttataaggccccctttttgggtgcaggtgggccttgcgcccttttccctcgcaggtcctggacgtacgaggagttcctggggatgagagggactgtgcctcggaacttctcttggctccctgaggactgttttacaggcagcaagcgctcagtaatggcaagtatatcgcgtcaacacagcgacctgacgggacctggcgcaagcagcggagggtgaaagaaggatatgtgccccaggaggaggtcccagtatatgaaaacaagtatgtgaagtttttcaagagtaaaccagagttgcccccagggctaagccctgaggccactgctcctgtcaccccatccaggcctgaaggtggtgaaccaggcctctccaagacagccaaacgtaacctgaagcgaaaggagaagaggcggcagcagcaagagaaaggagaggcagaggccttgagcaggactcttgataaggtgtccctggaagagacagcccaactccccagtgctccacagggctctcgggcagcccccacagctgcatctgaccagcctgactcagctgccaccactgagaaagccaagaagataaagaacctaaagaagaaactccggcaggtggaagagctgcagcagcggatccaggctggggaagtcagccagcccagcaaagagcagctagaaaagctagcaaggaggagggcgctagaagaggagttagaggacttggagttaggcctctgaggcctttggggaatagggaatggactgcagaacaaaccgtggggctctctggggtctgggggaatacgggcaacagcagtcaggaggggtaccccccatactggcttccacctcctgcggcccagctctgtcctccagagcctagcgtctccctcaatccttcccttttcttcccaacttctactttttggactttccccctcccattcccagtgttcaaaatctcagtgactaccccaggtacctttgctgctgatttgggtgtcttgtttaaaagaaaatcaggtgggtgggaatctcttggagaactgaggctgagggtagagggagtatgcccaagtcttggagtcttggttcctgttcgcggtgtttatgggttatttccctctccatccctcattttttttttttttttaaaaaaagcaaaaatgagaataaacacaagtagacatgtc

SEQ ID NO: 16204 - DNA, 2027 bp, Homo sapiens
tacccgccccccgtccgggacgcgacaataataaccaagtgggaaaaacagaagtaaaggttgataaggaaaaagctatatgagggtggaggagggcagagttgacacctgaggagaggaacctgcagccgggctcctctcaggctgtaggggaaacaagtttaacaggacttagccctgaaggaacaacagttgctgaaatgggcggcggagggagaccatatgggttcgtctgcagaatagggaggtacggcgcagggcaggactacaaatggagtgacactacgggaccggattattggcgagttgccccgctttagatcctcagcggttggacgagtttaattagaatactaagtaggtccgcccagaagctttcaccctgccctctgaccctagggcccagcccgaggaggcactcagggttaggaggtctgggcgagaagcaactagggccctcatcacttcgccgccgaatccccggcgccgcccagcggggcagagccaggccagggccgcccgcccaacctggtccgctgcctcttcggccatggaagctgccggcagccctgcggctacggagacaggtgaccgacccgcggcgccctccgccttgcacgcccctcccgcgggtctctggtggttgagtgggttggccgacagcaatcggcacacgaattcgacctccccaccttcttagggttagatagggtctccaaccgtccctagaaacacttgtgcgccccagtgcgttcctggagtttgtctgctccacgtcaccaagccgctctgagatctgggtgcaggccagagcctggatattcttcctttcttcatttataaggccccctttttgggtgcaggtgggccttgcgcccttttccctcgcaggtcctggacgtacgaggagttcctggggatgagagggactgtgcctcggaacttctcttggctccctgaggactgttttacaggcagcaagcgctcagtaatggcaagtatatcgcgtcaacacagcgacctgacgggacctggcgcaagcagcggagggtgaaagaaggatatgtgccccaggaggaggtcccagtatatgaaaacaagtatgtgaagtttttcaagagtaaaccagagttgcccccagggctaagccctgaggccactgctcctgtcaccccatccaggcctgaaggtggtgaaccaggcctctccaagacagccaaacgtaacctgaagcgaaaggagaagaggcggcagcagcaagagaaaggagaggcagaggccttgagcaggactcttgataaggtgtccctggaagagacagcccaactccccagtgctccacagggctctcgggcagcccccacagctgcatctgaccagcctgactcagctgccaccactgagaaagccaagaagataaagaacctaaagaagaaactccggcaggtggaagagctgcagcagcggatccaggctggggaagtcagccagcccagcaaagagcagctagaaaagctagcaaggaggagggcgctagaagaggagttagaggacttggagttaggcctctgaggcctttggggaatagggaatggactgcagaacaaaccgtggggctctctggggtctgggggaatacgggcaacagcagtcaggaggggtaccccccatactggcttccacctcctgcggcccagctctgtcctccagagcctagcgtctccctcaatccttcccttttcttcccaacttctactttttggactttccccctcccattcccagtgttcaaaatctcagtgactaccccaggtacctttgctgctgatttgggtgtcttgtttaaaagaaaatcaggtgggtgggaatctcttggagaactgaggctgagggtagagggagtatgcccaagtcttggagtcttggttcctgttcgcggtgtttatgggttatttccctctccatccctcattttttttttttttttaaaaaaagcaaaaatgagaataaacacaagtagacatgtc

SEQ ID NO: 16205 - DNA, 1812 bp, Homo sapiens
tacccgccccccgtccgggacgcgacaataataaccaagtgggaaaaacagaagtaaaggttgataaggaaaaagctatatgagggtggaggagggcagagttgacacctgaggagaggaacctgcagccgggctcctctcaggctgtaggggaaacaagtttaacaggacttagccctgaaggaacaacagttgctgaaatgggcggcggagggagaccatatgggttcgtctgcagaatagggaggtacggcgcagggcaggactacaaatggagtgacactacgggaccggattattggcgagttgccccgctttagatcctcagcggttggacgagtttaattagaatactaagtaggtccgcccagaagctttcaccctgccctctgaccctagggcccagcccgaggaggcactcagggttaggaggtctgggcgagaagcaactagggccctcatcacttcgccgccgaatccccggcgccgcccagcggggcagagccaggccagggccgcccgcccaacctggtccgctgcctcttcggccatggaagctgccggcagccctgcggctacggagacagcttctccactcttcctcctcctccacctccgcccatgaaatggtgcactctccctttaagactaagatggtggcttgctacgatcgggactccacttccggtggggaggggggcgggaccccagcccgctcacgccggaagtggtttgcgttttcaagatggcgactccctatgttactgacgagaccggcggcaagtatatcgcgtcaacacagcgacctgacgggacctggcgcaagcagcggagggtgaaagaaggatatgtgccccaggaggaggtcccagtatatgaaaacaagtatgtgaagtttttcaagagtaaaccagagttgcccccagggctaagccctgaggccactgctcctgtcaccccatccaggcctgaaggtggtgaaccaggcctctccaagacagccaaacgtaacctgaagcgaaaggagaagaggcggcagcagcaagagaaaggagaggcagaggccttgagcaggactcttgataaggtgtccctggaagagacagcccaactccccagtgctccacagggctctcgggcagcccccacagctgcatctgaccagcctgactcagctgccaccactgagaaagccaagaagataaagaacctaaagaagaaactccggcaggtggaagagctgcagcagcggatccaggctggggaagtcagccagcccagcaaagagcagctagaaaagctagcaaggaggagggcgctagaagaggagttagaggacttggagttaggcctctgaggcctttggggaatagggaatggactgcagaacaaaccgtggggctctctggggtctgggggaatacgggcaacagcagtcaggaggggtaccccccatactggcttccacctcctgcggcccagctctgtcctccagagcctagcgtctccctcaatccttcccttttcttcccaacttctactttttggactttccccctcccattcccagtgttcaaaatctcagtgactaccccaggtacctttgctgctgatttgggtgtcttgtttaaaagaaaatcaggtgggtgggaatctcttggagaactgaggctgagggtagagggagtatgcccaagtcttggagtcttggttcctgttcgcggtgtttatgggttatttccctctccatccctcattttttttttttttttaaaaaaagcaaaaatgagaataaacacaagtagacatgtc

SEQ ID NO: 16206 - DNA, 1711 bp, Homo sapiens
tacccgccccccgtccgggacgcgacaataataaccaagtgggaaaaacagaagtaaaggttgataaggaaaaagctatatgagggtggaggagggcagagttgacacctgaggagaggaacctgcagccgggctcctctcaggctgtaggggaaacaagtttaacaggacttagccctgaaggaacaacagttgctgaaatgggcggcggagggagaccatatgggttcgtctgcagaatagggaggtacggcgcagggcaggactacaaatggagtgacactacgggaccggattattggcgagttgccccgctttagatcctcagcggttggacgagtttaattagaatactaagtaggtccgcccagaagctttcaccctgccctctgaccctagggcccagcccgaggaggcactcagggttaggaggtctgggcgagaagcaactagggccctcatcacttcgccgccgaatccccggcgccgcccagcggggcagagccaggccagggccgcccgcccaacctggtccgctgcctcttcggccatggaagctgccggcagccctgcggctacggagacaggggtgggaaccgccaaacctctcccttctttttgacttcacccttggataccatcaaggccagaggatggaaccaagataacataaaataggcaagtatatcgcgtcaacacagcgacctgacgggacctggcgcaagcagcggagggtgaaagaaggatatgtgccccaggaggaggtcccagtatatgaaaacaagtatgtgaagtttttcaagagtaaaccagagttgcccccagggctaagccctgaggccactgctcctgtcaccccatccaggcctgaaggtggtgaaccaggcctctccaagacagccaaacgtaacctgaagcgaaaggagaagaggcggcagcagcaagagaaaggagaggcagaggccttgagcaggactcttgataaggtgtccctggaagagacagcccaactccccagtgctccacagggctctcgggcagcccccacagctgcatctgaccagcctgactcagctgccaccactgagaaagccaagaagataaagaacctaaagaagaaactccggcaggtggaagagctgcagcagcggatccaggctggggaagtcagccagcccagcaaagagcagctagaaaagctagcaaggaggagggcgctagaagaggagttagaggacttggagttaggcctctgaggcctttggggaatagggaatggactgcagaacaaaccgtggggctctctggggtctgggggaatacgggcaacagcagtcaggaggggtaccccccatactggcttccacctcctgcggcccagctctgtcctccagagcctagcgtctccctcaatccttcccttttcttcccaacttctactttttggactttccccctcccattcccagtgttcaaaatctcagtgactaccccaggtacctttgctgctgatttgggtgtcttgtttaaaagaaaatcaggtgggtgggaatctcttggagaactgaggctgagggtagagggagtatgcccaagtcttggagtcttggttcctgttcgcggtgtttatgggttatttccctctccatccctcattttttttttttttttaaaaaaagcaaaaatgagaataaacacaagtagacatgtc

SEQ ID NO: 16207 - DNA, 1903 bp, Homo sapiens
tacccgccccccgtccgggacgcgacaataataaccaagtgggaaaaacagaagtaaaggttgataaggaaaaagctatatgagggtggaggagggcagagttgacacctgaggagaggaacctgcagccgggctcctctcaggctgtaggggaaacaagtttaacaggacttagccctgaaggaacaacagttgctgaaatgggcggcggagggagaccatatgggttcgtctgcagaatagggaggtacggcgcagggcaggactacaaatggagtgacactacgggaccggattattggcgagttgccccgctttagatcctcagcggttggacgagtttaattagaatactaagtaggtccgcccagaagctttcaccctgccctctgaccctagggcccagcccgaggaggcactcagggttaggaggtctgggcgagaagcaactagggccctcatcacttcgccgccgaatccccggcgccgcccagcggggcagagccaggccagggccgcccgcccaacctggtccgctgcctcttcggccatggaagctgccggcagccctgcggctacggagacagcttctccactcttcctcctcctccacctccgcccatgaaatggtgcactctccctttaagactaagatggtggcttgctacgatcgggactccacttccggtggggaggggggcgggaccccagcccgctcacgccggaagtggtttgcgttttcaagatggcgactccctatgttactgacgagaccggcggggtgggaaccgccaaacctctcccttctttttgacttcacccttggataccatcaaggccagaggatggaaccaagataacataaaataggcaagtatatcgcgtcaacacagcgacctgacgggacctggcgcaagcagcggagggtgaaagaaggatatgtgccccaggaggaggtcccagtatatgaaaacaagtatgtgaagtttttcaagagtaaaccagagttgcccccagggctaagccctgaggccactgctcctgtcaccccatccaggcctgaaggtggtgaaccaggcctctccaagacagccaaacgtaacctgaagcgaaaggagaagaggcggcagcagcaagagaaaggagaggcagaggccttgagcaggactcttgataaggtgtccctggaagagacagcccaactccccagtgctccacagggctctcgggcagcccccacagctgcatctgaccagcctgactcagctgccaccactgagaaagccaagaagataaagaacctaaagaagaaactccggcaggtggaagagctgcagcagcggatccaggctggggaagtcagccagcccagcaaagagcagctagaaaagctagcaaggaggagggcgctagaagaggagttagaggacttggagttaggcctctgaggcctttggggaatagggaatggactgcagaacaaaccgtggggctctctggggtctgggggaatacgggcaacagcagtcaggaggggtaccccccatactggcttccacctcctgcggcccagctctgtcctccagagcctagcgtctccctcaatccttcccttttcttcccaacttctactttttggactttccccctcccattcccagtgttcaaaatctcagtgactaccccaggtacctttgctgctgatttgggtgtcttgtttaaaagaaaatcaggtgggtgggaatctcttggagaactgaggctgagggtagagggagtatgcccaagtcttggagtcttggttcctgttcgcggtgtttatgggttatttccctctccatccctcattttttttttttttttaaaaaaagcaaaaatgagaataaacacaagtagacatgtc

SEQ ID NO: 16208 - DNA, 1691 bp, Homo sapiens
tacccgccccccgtccgggacgcgacaataataaccaagtgggaaaaacagaagtaaaggttgataaggaaaaagctatatgagggtggaggagggcagagttgacacctgaggagaggaacctgcagccgggctcctctcaggctgtaggggaaacaagtttaacaggacttagccctgaaggaacaacagttgctgaaatgggcggcggagggagaccatatgggttcgtctgcagaatagggaggtacggcgcagggcaggactacaaatggagtgacactacgggaccggattattggcgagttgccccgctttagatcctcagcggttggacgagtttaattagaatactaagtaggtccgcccagaagctttcaccctgccctctgaccctagggcccagcccgaggaggcactcagggttaggaggtctgggcgagaagcaactagggccctcatcacttcgccgccgaatccccggcgccgcccagcggggcagagccaggccagggccgcccgcccaacctggtccgctgcctcttcggccatggaagctgccggcagccctgcggctacggagacaggcaagtatatcgcgtcaacacagcgacctgacgggacctggcgcaagcagcggagggtgaaagaaggatatgtgccccaggaggaggtcccagtatatgaaaacaagtatgtgaagtttttcaagagtaaaccagagttgcccccagggctaagccctgaggccactgctcctgtcaccccatccaggcctgaaggtggtgaaccaggcctctccaagacagccaaacgtaacctgaagcgaaaggagaagaggcggcagcagcaagagaaaggagaggcagaggccttgagcaggactcttgataaggtgtccctggaagagacagcccaactccccagtgctccacagggctctcgggcagcccccacagctgcatctgaccagcctgactcagctgccaccactgagaaagccaagaagataaagaacctaaagaagaaactccggcaggtggaagagctgcagcagcggatccaggctggggaagtcagccagcccagcaaagagcagctagaaaagctagcaaggaggagggcgctagaagaggagttagaggacttggagttaggcctctgaggcctttggggaatagggaatggactgcagaacaaaccgtggggctctctggggtctgggggaatacgggcaacagcagtcaggaggggtaccccccatactggcttccacctcctgcggcccagctctgtcctccagagcctagcgtctccctcaatccttcccttttcttcccaacttctactttttggactttccccctcccattcccagtgttcaaaatctcagtgactaccccaggtacctttgctgctgatttgggtgtcttgtttaaaagaaaatcaggtgggtgggaatctcttggagaactgaggctgagggtagagggagtatgcccaagtcttggagtcttggttcctgttcgcggtgtttatgggttatttccctctccatccctcattttttttttttttttttttttttttttttttttttttttttttttttatttttttttatcccacaggggggggcacgtgtgtcacaaatttttttacacccacaaaaatttttctgcaaaaaaaaa

SEQ ID NO: 16209 - DNA, 1402 bp, Homo sapiens
tacccgccccccgtccgggacgcgacaataataaccaagtgggaaaaacagaagtaaaggttgataaggaaaaagctatatgagggtggaggagggcagagttgacacctgaggagaggaacctgcagccgggctcctctcaggctgtaggggaaacaagtttaacaggacttagccctgaaggaacaacagttgctgaaatgggcggcggagggagaccatatgggttcgtctgcagaatagggaggtacggcgcagggcaggactacaaatggagtgacactacgggaccggattattggcgagttgccccgctttagatcctcagcggttggacgagtttaattagaatactaagtaggtccgcccagaagctttcaccctgccctctgaccctagggcccagcccgaggaggcactcagggttaggaggtctgggcgagaagcaactagggccctcatcacttcgccgccgaatccccggcgccgcccagcggggcagagccaggccagggccgcccgcccaacctggtccgctgcctcttcggccatggaagctgccggcagccctgcggctacggagacagcttctccactcttcctcctcctccacctccgcccatgaaatggtgcactctccctttaagactaagatggtggcttgctacgatcgggactccacttccggtggggaggggggcgggaccccagcccgctcacgccggaagtggtttgcgttttcaagatggcgactccctatgttactgacgagaccggcggggtgggaaccgccaaacctctcccttctttttgacttcacccttggataccatcaaggccagaggatggaaccaagataacataaaataggtgctcctttgtgataatgggctatttgtatctctgagggcttccacacaggatggccattcaagaagcttctgctctgcctttcattacagtctatctttagtcctcctaaaccttcagctataatctctatgcaatcaacttaaatatatgtttgtagtattgtccctttctcccaaattccatgtaaaacacttgcctgaattgaattgtttccacaaagttgttttcccctgtggactttgtttatatcagtagtttttattttcccaattttccaaattcaagagtgataattataaatagttgtgttcttgtttgttatctttctcactagaatgtatactctaagaaggcaagaaccttgcttgctttattcattgttgtattcctagcttctgttacagtgtctggcacaagagtaagtgctcaataaaaatttaaaatccacgtgtgaataaatgtgattaccatgtgccctaccgtatattgagaaaaataagaatacatgtgaaaagcacgagattaaaaa

SEQ ID NO: 16210 - DNA, 1210 bp, Homo sapiens
tacccgccccccgtccgggacgcgacaataataaccaagtgggaaaaacagaagtaaaggttgataaggaaaaagctatatgagggtggaggagggcagagttgacacctgaggagaggaacctgcagccgggctcctctcaggctgtaggggaaacaagtttaacaggacttagccctgaaggaacaacagttgctgaaatgggcggcggagggagaccatatgggttcgtctgcagaatagggaggtacggcgcagggcaggactacaaatggagtgacactacgggaccggattattggcgagttgccccgctttagatcctcagcggttggacgagtttaattagaatactaagtaggtccgcccagaagctttcaccctgccctctgaccctagggcccagcccgaggaggcactcagggttaggaggtctgggcgagaagcaactagggccctcatcacttcgccgccgaatccccggcgccgcccagcggggcagagccaggccagggccgcccgcccaacctggtccgctgcctcttcggccatggaagctgccggcagccctgcggctacggagacaggggtgggaaccgccaaacctctcccttctttttgacttcacccttggataccatcaaggccagaggatggaaccaagataacataaaataggtgctcctttgtgataatgggctatttgtatctctgagggcttccacacaggatggccattcaagaagcttctgctctgcctttcattacagtctatctttagtcctcctaaaccttcagctataatctctatgcaatcaacttaaatatatgtttgtagtattgtccctttctcccaaattccatgtaaaacacttgcctgaattgaattgtttccacaaagttgttttcccctgtggactttgtttatatcagtagtttttattttcccaattttccaaattcaagagtgataattataaatagttgtgttcttgtttgttatctttctcactagaatgtatactctaagaaggcaagaaccttgcttgctttattcattgttgtattcctagcttctgttacagtgtctggcacaagagtaagtgctcaataaaaatttaaaatccacgtgtgaataaatgtgattaccatgtgccctaccgtatattgagaaaaataagaatacatgtgaaaagcacgagattaaaaa

SEQ ID NO: 16211 - DNA, 750 bp, Homo sapiens
acagtgcctcgggctttcctggaggcgggcggcgggatgctgctccgttctccgggtcctctcctccggttcttgtcgtttggtcacgccctcagttcagtcggttattggaaaacgatcaaggcccaaagatggtttacgtggcgttgtggatgttatcaccgttgtttggtgaccgagcctggagcttgagccctgggacgtcttgccagccgcatgtggtcccgtgcccacttctcgcggtggcgcgttaatccacctagactgtgcattggtccagtctgggttgaccccgacccgaagtggccctttccttcgcgtcctgaacttcgcttctccgtcggtgtctggtctcttcccgccggcgggctctgcggtggcgggaggagctgtactactcgtgccttagcgcacccttactttcccaggccagaaacgcgaaatgctgtcggccttccagaggctgttccgagtcttatttgtgattgaaacagtctcagaatacggagtcctgatcttcatttatggatggccctttctccagacccttgcgatgctcctgatcgggacagtgtctttccacctttggatccgcagaaatcgagagagaaactcaaggagcggaaagactagatgccgatccaaaaggtgaccagccaccaagtaaagcactgatggtttcagaatgtgcctaaacctgcaccagtgaggcaagtatgcaaaaggagtccctttccgggatggacacac

SEQ ID NO: 16212 - DNA, 533 bp, Homo sapiens
cagaggccagctttccccagagtgaacttacagcatttctgtctgttgctggaaccaacactctgaaaaaataaagatattctgctgctcctgagtaattccccacattcatactgggaattttgcatatgtgtagaatgtatctaaatactcctgcctaaaaccatgcttgtccgccaggtagtcaaagagcatcctaccatccctggttgaccgcatttgccttgtcgtttctggatcttcaaacattttcacaattagttctgtttctgcctgaagctgtttcagttgtgcaacaactgtggttctattctctttcaaagcatgaggaatatcatcagaataaaggtttttgtatgcatccatagcaaagtctaccatgttggcatcactaagaaggtccaatttaccttgtaataattccttttctttatatatctcctttacagagagaaactcaaggagcggaaagactagatgccgatccaaaaggtgcgtgatgcgagtagttaagtcgtaccccgccatcttac

SEQ ID NO: 16213 - DNA, 955 bp, Homo sapiens
aggatcaacctgtcgtctgctgcgtgcccatcaacgtaagttgagagctagtggcgcatactgtgaactcctagcgcactggtccatggtcttgactacctgcttgtgttctcgatccacctaattacttcgcccgggggcgtcgaccagtctagaatgtgtctagatccagtcctggatgtgcaccagtagcactcctatgagacctgacttctacaccggtaacctgcagaactatcgacctatctaccgctccgtgcttctgggtctcttcccgccggcgggctctgcggtggcgggaggagctgtactactcgtgccttagcgcacccttactttcccaggccagaaacgcgaaatgctgtcggccttccagaggctgttccgagtcttatttgtgattgaaacagtctcagaatacggagtcctgatcttcatttatggatggccctttctccagacccttgcgatgctcctgatcgggacagtgtctttccacctttggatccgcagaaatcgagagagaaactcaaggagcggaaagactagatgccgatccaaaaggtcgggagcagagcatggacattgggaacgagtgctctcagcaagaaccgtggtggaccctgcctcaaaactttcattgcaccaatggctgtttcccctgggaagaggacaggaaggaactcatcttccggcatgtacacatacctttgctgatttaggtggccagaccaaccttattcgctggagtggttcccgctacggccaatcgtgtctggttcgcccccagccagcgcggcctgccctttgtgttgtgggccgcgccacatcaagccggcggagaggagggtgtgacgctttcacgcgtcgcccctttgcccacggcgcgtttcccagaagagtgtgttccccccccagggggcgttctctaccccggaggtaagcgaggccccga

SEQ ID NO: 16214 - DNA, 1742 bp, Homo sapiens
aaaaaaaatttttttagagatgggggacttgctgtgttgaccaggctggcctggaactcctggtctcaagcagccctcctgactcagcttcccaaagtgttgagattgcacatgtgaggcactgtgcctgcctgggtatctatatcttctaaatggggagtagcaggaaagggacagaacaaaaggtgggagaattgggagaataaccagtaaaaagcatgttacagaagccaaggaaagggtgtttttattttttattttttttatttttattttttgagacagtctcactctgttacccaggctggaatgcagtggcgtgatctcacctcactgcaacctctgcctcctgggttcaagcgattctcctgcctcagcctcccaagtaactaggattacaggcactcaccaccacacctggctgattttttgtgtttttagtagagagcaccttgggaggctgaggcgggtagatcacgaggtcaggagttcaagaccagcctggccaacatggcgaaacctcgtctctactaaatatacaaaataaattctctgggcatggtggcacacacctgtaatcccagctattcaggacgccaagtcatgagaatcatttgaacccaggaggcataggctgcaatgagccaagattatgccgctgcactccagcctgggcgacagagcaagactctgttctcaaaaagaaaaacaaaaaacatagtgagaagagatggtttggattaattatgtttataggcctagaggcagaaagccccttttatgctttcaaggcacattgtatttaatgttactgtgggaaggtattactaatcattttctcttgcctgtaccaagtaccccttaggtaagtgatattgtagatcctaactagaaaatcttttataggagggcaacaaatggatgccacaagttagtaaagtaaaacatacccactgataatccacatttttgaaaagagagaatggatttgtccaaagtattgggttcgttactatacaaatttctgtggaaatatagttaaatcattcaagataaattattcatatcattaaacaagcttgtataaatgttatctacatgatattctttttaatatgtttcttcttcagaagcctaaagaaactgttccaactcttgctccaaaaactctttcagtagcagcagcttttaatgaagatgaagatgtaagttgatatcgagttttgtttttttactttaaccagttatttaaggaaggtattagtggcaaattataggttataatagtattagtgaattttctttataatagtttttgtgtctgtgtgtgacatccataaaaactggatactctatttttgcattttatttggttgtaagattattttagagtattgttgactttggggacaagaagcttaaggatgaaatcagcaaatgtttattatgagtagtttgtgctaggaagtatgtaggatccaaaaaaagaaaaatctaatactgttgccttaataatttttatagttggggtcttcagtaatgatacattatgcatgcattcaattttaaaaagccaactattggctaggcgcggtgtctcatgcctgtaagcctagctctttgggaggctgaggcaggtggatcacttgaggtcagcggttcaagaccagcctggccaatatggtgaaaccccatctctactaaaaatacaaaaattagacaggcgtggtggcacaggccta

SEQ ID NO: 16215 - DNA, 691 bp, Homo sapiens
cgtgaccggctaacggaattaagtcgggccccataggggaacccggcacgatccacccccttggagccagagaaacctgggtccaagaaaccgcaaaggaccaaggcgccacttcagcacccgctgtcgtatgacgccccccgaacagatgaccgccccgaagttactgggtcttgtcttcatgatggtatataaactatttattaacagacaaggcctacagacttatttcttcttggacacacccacggtgcggccacggcggccagtggtcttggtgtgctggcctcggacacgaaggccccagaagtgacgcagccctctatgggcccgaatcttcttcagtcgctccaggtcttcacggagcttgttgtccagaccattggctaggacctggctgtattttccatcctttacatccttctgtctgttcaagaaccagtctgggatcttgtactggcgtggattctgcataatggtgatcacacgttccacctcatcatcagtgagttctcccgccctcttggtgaggtcaatgtctgctttcctcaacaccacatgagcatatcttcggcccacacccttcaatggcagtgatggcaaaggctattttccgccgcccatcgatgttggtgttgagtactcgcaaaatatgctggaacttttcagggatcactagagacatggctgc

SEQ ID NO: 16216 - DNA, 523 bp, Homo sapiens
gcagccgcctactactactaaattggcggccgcgtcgacgttggtaataactccagagaagcagcctgtgtatattcctaacactttgttcactagcatttaagtttagaataagcccaagtaagacaatggaaatgtatatagaactcttagttcttacatgatttaattatatcgatacatgaatttaacttactttaatgtaggcaaactatcaattttttgtccattttcctgtttgttaaaataacatacctctcctacgtattattttcttgacccaaatgaaatattaacctaaggtcaagctgggagagagaaatgactgagatgaatgtctttactaaagtaccaataaatttgtcaaactcaaaaaaaaaaaaaaagtcgacgcggccgggatttagtggtagtagtcgtcccgtgaattctgaccggttccgttggtgtaccgtcttcccttgatgaggcgtttggtgctgtgcgtatcttgtcagatcgtgtcctgggtttttgttttcct

SEQ ID NO: 16217 - DNA, 2282 bp, Homo sapiens
  misc_feature (24)..(24): n is a, c, g, or t
ggacgcgtgggtcgacccacgcgntcggacccacgcgtgcggggaggccgcggcggggaaaatggcggacgggaaggcgggagacgagaagcctgaaaagtcgcagcgagctggagccgccggaggacctgaagaagaagcagaaaaacctgtgaaaactaagactgtttcttccagtaatggaggggaaagttccagtcgcagcgctgagaagcgatcagctgaagaagaagctgccgacctcccaacaaagcctacaaagatctccaagtttggatttgccataggtagtcagacgacaaagaaagcatcagccatatccatcaaacttggatcaagtaagcctaaagaaactgttccaactcttgctccaaaaactctttcagtagcagcagcttttaatgaagatgaagatagtgaaccagaggaaatgcctccagaagcaaagatgaggatgaagaatattggaagggatacaccaacatcagctggaccaaactccttcaataaaggaaagcatgggttttctgataaccagaagctgtgggagcgaaatataaaatctcatcttggaaatgtccatgaccaagacaattaaatgatgttttgaaattggggtgtggggtgggtgtaaagttaaaaggaacagtttccttttttaaagaatggtataagactatctttggagccgctttttttttctttttcatttttttaaaagattgagtggtacactaataaatgagagtttgaaattagaggtaatttatgttttatatacagatttcaagacatttgctaattttgtagtttcatgtgattagtttccaaaggttacagataataaagaaatcagaaatggtacctttttaagaattgcatatttttttagacacaactattagcacattaagagggaagcaaagttactgtctatttaaaactgcaagcagttaactctcttaactcccttattacctaaacttgtctggctcccaggaacagccttatagagagagggagtattgtattgggaagaaaatgttactgaactattgactgaaagtaaatttagataaaatacagcttttttccttatgggcatttgttttgtttcaagtcatcataaactaggtattgcattgctatccgtggatacagacgcttagctcttaaaagattttttttttatgtaaactgttgaatatttgaaatagtccacttcaccttaatgggtcttgtctatcttcattagtcttcaaagaaaaaccatttgctaccaaagtaaatcagtattttgaatgtgcttctcttgtttttggtttattagctagttcctgtaagcatttccaccagaacttgaggcaaatcgtaaggaagctgtttcttttaaaacacaaaccaccaccaaaaatttaaatgtacatattgcttaagtatttggctgtttttattttttaaaaggtataaacaccaaaaaaaaaattaacattgtatgaagatggaaaataagaagatgcactttctgtaactttgtctaaggatttaaattactaacttatgaactccaatttgaattgaacttaactatcggctttcttactggtaaaattatatggtttattttaaatgcgtacatattgaccaatggcctctgaaaaagcacattttagatactgaaattgaaggaaagaaaatgcatcttcaaacattttttggaatctcaccacatatactttgttagatttgtgtattgtagggtgtttgttttgtatttttgtattgtatatgaactttttttaaatgtgacagttaaacacatctttaaaagcatagtcacagacaaaagcatacagtataaaaatttccttgaaaactcctacaatattatatttggaggcagcttcagactgttttattggtggtagctgcttgctgaggtcttttagttggtaataactccagagaagcagcctgtgtatattcctaacactttgttcactagcatttaagtttagaataagcccaagtaagacaatggaaatgtatatagaactcttagttcttacatgatttaattatatcgatacatgaatttaacttactttaatgtaggcaaactatcaattttttgtccattttcctgtttgttaaaataacatacctctcctacgtattattttcttgacccaaatgaaatattaacctaaggtcaagctgggagagagaaatgactgagatgaatgtctttactaaagtaccaataaatttgtcaaactcaa

SEQ ID NO: 16218 - DNA, 2211 bp, Homo sapiens
acgtccttggcgtggctgcagggggaggccgcggcggggaaaatggcggacgggaaggcgggagacgagaagcctgaaaagtcgcagcgagctggagccgccggagtaatggaggggaaagttccagtcgcagcgctgagaagcgatcagctgaagaagaagctgccgacctcccaacaaagcctacaaagatctccaagtttggatttgccataggtagtcagacgacaaagaaagcatcagccatatccatcaaacttggatcaagtaagcctaaagaaactgttccaactcttgctccaaaaactctttcagtagcagcagcttttaatgaagatgaagatagtgaaccagaggaaatgcctccagaagcaaagatgaggatgaagaatattggaagggatacaccaacatcagctggaccaaactccttcaataaaggaaagcatgggttttctgataaccagaagctgtgggagcgaaatataaaatctcatcttggaaatgtccatgaccaagacaattaaatgatgttttgaaattggggtgtggggtgggtgtaaagttaaaaggaacagtttccttttttaaagaatggtataagactatctttggagccgctttttttttctttttcatttttttaaaagattgagtggtacactaataaatgagagtttgaaattagaggtaatttatgttttatatacagatttcaagacatttgctaattttgtagtttcatgtgattagtttccaaaggttacagataataaagaaatcagaaatggtacctttttaagaattgcatatttttttagacacaactattagcacattaagagggaagcaaagttactgtctatttaaaactgcaagcagttaactctcttaactcccttattacctaaacttgtctggctcccaggaacagccttatagagagagggagtattgtattgggaagaaaatgttactgaactattgactgaaagtaaatttagataaaatacagcttttttccttatgggcatttgttttgtttcaagtcatcataaactaggtattgcattgctatccgtggatacagacgcttagctcttaaaagattttttttttatgtaaactgttgaatatttgaaatagtccacttcaccttaatgggtcttgtctatcttcattagtcttcaaagaaaaaccatttgctaccaaagtaaatcagtattttgaatgtgcttctcttgtttttggtttattagctagttcctgtaagcatttccaccagaacttgaggcaaatcgtaaggaagctgtttcttttaaaacacaaaccaccaccaaaaatttaaatgtacatattgcttaagtatttggctgtttttattttttaaaaggtataaacaccaaaaaaaaaattaacattgtatgaagatggaaaataagaagatgcactttctgtaactttgtctaaggatttaaattactaacttatgaactccaatttgaattgaacttaactatcggctttcttactggtaaaattatatggtttattttaaatgcgtacatattgaccaatggcctctgaaaaagcacattttagatactgaaattgaaggaaagaaaatgcatcttcaaacattttttggaatctcaccacatatactttgttagatttgtgtattgtagggtgtttgttttgtatttttgtattgtatatgaactttttttaaatgtgacagttaaacacatctttaaaagcatagtcacagacaaaagcatacagtataaaaatttccttgaaaactcctacaatattatatttggaggcagcttcagactgttttattggtggtagctgcttgctgaggtcttttagttggtaataactccagagaagcagcctgtgtatattcctaacactttgttcactagcatttaagtttagaataagcccaagtaagacaatggaaatgtatatagaactcttagttcttacatgatttaattatatcgatacatgaatttaacttactttaatgtaggcaaactatcaattttttgtccattttcctgtttgttaaaataacatacctctcctacgtattattttcttgacccaaatgaaatattaacctaaggtcaagctgggagagagaaatgactgagatgaatgtctttactaaagtaccaataaatttgtcaaactcaa

SEQ ID NO: 16219 - DNA, 2213 bp, Homo sapiens
gagtatcctcacctcctaccccacgggaggccgcggcggggaaaatggcggacgggaaggcgggagacgagaagcctgaaaagtcgcagcgagctggagccgccggagtaatggaggggaaagttccagtcgcagcgctgagaagcgatcagctgaagaagaagctgccgacctcccaacaaagcctacaaagatctccaagtttggatttgccataggtagtcagacgacaaagaaagcatcagccatatccatcaaacttggatcaagtaagcctaaagaaactgttccaactcttgctccaaaaactctttcagtagcagcagcttttaatgaagatgaagatagtgaaccagaggaaatgcctccagaagcaaagatgaggatgaagaatattggaagggatacaccaacatcagctggaccaaactccttcaataaaggaaagcatgggttttctgataaccagaagctgtgggagcgaaatataaaatctcatcttggaaatgtccatgaccaagacaattaaatgatgttttgaaattggggtgtggggtgggtgtaaagttaaaaggaacagtttccttttttaaagaatggtataagactatctttggagccgctttttttttctttttcatttttttaaaagattgagtggtacactaataaatgagagtttgaaattagaggtaatttatgttttatatacagatttcaagacatttgctaattttgtagtttcatgtgattagtttccaaaggttacagataataaagaaatcagaaatggtacctttttaagaattgcatatttttttagacacaactattagcacattaagagggaagcaaagttactgtctatttaaaactgcaagcagttaactctcttaactcccttattacctaaacttgtctggctcccaggaacagccttatagagagagggagtattgtattgggaagaaaatgttactgaactattgactgaaagtaaatttagataaaatacagcttttttccttatgggcatttgttttgtttcaagtcatcataaactaggtattgcattgctatccgtggatacagacgcttagctcttaaaagattttttttttatgtaaactgttgaatatttgaaatagtccacttcaccttaatgggtcttgtctatcttcattagtcttcaaagaaaaaccatttgctaccaaagtaaatcagtattttgaatgtgcttctcttgtttttggtttattagctagttcctgtaagcatttccaccagaacttgaggcaaatcgtaaggaagctgtttcttttaaaacacaaaccaccaccaaaaatttaaatgtacatattgcttaagtatttggctgtttttattttttaaaaggtataaacaccaaaaaaaaaattaacattgtatgaagatggaaaataagaagatgcactttctgtaactttgtctaaggatttaaattactaacttatgaactccaatttgaattgaacttaactatcggctttcttactggtaaaattatatggtttattttaaatgcgtacatattgaccaatggcctctgaaaaagcacattttagatactgaaattgaaggaaagaaaatgcatcttcaaacattttttggaatctcaccacatatactttgttagatttgtgtattgtagggtgtttgttttgtatttttgtattgtatatgaactttttttaaatgtgacagttaaacacatctttaaaagcatagtcacagacaaaagcatacagtataaaaatttccttgaaaactcctacaatattatatttggaggcagcttcagactgttttattggtggtagctgcttgctgaggtcttttagttggtaataactccagagaagcagcctgtgtatattcctaacactttgttcactagcatttaagtttagaataagcccaagtaagacaatggaaatgtatatagaactcttagttcttacatgatttaattatatcgatacatgaatttaacttactttaatgtaggcaaactatcaattttttgtccattttcctgtttgttaaaataacatacctctcctacgtattattttcttgacccaaatgaaatattaacctaaggtcaagctgggagagagaaatgactgagatgaatgtctttactaaagtaccaataaatttgtcaaactcaa

SEQ ID NO: 16220 - DNA, 2367 bp, Homo sapiens
  misc_feature (24)..(24): n is a, c, g, or t
  misc_feature (2298)..(2298): n is a, c, g, or t
ggacgcgtgggtcgacccacgcgntcggacccacgcgtgcggggaggccgcggcggggaaaatggcggacgggaaggcgggagacgagaagcctgaaaagtcgcagcgagctggagccgccggaggacctgaagaagaagcagaaaaacctgtgaaaactaagactgtttcttccagtaatggaggggaaagttccagtcgcagcgctgagaagcgatcagctgaagaagaagctgccgacctcccaacaaagcctacaaagatctccaagtttggatttgccataggtagtcagacgacaaagaaagcatcagccatatccatcaaacttggatcaagtaagcctaaagaaactgttccaactcttgctccaaaaactctttcagtagcagcagcttttaatgaagatgaagatagtgaaccagaggaaatgcctccagaagcaaagatgaggatgaagaatattggaagggatacaccaacatcagctggaccaaactccttcaataaaggaaagcatgggttttctgataaccagaagctgtgggagcgaaatataaaatctcatcttggaaatgtccatgaccaagacaattaaatgatgttttgaaattggggtgtggggtgggtgtaaagttaaaaggaacagtttccttttttaaagaatggtataagactatctttggagccgctttttttttctttttcatttttttaaaagattgagtggtacactaataaatgagagtttgaaattagaggtaatttatgttttatatacagatttcaagacatttgctaattttgtagtttcatgtgattagtttccaaaggttacagataataaagaaatcagaaatggtacctttttaagaattgcatatttttttagacacaactattagcacattaagagggaagcaaagttactgtctatttaaaactgcaagcagttaactctcttaactcccttattacctaaacttgtctggctcccaggaacagccttatagagagagggagtattgtattgggaagaaaatgttactgaactattgactgaaagtaaatttagataaaatacagcttttttccttatgggcatttgttttgtttcaagtcatcataaactaggtattgcattgctatccgtggatacagacgcttagctcttaaaagattttttttttatgtaaactgttgaatatttgaaatagtccacttcaccttaatgggtcttgtctatcttcattagtcttcaaagaaaaaccatttgctaccaaagtaaatcagtattttgaatgtgcttctcttgtttttggtttattagctagttcctgtaagcatttccaccagaacttgaggcaaatcgtaaggaagctgtttcttttaaaacacaaaccaccaccaaaaatttaaatgtacatattgcttaagtatttggctgtttttattttttaaaaggtataaacaccaaaaaaaaaattaacattgtatgaagatggaaaataagaagatgcactttctgtaactttgtctaaggatttaaattactaacttatgaactccaatttgaattgaacttaactatcggctttcttactggtaaaattatatggtttattttaaatgcgtacatattgaccaatggcctctgaaaaagcacattttagatactgaaattgaaggaaagaaaatgcatcttcaaacattttttggaatctcaccacatatactttgttagatttgtgtattgtagggtgtttgttttgtatttttgtattgtatatgaactttttttaaatgtgacagttaaacacatctttaaaagcatagtcacagacaaaagcatacagtataaaaatttccttgaaaactcctacaatattatatttggaggcagcttcagactgttttattggtggtagctgcttgctgaggtcttttagttggtaataactccagagaagcagcctgtgtatattcctaacactttgttcactagcatttaagtttagaataagcccaagtaagacaatggaaatgtatatagaactcttagttcttacatgatttaattatatcgatacatgaatttaacttactttaatgtaggcaaactatcaattttttgtccattttcctgtttgttaaaataacatacctctcctacgtattattttcttgacccaaatgaaatattaacctaaggtcaagctgggagagagaaatgactgagatgaatgtctttactaaagtaccaataaatttgtcaaactcaaaaaaaaaaaaacacancaacaacacaacaacacaacacaaacaacaaacaagacaaaacaaacagacaggacaaacaaacacaaa

SEQ ID NO: 16221 - DNA, 2626 bp, Homo sapiens
  misc_feature (24)..(24): n is a, c, g, or t
ggacgcgtgggtcgacccacgcgntcggacccacgcgtgcggggaggccgcggcggggaaaatggcggacgggaaggcgggagacgagaagcctgaaaagtcgcagcgagctggagccgccggaggtatataaactatttattaacagacaaggcctacagacttatttcttcttggacacacccacggtgcggccacggcggccagtggtcttggtgtgctggcctcggacacgaaggccccagaagtgacgcagccctctatgggcccgaatcttcttcagtcgctccaggtcttcacggagcttgttgtccagaccattggctaggacctggctgtattttccatcctttacatccttctgtctgttcaagaaccagtctgggatcttgtactggcgtggattctgcataatggtgatcacacgttccacctcatcatcagtgagttctcccgccctcttggtgaggacctgaagaagaagcagaaaaacctgtgaaaactaagactgtttcttccagtaatggaggggaaagttccagtcgcagcgctgagaagcgatcagctgaagaagaagctgccgacctcccaacaaagcctacaaagatctccaagtttggatttgccataggtagtcagacgacaaagaaagcatcagccatatccatcaaacttggatcaagtaagcctaaagaaactgttccaactcttgctccaaaaactctttcagtagcagcagcttttaatgaagatgaagatagtgaaccagaggaaatgcctccagaagcaaagatgaggatgaagaatattggaagggatacaccaacatcagctggaccaaactccttcaataaaggaaagcatgggttttctgataaccagaagctgtgggagcgaaatataaaatctcatcttggaaatgtccatgaccaagacaattaaatgatgttttgaaattggggtgtggggtgggtgtaaagttaaaaggaacagtttccttttttaaagaatggtataagactatctttggagccgctttttttttctttttcatttttttaaaagattgagtggtacactaataaatgagagtttgaaattagaggtaatttatgttttatatacagatttcaagacatttgctaattttgtagtttcatgtgattagtttccaaaggttacagataataaagaaatcagaaatggtacctttttaagaattgcatatttttttagacacaactattagcacattaagagggaagcaaagttactgtctatttaaaactgcaagcagttaactctcttaactcccttattacctaaacttgtctggctcccaggaacagccttatagagagagggagtattgtattgggaagaaaatgttactgaactattgactgaaagtaaatttagataaaatacagcttttttccttatgggcatttgttttgtttcaagtcatcataaactaggtattgcattgctatccgtggatacagacgcttagctcttaaaagattttttttttatgtaaactgttgaatatttgaaatagtccacttcaccttaatgggtcttgtctatcttcattagtcttcaaagaaaaaccatttgctaccaaagtaaatcagtattttgaatgtgcttctcttgtttttggtttattagctagttcctgtaagcatttccaccagaacttgaggcaaatcgtaaggaagctgtttcttttaaaacacaaaccaccaccaaaaatttaaatgtacatattgcttaagtatttggctgtttttattttttaaaaggtataaacaccaaaaaaaaaattaacattgtatgaagatggaaaataagaagatgcactttctgtaactttgtctaaggatttaaattactaacttatgaactccaatttgaattgaacttaactatcggctttcttactggtaaaattatatggtttattttaaatgcgtacatattgaccaatggcctctgaaaaagcacattttagatactgaaattgaaggaaagaaaatgcatcttcaaacattttttggaatctcaccacatatactttgttagatttgtgtattgtagggtgtttgttttgtatttttgtattgtatatgaactttttttaaatgtgacagttaaacacatctttaaaagcatagtcacagacaaaagcatacagtataaaaatttccttgaaaactcctacaatattatatttggaggcagcttcagactgttttattggtggtagctgcttgctgaggtcttttagttggtaataactccagagaagcagcctgtgtatattcctaacactttgttcactagcatttaagtttagaataagcccaagtaagacaatggaaatgtatatagaactcttagttcttacatgatttaattatatcgatacatgaatttaacttactttaatgtaggcaaactatcaattttttgtccattttcctgtttgttaaaataacatacctctcctacgtattattttcttgacccaaatgaaatattaacctaaggtcaagctgggagagagaaatgactgagatgaatgtctttactaaagtaccaataaatttgtcaaactcaa

SEQ ID NO: 16222 - DNA, 2483 bp, Homo sapiens
  misc_feature (24)..(24): n is a, c, g, or t
ggacgcgtgggtcgacccacgcgntcggacccacgcgtgcggggaggccgcggcggggaaaatggcggacgggaaggcgggagacgagaagcctgaaaagtcgcagcgagctggagccgccggagttaattcatgggagcctcttctactgccacacaatctcagttcctgctgtatactctaacaaacagtggaagagactgttgggtcagtaggtgacaactgcagaggtatcttccttataacgatgctttttgaggttgctgctcccatcaatctgctcagtaaaaatagctcatcttggtaagttgtttcgacttcaccaggacctgaagaagaagcagaaaaacctgtgaaaactaagactgtttcttccagtaatggaggggaaagttccagtcgcagcgctgagaagcgatcagctgaagaagaagctgccgacctcccaacaaagcctacaaagatctccaagtttggatttgccataggtagtcagacgacaaagaaagcatcagccatatccatcaaacttggatcaagtaagcctaaagaaactgttccaactcttgctccaaaaactctttcagtagcagcagcttttaatgaagatgaagatagtgaaccagaggaaatgcctccagaagcaaagatgaggatgaagaatattggaagggatacaccaacatcagctggaccaaactccttcaataaaggaaagcatgggttttctgataaccagaagctgtgggagcgaaatataaaatctcatcttggaaatgtccatgaccaagacaattaaatgatgttttgaaattggggtgtggggtgggtgtaaagttaaaaggaacagtttccttttttaaagaatggtataagactatctttggagccgctttttttttctttttcatttttttaaaagattgagtggtacactaataaatgagagtttgaaattagaggtaatttatgttttatatacagatttcaagacatttgctaattttgtagtttcatgtgattagtttccaaaggttacagataataaagaaatcagaaatggtacctttttaagaattgcatatttttttagacacaactattagcacattaagagggaagcaaagttactgtctatttaaaactgcaagcagttaactctcttaactcccttattacctaaacttgtctggctcccaggaacagccttatagagagagggagtattgtattgggaagaaaatgttactgaactattgactgaaagtaaatttagataaaatacagcttttttccttatgggcatttgttttgtttcaagtcatcataaactaggtattgcattgctatccgtggatacagacgcttagctcttaaaagattttttttttatgtaaactgttgaatatttgaaatagtccacttcaccttaatgggtcttgtctatcttcattagtcttcaaagaaaaaccatttgctaccaaagtaaatcagtattttgaatgtgcttctcttgtttttggtttattagctagttcctgtaagcatttccaccagaacttgaggcaaatcgtaaggaagctgtttcttttaaaacacaaaccaccaccaaaaatttaaatgtacatattgcttaagtatttggctgtttttattttttaaaaggtataaacaccaaaaaaaaaattaacattgtatgaagatggaaaataagaagatgcactttctgtaactttgtctaaggatttaaattactaacttatgaactccaatttgaattgaacttaactatcggctttcttactggtaaaattatatggtttattttaaatgcgtacatattgaccaatggcctctgaaaaagcacattttagatactgaaattgaaggaaagaaaatgcatcttcaaacattttttggaatctcaccacatatactttgttagatttgtgtattgtagggtgtttgttttgtatttttgtattgtatatgaactttttttaaatgtgacagttaaacacatctttaaaagcatagtcacagacaaaagcatacagtataaaaatttccttgaaaactcctacaatattatatttggaggcagcttcagactgttttattggtggtagctgcttgctgaggtcttttagttggtaataactccagagaagcagcctgtgtatattcctaacactttgttcactagcatttaagtttagaataagcccaagtaagacaatggaaatgtatatagaactcttagttcttacatgatttaattatatcgatacatgaatttaacttactttaatgtaggcaaactatcaattttttgtccattttcctgtttgttaaaataacatacctctcctacgtattattttcttgacccaaatgaaatattaacctaaggtcaagctgggagagagaaatgactgagatgaatgtctttactaaagtaccaataaatttgtcaaactcaa

SEQ ID NO: 16223 - DNA, 2400 bp, Homo sapiens
gtcatcgctgtctggaacagcgatgactcgagagggaggccgcggcggggaaaatggcggacgggaaggcgggagacgagaagcctgaaaagtcgcagcgagctggagccgccggagttaattcatgggagcctcttctactgccacacaatctcagttcctgctgtatactctaacaaacagtggaagagactgttgggtcagtaggtgacaactgcagaggtatcttccttataacgatgctttttgaggttgctgctcccatcaatctgctcagtaaaaatagctcatcttgtaatggaggggaaagttccagtcgcagcgctgagaagcgatcagctgaagaagaagctgccgacctcccaacaaagcctacaaagatctccaagtttggatttgccataggtagtcagacgacaaagaaagcatcagccatatccatcaaacttggatcaagtaagcctaaagaaactgttccaactcttgctccaaaaactctttcagtagcagcagcttttaatgaagatgaagatagtgaaccagaggaaatgcctccagaagcaaagatgaggatgaagaatattggaagggatacaccaacatcagctggaccaaactccttcaataaaggaaagcatgggttttctgataaccagaagctgtgggagcgaaatataaaatctcatcttggaaatgtccatgaccaagacaattaaatgatgttttgaaattggggtgtggggtgggtgtaaagttaaaaggaacagtttccttttttaaagaatggtataagactatctttggagccgctttttttttctttttcatttttttaaaagattgagtggtacactaataaatgagagtttgaaattagaggtaatttatgttttatatacagatttcaagacatttgctaattttgtagtttcatgtgattagtttccaaaggttacagataataaagaaatcagaaatggtacctttttaagaattgcatatttttttagacacaactattagcacattaagagggaagcaaagttactgtctatttaaaactgcaagcagttaactctcttaactcccttattacctaaacttgtctggctcccaggaacagccttatagagagagggagtattgtattgggaagaaaatgttactgaactattgactgaaagtaaatttagataaaatacagcttttttccttatgggcatttgttttgtttcaagtcatcataaactaggtattgcattgctatccgtggatacagacgcttagctcttaaaagattttttttttatgtaaactgttgaatatttgaaatagtccacttcaccttaatgggtcttgtctatcttcattagtcttcaaagaaaaaccatttgctaccaaagtaaatcagtattttgaatgtgcttctcttgtttttggtttattagctagttcctgtaagcatttccaccagaacttgaggcaaatcgtaaggaagctgtttcttttaaaacacaaaccaccaccaaaaatttaaatgtacatattgcttaagtatttggctgtttttattttttaaaaggtataaacaccaaaaaaaaaattaacattgtatgaagatggaaaataagaagatgcactttctgtaactttgtctaaggatttaaattactaacttatgaactccaatttgaattgaacttaactatcggctttcttactggtaaaattatatggtttattttaaatgcgtacatattgaccaatggcctctgaaaaagcacattttagatactgaaattgaaggaaagaaaatgcatcttcaaacattttttggaatctcaccacatatactttgttagatttgtgtattgtagggtgtttgttttgtatttttgtattgtatatgaactttttttaaatgtgacagttaaacacatctttaaaagcatagtcacagacaaaagcatacagtataaaaatttccttgaaaactcctacaatattatatttggaggcagcttcagactgttttattggtggtagctgcttgctgaggtcttttagttggtaataactccagagaagcagcctgtgtatattcctaacactttgttcactagcatttaagtttagaataagcccaagtaagacaatggaaatgtatatagaactcttagttcttacatgatttaattatatcgatacatgaatttaacttactttaatgtaggcaaactatcaattttttgtccattttcctgtttgttaaaataacatacctctcctacgtattattttcttgacccaaatgaaatattaacctaaggtcaagctgggagagagaaatgactgagatgaatgtctttactaaagtaccaataaatttgtcaaactcaa

SEQ ID NO: 16224 - DNA, 2465 bp, Homo sapiens
ttagcgtggtcgcggccgaggtacaaattgtagtgtttagttgaagggtcttgactttttgtgaactctgtgtttataattttaaattgctctgtattttatgctagttaattcatgggagcctcttctactgccacacaatctcagttcctgctgtatactctaacaaacagtggaagagactgttgggtcagtaggtgacaactgcagaggtatcttccttataacgatgctttttgaggttgctgctcccatcaatctgctcagtaaaaatagctcatcttggtaagttgtttcgacttcaccaggacctgaagaagaagcagaaaaacctgtgaaaactaagactgtttcttccagtaatggaggggaaagttccagtcgcagcgctgagaagcgatcagctgaagaagaagctgccgacctcccaacaaagcctacaaagatctccaagtttggatttgccataggtagtcagacgacaaagaaagcatcagccatatccatcaaacttggatcaagtaagcctaaagaaactgttccaactcttgctccaaaaactctttcagtagcagcagcttttaatgaagatgaagatagtgaaccagaggaaatgcctccagaagcaaagatgaggatgaagaatattggaagggatacaccaacatcagctggaccaaactccttcaataaaggaaagcatgggttttctgataaccagaagctgtgggagcgaaatataaaatctcatcttggaaatgtccatgaccaagacaattaaatgatgttttgaaattggggtgtggggtgggtgtaaagttaaaaggaacagtttccttttttaaagaatggtataagactatctttggagccgctttttttttctttttcatttttttaaaagattgagtggtacactaataaatgagagtttgaaattagaggtaatttatgttttatatacagatttcaagacatttgctaattttgtagtttcatgtgattagtttccaaaggttacagataataaagaaatcagaaatggtacctttttaagaattgcatatttttttagacacaactattagcacattaagagggaagcaaagttactgtctatttaaaactgcaagcagttaactctcttaactcccttattacctaaacttgtctggctcccaggaacagccttatagagagagggagtattgtattgggaagaaaatgttactgaactattgactgaaagtaaatttagataaaatacagcttttttccttatgggcatttgttttgtttcaagtcatcataaactaggtattgcattgctatccgtggatacagacgcttagctcttaaaagattttttttttatgtaaactgttgaatatttgaaatagtccacttcaccttaatgggtcttgtctatcttcattagtcttcaaagaaaaaccatttgctaccaaagtaaatcagtattttgaatgtgcttctcttgtttttggtttattagctagttcctgtaagcatttccaccagaacttgaggcaaatcgtaaggaagctgtttcttttaaaacacaaaccaccaccaaaaatttaaatgtacatattgcttaagtatttggctgtttttattttttaaaaggtataaacaccaaaaaaaaaattaacattgtatgaagatggaaaataagaagatgcactttctgtaactttgtctaaggatttaaattactaacttatgaactccaatttgaattgaacttaactatcggctttcttactggtaaaattatatggtttattttaaatgcgtacatattgaccaatggcctctgaaaaagcacattttagatactgaaattgaaggaaagaaaatgcatcttcaaacattttttggaatctcaccacatatactttgttagatttgtgtattgtagggtgtttgttttgtatttttgtattgtatatgaactttttttaaatgtgacagttaaacacatctttaaaagcatagtcacagacaaaagcatacagtataaaaatttccttgaaaactcctacaatattatatttggaggcagcttcagactgttttattggtggtagctgcttgctgaggtcttttagttggtaataactccagagaagcagcctgtgtatattcctaacactttgttcactagcatttaagtttagaataagcccaagtaagacaatggaaatgtatatagaactcttagttcttacatgatttaattatatcgatacatgaatttaacttactttaatgtaggcaaactatcaattttttgtccattttcctgtttgttaaaataacatacctctcctacgtattattttcttgacccaaatgaaatattaacctaaggtcaagctgggagagagaaatgactgagatgaatgtctttactaaagtaccaataaatttgtcaaactcaa

SEQ ID NO: 16225 - DNA, 2084 bp, Homo sapiens
aactgcgaaggctcgggaaacgcacacgagacgccctgccgacctcccaacaaagcctacaaagatctccaagtttggatttgccataggtagtcagacgacaaagaaagcatcagccatatccatcaaacttggatcaagtaagcctaaagaaactgttccaactcttgctccaaaaactctttcagtagcagcagcttttaatgaagatgaagatagtgaaccagaggaaatgcctccagaagcaaagatgaggatgaagaatattggaagggatacaccaacatcagctggaccaaactccttcaataaaggaaagcatgggttttctgataaccagaagctgtgggagcgaaatataaaatctcatcttggaaatgtccatgaccaagacaattaaatgatgttttgaaattggggtgtggggtgggtgtaaagttaaaaggaacagtttccttttttaaagaatggtataagactatctttggagccgctttttttttctttttcatttttttaaaagattgagtggtacactaataaatgagagtttgaaattagaggtaatttatgttttatatacagatttcaagacatttgctaattttgtagtttcatgtgattagtttccaaaggttacagataataaagaaatcagaaatggtacctttttaagaattgcatatttttttagacacaactattagcacattaagagggaagcaaagttactgtctatttaaaactgcaagcagttaactctcttaactcccttattacctaaacttgtctggctcccaggaacagccttatagagagagggagtattgtattgggaagaaaatgttactgaactattgactgaaagtaaatttagataaaatacagcttttttccttatgggcatttgttttgtttcaagtcatcataaactaggtattgcattgctatccgtggatacagacgcttagctcttaaaagattttttttttatgtaaactgttgaatatttgaaatagtccacttcaccttaatgggtcttgtctatcttcattagtcttcaaagaaaaaccatttgctaccaaagtaaatcagtattttgaatgtgcttctcttgtttttggtttattagctagttcctgtaagcatttccaccagaacttgaggcaaatcgtaaggaagctgtttcttttaaaacacaaaccaccaccaaaaatttaaatgtacatattgcttaagtatttggctgtttttattttttaaaaggtataaacaccaaaaaaaaaattaacattgtatgaagatggaaaataagaagatgcactttctgtaactttgtctaaggatttaaattactaacttatgaactccaatttgaattgaacttaactatcggctttcttactggtaaaattatatggtttattttaaatgcgtacatattgaccaatggcctctgaaaaagcacattttagatactgaaattgaaggaaagaaaatgcatcttcaaacattttttggaatctcaccacatatactttgttagatttgtgtattgtagggtgtttgttttgtatttttgtattgtatatgaactttttttaaatgtgacagttaaacacatctttaaaagcatagtcacagacaaaagcatacagtataaaaatttccttgaaaactcctacaatattatatttggaggcagcttcagactgttttattggtggtagctgcttgctgaggtcttttagttggtaataactccagagaagcagcctgtgtatattcctaacactttgttcactagcatttaagtttagaataagcccaagtaagacaatggaaatgtatatagaactcttagttcttacatgatttaattatatcgatacatgaatttaacttactttaatgtaggcaaactatcaattttttgtccattttcctgtttgttaaaataacatacctctcctacgtattattttcttgacccaaatgaaatattaacctaaggtcaagctgggagagagaaatgactgagatgaatgtctttactaaagtaccaataaatttgtcaaactcaa

SEQ ID NO: 16226 - DNA, 2771 bp, Homo sapiens
  misc_feature (24)..(24): n is a, c, g, or t
ggacgcgtgggtcgacccacgcgntcggacccacgcgtgcggggaggccgcggcggggaaaatggcggacgggaaggcgggagacgagaagcctgaaaagtcgcagcgagctggagccgccggaggacctgaagaagaagcagaaaaacctgtgaaaactaagactgtttcttccagtaatggaggggaaagttccagtcgcagcgctgagaagcgatcagctgaagaagaagctgccgacctcccaacaaagcctacaaagatctccaagtttggatttgccataggtagtcagacgacaaagaaagcatcagccatatccatcaaacttggatcaagtaagcctaaagaaactgttccaactcttgctccaaaaactctttcagtagcagcagcttttaatgaagatgaagatagtgaaccagaggaaatgcctccagaagcaaagatgaggatgaagaatattggaagggatacaccaacatcagctggaccaaactccttcaataaaggaaagcatgggttttctgataaccagaagctgtgggagcgaaatataaaatctcatcttggaaatgtccatgaccaagacaattaaatgatgttttgaaattggggtgtggggtgggtgtaaagttaaaaggaacagtttccttttttaaagaatggtataagactatctttggagccgctttttttttctttttcatttttttaaaagattgagtggtacactaataaatgagagtttgaaattagaggtaatttatgttttatatacagatttcaagacatttgctaattttgtagtttcatgtgattagtttccaaaggttacagataataaagaaatcagaaatggtacctttttaagaattgcatatttttttagacacaactattagcacattaagagggaagcaaagttactgtctatttaaaactgcaagcagttaactctcttaactcccttattacctaaacttgtctggctcccaggaacagccttatagagagagggagtattgtattgggaagaaaatgttactgaactattgactgaaagtaaatttagataaaatacagcttttttccttatgggcatttgttttgtttcaagtcatcataaactaggtattgcattgctatccgtggatacagacgcttagctcttaaaagattttttttttatgtaaactgttgaatatttgaaatagtccacttcaccttaatgggtcttgtctatcttcattagtcttcaaagaaaaaccatttgctaccaaagtaaatcagtattttgaatgtgcttctcttgtttttggtttattagctagttcctgtaagcatttccaccagaacttgaggcaaatcgtaaggaagctgtttcttttaaaacacaaaccaccaccaaaaatttaaatgtacatattgcttaagtatttggctgtttttattttttaaaaggtataaacaccaaaaaaaaaattaacattgtatgaagatggaaaataagaagatgcactttctgtaactttgtctaaggatttaaattactaacttatgaactccaatttgaattgaacttaactatcggctttcttactggtaaaattatatggtttattttaaatgcgtacatattgaccaatggcctctgaaaaagcacattttagatactgaaattgaaggaaagaaaatgcatcttcaaacattttttggaatctcaccacatatactttgttagatttgtgtattgtagggtgtttgttttgtatttttgtattgtatatgaactttttttaaatgtgacagttaaacacatctttaaaagcatagtcacagacaaaagcatacagtataaaaatttccttgaaaactcctacaatattatatttggaggcagcttcagactgttttattggtggtagctgcttgctgaggtcttttagttggtaataactccagagaagcagcctgtgtatattcctaacactttgttcactagcatttaagtttagaataagcccaagtaagacaatggaaatgtatatagaactcttagttcttacatgatttaattatatcgatacatgaatttaacttactttaatgtaggcaaactatcaattttttgtccattttcctgtttgttaaaataacatacctctcctacgtattattttcttgacccaaatgaaatattaacctaaggtcaagctgggagagagaaatgactgagatgaatgtctttactaaagtaccaataaatttgtcaaactcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacttgggggccctctgggcccaagccttttttattttgggaaagtttttggctcgggcccaaatttgggcccctttgcccaattccccctaaggggggggctattaaaaataaagggcccgtgtttaaacaaggggggggggggaaaaccccgggggaccccaacttaaaccctttgggaaaatccccctttttggagggggggggaattgaaaaaaggccccaccacattcctttttcaaaaaagtgggccaccttaattgggaatgaaaattttgggggtttattttgtgtaaatacccgggtaaaattttgaaaaaaagctattttttaaccataagcgccaatcggaaaatccccttaataaataaagaacgga

SEQ ID NO: 16227 - DNA, 2067 bp, Homo sapiens
  misc_feature (24)..(24): n is a, c, g, or t
ggacgcgtgggtcgacccacgcgntcggacccacgcgtgcggggaggccgcggcggggaaaatggcggacgggaaggcgggagacgagaagcctgaaaagtcgcagcgagctggagccgccggagaagcctaaagaaactgttccaactcttgctccaaaaactctttcagtagcagcagcttttaatgaagatgaagatagtgaaccagaggaaatgcctccagaagcaaagatgaggatgaagaatattggaagggatacaccaacatcagctggaccaaactccttcaataaaggaaagcatgggttttctgataaccagaagctgtgggagcgaaatataaaatctcatcttggaaatgtccatgaccaagacaattaaatgatgttttgaaattggggtgtggggtgggtgtaaagttaaaaggaacagtttccttttttaaagaatggtataagactatctttggagccgctttttttttctttttcatttttttaaaagattgagtggtacactaataaatgagagtttgaaattagaggtaatttatgttttatatacagatttcaagacatttgctaattttgtagtttcatgtgattagtttccaaaggttacagataataaagaaatcagaaatggtacctttttaagaattgcatatttttttagacacaactattagcacattaagagggaagcaaagttactgtctatttaaaactgcaagcagttaactctcttaactcccttattacctaaacttgtctggctcccaggaacagccttatagagagagggagtattgtattgggaagaaaatgttactgaactattgactgaaagtaaatttagataaaatacagcttttttccttatgggcatttgttttgtttcaagtcatcataaactaggtattgcattgctatccgtggatacagacgcttagctcttaaaagattttttttttatgtaaactgttgaatatttgaaatagtccacttcaccttaatgggtcttgtctatcttcattagtcttcaaagaaaaaccatttgctaccaaagtaaatcagtattttgaatgtgcttctcttgtttttggtttattagctagttcctgtaagcatttccaccagaacttgaggcaaatcgtaaggaagctgtttcttttaaaacacaaaccaccaccaaaaatttaaatgtacatattgcttaagtatttggctgtttttattttttaaaaggtataaacaccaaaaaaaaaattaacattgtatgaagatggaaaataagaagatgcactttctgtaactttgtctaaggatttaaattactaacttatgaactccaatttgaattgaacttaactatcggctttcttactggtaaaattatatggtttattttaaatgcgtacatattgaccaatggcctctgaaaaagcacattttagatactgaaattgaaggaaagaaaatgcatcttcaaacattttttggaatctcaccacatatactttgttagatttgtgtattgtagggtgtttgttttgtatttttgtattgtatatgaactttttttaaatgtgacagttaaacacatctttaaaagcatagtcacagacaaaagcatacagtataaaaatttccttgaaaactcctacaatattatatttggaggcagcttcagactgttttattggtggtagctgcttgctgaggtcttttagttggtaataactccagagaagcagcctgtgtatattcctaacactttgttcactagcatttaagtttagaataagcccaagtaagacaatggaaatgtatatagaactcttagttcttacatgatttaattatatcgatacatgaatttaacttactttaatgtaggcaaactatcaattttttgtccattttcctgtttgttaaaataacatacctctcctacgtattattttcttgacccaaatgaaatattaacctaaggtcaagctgggagagagaaatgactgagatgaatgtctttactaaagtaccaataaatttgtcaaactcaa

SEQ ID NO: 16228 - DNA, 2282 bp, Homo sapiens
  misc_feature (24)..(24): n is a, c, g, or t
  misc_feature (2235)..(2235): n is a, c, g, or t
  misc_feature (2237)..(2237): n is a, c, g, or t
  misc_feature (2239)..(2239): n is a, c, g, or t
ggacgcgtgggtcgacccacgcgntcggacccacgcgtgcggggaggccgcggcggggaaaatggcggacgggaaggcgggagacgagaagcctgaaaagtcgcagcgagctggagccgccggaggacctgaagaagaagcagaaaaacctgtgaaaactaagactgtttcttccagtaatggaggggaaagttccagtcgcagcgctgagaagcgatcagctgaagaagaagctgccgacctcccaacaaagcctacaaagatctccaagtttggatttgccataggtagtcagacgacaaagaaagcatcagccatatccatcaaacttggatcaagtaagcctaaagaaactgttccaactcttgctccaaaaactctttcagtagcagcagcttttaatgaagatgaagatagtgaaccagaggaaatgcctccagaagcaaagatgaggatgaagaatattggaagggatacaccaacatcagctggaccaaactccttcaataaaggaaagcatgggttttctgataaccagaagctgtgggagcgaaatataaaatctcatcttggaaatgtccatgaccaagacaattaaatgatgttttgaaattggggtgtggggtgggtgtaaagttaaaaggaacagtttccttttttaaagaatggtataagactatctttggagccgctttttttttctttttcatttttttaaaagattgagtggtacactaataaatgagagtttgaaattagaggtaatttatgttttatatacagatttcaagacatttgctaattttgtagtttcatgtgattagtttccaaaggttacagataataaagaaatcagaaatggtacctttttaagaattgcatatttttttagacacaactattagcacattaagagggaagcaaagttactgtctatttaaaactgcaagcagttaactctcttaactcccttattacctaaacttgtctggctcccaggaacagccttatagagagagggagtattgtattgggaagaaaatgttactgaactattgactgaaagtaaatttagataaaatacagcttttttccttatgggcatttgttttgtttcaagtcatcataaactaggtattgcattgctatccgtggatacagacgcttagctcttaaaagattttttttttatgtaaactgttgaatatttgaaatagtccacttcaccttaatgggtcttgtctatcttcattagtcttcaaagaaaaaccatttgctaccaaagtaaatcagtattttgaatgtgcttctcttgtttttggtttattagctagttcctgtaagcatttccaccagaacttgaggcaaatcgtaaggaagctgtttcttttaaaacacaaaccaccaccaaaaatttaaatgtacatattgcttaagtatttggctgtttttattttttaaaaggtataaacaccaaaaaaaaaattaacattgtatgaagatggaaaataagaagatgcactttctgtaactttgtctaaggatttaaattactaacttatgaactccaatttgaattgaacttaactatcggctttcttactggtaaaattatatggtttattttaaatgcgtacatattgaccaatggcctctgaaaaagcacattttagatactgaaattgaaggaaagaaaatgcatcttcaaacattttttggaatctcaccacatatactttgttagatttgtgtattgtagggtgtttgttttgtatttttgtattgtatatgaactttttttaaatgtgacagttaaacacatctttaaaagcatagtcacagacaaaagcatacagtataaaaatttccttgaaaactcctacaatattatatttggaggcagcttcagactgttttattggtggtagctgcttgctgaggtcttttagttggtaataactccagagaagcagcctgtgtatattcctaacactttgttcactagcatttaagtttagaataagcccaagtaagacaatggaaatgtatatagaactcttagttcttacatgatttaattatatcgatacatgaatttaacttactttaatgtaggcaaactatcaattttttgtccattttcctgtttgttaaaataacatacctctcctacgtattattttcttgacccaaatgaaatattaacctaaggtcaagctgggagagagaaatgancntngaggattacatctcggtgcgtggggttaaattatccaaagttt

SEQ ID NO: 16229 - DNA, 2411 bp, Homo sapiens
  misc_feature (24)..(24): n is a, c, g, or t
ggacgcgtgggtcgacccacgcgntcggacccacgcgtgcggggaggccgcggcggggaaaatggcggacgggaaggcgggagacgagaagcctgaaaagtcgcagcgagctggagccgccggaggtatataaactatttattaacagacaaggcctacagacttatttcttcttggacacacccacggtgcggccacggcggccagtggtcttggtgtgctggcctcggacacgaaggccccagaagtgacgcagccctctatgggcccgaatcttcttcagtcgctccaggtcttcacggagcttgttgtccagaccattggctaggacctggctgtattttccatcctttacatccttctgtctgttcaagaaccagtctgggatcttgtactggcgtggattctgcataatggtgatcacacgttccacctcatcatcagtgagttctcccgccctcttggtgagaagcctaaagaaactgttccaactcttgctccaaaaactctttcagtagcagcagcttttaatgaagatgaagatagtgaaccagaggaaatgcctccagaagcaaagatgaggatgaagaatattggaagggatacaccaacatcagctggaccaaactccttcaataaaggaaagcatgggttttctgataaccagaagctgtgggagcgaaatataaaatctcatcttggaaatgtccatgaccaagacaattaaatgatgttttgaaattggggtgtggggtgggtgtaaagttaaaaggaacagtttccttttttaaagaatggtataagactatctttggagccgctttttttttctttttcatttttttaaaagattgagtggtacactaataaatgagagtttgaaattagaggtaatttatgttttatatacagatttcaagacatttgctaattttgtagtttcatgtgattagtttccaaaggttacagataataaagaaatcagaaatggtacctttttaagaattgcatatttttttagacacaactattagcacattaagagggaagcaaagttactgtctatttaaaactgcaagcagttaactctcttaactcccttattacctaaacttgtctggctcccaggaacagccttatagagagagggagtattgtattgggaagaaaatgttactgaactattgactgaaagtaaatttagataaaatacagcttttttccttatgggcatttgttttgtttcaagtcatcataaactaggtattgcattgctatccgtggatacagacgcttagctcttaaaagattttttttttatgtaaactgttgaatatttgaaatagtccacttcaccttaatgggtcttgtctatcttcattagtcttcaaagaaaaaccatttgctaccaaagtaaatcagtattttgaatgtgcttctcttgtttttggtttattagctagttcctgtaagcatttccaccagaacttgaggcaaatcgtaaggaagctgtttcttttaaaacacaaaccaccaccaaaaatttaaatgtacatattgcttaagtatttggctgtttttattttttaaaaggtataaacaccaaaaaaaaaattaacattgtatgaagatggaaaataagaagatgcactttctgtaactttgtctaaggatttaaattactaacttatgaactccaatttgaattgaacttaactatcggctttcttactggtaaaattatatggtttattttaaatgcgtacatattgaccaatggcctctgaaaaagcacattttagatactgaaattgaaggaaagaaaatgcatcttcaaacattttttggaatctcaccacatatactttgttagatttgtgtattgtagggtgtttgttttgtatttttgtattgtatatgaactttttttaaatgtgacagttaaacacatctttaaaagcatagtcacagacaaaagcatacagtataaaaatttccttgaaaactcctacaatattatatttggaggcagcttcagactgttttattggtggtagctgcttgctgaggtcttttagttggtaataactccagagaagcagcctgtgtatattcctaacactttgttcactagcatttaagtttagaataagcccaagtaagacaatggaaatgtatatagaactcttagttcttacatgatttaattatatcgatacatgaatttaacttactttaatgtaggcaaactatcaattttttgtccattttcctgtttgttaaaataacatacctctcctacgtattattttcttgacccaaatgaaatattaacctaaggtcaagctgggagagagaaatgactgagatgaatgtctttactaaagtaccaataaatttgtcaaactcaa

SEQ ID NO: 16230 - DNA, 3072 bp, Homo sapiens
aaaaaaaatttttttagagatgggggacttgctgtgttgaccaggctggcctggaactcctggtctcaagcagccctcctgactcagcttcccaaagtgttgagattgcacatgtgaggcactgtgcctgcctgggtatctatatcttctaaatggggagtagcaggaaagggacagaacaaaaggtgggagaattgggagaataaccagtaaaaagcatgttacagaagccaaggaaagggtgtttttattttttattttttttatttttattttttgagacagtctcactctgttacccaggctggaatgcagtggcgtgatctcacctcactgcaacctctgcctcctgggttcaagcgattctcctgcctcagcctcccaagtaactaggattacaggcactcaccaccacacctggctgattttttgtgtttttagtagagagcaccttgggaggctgaggcgggtagatcacgaggtcaggagttcaagaccagcctggccaacatggcgaaacctcgtctctactaaatatacaaaataaattctctgggcatggtggcacacacctgtaatcccagctattcaggacgccaagtcatgagaatcatttgaacccaggaggcataggctgcaatgagccaagattatgccgctgcactccagcctgggcgacagagcaagactctgttctcaaaaagaaaaacaaaaaacatagtgagaagagatggtttggattaattatgtttataggcctagaggcagaaagccccttttatgctttcaaggcacattgtatttaatgttactgtgggaaggtattactaatcattttctcttgcctgtaccaagtaccccttaggtaagtgatattgtagatcctaactagaaaatcttttataggagggcaacaaatggatgccacaagttagtaaagtaaaacatacccactgataatccacatttttgaaaagagagaatggatttgtccaaagtattgggttcgttactatacaaatttctgtggaaatatagttaaatcattcaagataaattattcatatcattaaacaagcttgtataaatgttatctacatgatattctttttaatatgtttcttcttcagaagcctaaagaaactgttccaactcttgctccaaaaactctttcagtagcagcagcttttaatgaagatgaagatagtgaaccagaggaaatgcctccagaagcaaagatgaggatgaagaatattggaagggatacaccaacatcagctggaccaaactccttcaataaaggaaagcatgggttttctgataaccagaagctgtgggagcgaaatataaaatctcatcttggaaatgtccatgaccaagacaattaaatgatgttttgaaattggggtgtggggtgggtgtaaagttaaaaggaacagtttccttttttaaagaatggtataagactatctttggagccgctttttttttctttttcatttttttaaaagattgagtggtacactaataaatgagagtttgaaattagaggtaatttatgttttatatacagatttcaagacatttgctaattttgtagtttcatgtgattagtttccaaaggttacagataataaagaaatcagaaatggtacctttttaagaattgcatatttttttagacacaactattagcacattaagagggaagcaaagttactgtctatttaaaactgcaagcagttaactctcttaactcccttattacctaaacttgtctggctcccaggaacagccttatagagagagggagtattgtattgggaagaaaatgttactgaactattgactgaaagtaaatttagataaaatacagcttttttccttatgggcatttgttttgtttcaagtcatcataaactaggtattgcattgctatccgtggatacagacgcttagctcttaaaagattttttttttatgtaaactgttgaatatttgaaatagtccacttcaccttaatgggtcttgtctatcttcattagtcttcaaagaaaaaccatttgctaccaaagtaaatcagtattttgaatgtgcttctcttgtttttggtttattagctagttcctgtaagcatttccaccagaacttgaggcaaatcgtaaggaagctgtttcttttaaaacacaaaccaccaccaaaaatttaaatgtacatattgcttaagtatttggctgtttttattttttaaaaggtataaacaccaaaaaaaaaattaacattgtatgaagatggaaaataagaagatgcactttctgtaactttgtctaaggatttaaattactaacttatgaactccaatttgaattgaacttaactatcggctttcttactggtaaaattatatggtttattttaaatgcgtacatattgaccaatggcctctgaaaaagcacattttagatactgaaattgaaggaaagaaaatgcatcttcaaacattttttggaatctcaccacatatactttgttagatttgtgtattgtagggtgtttgttttgtatttttgtattgtatatgaactttttttaaatgtgacagttaaacacatctttaaaagcatagtcacagacaaaagcatacagtataaaaatttccttgaaaactcctacaatattatatttggaggcagcttcagactgttttattggtggtagctgcttgctgaggtcttttagttggtaataactccagagaagcagcctgtgtatattcctaacactttgttcactagcatttaagtttagaataagcccaagtaagacaatggaaatgtatatagaactcttagttcttacatgatttaattatatcgatacatgaatttaacttactttaatgtaggcaaactatcaattttttgtccattttcctgtttgttaaaataacatacctctcctacgtattattttcttgacccaaatgaaatattaacctaaggtcaagctgggagagagaaatgactgagatgaatgtctttactaaagtaccaataaatttgtcaaactcaa

SEQ ID NO: 16231 - DNA, 2155 bp, Homo sapiens
gaaacataactatactccctctctctataaggctgttcctgggagccagacaagtttaggtaataagggagttaagagagttaactgcttgcagttttaaatagacagtaactttgcttccctcttaatgtgctaatagtttgtaacattttcttcccaatacaatactccctctctctataaggctgttcctgggagtattgtattgggaagaagcctaaagaaactgttccaactcttgctccaaaaactctttcagtagcagcagcttttaatgaagatgaagatagtgaaccagaggaaatgcctccagaagcaaagatgaggatgaagaatattggaagggatacaccaacatcagctggaccaaactccttcaataaaggaaagcatgggttttctgataaccagaagctgtgggagcgaaatataaaatctcatcttggaaatgtccatgaccaagacaattaaatgatgttttgaaattggggtgtggggtgggtgtaaagttaaaaggaacagtttccttttttaaagaatggtataagactatctttggagccgctttttttttctttttcatttttttaaaagattgagtggtacactaataaatgagagtttgaaattagaggtaatttatgttttatatacagatttcaagacatttgctaattttgtagtttcatgtgattagtttccaaaggttacagataataaagaaatcagaaatggtacctttttaagaattgcatatttttttagacacaactattagcacattaagagggaagcaaagttactgtctatttaaaactgcaagcagttaactctcttaactcccttattacctaaacttgtctggctcccaggaacagccttatagagagagggagtattgtattgggaagaaaatgttactgaactattgactgaaagtaaatttagataaaatacagcttttttccttatgggcatttgttttgtttcaagtcatcataaactaggtattgcattgctatccgtggatacagacgcttagctcttaaaagattttttttttatgtaaactgttgaatatttgaaatagtccacttcaccttaatgggtcttgtctatcttcattagtcttcaaagaaaaaccatttgctaccaaagtaaatcagtattttgaatgtgcttctcttgtttttggtttattagctagttcctgtaagcatttccaccagaacttgaggcaaatcgtaaggaagctgtttcttttaaaacacaaaccaccaccaaaaatttaaatgtacatattgcttaagtatttggctgtttttattttttaaaaggtataaacaccaaaaaaaaaattaacattgtatgaagatggaaaataagaagatgcactttctgtaactttgtctaaggatttaaattactaacttatgaactccaatttgaattgaacttaactatcggctttcttactggtaaaattatatggtttattttaaatgcgtacatattgaccaatggcctctgaaaaagcacattttagatactgaaattgaaggaaagaaaatgcatcttcaaacattttttggaatctcaccacatatactttgttagatttgtgtattgtagggtgtttgttttgtatttttgtattgtatatgaactttttttaaatgtgacagttaaacacatctttaaaagcatagtcacagacaaaagcatacagtataaaaatttccttgaaaactcctacaatattatatttggaggcagcttcagactgttttattggtggtagctgcttgctgaggtcttttagttggtaataactccagagaagcagcctgtgtatattcctaacactttgttcactagcatttaagtttagaataagcccaagtaagacaatggaaatgtatatagaactcttagttcttacatgatttaattatatcgatacatgaatttaacttactttaatgtaggcaaactatcaattttttgtccattttcctgtttgttaaaataacatacctctcctacgtattattttcttgacccaaatgaaatattaacctaaggtcaagctgggagagagaaatgactgagatgaatgtctttactaaagtaccaataaatttgtcaaactcaa

SEQ ID NO: 16232 - DNA, 2226 bp, Homo sapiens
  misc_feature (24)..(24): n is a, c, g, or t
ggacgcgtgggtcgacccacgcgntcggacccacgcgtgcggggaggccgcggcggggaaaatggcggacgggaaggcgggagacgagaagcctgaaaagtcgcagcgagctggagccgccggaggacctgaagaagaagcagaaaaacctgtgaaaactaagactgtttcttccagtaatggaggggaaagttccagtcgcagcgctgagaagcgatcagctgaagaagaagctgccgacctcccaacaaagcctacaaagatctccaagtttggatttgccataggtagtcagacgacaaagaaagcatcagccatatccatcaaacttggatcaagtaagcctaaagaaactgttccaactcttgctccaaaaactctttcagtagcagcagcttttaatgaagatgaagatggatacaccaacatcagctggaccaaactccttcaataaaggaaagcatgggttttctgataaccagaagctgtgggagcgaaatataaaatctcatcttggaaatgtccatgaccaagacaattaaatgatgttttgaaattggggtgtggggtgggtgtaaagttaaaaggaacagtttccttttttaaagaatggtataagactatctttggagccgctttttttttctttttcatttttttaaaagattgagtggtacactaataaatgagagtttgaaattagaggtaatttatgttttatatacagatttcaagacatttgctaattttgtagtttcatgtgattagtttccaaaggttacagataataaagaaatcagaaatggtacctttttaagaattgcatatttttttagacacaactattagcacattaagagggaagcaaagttactgtctatttaaaactgcaagcagttaactctcttaactcccttattacctaaacttgtctggctcccaggaacagccttatagagagagggagtattgtattgggaagaaaatgttactgaactattgactgaaagtaaatttagataaaatacagcttttttccttatgggcatttgttttgtttcaagtcatcataaactaggtattgcattgctatccgtggatacagacgcttagctcttaaaagattttttttttatgtaaactgttgaatatttgaaatagtccacttcaccttaatgggtcttgtctatcttcattagtcttcaaagaaaaaccatttgctaccaaagtaaatcagtattttgaatgtgcttctcttgtttttggtttattagctagttcctgtaagcatttccaccagaacttgaggcaaatcgtaaggaagctgtttcttttaaaacacaaaccaccaccaaaaatttaaatgtacatattgcttaagtatttggctgtttttattttttaaaaggtataaacaccaaaaaaaaaattaacattgtatgaagatggaaaataagaagatgcactttctgtaactttgtctaaggatttaaattactaacttatgaactccaatttgaattgaacttaactatcggctttcttactggtaaaattatatggtttattttaaatgcgtacatattgaccaatggcctctgaaaaagcacattttagatactgaaattgaaggaaagaaaatgcatcttcaaacattttttggaatctcaccacatatactttgttagatttgtgtattgtagggtgtttgttttgtatttttgtattgtatatgaactttttttaaatgtgacagttaaacacatctttaaaagcatagtcacagacaaaagcatacagtataaaaatttccttgaaaactcctacaatattatatttggaggcagcttcagactgttttattggtggtagctgcttgctgaggtcttttagttggtaataactccagagaagcagcctgtgtatattcctaacactttgttcactagcatttaagtttagaataagcccaagtaagacaatggaaatgtatatagaactcttagttcttacatgatttaattatatcgatacatgaatttaacttactttaatgtaggcaaactatcaattttttgtccattttcctgtttgttaaaataacatacctctcctacgtattattttcttgacccaaatgaaatattaacctaaggtcaagctgggagagagaaatgactgagatgaatgtctttactaaagtaccaataaatttgtcaaactcaa

SEQ ID NO: 16233 - DNA, 1992 bp, Homo sapiens
  misc_feature (24)..(24): n is a, c, g, or t
ggacgcgtgggtcgacccacgcgntcggacccacgcgtgcggggaggccgcggcggggaaaatggcggacgggaaggcgggagacgagaagcctgaaaagtcgcagcgagctggagccgccggagagtgaaccagaggaaatgcctccagaagcaaagatgaggatgaagaatattggaagggatacaccaacatcagctggaccaaactccttcaataaaggaaagcatgggttttctgataaccagaagctgtgggagcgaaatataaaatctcatcttggaaatgtccatgaccaagacaattaaatgatgttttgaaattggggtgtggggtgggtgtaaagttaaaaggaacagtttccttttttaaagaatggtataagactatctttggagccgctttttttttctttttcatttttttaaaagattgagtggtacactaataaatgagagtttgaaattagaggtaatttatgttttatatacagatttcaagacatttgctaattttgtagtttcatgtgattagtttccaaaggttacagataataaagaaatcagaaatggtacctttttaagaattgcatatttttttagacacaactattagcacattaagagggaagcaaagttactgtctatttaaaactgcaagcagttaactctcttaactcccttattacctaaacttgtctggctcccaggaacagccttatagagagagggagtattgtattgggaagaaaatgttactgaactattgactgaaagtaaatttagataaaatacagcttttttccttatgggcatttgttttgtttcaagtcatcataaactaggtattgcattgctatccgtggatacagacgcttagctcttaaaagattttttttttatgtaaactgttgaatatttgaaatagtccacttcaccttaatgggtcttgtctatcttcattagtcttcaaagaaaaaccatttgctaccaaagtaaatcagtattttgaatgtgcttctcttgtttttggtttattagctagttcctgtaagcatttccaccagaacttgaggcaaatcgtaaggaagctgtttcttttaaaacacaaaccaccaccaaaaatttaaatgtacatattgcttaagtatttggctgtttttattttttaaaaggtataaacaccaaaaaaaaaattaacattgtatgaagatggaaaataagaagatgcactttctgtaactttgtctaaggatttaaattactaacttatgaactccaatttgaattgaacttaactatcggctttcttactggtaaaattatatggtttattttaaatgcgtacatattgaccaatggcctctgaaaaagcacattttagatactgaaattgaaggaaagaaaatgcatcttcaaacattttttggaatctcaccacatatactttgttagatttgtgtattgtagggtgtttgttttgtatttttgtattgtatatgaactttttttaaatgtgacagttaaacacatctttaaaagcatagtcacagacaaaagcatacagtataaaaatttccttgaaaactcctacaatattatatttggaggcagcttcagactgttttattggtggtagctgcttgctgaggtcttttagttggtaataactccagagaagcagcctgtgtatattcctaacactttgttcactagcatttaagtttagaataagcccaagtaagacaatggaaatgtatatagaactcttagttcttacatgatttaattatatcgatacatgaatttaacttactttaatgtaggcaaactatcaattttttgtccattttcctgtttgttaaaataacatacctctcctacgtattattttcttgacccaaatgaaatattaacctaaggtcaagctgggagagagaaatgactgagatgaatgtctttactaaagtaccaataaatttgtcaaactcaa

SEQ ID NO: 16234 - DNA, 2066 bp, Homo sapiens
tgcaaaatcagcaccgtagaagacaggcatttattttttaaatgtagttaaggtaaataactcactaattttctccttttaccaaaatttacagtagtgaaaatgctaaaagacttagatataaaatttagcgtattagtaatcaggaattgaataagtttgtatgcagttatcttggtttacttacttttttctttagagtgaaccagaggaaatgcctccagaagcaaagatgaggatgaagaatattggaagggatacaccaacatcagctggaccaaactccttcaataaaggaaagcatgggttttctgataaccagaagctgtgggagcgaaatataaaatctcatcttggaaatgtccatgaccaagacaattaaatgatgttttgaaattggggtgtggggtgggtgtaaagttaaaaggaacagtttccttttttaaagaatggtataagactatctttggagccgctttttttttctttttcatttttttaaaagattgagtggtacactaataaatgagagtttgaaattagaggtaatttatgttttatatacagatttcaagacatttgctaattttgtagtttcatgtgattagtttccaaaggttacagataataaagaaatcagaaatggtacctttttaagaattgcatatttttttagacacaactattagcacattaagagggaagcaaagttactgtctatttaaaactgcaagcagttaactctcttaactcccttattacctaaacttgtctggctcccaggaacagccttatagagagagggagtattgtattgggaagaaaatgttactgaactattgactgaaagtaaatttagataaaatacagcttttttccttatgggcatttgttttgtttcaagtcatcataaactaggtattgcattgctatccgtggatacagacgcttagctcttaaaagattttttttttatgtaaactgttgaatatttgaaatagtccacttcaccttaatgggtcttgtctatcttcattagtcttcaaagaaaaaccatttgctaccaaagtaaatcagtattttgaatgtgcttctcttgtttttggtttattagctagttcctgtaagcatttccaccagaacttgaggcaaatcgtaaggaagctgtttcttttaaaacacaaaccaccaccaaaaatttaaatgtacatattgcttaagtatttggctgtttttattttttaaaaggtataaacaccaaaaaaaaaattaacattgtatgaagatggaaaataagaagatgcactttctgtaactttgtctaaggatttaaattactaacttatgaactccaatttgaattgaacttaactatcggctttcttactggtaaaattatatggtttattttaaatgcgtacatattgaccaatggcctctgaaaaagcacattttagatactgaaattgaaggaaagaaaatgcatcttcaaacattttttggaatctcaccacatatactttgttagatttgtgtattgtagggtgtttgttttgtatttttgtattgtatatgaactttttttaaatgtgacagttaaacacatctttaaaagcatagtcacagacaaaagcatacagtataaaaatttccttgaaaactcctacaatattatatttggaggcagcttcagactgttttattggtggtagctgcttgctgaggtcttttagttggtaataactccagagaagcagcctgtgtatattcctaacactttgttcactagcatttaagtttagaataagcccaagtaagacaatggaaatgtatatagaactcttagttcttacatgatttaattatatcgatacatgaatttaacttactttaatgtaggcaaactatcaattttttgtccattttcctgtttgttaaaataacatacctctcctacgtattattttcttgacccaaatgaaatattaacctaaggtcaagctgggagagagaaatgactgagatgaatgtctttactaaagtaccaataaatttgtcaaactcaa

SEQ ID NO: 16235 - DNA, 2495 bp, Homo sapiens
  misc_feature (24)..(24): n is a, c, g, or t
ggacgcgtgggtcgacccacgcgntcggacccacgcgtgcggggaggccgcggcggggaaaatggcggacgggaaggcgggagacgagaagcctgaaaagtcgcagcgagctggagccgccggaggtatataaactatttattaacagacaaggcctacagacttatttcttcttggacacacccacggtgcggccacggcggccagtggtcttggtgtgctggcctcggacacgaaggccccagaagtgacgcagccctctatgggcccgaatcttcttcagtcgctccaggtcttcacggagcttgttgtccagaccattggctaggacctggctgtattttccatcctttacatccttctgtctgttcaagaaccagtctgggatcttgtactggcgtggattctgcataatggtgatcacacgttccacctcatcatcagtgagttctcccgccctcttggtgaggacctgaagaagaagcagaaaaacctgtgaaaactaagactgtttcttccagtaatggaggggaaagttccagtcgcagcgctgagaagcgatcagctgaagaagaagctgccgacctcccaacaaagcctacaaagatctccaagtttggatttgccataggtagtcagacgacaaagaaagcatcagccatatccatcaaacttggatcaagtggatacaccaacatcagctggaccaaactccttcaataaaggaaagcatgggttttctgataaccagaagctgtgggagcgaaatataaaatctcatcttggaaatgtccatgaccaagacaattaaatgatgttttgaaattggggtgtggggtgggtgtaaagttaaaaggaacagtttccttttttaaagaatggtataagactatctttggagccgctttttttttctttttcatttttttaaaagattgagtggtacactaataaatgagagtttgaaattagaggtaatttatgttttatatacagatttcaagacatttgctaattttgtagtttcatgtgattagtttccaaaggttacagataataaagaaatcagaaatggtacctttttaagaattgcatatttttttagacacaactattagcacattaagagggaagcaaagttactgtctatttaaaactgcaagcagttaactctcttaactcccttattacctaaacttgtctggctcccaggaacagccttatagagagagggagtattgtattgggaagaaaatgttactgaactattgactgaaagtaaatttagataaaatacagcttttttccttatgggcatttgttttgtttcaagtcatcataaactaggtattgcattgctatccgtggatacagacgcttagctcttaaaagattttttttttatgtaaactgttgaatatttgaaatagtccacttcaccttaatgggtcttgtctatcttcattagtcttcaaagaaaaaccatttgctaccaaagtaaatcagtattttgaatgtgcttctcttgtttttggtttattagctagttcctgtaagcatttccaccagaacttgaggcaaatcgtaaggaagctgtttcttttaaaacacaaaccaccaccaaaaatttaaatgtacatattgcttaagtatttggctgtttttattttttaaaaggtataaacaccaaaaaaaaaattaacattgtatgaagatggaaaataagaagatgcactttctgtaactttgtctaaggatttaaattactaacttatgaactccaatttgaattgaacttaactatcggctttcttactggtaaaattatatggtttattttaaatgcgtacatattgaccaatggcctctgaaaaagcacattttagatactgaaattgaaggaaagaaaatgcatcttcaaacattttttggaatctcaccacatatactttgttagatttgtgtattgtagggtgtttgttttgtatttttgtattgtatatgaactttttttaaatgtgacagttaaacacatctttaaaagcatagtcacagacaaaagcatacagtataaaaatttccttgaaaactcctacaatattatatttggaggcagcttcagactgttttattggtggtagctgcttgctgaggtcttttagttggtaataactccagagaagcagcctgtgtatattcctaacactttgttcactagcatttaagtttagaataagcccaagtaagacaatggaaatgtatatagaactcttagttcttacatgatttaattatatcgatacatgaatttaacttactttaatgtaggcaaactatcaattttttgtccattttcctgtttgttaaaataacatacctctcctacgtattattttcttgacccaaatgaaatattaacctaaggtcaagctgggagagagaaatgactgagatgaatgtctttactaaagtaccaataaatttgtcaaactcaa

SEQ ID NO: 16236 - DNA, 2151 bp, Homo sapiens
  misc_feature (24)..(24): n is a, c, g, or t
ggacgcgtgggtcgacccacgcgntcggacccacgcgtgcggggaggccgcggcggggaaaatggcggacgggaaggcgggagacgagaagcctgaaaagtcgcagcgagctggagccgccggaggacctgaagaagaagcagaaaaacctgtgaaaactaagactgtttcttccagtaatggaggggaaagttccagtcgcagcgctgagaagcgatcagctgaagaagaagctgccgacctcccaacaaagcctacaaagatctccaagtttggatttgccataggtagtcagacgacaaagaaagcatcagccatatccatcaaacttggatcaagtggatacaccaacatcagctggaccaaactccttcaataaaggaaagcatgggttttctgataaccagaagctgtgggagcgaaatataaaatctcatcttggaaatgtccatgaccaagacaattaaatgatgttttgaaattggggtgtggggtgggtgtaaagttaaaaggaacagtttccttttttaaagaatggtataagactatctttggagccgctttttttttctttttcatttttttaaaagattgagtggtacactaataaatgagagtttgaaattagaggtaatttatgttttatatacagatttcaagacatttgctaattttgtagtttcatgtgattagtttccaaaggttacagataataaagaaatcagaaatggtacctttttaagaattgcatatttttttagacacaactattagcacattaagagggaagcaaagttactgtctatttaaaactgcaagcagttaactctcttaactcccttattacctaaacttgtctggctcccaggaacagccttatagagagagggagtattgtattgggaagaaaatgttactgaactattgactgaaagtaaatttagataaaatacagcttttttccttatgggcatttgttttgtttcaagtcatcataaactaggtattgcattgctatccgtggatacagacgcttagctcttaaaagattttttttttatgtaaactgttgaatatttgaaatagtccacttcaccttaatgggtcttgtctatcttcattagtcttcaaagaaaaaccatttgctaccaaagtaaatcagtattttgaatgtgcttctcttgtttttggtttattagctagttcctgtaagcatttccaccagaacttgaggcaaatcgtaaggaagctgtttcttttaaaacacaaaccaccaccaaaaatttaaatgtacatattgcttaagtatttggctgtttttattttttaaaaggtataaacaccaaaaaaaaaattaacattgtatgaagatggaaaataagaagatgcactttctgtaactttgtctaaggatttaaattactaacttatgaactccaatttgaattgaacttaactatcggctttcttactggtaaaattatatggtttattttaaatgcgtacatattgaccaatggcctctgaaaaagcacattttagatactgaaattgaaggaaagaaaatgcatcttcaaacattttttggaatctcaccacatatactttgttagatttgtgtattgtagggtgtttgttttgtatttttgtattgtatatgaactttttttaaatgtgacagttaaacacatctttaaaagcatagtcacagacaaaagcatacagtataaaaatttccttgaaaactcctacaatattatatttggaggcagcttcagactgttttattggtggtagctgcttgctgaggtcttttagttggtaataactccagagaagcagcctgtgtatattcctaacactttgttcactagcatttaagtttagaataagcccaagtaagacaatggaaatgtatatagaactcttagttcttacatgatttaattatatcgatacatgaatttaacttactttaatgtaggcaaactatcaattttttgtccattttcctgtttgttaaaataacatacctctcctacgtattattttcttgacccaaatgaaatattaacctaaggtcaagctgggagagagaaatgactgagatgaatgtctttactaaagtaccaataaatttgtcaaactcaa

SEQ ID NO: 16237 - DNA, 1868 bp, Homo sapiens
tctatttactttttccttctccaacactctaaagagtaacgttctgttaagggtgccggatacaccaacatcagctggaccaaactccttcaataaaggaaagcatgggttttctgataaccagaagctgtgggagcgaaatataaaatctcatcttggaaatgtccatgaccaagacaattaaatgatgttttgaaattggggtgtggggtgggtgtaaagttaaaaggaacagtttccttttttaaagaatggtataagactatctttggagccgctttttttttctttttcatttttttaaaagattgagtggtacactaataaatgagagtttgaaattagaggtaatttatgttttatatacagatttcaagacatttgctaattttgtagtttcatgtgattagtttccaaaggttacagataataaagaaatcagaaatggtacctttttaagaattgcatatttttttagacacaactattagcacattaagagggaagcaaagttactgtctatttaaaactgcaagcagttaactctcttaactcccttattacctaaacttgtctggctcccaggaacagccttatagagagagggagtattgtattgggaagaaaatgttactgaactattgactgaaagtaaatttagataaaatacagcttttttccttatgggcatttgttttgtttcaagtcatcataaactaggtattgcattgctatccgtggatacagacgcttagctcttaaaagattttttttttatgtaaactgttgaatatttgaaatagtccacttcaccttaatgggtcttgtctatcttcattagtcttcaaagaaaaaccatttgctaccaaagtaaatcagtattttgaatgtgcttctcttgtttttggtttattagctagttcctgtaagcatttccaccagaacttgaggcaaatcgtaaggaagctgtttcttttaaaacacaaaccaccaccaaaaatttaaatgtacatattgcttaagtatttggctgtttttattttttaaaaggtataaacaccaaaaaaaaaattaacattgtatgaagatggaaaataagaagatgcactttctgtaactttgtctaaggatttaaattactaacttatgaactccaatttgaattgaacttaactatcggctttcttactggtaaaattatatggtttattttaaatgcgtacatattgaccaatggcctctgaaaaagcacattttagatactgaaattgaaggaaagaaaatgcatcttcaaacattttttggaatctcaccacatatactttgttagatttgtgtattgtagggtgtttgttttgtatttttgtattgtatatgaactttttttaaatgtgacagttaaacacatctttaaaagcatagtcacagacaaaagcatacagtataaaaatttccttgaaaactcctacaatattatatttggaggcagcttcagactgttttattggtggtagctgcttgctgaggtcttttagttggtaataactccagagaagcagcctgtgtatattcctaacactttgttcactagcatttaagtttagaataagcccaagtaagacaatggaaatgtatatagaactcttagttcttacatgatttaattatatcgatacatgaatttaacttactttaatgtaggcaaactatcaattttttgtccattttcctgtttgttaaaataacatacctctcctacgtattattttcttgacccaaatgaaatattaacctaaggtcaagctgggagagagaaatgactgagatgaatgtctttactaaagtaccaataaatttgtcaaactcaa

SEQ ID NO: 16238 - DNA, 1816 bp, Homo sapiens
  misc_feature (24)..(24): n is a, c, g, or t
ggacgcgtgggtcgacccacgcgntcggacccacgcgtgcggggaggccgcggcggggaaaatggcggacgggaaggcgggagacgagaagcctgaaaagtcgcagcgagctggagccgccggaggacctgaagaagaagcagaaaaacctgtgaaaactaagactgtttcttccagtaatggaggggaaagttccagtcgcagcgctgagaagcgatcagctgaagaagaagctgccgacctcccaacaaagcctacaaagatctccaagtttggatttgccataggtagtcagacgacaaagaaagcatcagccatatccatcaaacttggatcaagtaagcctaaagaaactgttccaactcttgctccaaaaactctttcagtagcagcagcttttaatgaagatgaagatagtgaaccagaggaaatgcctccagaagcaaagatgaggatgaagaatattggaagggatacaccaacatcagctggaccaaactccttcaataaaggaaagcatgggttttctgataaccagaagctgtgggagcgaaatataaaatctcatcttggaaatgtccatgaccaagacaattaaatgatgttttgaaattggggtgtggggtgggtgtaaagttaaaaggaacagtttccttttttaaagaatggtataagactatctttggagccgctttttttttctttttcatttttttaaaagattgagtggtacactaataaatgagagtttgaaattagaggtaatttatgttttatatacagatttcaagacatttgctaattttgtagtttcatgtgattagtttccaaaggttacagataataaagaaatcagaaatggtacctttttaagaattgcatatttttttagacacaactattagcacattaagagggaagcaaagttactgtctatttaaaactgcaagcagttaactctcttaactcccttattacctaaacttgtctggctcccaggaacagccttatagagagagggagtattgtattgggaagaaaatgttactgaactattgactgaaagtaaatttagataaaatacagcttttttccttatgggcatttgttttgtttcaagtcatcataaactaggtattgcattgctatccgtggatacagacgcttagctcttaaaagattttttttttatgtaaactgttgaatatttgaaatagtccacttcaccttaatgggtcttgtctatcttcattagtcttcaaagaaaaaccatttgctaccaaagtaaatcagtattttgaatgtgcttctcttgtttttggtttattagctagttcctgtaagcatttccaccagaacttgaggcaaatcgtaaggaagctgtttcttttaaaacacaaaccaccaccaaaaatttaaatgtacatattgcttaagtatttggctgtttttattttttaaaaggtataaacaccaaaaaaaaaattaacattgtatgaagatggaaaataagaagatgcactttctgtaactttgtctaaggatttaaattactaacttatgaactccaatttgaattgaacttaactatcttagttcttacatgatttaattatatcgatacatgaatttaacttactttaatgtaggcaaactatcaattttttgtccattttcctgtttgttaaaataacatacctctcctacgtattattttcttgacccaaatgaaatattaacctaaggtcaagctgggagagagaaatgactgagatgaatgtctttactaaagtaccaataaatttgtcaaactcaa

SEQ ID NO: 16239 - DNA, 428 bp, Homo sapiens
tccacaaacagtctgaagctgcctccaaatataatatggtaggagttttcaaggaaatgttttattggtggtagctgcttgctgaggtcttttagttggtaataactccagagaagcagcctgtgtatattcctaacactttgttcactagcatttaagtttagaataagcccaagtaagacaatggaaatgtatatagaactcttagttcttacatgatttaattatatcgatacatgaatttaacttactttaatgtaggcaaactatcaattttttgtccattttcctgtttgttaaaataacatacctctcctacgtattattttcttgacccaaatgaaatattaacctaaggtcaagctgggagagagaaatgactgagatgaatgtctttactaaagtaccaataaatttgtcaaactcaa

SEQ ID NO: 16240 - DNA, 1103 bp, Homo sapiens
  misc_feature (24)..(24): n is a, c, g, or t
ggacgcgtgggtcgacccacgcgntcggacccacgcgtgcggggaggccgcggcggggaaaatggcggacgggaaggcgggagacgagaagcctgaaaagtcgcagcgagctggagccgccggaggtatataaactatttattaacagacaaggcctacagacttatttcttcttggacacacccacggtgcggccacggcggccagtggtcttggtgtgctggcctcggacacgaaggccccagaagtgacgcagccctctatgggcccgaatcttcttcagtcgctccaggtcttcacggagcttgttgtccagaccattggctaggacctggctgtattttccatcctttacatccttctgtctgttcaagaaccagtctgggatcttgtactggcgtggattctgcataatggtgatcacacgttccacctcatcatcagtgagttctcccgccctcttggtgaggacctgaagaagaagcagaaaaacctgtgaaaactaagactgtttcttccagtaatggaggggaaagttccagtcgcagcgctgagaagcgatcagctgaagaagaagctgccgacctcccaacaaagcctacaaagatctccaagtttggatttgccataggtagtcagacgacaaagaaagcatcagccatatccatcaaacttggatcaagtgtgagttgttatttcatatatgatgtttgtaatgggtcttaaggatttgctttggaaacgtggcgtttactaggttatggtaaattaagggtgaaaaggtacattgtttgagaagtaatctttgacgtatgaacttagatgattagcaccctgtttaagaagggtctgaatgaattttatctcaataaagctgttaagaaacaaagatttggaatattaggaacaactattatagggaatatgatttataaaataataaacttagaatttttctgcgttggctgggcacagtggctcacacctgtaatctgaaaacttggggaggccaaagtgggaggaccagttgagcccaggaatttcagaccagtctgggcaacatagcaagatctatctctacaaaaaataaaaatataattaaa

SEQ ID NO: 16241 - DNA, 1296 bp, Homo sapiens
  misc_feature (24)..(24): n is a, c, g, or t
ggacgcgtgggtcgacccacgcgntcggacccacgcgtgcggggaggccgcggcggggaaaatggcggacgggaaggcgggagacgagaagcctgaaaagtcgcagcgagctggagccgccggaggtatataaactatttattaacagacaaggcctacagacttatttcttcttggacacacccacggtgcggccacggcggccagtggtcttggtgtgctggcctcggacacgaaggccccagaagtgacgcagccctctatgggcccgaatcttcttcagtcgctccaggtcttcacggagcttgttgtccagaccattggctaggacctggctgtattttccatcctttacatccttctgtctgttcaagaaccagtctgggatcttgtactggcgtggattctgcataatggtgatcacacgttccacctcatcatcagtgagttctcccgccctcttggtgaggacctgaagaagaagcagaaaaacctgtgaaaactaagactgtttcttccagtaatggaggggaaagttccagtcgcagcgctgagaagcgatcagctgaagaagaagctgccgacctcccaacaaagcctacaaagatctccaagtttggatttgccataggtagtcagacgacaaagaaagcatcagccatatccatcaaacttggatcaagtaagcctaaagaaactgttccaactcttgctccaaaaactctttcagtagcagcagcttttaatgaagatgaagatgtaagttgatatcgagttttgtttttttactttaaccagttatttaaggaaggtattagtggcaaattataggttataatagtattagtgaattttctttataatagtttttgtgtctgtgtgtgacatccataaaaactggatactctatttttgcattttatttggttgtaagattattttagagtattgttgactttggggacaagaagcttaaggatgaaatcagcaaatgtttattatgagtagtttgtgctaggaagtatgtaggatccaaaaaaagaaaaatctaatactgttgccttaataatttttatagttggggtcttcagtaatgatacattatgcatgcattcaattttaaaaagccaactattggctaggcgcggtgtctcatgcctgtaagcctagctctttgggaggctgaggcaggtggatcacttgaggtcagcggttcaagaccagcctggccaatatggtgaaaccccatctctactaaaaatacaaaaattagacaggcgtggtggcacaggccta

SEQ ID NO: 16242 - DNA, 397 bp, Homo sapiens
ccctggttcacaccattctcctgcctcagcctcccgagtagctgggactacaggtgcccaccaagacgcctggctaattttttgtattttttggtggagacggggtttcaccgtgttggccaggatggtgtcgatctcctgacctcgtgatctgcctgcctcggcctcccaaagtgctgggattacaggcgtgagacaccacgcctggcctagtttggcagctttttaaaccaaactcgaaccaaccatatgatctagccatttaagtatttacccaagagaacaagaaatatatgttcatgaaaagacttttgcttaaatgttcatagcggccttatttgtaaatggcccagacgtgtggataaaccaactgtagtacatccatgtaacagagtac

SEQ ID NO: 16243 - DNA, 461 bp, Homo sapiens
gtaagtgatagtaggaaacctttttcccctggtttaaaaaggatggatgcaataacatttataggtaagactgaggagcattttaaaaaccacaggccgggcacagtggctcatgcctgtaaccctagcactttgggaggctgaaacagttggatcacctgaggtcaggagtttgagaccagcctgggcagtgtggtgaaacacggggcatccaccaagagaaataaatcaaagtccaagtacttgaattcataatctgaggagagaggtgtatgtaaacaaaacacattcagtgtgacaatgtcagagagtatatggggttgctttggccctgtagaagaggtacttggcctgttttggagaaagatgggaatgcttcatagtgtgcttcatagtggatgtaaagtttgctgattcttgaagggtgagtaggatttcccctagcaagcactattggaagg

SEQ ID NO: 16244 - DNA, 439 bp, Homo sapiens
taactttttaagaaactgccaaaatcttttccagcatttcagaaaaatcttagaaaatgctatactatgttatattcccactggcagtatatgggggagttccagttcctccataccctcatcaacatgaggcatgatcagtctttttaattttaaccatgtcagtaggtgtgtgatggtctctcactgtggtgatttttatttgcacttccctggtgattttgagcatcttttcgtatgcttatttgccatatatcttctttggtgatatttctgttcaaagcctttgctcattttttaattgagttgcttttctactattcactattgaacactatttatatattttgaatacaaatactttatcagacatgtgatctacaaatattttccccagtgtgtggtttgtctttcttttctttctactgatagtatctta

SEQ ID NO: 16245 - DNA, 159 bp, Homo sapiens
ctctccagctaagccaagaaaggatgatttatcttccagtgagtaccagcctatttgagtgtaggaaggagaaaaatctgtgctcctgctcctgggtactgggcaaagaaaccctttggttggggatttttgcctggtaccaactttataggtgccaac

SEQ ID NO: 16246 - DNA, 805 bp, Homo sapiens
aaactgcctgtaaatctccctcctggagttggcaaggccctgagaagtgctgtatcgagaatcctgttgaccttgtttaacgaagcacttcctaggctcgtttgcccaggagccccttaacatcccatgaatgagcattctagagggtgaaccctgggaaatgctgacccagcctttctaacactgacatttgaagttctgtgcctttctaaatgtggagcctgtcaccactgtgtgatgatgggtgcctcctgggagttccatgaacccagaacagatgagctaggcaggagagaaccacgcgagagcctactcctgatgccccccagagagggtagcagaaggcagcaaaatctccccatgttgaaagtcacaacatgaaccacttaatgggagtgtaccttgggccaggcacgtgctgagccttttacatgttttctcacttaacccttccaatcatcctttaatgtaggtatttcttattttcacattttcctctatttacttttaatttatattccagcagatgcatttttaaaattcatatcaatatggctgggcgcggtgactcacgcctgtactcccaacactttgggagccaaggcgggcggatcgcttgagctcaggagttagagaccaacctgggcaatatggtgaaatgtcatctctcaaaaaatacaaaacttaggccgggcgcggtggctcacgcctgtaatcccagcactttgggaggctgaggcgggcggatcacaaggtcaggagttcgagaccagcctgaccaacatggtgaaaccctatctctact

SEQ ID NO: 16247 - DNA, 3521 bp, Homo sapiens
tttccttttattggcgtttgtaaaatttcttcttttaaaattgttatattttagagacagggtctcgctctgtcacccaggctggagtgcagtggtgcaatcacagctcaccacagcctccaactcctgggctcaaggcatcctcccacgtaggccttccaaagcgctgagattgtaggcataagccaccaggcccagcctattacctttacgttgtacttagtcccagataaaaaatgaccttagatcagtcctttcctctttggctggggagaggggggcttaaattccggtactgtgaaacagaagaatggactcagtgctatgtgacaaatctatgtatgtaaatgtgtgtatatacacacacataaattatatatatgaatatattttcattttcatattttgcaaggagagtagccaatgctctggacctctggtcctttttgtagggtaccctctgaggccgggaacctttgctcaactctcaggctgtccagggaagctttaggcggtgataccgagctacagaccaatataagagctcggggctgtggcactgaagagaggaggcggccgttgggaactgaggtgggcccagggcttgagctgagttggcgagggtggaggtggtgccggtcccacgccgtggtggggaccgagctgcgggctggagggaggggcagcgccgagggggcgggacggggagggctcgcggagtaggccaacggttggccccaaccgccactgactacagcctgcgcccgcctcttttcgttgccgttacctgtttccggcagtcgacacgctcttcgcttctcggggcttgtctccgtgtcctccgtctcagttgtttctccctctctatcctcctctgtctcagtctccccagccttggggccggtgcctcttccgggcttcggcgaatgagacctgcggacctgcccccgcgccccatggaagaatccccggcgtccagctctgccccgacagagacggaggagccggggtccagtgcagaggtcatggaagaagtgacaacatgctccttcaacagccctctgttccggcaggaagatgacagagggattacctaccggatcccagccctgctctacataccccccacccacaccttcctggcctttgcagagaagcgttccacgaggagagatgaggatgctctccacctggtgctgaggcgagggttgaggattgggcagttggtacagtgggggcccctgaagccactgatggaagccacactaccggggcatcggaccatgaacccctgtcctgtatgggagcagaagagtggttgtgtgttcctgttcttcatctgtgtgcggggccatgtcacagagcgtcaacagattgtgtcaggcaggaatgctgcccgcctttgcttcatctacagtcaggatgctggatgttcatggagtgaggtgagggacttgactgaggaggtcattggctcagagctgaagcactgggccacatttgctgtgggcccaggtcatggcatccagctgcagtcagggagactggtcatccctgcgtatacctactacatcccttcctggttcttttgcttccagctaccatgtaaaaccaggcctcattctctgatgatctacagtgatgacctaggggtcacatggcaccatggtagactcattaggcccatggttacagtagaatgtgaagtggcagaggtgactgggagggctggccaccctgtgctatattgcagtgcccggacaccaaacaggtgccgggcagaggcgctcagcactgaccatggtgaaggctttcagagactggccctgagtcgacagctctgtgagcccccacatggttgccaagggagtgtggtaagtttccggcccctggagatcccacataggtgccaggactctagcagcaaagatgcacccaccattcagcagagctctccaggcagttcactgaggctggaggaggaagctggaacaccgtcagaatcatggctcttgtactcacacccaaccagtaggaaacagagggttgacctaggtatctatctcaaccagacccccttggaggctgcctgctggtcccgcccctggatcttgcactgtgggccctgtggctactctgatctggctgctctggaggaggagggcttgtttgggtgtttgtttgaatgtgggaccaagcaagagtgtgagcagattgccttccgcctgtttacacaccgggagatcctgagtcacctgcagggggactgcaccagccctggtaggaacccaagccaattcaaaagcaattaattggcttaggacccaatttccatagatgcaaatggcagttacagacaggttaacagaagctactgaagtctacagataatcaaaaaacttaatattctgttccctaccttttttcacttttcctcctccaaagagcaaaatgaaaattttgccttagctactgcagtggaaagagcactgaactaggagttggaagacaaggatgtggtcctggctctgccactggcttgcttttggaccttggatgtgtcacctgaactctctggacctcaggtttccatctgtaaaatgagagtattggttctaagatttctcatcttctcatccctaggacaagcatagtgcctgcatgcttcatgatcagtaagtcctggctgcataaaggactctgatgtcaaaatggaaaccaggggacttaccttttcacatgacttacccctcatccgagtgtgaggttacaagcaggtgtcatggcaggaaggaagaccagatctgtatgatttgttccatttttaataacaaaaatatccacacccttttaataatgctcagagttctgtaggctctctatcctagaggaattgagcaaaacagaagaatcatgaagtctcctaccttctacagccttgtagttctgcttaccttctcttcctcatccagaaagcatcattttctagggagaacaatgagaatctcaatgccagtagtactggataatagtgcgtattgcttctggtggcattaccctgatgatgggctgaagttcatttattagggtggttcctgatgggaaaaggacatggattaggactttaaaacactggacagaatttcccacagtctttgccctcaaggagttcaccagtttatggggctagaagagcgagaaaattcaagaaaataaatgtagctggtgggagactttgtagatgttgggctatatgttggggtgatggtagctcctgatgtaattttcttagttgcatcttcaatatgcctggagtcgtctgtccaaggcttgtccaggcttctgggtttctctcaagtttgtttttctcaggatattgtcctggcccagctactcctttacctgtgagaagatcttcaccattaggaagatctctagacccccagatctcagaatcaggcctatttgtgtaggcccatggaaatcactacttgtgaagtagagatgcctttttgtctaaa

SEQ ID NO: 16248 - DNA, 1549 bp, Homo sapiens
tttccttttattggcgtttgtaaaatttcttcttttaaaattgttatattttagagacagggtctcgctctgtcacccaggctggagtgcagtggtgcaatcacagctcaccacagcctccaactcctgggctcaaggcatcctcccacgtaggccttccaaagcgctgagattgtaggcataagccaccaggcccagcctattacctttacgttgtacttagtcccagataaaaaatgaccttagatcagtcctttcctctttggctggggagaggggggcttaaattccggtactgtgaaacagaagaatggactcagtgctatgtgacaaatctatgtatgtaaatgtgtgtatatacacacacataaattatatatatgaatatattttcattttcatattttgcaaggagagtagccaatgctctggacctctggtcctttttgtagggtaccctctgaggccgggaacctttgctcaactctcaggctgtccagggaagctttaggcggtgataccgagctacagaccaatataagagctcggggctgtggcactgaagagaggaggcggccgttgggaactgaggtgggcccagggcttgagctgagttggcgagggtggaggtggtgccggtcccacgccgtggtggggaccgagctgcgggctggagggaggggcagcgccgagggggcgggacggggagggctcgcggagtaggccaacggttggccccaaccgccactgactacagcctgcgcccgcctcttttcgttgccgttacctgtttccggcagtcgacacgctcttcgcttctcggggcttgtctccgtgtcctccgtctcagttgtttctccctctctatcctcctctgtctcagtctccccagccttggggccggtgcctcttccgggcttcggcgaatgagacctgcggacctgcccccgcgccccatggaagaatccccggcgtccagctctgccccgacagagacggaggagccggggtccagtgcagaggtcatggaagaagtgacaacatgctccttcaacagccctctgttccggcaggaagatgacagagggattacctaccggatcccagccctgctctacataccccccacccacaccttcctggcctttgcagagaagcgttccacgaggagagatgaggatgctctccacctggtgctgaggcgagggttgaggattgggcagttggtacaggtgactcttcatcccagatctgagtctgggcctcagtttctcttcacaaagctcagagctcttcaggatctgtgccttttctcatcagtacaggaaagccctgtgtggggagcagaggcagaaaaaacagcaaaaacaatggctctcactgagtgcttattgtgtgccaggggcacattgggtcctcacagccattctgtgtcgtaggtactgttttcagtcatattttacagacaaggaaactgagactcagagaggttgccatttgctcaaggttatacagctataataaagcagtagaagctggtttcaaactc

SEQ ID NO: 16249 - DNA, 3229 bp, Homo sapiens
tttccttttattggcgtttgtaaaatttcttcttttaaaattgttatattttagagacagggtctcgctctgtcacccaggctggagtgcagtggtgcaatcacagctcaccacagcctccaactcctgggctcaaggcatcctcccacgtaggccttccaaagcgctgagattgtaggcataagccaccaggcccagcctattacctttacgttgtacttagtcccagataaaaaatgaccttagatcagtcctttcctctttggctggggagaggggggcttaaattccggtactgtgaaacagaagaatggactcagtgctatgtgacaaatctatgtatgtaaatgtgtgtatatacacacacataaattatatatatgaatatattttcattttcatattttgcaaggagagtagccaatgctctggacctctggtcctttttgtagggtaccctctgaggccgggaacctttgctcaactctcaggctgtccagggaagctttaggcggtgataccgagctacagaccaatataagagctcggggctgtggcactgaagagaggaggcggccgttgggaactgagtctccccagccttggggccggtgcctcttccgggcttcggcgaatgagacctgcggacctgcccccgcgccccatggaagaatccccggcgtccagctctgccccgacagagacggaggagccggggtccagtgcagaggtcatggaagaagtgacaacatgctccttcaacagccctctgttccggcaggaagatgacagagggattacctaccggatcccagccctgctctacataccccccacccacaccttcctggcctttgcagagaagcgttccacgaggagagatgaggatgctctccacctggtgctgaggcgagggttgaggattgggcagttggtacagtgggggcccctgaagccactgatggaagccacactaccggggcatcggaccatgaacccctgtcctgtatgggagcagaagagtggttgtgtgttcctgttcttcatctgtgtgcggggccatgtcacagagcgtcaacagattgtgtcaggcaggaatgctgcccgcctttgcttcatctacagtcaggatgctggatgttcatggagtgaggtgagggacttgactgaggaggtcattggctcagagctgaagcactgggccacatttgctgtgggcccaggtcatggcatccagctgcagtcagggagactggtcatccctgcgtatacctactacatcccttcctggttcttttgcttccagctaccatgtaaaaccaggcctcattctctgatgatctacagtgatgacctaggggtcacatggcaccatggtagactcattaggcccatggttacagtagaatgtgaagtggcagaggtgactgggagggctggccaccctgtgctatattgcagtgcccggacaccaaacaggtgccgggcagaggcgctcagcactgaccatggtgaaggctttcagagactggccctgagtcgacagctctgtgagcccccacatggttgccaagggagtgtggtaagtttccggcccctggagatcccacataggtgccaggactctagcagcaaagatgcacccaccattcagcagagctctccaggcagttcactgaggctggaggaggaagctggaacaccgtcagaatcatggctcttgtactcacacccaaccagtaggaaacagagggttgacctaggtatctatctcaaccagacccccttggaggctgcctgctggtcccgcccctggatcttgcactgtgggccctgtggctactctgatctggctgctctggaggaggagggcttgtttgggtgtttgtttgaatgtgggaccaagcaagagtgtgagcagattgccttccgcctgtttacacaccgggagatcctgagtcacctgcagggggactgcaccagccctggtaggaacccaagccaattcaaaagcaattaattggcttaggacccaatttccatagatgcaaatggcagttacagacaggttaacagaagctactgaagtctacagataatcaaaaaacttaatattctgttccctaccttttttcacttttcctcctccaaagagcaaaatgaaaattttgccttagctactgcagtggaaagagcactgaactaggagttggaagacaaggatgtggtcctggctctgccactggcttgcttttggaccttggatgtgtcacctgaactctctggacctcaggtttccatctgtaaaatgagagtattggttctaagatttctcatcttctcatccctaggacaagcatagtgcctgcatgcttcatgatcagtaagtcctggctgcataaaggactctgatgtcaaaatggaaaccaggggacttaccttttcacatgacttacccctcatccgagtgtgaggttacaagcaggtgtcatggcaggaaggaagaccagatctgtatgatttgttccatttttaataacaaaaatatccacacccttttaataatgctcagagttctgtaggctctctatcctagaggaattgagcaaaacagaagaatcatgaagtctcctaccttctacagccttgtagttctgcttaccttctcttcctcatccagaaagcatcattttctagggagaacaatgagaatctcaatgccagtagtactggataatagtgcgtattgcttctggtggcattaccctgatgatgggctgaagttcatttattagggtggttcctgatgggaaaaggacatggattaggactttaaaacactggacagaatttcccacagtctttgccctcaaggagttcaccagtttatggggctagaagagcgagaaaattcaagaaaataaatgtagctggtgggagactttgtagatgttgggctatatgttggggtgatggtagctcctgatgtaattttcttagttgcatcttcaatatgcctggagtcgtctgtccaaggcttgtccaggcttctgggtttctctcaagtttgtttttctcaggatattgtcctggcccagctactcctttacctgtgagaagatcttcaccattaggaagatctctagacccccagatctcagaatcaggcctatttgtgtaggcccatggaaatcactacttgtgaagtagagatgcctttttgtctaaa

SEQ ID NO: 16250 - DNA, 1221 bp, Homo sapiens
tttccttttattggcgtttgtaaaatttcttcttttaaaattgttatattttagagacagggtctcgctctgtcacccaggctggagtgcagtggtgcaatcacagctcaccacagcctccaactcctgggctcaaggcatcctcccacgtaggccttccaaagcgctgagattgtaggcataagccaccaggcccagcctattacctttacgttgtacttagtcccagataaaaaatgaccttagatcagtcctttcctctttggctggggagaggggggcttaaattccggtactgtgaaacagaagaatggactcagtgctatgtgacaaatctatgtatgtaaatgtgtgtatatacacacacataaattatatatatgaatatattttcattttcatattttgcaaggagagtagccaatgctctggacctctggtcctttttgtagggtaccctctgaggccgggaacctttgctcaactctcaggctgtccagggaagctttaggcggtgataccgagctacagaccaatataagagctcggggctgtggcactgaagagaggaggcggccgttgggaactgaggtgggcccagggcttgagctgagttggcgagggtggaggtggtgccggtcccacgccgtggtggggaccgagctgcgggctggagggaggggcagcgccgagggggcgggacggggagggctcgcggagtaggccaacggttggccccaaccgccactgactacagcctgcgcccgcctcttttcgttgccgttacctgtttccggcagtcgacacgctcttcgcttctcggggcttgtctccgtgtcctccgtctcagttgtttctccctctctatcctcctctgtctcagtctccccagccttggggccggtgcctcttccgggcttcggcgaatgagacctgcggacctgcccccgcgccccatggaagaatccccggcgtccagctctgccccgacagagacggaggagccggggtccagtgcagcacctgatttgtgtgaaacgttttgggtggcaatgccagaatcaccatctatattacttctgtcatcaacacgatcagcataattacaaaaattaatggctctaattgttatagtgataataaagcataaatgaaattgtgaggacatcaaaatttataattaaagacacctattaaaacagcagtttaaaatttataaaa

SEQ ID NO: 16251 - DNA, 255 bp, Homo sapiens
aaatttgaaagatgatttctggattacattcctgggttgtgccagataaggaccagagctcttttggttttaacatatcaggcttaaagtacctttggagctttcaggtagaagttcctgtaagcaattagatacatggttctgaaattcagaggaagagtattggctgtaaatggaaaactggaatctcccatacaggtaattggaactataggtatggatgaaattgcctaggtgagggaatataacttgggg

SEQ ID NO: 16252 - DNA, 407 bp, Homo sapiens
tcctaaatatttcatatttttggtgccattatcattgtatttttcaaatttcattttgtacttgttagtggtatatataggattacaactggtccatatattgattttacaaaattgttaaattattaatttcataatttatctgtaaatcttctggattttcaatgtacacattagatcatctgtaagtaatgcaatattttataattcttacatattttgttgctttttcttgtttaactgcatttgctagatcttctgtacaatgtcaaatagacagtgatagtgaatatccttgtcttattactgatttcagagagaaagcttacaacattttaccataaatatgatatttactataaatattttgtatatactcttatcagattaaagaagtttcctcctgt

SEQ ID NO: 16253 - DNA, 428 bp, Homo sapiens
atattttaataatgacactgtggctagcctttcttttccttcctccgttactctctacttataatttgcataataaatgaaactcctattttatctctcattccaatggcttctcttaggaaattaatggtttagaaaaatagcttacagctgggagccgtggctcacacctgtaatctcagcactttgggaggccgaggcaggtggttcacaaggtcaggagttcaagaccagcctgaccaacatggtgaaaccctgtctctactaaaaatacaaaaattagctgggcgtggtggcacacgtctgtaatcccagctactcaggaggctgaggcaggaaaatcacctgaacctgggaggcagaggttacagtgagcctagatcacccactgcacgctagcctgggtgacaaagcgagactccatctca

SEQ ID NO: 16254 - DNA, 483 bp, Homo sapiens
gaaactcgtgattcatttctgaaccaaatgaaccttggtacagggtaagtataggtatagccaaactgttacacaatagggctgtgatgcatttatgtagggaatgtaatcacagtgccttccatggcaaggatgattaagcattagaaaaatctttcagtgtggtttaccacataaagtggtgaagagtgaaaaagtatcagtagataaagaacaagcactggataaaatttaaaattttacatgtatacgcacatgtaaagttcttggaaaacttagaaggaaacttgcttaatcaaatatctatcaaagtcttatgttttatgctgaaatttaaaatgcgttaccatcaagatatattgaaacaggagcagttagggcatgatagctatcaccatagctctttgacgttgtactaaagaatccagccaatgcaagatgacaggaaaaagaaatgaagtgtgattagaaaaaaagtgaaaa

SEQ ID NO: 16255 - DNA, 379 bp, Homo sapiens
tcactttccttgaatgtgcaaaatgtaggcaaggacagacagtgagaaagacatattaccttagatcagataatttgtgagctttaaccctaacactagtgtattttctgagaagaccacaggcaggacagacacacctaagcatatccaatacagacacaactttcaggctccaagctattctaacagagacttgatgaacatggaatatggactgcatgtattttctattaaaaacagaaagatcatgacttaaagaagcctattaaaacttaccaaagacaggccagtcccaaaaaaaaaaagattgatataaattggcaaaaacagtatagcaactaaccctagccaacttttcaaaatgccttccattactcaa

SEQ ID NO: 16256 - DNA, 1045 bp, Homo sapiens
tgagatggagtctctctctgttgcccaggctgtgtcacgtctgacttctcagattacacctgagagggaagccccagccatcacaatgtgagaacattttacaatgaacaggatatgccaagtacattttaagactcattcaggattagcgttcaccttaaacttgacagactcagagaatgggctggccacgtgctgtgcacaacccttagtgcccttctgtgactaatatttggataattgattgttggaagctcaggaagcctctctctctcagaggggttgaagttaacttctttatttctgaggtagggaagaaaatgacgatgttctgccttttgctagactgaatactgtcttccaaaaattcacattcaccaggaatcccagaatgtgaccttattagaaaataggggcagggcatggtggctcatgcttgtaatcttagcactttgggaggctgaggcaggaggatcacttgaggtcaggagttcgagaccagcctggctagcatggcaaaccctgtctctactaaaaacataaaaattagctaggcatggtggcgtgcacctgtaatcccagctacttcagaggctgaggctgaagaatcacttgaacccaggaggcagagttgaagcgagctgagattgtgtcactgaactccagcctgggcaacagagcaagactccatcacaaaaaaaagaaaagaaaatagggtcactgcagatctaattacaaagaggtcatattggaatagcgtgaaccttaaatcgagtaataatggcatcctcatgggaagagaagaagagacagagacacacaggggagaaggccacatgagaatgaaggaagagaatggaatgatgtggacacaagccaaagaatgccagcaaccaccagaagccagaagaggcaaggaaggattcacccctagagccttcagagggagcatggccctgcgggtttcagacatcaagcttctggaactggagagaatgactttctgttgtcctgagccacccatttggggaactctgttagaaca

SEQ ID NO: 16257 - DNA, 408 bp, Homo sapiens
atttgctgttccccagttgcccttactgaaagtaatcagcatacccaaagcaacatattttggggtggcatttgctgaactccttccagtgcatatgcatgtgagtatgtgtatacagtgtgtttttgactgtctttctttaccagagattttacatctataaagtacctgaaaagctgaacacctaagaagtatttatgatataatagacatctggatgaaatttaaaaattaaattaaaactcccagtagctttgtctgcagatgccacacttctggaaacatctgtgtctttgtgtgtttgggtgtgagttcatgtagagtttttcctcctcatttttatgtgattcttaggaattgagtagacataagcttacataacaaaatatttcaactgcaaaaaaaaaa

SEQ ID NO: 16258 - DNA, 369 bp, Homo sapiens
aactacactgcatcaggccagcagctcaccaacactttgaatatacttactggaatctttcattcacaaagttgtaattttcatatgtggaaaaaaatcttagtgcttcaatttaggtttcacaaatcactcaaacagcactgtcaaaaactagccatgtgttctaggaggaggtaaggtttcacaggagaaactaatagtacatggaactccaatccaagtcaccctctcctttatcacagagatcacagcttccactcaacattccttgcctactttagtcacattaataatttcttccttctctgaactcccataaggtaacagaatccaccaaacaattcagcaattcacaactaaatagtgttt

SEQ ID NO: 16259 - DNA, 393 bp, Homo sapiens
gctttgttgactggggtgtgttatgtgtgaatcactcctatcttgtttatgctctaagcagtgatccatttctatcctatgaaaaagaaatgcctgggccgggcacggtggctcgctcctgtaatcccagcactttggaaggccgaggtgggcagatcttatgaggtcggaagttcgagaccagcctgaccaacatggagaaacctcgtctctactaaaaatacaaaattagccaggcatggtggtgcatgcctgtaatcccagctactcaggaaggctaaggcaggagaatcgcttgaacccaggaggcagaggttacggtgagccgagatcatgccactgcagtccagcttgggcaacaagagcgaaactcggtctcaccagaaaaaaaaa

SEQ ID NO: 16260 - DNA, 464 bp, Homo sapiens
cttttcttcagaggagctcaagctatttaatgacaatttgaccatttagagaagggctttgactttgtaatgtttagggtatttgctctggtcaattttccatgtggattcactagctgatgtgtggccatctcagagatggtttggggcctcattccataatttatgtggcagtgactcaaaaggtttagtacacatgataaatggtaacaataccttccacctaaataggggagtgtcattattttcacatatttttggtggcgtaactgataaccaaaacattttgttaaatttacccaaagttttcagcagccctgggatgccactacagttaagacatagctgtgtcagaaaggtggcaaactctgccctgccgaaaggctgccatgggaagacagacgcgtttttcatggatgactgtggaagcagtgcatttttaaaagggagttgcaattcccaga

SEQ ID NO: 16261 - DNA, 460 bp, Homo sapiens
cagtggccctatcgtggctcactgcaaccttgaattcctgggctcaagagatcctcccacctcagactcccaagtagcagtagctgagactatcagtgcgcaccaccaagtctgagtaattacaatacttttttctttttctttttcttttttttttcgtagagatggggtcttcctattttgtccaggctaatctggaactcctgccctcaaaggatcctcctgtctaattctctcaaagtgctgggattacaggcatgtgccaccgcacccggccaaatgcacctccttttttcaagtgtacaattcaatggtttttaatatattcacaaagtcatggaaccatcacacctatctaatttcaaaatgttttcatcactccaaaaaataaccccatatgggaggccgcggcgggcagatcactcgagaccagcctggccaacatattgaaaccccgtct

SEQ ID NO: 16262 - DNA, 467 bp, Homo sapiens
gagacggagtttcgctcatggcccaggctggagttcaatggcgcaatcttggctcaccgcaacctctgtctcctgggttcaagcgattctcctgcctcagccttttgagtagctgggattacaggcatgtgccaccatacccggctaattttgtattctttgtagagacggagtttctccatgttggtcaggctggtcttgaactcccgacctcaggtgatccgcccgcctcagcctcccaaagtactgggataataggtgtgagccaccgtgcccggccttagaacggatgaaatgcaggagtcagttccgggacccggctcagggcagccctggctccccaggaagaaagcccgtttcacactaacatgtacagaatccaaccgagggctttacaaaacaaaaccaaaaagataggaagcagccgggtgcacagacgcttagccacgcagctttgtactttgcgt

SEQ ID NO: 16263 - DNA, 308 bp, Homo sapiens
tatacaggaaaaaaaattgtttagactagttaggaagtacactgtcaaggataaacttaataaagggctaatcagttgtatacattttgaaggaagaaagagaaacactggtgtggaagagaacatcctgggtggataagattatacttgcaaagggaagaatgcgaaagtcattctcaacagtccataagtggctcatctttttttttttgagactgagtcttgctctgtgtcccaggctggagtggcacaatctcggctcagtacaatctccacctcccaggtttaagcagttctcgtgcctcagc

SEQ ID NO: 16264 - DNA, 367 bp, Homo sapiens
atagactcactggactcagaagaactgctgttctcttggttgcagcttattaaagtgagagagaacattacaatgaacaaaggaaaaggcacatgggataagcttacaagagttctttcccagtagagttgtgtggatgcgcttaattctccctgcaactatgtgtgacgtggcgagttggcagccagagaatctcacttgagccttgtttagggtttttattgggagtcagtcaggtattgtgtaactgaccttaactatgtatactccatccgcatagagtaaaaatgcatttaacacaaatcacatagttagcataaactctctaatcaagctggtgccatgtgacccaaggttctagacatag

SEQ ID NO: 16265 - DNA, 191 bp, Homo sapiens
agttatgatcacttctgtgaatatccactgcactctagcctggcaacttagtgagattccatctctttaaaaaaaaatgtccttgtattgtgcaagaggagattagcgatactaaatttattaaacaagttaaaatataagtgcagccactaagagaagaaataaagcatataacctccaaattgtagacc

SEQ ID NO: 16266 - DNA, 220 bp, Homo sapiens
ctgcatctgcccaggcttctctttattccttactacccaatccccattccagtcctctgttaataactcttacggacagtccccaactcatgatgacttgacttaggatttttctactttgcaatggtgcaaaagtgatccgcattcagtagaaactgttcctcaagtactcatacgacctctatttttcactttctgtacagtattcaataaattgcgt

SEQ ID NO: 16267 - DNA, 498 bp, Homo sapiens
gatataagcatccccagcaattccactccaaggaaaatatctaatagaaatgcatacattcatctaaagccatgtacaagaatgttcacagaagttccatctctcatagcccaatactgagaatcatccaaatgcacaattaattctggaaacagagtacatccacaaacaacaagatacattaatctcccaaagataatgctgaatcagagaaaccaaatacagaagagtacacacggtgtaatttcatgtatatgcattttaaaaataggcagaactaatctatggtgttagttactgtggtgttagaagtcacagtaatggttacactcggtgggggcaggataagtactgaaagaggaataaatggaacttttagtgtcctgataatattttctttcttaatctgggagccagtgttaatttagaaaagctcatcaggttgtaacttaagatttgtgcattttctgtatgtatgttatatgtcaataaaaagtt

SEQ ID NO: 16268 - DNA, 507 bp, Homo sapiens
atgcagaattaaaatttatctctgagcttcttggtttggatagatgtcccaaaatatagacctgtgtagacaaatttgtagcacactggacatgctttctccctaaaaatagtttttcggaaatcaagagggaattttctactttaacataaaaaggtgaattaaaaaaattgactctaacctttcttcccagtacttagaagtatcaagaaggtggaaaatatggcaacacagtagaccgctggtctttaaataggtactgccttaggtaaaaccctgaaaaactcttggtggagaagtcactcgcaacacttgtccaaagaccagctgcttcaaaatcacttggggcttttgtgaacatacgtactcccagatcccatcccagccgttacaaactgaactagactatctatgatctaggaatctaattttgttatcctgttaatttcaaggtttattgtaattcatataaattcaagatgacattaaagatatctgaaaccctgc

SEQ ID NO: 16269 - DNA, 929 bp, Homo sapiens
gagggcggccaggccgccgccgagcccgagtagacggcgtgcggctccatgaccccaccggcgccggtgggcagcagcggggaggcgggcaccgagctgtcgtggtgcgggtactcgccggccgccgcgccgccgcagccgcccatgtacgagtggccgccgttggaaggcaggtggggcaccgagtggctgggcagggccatgccgtccacgttgcccggcaagtggccgttcatcatgcccaggccgccctccagcgccaggctgttgggcgggcacgagaggccgccggccgagccctggaagccgtaggtgtccgggaggtggttgaagccgagcccgttcatcatgctgtacatgggcttgagcgcctggcatttccttcggaagccgcgcggccgccgccgaaaggagccctcctcgaacatgaactcgctggccgggtcgatggtccagtagtggcccttgccgggccgcccaaggcccttgggtagcttgatgaagcactcgttgagcgagaggttgtggcgcacggagttcttccagccctggtaggagccccggaagaaggggaagcggctctgcaggaactggtagatctcgctcagcgtcaggcgcttggtgggtgaactctggatggccatgacgatgagcgcgatgtaggaatagggcggcttctccgggcgccggatgccggcgttggtcttcttggccttggacgggccggacgacgcggggtccatggccgcgccgcctcccccgccgccgccgccgccgccgccgtgcggtggctgctgcttctcgggcgccgaagacatcgggtggctgctgccgccgccgccgctgccgccgctgctctgcgccgcggaccctcgtgccgaattcggcacgaggtgttaccattatttgagtacctgtctctatcaact

SEQ ID NO: 16270 - DNA, 494 bp, Homo sapiens
atgcttcccaggtgagtgtgggtcttagatgggataatgggaacagaggagtctgtgtcttcattcttccccttcaagccactgtgcccacagaagcagctgtcgagtttgagggacagaatggtggccttctgtgaactctgccagagttgcctctcagatgtggatactgagatcccaggagcaggtgagtactgactcaagtgggagcaacaaggcgagtatccctgcccccattccaaggagaaattgacagtgtcatttctaccttgggaaacattctgtccttttaaacatcctttcttttccccctacaggcttttgtcttattaagtgatctacttctcatctttagccctcagatgatagttgggggccgtgatttccttaggccacttgtcttttttcctgaagctactctccagtctgagctagccagcttcctcatggaccacgtcttcatccagccgggagacctgggcagtggtgcagtg

SEQ ID NO: 16271 - DNA, 171 bp, Homo sapiens
tggccgcaggtgctggcggcttggatggctcacacctcaccagacaccctggggccagggaggggcagaggctgccgtgtagctgcaggcgtggccctttcccctcctcgatgacagctcgtcctgtgctccaggtcttctccatactttgaggatatgaaaggagccaga

SEQ ID NO: 16272 - DNA, 510 bp, Homo sapiens
tatccatcatgctgagaagttgatgaactgtacagtaaatctgagcccacagtcaggactgagataagtcatttcagacaatacagtggagaatttatgagcaccagggacaatgtttcagattcctgtcatggaggtttctttacctatttagttgaataaagaccttataaagtccaagccacaatgctgtccttccacaggaataaatatgagattctaaaactttctcttaaaatgaaccattttgagagctaaagtgactagatgttgacagccaccatttttcataagtgcatcccataagaaagatgtactatagattatttgtcttgaagaagagctttgatatgtttcaaaattcgacgttggctttggaaggaaactgtaaatttacagatctttgtccttccccacaaagagccttaatctcacaggttggattatgtggaactcactgctatttttcagttctcctttaagtgactaaggaacatccagatacttcca

SEQ ID NO: 16273 - DNA, 333 bp, Homo sapiens
ccatgcccttctctcttaatccatggtaacttgaaaaccaacagccctcttagtatctgtgaaaatcagcaacctagtagccactggaggagacagaatagatttggaggtcccccagatctccactactagagaactgcctctatttgtcttgtctggcaactcactgaaaagctccattttcaggacctatctttatttgacttaactcagagctcactctgaaaacagcccttcctgcagaataatcagtggcaactgattaaccctgtggctgcctgaggcagcgttaccaggtggagctaacaaaaggctgaccaagaaacttaaaag

SEQ ID NO: 16274 - DNA, 278 bp, Homo sapiens
agaaaaatgatagtagttgaattaaacgtggaacatactgtaatgttaggatctctgtttcccatgtaatagccttcgtgattcagtcatgtgatggtaaatggatgaataggattttctttgccattttgtgctgacagacctttttttagttaattgctttttaaaataatttatagtgaatacaccaacaattctatttacaggttggtagttaaagcctcttaacagtcactgataactatattttgaaggtaaagaatatagctagttaaaac

SEQ ID NO: 16275 - DNA, 301 bp, Homo sapiens
tccctccccgggctgtgcgggagctcttgggcgccgcgtctgcgccggggccgactccgcccaggcttgtagccagaggtcgcgctatctcgccgggctggcccggcgctctctggggttgttccctcgggcggtgcatggggcccacaggcgtcggggcttgagggaagaggggccggggcctgaagggcggggaccacaacgaggcgcggggaggtcagtggagcggagagccggcgcaggccggcggcggcgcggccggaggagaaagagggcgctgtcttcctggcaaaggagtttt

SEQ ID NO: 16276 - DNA, 275 bp, Homo sapiens
gtcatgactaaatgaatgaaccacatgggctaccaaaatcaaattctctactgcatcactaatgtaatactaaataggatgctccatcaaaagagacctagaatttacataatttcccataaacttatcagaggaacaaatgtaagacaatgggaagaaaatcaagataagctcactgttgttgctggtttgtgtattcctgtctttctcaactcctcccacagctgatagaacattgtagttaagagagctggtagaaactacttcactaaaat

SEQ ID NO: 16277 - DNA, 257 bp, Homo sapiens
ttgtacatgctgttccctctaccaaaactacttttttgttgagcaatttctactcattttttaaactcactgagatgttactctcaaaaataatataacttcacaatctctagtaagtctcctctttttcttcctttgtgacttgttatttttcctcattgcatttatcacatttgtaatcatacatttatttaggtagatattaaacaattccctaaataaatgtatgattacaaatgtgacaaatgcaatgaggg

SEQ ID NO: 16278 - DNA, 602 bp, Homo sapiens
acagcagccgagttcgcgccgccggtaggtgctgccatgccagggggcgggatcgtggagcgcctcgcagaaccgcacgaaagcaaaaacaaagccatctctccggagcagaaatagaacagacgtggccggggaaagccaaatatttcctgccgtcctggtgaacacaatcgagcaaggcagtgaagcaaacatcattaggtggctggactcagacacatcacgctccagtttgggttccaaggtgcttctctctggattttcacctgccttgccaaaaatgattgattacgctgggccaactgggtgtccggcaatacccaacaaatgactttggcccctaacagcaggtcttggccagacagaaatcaatatttcaccattaaaatctatcaaagaagagttaaggcaccatctgtccctgccgcctctctatggtgtgtgaacattaaatccgacacttgtactacatgggtaatcaatatatagtggttcacagatcatttgtggttcccttttagcagtgatggatgtctggaatcgttgtgattcattttgtcagaccattaaacaagattctgtccagttccttcctgatttca

SEQ ID NO: 16279 - DNA, 521 bp, Homo sapiens
tgattggaaaggtctctctcccggataacaacaattcaatgtgccttgacattttaatagcctgccgcctgccgtcctggtgaacacaatcgagcaaggcagtgaagcaaacatcattaggtggctggactcagacacatcacgctccagtttgggttccaaggtgcttctctctggattttcacctgccttgccaaaaatgattgattacgctgggccaactgggtgtccggcaatacccaacaaatgactttggcccctaacagcaggtcttggccagacagaaatcaatatttcaccattaaaatctatcaaagaagagttaaggcaccatctgtccctgccgcctctctatggtgtgtgaacattaaatccgacacttgtactacatgggtaatcaatatatagtggttcacagatcatttgtggttcccttttagcagtgatggatgtctggaatcgttgtgattcattttgtcagaccattaaacaagattctgtccagttccttcctgatttca

SEQ ID NO: 16280 - DNA, 772 bp, Homo sapiens
acagcagccgagttcgcgccgccggtaggtgctgccatgccagggggcgggatcgtggagcgcctcgcagaaccgcacgaaagcaaaaacaaagccatctctccggagcagaaatagaacagacgtggccggggaaagccaaatatttgtggctggactcagacacatcacgctccagtttgggttccaaggtgcttctctctggattttcacctgccttgccaaaaatgattgattacgctgggccaactgggtgtccggcaatacccaacaaatgactttggcccctaacagcaggtcttggccagacagaaatcaatatttcaccattaaaatctatcaaagaagagttaaggcaccatctgtccctgccgcctctctatgcttgtggccttgaacaactgccttaacattgctgaaactcaatatcttcatttgaacaaacagagtggtgatttccaccccacagtggtgttgttcagaatgaacatgaaaataaagcagcgagcatgtagtcggctctcattaaaatcctggatatggagtccgagatatggaaggccaattggctgccaaagaaatgggagagacaacacgtgcggtggcttcaaaggaggagggagagttgagtttaaactaatgaagtaaaggcagggatgggagactgaaaggaaggaagacgctgacacttcttcagtgtgattgtatgccatacactgtgctgggtgctgttaatacaacaacgcttctggctatgtactgtttaacccca

SEQ ID NO: 16281 - DNA, 573 bp, Homo sapiens
gatttctgtggtatccgcacttgcgtggtgatctggggtataccgttttagtcttgggggtagagtgactgcttgcgaaccagttcagcagtgcctcaggtaagaggacttagttctcccgctgcagcgaagtaaaagaggaaggaggtctgtaccgcgagccgctcccagctcctggtgcggtgcgctgcgtgccgtagaaatttagtaaacgtggttagatgtagagaaggccgagctgctgccggggccacgggagtctttgtgcggtcagcagagggacttgaaagacaggtgaaaggacattggagacaagcccctcaggtctatgttgcttaggaaccttggaccgcctcatcgcactccgctctatcaaaccgttccaaattaagattgctggtgtctcccgaccagataaaagcagtgatctctcagtctcgacgagtccttaaatgcgtttgcaagaggtgttttacataactggagcccagttaattgtaaaacaaacaaacaaaaaacactagatcaatggctagtgagtatctactaataaaattttataatagttgctgc

SEQ ID NO: 16282 - DNA, 713 bp, Homo sapiens
gatttctgtggtatccgcacttgcgtggtgatctggggtataccgttttagtcttgggggtagagtgactgcttgcgaaccagttcagcagtgcctcagagacagggtctcactctgttgcccaggttggcctcaaactcctggactcaagcaatcctcccaccttggcctcccaagtagctgggactacagatgatagcttgctgtcttgcctaagctggtcttgaactcttggactcaagtgatcctcctgccttagcctcccaagtagctgggactatagctgtgtgctgctgagcctggctaactactaaagaaattaagacataacacttctaagtagccgacaaagaagaaatcaaaagggaaatcagaaaatattttgaatgaaataataaaaatacatatcaaaattgtgagacgcaggggcccagttctagaaaagatggagtaagcatcctccaccctgtctctcccactgagtgaagatgcacggaactgatatttgaggactctagaaagtaaatagtagcaggtggattggggaagaagtccagaattcaacataccaccgaactggtggtgagcttcacattttttcttctggtatgcactggcctgaactcaaggcaacctcaaatccagaaatgggcaattgcacagacagacagaactacagaagaaaccccctaggtctggctcaaggagaggga

SEQ ID NO: 16283 - DNA, 632 bp, Homo sapiens
gatttctgtggtatccgcacttgcgtggtgatctggggtataccgttttagtcttgggggtagagtgactgcttgcgaaccagttcagcagtgcctcagggacagagtcaggctggaggggaatctggatctgggcagctcctggaccaagagaatggagcaggggaatcagcgctggtctccgtctatgtacatctggactttccagataagacctggccccctgaactctccaggacactgactctccctgctgcctcagcttcctcttccccaaggcctcttctcactggcctcagactcacaacagagtgtaatgtcaaccacaaggggaatttctattgtgcttgcctctctggctaccagtggaacaccagcatctgcctccattaccctccttgtcaaagcctccacaaccaccagccttgtggctgccttgtcttcagccatcccgaacccgggtactgccagttgctgccacctgggtcccctgtcacctgcctccctgcagtccccgggatcctcaacctgaactcccagctgcagatgcctggtgacacgctgagcctgactctccatctgagccaggaggccaccaacctgagctggttcctgaggcacccagggagccc

SEQ ID NO: 16284 - DNA, 413 bp, Homo sapiens
tcccctctgctcctgtagaatcagcgctggtctccgtctatgtacatctggactttccagataagacctggccccctgaactctccaggacactgactctccctgctgcctcagcttcctcttccccaaggcctcttctcactggcctcagactcacaacagagtgtaatgtcaaccacaaggggaatttctattgtgcttgcctctctggctaccagtggaacaccagcatctgcctccattaccctccttgtcaaagcctccacaaccaccagccttgtggctgccttgtcttcagccatcccgaacccgggtactgccagttgctgccacctggtgaggaaggttgggaacttggaaaccaatggccttaagtgaaataaatgttctcagtggttttctcctctctgaac

SEQ ID NO: 16285 - DNA, 555 bp, Homo sapiens
gatttctgtggtatccgcacttgcgtggtgatctggggtataccgttttagtcttgggggtagagtgactgcttgcgaaccagttcagcagtgcctcagggacagagtcaggctggaggggaatctggatctgggcagctcctggaccaagagaatggagcaggggtaagtcctaactttcaatgtgtacccaaatacttgtatttatgcttttgataaaatgtattttcagcattaatacacatccgattatgccttatttatatatgaagaataaagttaccatgttatactgttatgtcctaaaattcaaatcactatttgagaaaccctcaaattggtgctttcattatataatgatacatttagacaaaaccccaaactaagccatttgaaacaagattctctccattgcagtttgtagcaatgttatttctgtgtatgtcatgagaaggctaaatatcagtgttaatttcttgtttgaatccgtgaaatcatgcctgtaaagcccaaacatttgtaacaaactccctaataaatttagagaaagtcaaa

SEQ ID NO: 16286 - DNA, 419 bp, Homo sapiens
gcattgcaaaacatccttcgaggatctgaattaattttgcaataatgagatcatatcagactatatatctgatattttagataacactggccagtgcttttggttatgttgtcatttttggctagatagtaacatgtattagcaaggccaaaatgtgaatacatttcacaaaaacacacattcttagccctgctcctctaacttggaataattttcatctcagtgagatattggctaggactttgattccaaaacaagtaaaattgaagcctatttctcttttcccctctgttctttattttttttctttgctggaaaatctgtttacatcttttttttcttttttgaaacacttttcccaagagatctcaattactactaagaaattttaactcagtttcagagctgaagaaactgtc

SEQ ID NO: 16287 - DNA, 1009 bp, Homo sapiens
gtgaaggggtgtagtctgacatttggaagcttaagaaccaagtctgctgccgtccaattcttttttaaagccttccatcatgtgtgtactttgcttgaatgattattttaaagtacatgtcctatttttgccaatctgacagctgtttccatagaaactagagaagaaatagtcattttcagcaagagttgttaaaactgtcttccaggcttcagctgtgagtgccagtgagtgctgcacttgctcattcggagatggtacttaaagaattaaggatctgaaatgttcgtagaggctaacaatccaaattgtttaattttctcacatcattaattttgttatcctagaagtctgccagctatgtttgttgacctgccacagctctttgaagagaatatgtcagccctgattttttttttttttatgtgctctgtagtctagtgattggctccttgaaaatgcatgaatagatttcttccctcattctttaccctttcttcaggataaaccgggtattacaaaatatcaggcactgtttctattcaaaacgacacttggttgtcagtgatagaaatgataatggttttaattatatatgcgtagtgttggggcttttgcttataccttctgtgtcaataggattcttttaaaatttttacacaagtcatgagaaatgagaaggagtttgcttgtcatgtgcagagctaagcagtgtgaatagatgtgcatagacatagagatgagagctttctttttctgtggggtgtaagtaaatcagggagtttggaatttaggaatgggtgaaggagggttggggaaggtgcctggagaagtagtaggagggcctggttcgccatatgaaggagtttgtggaagccatggaaaaccaacgaaagtccaggcgtggtggctcatgactgtaatcccaacacttcgcagtgcagtatgatcagttgagcccaggagttaaaaaccagcctgggcaacatagtgacacaccgtgtctaca

SEQ ID NO: 16288 - DNA, 157 bp, Homo sapiens
gagcagctgatacacccccaggtcaacagagtgactatgagcccatgctcaggacctgagaaacagccttgcaggccccatccaccacagacatgctcctggcctgcccaggagccctctgcctttgataagggcctgagaaacagtcccacaggct

SEQ ID NO: 16289 - DNA, 322 bp, Homo sapiens
aaatttcaacctgccacagagctgtgtctaagcagtgcaaatttcaaaacctcaagatgaaagtagacttgccattggtatccactcatcagctcagttcatatttgcctctccatttatcagtggtatggagtacaggaaataaaacaaatctggctgggttcgctttcttcctccacttccttttatagctctcaaatagtcctctatctctactattgaaaaatacatgtgtatgtttgcactaggacatatttatctgaccccaatggcctttctgaatatgtatttccatacaaataaatgcttgttggaaatactg

SEQ ID NO: 16290 - DNA, 515 bp, Homo sapiens
ttaatgtgaatgattgtatgctgaaataatctatggatgacaagtcaacctcccagaataaggcagtattttccaatagagtttcacaatatcctacccaaattaacttcaattaaattccattgctacaaatgccatgagtgtgaagttggccaaataaaatttattaatcaatgctacctagagaagtcctctattaatgacaagttttttaaaaaggacatctttggccaggcagtggctcacaactataatcccagcactttgggaggccaaggtgggtggatcacctgaggtcaagatttcaagaccagcctggcaaacatgatgaaaccccatttctattaagaaaaataaaactgcaaaaattagccaggcgtggcggtgcatgcccgtaatcccagctactcaggaagctgaggcaggaaaatagatctaacacaggaggcagatgttgcaatgaggtgagatcaggccactgcactccagcctgggtggcagagtgagattccgtc

SEQ ID NO: 16291 - DNA, 507 bp, Homo sapiens
tgaagctcacacggcaggaccagaacccaggtcagccccaccccgccctgccctgccactggaggtcaatggcgacaggagcctgggttcttgccaaactgcagacctcactccccacagtgagttccttcctgttttcacaaggatcggtctcactctcgggtaacagcgagattttcctagtgccccccaccccccactccaaccctgggcggacccttggcctcaggcaacatcacagggcagctgccgggggtgcctggcattcaagccttgctgagaacatgaaactgctgctctggggactcgcactggtgaccccaatgtggcagccgctctttcggctcttcaataatttagagaatgcatacaattcagcgggcagtttcatctctgggttcagaaacacaatgccctggggattgcttccagcgaagagtgaaattccacttgtcacagtgacagaggatgtgagcctgttcctggaaggggctctggtctctgggt

SEQ ID NO: 16292 - DNA, 492 bp, Homo sapiens
cactgctatctgcctcactcaagaaagtgattggcccaacttgttgtttgatatcagtctggcaacatcatagaggctggctgcccttgggttcaactagctggggctgaaaatatcaatagagtcctatgtgtactgagggtggggaggaggcttagaacaggaaagtacagccaggtgcaggggcatttccacctaacaaagggttgtgggcgtatttagccttagctgttgctatggtctgaagatgtcctccaaaattcatgtgttggaaacttaatcccccatgcaacagtgttggacgatggagctttatgggaaaaaccttcatgaccggactgatgccgccacagaaaggactttcaagagggggttcacccctttcttgtgaggatgcaccaagaaagcccttgccagatgccagtagcttgatcttagactttccagcctccagaactatgagaaataaacttctgttctttatacattacc

SEQ ID NO: 16293 - DNA, 427 bp, Homo sapiens
cagactcatctcagttccctaagaatttgaaaatcagtgtgtgtgtattggggagggaggtaggttttctctctggggagggccccacaaaagacctcaattttaaaatctgagcccagcaaacaattcctggccctgccactgatgaattttcttctgctctatcctcttcagacgcaattagacaattagcactcctgcccgcagcccccacaactttcatcagatgaaataacatcctaactggagtggaactattttcatgactccaaataaaaaatgcagtcttccaaatacacctttagtgaatccgtccttcctgaagtaggacttttttctttgtcttctgtttctaagctccccattttgctttctatctcaatctaaaataatgaaataaaacaaaatgtttggtcggccactaatc

SEQ ID NO: 16294 - DNA, 494 bp, Homo sapiens
ggggcgtgtttctgtatagaggtggggctagaggagggggccctggttctgtatagaggttggggtggaggtgattaagatgataagctcttggctcttttgcatgtctgagttctgtgactcaccagtccctctgtgaccttgggaaggtcactttcctctcagtttttccatctgtaatttcatggttcccaaaaatcaatgcatgtgctgctctctggggcaaagattgtttttaaaaatcactctgtagtgaaatgagggaaaaaaatgaccctgaagtaaggttttcataaaagaaaacttaatacactctaaaaactgtctctcattctgtgacttgtcctttttctgggttaaacttcgcttttgttatgaaatgatgatgaataagagactaaaagctagtcgttgggtttttgttctgttttgtttttgttgagacagtcttactctgttgcccaggctggagtgcagtggcacgatctaggctc

SEQ ID NO: 16295 - DNA, 354 bp, Homo sapiens
caatggacactgcctcgctggatcacaagtgcagcagatccacccctgccagatccagagggttggaagtcagctgcgggtctgcaatgacggcaaacagtggtggacggcgagtgaaagctcagctcgagccataaaaaacacagaccagaagagtgtgcagttgcaagatttaatagagtgaaaacagagctcccataaaatgggaggggacacaaagggggttgcccttcattctgtttttcataaggactgtactaatttacactcccaccaacagtgaataagggttccattttttgcacgtccttgccaacacatcttatcttctgtgtttttgatagtagtcattct

SEQ ID NO: 16296 - DNA, 480 bp, Homo sapiens
actttcaagatcatataatctacccccctccctggttattggacactcagattgatacttgccttttgcaaggttgcacattctgtttagagaagagtagcggctcgattccaggagtcctgattatcagcattgtaccctttctactacgccatgggggtaataaattggaaatgtacccgaattaaggaatagaaagagcttggcatgagaaatgtgccctcagtctaacgagcagctttgggaaatggttcagatggagtggactgactaaatcattgaactccaaggaggcatgtcgggtggaccaaagaggtaggagagaagtgaaaggccactaagatccacgcaggctgagattcacatcccctctgcaccacatgctgactaggtgacctcgggccattcttgaaatgtctagtaccttaatgttagaagctaacaaatgcagaagttctttcctttctcgtcttgtgagat

SEQ ID NO: 16297 - DNA, 403 bp, Homo sapiens
tagagacggggtttcaccatgttggtcaggttggtctcgaactcttgacctcaagtgatcctcccacctcggcctcccaaagtgctgggattacaggcgcgagccactgcgcctggccccaagtaaactaattgaaaatactctggggtagtttctgtaatctgtaacttgagtcaactctttcagattgtattatttaaattatcctcttccatctttgaatctactataaatcttgtttttccaagcatctattcactgagactatagtttccaaatgtttcagttcagttcacttgagcttgttagatgcccagcactatgggggagtatgacatagaccactatagcagtctcagtcctcatcttaaaagaactcatggaaccttaaacattgcagcca

SEQ ID NO: 16298 - DNA, 455 bp, Homo sapiens
aaggtagtgaggggctgttgaagcggtgtcaggagagagtttagttagttttcatggctttaggtaactgaagtttagtagccatgtggtttaaaactggagggtacttggctgggcacggtgtctcatgcctgtaatcccagcactttgggaggccaaggcgggcagatcacctgaggtcaggagttcgagaccagcctgaccaacatggagaaaccccgtctttactaaaaatacaaaaattagccgggcgtggtggtgcatgcctataatcccagctactcaggaggatgaggcaggagaatcacttgaagctgggaggcagaggttgcggtaagccaagatttgcgccattgcactccagcctgggcaacaagagcgaaactccatctcgaacaaaacaaaaaaaactggagggtactaggccgggcacagtggctcacgcctataatccc

SEQ ID NO: 16299 - DNA, 1300 bp, Homo sapiens
aggcatgagccaaccgcgcctggcctggccatgctaattctttcatgtattgtctataactgctttcatactataacagccgagttgtgtagttacgacagaggctatatggcttgcaaagcttaaactatttacgatctgttcctttaccaaaaagtttgctgactactgctgcatatggtatgctgaattgggtttaaatggcttgtaatagccctgaaaatttaagttggctctcctgtcccctgccgttgaggctggactgcatgagattattgtatctgttggctgtagctgtgactatgagctgagtgccatgtcccattggatagcatgtacttggtgacccctgacccacatacagctgactctttaaggcagttccctgccacacagtcaaggacaggaagatctggtgtgatttcccagatggggagttgtgcctattactagcatcccccagaagtagtgagagatagcattagctaatgggtaaataactggcttaaaagtgtaaactcctaggttttcacactccagtttttatgtggtcctggatatgtgattcttttctgccttggcattcctgtctaaaacactgatctagcaatcccaagccaccctttcctttttgcggcccttgttctgaataaaacagtgatttcatgtctcttctcactttcttccagaaggcagctagccagcacatactcactgaccagttgctgcctgcacagcagtgttttcactgctgtgttggagaaacccgaagtcttaaagggccataaggtattatttaaagagatcagtgtcatagtttaactgtcttcacagttccaggctgtaggaggtacagtttctgaggacaggggcaatgtatgtgggtttggtgatcatttctaaggcctttttcgatgacccctttgtcctttctgacacattagaattgctctttgctgctgcctgaaaaatgatgtcctcatgctggacagccccagctgaaaactcaggctgctgccttgacctatttcccttctccctgctggcattaaaagggaggatgcccccggggagctcattctgcaggctgcagtggccagggcagagtcctgggtttcctctctctcccttactccctgctttaaaaaaaaaaaaaaggtacagaaaaacattataagcaactgttgccattggggaaaaaaaagtatttacgtttcaggggaatgtggcctcagccatgaatattggtgtgtatttatgaaggggtgtatgtctgggaaataaaacttagaatacaaga

SEQ ID NO: 16300 - DNA, 424 bp, Homo sapiens
tattaagtaagttctcctgtttttattagctgtgatctgccttgaggcgcccaagtggattcccttccgaatgggtgctcctgtttagtaggtggtactcctgcctcttctgttagccatggacactgggcacttcccctgtgcccagcctgcccccctgcccctatactcacaggtacttgtaaggcccactgtacgtgttccctagcctcatgaccacggtggagccaatggctctgggaacaggctcaccaggatggcggtttaaatgcccaaatgccctgtgcatgcacattctccatccttggtaaggtgctccctcctactggtttgcttgctggggagagaggacttgtttttttttttgagatggtgtctgactctgtggcccagactggagtgcggtggcacaatctcagctcac

SEQ ID NO: 16301 - DNA, 583 bp, Homo sapiens
actaatggagcacatgaatggatagattttaaagaaatgcctaggctgggcgcagcagctcacgcctgtaatcccagcactttgggaggccaaggcaggcggatcacctgaggtcgggagtttgagaccagcctgatcaatatggagaaacgccgtctctactaaaaatgcaaaattagccgggtgtggtggcacatgtctgtaatctcagctacttgggaggctgaggcaggagaattgcttgaacccaggaggtggaggttgcagtgagctgagaatgcaccattgcactccagcctgggcaacaagagcgaaactccatttcaaaaaaaaaaaaaaaaaaacatggccagttgtttcactgctctctgacagaatcctgacagaatctcttgctctaggtagaacaaccaattttttattttaggctactcatctgtgaccttgataatatggagttagaattccttcctcctttctatttctttccgcactccctgtctccttctttctctttcctcccttctcccttcctccctctcttccttcttctgtctttccttctccttttccctccattccg

SEQ ID NO: 16302 - DNA, 553 bp, Homo sapiens
aactgggtgtcttttaaaatttatttattttttttgagatggagtctcactctgtcacccagggtggagtacatgagccgaggttgcagtgagccgagatcgcgccactgcactccaatctgggaaatgagcaaaactctgtctcaaaaaaaaaaaaaagtaagtgtcccttcagccctgaccactgcccaggggaaacctaggttcagttgcctgatctaggcagtgtctgtggggacacacattggctaccaagggtggagaaactgggctctaacgtgaagggctggctcgtcactgtcaggtcagaaccattttagataaaatttccagaaacattttatattgaattttatgtcttacctctcatatttattcaggtaaaccttccagaaagaggaaagcagagcatgaagaggaagaagatgatataaagccctaaaatgtgcactcattgtattcaatagtttgttttaaaacaattatgaaatgacttgttttaactgaagttgagttgcttttgcataatcctagttgtgaataaaaagttttc

SEQ ID NO: 16303 - DNA, 370 bp, Homo sapiens
taatttattcagcatctcggtgctttgtggtgagggacttttcacattatttacttggtaaactttctatgtaagtacagtttttttttttctggtactcaccatggctggaatgctcacattttcaacatataccccagtatcctgagaacttctagagtactaatttcatctctggggaagagggatagaaattttggtgaaagcaatacaaaaaagtactattgattgaattctggcactgaaccaggactatgtgtatgttacctctagttcttataacaaccctgaaaaaataggtggtattattacaattttagggaaggaaaaaaagtttcagaaagtcctattgcagtaccctgcacctagt

SEQ ID NO: 16304 - DNA, 770 bp, Homo sapiens
gcttacttgctggtgtcctgtcacattgcattgcttgaactgtgtcagatcgcattgagtaactttgcttaatccggcgctgacgtgacccgctgctttgcaacacttaagacaagtgtgtaggagcttttctcctcagtccattttgtgtgtgtgtgagtgcagtttaccagatgaggcatatgtaaatactattcgaattgaaaacacatctatttaagctagaatttattaaggggcctgtaggagtgaaggcacaagaaacatttactcacagaccccgacaggcttctacagaagactcactcctttgccccagaaaataccacgtttactaaattctgatattcacagtttcctatgtggaaacttctgaaaagtttagggcacactatggctgacagccggaaggtaaacttggctatgattttctgttgggccaactccccatgcccctgagaaacacattcttcacaaaaaataattgtaataggccgggcgcggtggctcacgcctttaatcccagcactttgggaggccgaggtgggcggatcacaaggtcagaagatcgagaccatcctggctaacacagtgaaaccccgtctctactaaaaatacaaaaattagccgggcatggtggcgggcacctgtagtcccagctactcgggaggctgaggcaggagaatggcgtgaacacgggaggaagagcttgcagtgagccaagatcgtgccactgcactccagcctgggcaacagagcaagactccgtc

SEQ ID NO: 16305 - DNA, 380 bp, Homo sapiens
gtaaatgatgaaaaatagaatattatgaactctcatatagcaattaatggctaagcttatgtcatctgtacctccaccttacccctctctcctctctctttttttagtttctatatagagatggggtcttgctatgttgcccaggctggtctcaaactcctaggctcacgtgatcttcccgctttggcttcccaaagtgctgggattacaagcatgaaccactgaacctggcctcacatgttaatttttttttttttaaactttattctgggctgtgcacagtggctcatgcctgtaatccctacactatgggagaccaaggcaggtgaatctcttgaactcaggagttcaagaacagcctaggaaacatggcgaaactc

SEQ ID NO: 16306 - DNA, 366 bp, Homo sapiens
ttcaaagccaggactacagcatctacaaatctctgactctcctgcctctctcttaaagggactgttgaaattaccctgggcttaaccaagaattatctccctgtctcaagaaacttaacttgattacatgttcatggattccagggagcaggacatgggtatctttggggaccattattctgtctaccacatggacaaagccaatactcagctcagatttccaattccaagtccagtgggtttctgcttgggactgcactgagagcaagaccatacgcacaggattgcacagaagagctggcattttggcttttatgggagaggtcttctcaatggtcctccttaaacgactccaataagaatcag

SEQ ID NO: 16307 - DNA, 757 bp, Homo sapiens
ctttggcgggaaagagtctcggaggcggggccaaagggggacggcccgggcggttgctccggaaacccgggtatcttcgtagggtgcgtctaatcccagagctgagttgcgggtgattgaacggaagagctggggcgttggtttgtcttcccgcccctgctgcgaatagaccgtggctgcttagacagatgtgtctaatttagcgaaaccgatttagattccttaatcctcttcattaagtaccgttccgccttctcgtcagaactttgcatagctcgggtcagcactcctagtgctagtcgcagtgggtccgtatcccgaccggcaacgtggtacccgccaaccagaaggggtaacaccgtaccgcctatgggacccacacctttttatctcttgttagtcgcctgtccgtgggactagcgcagaatgcctgcagaatgaatcgtttctgttgtttcctttcaaagaacgagaaggaagaaagggtgcgtgtgtgcagtccttttttcaaaagttttccctaaaagttactgatacaccaggttttgaaaataccggtcctcccaaagtgctgggattacaggcgtgagccacagcgcccggctggctgttgcttcttaacacctttattacttttgtaatcatgggtatgagttgattttctggtcagaaatttcagtagagctaatttcatttaaatgtgtgagatgtggtaaagttttgacaataaatacaaattttgacaaagcaaaaaaaa

SEQ ID NO: 16308 - DNA, 452 bp, Homo sapiens
aatggacttaaatcccttaaacccagacatcttctgggacctgacccccaataattggttaccagtgtgtcaggcaatctggactttgccctcaaaagagcagtggttcctgtttctaggttgtggatcttcagataaattctgtcattttcctttcacttcctgaaagccagggtcggttcatgaaaagctatgaaacagcatgctaaatgtgaaatgtcaaccctcactaaactttgccggttcagagcatcagatgaagacttcattgggttttacagtggctttctgatttttggtagtccattgaagaagggagtttgaaagttgttgtatactgttaacgattgtctgcccatgtcctgcccaaaataccatgattctttatggaaattatctttaataaagctggatacagtttggcttgggaaaaaaaaaagaaatgcacaaag

SEQ ID NO: 16309 - DNA, 393 bp, Homo sapiens
cattccatctcccaatctccttctctgtgtctactgtgagccatggtgaggcttacataatgtaatacttacatgaaatactctattaaaaatataaaccagaaatgaggggccaggcgcagtggctcacgtataatcctggcactttgggaggcgaggcaggccaaacatttgaggccaggagtttgagactagcctgaccaacatggtgaaaccccgtctctacaaaacaaacaaacaaaaattagccaggcatggtggtgcatgcctgtaatcccagctactcaggaggctgaggtacgagaatcacttgaacccaggaggcggaggttgcagtgagccaggattgtgccactgcactccagcctgggcaacagagtgaaaccctgactc

SEQ ID NO: 16310 - DNA, 357 bp, Homo sapiens
aatggtttttttattataatccaaaggactcctagggagacaaaagaagttggagatttttccaaactcctaatcagaagagagtccacaagccaaaactagcccacatgcattttcgggtttggcctggaaatattttgtaacactttaaaggatttgttccaacatttaaaatagaagactttgcatggcaattccaatgtcaggcatccctagaaaaatcagaagagttggcaacctgggactcaccctcctgcactccaacaattggctggggtagagtagcagtagcctgccccttaatttggcctgccacgttctcttatatactatggacctatcagctccacttcactc

SEQ ID NO: 16311 - DNA, 424 bp, Homo sapiens
atgtactcttgaaaaagggagcatgagcatcctttctctaggtagatgtggttggcggcattataaggtgaaggcgtgaagagctggtgccatggtgtggtgataaggcgactacagcgggcatctgggggtctggattccagtcaattctgctggccactagcttgctgtgaggcacagaaaactttacctctctagacaggggtgttggtaaaatggccaacaccaattggtaaaatggccaattgctatctatgaatgtctgtgatactaaggtggaaaatccataaatgtcaacaacaataaagaaggataaattaggcagttacaagaaaaataagtgctaaaataatgatttttttttcacagagcttacatcaaatgattatttagatatagctcagcctcttggaatctggtaaaa

SEQ ID NO: 16312 - DNA, 366 bp, Homo sapiens
atgtactcttgaaaaagggagcatgagcatcctttctctaggtagatgtggttggcggcattataaggtgaaggcgtgaagagctggtgccatggtgtggtgataaggcgactacagcgggcatctgggggtctggattccagtcaattctgctggccactagcttgctgtgaggcacagaaaactttacctctctagacaggggtgttggtaaaatggccaacaccaattggtaaaatggccaattgctatctatgaatgtctgtgatactaaggtggaaaatccataaatgtcaacaacaatatcacagagcttacatcaaatgattatttagatatagctcagcctcttggaatctggtaaaa

SEQ ID NO: 16313 - DNA, 553 bp, Homo sapiens
aaatcccgggagggacctgaagtgccttgtgggcggctccaggactgggccataggaatatctgctccccgcagggcgagaccccagctggtttgcattgtggaagctgcctaggcgttccccaccaggactgggggtgctgccaggaacactggggcccagcaggctgctttttggcagctgaagggggaggcattcattggcctccgttttctgcccacagaccgtcttgagcagcgtgggaaggaggtgagctccctggctcttaggagtattcaagagcaggttatgtgtcgttttcttgggtttctttctttctttttttgagacagagtctcgctctgtcacccaagctgtagtacagtggccccatctcggctcactgcaacctctgtctcccgggttcaagcgattctgacctcaggtaagccactgcacctggcccaggttttgtttttgatgaatacaaaggattgttaagtcagtgatttctccagccacagcagcatttcaaatgagcaggttttacttaaataatacaaatcatatccta

SEQ ID NO: 16314 - DNA, 2523 bp, Homo sapiens
agacaattaacagggtaccggtcttttactgtagtgccccagttgacagaatcatgcatcagaagcttttatgtgaaagtggaatctttgttctggagaaaatcaaagtgtgactgtatttgaaagccagctcgttgaaggattccttcttctaatgagctgcgccagtagtaactgaggtgtggtgattagcgaaaggtcactcctgccgtgccaccttccgtgccgatttccctacctaacacggggccagggaaggcagcgagcgcaataaatcagaacacaggtgcccattaacctgccgtgaggaacggtcagagagccttttccttgtttcattccaaaaaggtggggggagagagcaaggagaacaggtttttggcatattagaaccaagcacggtttgtgttaatcaaggacaccctgaatcagtgcaatgaaacctacatgtacagaatgaagcgttttttctttgtcatcatgaaaactcctttttttctacctttctgtttctttttttaaatatgtatccttggggtttgtttattttttttttcttgtttcacttcaaatgaatctggaaaaactttccagggggcttctccctgggtgtggtgtgtgatcggcagccccgccgttgtggcccgaggctcctggaagctcatcagctgatggtcttccttggcctgtagtaaaaatactgctgaattcctcgttgggctttaaatccattggcactgccacctggttccgttgtaacatagcttttggattattagaaataggaataacttgatagttaaatcattcagcagcatctttacgaatatggtttgggaagctggccttggagctaagaatcacattgaatggttaatttatttttaattctatgaaaggagctggagagagagaagtaaaatattcaggggattttctgtgttttaaaagagaaaacctcctgattgcaagctctaaaataaatgctaagatttgtcacactttcagcccacgggagatttgcttttctcgcatagtatggactcaccaggatctgaaattaggggctttccttagaggtggcctcaggctttcctacccccacagttggattatgcagagaaggtcactgggtcctgaggctgctgccgagcgtgctgtcccgggtggacagcgtgccctgtcatctttcattaggatgtgtgtgcctgtgccgcaccagccacaggtcaggatgccagcccctgcacgccctgcgtgctcatttgaaaactgagggtatctgggaagtcaccttacaaggtgccgaggagcagatggctaatttaaaggcaatctgtatgtgctctgagcctcccaaattatccatttcttgaatcctcaatgtgtgaaattcagcacactaagtcctcacaggctaggaaatcaaatgctggacaggccattccctaccatcatctggagtattcagagtatttggaatattcacagtcttcaaggtgtagctgtcgggctctgtgaaggataccttgcatttatagggatcgtcaggtctcctcttcctacgtatttgaagtattatggcttggagtactttctccaccaatgaagaaaagtttatatggcctctcctacgctcttgtcttgtcccaaaagtagggcttaactctgtccttgccatcaatctgtgcacatgttatggagtgaccatggtgaatgggcgatagaggttccttcctaggagaaactttcccagcttccccaaatgtgagaggggcgcctctctcccgaattccccagagccctttcctcccttccctctgccctcacctccctggatgcttcaggatactctgtggatactcttccgtgctccaggagagcatggccccgtggctgatagactcagctctcacccctctaagagctgctcatgagtatcctcgagtggatgagtgaacagatttctaactcaacagacataaatccccagtggagcttaagttaaatgcctggtttttaaattaagaaatatgacttcagcaatatgtataaaccaaaggaacattaaactaatgatagtatctttacaaatgagttgttgaggatttggagatagtttgtataacataaaacataacaaatacagtagaaagcatatggtagtgggattgaagaaacccgagaggttatttatcccaaacaccacctgatgttacagtgcttattgagtgattgatactgtgtcctacgtagagggggcacataaacaattcacatgtaatttttctgtattacattgacagatatatataaaatgatctctgcatctaaaattcaagcagtccagcctggaatactatcaccaaaaagtgaaaactgattttagaaacgaataatattttgttgtgaacaactctgaaaacatactggtcgatgaggtttatagctagagtctaaaatgccacatttatatgggtgaaacattttcagcttcaggagaaaataaaaccaaaaaaaaaa

SEQ ID NO: 16315 - DNA, 485 bp, Homo sapiens
agacaattaacagggtaccggtcttttactgtagtgccccagttgacagaatcatgcatcagaagcttttatgtgaaagtggaatctttgttctggagaaaatcaaagtgtgactgtatttgaaagccagctcgttgaaggattccttcttctaatgagctgcgccagtagtaactgaggtgtggtgattagcgaaaggtcactcctgccgtgccaccttccgtgccgatttccctacctaacacggggccagggaaggcagcgagcgcaataaatcagaacacaggtgcccattaacctgccgtgaggaacggtcagagagccttttccttgtttcattccaaaaaggtggggggagagagcaaggagaacaggtttttggcatattagaaccaagcacggtttgtgttaatcaaggacaccctgaatcagtgcaatgaaacctacatgtacagtaaaagccggtaccgagctcgattcgtatc

SEQ ID NO: 16316 - DNA, 388 bp, Homo sapiens
gatgcaaggtgttctggcccagtatccctgtgacattctgtatttccttatctaattggctgcttagctttttgtccatcacgtatctttactgtgtatcacctatttatctctctgtaattccatcatcataattcccatccccatcaatgttgcctttccaactagaagtccatgcagagttccacagttcttaaccacacataatgtctcacacaaaataactggtttagtaaatatttctttttagttgttgttttgtggaaattctttaatttttgttcatttgaaaagaaaagaacatcaagcaacccaaaaagtgcaaaggaaaaaaaattcattcaaattttattattcagaaataaacgttacctttgtgactatcact

SEQ ID NO: 16317 - DNA, 590 bp, Homo sapiens
agacagtgaactatagttcataaaaagaaacataatatcatatataatgatagctgaacataatagagttcttcttgttaatatacacagtagttctaatcctcttcttattatacctcctctaagctaagagacagcaggcctgatttctagtcctgaaattcactaaccagagctatcacctctgtagttaaatctcactatagagataatcgcctcctgttttaaaattgtgttccagtgttgatacttagggttggaacttattctagaatcatgtaattcttaataggaaaaaaaaatagagttgtacaaagatcttgtagaaatatttaaaataatgaatttccattttgtttttggatcagctacatttatagagcagggatttcttcagcgatctctatcttaataatggggtggagtgagcagggcatgaatcaaggccaaatattcctctgggattaaatgaggggtgtcttctcttccagtcacaagcatgtgtacttagttataaaaataaaatagaatatacaaattaatgaaaatttttcagcacatctgggaaggattttcagatgatgagttgc

SEQ ID NO: 16318 - DNA, 536 bp, Homo sapiens
agacagtgaactatagttcataaaaagaaacataatatcatatataatgatagctgaacataatagagttcttcttgttaatatacacagtagttctaatcctcttcttattatacctcctctaagctaagagacagcaggcctgatttctagtcctgaaattcactaaccaaaaattgtgttccagtgttgatacttagggttggaacttattctagaatcatgtaattcttaataggaaaaaaaaatagagttgtacaaagatcttgtagaaatatttaaaataatgaatttccattttgtttttggatcagctacatttatagagcagggatttcttcagcgatctctatcttaataatggggtggagtgagcagggcatgaatcaaggccaaatattcctctgggattaaatgaggggtgtcttctcttccagtcacaagcatgtgtacttagttataaaaataaaatagaatatacaaattaatgaaaatttttcagcacatctgggaaggattttcagatgatgagttgc

SEQ ID NO: 16319 - DNA, 278 bp, Homo sapiens
atgcggtcagagaggttcacagaatgaaaggcagtctgatgagtgagtgagatacacccgcctgtagagcacaatagaaaaatcaatagtaaggggaggtgaaagagtttcagctgggttttattgagcacaaagaagacaaactggcttttgctgtgacttcaactgtatgttaatagtgctttttaaaaactacagtacaggatttggggaaaaaaaatcacacggtaaaagttgccagccagtatatgtaagtgcacacacacacagagatgagg

SEQ ID NO: 16320 - DNA, 509 bp, Homo sapiens
ctttagaacactagttcactatcttctcagtttgctggctctctgtttaaaacctgctttccctcccaccaaacttggcctcttgtgtttggctttcgagcagcaaatagccaaacctgggtctggttacataagtaggtctgggatcttgataatggaccatctgcaatgtttgtatcttctcatttgactcagtattcagtaattagagaataattaacagctattttttatcaaaaaaaattctgcacttctttccttaccttgtttatttccctttagtttatgatttataatggtccattgttttgtttagaaaacagcaagtctcgaagtaatgcatttgctgaaaaaaatggacttcagaaatatgaatatgttttacatccaagaactacaggctttacttttgtggtagaccgtctaagagaaggtaagcacccatttcaaaatgtactttttaataaaagtggcaaaaattgctaagctttatatatagccctttagag

SEQ ID NO: 16321 - DNA, 235 bp, Homo sapiens
ggtgtgcacctgtaattccagctactcaggaggttgaggcaggagaattgcctgaacccgggaggtggaggttgcagtgagccgagatcgcaccactgcattccagcctgggcaacagagcaagactctgtctcaaaaaaattaaaataaaatacagttataaattatctcatctatgacggcttttctgaccgttattccccttcactacaattgataacttccttctttgtgc

SEQ ID NO: 16322 - DNA, 420 bp, Homo sapiens
attgggaaataagcatacttaggtccttttatgaatggacataacagcaaaataaccttttacacaaatagttttaaaaagtctactcacagagctaaaatcacacttaatggagaaagaatgaacgctttaccttaactagcctcaggagcgacacaagagtgtctgctctcaccacccccattcaactttgtagtggaggttctagccagcgtagttagaaaatgaaataaaaggtatccagattgtaaaggaagaagtaaaacgatctctatttgcagatgagatgatcctgtagagagaaaatcctaaggaatcacctagataactattccatttaataaatgagttcatcaagactgcaagatccaagatcagtatacaaaaatgaattatatgtgtatatgctagcaaggaaaa

SEQ ID NO: 16323 - DNA, 558 bp, Homo sapiens
ttcaagtgattctcctgcctcagcctcctgagcagctgggactacagatgtgtaccaccatgcccgactaatttttgtatttttagtagagatggggtttcaccatgttggtcaggctggcctggaactcctggccttaagtgatccacctgtctcggcctcccatagtgctgggattataggtgtgtgccaccctgctgggccgagaatgtgcttttgactgagggtggaaagtcagcagctgcagcccaagaagttagagccaggggcagtgcctttgatgggaagcttgggggtctaaagaaatcagaaaggggagaaaataatcctgcgtgtgctcagccctcactcagatcaacagcccctcgggtcccagctagatgtactttgtagaaggctttttttctccccctcaccctcaaaactccaggattaatgtgctattcccttttttctactgttctctgtctccccccaacccatcagcagtctgagaaatgctatggtggaaaaaaaaaaacaacagccctataaccagtacaaacaaaaagccaagac

SEQ ID NO: 16324 - DNA, 454 bp, Homo sapiens
tgatctgttattgcagtgttcactctcactgtaggcgaggtacatcctaaaagggtaggttcatgggacttgggaactcaggctgtgtttgcaattctgattcccacaagtctttggggctacaatttaactaatgtatcacattacctgccacctgcagagcttatctaacaagctaattactttgatgagaataccgctgtaatatcctccaaaatggcaaaaacaagtagtgccaaagagatctcaaaacatctagtacatctggaaagaaaaataatagaagcattccattcattaacaaaatgacagacatataaacacctgatttgcaaattaactttatggacaaaaaagtgctcccatctccagtactgactcccttgcaacagatgacatgagttgctggtatccacactagtgcaattagaaaaggcatggtttgacatgagga

SEQ ID NO: 16325 - DNA, 312 bp, Homo sapiens
aggcaggagaattgcttgaacccaggaggtggaggttacagtgagccgagatcatgccattgcactccagcctgggcgacagagcaagactctgtcttcaaaacaaaacagaaggggcagggtgtggccacaagcccagattcctggtcaagtcaggccccagaagtgtagcatttcagggtgtatgggaaaggtgacagagcccaccaccagcccttaactgctgggctgaccctaccccatggccagtgtatggttgatgaacagagctcccacttatcccattggtcagtgaacaacctatacaacagg

SEQ ID NO: 16326 - DNA, 780 bp, Homo sapiens
ttctttcaactaagtctcagagaaaagtagttatttaccatataacctacctgctttcatacctggatgaggagggctttctcacatccaggatttatccttactcttagaaaatataacttatacaacttatcattttaaagggatatgttaatagaaaggtttaatcttcgtcgagactggcacacttttaatagaaatgacaagacagcaaatagtttaggctatgtgggccatacaatctttgttgcaactgcccagttctgccattgtagcatgaaaacagccacagacaatgtgtaattgaatggatatgtatatgctccaataaaactttatctacaaaaacagatggtgggccaaatttgacctgcaggtcaggcttaccaacccctaatctaaatcattgcacacaattcctgaaaaatgaaatatacagtgggttctatcaatgtagaaagacttttaccttattagtaccattgttccataggcaaagattcgtgccaaccgtttgtttttaaattgttctaatttttatctcttagcaaaatctggtattgaataaactcgtgctatacccagttttttttaatcataagtacttttgcttaaacatgccacatcttaatgctaaaactaggcatttaatcatgctctgtgctgactctttttaataggaagcttcattatttaaaatacctgctatgcatcaagcatatactggagatacagattcagaaatccttagctcataagtagaaatgaaaagtaagaagg

SEQ ID NO: 16327 - DNA, 306 bp, Homo sapiens
ccaggagttgggggtgaagaggttgaatacatagagcagagactatttttagagcagggaaaatactctgcatggtaccttaatggtggcacatatcattataaatttttccaacttatgtaatgtacagcagtgagggtaaaccctaatgtaaactatggagtttggtgattatgatatgtcaatgtaggttcatcatttgtaacaactgtcccatgctggtaggggatattgataatgaaaggctctgcatgtgagggggcagaggacttatgggaaatccctgttacatcctttcagttttgc

SEQ ID NO: 16328 - DNA, 523 bp, Homo sapiens
agataatcccagacatcgtatcatttccttcataaacatttcactaagtaacctttataaaaacataaccatgtagcatacctaaaaaaatccagtaattccttaatatcagcaaatatttagtcaatatccaaacttccctgattatcttataattttttaattgatacataatgttttatatatttatgaggtacatgtgatattttgttacatgcatggactgtgtgattctcaagttggtatttggggtattcatcaccttgagtattatttttgtgtgttggaaacattttaggtcctttcttctagtgactatgaaaaatatatcacacattattgctaactatactcaccctactctgctattgaatattagaatgtaatccttctatctaattgtatgtttatacccatcggccaaagtctcttcatcctccctcctactcacacacttttctcagcctctggtatctaacattcttctctctacctccatgagaacttttttaggtctcacatg

SEQ ID NO: 16329 - DNA, 310 bp, Homo sapiens
gagactcttgtctcaaaaaaaaaaaaaaaagaaagaaagaaaagaagaaaatatagctgtgtgggcaatagtcagatgaactattcccctaactttgccccaattcggtgtatgactatgtacaaatcttaactctttcagatctcaaagaaaagctctgtgtcttagtttcctcctctgtagaatgagaacagtaacagtatccttctcttatcgtgaggatctaatgcaaccacgagagtaaaatacacagaaaggagcctggtactgcatgggctaagtgcctaatgaacatcagcttactactatc

SEQ ID NO: 16330 - DNA, 188 bp, Homo sapiens
aaatactgagaaatgtgatttttacagccaaaagtaacagcagtgaagtcaagagtagttaagttgtactgtgatcatatttaggaagcagctacacacaaaatcaaccaaagatctccatgcacatgttatacaactgtatgctgtgtgtgttgtaggaaacacccagaatctcaacctaaaggaaa

SEQ ID NO: 16331 - DNA, 644 bp, Homo sapiens
ccttaggagacagagtcttgctctgtggcccagggtctctctagatctctatttcctgttctgttaaaatgaagataataaatggacaggtccacattcctctatcctcatttccaaaacctaaaaagtgctgaaaatgttaagtgtgttttttatgtttgaaacaaactaatatggtagtaaaacctgaaccgatgaagcatcttataatcttcatttaactgttaatgtgattatttgcattctgctgcagaaacactagtggttttaactctgggatgctattagagtcttaaataatgtataatgttcagcatactacactaactttttagtatttaaaaaatactgaattctgaaacacacatggcccttaagggttttggatataggattctggatctattagagggcagtggcacaatcatagcttaccgtaatctagaactcctggactcagtcttagcctctcaaatatttgggactacaggtgtgagccacaatgcctggctaatttttttttttattttttgtagagacagggtcttgctgtgttgcccaggaggtcaaggctggagtgagccgtgattgtgccactgcactttaccctgggtgacagtgtgagaccctgtttccggaaaaaa

SEQ ID NO: 16332 - DNA, 466 bp, Homo sapiens
tgctattgagaaacaaatttaaataatcttcagggcaactaaggtgaaaaacaatacacatttgattgtattgtccttatgttgaaagaaaggaggtataacaatttattgggaaaaatacagttctttccaggcactgacttttcaaggtaatttatcactcagatatttatttaaagaacattaagggtgggtatggtggctcacacctgtaatcccagcactgtgggaggccatggtaggaggcttgcttaaacccaggagttcgagaccagcctgggcatcacagcaaggctcccactacaaaaaattaaacattatttgggggtgcttgcatgtgcctgtagtcccagctatgtgggggctggggcaggaggatgacttgagcccaggagttcgagtttgcaatgagctatgatagtgccactgcactccagcctgagtgacagagccaaatcctgtctgt

SEQ ID NO: 16333 - DNA, 439 bp, Homo sapiens
ctgatcctcgtgccaggcttctggttcactggggccaggggcccctcatggttgcctgggtgccagcaggggctgggcagagagatccacaggcccaggctgatctcttccctgctcagaggtctttccagtccagatcgtccaagctgcgtccagtggctcctggaggagtcagtgggtactgtggcctggcgcctggtagctggccgtttggtgccaagtgaccttgtccttgctgtgggcgtggctgccccagcagcctttccaacacggttgggagccgagcctgtggcaaagaggcccatgccccttggttgcctgagggtccgtgctctaccgctctgcccaaatgggtgcagtcagatgaaggagacagaaggccagggccgatgtcaggtggaccagtcctttcttaggtcagcaattaccatgaaatggg

SEQ ID NO: 16334 - DNA, 653 bp, Homo sapiens
ctcggaggccggcgtcggctgttgcagcctgctgcgcgcccaggggtcccgcgggttttcgggcgcagggtggcgcccgcggcaggcggcggccatgaacttctccgaggtattcaagctctccagcttactctgcaagttctccccggacggcaagtacctggcttcctgtgtccagtaccggttagtggtccgggatgtgaacacccttcagatccttcagctgtacacgtgcctagaccagatccagcacatcgagtggtcggcagactcgctcttcatcctgtgcgccatgtacaagcgagggctggtgcaggtgtgtgctgccgtgtcgcttagaatctggacaccttctgagggcccctgggaaggaggggttttgttctgtgcctttctagtttgaaaaaaaaagtcccgtgcagctcaaagccagttttcttttgaaattataacgttctctaaagtttaagaacatttaaactaaggaaactccaacgtagtcttaatttctaagcaatatagttgagaaacggaggtgttgacagcaatctagccacgcggatgtggtgtgtttcaggaagtcctaagaagtcgtgttttcttctgtgtccaaagcttaactaaatgaggtcttaggaatgacaatgtgaata

SEQ ID NO: 16335 - DNA, 2033 bp, Homo sapiens
ctcggaggccggcgtcggctgttgcagcctgctgcgcgcccaggggtcccgcgggttttcgggcgcagggtggcgcccgcggcaggcggcggccatgaacttctccgaggtattcaagctctccagcttactctgcaagttctccccggacggcaagtacctggcttcctgtgtccagtaccggttagtggtccgggatgtgaacacccttcagatccttcagctgtacacgtgcctagaccagatccagcacatcgagtggtcggcagactcgctcttcatcctgtgcgccatgtacaagcgagggctggtgcaggtctggtctttagagcagcccgaatggcactgcaaaatagacgagggctcagccgggctggtggcctcgtgctggagcccggacgggcgccacattctcaacaccacggaattccatctgcggataaccgtctggtccttgtgcacaaaatccgtgtcttacatcaaatacccgaaagcttgtctgcagggaatcaccttcaccagggacggccgctacatggcgctggcagaacggcgcgactgcaaagattacgtgagcatcttcgtctgcagtgattggcagctcctgcggcattttgatacggacacccaggatctcacagggattgagtgggccccaaacggctgtgtgctggcagtgtgggacacctgcttggagtacaagattctgctgtactcattggatggccggttgttgtccacgtacagcgcttacgagtggtccctgggcatcaagtctgtggcctggagccccagcagtcagttcctggcagttgggagctatgatggaaaggtgcgcatccttaatcacgtgacttggaaaatgatcacggagtttgggcatcctgcagccattaatgatcccaagatagtggtgtataaggaggccgagaagagcccacagctgggactgggctgcctctccttcccgccgccccgggccggggccggccctctcccgagctcagagagtaaatatgagatcgcctctgtcccagtctccttacagacactgaaacctgttaccgacagagcaaacccgaaaatcggcataggaatgctggcatttagtcctgacagctacttcctggcgacaaggaacgacaacattcccaatgccgtctgggtctgggacattcagaagctgaggctgttcgcggtgctcgagcagctgtccccagtgcgcgcgtttcagtgggacccgcagcagccgcggctggccatctgcacgggaggcagcaggctctacctgtggtccccagcgggctgcatgtcggtgcaggtgcctggggaaggtaagcacatccccgaggccacggacgtggcagccttgctgtgtgcagtctggcatcacacgggctgaactgttgaagcccagctgctgtctccggcagcactccagggaaactgccctcagagtctttgcgtaaacctcaagacggacacacaggggacccgctgccctcagctttatgggctagaagcagcctctccctgacttgaggcagctctggggctccaccctggctctgcctatgtgggtcactccaggcactgtgctggcctgcaggacaagggggtgcccatcccccagaatctgggcctcccctgctgtaatcctctggccacctgtctctctctaggcgactttgcagtgctctctctgtgctggcatttaagcggagactcgatggccctcctcagcaaggatcacttctgcctctgcttcctggagacagaggcagtggtcggcacagcctgcagacagctgggcggccacacgtagcagcggtgcactaacgtgtgcagaaacagggctactctgtgtttccagtgtgggaaaaaacacagcttcaccaggaggttctccactgtggtggtctggattcagtgattgattctatttttctatagcaaagcatttttgtaaatatgtatggtataaaactgtagttttattatttaaaataaatacttgctgatttatacaacta

SEQ ID NO: 16336 - DNA, 477 bp, Homo sapiens
gggtgacaatggcgtgttcttcctgttggtgttctagatgagatcgcctctgtcccagtctccttacagacactgaaacctgttaccgacagagcaaacccgaaaatcggcataggaatgctggcatttagtcctgacagctacttcctggcgacaaggaacggtcagttgtgctgacgcaggtgctgtctcaccctttactgtgtcctgtggccccaggtgtagaagcgactggaaaagaaaatgaagttgggggtttccgacacgtcacctcctttcacgtttctgcagtagccgaggtgctcacagaagctccttggaggcgctgggcctttgtcctgcagcagccgcaggtccgcgcatgagtcaggaggcctccaccctgctcacttgctccactctgctgagtagaaagcagggctgggcacactgcagcccgccttttgttaagggtttctccatttgtaaagggctaaa

SEQ ID NO: 16337 - DNA, 3276 bp, Homo sapiens
ctcggaggccggcgtcggctgttgcagcctgctgcgcgcccaggggtcccgcgggttttcgggcgcagggtggcgcccgcggcaggcggcggccatgaacttctccgaggtattcaagctctccagcttactctgcaagttctccccggacggcaagtacctggcttcctgtgtccagtaccggttagtggtccgggatgtgaacacccttcagatccttcagctgtacacgtgcctagaccagatccagcacatcgagtggtcggcagactcgctcttcatcctgtgcgccatgtacaagcgagggctggtgcaggtctggtctttagagcagcccgaatggcactgcaaaatagacgagggctcagccgggctggtggcctcgtgctggagcccggacgggcgccacattctcaacaccacggaattccatctgcggataaccgtctggtccttgtgcacaaaatccgtgtcttacatcaaatacccgaaagcttgtctgcagggaatcaccttcaccagggacggccgctacatggcgctggcagaacggcgcgactgcaaagattacgtgagcatcttcgtctgcagtgattggcagctcctgcggcattttgatacggacacccaggatctcacagggattgagtgggccccaaacggctgtgtgctggcagtgtgggacacctgcttggagtacaagattctgctgtactcattggatggccggttgttgtccacgtacagcgcttacgagtggtccctgggcatcaagtctgtggcctggagccccagcagtcagttcctggcagttgggagctatgatggaaaggtgcgcatccttaatcacgtgacttggaaaatgatcacggagtttgggcatcctgcagccattaatgatcccaagatagtggtgtataaggaggccgagaagagcccacagctgggactgggctgcctctccttcccgccgccccgggccggggccggccctctcccgagctcagagagtaaatatgagatcgcctctgtcccagtctccttacagacactgaaacctgttaccgacagagcaaacccgaaaatcggcataggaatgctggcatttagtcctgacagctacttcctggcgacaaggaacgacaacattcccaatgccgtctgggtctgggacattcagaagctgaggctgttcgcggtgctcgagcagctgtccccagtgcgcgcgtttcagtgggacccgcagcagccgcggctggccatctgcacgggaggcagcaggctctacctgtggtccccagcgggctgcatgtcggtgcaggtgcctggggaaggcgactttgcagtgctctctctgtgctggcatttaagcggagactcgatggccctcctcagcaaggatcacttctgcctctgcttcctggagacagaggcagtggtcggcacagcctgcagacagctgggcggccacacgtagcagcggtgcactaacgtgtgcagaaacagggctactctgtgtttccagtgtgggaaaaaacacagcttcaccaggaggttctccactgtggtggtctggattcagtgattgattctatttttctatagcaaagcatttttgtaaatatgtatggtataaaactgtagttttattatttaaaataaatacttgctgatttatacaactaaaaaaaaaaaaaaaaaaaaaaaaatttggggggggccggggcccgggaaaagcgttttttagaccacttccgtgttggaggcgcgcgcgggcgcccccatgatggtatacggtgcagacacttgtggtgcactagagcgtggttctccccaagaggagactcccgtggccaacgagcactagaggtcgcttgggatgttcccccacaatatttaaaaacacgccccgggggggaacccgaggaggcgtgctttgggaaaacaaaatcccccgagaggtggaagctccgagagagggccactaaacgagcgggggatctctcaccaacagccggcggagttcccaagagggagacgccgatatattaacaattggcccccgcagcgctgggaggtacacaggagacacggacagacgatgagcagaacgagaagtagaaatagacgaaccagaagacgaagcaagagcacgaagacaacaacacacaagcgcaagaacaggacgacaagagaaggcaaggaagaagaagggacaggagagagagacggggaggaggggagggaggggggcgcgggaggagagggagagaggaaagcaagggggcgacagaggagagaagagaacgaacgaggggagagggggggagcgaggacggcgaggggacggacgggagggaggacgagagagcaatagacgactgcacgagaaggaaagagaggagcgcgcgcgaaggacaaggacagaggggaggagaaggagaacggaaggagagacaggaagcacgggggagcgaagacggatgcgagacaacaggaccaggaggcgggaggacgcgagcccggcaccagagaccagaacggggacgagagaggaggaaggggaaggggggagcgacgagggagggcagaagagaagagaggaggagcgaagggagagcggagaggaaagaggagaaggaggggggagcggagggggggggggggagcagcggggaggagagggaggaggaagaggggcagcgagccgggagaggggagaaggagaggcagagggcgaggaggggggaggacgaggaggagagagacaagagaggcagaacgagcggggagagagagcaggaggagagaggaggagaggaaagaagagaagaagcgggggagggagaggaggagaacgaaggaggggagaaggaggagaagaggaacaggagcaaaggcgagcgagcgaggagagaatcaagccgagagcgcgagaggtgtagggaggaagcgaagagggcgagaagagacagagcggagcaggggacaagggaggataggaagagaacggaaaggagagggcgaggaggagaagagccagaagggacaggaagagacagggagtaaagagacgcaggaaagacgaaagcgagggagaaacgaggaacacgagaagaaagaggagagagcaggaagaaagggagacaacgggacggaggacagaaggcagaggaacacacaggggaaacgcaacagcaggaagaggagagaacagaagaacacacagaagcaagaaagcgaaggggagatagcagcgaagaaaacagcggccag

SEQ ID NO: 16338 - DNA, 1339 bp, Homo sapiens
ctcggaggccggcgtcggctgttgcagcctgctgcgcgcccaggggtcccgcgggttttcgggcgcagggtggcgcccgcggcaggcggcggccatgaacttctccgaggtattcaagctctccagcttactctgcaagttctccccggacggcaagtacctggcttcctgtgtccagtaccggttagtggtccgggatgtgaacacccttcagatccttcagctgtacacgtgcctagaccagatccagcacatcgagtggtcggcagactcgctcttcatcctgtgcgccatgtacaagcgagggctggtgcaggtctggtctttagagcagcccgaatggcactgcaaaatagacgagggctcagccgggctggtggcctcgtgctggagcccggacgggcgccacattctcaacaccacggaattccatctgcggataaccgtctggtccttgtgcacaaaatccgtgtcttacatcaaatacccgaaagcttgtctgcagggaatcaccttcaccagggacggccgctacatggcgctggcagaacggcgcgactgcaaagattacgtgagcatcttcgtctgcagtgattggcagctcctgcggcattttgatacggacacccaggatctcacagggattgagtgggccccaaacggctgtgtgctggcagtgtgggacacctgcttggagtacaagattctgctgtactcattggatggccggttgttgtccacgtacagcgcttacgagtggtccctgggcatcaagtctgtggcctggagccccagcagtcagttcctggcagttgggagctatgatggaaaggtgcgcatccttaatcacgtgacttggaaaatgatcacggagtttgggcatcctgcagccattaatgatcccaagatagtggtgtataaggaggccgagaagagcccacagctgggactgggctgcctctccttcccgccgccccgggccggggccggccctctcccgagctcagagagtaaatgtaagtagcacatgtgatgtcatttgttttccttttttaatgcaagattcctcgttgtccagataaacttcggatgttccttatgtttaaaaaaaaaaactttttttcccttccatgcttccagccagtgtgcccctcagcctgttggctggaggttgactagggtctgaattgcgcagtgggccgtgaaggtgcggcttctgttactgaatatgagccctggagacccggatctgacagcgggagctccgaggggatgtttttccggagctccgagaatgatgtttttcaaagaaacacttttccgtgggtggcgctcagag

SEQ ID NO: 16339 - DNA, 1022 bp, Homo sapiens
ctcggaggccggcgtcggctgttgcagcctgctgcgcgcccaggggtcccgcgggttttcgggcgcagggtggcgcccgcggcaggcggcggccatgaacttctccgaggtattcaagctctccagcttactctgcaagttctccccggacggcaagtacctggcttcctgtgtccagtaccggttagtggtccgggatgtgaacacccttcagatccttcagctgtacacgtgcctagaccagatccagcacatcgagtggtcggcagactcgctcttcatcctgtgcgccatgtacaagcgagggctggtgcaggtctggtctttagagcagcccgaatggcactgcaaaatagacgagggctcagccgggctggtggcctcgtgctggagcccggacgggcgccacattctcaacaccacggaattccatctgcggataaccgtctggtccttgtgcacaaaatccgtgtcttacatcaaatacccgaaagcttgtctgcagggaatcaccttcaccagggacggccgctacatggcgctggcagaacggcgcgactgcaaagattacgtgagcatcttcgtctgcagtgattggcagctcctgcggcattttgatacggacacccaggatctcacagggattgagtgggccccaaacggctgtgtgctggcagtgtgggacacctgcttggagtacaagattctgctgtactcattggatggccggttgttgtccacgtacagcgcttacgagtggtccctgggcatcaagtctgtggcctggagccccagcagtcagttcctggcagttgggagctatgatggaaaggtgcgcatccttaatcacgtgacttggaaaatgatcacggagtttgggcatcctgcagccattaatgatcccaagatagtaagtctggaacacgtgtttctgcctgagcaggctgttggggagggcggtgggaaactgctccttcactttgctttcttgattgtggtttattatttaaccgggcacttcc

SEQ ID NO: 16340 - DNA, 1685 bp, Homo sapiens
ctcggaggccggcgtcggctgttgcagcctgctgcgcgcccaggggtcccgcgggttttcgggcgcagggtggcgcccgcggcaggcggcggccatgaacttctccgaggtattcaagctctccagcttactctgcaagttctccccggacggcaagtacctggcttcctgtgtccagtaccggttagtggtccgggatgtgaacacccttcagatccttcagctgtacacgtgcctagaccagatccagcacatcgagtggtcggcagactcgctcttcatcctgtgcgccatgtacaagcgagggctggtgcaggtctggtctttagagcagcccgaatggcactgcaaaatagacgagggctcagccgggctggtggcctcgtgctggagcccggacgggcgccacattctcaacaccacggaattccatctgcggataaccgtctggtccttgtgcacaaaatccgtgtcttacatcaaatacccgaaagcttgtctgcagggaatcaccttcaccagggacggccgctacatggcgctggcagaacggcgcgactgcaaagattacgtgagcatcttcgtctgcagtgattggcagctcctgcggcattttgatacggacacccaggatctcacagggattgagtgggccccaaacggctgtgtgctggcagtgtgggacacctgcttggagtacaagattctgctgtactcattggatggccggttgttgtccacgtacagcgcttacgagtggtccctgggcatcaagtctgtggcctggagccccagcagtcagttcctggcagttgggagctatgatggaaaggtgcgcatccttaatcacgtgacttggaaaatgatcacggagtttgggcatcctgcagccattaatgatcccaagatagtggtgtataaggaggccgagaagagcccacagctgggactgggctgcctctccttcccgccgccccgggccggggccggccctctcccgagctcagagagtaaatatgagatcgcctctgtcccagtctccttacagacactgaaacctgttaccgacagagcaaacccgaaaatcggcataggaatgctggcatttagtcctgacagctacttcctggcgacaaggaacgacaacattcccaatgccgtctgggtctgggacattcagaagctgaggctgttcgcggtgctcgagcagctgtccccagtgcgcgcgtttcagtgggacccgcagcagccgcggctggccatctgcacgggaggcagcaggctctacctgtggtccccagcgggctgcatgtcggtgcaggtgcctggggaaggcgactttgcagtgctctctctgtgctggcatttaagcggagactcgatggccctcctcagcaaggatcacttctgcctctgcttcctggagacagaggcagtggtcggcacagcctgcagacagctgggcggccacacgtagcagcggtgcactaacgtgtgcagaaacagggctactctgtgtttccagtgtgggaaaaaacacagcttcaccaggaggttctccactgtggtggtctggattcagtgattgattctatttttctatagcaaagcatttttgtaaatatgtatggtataaaactgtagttttattatttaaaataaatacttgctgatttatacaacta

SEQ ID NO: 16341 - DNA, 802 bp, Homo sapiens
tctcagtactagctggcagttccagcttttccacggccacgcggacagtcctgccagctttgtgctatctgcaccaatgtcactctgcagcacccgcgtctgtggtgtgttcctggcgacgggggtgtattcattattaactgaaatgtctcatctgcagtacaagattctgctgtactcattggatggccggttgttgtccacgtacagcgcttacgagtggtccctgggcatcaagtctgtggcctggagccccagcagtcagttcctggcagttgggagctatgatggaaaggtgcgcatccttaatcacgtgacttggaaaatgatcacggagtttgggcatcctgcagccattaatgatcccaagatagtggtgtataaggaggccgagaagagcccacagctgggactgggctgcctctccttcccgccgccccgggccggggccggccctctcccgagctcagagagtaaatgtaagtagcacatgtgatgtcatttgttttccttttttaatgcaagattcctcgttgtccagataaacttcggatgttccttatgtttaaaaaaaaaaactttttttcccttccatgcttccagccagtgtgcccctcagcctgttggctggaggttgactagggtctgaattgcgcagtgggccgtgaaggtgcggcttctgttactgaatatgagccctggagacccggatctgacagcgggagctccgaggggatgtttttccggagctccgagaatgatgtttttcaaagaaacacttttccgtgggtggcgctcagag

SEQ ID NO: 16342 - DNA, 1456 bp, Homo sapiens
ctcggaggccggcgtcggctgttgcagcctgctgcgcgcccaggggtcccgcgggttttcgggcgcagggtggcgcccgcggcaggcggcggccatgaacttctccgaggtattcaagctctccagcttactctgcaagttctccccggacggcaagtacctggcttcctgtgtccagtaccggttagtggtccgggatgtgaacacccttcagatccttcagctgtacacgtgcctagaccagatccagcacatcgagtggtcggcagactcgctcttcatcctgtgcgccatgtacaagcgagggctggtgcaggtctggtctttagagcagcccgaatggcactgcaaaatagacgagggctcagccgggctggtggcctcgtgctggagcccggacgggcgccacattctcaacaccacggaattccatctgcggataaccgtctggtccttgtgcacaaaatccgtgtcttacatcaaatacccgaaagcttgtctgcagggaatcaccttcaccagggacggccgctacatggcgctggcagaacggcgcgactgcaaagattacgtgagcatcttcgtctgcagtgattggcagctcctgcggcattttgatacggacacccaggatctcacagggattgagtgggccccaaacggctgtgtgctggcagtgtgggacacctgcttggagtacaagattctgctgtactcattggatggccggttgttgtccacgtacagcgcttacgagtggtccctgggcatcaagtctgtggcctggagccccagcagtcagttcctggcagttgggagctatgatggaaaggtgcgcatccttaatcacgtgacttggaaaatgatcacggagtttgggcatcctgcagccattaatgatcccaagatagtggtgtataaggaggccgagaagagcccacagctgggactgggctgcctctccttcccgccgccccgggccggggccggccctctcccgagctcagagagtaaatatgagatcgcctctgtcccagtctccttacagacactgaaacctgttaccgacagagcaaacccgaaaatcggcataggaatgctggcatttagtcctgacagctacttcctggcgacaaggaacggtcagttgtgctgacgcaggtgctgtctcaccctttactgtgtcctgtggccccaggtgtagaagcgactggaaaagaaaatgaagttgggggtttccgacacgtcacctcctttcacgtttctgcagtagccgaggtgctcacagaagctccttggaggcgctgggcctttgtcctgcagcagccgcaggtccgcgcatgagtcaggaggcctccaccctgctcacttgctccactctgctgagtagaaagcagggctgggcacactgcagcccgccttttgttaagggtttctccatttgtaaagggctaaa

SEQ ID NO: 16343 - DNA, 1550 bp, Homo sapiens
ctcggaggccggcgtcggctgttgcagcctgctgcgcgcccaggggtcccgcgggttttcgggcgcagggtggcgcccgcggcaggcggcggccatgaacttctccgaggtattcaagctctccagcttactctgcaagttctccccggacggcaagtacctggcttcctgtgtccagtaccggttagtggtccgggatgtgaacacccttcagatccttcagctgtacacgtgcctagaccagatccagcacatcgagtggtcggcagactcgctcttcatcctgtgcgccatgtacaagcgagggctggtgcaggtctggtctttagagcagcccgaatggcactgcaaaatagacgagggctcagccgggctggtggcctcgtgctggagcccggacgggcgccacattctcaacaccacggaattccatctgcggataaccgtctggtccttgtgcacaaaatccgtgtcttacatcaaatacccgaaagcttgtctgcagggaatcaccttcaccagggacggccgctacatggcgctggcagaacggcgcgactgcaaagattacgtgagcatcttcgtctgcagtgattggcagctcctgcggcattttgatacggacacccaggatctcacagggattgagtgggccccaaacggctgtgtgctggcagtgtgggacacctgcttggaggtgcgcatccttaatcacgtgacttggaaaatgatcacggagtttgggcatcctgcagccattaatgatcccaagatagtggtgtataaggaggccgagaagagcccacagctgggactgggctgcctctccttcccgccgccccgggccggggccggccctctcccgagctcagagagtaaatatgagatcgcctctgtcccagtctccttacagacactgaaacctgttaccgacagagcaaacccgaaaatcggcataggaatgctggcatttagtcctgacagctacttcctggcgacaaggaacgacaacattcccaatgccgtctgggtctgggacattcagaagctgaggctgttcgcggtgctcgagcagctgtccccagtgcgcgcgtttcagtgggacccgcagcagccgcggctggccatctgcacgggaggcagcaggctctacctgtggtccccagcgggctgcatgtcggtgcaggtgcctggggaaggcgactttgcagtgctctctctgtgctggcatttaagcggagactcgatggccctcctcagcaaggatcacttctgcctctgcttcctggagacagaggcagtggtcggcacagcctgcagacagctgggcggccacacgtagcagcggtgcactaacgtgtgcagaaacagggctactctgtgtttccagtgtgggaaaaaacacagcttcaccaggaggttctccactgtggtggtctggattcagtgattgattctatttttctatagcaaagcatttttgtaaatatgtatggtataaaactgtagttttattatttaaaataaatacttgctgatttatacaacta

SEQ ID NO: 16344 - DNA, 585 bp, Homo sapiens
ctcggaggccggcgtcggctgttgcagcctgctgcgcgcccaggggtcccgcgggttttcgggcgcagggtggcgcccgcggcaggcggcggccatgaacttctccgaggtattcaagctctccagcttactctgcaagttctccccggacggcaagtacctggcttcctgtgtccagtaccggttagtggtccgggatgtgaacacccttcagatccttcagctgtacacgtgcctagaccagatccagcacatcgagtggtcggcagactcgctcttcatcctgtgcgccatgtacaagcgagggctggtgcaggtctggtctttagagcagcccgaatggcactgcaaaatagacgagggctcagccgggctggtggcctcgtgctggagcccggacgggcgccacattctcaacaccacggaattccatctgcggataaccgtctggtccttgtgcacaaaatccgtgtcttacatcaaatacccgaaagcttgtctgcagggaatcaccttcaccagggacgggcgccacattctcaacaccacggaattccatctgcggataaccgtctggtcctcgtg

SEQ ID NO: 16345 - DNA, 436 bp, Homo sapiens
tcctgtatagaggtctgctgtgcatttaatatttccagtgaggcaaagaaagctagaacaggaagagaatactttcaactaagtcatgtctctcaggatcccatatacttcaattgcttagtggagacaagccagagcatttggttgctcatgagcaattctaatcactccaagcaccctgtggtaatctggacacatacttggagcttttccagagagctgttctcaatcaggcaattgtctcgataatagaacaattgcatactcagccctatttaaagcattcaccctgctatgaccactaaaccttttgttaaaatatacaggattctcctttattctctgtgttaacacatacaaggagaaatgatagcccatagtgaggaaatggcaggtgtgctttcttgctttcccagtgtagttaatattttaagaa

SEQ ID NO: 16346 - DNA, 1668 bp, Homo sapiens
cctgaagagtcaggtcatctagggatcatagcagtgacaatgaagtctcaatataaaggaaagacttgattgttctctgagttgtgagtcttctcctttgtcctgacagagtttggatgtttcactctctctcttgcttcctgtctccttatatttgtcatgtttcagaaattcccagaataattttcacccatgattagaaataggttggatcattctttctgtacccattctgaaggccaggataataggttgaagttctttatattttggaaaatggattttgtggtaaggtaggaactaacgggtgtgtgcatataaaggttaatgctgttgtatttggatgctgatctgtgctgttttcatgacctctctcccacactatttgaatcagtctgttcagaactgtgtgtttcacctgcagtgctctgtcccagtcccatgcccattcccatcacttcactgtgatggaaatagagtttatgttcaacagtggggcatgacctctgcaatttgcttgggaaagtcttccaagcaagatggacatgatgaatacaaataagatctactcaaagtacttcaaacaaaaaataaataattcattggctcatgtatcttggccacccagggaaggtctgacattgttagttagatccagagtttcaaatgtcatcaccatggatgtgtctttttctctctctcatttcccctccccatatcttgtcttttatttattataggtttgtctcattccctggcaggctctctccctgtgataggaaagagagtccccagcagccccagggtgacatagttgttatagttcattatggaatagaagagagaagagcattctcaataacccggcaaagttcccagggatgactctgatatgtctatgtctcaggtcacatttccatctatgaaccaatcatattcagaggtggaatgctaattggccaggcctgggtcatatatacaagtctagggaagaaatgagcttcatccctgtccaattgacatggactgattaggggtattaatggaagaggtgtgccaccacaaaagaatgtaccctgggcagatcaaagaacatattctgtatgtcaggcttggcacaaaagaatgacacaagtaatatgctgtagatcagaacctctctgctaatattgcctttttagcatggttaagatagctaagatctagtactgtcactccagtatgtcccaattctacctacgtttattgaagggtcaacagttctgatctcagcattgggtaaagggtgggacattcagatttacggtccttgataaaaacaatttacaacgttccgttgtgtaataaatgtaagtgtacatatgcctgggacatcagctggaaaagggacagactatcagagagttgcactgttgcggtatgggccaaatccaacataatacccgctgtacctctagagaactaaaaccttaatttctcagatcttttctgcactaatggtctttacatacagcctacattttaactaactcttgcatgggcttgtttcacagcaggaaactatattcatcatatccttattatgatagagaatgacaacattcaaaagggtgtggtgcttctgaaaatatacacaataaatggcatgatttgacctctgtcaaattc

SEQ ID NO: 16347 - DNA, 210 bp, Homo sapiens
gttttacagataaggaaacagactcagattaaatagcttccaaaaaagtcacacagagactgacctgtgactggaattttgggctgtttggttacacagcctgtacattggctgatctactgtgttccctctctaagttcaatttattcatttcttcaggtaatacaaacttgggaaacattcttactctccctcaccttctgtttgttc

SEQ ID NO: 16348 - DNA, 1171 bp, Homo sapiens
aggagcgtttttggagaaagctgcactctgttgagctccaggcgcagtggagggagggagtgaaggagctctctgtacccaaggaaagtgcagctgagactcagacaagattacaatgaaccaactcagcttcctgctgtttctcatagcgaccaccagaggatggagtacagatgaggctaatacttacttcaaggaatggacctgttcttcgtctccatctctgcccagaagctgcaaggaaatcaaagacgaatgtcctagtgcatttgatggcctgtattttctccgcactgagaatggtgttatctaccagaccttctgtgacatgacctctgggggtggcggctggaccctggtggccagcgtgcacgagaatgacatgcgtgggaagtgcacggtgggtgatcgctggtccagtcagcagggcaacaaagcagactacccagagggggatggcaactgggccaactacaacacctttggatctgcagaggcggccacgagcgatgactacaagaaccctggctactacgacatccaggccaaggacctgggcatctggcatgtgcccaacaagtcccccatgcagcattggagaaacagcgccctgctgaggtaccgcaccaacactggcttcctccagagactgggacataatctgtttggcatctaccagaaatacccagtgaaatacagatcagggaaatgttggaatgacaatggcccagccatacctgtggtctatgactttggtgatgctaagaagactgcatcttattactcaccgtatggtcaacgggaatttgttgcaggattcgttcagttccgggtgtttaataacgagagagcagccaacgccctttgtgctgggataaaagttactggctgtaacactgagcatcactgcatcggtggaggagggttcttcccacagggcaaaccccgtcagtgtggggacttctccgcctttgactgggatggatatggaactcacgttaagagcagctgcagtcgggagataacggaggcggctgtactcttgttctatagatgagacagagctctgcggtgtcagggcgagaacccatcttccaaccccggctatttggagacggaaaaactggaattctaacaaggaggagaggagactaaatcacatcaatttgca

SEQ ID NO: 16349 - DNA, 952 bp, Homo sapiens
gggtgaggtgtggagtgtggctggccaccagcctgcaggagggagggctggaaggtggggatatggggaagggctggagaagaagagagaaatacaggacttgaatcacaacttcctctcaacaaggctgttagggccctgggtggtggtgggatcatcagctgggagtggggtgtctgagcgtggctggccatctgcctactgatcccagagctctcagcccagctgaggctgcacatgtggaccttctgcctcctggtacctcctggcccagtcaggctcagtgtctgttgctttccagaaccctggctactacgacatccaggccaaggacctgggcatctggcatgtgcccaacaagtcccccatgcagcattggagaaacagcgccctgctgaggtaccgcaccaacactggcttcctccagagactgggacataatctgtttggcatctaccagaaatacccagtgaaatacagatcagggaaatgttggaatgacaatggcccagccatacctgtggtctatgactttggtgatgctaagaagactgcatcttattactcaccgtatggtcaacgggaatttgttgcaggattcgttcagttccgggtgtttaataacgagagagcagccaacgccctttgtgctgggataaaagttactggctgtaacactgagcatcactgcatcggtggaggagggttcttcccacagggcaaaccccgtcagtgtggggacttctccgcctttgactgggatggatatggaactcacgttaagagcagctgcagtcgggagataacggaggcggctgtactcttgttctatagatgagacagagctctgcggtgtcagggcgagaacccatcttccaaccccggctatttggagacggaaaaactggaattctaacaaggaggagaggagactaaatcacatcaatttgca

SEQ ID NO: 16350 - DNA, 1084 bp, Homo sapiens
caagacagtcagtgcctctgctcataggtgagcagaacacaagatgcatggagcatcgtcttccagcaagtatgtgttggagtcttctgagtgtgcttttgacttcctagggcttttctattcacggagctgagatgaaccctgagctctcagacagggaggctctgggctggttctctctacagatggcctgtattttctccgcactgagaatggtgttatctaccagaccttctgtgacatgacctctgggggtggcggctggaccctggtggccagcgtgcacgagaatgacatgcgtgggaagtgcacggtgggtgatcgctggtccagtcagcagggcaacaaagcagactacccagagggggatggcaactgggccaactacaacacctttggatctgcagaggcggccacgagcgatgactacaagaaccctggctactacgacatccaggccaaggacctgggcatctggcatgtgcccaacaagtcccccatgcagcattggagaaacagcgccctgctgaggtaccgcaccaacactggcttcctccagagactgggacataatctgtttggcatctaccagaaatacccagtgaaatacagatcagggaaatgttggaatgacaatggcccagccatacctgtggtctatgactttggtgatgctaagaagactgcatcttattactcaccgtatggtcaacgggaatttgttgcaggattcgttcagttccgggtgtttaataacgagagagcagccaacgccctttgtgctgggataaaagttactggctgtaacactgagcatcactgcatcggtggaggagggttcttcccacagggcaaaccccgtcagtgtggggacttctccgcctttgactgggatggatatggaactcacgttaagagcagctgcagtcgggagataacggaggcggctgtactcttgttctatagatgagacagagctctgcggtgtcagggcgagaacccatcttccaaccccggctatttggagacggaaaaactggaattctaacaaggaggagaggagactaaatcacatcaatttgca

SEQ ID NO: 16351 - DNA, 686 bp, Homo sapiens
aattttttaatagaagcaaaatttaaaatcttttttaagaagtaataaaatcactctgaatggattatttttggctttatcaatttgataaatcaatccaggctgaaatatcatttataacctctagagtgagtgcccctgctcttgtctcaaatatgagagtgattatcaaccaaagttagataccccagccctggcagtcaaactcaaaagcaagcttgcacgccgtctctcaagtctctcagcattctccccaaacaagaaatcaagtgccagagcttatacacttaatatttgagaccaaaaaagaaaactccaaacgagagatttactcaaatgtgcttgtctcccagttactttataagaagtaaatccatgtcagaagaaaagatgcccatgtcttgttctgcatgggaaataagtgccatgtactaaaagaagcctaaaaatggtggcacaagtttctttaaatggctaaaatccctcaaaatactgaacatctcatcagaccatcaagagttatgttttttgtcacacattatgaaattctagatatcccagcctgggcaatatggaaaacctcgtctctacaaaaaatgaaaaactatccaggtatggtgccccatgcctatagtcccagctacttggtaggctgaggtgggaggattgtttgagcctgagaggca

SEQ ID NO: 16352 - DNA, 449 bp, Homo sapiens
catctcccacaagaggcatgatatgaggtcccgttgcctcccatccccatgactgctgcctaggaggctacatgtttgtcctccctgaaaccacgggtagctgagccatatgcttttgcagggtacttgggttctcttcctttaagttccgtgcttaaaagagcaggatagttggtgttggtgccacacgtggtactgccacttctctagttatttagaactcactgcagtttgaccatcagggatgctgtagtcaccagatttgagtgcatctcctccttaaaatgtcctcatgttccaacctccagtattattatccccaagcaggcaagtttattcctctgcttccaactttgtatacccatcttgcaactttaaaagacctgtgtacattactgccttggacgccatagacttctgtcaaattataagcacactctctatcctgc

SEQ ID NO: 16353 - DNA, 410 bp, Homo sapiens
tgcaacctctgctcttgggctcaggtgattctcttgcctcagcctcccgagtagctgggactacaagtgggtgtgtgccaccatgcctgtctaagttttgtattttttgtagagattgggtttctctatgttgcccaagctggtcttgaactcctggtctcaagtgatccaactgccttagcctcccaaagtgctgggattataggcatgagcaaccgcacccggccatgtttattcatttctttgtgaagatttaggtggttattaggaagcttcagatgcaccctgtagaagtaggttaagtaatgtagtggaaaaaatatggaattgggagtctgaggccctggcttcttctcatctgggttctgcacctatttgccagtgtgtcctaggtaaatttcttcacctga

SEQ ID NO: 16354 - DNA, 493 bp, Homo sapiens
taggaccaggattagagcggatggagggccacagagtgaggagggtagaggaggggcccggccaagcgcaggggtgggggacagagggctcactatctctcttcagaggccaaccacatttgcagggagcaacctggggctgtggcccttgaggccctgagggtggcaggtgctctgatatggggctggccagcagactggcttctgtggcaggtggcgcttgggatgggaagcccctgagaccattcacagtgacagccgggacagtcggggggacagagggcttggggcagcccaggctgcactctaagtgcctgcctcttctgggggcacggggagagccctgtgctcaaagcttgtcccagactccaggaggacccagggggcgtgagggtggccccctcaggtggctgagcctctgggattctgtaagctgggacggctgtctcccctgggagaaggaagcttgatctcatgactcgatttctcagca

SEQ ID NO: 16355 - DNA, 626 bp, Homo sapiens
ctatttttggaagggatggggtttcaccatgttggccaggctgctctcgaactgcaacctcaggtgatccatccgccttagcctcccaaagtgcggggattacaggcgtgagccaccgcgctcagccagcagtgtttcttaaattcaagctcacatatgtattttgcaggttctgcgaaaattttcttgattttaaagaggatttgaacaattctaactaagaacactgacgtagagaattttgaagaattacgcagaaatttgatttccaaggaagacgaaaacaaacctttcctattctgactttagacaagactgtttaaatccttgagtgtcagatttataaccattaaaatatacgtaccaatgtatataatcgtatagattcctttgggctctaagaatcactggttctgaactttgtccttacacatgggaatattcaaactgtcacaaaaaaactcttgtccttaattaaacatcctcaggaatgtattctctgtaacttcctaaacaggttcattaaatttttggtaattatgataataaagatagctttctaaagtatttcttctttaaagtcattttctcttgatatttattctttacatgtttcaacaccacag

SEQ ID NO: 16356 - DNA, 2262 bp, Homo sapiens
actttgtggttgctcgtagtgagttgcgctcgctatgtctggacgtggcaagcagggaggcaaagcccgcgctaaggccaagactcgctcttctagggccggtctccagttccccgtgggccgagtgcaccgcctgctccgcaaaggcaactatgccgagcgggtcggggccggcgcgccggtgtatctggcagcggtgctggagtacctgaccgccgagatcctggaactggcgggcaacgcggcccgcgacaacaagaagacccgcatcatcccgcgtcatctccaactggccatccgcaacgacgaggagctcaacaagctgctgggcaaagtcaccatcgcacagggcggtgtcctgcccaacattcaggccgtgctactgcccaaaaagactgagagccaccacaaggcgaagggcaagtaactatctgtactagtttgtggcagctcaagtaaaatcgagtccaaaccaacggctcttttcagggccacccacgtcttctctaaaagaacttaacatttattccatgtgaaagaaagtgagacatggacaagactctagtcataaattacccatctttttgaaaacagtgtagcgaacaccgcagatttaaaagaaaaactagagggaaggtggtccagattttaccacgcttaaaagttaagatgtgaacaaatctcttaggccattacttaattttaaacttaatcagtgtgtgtccacagagcaccagtggcttcgtgagttcttgaagcactttggcccaaaagagttatcgcccgggctagaatttagcagacagctgttccacgcgggccagggcggcatgaagaagtcccgccgctacgtgcccggcacagtggccctgcgcgacgttcggcgctaccagaactccgagctgctgatcagcaagctgccgctcctgcgagagctcggcggtgacgccgctgcacgagagcgaggctgaagaactttgtgacacaatagtccacctccctgcaaggctctgtcagagactcacatctttcctgatggatagctgtgaagcattctcttacccaccctactgcatgttgcaaagtattcctttaaaatgaagtgagtaaaatactgggatgacgttatctggagcccaagaaagatggctcatttggaaaggcctaatatcccaagttgcttacctagaagaacttgacaggatagttaataataaaccttaaaacccatgaagaaatctgaggtaaagtgttagcacacagactgttaaaatgtctgcctcacagataggagggaaaatatatagaggattataatatggttcaacaaatgttgatgagtattagaaatgtacattagaaatattagaaatgtttatgactattagaaaagtacagggtattgggcgttcctgacacaaactgaggcctcctagcaagactggcagttttctgtaaaggagggttatttactacggtagtgcaaataacttttggtgttgtagctaaataaggaatactcatgccaagatcatcgaattgtgcctcctccctctgttcactgaactctgatgtaattttttttttttttttttgagacggagtctcgctctgtcgcccaggctggagtgcagtgggcgctatctcggctcactgcaagctccgcctcccgggttcacgccattctcctgcctcagcctcctgagtagctggggctacaggcgtctgccaccatgcccagctacttttttgtatttttagtagatacggggtttcaccgtgttagccaggatggtcttgatgtcctgacctcgtgatccaccggcctcggcctcccaaagtgctgggattaccggcgtaagccaccacgcccggcccactctgaagtaatcttaagaagacgttaactcatttttcttgtgtattgtagacacttttggctgtctggtaacatggaaaatctcagaatgatgttttaagtatataaaatgccaaacaaagttaaattacagttatcaaagtatttttaaaacttcatagtgataaatgagactatatagttatattgttaatatagttaacacattacatgatttggtgagcctaattgctgttactaattagaggagtaaaaatgtttcacgataactcagcaattgtaatgagaaatgaaacatctaatgtcttttgggttacaaagtaacaggtactgagatttgtggcctaaattcataataaagtgaaatgttcaagttcagtcaa

SEQ ID NO: 16357 - DNA, 366 bp, Homo sapiens
ctgtagggatagtgccataactaagctgttgaactctcacccctataaggcacttatctctctctgctccagctccatgaccttgcccatggggctaccaggacttctcttggttgtctcaatgcacctcatatattagccactatatgctctttcagagtgaaagaccatcacccaaaacttggcccaactcttctatgtgtcatcatctgagggcagcaataaagaactaggccagatgcatccactagaagaaaccatggtctgaaacatctgcatttcaaatccagctctagatgaataataaatcgagatgtctctgacttaaattggaaaagaggtcccatgactaatcatgcctcttag

SEQ ID NO: 16358 - DNA, 439 bp, Homo sapiens
actctgcagggcatagtcctttacacatagaaggcgcttgatgaatatgggttgaattgaaatgcaagggagctatcactaaacacagcattgaaatgttgcaggataaattgacagttccttactctctccacttcgggtcattctcctcagtttgggagaaagaattaagatttaccagatggtttgcaactgagtaggaaaaataaataggaagtgagtcttcatttcagtgaaaccagtgccctcaaggttctgaagcaggaatcacacttcctgggtatctttagagattctcaccattccattaagctcctccatatacactctaaggaagtttgggggtgaagaagcttcagggagtggttagctgcattctcttgactgttaagtggaattgggttttgctagttgtgggtaatggaagtactcaacatag

SEQ ID NO: 16359 - DNA, 2794 bp, Homo sapiens
  misc_feature (2794)..(2794): n is a, c, g, or t
tcgcccacgcgtccgacttgttgcagttgctgtaggattctaaatccaggtgattgtttcaaactgagcatcaacaacaaaaacatttgtatgatatctatatttcaatcatggaccaaaatcaacatttgaataaaacagcagaggcacaaccttcagagaataagaaaacaagatactgcaatggattgaagatgttcttggcagctctgtcactcagctttattgctaagacactaggtgcaattattatgaaaagttccatcattcatatagaacggagatttgagatatcctcttctcttgttggttttattgacggaagctttgaaattggaaatttgcttgtgattgtatttgtgagttactttggatccaaactacatagaccaaagttaattggaatcggttgtttcattatgggaattggaggtgttttgactgctttgccacatttcttcatgggatattacaggtattctaaagaaactaatatcaattcatcagaaaattcaacatcgaccttatccacttgtttaattaatcaaattttatcactcaatagagcatcacctgagatagtgggaaaaggttgtttaaaggaatctgggtcatacatgtggatatatgtgttcatgggtaatatgcttcgtggaataggggagactcccatagtaccactggggctttcttacattgatgatttcgctaaagaaggacattcttctttgtatttaggtatattgaatgcaatagcaatgattggtccaatcattggctttaccctgggatctctgttttctaaaatgtacgtggatattggatatgtagatctaagcactatcaggataactcctactgattctcgatgggttggagcttggtggcttaatttccttgtgtctggactattctccattatttcttccataccattctttttcttgccccaaactccaaataaaccacaaaaagaaagaaaagcttcactgtctttgcatgtgctggaaacaaatgatgaaaaggatcaaacagctaatttgaccaatcaaggaaaaaatattaccaaaaatgtgactggttttttccagtcttttaaaagcatccttactaatcccctgtatgttatgtttgtgcttttgacgttgttacaagtaagcagctatattggtgcttttacttatgtcttcaaatacgtagagcaacagtatggtcagccttcatctaaggctaacatcttattgggagtcataaccatacctatttttgcaagtggaatgtttttaggaggatatatcattaaaaaattcaaactgaacaccgttggaattgccaaattctcatgttttactgctgtgatgtcattgtccttttacctattatattttttcatactctgtgaaaacaaatcagttgccggactaaccatgacctatgatggaaataatccagtgacatctcatagagatgtaccactttcttattgcaactcagactgcaattgtgatgaaagtcaatgggaaccagtctgtggaaacaatggaataacttacatctcaccctgtctagcaggttgcaaatcttcaagtggcaataaaaagcctatagtgttttacaactgcagttgtttggaagtaactggtctccagaacagaaattactcagcccatttgggtgaatgcccaagagatgatgcttgtacaaggaaattttacttttttgttgcaatacaagtcttgaatttatttttctctgcacttggaggcacctcacatgtcatgctgattgttaaaattgttcaacctgaattgaaatcacttgcactgggtttccactcaatggttatacgagcactaggaggaattctagctccaatatattttggggctctgattgatacaacgtgtataaagtggtccaccaacaactgtggcacacgtgggtcatgtaggacatataattccacatcattttcaagggtctacttgggcttgtcttcaatgttaagagtctcatcacttgttttatatattatattaatttatgccatgaagaaaaaatatcaagagaaagatatcaatgcatcagaaaatggaagtgtcatggatgaagcaaacttagaatccttaaataaaaataaacattttgtcccttctgctggggcagatagtgaaacacattgttaaggggagaaaaaaagccacttctgcttctgtgtttccaaacagcattgcattgattcagtaagatgttatttttgaggagttcctggtcctttcactaagaatttccacatcttttatggtggaagtataaataagcctatgaacttataataaaacaaactgtaggtagaaaaaatgagagtactcattgttacattatagctacatatttgtggttaaggttagactatatgatccatacaaattaaagtgagagacatggttactgtgtaataaaagaaaaaatacttgttcaggtaattctaattcttaataaaacaaatgagtatcatacaggtagaggttaaaaaggaggagctagattcatatcctaagtaaagagaaatgcctagtgtctattttattaaacaaacaaacacagagtttgaactataatactaaggcctgaagtctagcttggatatatgctacaataatatctgttactcacataaaattatatatttcacagactttatcaatgtataattaacaattatcttgtttaagtaaatttagaatacatttaagtattgtggaagaaataaagacattccaatatttgcaan

SEQ ID NO: 16360 - DNA, 2740 bp, Homo sapiens
  misc_feature (2740)..(2740): n is a, c, g, or t
tcgcccacgcgtccgacttgttgcagttgctgtaggattctaaatccaggtgattgtttcaaactgagcatcaacaacaaaaacatttgtatgatatctatatttcaatcatggaccaaaatcaacatttgaataaaacagcagaggcacaaccttcagagaataagaaaacaagatactgcaatggattgaagatgttcttggcagctctgtcactcagctttattgctaagacactaggtgcaattattatgaaaagttccatcattcatatagaacggagatttgagatatcctcttctcttgttggttttattgacggaagctttgaaattggaaatttgcttgtgattgtatttgtgagttactttggatccaaactacatagaccaaagttaattggaatcggttgtttcattatgggaattggaggtgttttgactgctttgccacatttcttcatgggatattacaggtattctaaagaaactaatatcaattcatcagaaaattcaacatcgaccttatccacttgtttaattaatcaaattttatcactcaatagagcatcacctgagatagtgggaaaaggttgtttaaaggaatctgggtcatacatgtggatatatgtgttcatgggtaatatgcttcgtggaataggggagactcccatagtaccactggggctttcttacattgatgatttcgctaaagaaggacattcttctttgtatttaggtatattgaatgcaatagcaatgattggtccaatcattggctttaccctgggatctctgttttctaaaatgtacgtggatattggatatgtagatctaagcactatcaggataactcctactgattctcgatgggttggagcttggtggcttaatttccttgtgtctggactattctccattatttcttccataccattctttttcttgccccaaactccaaataaaccacaaaaagaaagaaaagcttcactgtctttgcatgtgctggaaacaaatgatgaaaaggatcaaacagctaatttgaccaatcaaggaaaaaatattaccaaaaatgtgactggttttttccagtcttttaaaagcatccttactaatcccctgtatgttatgtttgtgcttttgacgttgttacaagtaagcagctatattggtgcttttacttatgtcttcaaatacgtagagcaacagtatggtcagccttcatctaaggctaacatcttattgggagtcataaccatacctatttttgcaagtggaatgtttttaggaggatatatcattaaaaaattcaaactgaacaccgttggaattgccaaattctcatgttttactgctgtgatgtcattgtccttttacctattatattttttcatactctgtgaaaacaaatcagttgccggactaaccatgacctatgatggaaataatccagtgacatctcatagagatgtaccactttcttattgcaactcagactgcaattgtgatgaaagtcaatgggaaccagtctgtggaaacaatggaataacttacatctcaccctgtctagcaggttgcaaatcttcaagtggcaataaaaagcctatagtgttttacaactgcagttgtttggaagtaactggtctccagaacagaaattactcagcccatttgggtgaatgcccaagagatgatgcttgtacaaggaaattttacttttttgttgcaatacaagtcttgaatttatttttctctgcacttggaggcacctcacatgtcatgctgattgttaaaattgttcaacctgaattgaaatcacttgcactgggtttccactcaatggttatacgagcactaggaggaattctagctccaatatattttggggctctgattgatacaacgtgtataaagtggtccaccaacaactgtggcacacgtgggtcatgtaggacatataattccacatcattttcaagggtctacttgggcttgtcttcaatgttaagagtctcatcacttgttttatatattatattaatttatgccatgaagaaaaaatatcaagagaaagatatcaatgcatcagaaaatggaagtgtcatggatgaagcaaacttagaatccttaaataaaaataaacattttgtcccttctgctggggcagatagtgaaacacattgttaaggggagaaaaaaagccacttctgcttctgtgtttccaaacagcattgcattgattcagtaagatgttatttttgaggagttcctggtcctttcactaagaatttccacatcttttatggtggaagtataaataagcctatgaacttataataaaacaaactgtaggtagaaactatatgatccatacaaattaaagtgagagacatggttactgtgtaataaaagaaaaaatacttgttcaggtaattctaattcttaataaaacaaatgagtatcatacaggtagaggttaaaaaggaggagctagattcatatcctaagtaaagagaaatgcctagtgtctattttattaaacaaacaaacacagagtttgaactataatactaaggcctgaagtctagcttggatatatgctacaataatatctgttactcacataaaattatatatttcacagactttatcaatgtataattaacaattatcttgtttaagtaaatttagaatacatttaagtattgtggaagaaataaagacattccaatatttgcaan

SEQ ID NO: 16361 - DNA, 813 bp, Homo sapiens
tattgctaagacactaggtgcaattattatgaaaagttccatcattcatatagaacggagatttgagatatcctcttctcttgttggttttattgacggaagctttgaaattggtaacatttattttctattttaataaccaaacttgcaaagttaaaaaatatatatgctttacaccactggttatcaactggggtaaatttatctctcacaggcaatttggcaataactaaaaacatttgtggttgtcataactgcacaggggttgggggcaatggaagtgctactggtatctaaaggtagaggtcaggggtactgctaaatattctataatgcacaaagaatgatgtaactgaaaatgttgatagtgaggatgttcagaaaccctgattctacacaaattcattttttgcaaactaacgccatgtcatactttacctcccctctctcaagatgaagaaactttgggagaggactgttattcttaaggagaaaggaatcttttcagagcaacctacgttagacctctattgtttcactgagcacacaaaaatctttcctttgaaatactgaagatattttgttgtcttcattttatgttggatttctccaataacagctcagggaaaacattttctggttcatatttgtgtttttccctattagtaatttttttctagataatttataagatgaatattaaattttctgggaatttttctctttaaatttttttcttctaaatttccattgtttttctttatgtttcattaatctttgatgccatcatccatcttaccatattaagttcta

SEQ ID NO: 16362 - DNA, 435 bp, Homo sapiens
gtagttctaaaggttttatattcgtttgatctcttgtatttacagataatgtttgaatcatgttaaactgctccttacatatttagatcttatagtctcctttacttcagagaagatttgtcttgggtctctccttccttaacccgtggttgaaaaacagtttctccttttataaaatgagcttctctcagcttaacttaccttttctctcctccccccctgggattttagaactgtccccattgggagtagggatttctccctgccagttgcctgcttctatttattcagatgctttggggtcaacattgctacttgatgctgtaaaaactgataggatgttatgagctgtttaaaagaggcctgtggcccacctgctaacctcattgctgatgttgtgagcttataaatgacaacagatttataagattgttg

SEQ ID NO: 16363 - DNA, 521 bp, Homo sapiens
tcctttcttaagtttttaaaaaatagagacagggttttgctgtgttctcaaattcctgggctcaaataatctgcccacctcagctgcccaaaatgttaggattactggcatgagctaccacacccggctgagctacattttaatatgtgtggttcgataatgctctcataacacacctagaaagtaaaaccatctaagcctgcccctcctcctatggagccacctcctcagtcttaaagcctcagctgctcgtgaggaaaccctctatcctcacaatacacccactgctacatgttctcatagacgcctctccccgtccttatcgtagtactcactgcaccctgtcgttgcttaattttcctctctcttcacctatggtggtaggggccatcttttaagatctggtgtgtccatgatcttaaagtttttaagtttctattaaaaatcaattatattatttgtgagagaagttttttttttttctttttgaaatacgtaaaataaagctggctggcttcttg

SEQ ID NO: 16364 - DNA, 365 bp, Homo sapiens
aattcatgcttcagattggttcataataccatttccagaaatgtattccatggggattacaaagaatctaggtgtgtgttggggggcacctacagtcaaacaaattcagaaaattgtggattaaataaagcaaaatagtattctgtaggactactgaatactatggtatattgggactctccattgggaggtaattttatacagcatctcctcaacttatatgacaaaataactcactttctgaagcatcttaacagacatttcagtgaataacacattggaaaatggtgatcttttgtgctttctgtcaggttttgatatcatggttatgctggcctcaggaatgatgaaactattagaaatct

SEQ ID NO: 16365 - DNA, 307 bp, Homo sapiens
catacaaagcaacttgtttatgaggagttctgtacagaatattatttctaaaatataaagtggaggctggtcaaggagggaatgagtccatagaatgccaggggcaggccctgaacagcattataggccagcttgaagtgtttgagctatctcttagaggcagtagatcatattaatatgatcatattaatatttcagaaaaataaccctgtgcaatggtttcagtgtcaccaccaaaactcatattgaaattgaattcccattgtgacggtattaagaggtgatcctagaaggtgcagctgcttta

SEQ ID NO: 16366 - DNA, 367 bp, Homo sapiens
gtcccagtttcaacttcaaaatcttgcaggttttgcattcatcttcataatgtggctataaagttattgtttaacagtgaaggtgcagctgggcgtggtggctcacacctgtaatccaagcactttggtaggctgaggcgggtggggcaccggaggttgggagtttgagaccagcctgaccaacatggagaaaccctgtctctactaaaaacagaaaattagccaggcatggtggcacatgcctgtaatcccaactacttgggaggctgaggcaggagaatcacttgaatccaggtggctgaggttgcagtgagccaagatcatgccactgcactccagcctgggcgacacagcgagactccgtctc

SEQ ID NO: 16367 - DNA, 251 bp, Homo sapiens
ccctgagggcggtcggggcccaggggtgggttctaggctggaaagatgtgtcggaacgtggctgtagccacagggtggacaggaggtcccggaagcaggaggggtgtgtctggagtgggggtgcctggaatgccgccctctggttcccttggggtggagttgggggctctggcctagaacaggctgacactgccctgtggaccctgagacccctcaactgggacaggtcggccccttggtggggtggggct

SEQ ID NO: 16368 - DNA, 369 bp, Homo sapiens
gccctctgttagaagattgagaattttcatgtcaattataagctaaatttgaggatttcaatgagcccaacaagaaaaccatcctcaaccacaatggaaaaataaaaaaactcaaacaggcaaggtattttgttttctttaaaatgtctatggtttcttatcctttacaaaactcttcatagctcatccactttttttctaactttttattttgaagaatttatagactcacaggaagttacaaaataaatgtacagtgatgtcctgtttaccttttactaagtttctcccaattgttatattttaagtaattatagtacactatcaaagccaggacattgatgttgatctaattcagttttaaattcg

SEQ ID NO: 16369 - DNA, 411 bp, Homo sapiens
gcttaaacaacagctggcaaaaatgaagtgacatgaacacagaatgagtaaaagcatccatcccagccttgggtttcacatttgcagtcccaaaataagcgaacagccagttattttggggctcttaaaaatctttgaagttgccaactatcccaaattttgtaattggtttaaggaggaaagctggggattcccctaattttgaatctggaaaggatggcagcaatgaattctagtttcagggcagtagctccttatacagacaccctgagtattgccaatgttttgaccatcggtgcagagctctcctttaataacatttgcttaatgctttaatttattaacacttaaccttctctttcccttttcaaccctttttctcttccctttgctatattcccacgtaacttt

SEQ ID NO: 16370 - DNA, 455 bp, Homo sapiens
  misc_feature (22)..(22): n is a, c, g, or t
gacccaagtcttcttctggcgnggcctctcgtctccttcctggtttgggcggaagctttgaatccctacttttgatttttttttggatatatacctagaaatggaattgctgggtcataaagtagttctatgtttaacctgtagagaaactggcaaactgtttttcactctaagctctgacttttaagtcaaaagtctcaattagatcacagctacatgaaatcctcaatagcattttccaggaaaatattgtttgtgaatatcatctgttgtcctacacaatgtctcctacatataatcccaaagagaaaatacttttgagaattaggtactggggccaggtgcagtggctcacacctgtaatctcagcactttgggaggctgaggtgggcggatcacttgagaccaggatttcaagaccagcctgatcaacatggtgtagccctctctctact

SEQ ID NO: 16371 - DNA, 533 bp, Homo sapiens
taccaaatgaatgctacataaatgagagaggattcactgtatgaatacctaaagatggcttgtcatggtgataaagacattgtgcttagggtaaggcaatcccagtttgtatcatggctctgccatttactaggttatgacaataactaagtcagttaacctctcaaatctctgttaattcatttctaaaatagagattgtaatagcacccacatcataggagtgttgacctggcacatagtgaacactttaactagtattatttctgaaacaatttttatttcgaatgtaatttctaaacagttcagtggatttcatttctcttaaaagaaagccgaagaagtacagagtgccaataaactccttataataaaatgttgtatactagagtagtacaaaagttatcagtctccagggctgggcgtgatggctcaagcctgtaatcccagcactttgggaggccgaggtgggcagatcacgaggtcaggagatcgtgaccatcctggctaacacagtgaaaccccatctctact

SEQ ID NO: 16372 - DNA, 340 bp, Homo sapiens
gaattggtgattatgatagagtagtgctataattatttgaccaggaaattatacttttcaagatatatgaaaatttaaaataatttgtctcatttttaatttgtaccttaaagaactgaaaatcaggatgactgagtttcttttcttttctttttttcagctgtaggcaatttactcaggtactttaatggattgtttaacctcattatgcctcagtttccttacctataaatgagaggagtgaactacataatgttcttaaagcaaaaaattacttatttttaacaaaaaagctatagtagaaggtagaagaaaagtagaaagttgagaaactatagat

SEQ ID NO: 16373 - DNA, 432 bp, Homo sapiens
cagtgcttgctcccctcactgcagcaggaagcctaacttgcgaactgcaggtgtgctccaggtggtcactggatgcaagaaatggtgcgagaactttggatgtggaacgtggaggaggaggaacacgaagtggggatctgcacttggggtggtcagcactgcggatgcccagcaaagtcactgcctggtccacatcccggaggggtctctgcgcctcagtcggcatcgcagctgatggtgaaacttttggtgtggcagaagagtgtccacaaacttcggaagttgctagagaaaactgaaaactactagttttgaaagcctcacttctgccaatggaagcacattccagcatgtcgccaacgcaatccactttccaccactttcacaaaaaacgttactgcacaattatactatcctacccttatataaatt

SEQ ID NO: 16374 - DNA, 730 bp, Homo sapiens
cagtgcttgctcccctcactgcagcaggaagcctaacttgcgaactgcaggtgtgctccaggtggtcactggatgcaagaaatggtgcgagaactttggatgtggaacgtggaggaggaggaacacgaagtggggatctgcacttggggtggtcagcactgcggatgcccagcaaagtcactgcctggtccacatcccggaggggtctctgcgcctcagtcggcatcgcagctgatggtgaaacttttggtgtggcagaagagtgtccacaaacttcggaagggccgcggcggcaaggtccttgctcccatggcgtgactccagggtgcaggagcctgggctgagcaggtggagtagggtgagctccgccaagaacccagcgagagtggcgccccagggcggcacaggaggccgcatttaacatgtcaatcatctgaaagattttatggcatcttttttttgacatcttataatatctataatgtttattatatcttgtgatataattattaacaccacttcagtgtgattattatgattatttttataccaacacatcttcaattattaatattcccagttgctagagaaaactgaaaactactagttttgaaagcctcacttctgccaatggaagcacattccagcatgtcgccaacgcaatccactttccaccactttcacaaaaaacgttactgcacaattatactatcctacccttatataaatt

SEQ ID NO: 16375 - DNA, 421 bp, Homo sapiens
tgcgcctcagtcggcatcgcagctgatggtgaaacttttggtgtggcagaagagtgtccacaaacttcggaaggtatccgctacatcctccatagccgtgtatccctgcccagggcaatcttctgggggagcggaaagtcctgctcccgggccagggctggctggctggagccacttgtgcggcgcagccctggcggaggttcaggcggccccggtgtcgcaagcggctgtgagtgatgcctccctggggccggagtggtcccaggaaggctgcagaccagggctgaccagcgggcagcatggtggccgcgatggaaggtgacggggttcgcagcgccaggggacccagcagagcccgagcccgggcatcccgcatctccagcagcatcgcaggtaggcctggtgctggtgaagtggcggc

SEQ ID NO: 16376 - DNA, 566 bp, Homo sapiens
cccagcccgagatacttgcataaagccgcatttcccccagcaacagtctctggtccctgtctgtccattagctgactccagtcctgaccagcctgttctcagtcctcctgccaggacacattctaaagaccgtgggagactcagctcagcctcactcctccccagagccagattacaaccttttgaggctctaagcattgactatggtgatgcccccagtcactgtcccagcccctcactgttcaattcacaacaaaacagtattttgcagaatgacacaaaactgatattgatactggaattcaaatagccttattctgaattttcagattgcaaaatcctgtataagtttgtcaagaatgagcgcctctctgtctcttcgggtgtgtgttcttgtgtgagtgtgtgcctggatgtgggtgtgggtgactctggtgtgagtctggatgcaggggtgtgagtatgtgtgtttcctggctttttattttttggtgggcagagtctcgttctatcacccaggctggagtgtagtggcatgatctcagctcactgcaaattcctcctcc

SEQ ID NO: 16377 - DNA, 888 bp, Homo sapiens
agcggactgtccattccacaggtaacaatgattggtccagaatagggcaaatactacattcagaacaagaagatcaaaagaaagctctcctgtagcttctgaaaaagaaaacttttcactgtttggaatgcgtaggatgagtttaggaggttgggactgctacagctaattggttacatgaagagaggcagcttgatgatgaaaccgacactcagaggaaagggccctgagacatggatctcagtgacctcatttgagccttcgcagcaactaaagccagacctactcatgttctttttaggtctatcaagcaacaaatttcgttttagttcaagccattttgaggtaggatttctgccaattacaagcaaaaggacccttaatgatgcaagtactgaactgggaataataaacaccaatagttgagtcaatgttcttgccattaaccaactgcacatgggagcaaatcacccctatagttgagaaagctgtctccaaaaaaggagaagtctttccttcctacttcaaaaatgtattcagagcctcagtagagaagatgtacacaaaaatgctttttaagtagtaaattgctgaacaatgataagagagtattattgaaacctcagggatgtagagtagaatgagcattattttttccctcttactactaaaaaaactgagtcacaaaaattagatggtagaaagttaaattaagatatttaaatttactatccaatatgtcagccatcccatgctgcttattttattttaatttttatatatgtcaacagaatagttctcactcgctggtaaagtgtggaataatattgaaaattgtgttttattagtgacagtaatttctgattagttttgtacacactttccctc

SEQ ID NO: 16378 - DNA, 286 bp, Homo sapiens
tccaatgtatgagctcccctagcttgaactgtcaacccatagttctattactagcaaaaatatccttcagtaatgaagtgatgaaataaagacatcctcagatgaaggaaaactaagaggagttgtttttagtaagcttgcactaaaagaattgctaaaggaaattcaccatatagtagggaaatgataccaaaaggaaacttggagcattaggaataaaggaagagcaacagaaatggcaaataccaagataagtataatattcttctcctctttagttctttaa

SEQ ID NO: 16379 - DNA, 489 bp, Homo sapiens
agaaaccaagcactttacttctcactaaaaatgagattattgatctaccataaccattaactcttcgattaagtatagaaggttatcaaaggcttataaaatacagaattacaggcatagctgataatagtataaataaatcattttaatgcatcgtattcaattttgtgctcttaagtatattgatttctggactgttttgttaacagctctgtaaaactgccaccagtatttccatttagtaaaatacaattgggccaggcatggtggttcatgcctgtaatcccaccattttgggaggctgaggcaggcagatcgcttgggcccagaagttcaagaccagcctgggcgacacggcaaaacctgtctctgcagaaaaaaaaataataataataataataatacaaaaagaatcagcagggcatggtggtgcacacctgtagtcccagctacttgaggggctgaggtggcaggatcacttgagtccag

SEQ ID NO: 16380 - DNA, 687 bp, Homo sapiens
atggagaagagacggattctctaaaacgagttgcagatcataaaagggctttaccacctggtggaagagtggggactctctcctaagggccacaacatgagggtggaatatgtcaagatcagtctcccttcacctcctggagaacagtcttccttgtggcatcagctcaaacagatgggacctctctaggcagccttccaagcttcccgttcctcccctacctcagaagctggccacttgtctgatcaagtcctgggatcaaagggcagcctctcccaggctcacaggcctagtgggtggggtatgagccatctttttcaccgtaggccctccttgagccaggaggagtgcccacatccttcctagtctccatcttcatgcctattctgccactacctgctctcccagtctcaccaggagtgagtcatactgcaggccctccagggcacaaacacttcttggttccttctcatcttcttttcagtcccattctctaatgattggtcaaccctgaaagcttgggaacagatgggcctgtctctgctccctaacagctctccagaatgaatggaaaagacaggctgtaagctggcagttccgagagggtgctgacgtgaatgggaactagaagacttggagtcagctgctgctctgccccctcctggatatgggatcctgaatgttctc

SEQ ID NO: 16381 - DNA, 1555 bp, Homo sapiens
gggttcaagccattcgtctgcctcagcctcccgagtagctgggataacaggcatgtgccaccacacccagctaattttttgtattttgagtagagacagggtttcaccatgttggccaggatggtctcaaactcctgacctcatgatccacctgcctcagcctcccaaagtgctgggattacaggcatgagccactgcacctggctctcttccactttagagtgagaagttgcttcaggaagtttgaaagcctgtttcatggcccactgagtctcttctgtgcaaaggggggtgccacaggcttttttcccccaagtgaaatggggcttccagtggatcgaagatctggtgtcctgtatgggggcctcaaggtcttggagcaagacagtctcaatgttgtatgggcttgggacctgcatctggccccaagcatctggaactgtgcacttaacctttcttcattacccagacttggatggccttgttggggttcaagggataggtcctctgtctcttcctttaaattattaactatttattacatccggaacctgtgagattcagcactcccaaccagaccctgggatgggtgagagaaaagcgggggtgtctctcccctccccactctgcccagctctcatcactgtcagacccaccagagctgagggcggagggattgggggctggggcagcctgggtccccatgcccctctctgtgcctcggtctccccccttccatggtgggcgggggggaagctccattcttaacctacctcgttttggggaggggtgggacgggggaccagagtgctgtacggtgctgtgggatctgcagatgaagcggtgggggctaaggaaaggtcccctggccgccacttcccagcagcgcctctcccaggtcccccagtcctgctccctgctgagacccacctctgatccatgattccccttcattgcccccaaatcaggggtacatggagggccgccctgggagccaggcagacctcagaccctggagcccccaggcccaatttcccagccgcttgcccctcagatcggatgcttggcccccagatttgggggaggcaccccaacatatatcttcctgatcttgtttctaagccagtctgtgacctcaatattgttagtgtcagtgcaggctgaagtggtgggggaggatgggggccaaagacccagccttgtcatcgggggagggggcacgagatctgctccaagaaatgtctgtgacaaagtctcagcctgtgttatttatttgcctctgtgcaccccacccactcaccttcctgaactgctaaaccagtctcctacttaaattctcccttctcccatcagaccctcaagctgagttttataagacactcaacaaatgcatttattgagcacctaattatgtgccaagccctgttgaaagcactggagataaagcagtgggcagaacagacaaaagtccctcctgcaaagagcttatgagctttatagtaggggagacaataagtaaatgacttaatatgttagaaatgatagaaagcagaaa

SEQ ID NO: 16382 - DNA, 699 bp, Homo sapiens
gcggaggcgcgcttgggctcccggcggcgacgactacgaccactaggagagcggacggaggcggcgcctgaagcggcggcggagcccatgccccgggacggcgggcggacccggagagacaaatccggggcccggggcatgtccccggggcccccgtgaggaggcggcggcggctatggagatcgcgccgcaggaggcgccgcccgtgccgggcgcggacggcgacattgaagaggccccagctgaggccgggtctcccagccccgcgtcgccccccgccgatgggcgcctcaaggctgcagccaagcgcgtcacattcccgtccgacgaggatatcgtgtctggagcagtggagcccaaagacccctggagacatgcccagaatgtgaccgtggacgaggtcatcggcgcctacaagcaggcctgccagaagctgaactgcaggcagatccccaagctcctcaggcagctgcaggaattcacagacctcgggcaccgcctcgactgtctggacctgaaaggtgagaagcttgactacaagacctgtgaggccctggaagaggtcttcaagaggctgcagttcaaggtcgtggacctggagcagacaaacctggatgaagatggtgcctcggccctcttcgacatgatcgagtactacgagtcggccacccacctcaacatctccttcaacaagcacat

SEQ ID NO: 16383 - DNA, 541 bp, Homo sapiens
aaatgccctgtgttggacggactgcagctggagcagtcactgagcacggaggccagaaacctgtttttacaaaagctccccaggtggttctgacaacctcgcttggctgtctgtgtgctttgctccgccatccatcactcagtcccaagcctgccttcagacctcagttcaggggtggctggcattgacctcaaagccttttttggagcaaattaacagcccagaatgtgaccgtggacgaggtcatcggcgcctacaagcaggcctgccagaagctgaactgcaggcagatccccaagctcctcaggcagctgcaggaattcacagacctcgggcaccgcctcgactgtctggacctgaaaggtgagaagcttgactacaagacctgtgaggccctggaagaggtcttcaagaggctgcagttcaaggtcgtggacctggagcagacaaacctggatgaagatggtgcctcggccctcttcgacatgatcgagtactacgagtcggccacccacctcaacatctccttcaacaagcacat

SEQ ID NO: 16384 - DNA, 555 bp, Homo sapiens
gcggaggcgcgcttgggctcccggcggcgacgactacgaccactaggagagcggacggaggcggcgcctgaagcggcggcggagcccatgccccgggacggcgggcggacccggagagacaaatccggggcccggggcatgtccccggggcccccgtgaggaggcggcggcggctatggagatcgcgccgcaggaggcgccgcccgtgccgggcgcggacggcgacattgaagaggccccagctgaggccgggtctcccagccccgcgtcgccccccgccgatgggcgcctcaaggctgcagccaagcgcgtcacattcccgtccgacgaggatatcgtgtctggagcagtggagcccaaagacccctggagacatggtgagaagcttgactacaagacctgtgaggccctggaagaggtcttcaagaggctgcagttcaaggtcgtggacctggagcagacaaacctggatgaagatggtgcctcggccctcttcgacatgatcgagtactacgagtcggccacccacctcaacatctccttcaacaagcacat

SEQ ID NO: 16385 - DNA, 609 bp, Homo sapiens
gcggaggcgcgcttgggctcccggcggcgacgactacgaccactaggagagcggacggaggcggcgcctgaagcggcggcggagcccatgccccgggacggcgggcggacccggagagacaaatccggggcccggggcatgtccccggggcccccgtgaggaggcggcggcggctatggagatcgcgccgcaggaggcgccgcccgtgccgggcgcggacggcgacattgaagaggccccagctgaggccgggtctcccagccccgcgtcgccccccgccgatgggcgcctcaaggctgcagccaagcgcgtcacattcccgtccgacgaggatatcgtgtctggagcagtggagcccaaagacccctggagacatggctggagtgcaatggcgcgatctcaggtcatcacaacttccgcctcccaggttcaagcgattctcctgccacagcctcccgagtagctgggattacaggcatgcaccaccacacccggctaattttgtatgttttgtagagacaggatttctccatgttggtcaggctggtctgtaactcccgacctcaggtgatccacgcgccttggcctcccaaagtctgggatgacagg

SEQ ID NO: 16386 - DNA, 754 bp, Homo sapiens
gcggaggcgcgcttgggctcccggcggcgacgactacgaccactaggagagcggacggaggcggcgcctgaagcggcggcggagcccatgccccgggacggcgggcggacccggagagacaaatccggggcccggggcatgtccccggggcccccgtgaggaggcggcggcggctatggagatcgcgccgcaggaggcgccgcccgtgccgggcgcggacggcgacattgaagaggccccagctgaggccgggtctcccagccccgcgtcgccccccgccgatgggcgcctcaaggctgcagccaagcgcgtcacattcccgtccgacgaggatatcgtgtctggagcagtggagcccaaagacccctggagacatgcccagaatgtgaccgtggacgaggtcatcggcgcctacaagcaggcctgccagaagctgaactgcaggcagatccccaagctcctcaggcagctgcaggaattcacagacctcgggcaccgcctcgactgtctggacctgaaaggtgagaagcttgactacaagacctgtgaggccctggaagaggtcttcaagaggctgcagttcaaggtcgtggacctggagcagacaaacctggatgaagatgtgagcggccctgccaccgcccacttggctccctgagctcccgggccccttcgagggtgcctcggccctcttcgacatgatcgagtactacgagtcggccacccacctcaacatctccttcaacaagcacat

SEQ ID NO: 16387 - DNA, 312 bp, Homo sapiens
gtgagcattgaaatactgcagaaattcaagctgagccggccacctgctgcagtagggcatgggggcaggtgggttaaattcttgccttctggctgaccttagtcatcaccagtcattgccttccatgtgcctgtaccaggcactggtctcagtgccttttgtgtattatcgcatttagatatcacagccaccccaggaggtaggtgccgtttgccccaatttgtagatgaggaaatggagcccatagaggtaaagtaattttcctgaggtcacacagtgggtaagtggtggagctgggattcaaatccaggc

SEQ ID NO: 16388 - DNA, 788 bp, Homo sapiens
atccttgcattctagaaagcttatttcattctcccatgtcataagtttgtcagctctgcactcagttgcctggggggatatggcaagtgctataacagaggctgtctttcatattttattttgaaccttttccactgttcaccatctctctctcgttttttaaggatcaagctagtttagtttacctaagaacataggcctatgggcatgactacaaacctctttctgttcctcttatgaaggccagtatgtcattttagagtgccctgttcaaatttaaatggggtgacaatacctcagacttgattgcctaggttgaattttttctcctgggttttctatgcagtgggtattttcaggtagaggctagaaagctttagcctttttcccaaggcttgctgaattgtaggagttttgtcttagaacgctttttctagacactttaagaactttaagaagattcaaacttattacccaaatttcctgtaggctttgttttgtcagtttttgcttctgtcttgcctggaggcctgacacctcctgtcttccaggtaaattgacttcccttgtacatcttaccagaaagatatttaccctaacttgttacacaaactattgccacagtacctgtggatttttaagttaactaacatgggtatttctctttaaaggttttgtgcacagaccaaacaaatcaccctcagtcttcccagcagtcagatgtggtaactgagactaggacggataatataggttgtgaggtggcaatcgcttagggtcctaagatt

SEQ ID NO: 16389 - DNA, 484 bp, Homo sapiens
aagcagtatgattttactgttgcagttggttactcttcaatcaaggttgccagataaagtcctctgtttttatttgctaagcctggcaaccctatctttggtacagtagggctaaatctctacagcgaaggagctcaaatctgaactggcatctattcttgtaggtaagggaagccattaaaggcagttgaccaaagggttatgtaaaaagaattgtgttttagcagaacaaaaatgataatggtgtgctaggatagatgatgaatgagatcttcctgatcatcaggataattcccatatctctggctttgagaagcagtggagaaaatttagaagataagcttacatttagaagacaagcaacttggtcggtgcggtggctcacgcctgtaatcccggcactttgggaggctgaggtgggtggatcacaaggtcaggagtttgaaaccagcctggccaccatagtgaaacctcgtctctacta

SEQ ID NO: 16390 - DNA, 385 bp, Homo sapiens
gataaatcctcaaatctgagagcacaacactgtgctccctaaccctaatctccctctcccagcagggagtgaatcctgcttcatttgctcagtgagcacaaggaaggcacgggccctggggtccatccctgccaggccactccttccagccctctctgtcattcccacagcagcagacaggcaacagcattccctcttcccagcatcgctgatgccaggctgggtaccacaacctctgcataccaacggactggtccctacatcctgatgccagaggaggtgggtaacattgagccatcacactcactcaattaccagacccctgggtcagcttaagaagggatggagtccgggcgcagtggctcacacctataaccccagcact

SEQ ID NO: 16391 - DNA, 226 bp, Homo sapiens
aaggcaggtaggtagataattttcatagtctttaaaaataaaaataacatgtaagagactgtaaaatcagttattataaatataaacttatctctacaaatgattttatattttgaatggtagctggttaatttaaagcctgatgctaaggttaacagaattgttcaaataattaacattaattagcaatatcactaaaatgattcagaggccttctagtgatggc

SEQ ID NO: 16392 - DNA, 3200 bp, Homo sapiens
  misc_feature (3188)..(3192): n is a, c, g, or t
  misc_feature (3194)..(3196): n is a, c, g, or t
  misc_feature (3200)..(3200): n is a, c, g, or t
gaattccgggtttgtgcatccactctggaaccgctcgtgtgtggcctgtcggaatgacatcgccctcatcagtctccgcacgcggttccgcaggtggcagcgatggcccagtcctgaactccccgccatggccggcgcccccggcccgctgcgccttgcgctgctgctgctcgggatggtgggcagggccggcccccgcccccagggtgccactgtgtccctctgggagacggtgcagaaatggcgagaataccgacgccagtgccagcgctccctgactgaggatccacctcctgccacagacttgttctgcaaccggaccttcgatgaatacgcctgctggccagatggggagccaggctcgttcgtgaatgtcagctgcccctggtacctgccctgggccagcagtgtgccgcagggccacgtgtaccggttctgcacagctgaaggcctctggctgcagaaggacaactccagcctgccctggagggacttgtcggagtgcgaggagtccaagcgaggggagagaagctccccggaggagcagctcctgttcctctacatcatctacacggtgggctacgcactctccttctctgctctggttatcgcctctgcgatcctcctcggcttcagacacctgcactgcaccaggaactacatccacctgaacctgtttgcatccttcatcctgcgagcattgtccgtcttcatcaaggacgcagccctgaagtggatgtatagcacagccgcccagcagcaccagtgggatgggctcctctcctaccaggactctctgagctgccgcctggtgtttctgctcatgcagtactgtgtggcggccaattactactggctcttggtggagggcgtgtacctgtacacactgctggccttctcggtcttatctgagcaatggatcttcaggctctacgtgagcataggctggggtgttcccctgctgtttgttgtcccctggggcattgtcaagtacctctatgaggacgagggctgctggaccaggaactccaacatgaactactggctcattatccggctgcccattctctttgccattggggtgaacttcctcatctttgttcgggtcatctgcatcgtggtatccaaactgaaggccaatctcatgtgcaagacagacatcaaatgcagacttgccaagtccacgctgacactcatccccctgctggggactcatgaggtcatctttgcctttgtgatggacgagcacgcccgggggaccctgcgcttcatcaagctgtttacagagctctccttcacctccttccaggggctgatggtggccatattatactgctttgtcaacaatgaggtccagctggaatttcggaagagctgggagcgctggcggcttgagcacttgcacatccagagggacagcagcatgaagcccctcaagtgtcccaccagcagcctgagcagtggagccacggcgggcagcagcatgtacacagccacttgccaggcctcctgcagctgagactccagcgcctgccctccctggggtccttgctgcaggccgggtggccaatccaggtgggagagacactcccagggacaagggaaggaagggacacacacacacacacacacacacacacacacacacatacatcctgctttccctccccaaacccatcagacaggtaaatgggcagtgcctcctgggaccatggacacattttctcctaggagaagcagcctcctaatttgatcacagtggcgagaggagaggaaaaacgatcgctgtgaaaatgaggaggattgcttcttgtgaaaccacaggcccttggggttcccccagacagagccgcaaatcaaccccagactcaaactcaaggtcaacggcttattagtgaaactggggcttgcaagaggaggtggttctgaaagtggctcttctaacctcagccaaacacagagcgggagtgacgggagcctcctctgcttgcatcacttggggtcaccaccctcccctgtcttctctcaaagggaagctgtttgtgtgtctgggttgcttatttccctcatcttgccccctcatctcactgcccagtttctttttgaggggctttgtttgggccactgccagcagctgtttctggaaatggctgtaggtggtgttgagaaagaatgagcattgagacggtgctcgcttctcctccaggtatttgagttgttttggtgcctgcctctgccatgcccagagaatcagggcaggcttgccaccggggaacccagccctggggtatgagctgccaagtctattttaaagacgctcaagaatcctctggggttcatctagggacacgttaggaatgtccagactgtgggtgtagattacctgccacttccaggagcccagagggccaagagagacattgcctccacctctccttggaaatactttatctgtgaccacacgctgtctcttgagaatttggatacactctctagctttaggggaccatgaagagactctcttagggaaaccaatagtccccatcagcaccatggaggcaggctccccctgcctttgaaattcccccacttgggagcttgtatatacttcactcacttttctttattgctgtgaatagtctgtgtgcacaatgggcaattctgacttctcccatctagtggaaatgagcgaaatcatggttgtagtgatgttgtttgggagagtgcagtagtaattgatttgacccactcacacttggagctaattaaggtttgccctgcctgcagcctcccccacaaataatgaacagcagaaagactggacggggaaacctatcaatcctgcccccagccatggtgaggaagccccaagccatggtgacacacagcagcactgcagatagccagacacatggctatcctagagaggctggcaaggagttcgtggctgcaaaagaagtttctggagcaagagagagctcgctcttgggagtcaggacctccggggagagcagagggttccgacggattcctttatgagtcagtctctctctcccttttaaatggtgggaaccctccccaaaacctttccccagacacattctcctgtgcccctcagagaggcatgtgatgtgcaaggaaaataataggatataaaacacatcaagtagaaaatttcttatacttcnnnnnannnaagn

SEQ ID NO: 16393 - DNA, 3044 bp, Homo sapiens
  misc_feature (3032)..(3036): n is a, c, g, or t
  misc_feature (3038)..(3040): n is a, c, g, or t
  misc_feature (3044)..(3044): n is a, c, g, or t
gaattccgggtttgtgcatccactctggaaccgctcgtgtgtggcctgtcggaatgacatcgccctcatcagtctccgcacgcggttccgcaggtggcagcgatggcccagtcctgaactccccgccatggccggcgcccccggcccgctgcgccttgcgctgctgctgctcgggatggtgggcagggccggcccccgcccccagggtgccactgtgtccctctgggagacggtgcagaaatggcgagaataccgacgccagtgccagcgctccctgactgaggatccacctcctgccacagacttgttctgcaaccggaccttcgatgaatacgcctgctggccagatggggagccaggctcgttcgtgaatgtcagctgcccctggtacctgccctgggccagcagtgtgccgcagggccacgtgtaccggttctgcacagctgaaggcctctggctgcagaaggacaactccagcctgccctggagggacttgtcggagtgcgaggagtccaagcgaggggagagaagctccccggaggagcagctcctgttcctctacatcatctacacggtgggctacgcactctccttctctgctctggttatcgcctctgcgatcctcctcggcttcagacacctgcactgcaccaggaactacatccacctgaacctgtttgcatccttcatcctgcgagcattgtccgtcttcatcaaggacgcagccctgaagtggatgtatagcacagccgcccagcagcaccagtgggatgggctcctctcctaccaggactctctgagctgccgcctggtgtttctgctcatgcagtactgtgtggcggccaattactactggctcttggtggagggcgtgtacctgtacacactgctggccttctcggtcttatctgagcaatggatcttcaggctctacgtgagcataggctggggtgttcccctgctgtttgttgtcccctggggcattgtcaagtacctctatgaggacgagggctgctggaccaggaactccaacatgaactactggctcattatccggctgcccattctctttgccattggggtgaacttcctcatctttgttcgggtcatctgcatcgtggtatccaaactgaaggccaatctcatgtgcaagacagacatcaaatgcagacttgccaagtccacgctgacactcatccccctgctggggactcatgaggtcatctttgcctttgtgatggacgagcacgcccgggggaccctgcgcttcatcaagctgtttacagagctctccttcacctccttccaggggctgatggtggccatattatactgctttgtcaacaatgaggtccagctggaatttcggaagagctgggagcgctggcggcttgagcacttgcacatccagagggacagcagcatgaagcccctcaagtgtcccaccagcagcctgagcagtggagccacggcgggcagcagcatgtacacagccacttgccaggcctcctgcagctgagactccagcgcctgccctccctggggtccttgctgcaggccgggtggccaatccaggagaagcagcctcctaatttgatcacagtggcgagaggagaggaaaaacgatcgctgtgaaaatgaggaggattgcttcttgtgaaaccacaggcccttggggttcccccagacagagccgcaaatcaaccccagactcaaactcaaggtcaacggcttattagtgaaactggggcttgcaagaggaggtggttctgaaagtggctcttctaacctcagccaaacacagagcgggagtgacgggagcctcctctgcttgcatcacttggggtcaccaccctcccctgtcttctctcaaagggaagctgtttgtgtgtctgggttgcttatttccctcatcttgccccctcatctcactgcccagtttctttttgaggggctttgtttgggccactgccagcagctgtttctggaaatggctgtaggtggtgttgagaaagaatgagcattgagacggtgctcgcttctcctccaggtatttgagttgttttggtgcctgcctctgccatgcccagagaatcagggcaggcttgccaccggggaacccagccctggggtatgagctgccaagtctattttaaagacgctcaagaatcctctggggttcatctagggacacgttaggaatgtccagactgtgggtgtagattacctgccacttccaggagcccagagggccaagagagacattgcctccacctctccttggaaatactttatctgtgaccacacgctgtctcttgagaatttggatacactctctagctttaggggaccatgaagagactctcttagggaaaccaatagtccccatcagcaccatggaggcaggctccccctgcctttgaaattcccccacttgggagcttgtatatacttcactcacttttctttattgctgtgaatagtctgtgtgcacaatgggcaattctgacttctcccatctagtggaaatgagcgaaatcatggttgtagtgatgttgtttgggagagtgcagtagtaattgatttgacccactcacacttggagctaattaaggtttgccctgcctgcagcctcccccacaaataatgaacagcagaaagactggacggggaaacctatcaatcctgcccccagccatggtgaggaagccccaagccatggtgacacacagcagcactgcagatagccagacacatggctatcctagagaggctggcaaggagttcgtggctgcaaaagaagtttctggagcaagagagagctcgctcttgggagtcaggacctccggggagagcagagggttccgacggattcctttatgagtcagtctctctctcccttttaaatggtgggaaccctccccaaaacctttccccagacacattctcctgtgcccctcagagaggcatgtgatgtgcaaggaaaataataggatataaaacacatcaagtagaaaatttcttatacttcnnnnnannnaagn

SEQ ID NO: 16394 - DNA, 1914 bp, Homo sapiens
  misc_feature (1902)..(1906): n is a, c, g, or t
  misc_feature (1908)..(1910): n is a, c, g, or t
  misc_feature (1914)..(1914): n is a, c, g, or t
gaattccgggtttgtgcatccactctggaaccgctcgtgtgtggcctgtcggaatgacatcgccctcatcagtctccgcacgcggttccgcaggtggcagcgatggcccagtcctgaactccccgccatggccggcgcccccggcccgctgcgccttgcgctgctgctgctcgggatggtgggcagggccggcccccgcccccagggtgccactgtgtccctctgggagacggtgcagaaatggcgagaataccgacgccagtgccagcgctccctgactgaggatccacctcctgccacagacttgttctgcaaccggaccttcgatgaatacgcctgctggccagatggggagccaggctcgttcgtgaatgtcagctgcccctggtacctgccctgggccagcagtgtgccgcagggccacgtgtaccggttctgcacagctgaaggcctctggctgcagaaggacaactccagcctgccctggagggacttgtcggagtgcgaggagtccaagcgaggggagagaagctccccggaggagcagctcctgttcctctacatcatctacacggtgggctacgcactctccttctctgctctggttatcgcctctgcgatcctcctcggcttcagacacctgcactgcaccaggaactacatccacctgaacctgtttgcatccttcatcctgcgagcattgtccgtcttcatcaaggacgcagccctgaagtggatgtatagcacagccgcccagcagcaccagtgggatgggctcctctcctaccaggactctctgagctgccgcctggtgtttctgctcatgcagtactgtgtggcggccaattactactggctcttggtggagggcgtgtacctgtacacactgctggccttctcggtcttatctgagcaatggatcttcaggctctacgtgagcataggctggggtgttcccctgctgtttgttgtcccctggggcattgtcaagtacctctatgaggacgagggctgctggaccaggaactccaacatgaactactggctcattatccggctgcccattctctttgccattggggtgaacttcctcatctttgttcgggtcatctgcatcgtggtatccaaactgaaggccaatctcatgtgcaagacagacatcaaatgcagacttgccaagtccacgctgacactcatccccctgctggggactcatgaggtcatctttgcctttgtgatggacgagcacgcccgggggaccctgcgcttcatcaagctgtttacagagctctccttcacctccttccaggggctgatggtggccatattatactgctttgtcaacaatgaggtccagctggaatttcggaagagctgggagcgctggcggcttgagcacttgcacatccagagggacagcagcatgaagcccctcaagtgtcccaccagcagcctgagcagtggagccacggcgggcagcagcatgtacacagccacttgccaggcctcctgcagctgagactccagcgcctgccctccctggggtccttgctgcaggccgggtggccaatccagcctcccccacaaataatgaacagcagaaagactggacggggaaacctatcaatcctgcccccagccatggtgaggaagccccaagccatggtgacacacagcagcactgcagatagccagacacatggctatcctagagaggctggcaaggagttcgtggctgcaaaagaagtttctggagcaagagagagctcgctcttgggagtcaggaccctccccaaaacctttccccagacacattctcctgtgcccctcagagaggcatgtgatgtgcaaggaaaataataggatataaaacacatcaagtagaaaatttcttatacttcnnnnnannnaagn

SEQ ID NO: 16395 - DNA, 2199 bp, Homo sapiens
  misc_feature (2187)..(2191): n is a, c, g, or t
  misc_feature (2193)..(2195): n is a, c, g, or t
  misc_feature (2199)..(2199): n is a, c, g, or t
cagagctgaatgtttcagaagcccagtgaaaggctctacgtgagcataggctggggtgttcccctgctgtttgttgtcccctggggcattgtcaagtacctctatgaggacgagggctgctggaccaggaactccaacatgaactactggctcattatccggctgcccattctctttgccattggggtgaacttcctcatctttgttcgggtcatctgcatcgtggtatccaaactgaaggccaatctcatgtgcaagacagacatcaaatgcagacttgccaagtccacgctgacactcatccccctgctggggactcatgaggtcatctttgcctttgtgatggacgagcacgcccgggggaccctgcgcttcatcaagctgtttacagagctctccttcacctccttccaggggctgatggtggccatattatactgctttgtcaacaatgaggtccagctggaatttcggaagagctgggagcgctggcggcttgagcacttgcacatccagagggacagcagcatgaagcccctcaagtgtcccaccagcagcctgagcagtggagccacggcgggcagcagcatgtacacagccacttgccaggcctcctgcagctgagactccagcgcctgccctccctggggtccttgctgcaggccgggtggccaatccagacaggtaaatgggcagtgcctcctgggaccatggacacattttctcctaggagaagcagcctcctaatttgatcacagtggcgagaggagaggaaaaacgatcgctgtgaaaatgaggaggattgcttcttgtgaaaccacaggcccttggggttcccccagacagagccgcaaatcaaccccagactcaaactcaaggtcaacggcttattagtgaaactggggcttgcaagaggaggtggttctgaaagtggctcttctaacctcagccaaacacagagcgggagtgacgggagcctcctctgcttgcatcacttggggtcaccaccctcccctgtcttctctcaaagggaagctgtttgtgtgtctgggttgcttatttccctcatcttgccccctcatctcactgcccagtttctttttgaggggctttgtttgggccactgccagcagctgtttctggaaatggctgtaggtggtgttgagaaagaatgagcattgagacggtgctcgcttctcctccaggtatttgagttgttttggtgcctgcctctgccatgcccagagaatcagggcaggcttgccaccggggaacccagccctggggtatgagctgccaagtctattttaaagacgctcaagaatcctctggggttcatctagggacacgttaggaatgtccagactgtgggtgtagattacctgccacttccaggagcccagagggccaagagagacattgcctccacctctccttggaaatactttatctgtgaccacacgctgtctcttgagaatttggatacactctctagctttaggggaccatgaagagactctcttagggaaaccaatagtccccatcagcaccatggaggcaggctccccctgcctttgaaattcccccacttgggagcttgtatatacttcactcacttttctttattgctgtgaatagtctgtgtgcacaatgggcaattctgacttctcccatctagtggaaatgagcgaaatcatggttgtagtgatgttgtttgggagagtgcagtagtaattgatttgacccactcacacttggagctaattaaggtttgccctgcctgcagcctcccccacaaataatgaacagcagaaagactggacggggaaacctatcaatcctgcccccagccatggtgaggaagccccaagccatggtgacacacagcagcactgcagatagccagacacatggctatcctagagaggctggcaaggagttcgtggctgcaaaagaagtttctggagcaagagagagctcgctcttgggagtcaggacctccggggagagcagagggttccgacggattcctttatgagtcagtctctctctcccttttaaatggtgggaaccctccccaaaacctttccccagacacattctcctgtgcccctcagagaggcatgtgatgtgcaaggaaaataataggatataaaacacatcaagtagaaaatttcttatacttcnnnnnannnaagn

SEQ ID NO: 16396 - DNA, 492 bp, Homo sapiens
cctgccaggcccctcccgcgggcagggcggcccctcgccggctcctcccccaccgcccgccaccagcccgggatcagtctccgcacgcggttccgcaggtggcagcgatggcccagtcctgaactccccgccatggccggcgcccccggcccgctgcgccttgcgctgctgctgctcgggatggtgggcagggccggcccccgcccccaggtgagatccagggaccccgacgacaccgggggaggcgggtggctctgcgggctgcaggcgcagtgtcctggtggagggccccgggacttgaacgaaactccgagaccgctggcgggggcatccgaaagcctcggggggagtagggactggagacttggtgcccctgggctggaaggcccaggtgagggcttggactacagaggattccccccaaccccagcgaggcgccctcttcctcgccacccgggtccctctgcccgggcacccgctgccccgcggccg

SEQ ID NO: 16397 - DNA, 3746 bp, Homo sapiens
acagaggctgtggctggaaggagctgggcatccggcctgaggcgcagcggtcgcgttagttcggcccaatggcggcaccgctgcttcacacgcgtttgccgggagatgcggccgcttcgtcctctgcagttaagaagctgggcgcgtcgaggactgggatttcaaatatgcgtgcattagagaatgactttttcaattctcccccaagaaaaactgttcggtttggtggaactgtgacagaagtcttgctgaagtacaaaaagggtgaaacaaatgactttgagttgttgaagaaccagctgttagatccagacataaaggatgaccagatcatcaactggctgctagaattccgttcttctatcatgtacttgacaaaagactttgagcaacttatcagtattatattaagattgccttggttgaatagaagtcaaacagtagtggaagagtatttggcttttcttggtaatcttgtatcagcacagactgttttcctcagaccgtgtctcagcatgattgcttcccattttgtgcctccccgagtgatcattaaggaaggcgatgtagatgtttcagattctgatgatgaagatgataatcttcctgcaaattttgacacatgtcacagagccttgcaaataatagcaagatatgtaccatcgacaccgtggtttctcatgccaatactggtggaaaaatttccatttgttcgaaaatcagagagaacactggaatgttacgttcataacttactaaggattagtgtatattttccaaccttgaggcatgaaattctggagcttattattgaaaaactactcaagttggatgtgaatgcatcccggcagggtattgaagatgctgaagaaacagcaactcaaacttgtggtgggacagattccacggaaggattgtttaatatggatgaagatgaagaaactgaacatgaaacaaaggctggtcctgaacggctcgaccagatggtgcatcctgtagccgagcgcctggacatcctgatgtctttggttttgtcctacatgaaggatgtctgctatgtagatggtaaggttgataacggcaaaacaaaggatctatatcgcgacctgataaacatctttgacaaactcctgttgcccacccatgcctcctgccatgtacagtttttcatgttttacctctgtagtttcaaattgggattcgcagaggcatttttggaacatctctggaaaaaattgcaggacccaagtaatcctgccatcatcaggcaggctgctggaaattatattggaagctttttggcaagagctaaatttattcctcttattactgtaaaatcatgcctagatcttttggttaactggctgcacatataccttaataaccaggattcgggaacaaaggcattctgcgatgttgctctccatggaccattttactcagcctgccaagctgtgttctacacctttgtttttagacacaagcagcttttgagcggaaacctgaaagaaggtttgcagtatcttcagagtctgaattttgagcggatagtgatgagccagctaaatcccctgaagatttgcctgccctcagtggttaacttttttgctgcaatcacaaataagtaccagctcgtcttctgctacaccatcattgagaggaacaatcgccagatgctgccagtcattaggagtaccgctggaggagactcagtgcagatctgcacaaacccgctggacaccttcttcccctttgatccctgtgtgctgaagaggtcaaagaaattcattgatcctatttatcaggtgtgggaagacatgagtgctgaagagctacaggagttcaagaaacccatgaaaaaggacatagtggaagatgaagatgatgactttctgaaaggcgaagtgccccagaatgataccgtgattgggatcacaccaagctcctttgacacgcatttccgaagtccttcaagtagtgtgggctccccacccgtgttgtacatgcaacccagtcccctctgacggcagaaatttgtgactgagatgtgacatttgggattccccatcacttgtcatgccctcagcacccagcttgtgccattgggcattgatggcattgaactagagcgagtgcctgcctcggctgtggcacttccaggttcgactgaatcaagcatctgaagactgggtttttttgttgttgttgttccccttacagacaaaatgaagactatcatgtgcaatcttttacagtggggttgatgatacatttggaaggatttgcttgtttaatatgtacattttttgtgttaacagctttttgacacaattactgggtaatttctaatataggcagcagactgttttacgggttgctgttttaacatgggtttttgtcagatccatggtcttaggacttgactgatgagctttcagtgaagaatcctctaagataaaacttctatttaaagactttaactagaaagtgtttattttggctacattgttcaccttctgctgtattggtatttgtctgttgggatttcaagggagtgtagagaagacagaaggaaagctgagagctggcccgacatggtctgggacacagagttggagctggcactgaagatctccagggacttcagagaccaataaaagcccatagggaagagagagaggatatagggaaacagaatcagatgtgtaatatacttggcacagcgaaaaaatggatttaaaagacaaaaatggaggtccaggtagatgtaattcacacagactgaaagtgagttcgggcttgtgtaaaacacatgagattggatttgaccccttggctctcaagtgtccccttagatctagaactgctccttggtggccattagatcgagtcagttttgatctgcatcacttagttattgggaatttctttgttggaaacaggaaaatttttttagattatttggtgtacggttttgctcacaacaataggtggaagttgctagtgcagtcttggtctgatggctgtgtgcatcgcacattcggcttggtgaaatccttctctaaagcctctttttgtatttttataactaaacagaggaagtcttcagaagacctcgctttaaaacaaatttgtgcaaacactgctagagtcattttgaagctcaagcattttcactttgtttcttacatgtgtacttttttgtttacttgtgaaaatggccatctttaagcatatttattttctgccactttatttaaaggcaagcaatattttcttgatcataaatattttgtaatgaaatacttcctcttttccagggctttgtatgcacttgtataattacattgatggcaatgtagagtttgaatttcagtctgtaaatacttttttggaaaatagaaatttttattgctttaaagttttggatatgggtggttttcttttccgggtttggtggaaagtaatttgagaactttaaggttgtctttttaactgctggcaaaatgttgattttttaatattagataaaacgagtaaacgaaattccccagaaattagtagtaagtggggtctttgtgggttgggaagtagttttaatgtagaaagacatttacatataagtctgtttaatttcaaaggagtttgtgaaaaaaaatccatggtgaaaatgaaacaatgacatggttaatctggaacttacgttcttataccaataaaaggtacctcaatacatgttctttcaa

SEQ ID NO: 16398 - DNA, 581 bp, Homo sapiens
acagaggctgtggctggaaggagctgggcatccggcctgaggcgcagcggtcgcgttagttcggcccaatggcggcaccgctgcttcacacgcgtttgccgggagatgcggccgcttcgtcctctgcagttaagaagctgggcgcgtcgaggactgggatttcaaatatgcgtgcattagagaatgactttttcaattctcccccaagaaaaactgttcggtttggtggaactgtgacagaagtcttgctgaagtacaaaaagctccaccctcatgcagatgataatagtcaagacacctgccgagcgtctgcagggggccgcaattccacccgtcagcggatgataagactcaagacacacttccgagcgatcagctcacatccccattccacccatcagactccaccactcacgcagcatgataaatatcaagaacaccttgcacgagacgatctgcgagagggccgcattccacccgtcagacgggatgagtaatcgtacaagacaccattccgaggcgtcagcatcgacagtcccgcatgtcgcacacatcagcatccacaccatcagaaagaatga

SEQ ID NO: 16399 - DNA, 271 bp, Homo sapiens
caatcagctcggtacctgatttggattctgaagatgatgtgaatgcatcccggcagggtattgaagatgctgaagaaacagcaactcaaacttgtggtgggacagattccacggaaggattgtttaatatggatgaagatgaagaaactgaacatgaaacaaaggctggtcctgaacggctcgaccagatggtgcatcctgtagccgagccgttcaggaccagcctttgtgtcatgttcagtcttcaccttcatcttcagaatccaaatca

SEQ ID NO: 16400 - DNA, 4041 bp, Homo sapiens
acagaggctgtggctggaaggagctgggcatccggcctgaggcgcagcggtcgcgttagttcggcccaatggcggcaccgctgcttcacacgcgtttgccgggagatgcggccgcttcgtcctctgcagttaagaagctgggcgcgtcgaggactgggatttcaaatatgcgtgcattagagaatgactttttcaattctcccccaagaaaaactgttcggtttggtggaactgtgacagaagtcttgctgaagtacaaaaagggtgaaacaaatgactttgagttgttgaagaaccagctgttagatccagacataaaggatgaccagatcatcaactggctgctagaattccgttcttctatcatgtacttgacaaaagactttgagcaacttatcagtattatattaagattgccttggttgaatagaagtcaaacagtagtggaagagtatttggcttttcttggtaatcttgtatcagcacagactgttttcctcagaccgtgtctcagcatgattgcttcccattttgtgcctccccgagtgatcattaaggaaggcgatgtagatgtttcagattctgatgatgaagatgataatcttcctgcaaattttgacacatgtcacagagccttgcaaataatagcaagatatgtaccatcgacaccgtggtttctcatgccaatactggtggaaaaatttccatttgttcgaaaatcagagagaacactggaatgttacgttcataacttactaaggattagtgtatattttccaaccttgaggcatgaaattctggagcttattattgaaaaactactcaagttggatgtgaatgcatcccggcagggtattgaagatgctgaagaaacagcaactcaaacttgtggtgggacagattccacggaaggattgtttaatatggatgaagatgaagaaactgaacatgaaacaaaggctggtcctgaacggctcgaccagatggtgcatcctgtagccgagcgcctggacatcctgatgtctttggttttgtcctacatgaaggatgtctgctatgtagatggtaaggttgataacggcaaaacaaaggatctatatcgcgacctgataaacatctttgacaaactcctgttgcccacccatgcctcctgccatgtacagtttttcatgttttacctctgtagtttcaaattgggattcgcagaggcatttttggaacatctctggaaaaaattgcaggacccaagtaatcctgccatcatcaggcaggctgctggaaattatattggaagctttttggcaagagctaaatttattcctcttattactgtaaaatcatgcctagatcttttggttaactggctgcacatataccttaataaccaggattcgggaacaaaggcattctgcgatgttgctctccatggaccattttactcagcctgccaagctgtgttctacacctttgtttttagacacaagcagcttttgagcggaaacctgaaagaaggtttgcagtatcttcagagtctgaattttgagcggatagtgatgagccagctaaatcccctgaagatttgcctgccctcagtggttaacttttttgctgcaatcacaaataagtaccagctcgtcttctgctacaccatcattgagaggaacaatcgccagatgctgccagtcattaggagtaccgctggaggagactcagtgcagatctgcacaaacccgctggacaccttcttcccctttgatccctgtgtgctgaagaggtcaaagaaattcattgatcctatttatcaggtgtgggaagacatgagtgctgaagagctacaggagttcaagaaacccatgaaaaaggacatagtggaagatgaagatgatgactttctgaaaggcgaagtgccccagaatgataccgtgattgggatcacaccaagctcctttgacacgcatttccgaagtccttcaagtagtgtgggctccccacccgtgttgtacatgcaacccagtcccctctgacggcagaaatttgtgactgagatgtgacatttgggattccccatcacttgtcatgccctcagcacccagcttgtgccattgggcattgatggcattgaactagagcgagtgcctgcctcggctgtggcacttccaggttcgactgaatcaagcatctgaagactgggtttttttgttgttgttgttccccttacagacaaaatgaagactatcatgtgcaatcttttacagtggggttgatgatacatttggaaggatttgcttgtttaatatgtacattttttgtgttaacagctttttgacacaattactgggtaatttctaatataggcagcagactgttttacgggttgctgttttaacatgggtttttgtcagatccatggtcttaggacttgactgatgagctttcagtgaagaatcctctaagataaaacttctatttaaagactttaactagaaagtgtttattttggctacattgttcaccttctgctgtattggtatttgtctgttgggatttcaagggagtgtagagaagacagaaggaaagctgagagctggcccgacatggtctgggacacagagttggagctggcactgaagatctccagggacttcagagaccaataaaagcccatagggaagagagagaggatatagggaaacagaatcagatgtgtaatatacttggcacagcgaaaaaatggatttaaaagacaaaaatggaggtccaggtagatgtaattcacacagactgaaagtgagttcgggcttgtgtaaaacacatgagattggatttgaccccttggctctcaagtgtccccttagatctagaactgctccttggtggccattagatcgagtcagttttgatctgcatcacttagttattgggaatttctttgttggaaacaggaaaatttttttagattatttggtgtacggttttgctcacaacaataggtggaagttgctagtgcagtcttggtctgatggctgtgtgcatcgcacattcggcttggtgaaatccttctctaaagcctctttttgtatttttataactaaacagaggaagtcttcagaagacctcgctttaaaacaaatttgtgcaaacactgctagagtcattttgaagctcaagcattttcactttgtttcttacatgtgtacttttttgtttacttgtgaaaatggccatctttaagcatatttattttctgccactttatttaaaggcaagcaatattttcttgatcataaatattttgtaatgaaatacttcctcttttccagggctttgtatgcacttgtataattacattgatggcaatgtagagtttgaatttcagtctgtaaatacttttttggaaaatagaaatttttattgctttaaagttttggatatgggtggttttcttttccgggtttggtggaaagtaatttgagaactttaaggttgtctttttaactgctggcaaaatgttgattttttaatattagataaaacgagtaaacgaaattccccagaaattagtagtaagtggggtctttgtgggttgggaagtagttttaatgtagaaagacatttacatataagtctgtttaatttcaaaggagtttgtgaaaaaaaatccatggtgaaaatgaaacaatgacatggttaatctggaacttacgttcttataccaataaaaggtacctcaatacatgttctttcaaaaaaaaaaaaaaaaaaaaaaaaaaaaaaaaaaaaaaaaaaaaaaaaaaaaaaaaaaaacaaacaaaagcaaacgaaggaaaaaaccaagaaaacggaacaagcaccatacaaaggaaacaagacgaggtcagccatgataataaagaaagacggacagatcgaacaacaacggaccagcgaacaacgtaagacgacagacggagcaggcgggctcatccagaacgatcgcactaaggaagacacgacaggggaataagtacacctaacaagcgagagaacaaacagagagtaatc

SEQ ID NO: 16401 - DNA, 3685 bp, Homo sapiens
acagaggctgtggctggaaggagctgggcatccggcctgaggcgcagcggtcgcgttagttcggcccaatggcggcaccgctgcttcacacgcgtttgccgggagatgcggccgcttcgtcctctgcagttaagaagctgggcgcgtcgaggactgggatttcaaatatgcgtgcattagagaatgactttttcaattctcccccaagaaaaactgttcggtttggtggaactgtgacagaagtcttgctgaagtacaaaaagggtgaaacaaatgactttgagttgttgaagaaccagctgttagatccagacataaaggatgaccagatcatcaactggctgctagaattccgttcttctatcatgtacttgacaaaagactttgagcaacttatcagtattatattaagattgccttggttgaatagaagtcaaacagtagtggaagagtatttggcttttcttggtaatcttgtatcagcacagactgttttcctcagaccgtgtctcagcatgattgcttcccattttgtgcctccccgagtgatcattaaggaaggcgatgtagatgtttcagattctgatgatgaagatgataatcttcctgcaaattttgacacatgtcacagagccttgcaaataatagcaagatatgtaccatcgacaccgtggtttctcatgccaatactggtggaaaaatttccatttgttcgaaaatcagagagaacactggaatgttacgttcataacttactaaggattagtgtatattttccaaccttgaggcatgaaattctggagcttattattgaaaaactactcaagttggatgtgaatgcatcccggcagggtattgaagatgctgaagaaacagcaactcaaacttgtggtgggacagattccacggaaggattgtttaatatggatgaagatgaagaaactgaacatgaaacaaaggctggtcctgaacggctcgaccagatggtgcatcctgtagccgagcgcctggacatcctgatgtctttggttttgtcctacatgaaggatgtctgctatgtagatggtaaggttgataacggcaaaacaaaggatctatatcgcgacctgataaacatctttgacaaactcctgttgcccacccatgcctcctgccatgtacagtttttcatgttttacctctgtagtttcaaattgggattcgcagaggcatttttggaacatctctggaaaaaattgcaggacccaagtaatcctgccatcatcaggcaggctgctggaaattatattggaagctttttggcaagagctaaatttattcctcttatgattcgggaacaaaggcattctgcgatgttgctctccatggaccattttactcagcctgccaagctgtgttctacacctttgtttttagacacaagcagcttttgagcggaaacctgaaagaaggtttgcagtatcttcagagtctgaattttgagcggatagtgatgagccagctaaatcccctgaagatttgcctgccctcagtggttaacttttttgctgcaatcacaaataagtaccagctcgtcttctgctacaccatcattgagaggaacaatcgccagatgctgccagtcattaggagtaccgctggaggagactcagtgcagatctgcacaaacccgctggacaccttcttcccctttgatccctgtgtgctgaagaggtcaaagaaattcattgatcctatttatcaggtgtgggaagacatgagtgctgaagagctacaggagttcaagaaacccatgaaaaaggacatagtggaagatgaagatgatgactttctgaaaggcgaagtgccccagaatgataccgtgattgggatcacaccaagctcctttgacacgcatttccgaagtccttcaagtagtgtgggctccccacccgtgttgtacatgcaacccagtcccctctgacggcagaaatttgtgactgagatgtgacatttgggattccccatcacttgtcatgccctcagcacccagcttgtgccattgggcattgatggcattgaactagagcgagtgcctgcctcggctgtggcacttccaggttcgactgaatcaagcatctgaagactgggtttttttgttgttgttgttccccttacagacaaaatgaagactatcatgtgcaatcttttacagtggggttgatgatacatttggaaggatttgcttgtttaatatgtacattttttgtgttaacagctttttgacacaattactgggtaatttctaatataggcagcagactgttttacgggttgctgttttaacatgggtttttgtcagatccatggtcttaggacttgactgatgagctttcagtgaagaatcctctaagataaaacttctatttaaagactttaactagaaagtgtttattttggctacattgttcaccttctgctgtattggtatttgtctgttgggatttcaagggagtgtagagaagacagaaggaaagctgagagctggcccgacatggtctgggacacagagttggagctggcactgaagatctccagggacttcagagaccaataaaagcccatagggaagagagagaggatatagggaaacagaatcagatgtgtaatatacttggcacagcgaaaaaatggatttaaaagacaaaaatggaggtccaggtagatgtaattcacacagactgaaagtgagttcgggcttgtgtaaaacacatgagattggatttgaccccttggctctcaagtgtccccttagatctagaactgctccttggtggccattagatcgagtcagttttgatctgcatcacttagttattgggaatttctttgttggaaacaggaaaatttttttagattatttggtgtacggttttgctcacaacaataggtggaagttgctagtgcagtcttggtctgatggctgtgtgcatcgcacattcggcttggtgaaatccttctctaaagcctctttttgtatttttataactaaacagaggaagtcttcagaagacctcgctttaaaacaaatttgtgcaaacactgctagagtcattttgaagctcaagcattttcactttgtttcttacatgtgtacttttttgtttacttgtgaaaatggccatctttaagcatatttattttctgccactttatttaaaggcaagcaatattttcttgatcataaatattttgtaatgaaatacttcctcttttccagggctttgtatgcacttgtataattacattgatggcaatgtagagtttgaatttcagtctgtaaatacttttttggaaaatagaaatttttattgctttaaagttttggatatgggtggttttcttttccgggtttggtggaaagtaatttgagaactttaaggttgtctttttaactgctggcaaaatgttgattttttaatattagataaaacgagtaaacgaaattccccagaaattagtagtaagtggggtctttgtgggttgggaagtagttttaatgtagaaagacatttacatataagtctgtttaatttcaaaggagtttgtgaaaaaaaatccatggtgaaaatgaaacaatgacatggttaatctggaacttacgttcttataccaataaaaggtacctcaatacatgttctttcaa

SEQ ID NO: 16402 - DNA, 3695 bp, Homo sapiens
acagaggctgtggctggaaggagctgggcatccggcctgaggcgcagcggtcgcgttagttcggcccaatggcggcaccgctgcttcacacgcgtttgccgggagatgcggccgcttcgtcctctgcagttaagaagctgggcgcgtcgaggactgggatttcaaatatgcgtgcattagagaatgactttttcaattctcccccaagaaaaactgttcggtttggtggaactgtgacagaagtcttgctgaagtacaaaaagggtgaaacaaatgactttgagttgttgaagaaccagctgttagatccagacataaaggatgaccagatcatcaactggctgctagaattccgttcttctatcatgtacttgacaaaagactttgagcaacttatcagtattatattaagattgccttggttgaatagaagtcaaacagtagtggaagagtatttggcttttcttggtaatcttgtatcagcacagactgttttcctcagaccgtgtctcagcatgattgcttcccattttgtgcctccccgagtgatcattaaggaaggcgatgtagatgtttcagattctgatgatgaagatgataatcttcctgcaaattttgacacatgtcacagagccttgcaaataatagcaagatatgtaccatcgacaccgtggtttctcatgccaatactggtggaaaaatttccatttgttcgaaaatcagagagaacactggaatgttacgttcataacttactaaggattagtgtatattttccaaccttgaggcatgaaattctggagcttattattgaaaaactactcaagttggatgtgaatgcatcccggcagggtattgaagatgctgaagaaacagcaactcaaacttgtggtgggacagattccacggaaggattgtttaatatggatgaagatgaagaaactgaacatgaaacaaaggctggtcctgaacggctcgaccagatggtgcatcctgtagccgagcgcctggacatcctgatgtctttggttttgtcctacatgaaggatgtctgctatgtagatggtaaggttgataacggcaaaacaaaggatctatatcgcgacctgataaacatctttgacaaactcctgttgcccacccatgcctcctgccatgtacagtttttcatgttttacctctgtagtttcaaattgggattcgcagaggcatttttggaacatctctggaaaaaattgcaggacccaagtaatcctgccatcatcaggcaggctgctggaaattatattggaagctttttggcaagagctaaatttattcctcttattactgtaaaatcatgcctagatcttttggttaactggctgcacatataccttaataaccaggattcgggaacaaaggcattctgcgatgttgctctccatggaccattttactcagcctgccaagctgtgttctacacctttgtttttagacacaagcagcttttgagcggaaacctgaaagaaggtttgcagtatcttcagagtctgaattttgagcggatagtgatgagccagctaaatcccctgaagatttgcctgccctcagtggttaacttttttgctgcaatcacaaataagtaccagctcgtcttctgctacaccatcattgagaggaacaatcgccagatgctgccagtcattaggagtaccgctggaggagactcagtgcagatctgcacaaacccgctggacaccttcttcccctttgatccctgtgtgctgaagaggtcaaagaaattcattgatcctatttatcaggtgtgggaagacatgagtgctgaagagctacaggagttcaagaaacccatgaaaaagaatgataccgtgattgggatcacaccaagctcctttgacacgcatttccgaagtccttcaagtagtgtgggctccccacccgtgttgtacatgcaacccagtcccctctgacggcagaaatttgtgactgagatgtgacatttgggattccccatcacttgtcatgccctcagcacccagcttgtgccattgggcattgatggcattgaactagagcgagtgcctgcctcggctgtggcacttccaggttcgactgaatcaagcatctgaagactgggtttttttgttgttgttgttccccttacagacaaaatgaagactatcatgtgcaatcttttacagtggggttgatgatacatttggaaggatttgcttgtttaatatgtacattttttgtgttaacagctttttgacacaattactgggtaatttctaatataggcagcagactgttttacgggttgctgttttaacatgggtttttgtcagatccatggtcttaggacttgactgatgagctttcagtgaagaatcctctaagataaaacttctatttaaagactttaactagaaagtgtttattttggctacattgttcaccttctgctgtattggtatttgtctgttgggatttcaagggagtgtagagaagacagaaggaaagctgagagctggcccgacatggtctgggacacagagttggagctggcactgaagatctccagggacttcagagaccaataaaagcccatagggaagagagagaggatatagggaaacagaatcagatgtgtaatatacttggcacagcgaaaaaatggatttaaaagacaaaaatggaggtccaggtagatgtaattcacacagactgaaagtgagttcgggcttgtgtaaaacacatgagattggatttgaccccttggctctcaagtgtccccttagatctagaactgctccttggtggccattagatcgagtcagttttgatctgcatcacttagttattgggaatttctttgttggaaacaggaaaatttttttagattatttggtgtacggttttgctcacaacaataggtggaagttgctagtgcagtcttggtctgatggctgtgtgcatcgcacattcggcttggtgaaatccttctctaaagcctctttttgtatttttataactaaacagaggaagtcttcagaagacctcgctttaaaacaaatttgtgcaaacactgctagagtcattttgaagctcaagcattttcactttgtttcttacatgtgtacttttttgtttacttgtgaaaatggccatctttaagcatatttattttctgccactttatttaaaggcaagcaatattttcttgatcataaatattttgtaatgaaatacttcctcttttccagggctttgtatgcacttgtataattacattgatggcaatgtagagtttgaatttcagtctgtaaatacttttttggaaaatagaaatttttattgctttaaagttttggatatgggtggttttcttttccgggtttggtggaaagtaatttgagaactttaaggttgtctttttaactgctggcaaaatgttgattttttaatattagataaaacgagtaaacgaaattccccagaaattagtagtaagtggggtctttgtgggttgggaagtagttttaatgtagaaagacatttacatataagtctgtttaatttcaaaggagtttgtgaaaaaaaatccatggtgaaaatgaaacaatgacatggttaatctggaacttacgttcttataccaataaaaggtacctcaatacatgttctttcaa

SEQ ID NO: 16403 - DNA, 3656 bp, Homo sapiens
acagaggctgtggctggaaggagctgggcatccggcctgaggcgcagcggtcgcgttagttcggcccaatggcggcaccgctgcttcacacgcgtttgccgggagatgcggccgcttcgtcctctgcagttaagaagctgggcgcgtcgaggactgggatttcaaatatgcgtgcattagagaatgactttttcaattctcccccaagaaaaactgttcggtttggtggaactgtgacagaagtcttgctgaagtacaaaaagggtgaaacaaatgactttgagttgttgaagaaccagctgttagatccagacataaagagattgccttggttgaatagaagtcaaacagtagtggaagagtatttggcttttcttggtaatcttgtatcagcacagactgttttcctcagaccgtgtctcagcatgattgcttcccattttgtgcctccccgagtgatcattaaggaaggcgatgtagatgtttcagattctgatgatgaagatgataatcttcctgcaaattttgacacatgtcacagagccttgcaaataatagcaagatatgtaccatcgacaccgtggtttctcatgccaatactggtggaaaaatttccatttgttcgaaaatcagagagaacactggaatgttacgttcataacttactaaggattagtgtatattttccaaccttgaggcatgaaattctggagcttattattgaaaaactactcaagttggatgtgaatgcatcccggcagggtattgaagatgctgaagaaacagcaactcaaacttgtggtgggacagattccacggaaggattgtttaatatggatgaagatgaagaaactgaacatgaaacaaaggctggtcctgaacggctcgaccagatggtgcatcctgtagccgagcgcctggacatcctgatgtctttggttttgtcctacatgaaggatgtctgctatgtagatggtaaggttgataacggcaaaacaaaggatctatatcgcgacctgataaacatctttgacaaactcctgttgcccacccatgcctcctgccatgtacagtttttcatgttttacctctgtagtttcaaattgggattcgcagaggcatttttggaacatctctggaaaaaattgcaggacccaagtaatcctgccatcatcaggcaggctgctggaaattatattggaagctttttggcaagagctaaatttattcctcttattactgtaaaatcatgcctagatcttttggttaactggctgcacatataccttaataaccaggattcgggaacaaaggcattctgcgatgttgctctccatggaccattttactcagcctgccaagctgtgttctacacctttgtttttagacacaagcagcttttgagcggaaacctgaaagaaggtttgcagtatcttcagagtctgaattttgagcggatagtgatgagccagctaaatcccctgaagatttgcctgccctcagtggttaacttttttgctgcaatcacaaataagtaccagctcgtcttctgctacaccatcattgagaggaacaatcgccagatgctgccagtcattaggagtaccgctggaggagactcagtgcagatctgcacaaacccgctggacaccttcttcccctttgatccctgtgtgctgaagaggtcaaagaaattcattgatcctatttatcaggtgtgggaagacatgagtgctgaagagctacaggagttcaagaaacccatgaaaaaggacatagtggaagatgaagatgatgactttctgaaaggcgaagtgccccagaatgataccgtgattgggatcacaccaagctcctttgacacgcatttccgaagtccttcaagtagtgtgggctccccacccgtgttgtacatgcaacccagtcccctctgacggcagaaatttgtgactgagatgtgacatttgggattccccatcacttgtcatgccctcagcacccagcttgtgccattgggcattgatggcattgaactagagcgagtgcctgcctcggctgtggcacttccaggttcgactgaatcaagcatctgaagactgggtttttttgttgttgttgttccccttacagacaaaatgaagactatcatgtgcaatcttttacagtggggttgatgatacatttggaaggatttgcttgtttaatatgtacattttttgtgttaacagctttttgacacaattactgggtaatttctaatataggcagcagactgttttacgggttgctgttttaacatgggtttttgtcagatccatggtcttaggacttgactgatgagctttcagtgaagaatcctctaagataaaacttctatttaaagactttaactagaaagtgtttattttggctacattgttcaccttctgctgtattggtatttgtctgttgggatttcaagggagtgtagagaagacagaaggaaagctgagagctggcccgacatggtctgggacacagagttggagctggcactgaagatctccagggacttcagagaccaataaaagcccatagggaagagagagaggatatagggaaacagaatcagatgtgtaatatacttggcacagcgaaaaaatggatttaaaagacaaaaatggaggtccaggtagatgtaattcacacagactgaaagtgagttcgggcttgtgtaaaacacatgagattggatttgaccccttggctctcaagtgtccccttagatctagaactgctccttggtggccattagatcgagtcagttttgatctgcatcacttagttattgggaatttctttgttggaaacaggaaaatttttttagattatttggtgtacggttttgctcacaacaataggtggaagttgctagtgcagtcttggtctgatggctgtgtgcatcgcacattcggcttggtgaaatccttctctaaagcctctttttgtatttttataactaaacagaggaagtcttcagaagacctcgctttaaaacaaatttgtgcaaacactgctagagtcattttgaagctcaagcattttcactttgtttcttacatgtgtacttttttgtttacttgtgaaaatggccatctttaagcatatttattttctgccactttatttaaaggcaagcaatattttcttgatcataaatattttgtaatgaaatacttcctcttttccagggctttgtatgcacttgtataattacattgatggcaatgtagagtttgaatttcagtctgtaaatacttttttggaaaatagaaatttttattgctttaaagttttggatatgggtggttttcttttccgggtttggtggaaagtaatttgagaactttaaggttgtctttttaactgctggcaaaatgttgattttttaatattagataaaacgagtaaacgaaattccccagaaattagtagtaagtggggtctttgtgggttgggaagtagttttaatgtagaaagacatttacatataagtctgtttaatttcaaaggagtttgtgaaaaaaaatccatggtgaaaatgaaacaatgacatggttaatctggaacttacgttcttataccaataaaaggtacctcaatacatgttctttcaa

SEQ ID NO: 16404 - DNA, 3006 bp, Homo sapiens
acagaggctgtggctggaaggagctgggcatccggcctgaggcgcagcggtcgcgttagttcggcccaatggcggcaccgctgcttcacacgcgtttgccgggagatgcggccgcttcgtcctctgcagttaagaagctgggcgcgtcgaggactgggatttcaaatatgcgtgcattagagaatgactttttcaattctcccccaagaaaaactgttcggtttggtggaactgtgacagaagtcttgctgaagtacaaaaagggtgaaacaaatgactttgagttgttgaagaaccagctgttagatccagacataaaggatgaccagatcatcaactggctgctagaattccgttcttctatcatgtacttgacaaaagactttgagcaacttatcagtattatattaagattgccttggttgaatagaagtcaaacagtagtggaagagtatttggcttttcttggtaatcttgtatcagcacagactgttttcctcagaccgtgtctcagcatgattgcttcccattttgtgcctccccgagtgatcattaaggaaggcgatgtagatgtttcagattctgatgatgaagatgataatcttcctgcaaattttgacacatgtcacagagccttgcaaataatagcaagatatgtaccatcgacaccgtggtttctcatgccaatactggtggaaaaatttccatttgttcgaaaatcagagagaacactggaatgttacgttcataacttactaaggattagtgtatattttccaaccttgaggcatgaaattctggagcttattattgaaaaactactcaagttggatgtgaatgcatcccggcagggtattgaagatgctgaagaaacagcaactcaaacttgtggtgggacagattccacggaaggattgtttaatatggatgaagatgaagaaactgaacatgaaacaaaggctggtcctgaacggctcgaccagatggtgcatcctgtagccgagcgcctggacatcctgatgtctttggttttgtcctacatgaaggatgtctgctatgtagatggtgtgggaagacatgagtgctgaagagctacaggagttcaagaaacccatgaaaaaggacatagtggaagatgaagatgatgactttctgaaaggcgaagtgccccagaatgataccgtgattgggatcacaccaagctcctttgacacgcatttccgaagtccttcaagtagtgtgggctccccacccgtgttgtacatgcaacccagtcccctctgacggcagaaatttgtgactgagatgtgacatttgggattccccatcacttgtcatgccctcagcacccagcttgtgccattgggcattgatggcattgaactagagcgagtgcctgcctcggctgtggcacttccaggttcgactgaatcaagcatctgaagactgggtttttttgttgttgttgttccccttacagacaaaatgaagactatcatgtgcaatcttttacagtggggttgatgatacatttggaaggatttgcttgtttaatatgtacattttttgtgttaacagctttttgacacaattactgggtaatttctaatataggcagcagactgttttacgggttgctgttttaacatgggtttttgtcagatccatggtcttaggacttgactgatgagctttcagtgaagaatcctctaagataaaacttctatttaaagactttaactagaaagtgtttattttggctacattgttcaccttctgctgtattggtatttgtctgttgggatttcaagggagtgtagagaagacagaaggaaagctgagagctggcccgacatggtctgggacacagagttggagctggcactgaagatctccagggacttcagagaccaataaaagcccatagggaagagagagaggatatagggaaacagaatcagatgtgtaatatacttggcacagcgaaaaaatggatttaaaagacaaaaatggaggtccaggtagatgtaattcacacagactgaaagtgagttcgggcttgtgtaaaacacatgagattggatttgaccccttggctctcaagtgtccccttagatctagaactgctccttggtggccattagatcgagtcagttttgatctgcatcacttagttattgggaatttctttgttggaaacaggaaaatttttttagattatttggtgtacggttttgctcacaacaataggtggaagttgctagtgcagtcttggtctgatggctgtgtgcatcgcacattcggcttggtgaaatccttctctaaagcctctttttgtatttttataactaaacagaggaagtcttcagaagacctcgctttaaaacaaatttgtgcaaacactgctagagtcattttgaagctcaagcattttcactttgtttcttacatgtgtacttttttgtttacttgtgaaaatggccatctttaagcatatttattttctgccactttatttaaaggcaagcaatattttcttgatcataaatattttgtaatgaaatacttcctcttttccagggctttgtatgcacttgtataattacattgatggcaatgtagagtttgaatttcagtctgtaaatacttttttggaaaatagaaatttttattgctttaaagttttggatatgggtggttttcttttccgggtttggtggaaagtaatttgagaactttaaggttgtctttttaactgctggcaaaatgttgattttttaatattagataaaacgagtaaacgaaattccccagaaattagtagtaagtggggtctttgtgggttgggaagtagttttaatgtagaaagacatttacatataagtctgtttaatttcaaaggagtttgtgaaaaaaaatccatggtgaaaatgaaacaatgacatggttaatctggaacttacgttcttataccaataaaaggtacctcaatacatgttctttcaa

SEQ ID NO: 16405 - DNA, 2450 bp, Homo sapiens
taaagttgacttgaatttttcttttctctagtactgtaaaatcatgcctagatcttttggttaactggctgcacatataccttaataaccaggattcgggaacaaaggcattctgcgatgttgctctccatggaccattttactcagcctgccaagctgtgttctacacctttgtttttagacacaagcagcttttgagcggaaacctgaaagaaggtttgcagtatcttcagagtctgaattttgagcggatagtgatgagccagctaaatcccctgaagatttgcctgccctcagtggttaacttttttgctgcaatcacaaataagtaccagctcgtcttctgctacaccatcattgagaggaacaatcgccagatgctgccagtcattaggagtaccgctggaggagactcagtgcagatctgcacaaacccgctggacaccttcttcccctttgatccctgtgtgctgaagaggtcaaagaaattcattgatcctatttatcaggtgtgggaagacatgagtgctgaagagctacaggagttcaagaaacccatgaaaaaggacatagtggaagatgaagatgatgactttctgaaaggcgaagtgccccagaatgataccgtgattgggatcacaccaagctcctttgacacgcatttccgaagtccttcaagtagtgtgggctccccacccgtgttgtacatgcaacccagtcccctctgacggcagaaatttgtgactgagatgtgacatttgggattccccatcacttgtcatgccctcagcacccagcttgtgccattgggcattgatggcattgaactagagcgagtgcctgcctcggctgtggcacttccaggttcgactgaatcaagcatctgaagactgggtttttttgttgttgttgttccccttacagacaaaatgaagactatcatgtgcaatcttttacagtggggttgatgatacatttggaaggatttgcttgtttaatatgtacattttttgtgttaacagctttttgacacaattactgggtaatttctaatataggcagcagactgttttacgggttgctgttttaacatgggtttttgtcagatccatggtcttaggacttgactgatgagctttcagtgaagaatcctctaagataaaacttctatttaaagactttaactagaaagtgtttattttggctacattgttcaccttctgctgtattggtatttgtctgttgggatttcaagggagtgtagagaagacagaaggaaagctgagagctggcccgacatggtctgggacacagagttggagctggcactgaagatctccagggacttcagagaccaataaaagcccatagggaagagagagaggatatagggaaacagaatcagatgtgtaatatacttggcacagcgaaaaaatggatttaaaagacaaaaatggaggtccaggtagatgtaattcacacagactgaaagtgagttcgggcttgtgtaaaacacatgagattggatttgaccccttggctctcaagtgtccccttagatctagaactgctccttggtggccattagatcgagtcagttttgatctgcatcacttagttattgggaatttctttgttggaaacaggaaaatttttttagattatttggtgtacggttttgctcacaacaataggtggaagttgctagtgcagtcttggtctgatggctgtgtgcatcgcacattcggcttggtgaaatccttctctaaagcctctttttgtatttttataactaaacagaggaagtcttcagaagacctcgctttaaaacaaatttgtgcaaacactgctagagtcattttgaagctcaagcattttcactttgtttcttacatgtgtacttttttgtttacttgtgaaaatggccatctttaagcatatttattttctgccactttatttaaaggcaagcaatattttcttgatcataaatattttgtaatgaaatacttcctcttttccagggctttgtatgcacttgtataattacattgatggcaatgtagagtttgaatttcagtctgtaaatacttttttggaaaatagaaatttttattgctttaaagttttggatatgggtggttttcttttccgggtttggtggaaagtaatttgagaactttaaggttgtctttttaactgctggcaaaatgttgattttttaatattagataaaacgagtaaacgaaattccccagaaattagtagtaagtggggtctttgtgggttgggaagtagttttaatgtagaaagacatttacatataagtctgtttaatttcaaaggagtttgtgaaaaaaaatccatggtgaaaatgaaacaatgacatggttaatctggaacttacgttcttataccaataaaaggtacctcaatacatgttctttcaa

SEQ ID NO: 16406 - DNA, 1703 bp, Homo sapiens
cccacgcgtccgccacgcgtcgcatcacttgtcatgccctcagcacccagcttgtgccattgggcattgatggcattgaactagagcgagtgcctgcctcggctgtggcacttccaggttcgactgaatcaagcatctgaagactgggtttttttgttgttgttgttccccttacagacaaaatgaagactatcatgtgcaatcttttacagtggggttgatgatacatttggaaggatttgcttgtttaatatgtacattttttgtgttaacagctttttgacacaattactgggtaatttctaatataggcagcagactgttttacgggttgctgttttaacatgggtttttgtcagatccatggtcttaggacttgactgatgagctttcagtgaagaatcctctaagataaaacttctatttaaagactttaactagaaagtgtttattttggctacattgttcaccttctgctgtattggtatttgtctgttgggatttcaagggagtgtagagaagacagaaggaaagctgagagctggcccgacatggtctgggacacagagttggagctggcactgaagatctccagggacttcagagaccaataaaagcccatagggaagagagagaggatatagggaaacagaatcagatgtgtaatatacttggcacagcgaaaaaatggatttaaaagacaaaaatggaggtccaggtagatgtaattcacacagactgaaagtgagttcgggcttgtgtaaaacacatgagattggatttgaccccttggctctcaagtgtccccttagatctagaactgctccttggtggccattagatcgagtcagttttgatctgcatcacttagttattgggaatttctttgttggaaacaggaaaatttttttagattatttggtgtacggttttgctcacaacaataggtggaagttgctagtgcagtcttggtctgatggctgtgtgcatcgcacattcggcttggtgaaatccttctctaaagcctctttttgtatttttataactaaacagaggaagtcttcagaagacctcgctttaaaacaaatttgtgcaaacactgctagagtcattttgaagctcaagcattttcactttgtttcttacatgtgtacttttttgtttacttgtgaaaatggccatctttaagcatatttattttctgccactttatttaaaggcaagcaatattttcttgatcataaatattttgtaatgaaatacttcctcttttccagggctttgtatgcacttgtataattacattgatggcaatgtagagtttgaatttcagtctgtaaatacttttttggaaaatagaaatttttattgctttaaagttttggatatgggtggttttcttttccgggtttggtggaaagtaatttgagaactttaaggttgtctttttaactgctggcaaaatgttgattttttaatattagataaaacgagtaaacgaaattccccagaaattagtagtaagtggggtctttgtgggttgggaagtagttttaatgtagaaagacatttacatataagtctgtttaatttcaaaggagtttgtgaaaaaaaatccatggtgaaaatgaaacaatgacatggttaatctggaacttacgttcttataccaataaaaggtacctcaatacatgttctttcaa

SEQ ID NO: 16407 - DNA, 2101 bp, Homo sapiens
caaagtgctgggattacaggcgtgagccaccgcgcccggccaggaggtggatttaaacgtgatacataggcgtgtgccactacactggctttcttttgaaattaagatattttcttcaccatctttacaaacgttaacaccttcctgaggaaggaattgttgaaagcttttcagtcagcactggtgatgttactgatgatttctgatgtttctgcaggacatagtggaagatgaagatgatgactttctgaaaggcgaagtgccccagaatgataccgtgattgggatcacaccaagctcctttgacacgcatttccgaagtccttcaagtagtgtgggctccccacccgtgttgtacatgcaacccagtcccctctgacggcagaaatttgtgactgagatgtgacatttgggattccccatcacttgtcatgccctcagcacccagcttgtgccattgggcattgatggcattgaactagagcgagtgcctgcctcggctgtggcacttccaggttcgactgaatcaagcatctgaagactgggtttttttgttgttgttgttccccttacagacaaaatgaagactatcatgtgcaatcttttacagtggggttgatgatacatttggaaggatttgcttgtttaatatgtacattttttgtgttaacagctttttgacacaattactgggtaatttctaatataggcagcagactgttttacgggttgctgttttaacatgggtttttgtcagatccatggtcttaggacttgactgatgagctttcagtgaagaatcctctaagataaaacttctatttaaagactttaactagaaagtgtttattttggctacattgttcaccttctgctgtattggtatttgtctgttgggatttcaagggagtgtagagaagacagaaggaaagctgagagctggcccgacatggtctgggacacagagttggagctggcactgaagatctccagggacttcagagaccaataaaagcccatagggaagagagagaggatatagggaaacagaatcagatgtgtaatatacttggcacagcgaaaaaatggatttaaaagacaaaaatggaggtccaggtagatgtaattcacacagactgaaagtgagttcgggcttgtgtaaaacacatgagattggatttgaccccttggctctcaagtgtccccttagatctagaactgctccttggtggccattagatcgagtcagttttgatctgcatcacttagttattgggaatttctttgttggaaacaggaaaatttttttagattatttggtgtacggttttgctcacaacaataggtggaagttgctagtgcagtcttggtctgatggctgtgtgcatcgcacattcggcttggtgaaatccttctctaaagcctctttttgtatttttataactaaacagaggaagtcttcagaagacctcgctttaaaacaaatttgtgcaaacactgctagagtcattttgaagctcaagcattttcactttgtttcttacatgtgtacttttttgtttacttgtgaaaatggccatctttaagcatatttattttctgccactttatttaaaggcaagcaatattttcttgatcataaatattttgtaatgaaatacttcctcttttccagggctttgtatgcacttgtataattacattgatggcaatgtagagtttgaatttcagtctgtaaatacttttttggaaaatagaaatttttattgctttaaagttttggatatgggtggttttcttttccgggtttggtggaaagtaatttgagaactttaaggttgtctttttaactgctggcaaaatgttgattttttaatattagataaaacgagtaaacgaaattccccagaaattagtagtaagtggggtctttgtgggttgggaagtagttttaatgtagaaagacatttacatataagtctgtttaatttcaaaggagtttgtgaaaaaaaatccatggtgaaaatgaaacaatgacatggttaatctggaacttacgttcttataccaataaaaggtacctcaatacatgttctttcaa

SEQ ID NO: 16408 - DNA, 2086 bp, Homo sapiens
  misc_feature (140)..(140): n is a, c, g, or t
tagtagtaaacaggtggggactccattgccagcttggtgccttatctactgggcagtcgagttggtgtcttcatgggcagaaataggttgtaaaggtggccaactctccaggtgagagagagttttgtagcaggactttnggttgtaaatcgactattaccaacctactggtgggtgagagttcaagaaacccatgaaaaaggacatagtggaagatgaagatgatgactttctgaaaggcgaagtgccccagaatgataccgtgattgggatcacaccaagctcctttgacacgcatttccgaagtccttcaagtagtgtgggctccccacccgtgttgtacatgcaacccagtcccctctgacggcagaaatttgtgactgagatgtgacatttgggattccccatcacttgtcatgccctcagcacccagcttgtgccattgggcattgatggcattgaactagagcgagtgcctgcctcggctgtggcacttccaggttcgactgaatcaagcatctgaagactgggtttttttgttgttgttgttccccttacagacaaaatgaagactatcatgtgcaatcttttacagtggggttgatgatacatttggaaggatttgcttgtttaatatgtacattttttgtgttaacagctttttgacacaattactgggtaatttctaatataggcagcagactgttttacgggttgctgttttaacatgggtttttgtcagatccatggtcttaggacttgactgatgagctttcagtgaagaatcctctaagataaaacttctatttaaagactttaactagaaagtgtttattttggctacattgttcaccttctgctgtattggtatttgtctgttgggatttcaagggagtgtagagaagacagaaggaaagctgagagctggcccgacatggtctgggacacagagttggagctggcactgaagatctccagggacttcagagaccaataaaagcccatagggaagagagagaggatatagggaaacagaatcagatgtgtaatatacttggcacagcgaaaaaatggatttaaaagacaaaaatggaggtccaggtagatgtaattcacacagactgaaagtgagttcgggcttgtgtaaaacacatgagattggatttgaccccttggctctcaagtgtccccttagatctagaactgctccttggtggccattagatcgagtcagttttgatctgcatcacttagttattgggaatttctttgttggaaacaggaaaatttttttagattatttggtgtacggttttgctcacaacaataggtggaagttgctagtgcagtcttggtctgatggctgtgtgcatcgcacattcggcttggtgaaatccttctctaaagcctctttttgtatttttataactaaacagaggaagtcttcagaagacctcgctttaaaacaaatttgtgcaaacactgctagagtcattttgaagctcaagcattttcactttgtttcttacatgtgtacttttttgtttacttgtgaaaatggccatctttaagcatatttattttctgccactttatttaaaggcaagcaatattttcttgatcataaatattttgtaatgaaatacttcctcttttccagggctttgtatgcacttgtataattacattgatggcaatgtagagtttgaatttcagtctgtaaatacttttttggaaaatagaaatttttattgctttaaagttttggatatgggtggttttcttttccgggtttggtggaaagtaatttgagaactttaaggttgtctttttaactgctggcaaaatgttgattttttaatattagataaaacgagtaaacgaaattccccagaaattagtagtaagtggggtctttgtgggttgggaagtagttttaatgtagaaagacatttacatataagtctgtttaatttcaaaggagtttgtgaaaaaaaatccatggtgaaaatgaaacaatgacatggttaatctggaacttacgttcttataccaataaaaggtacctcaatacatgttctttcaa

SEQ ID NO: 16409 - DNA, 1653 bp, Homo sapiens
  misc_feature (1644)..(1644): n is a, c, g, or t
acagaggctgtggctggaaggagctgggcatccggcctgaggcgcagcggtcgcgttagttcggcccaatggcggcaccgctgcttcacacgcgtttgccgggagatgcggccgcttcgtcctctgcagttaagaagctgggcgcgtcgaggactgggatttcaaatatgcgtgcattagagaatgactttttcaattctcccccaagaaaaactgttcggtttggtggaactgtgacagaagtcttgctgaagtacaaaaagggtgaaacaaatgactttgagttgttgaagaaccagctgttagatccagacataaaggatgaccagatcatcaactggctgctagaattccgttcttctatcatgtacttgacaaaagactttgagcaacttatcagtattatattaagattgccttggttgaatagaagtcaaacagtagtggaagagtatttggcttttcttggtaatcttgtatcagcacagactgttttcctcagaccgtgtctcagcatgattgcttcccattttgtgcctccccgagtgatcattaaggaaggcgatgtagatgtttcagattctgatgatgaagatgataatcttcctgcaaattttgacacatgtcacagagccttgcaaataatagcaagatatgtaccatcgacaccgtggtttctcatgccaatactggtggaaaaatttccatttgttcgaaaatcagagagaacactggaatgttacgttcataacttactaaggattagtgtatattttccaaccttgaggcatgaaattctggagcttattattgaaaaactactcaagttggatgtgaatgcatcccggcagggtattgaagatgctgaagaaacagcaactcaaacttgtggtgggacagattccacggaaggattgtttaatatggatgaagatgaagaaactgaacatgaaacaaaggctggtcctgaacggctcgaccagatggtgcatcctgtagccgagcgcctggacatcctgatgtctttggttttgtcctacatgaaggatgtctgctatgtagatggtaaggttgataacggcaaaacaaaggatctatatcgcgacctgataaacatctttgacaaactcctgttgcccacccatgcctcctgccatgtacagtttttcatgttttacctctgtagtttcaaattggtgagtaagaatgtgattaacattatcttagcttactttgtttttgcccaaaaattttccctaaaaactggggtggacggagaccatgaagtaaataattcttttctttgagcttacttgctagtctgcttaataaaatcgcattctcctttctttttttgttttcttttcctttcttttttgagacacagtctcgctctgctgcccactgctgcaacctccacctcttgggctcaacggactctcagtccttaccctctcgatagctgggaccacaggttaccatgcctggctaatttttgtatttttagaagaggtggggtttcgccacgttggccatactggtcttgaactcctgaccacaagtgatctccgctctgccccaagctggatacagtgtacacttctgccactcctccagtacactgagagaacagctcaggatctntagatacca

SEQ ID NO: 16410 - DNA, 1706 bp, Homo sapiens
acagaggctgtggctggaaggagctgggcatccggcctgaggcgcagcggtcgcgttagttcggcccaatggcggcaccgctgcttcacacgcgtttgccgggagatgcggccgcttcgtcctctgcagttaagaagctgggcgcgtcgaggactgggatttcaaatatgcgtgcattagagaatgactttttcaattctcccccaagaaaaactgttcggtttggtggaactgtgacagaagtcttgctgaagtacaaaaagggtgaaacaaatgactttgagttgttgaagaaccagctgttagatccagacataaaggatgaccagatcatcaactggctgctagaattccgttcttctatcatgtacttgacaaaagactttgagcaacttatcagtattatattaagattgccttggttgaatagaagtcaaacagtagtggaagagtatttggcttttcttggtaatcttgtatcagcacagactgttttcctcagaccgtgtctcagcatgattgcttcccattttgtgcctccccgagtgatcattaaggaaggcgatgtagatgtttcagattctgatgatgaagatgataatcttcctgcaaattttgacacatgtcacagagccttgcaaataatagcaagatatgtaccatcgacaccgtggtttctcatgccaatactggtggaaaaatttccatttgttcgaaaatcagagagaacactggaatgttacgttcataacttactaaggattagtgtatattttccaaccttgaggcatgaaattctggagcttattattgaaaaactactcaagttggatgtgaatgcatcccggcagggtattgaagatgctgaagaaacagcaactcaaacttgtggtgggacagattccacggaaggattgtttaatatggatgaagatgaagaaactgaacatgaaacaaaggctggtcctgaacggctcgaccagatggtgcatcctgtagccgagcgcctggacatcctgatgtctttggttttgtcctacatgaaggatgtctgctatgtagatggtaaggttgataacggcaaaacaaaggatctatatcgcgacctgataaacatctttgacaaactcctgttgcccacccatgcctcctgccatgtacagtttttcatgttttacctctgtagtttcaaattgggattcgcagaggcatttttggaacatctctggaaaaaattgcaggacccaagtaatcctgccatcatcaggcaggctgctggaaattatattggaagctttttggcaagagctaaatttattcctcttatgattcgggaacaaaggcattctgcgatgttgctctccatggaccattttactcagcctgccaagctgtgttctacacctttgtttttagacacaagcagcttttgagcggaaacctgaaagaaggtttgcagtatcttcagagtctgaattttgagcggatagtgatgagccagctaaatcccctgaagatttgcctgccctcagtggttaacttttttgctgcaatcacaaagatgaagacttgtggatatggatggtggtgatggttgcacaacaatatcaatttattttataccactgaaccgtgcacttcaaaatggttaagatggtaaattttatgttgtgtattttaccataataaaaaaaattgtagaggga

SEQ ID NO: 16411 - DNA, 248 bp, Homo sapiens
gctctgatgttgggtgcatatataattgttacgtcttcctgttgaattgacccttttatcattatgtaatgaccttctttgtctcttgtgacagtttttgacttgaagtctttttgtctaatataagaaaagctgcttacgctctgttttggtgaccatttgcatgatatatcttgtttcatcccttcactttcagcctacgtgtgtccttaaagctaaagtgagtcttttgtagacaccctataatt

SEQ ID NO: 16412 - DNA, 700 bp, Homo sapiens
agaatagcctgaacaacagagaccatctctactaaaaaaagcaaacaaaccaacctagccaagcatagtagcatacctactctggaggctgaggcaggagaatcctgagcctaggagtttgaggctgcagtgagctatgattgtaccatttccctccagcctgggtgacaaagtgagaccctgtttcagaaaagaaaaaagatatatcatgcaaatacaagtaaaaaggaagttggtgtagttatactaatatcagataatatggaatttaaggtaagaagcattactacagttaaagacagacatttcataatgataaaatgatcactagggatatagaaagttgtaaatttatatgtaactaatagcatagttttaagttctataacaaatattaaacataaatctgcagtcttagtggaattttacatacctctcaataggtgatagaattaagcagacaaaaaaatcagtaaaaatataaatcatcttactaaaaagcaaacttgacctaactgatatttctataatgttgatatcaactgtgacaaactactcatttttaaaaagccacatggaacatttaccatcttgatcataacctgagtcataaattaagcctcagttaaattttaacacatttaaatcatttacagtatgtgttctcaccatagtggattaagctaaaaaaaaaaaaaaa

SEQ ID NO: 16413 - DNA, 797 bp, Homo sapiens
  misc_feature (360)..(360): n is a, c, g, or t
aaaataataaataatagctgattagggtaatcatttatttaatcagaataaagattatatccataaaatttacttgcagagaagtactttctttttgttttaaagacagggtctcactctgtcacccaagctatggtgcagtggcacaatcacagctcactgcagcctggacctcctggcctcaaggggatgatcctcctacttcaggaattatgccaccatgcccggctagttgagaagtactttcaaatagcaacatgaagcctttcctttaccatttgaaaataaaacatagttgtaaacataaaccagtatgtctttgtaaagccaataatatatcattttataggagcattgtcntcttgtgtttttcaagttgactatgtagttcaatgtcagtctccattttaatatcttgtttgtttatcagcctgagcatatttcattttaaaatgtatttgttgagaagtcatggtggttttttgtttttcacaagtcaagtagcttgaacactatcacttgtccaatgggaaagttgatgcttatctttatggcaaatgcttggttgaataatatatttgcaaagatgttaattctacagagagctaaataaagttaagatacctgtaaaacagtttctccagatgactttaaaataagccttatttttgtaaatttatgttaaattttaggtgttaagttgtgaaatacctaatgatgtgggcctaaatttgcctcattcagactgagacagggctggtaaaattcatttctagctaataaactgtgctataact

SEQ ID NO: 16414 - DNA, 394 bp, Homo sapiens
gccatgacctcttgtgctcaggcagttctccctgcctcagcctccttagtagctggaacccacaggtatgtgcccacccacacccggctaatttttgtatttttttgtagagatgggttttcgctatgttgcccaggctggtctcaaattccctgggctcaaacaatccacccacctctgcctcccaaagtgctgggattacaggtgtgagccaccaagcccagcctagctcctctacctgaacttatttttcattatcctaaagtgataaaatagatcaagaagatcagaacaggcttaaattgatgctataaaaccaattactctgtattatctttgcaactcttttgtaagtctaaaattgtttgaaaataaaagtttattttaaaaatta

SEQ ID NO: 16415 - DNA, 354 bp, Homo sapiens
cttctgcttagccaatagccctgaagatcagcatattatgtgatatggtagaatctgcacctttcacaatgatgaagctaatgataaactattttcattgtactcaattgcaagaaggcatgagaatatgcagtactgtttagaataattttcttatacactggtcaatgtaaaacaaatttttaagtattggtacttgaattaataaaatattagttaaaaagaaagtttaactctccgaaacagtgccctcttgtgggtttcattaactgaagtttgactccagagggaaagaatgaccactccaccctagaattctctgcaccaatttttaaaataataaaaaaattttga

SEQ ID NO: 16416 - DNA, 365 bp, Homo sapiens
gttgatcttcagcccctgggctcaagcagtccttccaccttggtctcccaaagtgctgggattatatgtgtgagccacagcacctggcctcatctatgttttttaatgctgcatagctgaggcccttgagccagatccctggggttcatatttcattactgccactgtgtgagtacgactctggtcatctgttgaacttgttccctcatcagtaaaatgacttttaatacgaatacctgcgtgataagagtttttgtgggaattaaactgtaatacttagaaacgtatagtttagtgtcacatagtaggtgattgataaatttttgcttttttccatgatgtggatgcaatacattgttggacct

SEQ ID NO: 16417 - DNA, 569 bp, Homo sapiens
gtacaccacctgattatttagccacgctgaaatgctggctggggaccctgctggaaggaaggtccctgagaccccactggtcttttctactttgttcttcattacgagtgaagcgggctcaagatcttcccattgtcaccagcacggaaagagccccaagatcttgtggccattctgttttcctcttggactgaattgtcttccgtttgtttcttttttaaggtaagaattgtgacaaaggccagtcttttttcattgacgccccagattccccagccacgttagcctacagaagtataattcagagtaagtatttccatgagtactaaatgcagatgcctgtggggcaggaagcaacataaaggagccaggggtgtggaaggacaggtgggtggtggggtctgtgatgaccacagagtggcccccatagccgaggaagccaggagtccatgagaaatctctcaatgtgtgagtattgtgaattaattcatagtttaaaaaacatggtgagggtgaaatttatggcttaggaaatacatcccaataaagggataaagtaattcattttt

SEQ ID NO: 16418 - DNA, 1237 bp, Homo sapiens
accacgaaggcggcaaaggcgacggaatggaggaggtgcctcacgactgtccaggggccgacagcgcccaggcgggcagaggggcttcatgtcagggatgccccaaccagcggctgtgcgcttctggagcgggggccactccggacacggctatagaggaaatcaaagagaaaatgaagactgtaaaacacaaaatcttggtattgtctgggaaaggcggtgttgggaaaagcacattcagcgcccaccttgcccatggcctagcagaggatgaaaacacacagattgctcttctagacatcgatatatgtgggccatcgattcccaagataatgggattggaaggagagcaggttcaccagagtggctcaggctggtctccagtgtacgtggaagacaacctgggggtgatgtcagtgggcttcctgctcagcagtcctgatgatgctgttatctggaggggacccaagaaaaacggcatgatcaagcagttcctccgagatgtggactggggagaggtcgactacctcattgtggacaccccacctgggacgtcggatgaacacctctcggtcgtccggtacctggccacagcacacatcgatggagcagtgatcatcaccactccccaggaggtgtcactccaggatgtccggaaagaaatcaacttctgccgcaaggtgaagctgcccatcatcggggtggtggagaacatgagtggcttcatctgtcctaagtgcaagaaagaatctcagatattccctcccacaaccgggggcgcggagctcatgtgccaggacttggaggtccctctcctcggcagagtgcccctggatccgctcataggtaagaattgtgacaaaggccagtcttttttcattgacgccccagattccccagccacgttagcctacagaagtataattcagagaatccaagagttttgtaatctccatcagtcaaaagaagagaacctcatcagttcctgaaacgagagaatgttcaggaccaagcagttaccgagcgaggcactcactgggcagcacatccagccagacccgaccagctccgggatggggtgggtcacagcaaaaggaccagatgctggtgtggtccgaagccactttctcagagacactttaatcattgagtatttgtacacttttctttagaacatatataaagggcattctctacaaatgtgccgttttaagaataaaaccccctcaaatctctc

SEQ ID NO: 16419 - DNA, 750 bp, Homo sapiens
ggttcagacatttggtgtatgtgcttggctgaggagccaatggggcaaaggcgacggaatggaggaggtgcctcacgactgtccaggggccgacagcgcccaggcgggcagaggggcttcatgtcagggatgccccaaccagcggctgtgcgcttctggagcgggggccactccggacacggtaaaaaaaaaaaaaaaaaaaaaaaaaaaaaatttttggggggcttgggccctggaaaaggtttcttaagagcccattccggtggggcgcgcgggggcccagaggtgaggggcacgtgggcaaacgggggtcccaagggaagaccggggccaagcagcaaaggcgcggggagttctcccccaatataaaaaaaagcgccgcggggggacaccggagggttctggaacaacaattcgcgaaaggggatacacgggaggaccaaacgggggacctatcaacaagggggtccccaggggagcccgcgaatttcaaatttagcccgagtgtcgtgtgtgacacaagagaacaaaaacaaattaaaacaaaacaaaaaaaagaaagaaaaaaaaaaataaaaaataaaaaataaaaacaaaaacaaaacggcggaggccagggcgcgcccccgcgacggcggggcgccggggcggcgggggcagcccggcgggggcgaggcgcgcgccgcggccaccgcgcgccgccgcgcccggggccgcgggagggggcgggcgggggggcggctctgaaac

SEQ ID NO: 16420 - DNA, 377 bp, Homo sapiens
aagctggatgcatcgcgcagccatgcaggatcgacacctagatggaatccaaagaaatatcaggcacgagggaggtttttgaaaatcatccattcaggttcaaaagaagagaacctcatcagttcctgaaacgagagaatgttcaggaccaagcagttaccgagcgaggcactcactgggcagcacatccagccagacccgaccagctccgggatggggtgggtcacagcaaaaggaccagatgctggtgtggtccgaagccactttctcagagacactttaatcattgagtatttgtacacttttctttagaacatatataaagggcattctctacaaatgtgccgttttaagaataaaaccccctcaaatctctc

SEQ ID NO: 16421 - DNA, 699 bp, Homo sapiens
tgggggattttgtccccaagttggtgaccattgctgtttgcaaagttctcttctggagctgggaatacagcactgaaagcttcagacagttcctacctttgtggagactatgttctagttgggggagacaaacgtgtaaaccaataaatgagaccccttcaagtgtgataatagccttattttcttcctagcacttatttctaccattgtctgagaggtatttcagaggatcgttttaaacagccccaggactagtactaggactaggacttagctctttctagttgactggaagcgtgacattcgaggtttggtgtgggacctcatcccctgaactttggttttctttgcagctatagaggaaatcaaagagaaaatgaagactgtaaaacacaaaatcttggtattgtctgggaaaggcggtgttgggaaaagcacattcagcgcccaccttgcccatggcctagcagaggatgaaaacacacaggtgagacctcaggaaccactgggagatgctcattttgtctgagggtcgtgatggctactaaataactgattcctaggccaggcgcagtggttcatgcctgtaatcccagcactttgggaggccaaggcctaaaattgcaatttttaaattagtacctaagtacctacatatgatccttgattttgcccacaaagcctaataatatatttgct

SEQ ID NO: 16422 - DNA, 1271 bp, Homo sapiens
accacgaaggcggcaaaggcgacggaatggaggaggtgcctcacgactgtccaggggccgacagcgcccaggcgggcagaggggcttcatgtcagggatgccccaaccagcggctgtgcgcttctggagcgggggccactccggacacggctatagaggaaatcaaagagaaaatgaagactgtaaaacacaaaatcttggtattgtctgggaaaggcggtgttgggaaaagcacattcagcgcccaccttgcccatggcctagcagaggatgaaaacacacagattgctcttctagacatcgatatatgtgggccatcgattcccaagataatgggattggaaggagagcaggttcaccagagtggctcaggctggtctccagtgtacgtggaagacaacctgggggtgatgtcagtgggcttcctgctcagcagtcctgatgatgctgttatctggaggggacccaagaaaaacggcatgatcaagcagttcctccgagatgtggactggggagaggtcgactacctcattgtggacaccccacctgggacgtcggatgaacacctctcggtcgtccggtacctggccacagcacacatcgatggagcagtgatcatcaccactccccaggaggtgtcactccaggatgtccggaaagaaatcaacttctgccgcaaggtgaagctgcccatcatcggggtggtggagaacatgagtggcttcatctgtcctaagtgcaagaaagaatctcagatattccctcccacaaccgggggcgcggagctcatgtgccaggacttggaggtccctctcctcggcagagtgcccctggatccgctcataggtaagaattgtgacaaaggccagtcttttttcattgacgccccagattccccagccacgttagcctacagaagtataattcagagaatccaagagttttgtaatctccatcagtcaaaagaagagaacctcatcagttcctgaaacgagagaatgttcaggaccaagcagttaccgagcgaggcactcactgggcagcacatccagccagacccgaccagctccgggatggggtgggtcacagcaaaaggaccagatgctggtgtggtccgaagccactttctcagagacactttaatcattgagtatttgtacacttttctttagaacatatataaagggcattctctacaaatgtgccgttttaagaataaaaccccctcaaatctctcaaaagaatatagagacaaaacaaacaacaaaacg

SEQ ID NO: 16423 - DNA, 1400 bp, Homo sapiens
accacgaaggcggcaaaggcgacggaatggaggaggtgcctcacgactgtccaggggccgacagcgcccaggcgggcagaggggcttcatgtcagggatgccccaaccagcggctgtgcgcttctggagcgggggccactccggacacggctatagaggaaatcaaagagaaaatgaagactgtaaaacacaaaatcttggtattgtctgggaaaggcggtgttgggaaaagcacattcagcgcccaccttgcccatggcctagcagaggatgaaaacacacagattgctcttctagacatcgatatatgtgggccatcgattcccaagataatgggattggaaggagagcaggttcaccagagtggctcaggctggtctccagtgtacgtggaagacaacctgggggtgatgtcagtgggcttcctgctcagcagtcctgatgatgctgttatctggaggggacccaagaaaaacggcatgatcaagcagttcctccgagatgtggactggggagaggtcgactacctcattgtggacaccccacctgggacgtcggatgaacacctctcggtcgtccggtacctggccacagcacacatcgatggagcagtgatcatcaccactccccaggaggtgtcactccaggatgtccggaaagaaatcaacttctgccgcaaggtgaagctgcccatcatcggggtggtggagaacatgagtggcttcatctgtcctaagtgcaagaaagaatctcagatattccctcccacaaccgggggcgcggagctcatgtgccaggacttggaggtccctctcctcggcagagtgcccctggatccgctcataggtaagaattgtgacaaaggccagtcttttttcattgacgccccagattccccagccacgttagcctacagaagtataattcagagaatccaagagttttgtaatctccatcagtcaaaagaagagaacctcatcagttcctgaaacgagagaatgttcaggaccaagcagttaccgagcgaggcactcactgggcagcacatccagccagacccgaccagctccgggatggggtgggtcacagcaaaaggaccagatgctggtgtggtccgaagccactttctcagagacactttaatcattgagtatttgtacacttttctttagaacatatataaagggcattctctacaaatgtgccgttttaagaataaaaccccctcaaatctctcccccgaggcctgtttcacgtaaaaaacaaatgggttgtgggatcgtgggattctgctgtgtcggaagcttagtcgattgtagaaactcccgtttaagccatttctgcctgtgaagataagaaagcctaatgctggtgaatctccagcccctcgaggccaggct

SEQ ID NO: 16424 - DNA, 1087 bp, Homo sapiens
accacgaaggcggcaaaggcgacggaatggaggaggtgcctcacgactgtccaggggccgacagcgcccaggcgggcagaggggcttcatgtcagggatgccccaaccagcggctgtgcgcttctggagcgggggccactccggacacggctatagaggaaatcaaagagaaaatgaagactgtaaaacacaaaatcttggtattgtctgggaaaggcggtgttgggaaaagcacattcagcgcccaccttgcccatggcctagcagaggatgaaaacacacagattgctcttctagacatcgatatatgtgggccatcgattcccaagataatgggattggaaggagagcaggttcaccagagtggctcaggctggtctccagtgtacgtggaagacaacctgggggtgatgtcagtgggcttcctgctcagcagtcctgatgatgctgttatctggaggggacccaagaaaaacggcatgatcaagcagttcctccgagatgtggactggggagaggtcgactacctcattgtggacaccccacctgggacgtcggatgaacacctctcggtcgtccggtacctggccacagcacacatcgatggagcagtgatcatcaccactccccaggaggtgtcactccaggatgtccggaaagaaatcaacttctgccgcaaggtgaagctgcccatcatcggggtggtggagaacatgagtggcttcatctgtcctaagtgcaagaaagaatctcagatattccctcccacaaccgggggcgcggagctcatgtgccaggacttggaggtccctctcctcggcagagtgcccctggatccgctcataggtaagaattgtgacaaaggccagtcttttttcattgacgccccagattccccagccacgttagcctacagaagtataattcagagaatccaagagttttgtaatctccatcagtcaaaagaagagaacctcatcagttcctgaaacgagagaatgttcaggaccaagcagttaccgagcgaggcactcactggggtactggcccgcacatccgtactggcccgcacatccgtactggcccg

SEQ ID NO: 16425 - DNA, 1082 bp, Homo sapiens
accacgaaggcggcaaaggcgacggaatggaggaggtgcctcacgactgtccaggggccgacagcgcccaggcgggcagaggggcttcatgtcagggatgccccaaccagcggctgtgcgcttctggagcgggggccactccggacacggctatagaggaaatcaaagagaaaatgaagactgtaaaacacaaaatcttggtattgtctgggaaaggcggtgttgggaaaagcacattcagcgcccaccttgcccatggcctagcagaggatgaaaacacacagattgctcttctagacatcgatatatgtgggccatcgattcccaagataatgggattggaaggagagcaggttcaccagagtggctcaggctggtctccagtgtacgtggaagacaacctgggggtgatgtcagtgggcttcctgctcagcagtcctgatgatgctgttatctggaggggacccaagaaaaacggcatgatcaagcagttcctccgagatgtggactggggagaggtcgactacctcattgtggacaccccacctgggacgtcggatgaacacctctcggtcgtccggtacctggccacagcacacatcgatggagcagtgatcatcaccactccccaggaggtgtcactccaggatgtccggaaagaaatcaacttctgccgcaaggtgaagctgcccatcatcggggtggtggagaacatgagtggcttcatctgtcctaagtgcaagaaagaatctcagatattccctcccacaaccgggggcgcggagctcatgtgccaggacttggaggtccctctcctcggcagagtgcccctggatccgctcataggtaagaattgtgacaaaggccagtcttttttcattgacgccccagattccccagccacgttagcctacagaagtataattcagagaatccaagagttttgtaatctccatcagtcaaaagaagagaacctcatcagttcctgaaacgagagaatgttcaggaccaagcagttaccgagcgaggcactcactgggccccgagggtcccgcgtgaccctcatagtaggtagggacagt

SEQ ID NO: 16426 - DNA, 1182 bp, Homo sapiens
accacgaaggcggcaaaggcgacggaatggaggaggtgcctcacgactgtccaggggccgacagcgcccaggcgggcagaggggcttcatgtcagggatgccccaaccagcggctgtgcgcttctggagcgggggccactccggacacgggtctgggaaaggcggtgttgggaaaagcacattcagcgcccaccttgcccatggcctagcagaggatgaaaacacacagattgctcttctagacatcgatatatgtgggccatcgattcccaagataatgggattggaaggagagcaggttcaccagagtggctcaggctggtctccagtgtacgtggaagacaacctgggggtgatgtcagtgggcttcctgctcagcagtcctgatgatgctgttatctggaggggacccaagaaaaacggcatgatcaagcagttcctccgagatgtggactggggagaggtcgactacctcattgtggacaccccacctgggacgtcggatgaacacctctcggtcgtccggtacctggccacagcacacatcgatggagcagtgatcatcaccactccccaggaggtgtcactccaggatgtccggaaagaaatcaacttctgccgcaaggtgaagctgcccatcatcggggtggtggagaacatgagtggcttcatctgtcctaagtgcaagaaagaatctcagatattccctcccacaaccgggggcgcggagctcatgtgccaggacttggaggtccctctcctcggcagagtgcccctggatccgctcataggtaagaattgtgacaaaggccagtcttttttcattgacgccccagattccccagccacgttagcctacagaagtataattcagagaatccaagagttttgtaatctccatcagtcaaaagaagagaacctcatcagttcctgaaacgagagaatgttcaggaccaagcagttaccgagcgaggcactcactgggcagcacatccagccagacccgaccagctccgggatggggtgggtcacagcaaaaggaccagatgctggtgtggtccgaagccactttctcagagacactttaatcattgagtatttgtacacttttctttagaacatatataaagggcattctctacaaatgtgccgttttaagaataaaaccccctcaaatctctc

SEQ ID NO: 16427 - DNA, 1168 bp, Homo sapiens
accacgaaggcggcaaaggcgacggaatggaggaggtgcctcacgactgtccaggggccgacagcgcccaggcgggcagaggggcttcatgtcagggatgccccaaccagcggctgtgcgcttctggagcgggggccactccggacacggctatagaggaaatcaaagagaaaatgaagactgtaaaacacaaaatcttggtattgtctgggaaaggcggtgttgggaaaagcacattcagcgcccaccttgcccatggcctagcagaggatgaaaacacacaggttcaccagagtggctcaggctggtctccagtgtacgtggaagacaacctgggggtgatgtcagtgggcttcctgctcagcagtcctgatgatgctgttatctggaggggacccaagaaaaacggcatgatcaagcagttcctccgagatgtggactggggagaggtcgactacctcattgtggacaccccacctgggacgtcggatgaacacctctcggtcgtccggtacctggccacagcacacatcgatggagcagtgatcatcaccactccccaggaggtgtcactccaggatgtccggaaagaaatcaacttctgccgcaaggtgaagctgcccatcatcggggtggtggagaacatgagtggcttcatctgtcctaagtgcaagaaagaatctcagatattccctcccacaaccgggggcgcggagctcatgtgccaggacttggaggtccctctcctcggcagagtgcccctggatccgctcataggtaagaattgtgacaaaggccagtcttttttcattgacgccccagattccccagccacgttagcctacagaagtataattcagagaatccaagagttttgtaatctccatcagtcaaaagaagagaacctcatcagttcctgaaacgagagaatgttcaggaccaagcagttaccgagcgaggcactcactgggcagcacatccagccagacccgaccagctccgggatggggtgggtcacagcaaaaggaccagatgctggtgtggtccgaagccactttctcagagacactttaatcattgagtatttgtacacttttctttagaacatatataaagggcattctctacaaatgtgccgttttaagaataaaaccccctcaaatctctc

SEQ ID NO: 16428 - DNA, 1236 bp, Homo sapiens
ggttcagacatttggtgtatgtgcttggctgaggagccaatggggcaaaggcgacggaatggaggaggtgcctcacgactgtccaggggccgacagcgcccaggcgggcagaggggcttcatgtcagggatgccccaaccagcggctgtgcgcttctggagcgggggccactccggacacggctatagaggaaatcaaagagaaaatgaagactgtaaaacacaaaatcttggtattgtctgggaaaggcggtgttgggaaaagcacattcagcgcccaccttgcccatggcctagcagaggatgaaaacacacagattgctcttctagacatcgatatatgtgggccatcgattcccaagataatgggattggaaggagagcagtacgtggaagacaacctgggggtgatgtcagtgggcttcctgctcagcagtcctgatgatgctgttatctggaggggacccaagaaaaacggcatgatcaagcagttcctccgagatgtggactggggagaggtcgactacctcattgtggacaccccacctgggacgtcggatgaacacctctcggtcgtccggtacctggccacagcacacatcgatggagcagtgatcatcaccactccccaggaggtgtcactccaggatgtccggaaagaaatcaacttctgccgcaaggtgaagctgcccatcatcggggtggtggagaacatgagtggcttcatctgtcctaagtgcaagaaagaatctcagatattccctcccacaaccgggggcgcggagctcatgtgccaggacttggaggtccctctcctcggcagagtgcccctggatccgctcataggtaagaattgtgacaaaggccagtcttttttcattgacgccccagattccccagccacgttagcctacagaagtataattcagagaatccaagagttttgtaatctccatcagtcaaaagaagagaacctcatcagttcctgaaacgagagaatgttcaggaccaagcagttaccgagcgaggcactcactgggcagcacatccagccagacccgaccagctccgggatggggtgggtcacagcaaaaggaccagatgctggtgtggtccgaagccactttctcagagacactttaatcattgagtatttgtacacttttctttagaacatatataaagggcattctctacaaatgtgccgttttaagaataaaaccccctcaaatctctc

SEQ ID NO: 16429 - DNA, 1193 bp, Homo sapiens
accacgaaggcggcaaaggcgacggaatggaggaggtgcctcacgactgtccaggggccgacagcgcccaggcgggcagaggggcttcatgtcagggatgccccaaccagcggctgtgcgcttctggagcgggggccactccggacacggctatagaggaaatcaaagagaaaatgaagactgtaaaacacaaaatcttggtattgtctgggaaaggcggtgttgggaaaagcacattcagcgcccaccttgcccatggcctagcagaggatgaaaacacacagattgctcttctagacatcgatatatgtgggccatcgattcccaagataatgggattggaaggagagcaggttcaccagagtggctcaggctggtctccagtgtacgtggaagacaacctgggggtgatgtcagtgggcttcctgctcagcagtcctgatgatgctgttatctggaggggacccaagaaaaacggcatgatcaagcagttcctccgagatgtggactggggagaggtcgactacctcattgtggacaccccacctgggacgtcggatgaacacctctcggtcgtccggtacctggccacagcacacatcgatggagcagtgatcatcaccactccccaggaggtgtcactccaggatgtccggaaagaaatcaacttctgccgcaaggtgaagctgcccatcatcggggtggtggagaacatgagtggcttcatctgtcctaagtgcaagaaagaatctcagatattccctcccacaaccgggggcgcggagctcatgtgccaggacttggaggtccctctcctcggcagagtgcccctggatccgctcataggtaagaattgtgacaaaggccagtcttttttcattgacgccccagattccccagccacgttagcctacagaagtataattcagagtaagtatttccatgagtactaaatgcagatgcctgtggggcaggaagcaacataaaggagccaggggtgtggaaggacaggtgggtggtggggtctgtgatgaccacagagtggcccccatagccgaggaagccaggagtccatgagaaatctctcaatgtgtgagtattgtgaattaattcatagtttaaaaaacatggtgagggtgaaatttatggcttaggaaatacatcccaataaagggataaagtaattcattttt

SEQ ID NO: 16430 - DNA, 1153 bp, Homo sapiens
accacgaaggcggcaaaggcgacggaatggaggaggtgcctcacgactgtccaggggccgacagcgcccaggcgggcagaggggcttcatgtcagggatgccccaaccagcggctgtgcgcttctggagcgggggccactccggacacggctatagaggaaatcaaagagaaaatgaagactgtaaaacacaaaatcttggtattgtctgggaaaggcggtgttgggaaaagcacattcagcgcccaccttgcccatggcctagcagaggatgaaaacacacagattgctcttctagacatcgatatatgtgggccatcgattcccaagataatgggattggaaggagagcaggttcaccagagtggctcaggctggtctccagtgtacgtggaagacaacctgggggtgatgtcagtgggcttcctgctcagcagtcctgatgatgctgttatctggaggggacccaagaaaaacggcatgatcaagcagttcctccgagatgtggactggggagaggtcgactacctcattgtggacaccccacctgggacgtcggatgaacacctctcggtcgtccggtacctggccacagcacacatcgatggagcagtgatcatcaccactccccaggaggtgtcactccaggatgtccggaaagaaatcaacttctgccgcaaggtgaagctgcccatcatcggggtggtggagaacatgagtggcttcatctgtcctaagtgcaagaaagaatctcagatattccctcccacaaccgggggcgcggagctcatgtgccaggacttggaggtccctctcctcggcagagtgcccctggatccgctcataggaatccaagagttttgtaatctccatcagtcaaaagaagagaacctcatcagttcctgaaacgagagaatgttcaggaccaagcagttaccgagcgaggcactcactgggcagcacatccagccagacccgaccagctccgggatggggtgggtcacagcaaaaggaccagatgctggtgtggtccgaagccactttctcagagacactttaatcattgagtatttgtacacttttctttagaacatatataaagggcattctctacaaatgtgccgttttaagaataaaaccccctcaaatctctc

SEQ ID NO: 16431 - DNA, 1051 bp, Homo sapiens
accacgaaggcggcaaaggcgacggaatggaggaggtgcctcacgactgtccaggggccgacagcgcccaggcgggcagaggggcttcatgtcagggatgccccaaccagcggctgtgcgcttctggagcgggggccactccggacacggctatagaggaaatcaaagagaaaatgaagactgtaaaacacaaaatcttggtattgtctgggaaaggcggtgttgggaaaagcacattcagcgcccaccttgcccatggcctagcagaggatgaaaacacacagattgctcttctagacatcgatatatgtgggccatcgattcccaagataatgggattggaaggagagcaggttcaccagagtggctcaggctggtctccagtgtacgtggaagacaacctgggggtgatgtcagtgggcttcctgctcagcagtcctgatgatgctgttatctggaggggacccaagaaaaacggcatgatcaagcagttcctccgagatgtggactggggagaggtcgactacctcattgtggacaccccacctgggacgtcggatgaacacctctcggtcgtccggtacctggccacagcacacatcgatggagcagtgatcatcaccactccccaggaggtgtcactccaggatgtccggaaagaaatcaacttctgccgcaaggtgaagctgcccatcatcggggtggtggagaacatgagtggcttcatctgtcctaagtgcaagaaagaatctcagatattccctcccacaaccgggggcgcggagctcatgtgccaggacttggaggtccctctcctcggcagagtgcccctggatccgctcataggaatccaagagttttgtaatctccatcagtcaaaagaagagaacctcatcagttcctgaaacgagagaatgttcaggaccaagcagttaccgagcgaggcactcactggggctgcccacgaagtggctgccccaagtgttcaggtttactgagagcattaggggcaacaagggagccctgggcatctggggacaaggcctggcat

SEQ ID NO: 16432 - DNA, 782 bp, Homo sapiens
accacgaaggcggcaaaggcgacggaatggaggaggtgcctcacgactgtccaggggccgacagcgcccaggcgggcagaggggcttcatgtcagggatgccccaaccagcggctgtgcgcttctggagcgggggccactccggacacggctatagaggaaatcaaagagaaaatgaagactgtaaaacacaaaatcttggtattgtctgggaaaggcggtgttgggaaaactgcccatcatcggggtggtggagaacatgagtggcttcatctgtcctaagtgcaagaaagaatctcagatattccctcccacaaccgggggcgcggagctcatgtgccaggacttggaggtccctctcctcggcagagtgcccctggatccgctcataggtaagaattgtgacaaaggccagtcttttttcattgacgccccagattccccagccacgttagcctacagaagtataattcagagaatccaagagttttgtaatctccatcagtcaaaagaagagaacctcatcagttcctgaaacgagagaatgttcaggaccaagcagttaccgagcgaggcactcactgggcagcacatccagccagacccgaccagctccgggatggggtgggtcacagcaaaaggaccagatgctggtgtggtccgaagccactttctcagagacactttaatcattgagtatttgtacacttttctttagaacatatataaagggcattctctacaaatgtgccgttttaagaataaaaccccctcaaatctctc

SEQ ID NO: 16433 - DNA, 1102 bp, Homo sapiens
accacgaaggcggcaaaggcgacggaatggaggaggtgcctcacgactgtccaggggccgacagcgcccaggcgggcagaggggcttcatgtcagggatgccccaaccagcggctgtgcgcttctggagcgggggccactccggacacggctatagaggaaatcaaagagaaaatgaagactgtaaaacacaaaatcttggtattgtctgggaaaggcggtgttgggaaaagcacattcagcgcccaccttgcccatggcctagcagaggatgaaaacacacagattgctcttctagacatcgatatatgtgggccatcgattcccaagataatgggattggaaggagagcaggttcaccagagtggctcaggctggtctccagtgtacgtggaagacaacctgggggtgatgtcagtgggcttcctgctcagcagtcctgatgatgctgttatctggaggggacccaagaaaaacggcatgatcaagcagttcctccgagatgtggactggggagaggtcgactacctcattgtggacaccccacctgggacgtcggatgaacacctctcggtcgtccggtacctggccacagcacacatcgatggagcagtgatcatcaccactccccaggaggtgtcactccaggatgtccggaaagaaatcaacttctgccgcaaggtgaagctgcccatcatcggggtggtggagaacatgagtggcttcatctgtcctaagtgcaagattgacgccccagattccccagccacgttagcctacagaagtataattcagagaatccaagagttttgtaatctccatcagtcaaaagaagagaacctcatcagttcctgaaacgagagaatgttcaggaccaagcagttaccgagcgaggcactcactgggcagcacatccagccagacccgaccagctccgggatggggtgggtcacagcaaaaggaccagatgctggtgtggtccgaagccactttctcagagacactttaatcattgagtatttgtacacttttctttagaacatatataaagggcattctctacaaatgtgccgttttaagaataaaaccccctcaaatctctc

SEQ ID NO: 16434 - DNA, 512 bp, Homo sapiens
cctgcccgagtgccatgctcgtctcagtcactagctaggagcagcctgggagtggcattgcctcaacacaaacgtggtggtggattttggagcatggcagctgctgccagagatccaagaggtaagaattgtgacaaaggccagtcttttttcattgacgccccagattccccagccacgttagcctacagaagtataattcagagaatccaagagttttgtaatctccatcagtcaaaagaagagaacctcatcagttcctgaaacgagagaatgttcaggaccaagcagttaccgagcgaggcactcactgggcagcacatccagccagacccgaccagctccgggatggggtgggtcacagcaaaaggaccagatgctggtgtggtccgaagccactttctcagagacactttaatcattgagtatttgtacacttttctttagaacatatataaagggcattctctacaaatgtgccgttttaagaataaaaccccctcaaatctctc

SEQ ID NO: 16435 - DNA, 786 bp, Homo sapiens
accacgaaggcggcaaaggcgacggaatggaggaggtgcctcacgactgtccaggggccgacagcgcccaggcgggcagaggggcttcatgtcagggatgccccaaccagcggctgtgcgcttctggagcgggggccactccggacacggctatagaggaaatcaaagagaaaatgaagactgtaaaacacaaaatcttggtattgtctgggaaaggcggtgttgggaaaagcacattcagcgcccaccttgcccatggcctagcagaggatgaaaacacacagattgctcttctagacatcgatatatgtgggccatcgattcccaagataatgggattggaaggagagcaggttcaccagagtggctcaggctggtctccagtgtacgtggaagacaacctgggggtgatgtcagtgggcttcctgctcagcagtcctgatgatgctgttatctggaggggacccaagaaaaacggcatgatcaagcagttcctccgagctgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagagaactagtgctgagggcctcaataaagtttgtgtttatgcc

SEQ ID NO: 16436 - DNA, 685 bp, Homo sapiens
accacgaaggcggcaaaggcgacggaatggaggaggtgcctcacgactgtccaggggccgacagcgcccaggcgggcagaggggcttcatgtcagggatgccccaaccagcggctgtgcgcttctggagcgggggccactccggacacggctatagaggaaatcaaagagaaaatgaagactgtaaaacacaaaatcttggtattgtctgggaaaggcggtgttgggaaaagcacattcagcgcccaccttgcccatggcctagcagaggatgaaaacacacagattgctcttctagacatcgatatatgtgggccatcgattcccaagataatgggattggaaggagagcaggtaatagccggttacagaactcaggaaattattctcttaaggcaaactctgtagcactgaactgtcaaacctcaacaaagaggcatgcggagcccataaatgtttttttgttgttgttttgttttgttgtttttgagacaaggtctcactcttgtcgcccgggctggagtgcaagcgagactttttctcaaaaaaaaagctatagaaccctgaaattatttttatcatggttttatagtggcttatttgggtcagagaggtgagatcaacaggaggttgatctggtactgagacttaaggtaataatgtgaaagtgttatcagggcaagctt

SEQ ID NO: 16437 - DNA, 388 bp, Homo sapiens
taagtttctttaaaatgtggtccatccttgtgattctgcaaaaaaattatgtttcctcccctttgaatttgccttgcagaaagaatctcagatattccctcccacaaccgggggcgcggagctcatgtgccaggacttggaggtccctctcctcggcagagtgcccctggatccgctcataggtgggtgaccccagtgtggggcagcacctcactcctcggtcagccccacaggcacgggtcgggcacaacagggggcggctacagagaggggcaatggaaggaggagggtcaatggggcgctggagccagacccaccctccagctggcaccccaagaggccaccgggagagaggccgagacccctgcgggcaggtagcgggagcaag

SEQ ID NO: 16438 - DNA, 209 bp, Homo sapiens
aaccttttaacctttgtccttgcactttacaatctaaagatctacctgtggctctcagacttcctcacacttgggttttagaaataacttgtaaagcagactggacccaaggccgccttcagtgtcaagaagggcattgtgacttgcccctcaatttctgtccattgaagtctggttttccatgaggaacttgcgggctcacccacccc

SEQ ID NO: 16439 - DNA, 351 bp, Homo sapiens
gtcggtaggcccagtagtcaactcctaactaatagagtagttattagctggttagttgtctgcagctaagcaggaatgggactggatggtggggactcctgtgagaatgctgatgggtgccgcctcctcacctgtgtgtcgcaggtgtaggcgatacctgggaagccgttgtacggggctggcatttgctacttttataagatgtcacaagcatgacccaggagcacaccccatgagagtcacagtggtaccagcacctgctggctgctctctgcactgatgacagctgttagggaatcacattcgagactttaactagattggtccagagtgcttcactcttcttcttta

SEQ ID NO: 16440 - DNA, 159 bp, Homo sapiens
tcagatgcaattaaatataacagaacactgtgctggtcaaatggactatatatgtatatatgtgtgtgtgtgtatagaggtatgaactaatatatatgtatgaaatacatatatacacacacacttatatgtgagggagtagtggaggagggaagaaag

SEQ ID NO: 16441 - DNA, 596 bp, Homo sapiens
ggacttgagcatgggtagggtggcttcagagtggtagtctggctgtttgtttgtaatcaccaaaatgaagctacagtgatgtttcagtttacataacagagtcctgaggcttaaagatgccaggaaattaatttaaagatattgtagtacgtatccctgtccagactagaactccagtccaggagaacgccagtgctccttctgtttcacatagagaacacatcagtactgtgacacacagaaaggttttagtgggatgcttggttaagagaaatacgtttacaacaaaagaggtgatactgttgcttgtcttagaaaaatatgggagacctcaatcagctgaagttcaacatgttcaaaggtggacaaagtttctcgttgctctaagtaagtttaaaattgagccaaaaaggtcttgattgataagggtggctgatacatttttgaatgttttcactggcatgattcacaaaattgtataaattgtatagtcccaggctatcccaccattaactgcctcatggggactgtctctaacttccccaggacttgatccatagggaaatgcttgcaagaataaaaagcattaatgaatt

SEQ ID NO: 16442 - DNA, 556 bp, Homo sapiens
cagatgaaaatcatatgaagacacagcatcatgtcaggcaatagagacaaaagcatcaacctttcgggatcatttgatggattaaacaggaaaaccaaaaatctccaagtgagaagaccttacttgtcttctgaaagtctgaaaagctgggatacatgaagactgccatcccttgagtcacttgccctgtagctgccactgttggaaaagggcttgcttctgtgtccttgtgcccactttgaaaatccctgggaagtccttggagtcagatgagcaggcctccgccactctgccaaaaagtctgttcacttgatgaacacctgttttcgaagtcctgaatctgtagtcataagattcagccctgtttccttccaaatcttgacttcatattcaaactagagaataaaaatttaaaaacaggcccttgtgcctaggatgtagaaaaaattactaattgttttcctatgtcccacgtaaaataccaaacagtttttaaccattatgaaaatgtatcgtaagacagcttcaaaataaagtattttcatgtaagtttaaa

SEQ ID NO: 16443 - DNA, 477 bp, Homo sapiens
  misc_feature (97)..(97): n is a, c, g, or t
ccaacagctgggagaagctgagtcccatcagccattcaaaagactgcagccccagccaagagtttgatgtaacctcaggagagaccctgagccaganccacctagaaaagctgggatacatgaagactgccatcccttgagtcacttgccctgtagctgccactgttggaaaagggcttgcttctgtgtccttgtgcccactttgaaaatccctgggaagtccttggagtcagatgagcaggcctccgccactctgccaaaaagtctgttcaggtatttttcctctggaaatgagctgactaggcacgctacttctacttgaaaaagactgatgcttgtcttacaccattttgaggtcaccacagtacatgactcagaatcattagacaaatgttgattgaatatctcctacattccaaatactgtgttgaatgtggttaaagcattaaatgttaatggaatattttgtacagtcaa

SEQ ID NO: 16444 - DNA, 739 bp, Homo sapiens
  misc_feature (97)..(97): n is a, c, g, or t
ccaacagctgggagaagctgagtcccatcagccattcaaaagactgcagccccagccaagagtttgatgtaacctcaggagagaccctgagccaganccacctagaaaagctgggatacatgaagactgccatcccttgagtcacttgccctgtagctgccactgttggaaaagggcttgcttctgtgtccttgtgcccactttgaaaatccctgggaagtccttggagtcagatgagcaggcctccgccactctgccaaaaagtctgttcacaggaagtttcacatcactagagaagagagaagaaggacatttgtactgggaggagtcgaccggtcccagtaaggagaaagtagctacagcgtcatgggtgagctgggtcccccaaaaaggaactttaagggaatggactgaatcaagtctgagatgtccccaaagcaagaccaaagaactgaggaagagaagcattcatcagaaaccaaaattcagctacaagtgagcatccagatggaggtattatgaagaggaactgagactgagggcaaaaggtgccagccagaatcctggataggagagcaagaaccaggacctcatttaagagacaacctgcttaaggcagagtaagcacaaatgggcactcaacatcaatgaagtaacagcaaagtcacataataaaagcatggaattaagacaagctgaagattcggatgcaataaaacaaccacccattattaaaaaa

SEQ ID NO: 16445 - DNA, 530 bp, Homo sapiens
  misc_feature (97)..(97): n is a, c, g, or t
ccaacagctgggagaagctgagtcccatcagccattcaaaagactgcagccccagccaagagtttgatgtaacctcaggagagaccctgagccaganccacctagaaaagctgggatacatgaagactgccatcccttgagtcacttgccctgtagctgccactgttggaaaagggcttgcttctgtgtccttgtgcccactttgaaaatccctgggaagtccttggagtcagatgagcaggcctccgccactctgccaaaaagtctgttcaatcaggagtccccaacccctgagccatggactgatatggagctatggtctgttaggaactgggctgcccaggaggagcaatggtgcttctacaatttccttataggaggagtgaagagtaagcatttggattggaccaggatttggagaacttgtcatgttgctctacgtgcatatgaaatacatcattgtaacttagaatgtgaattacagaacaaacatgaaagttagaaaaatattctaaacatatttttatgat

SEQ ID NO: 16446 - DNA, 553 bp, Homo sapiens
  misc_feature (97)..(97): n is a, c, g, or t
ccaacagctgggagaagctgagtcccatcagccattcaaaagactgcagccccagccaagagtttgatgtaacctcaggagagaccctgagccaganccacctagaaaagctgggatacatgaagactgccatcccttgagtcacttgccctgtagctgccactgttggaaaagggcttgcttctgtgtccttgtgcccactttgaaaatccctgggaagtccttggagtcagatgagcaggcctccgccactctgccaaaaagtctgttcaaaaaatatgggagacctcaatcagctgaagttcaacatgttcaaaggtggacaaagtttctcgttgctctaagtaagtttaaaattgagccaaaaaggtcttgattgataagggtggctgatacatttttgaatgttttcactggcatgattcacaaaattgtataaattgtatagtcccaggctatcccaccattaactgcctcatggggactgtctctaacttccccaggacttgatccatagggaaatgcttgcaagaataaaaagcattaatgaatt

SEQ ID NO: 16447 - DNA, 549 bp, Homo sapiens
  misc_feature (97)..(97): n is a, c, g, or t
ccaacagctgggagaagctgagtcccatcagccattcaaaagactgcagccccagccaagagtttgatgtaacctcaggagagaccctgagccaganccacctagaaaagctgggatacatgaagactgccatcccttgagtcacttgccctgtagctgccactgttggaaaagggcttgcttctgtgtccttgtgcccactttgaaaatccctgggaagtccttggagtcagatgagcaggcctccgccactctgccaaaaagtctgttcaaaaaatatgggagacctcaatcagctgaagttcaacatgttcaaaggtggacaaagtttctcgttgctctaaggtatttttcctctggaaatgagctgactaggcacgctacttctacttgaaaaagactgatgcttgtcttacaccattttgaggtcaccacagtacatgactcagaatcattagacaaatgttgattgaatatctcctacattccaaatactgtgttgaatgtggttaaagcattaaatgttaatggaatattttgtacagtcaa

SEQ ID NO: 16448 - DNA, 308 bp, Homo sapiens
taatgtaagcattaacaactaagactttcataaaagcactgtatcttaactttcctggcctaaatcaaaaaaaggaaaacattgataagtgtcctagaaacttggattcttttatagatttgttcttggggctctgatgtttgggattgacgttctgtgctgaccattttatatgcattttatcttaatagtatgtgctttcatgaagattctgatacaagtgggcaatccttaaattatctttgaaaaattggttaattttggttaaaaaagggaaagtggctgggtgcagtggctcacgcctgtaa

SEQ ID NO: 16449 - DNA, 414 bp, Homo sapiens
agtaagcaactgaatatgtttacagtgcttggtgctggctgtctgcctcctatacgcattgccttggctgaagaaagtcaccatatgcaagtcaatccccttctaggaggtccacatcgcgtgttaattgatggaagggggtgttaaataggcccagtgccctagtcccaacccgtgacacttctaaaagatcatcccaggtgcagaacacccctatggttggctgaggcccgcactatgattgcacctccgttcggtaattctcttgtcccaaatctgcttcttttccttcccttccatttcataagaaaactctgctaaaccttcacattcaccttcatctcaaagtatgctttttgggaaattcaccttgcagcagaagcctagtagaaatattaaagatagatttgtgta

SEQ ID NO: 16450 - DNA, 1224 bp, Homo sapiens
gtatttttttgtagagatgagggttttgccatgttgtccaggctggtctcaaactcctgggctcaagcagtcctccacctgggccccccagagtgttgggattacagatgtgagccaccttacccagcctacctaaaacctttcagtctcttttctaaactccagaaaagagaagactctgaaaagctgaaatctgtgggggctgtagaaggttctaggattgatgtggtatttgacatttgtatagaaaaaattgccaatttcttttttttccttatggtaattctggataccagtttaataattttggagatatttaaaactgtcaatatgaggaataattcatacatgtgtacttttttcctacaaatgagtaattgaagaattttgtttagccagaccatttaattctcatcaattgcatatttctagttaaatccgaacttcattctatattaagtaacattttattcagatccatatctaaatagcaatattttgtgagatttactaagaatttttcctggtatgtatggttttggtgtattggaatgtacctctgttgactctgtgcttaaaaatgtaaagcaagtagctacttccatgaatcctcaaaatgccagttaaatgggcatagagttaagtggaaggtgattaaaagaaatagggaaacctactttctaactcgttgagggcaagagaacttctatggtcatcttttgtgtcaaatctttagtatatagtatttggctcatgccaggaggaccttattcaataaaggctgataatattgaaattggactttcttaaaaaatgttttaaaacttaccatttaaaaagccttctttaatatataatctaaaagttggggaggagtataattgaaggaaattatccaaattagatttttctgctttgccaaggatatgccatcaagaaacaatttttggggctatctttttatggtgatgaggtatgtgatacaatttggagaattctgaatttataaaaagaatacaatcgaaaattggcattgcttgtcttttgacaatcttgcagtaagctctaggcggtggccgtgacttagtttctgtgaataattggcaggttaagggtagaaaactcatttgaagattgatagcagtatcgttctttgcgtaatttaaaaacaggattagtagctggagcaacatggcaagaacctacttttccaaaaaaaaaaaa

SEQ ID NO: 16451 - DNA, 423 bp, Homo sapiens
  misc_feature (3)..(3): n is a, c, g, or t
  misc_feature (6)..(6): n is a, c, g, or t
  misc_feature (69)..(69): n is a, c, g, or t
ggncantaggtttttattatttattattattgtttgttttgagatgcaatcttgctctgtcacccaggntggtgtgcactgggcaacaagagctagactctatctcaatacaacaacacgtttattaataacagaagagaaactaggtgctgaagggacagtgggcagggaggggaggagagagcccagactgcagaatgaatcggagtgggcagaggggcatctccgcccacagggacagggaactcacaatggctctcacacagtctcagctgtgctgcttggggagccagtgtgctctcagagatccatccagacccattatcagagtggtttcttctcaggaacaccatgactcagaaagtcttttcagggctggaatgatggccaggtattatggaggccattaaaaattatttaatt

SEQ ID NO: 16452 - DNA, 566 bp, Homo sapiens
gaggaaactgaggctcagaaggataaaggaactctgagtttgtaagtggcacagccaggacttgaacctgaatcagtctgatccccagaagcaaggctcttagccacaatgcctgctgcagtcggccagctctgcatccctccataactcttccacactttccaatcccaagtctttgtacctggcatctcccttacctttttccatccagtaaccttggtgttttctcctcagtggacccttcttggccctgagccacatttgtggccctctctttggtgctcctgtaagttggcccttgtcccactgagtggtcaaaacctagtaacatgtccctctcctccacctctgtattcccagggcttggcaaatagtaagcacccaataactctgttaaatacatttgccttgaatatattctacctgatatctcagctcaagggaagtttgtgaatttcaagggaagtgtgttaatcagtatcacataaccaatttagtggttttcaatggagtaactgaagttacttgaaaagttttttttaattaaattaaattaattaattaat

SEQ ID NO: 16453 - DNA, 434 bp, Homo sapiens
catttgcaaaatagtaataaataaatatcagtgtccagcactgtgtctgggccatagtacgtgttcagtaaattatatgtctaatgttccattattggaacgctaagcatgtgggagttatttatatcctactgctcgggtcatcaccagggtctgatttttcacacgtgtctgcaattcaaaaaattgcaacctctggcataaatgggttaatgttattccttttctcatgctctcccagaatgtgacagggcttccgagggaaacactataccatggaagaaccggcagagtgtccttaaggccccggcaggagtcagggtcattatgtgctggagccaccatatttggtgaaaaggacttattcccaggcctgacccagcaggatcacctatgaaattggtttcttaggagattcctggctcttttctttg

SEQ ID NO: 16454 - DNA, 300 bp, Homo sapiens
ctctcccccacacctcaaagtagccacacctcctagggtcccctggcttagtgaatggaccactctcatcctgctgagcaggttagtaacctgggggtcaacctggacaccttccttctcatccccatgttccttgtatcacaaagttctcccctaattcctaagaatctagaatgcctccctggaacctctatgtctttggccggccatcttggtctgagcacccatcatctcttccctgcatcagtacaatgtcctactgacaggtcatttccacgtactctggccttctccaattca

SEQ ID NO: 16455 - DNA, 400 bp, Homo sapiens
aacacaccctcatgtcctcatcttaacctaatctcttctttaaaggtcctatctctaaatacagtcacattctcagataatgggggtagggcttcaacatatgaattttggagggatgcagtttcgcccataacaggataatttttttgttttgttttgttttgagacaagagcctgggcgacagagcaagactccatctcaaaaaaaaaaaaaaaaaaaaaaggaaatatgtgtggtatgatatgagtaagtttaaaagagatatgagtaagtttaaaagtccccacacagctgggcatggtggttcttgcctggagtcccagtctttgggaggctgaggattgcttgagctcaggaattccagcacagcctgggcagcatagtaagactatggctctc

SEQ ID NO: 16456 - DNA, 362 bp, Homo sapiens
gtcatagctcgctatagcctcaagctcctgggctcaagcaatctttctgccttagcctcctgagtagctgggactacaagcagacgccatcataccctgctaattttaaaattttattgtagatatgggggtctccctatgttccccaggctggtcttgaactcctgggctcatgtgatcctcttgcctgagcctcccaaagtgctgggattacaagtgtgagctgccatatctggcgttactgtgatttttattaaaaaatttgattgtggtaaagtatatgtaataaaatttacttattttaactatttttaagtatatacttcagtggcattaaatacaccttgttgtgcaaccatcac

SEQ ID NO: 16457 - DNA, 438 bp, Homo sapiens
atggctgtgtgctgtcttctggttctggagctcgagctaagtgagctctgcatgtttgagcttcctaggaatctggtcattatgactgataggtgccaggactcatgctgaaggtactccagtaagaaaagcacggtattatgggagcccaggaaaggggccactgactagaggcttccagggagatgtttgattcctgaatcttgaaagctgagttggtgttagctgggtgaaaggaagaagggagggctttgcagccagtgggaactgcaggaacagaaaggtgagaaacgtttgaggtgtgaaagagagcattattctagggctgttactacccatgtccagaagcttacgacttggaaaggtggagtggttgcctcgggattacgcctgggccaggctgggaggggctttgtgtgctaggccaagcagcttgaa

SEQ ID NO: 16458 - DNA, 492 bp, Homo sapiens
agggcagcccccactttcctacaaaatggagggagccatcccttccctgtccacctcaccaggggtgctatgacatgcaagtgagaagctgggcatgaacgcactttataaaagcaaaagctctgtgtaaatctaactacaaggacaatgccttgggagagattttgtcgggacagagaggagttgccagggaagaaggtttgaaagatacggttgtctagaggtgagaccaaaggatccagagacttggggaccagaggtgacagtggatgacgtgaagccacaggagccccacccccatgcagcctcttccccacccccccccaccacgcgctcaatcatgagtacctcaaaggattgttgggcttgggggaaaagaggtggattcctgggcaagaacctaaagtagcaggactcggaattctcgggaaattattatgactcaataaaagaattcacaccttaggtgtgggagtaagaacaaaaaaaact

SEQ ID NO: 16459 - DNA, 525 bp, Homo sapiens
gaagggcccaaagagttctcccaaaggagaactctcccatgacgccaaggttgcctcctcagccatgtcccttgtggcttcacctattatcccagctgttggccagcttggttgcctttccatctgtgaccccctcctccactgccttcttcctcactgtgcctgacttccccatccacacagcattttgtaccgaagccgaccgatgccacagcgcaggcccctgaggggcgctttgctgtgcaggctccagcctctcctgcatctgcttggcaaagtgaggtccacctccttgggtttttgcctctttctaaacaccacctgcaaactgcctccccgcaaaggaaagtagcagggacttgtcctccccagggcactgcacacaggctcgaagcctggtcgggaggctctttggtcaggctggaaagagctttgacaagacagagtggcccctgctgggctggggtgtgctggggagagtcccttttcctctgactcctgaactcatcaggcaacagtacagga

SEQ ID NO: 16460 - DNA, 858 bp, Homo sapiens
attccctgccaggcggcagcatcctcacgactgctgtgagtgtccccaggtctccagctgtgcagtgtgagggagctcttggaccagagcccctgctgcctcattacccagatgcacagccccggcgtcacaccggcctcccgagccccgtgttaactgcagaagaaattagccagactcaggcgctgggagcaggtcagctggccgccggcacctgtgagattgtgaccttggaccgggacagcagccagcctcggaggacgatcgcccggcagaccgcccgctgtgcgtgtagaaaggggcagatcgccggcaccacgagagcccggcccgcctgtgtggacgcaagaatcatcaagaccaagcagtggtgtgacatgcttccgtgtctggagggggaaggctgcgacttgttaatcaaccggtcaggctggacgtgcacgcagcccggcggagcggagagggcggccgtggtggaggcctccaccccaggagcaccccgcgcaccctcggaggacgggcttcggctgcgcggaggccgtggcacacctgcgggaggcagcgacggcccccacgcagacgccgggaacgcaggccgctttattcctctgtacttagatcaacttgaccgtactaaaatccctttctgttttaaccagttaaacatgcctcttctacagctccatttttgatagttggataatccagtatctgccaagagcatgttgggtctcccgtgactgctgcctcatcgataccccatttagctccagaaagcaaagaaaactcgagtaacacttgtttgaaagagatcattaaatgtattttgcaaagcctaaagttatatatttaacagtt

SEQ ID NO: 16461 - DNA, 1521 bp, Homo sapiens
gcatgtacaggctgggtggttaatcggccgaggggcggatggagggcgcgagcgggcggccgcggaggctgcacccggcggggcgctgatgcggcgcctggaccttcgctgcgcgacttcgggggcgtcggccgagttgggactccgcgatgcagctcctgaaggcgctctgggcactggcaggggccgcgctctgctgcttcctcgtcctagtgatccacgcgcagttcctcaaagaaggtcagctggccgccggcacctgtgagattgtgaccttggaccgggacagcagccagcctcggaggacgatcgcccggcagaccgcccgctgtgcgtgtagaaaggggcagatcgccggcaccacgagagcccggcccgcctgtgtggacgcaagaatcatcaagaccaagcagtggtgtgacatgcttccgtgtctggagggggaaggctgcgacttgttaatcaaccggtcaggctggacgtgcacgcagcccggcgggaggataaagaccaccacggtctcctgacaaacacagcccctgaggggccccgggagtggccttggctccctggagagcccacgtctcagccacagttctccactcgcctcggacttcacccgttctctgccgcccgcccactccgtttccctgtggtccgtgaaggacggcctcaggccttggcatcctgagcttcggtctgtccagccgacccgaggaggccggactcagacacataggcggggggcggcacctggcatcagcaatacgcagtctgtgggagcccggccgcgcccagcccccgccgaccgtggcgttggccctgctgtcctcagaggaggaggaggaggaggcagctccggcagccacagaaggctgcagcccagcccgcctgagacacgacgcctgccccaggggactgtcaggcacagaagcggcctcctcccgtgccccagactgtccgaattgcttttattttcttatactttcagtatactccatagaccaaagagcaaaatctatctgaacctggacgcaccctcactgtcagggtccctggggtcgcttgtgcgggcgggagggcaatggtggcagagacatgctggtggccccggcggagcggagagggcggccgtggtggaggcctccaccccaggagcaccccgcgcaccctcggaggacgggcttcggctgcgcggaggccgtggcacacctgcgggaggcagcgacggcccccacgcagacgccgggaacgcaggccgctttattcctctgtacttagatcaacttgaccgtactaaaatccctttctgttttaaccagttaaacatgcctcttctacagctccatttttgatagttggataatccagtatctgccaagagcatgttgggtctcccgtgactgctgcctcatcgataccccatttagctccagaaagcaaagaaaactcgagtaacacttgtttgaaagagatcattaaatgtattttgcaaagcctaaagttatatatttaacagtt

SEQ ID NO: 16462 - DNA, 1125 bp, Homo sapiens
gcatgtacaggctgggtggttaatcggccgaggggcggatggagggcgcgagcgggcggccgcggaggctgcacccggcggggcgctgatgcggcgcctggaccttcgctgcgcgacttcgggggcgtcggccgagttgggactccgcgatgcagctcctgaaggcgctctgggcactggcaggggccgcgctctgctgcttcctcgtcctagtgatccacgcgcagttcctcaaagaaggtcagctggccgccggcacctgtgagattgtgaccttggaccgggacagcagccagcctcggaggacgatcgcccggcagaccgcccgctgtgcgtgtagaaaggggcagatcgccggcaccacgagagcccggcccgcctgtgtggacgcaagaatcatcaagaccaagcagtggtgtgacatgcttccgtgtctggagggggaaggctgcgacttgttaatcaaccggtcaggctggacgtgcacgcagcccggcgggaggataaagaccaccacggtctcctgacaaacacagcccctgaggggccccgggagtggccttggctccctggagagcccacgtctcagccacagttctccactcgcctcggacttcacccgttctctgccgcccgcccactccgtttccctgtggtccgtgaaggacggcctcaggccttggcatcctgagcttcggtctgtccagccgacccgaggaggccggactcagacacataggcggggggcggcacctggcatcacaccccgcgcaccctcggaggacgggcttcggctgcgcggaggccgtggcacacctgcgggaggcagcgacggcccccacgcagacgccgggaacgcaggccgctttattcctctgtacttagatcaacttgaccgtactaaaatccctttctgttttaaccagttaaacatgcctcttctacagctccatttttgatagttggataatccagtatctgccaagagcatgttgggtctcccgtgactgctgcctcatcgataccccatttagctccagaaagcaaagaaaactcgagtaacacttgtttgaaagagatcattaaatgtattttgcaaagcctaaagttatatatttaacagtt

SEQ ID NO: 16463 - DNA, 903 bp, Homo sapiens
gcatgtacaggctgggtggttaatcggccgaggggcggatggagggcgcgagcgggcggccgcggaggctgcacccggcggggcgctgatgcggcgcctggaccttcgctgcgcgacttcgggggcgtcggccgagttgggactccgcgatgcagctcctgaaggcgctctgggcactggcaggggccgcgctctgctgcttcctcgtcctagtgatccacgcgcagttcctcaaagaaggtcagctggccgccggcacctgtgagattgtgaccttggaccgggacagcagccagcctcggaggacgatcgcccggcagaccgcccgctgtgcgtgtagaaaggggcagatcgccggcaccacgagagcccggcccgcctgtgtggacgcaagaatcatcaagaccaagcagtggtgtgacatgcttccgtgtctggagggggaaggctgcgacttgttaatcaaccggtcaggctggacgtgcacgcagcccggcggagcggagagggcggccgtggtggaggcctccaccccaggagcaccccgcgcaccctcggaggacgggcttcggctgcgcggaggccgtggcacacctgcgggaggcagcgacggcccccacgcagacgccgggaacgcaggccgctttattcctctgtacttagatcaacttgaccgtactaaaatccctttctgttttaaccagttaaacatgcctcttctacagctccatttttgatagttggataatccagtatctgccaagagcatgttgggtctcccgtgactgctgcctcatcgataccccatttagctccagaaagcaaagaaaactcgagtaacacttgtttgaaagagatcattaaatgtattttgcaaagcctaaagttatatatttaacagtt

SEQ ID NO: 16464 - DNA, 1511 bp, Homo sapiens
ggcggcggcggcggaggatggcgcgcgcggggcccgcacgtggaggccggcgcgggggcgcgggcagggccggctgctgagacgcgctgctgccccccgcgcgggcgccgcggcttcaatggcgccatcgcccaggaccggcagccggcaagatgcgaccgccctgcccagcatgtcctcaactttctgggcgttcatgatcctggccagcctgctcatcgcctactgcagtcagctggccgccggcacctgtgagattgtgaccttggaccgggacagcagccagcctcggaggacgatcgcccggcagaccgcccgctgtgcgtgtagaaaggggcagatcgccggcaccacgagagcccggcccgcctgtgtggacgcaagaatcatcaagaccaagcagtggtgtgacatgcttccgtgtctggagggggaaggctgcgacttgttaatcaaccggtcaggctggacgtgcacgcagcccggcgggaggataaagaccaccacggtctcctgacaaacacagcccctgaggggccccgggagtggccttggctccctggagagcccacgtctcagccacagttctccactcgcctcggacttcacccgttctctgccgcccgcccactccgtttccctgtggtccgtgaaggacggcctcaggccttggcatcctgagcttcggtctgtccagccgacccgaggaggccggactcagacacataggcggggggcggcacctggcatcagcaatacgcagtctgtgggagcccggccgcgcccagcccccgccgaccgtggcgttggccctgctgtcctcagaggaggaggaggaggaggcagctccggcagccacagaaggctgcagcccagcccgcctgagacacgacgcctgccccaggggactgtcaggcacagaagcggcctcctcccgtgccccagactgtccgaattgcttttattttcttatactttcagtatactccatagaccaaagagcaaaatctatctgaacctggacgcaccctcactgtcagggtccctggggtcgcttgtgcgggcgggagggcaatggtggcagagacatgctggtggccccggcggagcggagagggcggccgtggtggaggcctccaccccaggagcaccccgcgcaccctcggaggacgggcttcggctgcgcggaggccgtggcacacctgcgggaggcagcgacggcccccacgcagacgccgggaacgcaggccgctttattcctctgtacttagatcaacttgaccgtactaaaatccctttctgttttaaccagttaaacatgcctcttctacagctccatttttgatagttggataatccagtatctgccaagagcatgttgggtctcccgtgactgctgcctcatcgataccccatttagctccagaaagcaaagaaaactcgagtaacacttgtttgaaagagatcattaaatgtattttgcaaagcctaaagttatatatttaacagtt

SEQ ID NO: 16465 - DNA, 1476 bp, Homo sapiens
attccctgccaggcggcagcatcctcacgactgctgtgagtgtccccaggtctccagctgtgcagtgtgagggagctcttggaccagagcccctgctgcctcattacccagatgcacagccccggcgtcacaccggcctcccgagccccgtgttaactgcagaagaaattagccagactcaggcgctgggagcaggtcagctggccgccggcacctgtgagattgtgaccttggaccgggacagcagccagcctcggaggacgatcgcccggcagaccgcccgctgtgcgtgtagaaaggggcagatcgccggcaccacgagagcccggcccgcctgtgtggacgcaagaatcatcaagaccaagcagtggtgtgacatgcttccgtgtctggagggggaaggctgcgacttgttaatcaaccggtcaggctggacgtgcacgcagcccggcgggaggataaagaccaccacggtctcctgacaaacacagcccctgaggggccccgggagtggccttggctccctggagagcccacgtctcagccacagttctccactcgcctcggacttcacccgttctctgccgcccgcccactccgtttccctgtggtccgtgaaggacggcctcaggccttggcatcctgagcttcggtctgtccagccgacccgaggaggccggactcagacacataggcggggggcggcacctggcatcagcaatacgcagtctgtgggagcccggccgcgcccagcccccgccgaccgtggcgttggccctgctgtcctcagaggaggaggaggaggaggcagctccggcagccacagaaggctgcagcccagcccgcctgagacacgacgcctgccccaggggactgtcaggcacagaagcggcctcctcccgtgccccagactgtccgaattgcttttattttcttatactttcagtatactccatagaccaaagagcaaaatctatctgaacctggacgcaccctcactgtcagggtccctggggtcgcttgtgcgggcgggagggcaatggtggcagagacatgctggtggccccggcggagcggagagggcggccgtggtggaggcctccaccccaggagcaccccgcgcaccctcggaggacgggcttcggctgcgcggaggccgtggcacacctgcgggaggcagcgacggcccccacgcagacgccgggaacgcaggccgctttattcctctgtacttagatcaacttgaccgtactaaaatccctttctgttttaaccagttaaacatgcctcttctacagctccatttttgatagttggataatccagtatctgccaagagcatgttgggtctcccgtgactgctgcctcatcgataccccatttagctccagaaagcaaagaaaactcgagtaacacttgtttgaaagagatcattaaatgtattttgcaaagcctaaagttatatatttaacagtt

SEQ ID NO: 16466 - DNA, 1411 bp, Homo sapiens
aacgactctagaggcgtgggtccaaaagggactacaagatgcacttcctgaacgctctatgggcactgggaggggccctgctctgctgcttactaactctaacgatacacgcgcagaacatcaaacaacgtcagcttggcaccagcagatgggagatggccacctctgacacccacagccttcagacggtgacgacgattgcttcgcataccgtccgatgtgcgtgtagaaatgagtggatcaggctggaccatgacagcctggtcctcatgtgtggactcaagaatcatcaagaccaagcagtggtgtgacatgcttccgtgtctggagggggaaggctgcgacttgttaatcaaccggtcaggctggacgtgcacgcagcccggcgggaggataaagaccaccacggtctcctgacaaacacagcccctgaggggccccgggagtggccttggctccctggagagcccacgtctcagccacagttctccactcgcctcggacttcacccgttctctgccgcccgcccactccgtttccctgtggtccgtgaaggacggcctcaggccttggcatcctgagcttcggtctgtccagccgacccgaggaggccggactcagacacataggcggggggcggcacctggcatcagcaatacgcagtctgtgggagcccggccgcgcccagcccccgccgaccgtggcgttggccctgctgtcctcagaggaggaggaggaggaggcagctccggcagccacagaaggctgcagcccagcccgcctgagacacgacgcctgccccaggggactgtcaggcacagaagcggcctcctcccgtgccccagactgtccgaattgcttttattttcttatactttcagtatactccatagaccaaagagcaaaatctatctgaacctggacgcaccctcactgtcagggtccctggggtcgcttgtgcgggcgggagggcaatggtggcagagacatgctggtggccccggcggagcggagagggcggccgtggtggaggcctccaccccaggagcaccccgcgcaccctcggaggacgggcttcggctgcgcggaggccgtggcacacctgcgggaggcagcgacggcccccacgcagacgccgggaacgcaggccgctttattcctctgtacttagatcaacttgaccgtactaaaatccctttctgttttaaccagttaaacatgcctcttctacagctccatttttgatagttggataatccagtatctgccaagagcatgttgggtctcccgtgactgctgcctcatcgataccccatttagctccagaaagcaaagaaaactcgagtaacacttgtttgaaagagatcattaaatgtattttgcaaagcctaaagttatatatttaacagtt

SEQ ID NO: 16467 - DNA, 1137 bp, Homo sapiens
gtgtagtaaatttaagcttatttttcatgtgggattcttcttggatgaccaactctggactaccagaaaaaaaaaattttaagttctgtgacttttctgagatactagaacaaaagaagaattaatcttcatctttctcaagaaatagatgttgacaaagaatcacttagcgattctgacatatcaattcccctatcttgaaatgaggtcactgtatgtaaatgatggaattatatcactccatttccaagggtagattttctataagtaaatatctcggaatttgtgtgcttgttttctgaatatatacagttgttttctttaaagatctcttggaattttgcctgttctgtgtgaaataaagtgttttaatgtgcattataggtatgatatagagaatctcctttccatccttgttactaaagggactggacaaataaatcttaaaaccaaaatactgaattaattttgcaagcatggctagtttttaggaagcatgctatcaaaaaaaaaaagactaaaaatgactgaaaaaatccaactgttttatatatatataaatatatatatatttatatatatatataaaggatattctgtaaagttatatgttgtttgacagtaaagccatcaatatttttgctatcaaaatagtataatactagtatctttttgtatgaaaatgtaatctttatataaataatacctctgatatttgcaactgcataatcgttcagtaattcaaaaagacatactagaatcctttttctgaaagtgttccttcaatttgcttttgttgaaaacggtagtccaggacctatgatatccctccacttcattcattatgaaagaaatcccttgtagataaacaagatattggcatctgcatgtaattatccccagattcagctgaaaactcccaacacagatggaattggctagacattttaatatatgtgatacctatatctagatatagaaggctgagagtgagcactggatataattcattttgattgaaattgatatggtgttattgttcttccagttgtctgtcctttgtgtatgttcttatttatatgttgatacactgtaacactatatgctattgctaaataaaattgattgagaaattca

SEQ ID NO: 16468 - DNA, 471 bp, Homo sapiens
gaggatgggaactgatggtagctaggaaggaaagcgtcaagaaggacctgaatgtacccagcttttctcgccaaacttcaataccacctcaggaaaaggcccactgtgtccaggggcgtcagtccagctcaatagtgtctagcttttcagaatcttctgattgtttggtctttaacaaaaacatagcatctatttgctaacaataaacttaagcaacatatgataatcatttcatctccttccaagaagtggtgaaaatgaaccaggtgacattaatttaacttctgtttttgtttatttttaatacaaccaaaaagatatgcacatattttaatttacattatggtactgtataatttaaaccataaactggtgctgattaatttctgcaacaaagcagcatattaaatgtactacatctagtgttgtagcaaaattaataaacttgttttaagttctgagacactttcc

SEQ ID NO: 16469 - DNA, 418 bp, Homo sapiens
tcaataacaatgtattatatttttgaaaattgcgaagagagtaagtattctcaccacaagaaatgatgagaacctgagatactgcatatatatgcatatgtatctctgtcttcctacatatacatatatatacacatacatatatgtatacacacacacacaaatatatatatatatatatatatatatatatatatatgtatagagagagagagacagaactcaaatcaatagtatgaattaataaattagatacttggagttttattttagaccaagaaagatatctggaacacaatgttctgcctcctgtatttgtaacttaatgtatcacagagagtagttcatttcattatatatagctctaacttattgtgtgttattgatcccaatactcagtttaatgaacacacgagtt

SEQ ID NO: 16470 - DNA, 125 bp, Homo sapiens
caagctccagctctcgctgaaaccctttcctgcctttgcttgcggggcacactgggtgctgtgagatttggagacgtccccgaagactcaggccctccaggagcctccctgaacccacatgtcct

SEQ ID NO: 16471 - DNA, 462 bp, Homo sapiens
ctgctcttacccccaccatagtggcctttggcgatgcctcctaccttcccccaacaactctcttgcgtgttagagagaaggggccctcccagcacaaagttgcattcctccccccaatttattctaatttattaatttagtcccaccccttctgagcctgcagccttctgcagcctggggactgtagagtaagtagctgccccagcccctcccaggcctgacccagcctggggagtgggacaaggtgtgggtgtggccctgttggaggttgatgttgctgtttttatctcttggctttgtgtttgtgttctgtgatactttttgagaaagaagaggccaggcacagtggcttacgcctgtaatcccagcactttgggaggccaaggtgggcggatcacttgagctcaagagtttgagaccagcctgggtaacatggtgaaaccccctctctgccaaaaatac

SEQ ID NO: 16472 - DNA, 513 bp, Homo sapiens
cccatatttggcttttctccatacctggtcattctgcataacatggcctggatgcctcagacttctaggagccatctaagattgtgagctgatgccaatcagctcctagagcttgcactccctccaggattgggatgccagtgaagcaaaaaaatggcccaacctgaaataaggaggtaggataaagagcataaggtcttagacaaatgcagactgttcagcttccagttttaggacatgtggatgtaattttatatcgtgtttctcatgttcgttgacttaaagcaagggttccacatttttttctacaaaaggtcagagaataaatattttagactatgggtacatgtgttttctgtcacacactctttttcattttattatttattatttttatttatttatttttgagacagagtcttgctctgttgcctaggctggagtgcagtggtgcgatctcaactcactgcaacctatgccttctgggttcaagtgattctcatgcctcagctt

SEQ ID NO: 16473 - DNA, 339 bp, Homo sapiens
gaatgcaagaaattacattatagaaagcaagctgtacttcagaaaaacacacatcaacagaggaagagaaaggctccatttcttttgaaaatgatggaagattcttctcagaaatctttttaaaaaatcagtatattcagagatctgatagagactttattttagttctagtttttttggggaaaagtttgccatggttttggaggctccttaaagtattaaatcttgagctcttcttatcaaagtcaagggaacctactgagtaaaactatttttaaaagggagaaatttttatgctttccttttaagaggttaatcaataaacccaagtgaacaaga

SEQ ID NO: 16474 - DNA, 320 bp, Homo sapiens
tataaaatcttggaaatgactttgttatacttgcctttattcactaatagatcatccaggaacttatgaagactttcatgtaaaacgtcaaagttcttttattttattttttttctaagccacctctgttcctgttcaatttttactttattaacaggctcttcttgcaaaatagaccatatcaccttattattttgatcacatatctcaggactctcagaattgttggtattccttcaacgaatatatggtatcttattttatcatgtaagtaacttcaaattttgtctttgatgaagtctcacgtattcatataccaa

SEQ ID NO: 16475 - DNA, 371 bp, Homo sapiens
caggtgccaggtcaatcacagtgtctggttggcccttacacactcttattgttaataataatacctacaataatgtattaagatacacataatacaggccgggcacggtggctcacacctgtaatactagcactttgggaggccgagatgggtggatcacgaagtcaggagagtgaaaccatcctggccaacatgatgaaaccccgtctctactaaaaatacaaaaattagcagggcatagtggcctgtaatttcagctactcaggaggttgagttaggagaatagcttgaactaaggagtcagaagttgcagtgagccgagatcgtgccactgaactccagcctgatgacatagcaagactccatctcaa

SEQ ID NO: 16476 - DNA, 770 bp, Homo sapiens
gcctggctctaaattcaagccaatgaagtcccaccatgaagagaggtctcctgttatagagaagccagccaatatctcttcctttatcccttggggtgcatgctttccatctgaggttgggtttagggtgcgtgaaaacctcctaggaagcttttaaaatgcagaatcctagacttgtggctaagattctaagacagtgagtctgggaccatggccaggaattggagctgtttaataagcatcccaggtaattctgctgcaagcccacccttggagaacactgggcagggtgagagggagctagaagcgcccccatgtggccatggcaggatgctgcaagagacagtctgctctcccaggtcagctggggtgtgcctgccctccttggagagtatgtaactccacccaccagagtgccactcctctctgctcttcctctcctatcaagtcttgcctctctctctctttgcctcagttctctgtccctgcacagcaggagttctgcttgatcctccctttgaggattggccccagtgcctggggaccctctgaatgtcgtctttggtctgttcctctcctttctggctctatctacctttctgagtttggcttctaccagcctgatttacactaccattctcttggggcaaggaatgtccccaccatttttggtttgccattgatgcattgattgtcacacctgttgtcccaggaagttgacctataactctccatggccagagtccctgctgatcagaattcaatttgcc

SEQ ID NO: 16477 - DNA, 493 bp, Homo sapiens
aaaattgctaattatacttttgcttacctcctgccatttaagtttgtaaatttctctatgtgaggctgaaaggttaggtcctggaaaattgtgattggtctgtaagcaccagaaatgtccaaaagtatatatcccctttgttaactgcacctgagcctgacatcctaccattcacatttggaatatataactcaaaacattgtccatatactgtttggtagaaatggtgtatcaagtttggtacagaaatatgtctgtcatgaacagcggcagcaatgaaaaccaggaggaggttaatgagagttctatggaggttttacgccactgtgataactttttataacaagggcctgagattaggggaagagtgagttgccagttcattaaattcttgtccattaaaacccatttctctttctggccgcttgtctacagtcatcccattctcagatgtactcatcccagcacattctttttttttcattgtggcaaa

SEQ ID NO: 16478 - DNA, 238 bp, Homo sapiens
catctaaattttaaagaccaagtgtatttgaaagagaaaaagtatagagagggagggagaagagctgtgtttgaatctatttatcctaacatctcttagatgtgactgtatgtggagatgcagaagtttaggacacaagactgaaggaatactaaccctagccatgacctgaaatatagtatcttttaaaagcctaatgttttcgtagtcttcctatttatttcttcttatcaagatt

SEQ ID NO: 16479 - DNA, 411 bp, Homo sapiens
acatctgtcagagaattgaggtcacagggcaaaccttcaccgcaaaaacaggcaggaaaatggagatcggctcacctaaggcagaagctgttggagacagtaattgagatttaaacatattgctgtgggctaagtgtggactagcttgagggttcaaaaccgggagcttgtctaagggaaccccacactttggtgggttttacctcgaggagacccactaggttctcctgtaaagatggcaggaaaattcccttgtgctttggacacgggaagggggaaagtaatccttttgaaatacatccaggaagaaatcagccccagatcttctgttctccatggcagagaacagttttctcagggaaaactacttgcagaagccttctctagcttaggagaagggcagttggatgg

SEQ ID NO: 16480 - DNA, 600 bp, Homo sapiens
tagggtgtctgaattagttgtccttcctttgttacagtctttcgtttttgctatttgtaagagggacctcagaaaagtatggattctagacagttctccctgcccctagtatgcagcagcatttgtttccccttggtaatacacccgagtcagtaaaccccttatttgcttgttggttcagtgcccagaagggcccaaaacagcaggtgagcctcaatgtacaattcagtgagctgttgtcttgtgttccccggaagcattcctcctgtaaaaaccaagccctccaaaccagtagaactccagttgaggggacaggtgagaggaaccactcctacttctatcccttgattcctggacccgtgaatcctggttataggagagacaacacatgcaaagcagaaccttgggggcagcacccaaaagttgtctcccaagtggtgctgtaacggagtcttcacgaggccgtttcactctaatgtttgtccagctgcttcctcctgctgagatacgtggtatgactgtgattacctggtcacaagcccattgcctcactttctttgctgtgaaatttgtttcttgattaaaagcaatattgaataa

SEQ ID NO: 16481 - DNA, 999 bp, Homo sapiens
cttttttagaggtggggccttgctctgtcaccctggctagagtgctgtgaaacgatcacagtccactgtaaccttgaacaccaactgcaggattcctattctcttttgtgggcaagatagggtgggggacattgtgcacccccttcttctctgtcccagtctgtgacagaccctgtcagacattgagaggcctgagagctgcaacagtggttgtgccagagaggaatttgccaaagctctcagcgacctttctgcattaaagtttcgtgccattatctctttcacatacaaattcaagcccttttttttcccttgaaatcacttttgtgctgtttaacctctttaccccgatttcccccccttctttcttgctccctttctagtagtttccagctaatggatcacctggataagattgcccctgtctttgtgagagcagcaattagctctcaccctgagaaggcggcgtgttctgttgcttggcagccttggtgtagaggatggattgggtctgcgtcttttcatttgaaagtaggttatcgattagcacggatgccaatttactacagaggctgttgccaatgcctcttgatctcattatggtgtaaattttcaagattgtatcacattagctcaggagaattcaggagagaaaaacgtagtaaagttaaaaaaaaaaaagccaaaaaaaaaaaaaaaacaacaaacaaacacacacaaattgtttgcggcgcgcctgcggcgccgaggaagaaaagcatttgaagaaaaccaactatcgtgttgtggcggcggcggcggcccccgagctagtgttataaggtgcgaaacgtgtggctccatctacgtggtttccccatgggcagaccggggcccatcgacaatggtgggggtgtgcttcctccgccaaaatgaaaaagaccccgcggggggaacccccagccgcgttctgtagacaaactccgaagggcggacttgggcgacagtagaggggactct

SEQ ID NO: 16482 - DNA, 2079 bp, Homo sapiens
ctggggatacctttaaaacaaacaaacaaacaaacaaaacaggatctgtctatcacctgtccaaatcctgaagcaaaatgagccttctttatggccaccttggaaaggcctgagtccccagcatcacctgggatacaaagtgttctgaggtgggggcagagtgccctcctgcccagatgccacactccacaatatctcttcctggcagacaggtttctcttaacttcctttggcaaatttggtttcacttccttttgcaactttagaacctttctcaggtcagtcataaggtagtggagaagccaggatttgaacccattctgtctgattccagagctcatgcattaaccacctgactgtggtgcctccccatcatatgtgcatcaagtatgatcatttttgtagttctcagagtacttagcaccatgcacatctgtaataagtacagccactgcctactgggaggtctaaaggttcaactcataagggacccacaggccacactgggctccagtctccttaaaagatgtgggacggagatcaacaattgtcagcagaaccccatcaggcatttgtcttctcactgagccttgcagcaaaccacacagctgtctataacctatctgttcccagattcaagaacacaagctgctcatcagttgggtgcaggatccactctagtacaaaagctgtgtgtctcaaggcataattccttatgattacttcatagctctgcttttgtcttgagacaaaagaaatttccttcaattcctacttttgctgagatattgttttttgaaaagcaattaaatcttgtcaatcacttttcccacctctttgagatacttacatggcttttcttctttattctcttagtgtggtaaattacattgatttattttaaatatgaaaccagccttgaattccaggaacaaactccatttggacatgctagaacaaccttttatatttgtttagatttgatttcctgaagtggtgttaaaaggttttcatatctatgtctgtgagggatattaatctgtacatttttttattactattttctggtgttatggtaatgctagtctcatagaatgaattaggaaaagttgcctccttctgtattttctgagagtttgtgtggcactggtaaaatattttctgtatatgtttgacataattcaccaggaaaattatttgtacctacaagttccctcctggaaagatgttgataatcacttattatcctttcattgtctgccagatctgtggcattgcttttttctctggtattagtaatttaaattttcccttatttcttgatcaattttggcagagatttatcaattttattaatctcttttaaaaatctgtattgagctttgttaattttctctattacatactttttatttctactcttacgattgctatttctttatttctcctttggatttagcccatttttctatttgtctaattttaggatttaaaattcaatcattatttttagatatttttatttttaaatataaacatgaaagttgcaatattaccttgggcactgttttgactgcattccacaagtttttatttgtcatgttttaatcaccattcagttcaaaatactttctaatgctccttgttatttcttctttgacccattggttatataaaagtacgttttgctttatttctaaatatgtgaagactttctagatatctcagttatttattactaatttaattttattgtagccagagaaaatacactgtatgtgttcaatctttggaaatttcttgagacttattttttgacccagtatgtttgccctcatgaacattccatattcactagaaaaagaatgtgtgttcaaataatgttggatatagtgttatgcaaatgccactaaatcaagataaatcttttgcactcttgttttttgcctgcttgttctaacaataagtgagaaagaagtgttaatatctccaattgtgattgtaatttgactgttatcctttggtttggtcagtttttgcctgttgaaattctgctattaaaacataaacatttaagat

SEQ ID NO: 16483 - DNA, 2050 bp, Homo sapiens
ctggggatacctttaaaacaaacaaacaaacaaacaaaacaggatctgtctatcacctgtccaaatcctgaagcaaaatgagccttctttatggccaccttggaaaggcctgagtccccagcatcacctgggatacaaagtgttctgaggtgggggcagagtgccctcctgcccagatgccacactccacaatatctcttcctggcagacaggtttctcttaacttcctttggcaaatttggtttcacttccttttgcaactttagaacctttctcaggtcagtcataaggtagtggagaagccaggatttgaacccattctgtctgattccagagctcatgcattaaccacctgactgtggtgcctccccatcatatgtgcatcaagtatgatcatttttgtagttctcagagtacttagcaccatgcacatctgtaataagtacagccactgcctactgggaggtctaaaggttcaactcataagggacccacaggccacactgggctccagtctccttaaaagatgtgggacggagatcaacaattgtcagcagaaccccatcaggcatttgtcttctcactgagccttgcagcaaaccacacagctgtctataacctatctgttcccagattcaagaacacaagctgctcatcagttgggtgcaggatccactctagtacaaaagctgtgtgtctcaaggcataattccttatgattacttcatagctctgcttttgtcttgagacaaaagaaatttccttcaattcctacttttgctgagatattgttttttgaaaagcaattaaatcttgtcaatcacttttcccacctctttgagatacttacatggcttttcttctttattctcttagtgtggtaaattacattgatttattttaaatatgaaaccagccttgaattccaggaacaaactccatttggacatgctagaacaaccttttatatttgtttagatttgatttcctgaagtggtgttaaaaggttttcatatctatgtctgtgagggatattaatctgtacatttttttattactattttctggtgttatggtaatgctagtctcatagaatgaattaggaaaagttgcctccttctgtattttctgagagtttgtgtggcactggtaaaatattttctgtatatgtttgacataattcaccaggaaaattatttgtacctacaagttccctcctggaaagatgttgataatcacttattatcctttcattgtctgccagatctgtggcattgcttttttctctggtattagtaatttaaattttcccttatttcttgatcaattttggcagagatttatcaattttattaatctcttttaaaaatctgtattgagctttgttaattttctctattacatactttttatttctactcttacgattgctatttctttatttctcctttggatttagcccatttttctatttgtctaattttaggatttaaaattcaatcattatttttagatatttttatttttaaatataaacatgaaagttgcaatattaccttgggcactgttttgactgcattccacaagtttttatttgtcatgttttaatcaccattcagttcaaaatactttctaatgctccttgttatttcttctttgacccattggttatataaaagtacgttttgctttatttctaaatatgtgaagactttctagatatctcagttatttattactaatttaattttattgtagccagagaaaatacactgtatgtgttcaatctttggaaatttcttgagacttaaacattccatattcactagaaaaagaatgtgtgttcaaataatgttggatatagtgttatgcaaatgccactaaatcaagataaatcttttgcactcttgttttttgcctgcttgttctaacaataagtgagaaagaagtgttaatatctccaattgtgattgtaatttgactgttatcctttggtttggtcagtttttgcctgttgaaattctgctattaaaacataaacatttaagat

SEQ ID NO: 16484 - DNA, 986 bp, Homo sapiens
gccaagaattcggcacgagcggcacgagctttattattatagtcatttgaaattgaaagagtaacatttatctttttgtagcattcttggtccctgctgttctgattaatattttatcagtgataaaaaataccaaaatatagtgtgtttgctcatcagatttgcaaattacaaaaactaggaggatatttcagtaatggtggaggctaagcttctgtaacaaaccgctgacacagtggctcaaagagcgcagatgttcatttcacttttgtaaccaccctgtggggtaggcaggctctgtaccggtaagtcgtcaagggcctggtctggtggagcacctctgctttcctcaacatgtgccttccaaggaggctccatggcttctgcttccagctggtgtggaagaaagaaggggcatgcaggaggagggattgcctttccccaggtgccttcaaggttgcagatgtcactcctgctcccaaaccattggcaagaacttggtcacgtggccacacctaatcacagggaggctgggagatgtaatcttacctgggcagttgtgtccctggagataagggaacagtgggttttcggggagctgctagcagtcttctcagaagaacaatagctctaacacattagctgcctcagcaagctggagttttgggctttatagtcaaaatatgaaacatagaaggaggccaggcatgatggctctcacctgtaatctcggcattttgggaggccaaggcaggcagatcgtttgagtcctggagaccatcctgggcaacatagcaaaaccttgtgtttacataaaatacaaaaaattagccaggcgtggtggcatgtgcctgtagtctcagctacctaggaggctgaggtgggaggatcacctgagcctggagggccgaggctgcagtgagccatgatcctgtcactgcactccattcagcctgggctacagagtgagactctgtctcaaaaaa

SEQ ID NO: 16485 - DNA, 1092 bp, Homo sapiens
ttgaatcctagcttttagaatattaataggagactcaaagttaatattcttaacaacttaaaattaaaaaaagtcataatctatcaaaagtttatttattggatggcattaaaacatttttgaggcagttgtctaatatgaacaataatctaaacaatatattccttaaattaagaggaaagacaagtgtcgtatttcgatcctgtttattcaaatgtgtgattttgctgaaatgaaagggataaaatgaatacttagagaataatacttcatttttgcagtactttttaattttgataaaaaagatacaaagttcataatatcaaaatatgtgttcaaaattggtattttaattttaatatttttgtaagttgatttaaattttgctcttttttcaggtgtgcttggtttattatatttagtcaagttaatttagtcgaatgtggtaacatttttctgatttatctttagttggagcacacccttgaactgaacagtggccaaaggaaagctttctgggctttggaaagtagttgtttaactttgttttaagccgttttcttagtgattctgtatcaagtagaggataagtgtagtttaacttagtttttaatataacccataatcaagaacatgagcgaaaagcagacataaatcgatatggatggtttgtggtgtgtgtgggatgtgggggaattaagaaaatgccatttacctaagcacagtttgcctgaatttctgcttggttgtgttgtttaccgtaagtactgagggtagtttccctaagtctgtcctgagaaaaagcatacttagtactcctgtatttgttcttatgaaatgactatctgccttcttgtatctagtaagattggctggctcaattttcttctgtcaaattatatggttattttttatattaccacatcagcattatattaaaagtgtttttaatagttgattgtattttgccaactactagtatagactcaaatttgctatttaatttttaaaatacaatttattttgtaaatcctttaaaaaatatttggttagttttggattagaaatgatttatgttagccatgtgttgaa

SEQ ID NO: 16486 - DNA, 2512 bp, Homo sapiens
tcccctcgggggtggggtagtgctcagctcccaccgtggtcctcgcaggcaccacatacttattcggaggaggcgcccccggggtcgcgagatggaagcgcgcgtccgggaggccgtgtaacgggagctgcgggactcagcgggccagagagcgcggcgggccacccccggctcagcccgtggatgctgaccgccccctcggagagtccccgcagacatggcggagagctggctgcgcctctcgggagccgggccggcggaggaggccgggccggagggcggcctggaggagcccgacgccctggatgacagcctgaccagcctgcagtggctgcaggaattctccattctcaacgccaaggcccccgccctgcccccggggggcaccgacccccacggctaccaccaggtgccaggttcagcggcgcccgggtcccccctggcggccgaccccgcctgcctggggcagccacacacgccgggcaagcccacgtcgtcgtgcacgtcgcggagcgcgcccccggggctgcaggccccaccccccgacgacgtggactacgccaccaatccgcacgtgaagcctccctactcgtatgccacgctcatctgcatggccatgcaggccagcaaggccaccaagatcaccctgtcggccatctacaagtggatcacggacaacttctgctacttccgccacgcagatcccacctggcagaattcaatccgccacaacctgtctctgaacaagtgcttcatcaaagtgcctcgggagaaggacgaaccaggcaaggggggcttctggcgcattgacccccagtacgcggagcggctactgagcggcgctttcaagaagcggcgactgccccctgtccacatccacccagcctttgcccgccaggccgcgcaggagcccagcgctgtcccccgggccgggccgctgacggtgaataccgaggcccagcagctgctgcgggagttcgaggaggccaccggggaggcgggctggggtgcaggcgagggcaggctggggcataagcgcaaacagccgctgcccaagcgggtggccaaggtcccgcggccccccagcaccctgctgcccaccccggaggagcagggtgagctggaacccctcaaaggcaactttgactgggaggccatcttcgacgccggcactctgggcggggagctgggtgcactggaggccctggagctgagcccgcctctgagccccgcctcacacgtggacgtggacctcaccatccacggccgccacatcgactgccctgccacctgggggccttcggtggagcaggctgccgacagcctggacttcgatgagaccttcctggccacatccttcctgcagcacccctgggacgagagcggcagtggctgcctgcccccggagcccctctttgaggctggggatgccaccctggcctccgacctgcaggactgggccagcgtgggggccttcttgtaagaggccaggccctgccccacctctggacagtgcccaagtcagggtccagaactgccccccaacacaggtccacagacaccccaccacctaggcaggggctgggccagggctccaaggcttgccccagaggccacatggccaccagccccagctgccatcagattcaagcccaggaggctgaaaacgagggcccaggaccagaatcgctgcctcctctccccagccccaccttgtacacacagtgtttcattgctccgcgtcttcccagccccagaaaccggctaaaggaccctgcaccatgagagccgaggcctggaggagcccgggtcaggctggggaggaacagaactgggccctcccagagcacctccgcttcccccctgcttccccaggtctctatccagagagagtccccaggtacaacaaatgctaattagatgacagcaaattaaccccctggaggcttctcctggcagagcctccctggggccggggcaggctgtggatggggcggagcagggcagaagatggactgggggagggggcagagagaggagaccaaaatgaggtggtggcacagggtggggcaaggagatcctctctaaggcctctggggtctttgcctggccccatccctagggggcggggaggggacgtaaatccctaatctttaagcccgacttgaggctgagagcagctggaagtttgggtttggtggtttgggggccggggcagccaagctgtatggggcaggacagacagactaatgtagtgagtgtagctgtagctgaggcttaactgggagggatgccgagcttgctggaactactgggaccaagaagcggggtaccccacgcccctgcctgcactcctcgggggcgtggggcgtgccttgctccacccggactccctgggctgcgtcccacatccaccctcctgccccgtggggcaatttaacctttttcatgaaagttatttacaatgaaaagtttttaaaaataaaatttttaaaaatctaaaaaaaaaact

SEQ ID NO: 16487 - DNA, 2641 bp, Homo sapiens
ctttggagcggctacttaatgccggtcccggggccgcggtagctcagagaagcgccgtcgggcgggggggcggcaagaggcgctggcagggcccccgagctgggggcagagagccgcagggggtgggagcaacttcttccagaaccttcctctggcccgggctgcgctctgagccaggcaccacatacttattcggaggaggcgcccccggggtcgcgagatggaagcgcgcgtccgggaggccgtgtaacgggagctgcgggactcagcgggccagagagcgcggcgggccacccccggctcagcccgtggatgctgaccgccccctcggagagtccccgcagacatggcggagagctggctgcgcctctcgggagccgggccggcggaggaggccgggccggagggcggcctggaggagcccgacgccctggatgacagcctgaccagcctgcagtggctgcaggaattctccattctcaacgccaaggcccccgccctgcccccggggggcaccgacccccacggctaccaccaggtgccaggttcagcggcgcccgggtcccccctggcggccgaccccgcctgcctggggcagccacacacgccgggcaagcccacgtcgtcgtgcacgtcgcggagcgcgcccccggggctgcaggccccaccccccgacgacgtggactacgccaccaatccgcacgtgaagcctccctactcgtatgccacgctcatctgcatggccatgcaggccagcaaggccaccaagatcaccctgtcggccatctacaagtggatcacggacaacttctgctacttccgccacgcagatcccacctggcagaattcaatccgccacaacctgtctctgaacaagtgcttcatcaaagtgcctcgggagaaggacgaaccaggcaaggggggcttctggcgcattgacccccagtacgcggagcggctactgagcggcgctttcaagaagcggcgactgccccctgtccacatccacccagcctttgcccgccaggccgcgcaggagcccagcgctgtcccccgggccgggccgctgacggtgaataccgaggcccagcagctgctgcgggagttcgaggaggccaccggggaggcgggctggggtgcaggcgagggcaggctggggcataagcgcaaacagccgctgcccaagcgggtggccaaggtcccgcggccccccagcaccctgctgcccaccccggaggagcagggtgagctggaacccctcaaaggcaactttgactgggaggccatcttcgacgccggcactctgggcggggagctgggtgcactggaggccctggagctgagcccgcctctgagccccgcctcacacgtggacgtggacctcaccatccacggccgccacatcgactgccctgccacctgggggccttcggtggagcaggctgccgacagcctggacttcgatgagaccttcctggccacatccttcctgcagcacccctgggacgagagcggcagtggctgcctgcccccggagcccctctttgaggctggggatgccaccctggcctccgacctgcaggactgggccagcgtgggggccttcttgtaagaggccaggccctgccccacctctggacagtgcccaagtcagggtccagaactgccccccaacacaggtccacagacaccccaccacctaggcaggggctgggccagggctccaaggcttgccccagaggccacatggccaccagccccagctgccatcagattcaagcccaggaggctgaaaacgagggcccaggaccagaatcgctgcctcctctccccagccccaccttgtacacacagtgtttcattgctccgcgtcttcccagccccagaaaccggctaaaggaccctgcaccatgagagccgaggcctggaggagcccgggtcaggctggggaggaacagaactgggccctcccagagcacctccgcttcccccctgcttccccaggtctctatccagagagagtccccaggtacaacaaatgctaattagatgacagcaaattaaccccctggaggcttctcctggcagagcctccctggggccggggcaggctgtggatggggcggagcagggcagaagatggactgggggagggggcagagagaggagaccaaaatgaggtggtggcacagggtggggcaaggagatcctctctaaggcctctggggtctttgcctggccccatccctagggggcggggaggggacgtaaatccctaatctttaagcccgacttgaggctgagagcagctggaagtttgggtttggtggtttgggggccggggcagccaagctgtatggggcaggacagacagactaatgtagtgagtgtagctgtagctgaggcttaactgggagggatgccgagcttgctggaactactgggaccaagaagcggggtaccccacgcccctgcctgcactcctcgggggcgtggggcgtgccttgctccacccggactccctgggctgcgtcccacatccaccctcctgccccgtggggcaatttaacctttttcatgaaagttatttacaatgaaaagtttttaaaaataaaatttttaaaaatctaaaaaaaaaact

SEQ ID NO: 16488 - DNA, 1788 bp, Homo sapiens
ctttggagcggctacttaatgccggtcccggggccgcggtagctcagagaagcgccgtcgggcgggggggcggcaagaggcgctggcagggcccccgagctgggggcagagagccgcagggggtgggagcaacttcttccagaaccttcctctggcccgggctgcgctctgagccaggcaccacatacttattcggaggaggcgcccccggggtcgcgagatggaagcgcgcgtccgggaggccgtgtaacgggagctgcgggactcagcgggccagagagcgcggcgggccacccccggctcagcccgtggatgctgaccgccccctcggagagtccccgcagacatggcggagagctggctgcgcctctcgggagccgggccggcggaggaggccgggccggagggcggcctggaggagcccgacgccctggatgacagcctgaccagcctgcagtggctgcaggaattctccattctcaacgccaaggcccccgccctgcccccggggggcaccgacccccacggctaccaccaggtgccaggttcagcggcgcccgggtcccccctggcggccgaccccgcctgcctggggcagccacacacgccgggcaagcccacgtcgtcgtgcacgtcgcggagcgcgcccccggggctgcaggccccaccccccgacgacgtggactacgccaccaatccgcacgtgaagcctccctactcgtatgccacgctcatctgcatggccatgcaggccagcaaggccaccaagatcaccctgtcggccatctacaagtggatcacggacaacttctgctacttccgccacgcagatcccacctggcagaattcaatccgccacaacctgtctctgaacaagtgcttcatcaaagtgcctcgggagaaggacgaaccaggcaaggggggcttctggcgcattgacccccagtacgcggagcggctactgagcggcgctttcaagaagcggcgactgccccctgtccacatccacccagcctttgcccgccaggccgcgcaggagcccagcgctgtcccccgggccgggccgctgacggtgaataccgaggcccagcagctgctgcgggagttcgaggaggccaccggggaggcgggctggggtgcaggcgagggcaggctggggcataagcgcaaacagccgctgcccaagcgggtggccaaggtcccgcggccccccagcaccctgctgcccaccccggaggagcagggtgagctggaacccctcaaaggcaactttgactgggaggccatcttcgacgccggcactctgggcggggagctgggtgcactggaggccctggagctgagcccgcctctgagccccgcctcacacgtggacgtggacctcaccatccacggccgccacatcgactgccctgccacctgggggccttcggtggagcaggctgccgacagcctggacttcgatgagaccttcctggccacatccttcctgcagcacccctgggacgagagcggcagtggctgcctgcccccggagcccctctttgaggctggggatgccaccctggcctccgacctgcaggactgggccagcgtgggggccttcttgtaagaggccaggccctgccccacctctggacagtgcccaagtcagggtccagaactgccccccaacacaggtccacatccaccctcctgccccgtggggcaatttaacctttttcatgaaagttatttacaatgaaaagtttttaaaaataaaatttttaaaaatctaaaaaaaaaact

SEQ ID NO: 16489 - DNA, 1237 bp, Homo sapiens
ctttggagcggctacttaatgccggtcccggggccgcggtagctcagagaagcgccgtcgggcgggggggcggcaagaggcgctggcagggcccccgagctgggggcagagagccgcagggggtgggagcaacttcttccagaaccttcctctggcccgggctgcgctctgagccaggcaccacatacttattcggaggaggcgcccccggggtcgcgagatggaagcgcgcgtccgggaggccgtgtaacgggagctgcgggactcagcgggccagagagcgcggcgggccacccccggctcagcccgtggatgctgaccgccccctcggagagtccccgcagacatggcggagagctggctgcgcctctcgggagccgggccggcggaggaggccgggccggagggcggcctggaggagcccgacgccctggatgacagcctgaccagcctgcagtggctgcaggaattctccattctcaacgccaaggcccccgccctgcccccggggggcaccgacccccacggctaccaccaggtgccaggttcagcggcgcccgggtcccccctggcggccgaccccgcctgcctggggcagccacacacgccgggcaagcccacgtcgtcgtgcacgtcgcggagcgcgcccccggggctgcaggccccaccccccgacgacgtggactacgccaccaatccgcacgtgaagcctccctactcgtatgccacgctcatctgcatggccatgcaggccagcaaggccaccaagatcaccctgtcggccatctacaagtggatcacggacaacttctgctacttccgccacgcagatcccacctggcaggtagaggaggcacgggcggcggccgctccctccccattccctcctcgctccccacgctgcactggattcatatcccaaatctgcaggccaagtaggctctgcggtgcggccagcgccccagaagggagccctgcaaaggagcccagttcttgcaactgcccctcctttgacttccagagagagagagagagagaagggagaatgtccagaggtggagggctttaggggtgcagaggctgagattcaaggggaaataacctgccattcatccagcaggcccaggccaaagaccagggctagactctgcgtggacagaatctccttggggagagcgatgaactgaaggcgcattcttgtcccaagtcctagaattcctagacactgccctgcccc

SEQ ID NO: 16490 - DNA, 229 bp, Homo sapiens
ttataattttctgaaaaaattaagtccaaaactagctggggtcagtagggctctgacatgttgcatctaaagaaaactgtgaataaaagtagagtaaaatatgtgctttatttgtcatccccagtgctttaaatgtttcgatcattttatcacatttcaactcatgatgtttatgaagatgaatgcaattaaactttgtttctatagttgcttttttggttgttattta

SEQ ID NO: 16491 - DNA, 157 bp, Homo sapiens
taaataatgacactcccttataacacatttttatgcagatgctccaaacatatttctaaagaatatttaactgacatgggaaaatggttaaatattacagtcaggtaagaaaaggacaacaggctaataaaagaacactagtaatgattccaatttt

SEQ ID NO: 16492 - DNA, 909 bp, Homo sapiens
gacacaactcaacacctacccctattataatattttatagcatcacttttcaatcttcaaatgaaaatcatggatgatgaagcttaccttcactcataaaaacatcactccatttactattctgaaatgaaactagcaggtaatataactagcctctaaaacatacccatcagtgacgttctaactgaaacagataagatattttataatgaaataattattttcatatgtacatattctagcatggttatattacaagatgtaattaaactactaagcagggcacatactttgtatgtgtgtgtataaatataaatatgtgaaaaatcaccatgaatgtggtagttaccaattcagacctgctgcattggcagttcaataccaggaaaggggtcgatgtcagcagtatgattttctaaaatgtggccaattctttagataaagttctaggcatacctagtctgtaatggcttcactcatatagtgcttgctgtgtgcctggcattgttctaatacctttctaataaatctatgaggtgagtactgctgttagtcccgttttgcatatgagggagttacccaggttatgtgctagtcatcctggttatgtgctaataatggcagagctgggattaaaatgaaagcagcctggctctggctttcttgctcataatcactcagtatataggcttccttccatttatagaattctctcattgcattcttgaaaaatccaaagcatattaaaactgggctgaaaattctgtgtgtttatatataaaatgaaatgagatcatagatttgttattgtaaactgagttcccatctatatgaatattgggcggggcaattgaaagttgtgttgatgagtcagctctttgttgtgagggctgtaagctgcagggcttg

SEQ ID NO: 16493 - DNA, 355 bp, Homo sapiens
gcctctctgttgcccaggatagagtgcagtggcatgatcataggctactatatagccttaggctcaagtgatccactcacctcagccttctgagtagctaggactatataggcatgcactaccatgcctggctaattcttaagtttttttgtagagatggggtctcttgccccagctggtcttgaacttctggtctcaagcaatcgatacttctgccttggcctcccaaagcactgggattacaggcgtgagcctccatgctgggcctaaagcatagctttaattttaagatatcgaataacaaattgtgaaatatttcagacttcaagaatgaaataatttgaatctggtgaac

SEQ ID NO: 16494 - DNA, 385 bp, Homo sapiens
tagtcagcatgttgtacacctggaatttattagcatctgtcatggatgacagaagtttaatttagttattttccaaataaataaccattttctccagcatcgtttattatattgctatccttttcttcctaaactggaatgtcatttatatcacattttccattacagattgagtatcccttatccaaaatgctcaggaccagaagtgtttcagctttcagattttttcatattttaaaatattctcattatatttaccagttcagcatccctaattcaaaaatttgaaatccagaatgcttcatgagcattttctttaagcagcctgtctgtgcttaaaaggtttcggattttggagcattttggattttggattttcagatta

SEQ ID NO: 16495 - DNA, 449 bp, Homo sapiens
cccagagacagagctggagcttggctcagcttggcaaacagagccctgatgttattagtttggcttctgggttgctgatgattgtactggaagggaaaagaggagaaacaggtcatgagccaaatgaggagtcccacagatgccacttcacaggcaccctatgtcataggaaggatattcaaatgtccagcacctaacgggtacaaaaagtagttagaaaaaatgaataagacctgctttgtgttagcacaacagggcgactatagtctaataatcgtgcattttaaaataactaaaagtataatcaattgtttgtgacacaaagaataaatacttaaggggatggataccccattctccatgacatgattattacgcattgcatgcctgtatcaaaacatctcagataccccataaatacgtacacttgctatgtacccacagaaatt

SEQ ID NO: 16496 - DNA, 336 bp, Homo sapiens
atcgcttgaacccgggtgtttaaggctgcagtgaactgagatcaggccacagcacctcaacctgggagacaaagtgagaccctgtctcaaaaaaaaaaaaaagcagagtttatgtaatccatcgtgtgcatatttatacaataatttacaattctatgtattttaaaagtgtataattcatatattatgtgacacaatatataatggaatataaaatatatattttatgtcatgtgtaacataacatcatctattatatgtagtgtatgtgcttatgtacatatcattggaatgaaagtttcattaaataattacccttaatatttgcagcccggt

SEQ ID NO: 16497 - DNA, 1384 bp, Homo sapiens
cattttattccctgaaaccctggggttgcttgccctgctacttttcgatagtacctttcctggccttcagtggtttgctcacataggttcgtcagtacatgttgaagtcttgaagaccctgtatagatctctggagatccagggatctccagatctctagatgcaaatctgcatagatgcaaatattttcttcctggatttccggctcttacatcctcagtctagggtgacaactaggttgtgctgagctgtggcctaggaattcttttccagacagctcacacaatcctaggggtcacctcattggtttccacttacccaggcatcactgccctgccctgcctgatactcagtgtctgaaaagtattgttaatatatatttctagttaaggttatttcacgtgggagatgaacctgatccttataattccagaagtggaattctaaaacagagcagctttttgcatacgttcaagtacagagaaaaaaataaaacagaaatttgtattaaaaaataaaaaagtaaattaatattagaaaccagagcatttttaaaaggaagttgagaaatttttttttagtgtttgaatggcatttattctttatatttacttttgaaataagggtaataaatgaaaattggctaaacttctaattgcactaagtaaattattacctaatattctttgtgtgcttttcttacctgattatgctatgaattaattttgtgaatttcttattatttaaatgtttcactctgacctgtgtcagtatgtttgccatttttagttgcttggttgtttttgttagaaagtaaaatgtattgttgcaccatgcatttgttatgtgtataaaattttttacttcacaaaactgtctataggcaattagcaattagtattaagaagttgtataaattgaaatcactttcatatactaaaaactgtaaaatgagagttattacaaaagatgttgtttattgttttattgtctcaacctttttaacataaaagaccgggtcataattgtgctaaattagggaagtaaaaagagaattgagctagatgcagtggctcatgcctggaatcctagcactttagtaggctgaggcaggcagatggcttgagcccaggattttgacaacagtctgcacaacatggcgaaacctcgtctctcctaaaaatacagaaattcatggcatgtgcctgtggtctcagttacttgtgaggctgaggtgagatgatcacttgagcctgggatgttgaggctgcagtgaaccgcgattacaccactgcactccagcctgggcaacacagcgagaccttatttttatattgtacatttgctcattttgtgctttttcttcttctccttatagttctgg

SEQ ID NO: 16498 - DNA, 328 bp, Homo sapiens
  misc_feature (296)..(296): n is a, c, g, or t
cacaagattctcaacttattcccaaaatagaattcttgattcttccctcttaaaatctgctccttcactatcccccatttattagctactgaagtcactactagtgagaggcaaaatttaagagctataaactaggatatttagcagaaaaaaatctctaagcaaagtgttcaggatactgcatggcttctcttggctgcttatagtaaaatccaaggagagacaatgaggtgaagatgaaatttataatcaaaaaagacatagaatgtaaagatttggaaaattctcaaccaggnccaggtaaagaataaaaaagcatgcttaggag

SEQ ID NO: 16499 - DNA, 447 bp, Homo sapiens
gtgaacttcattagtatcccttgccctcttctggaaaggcagaagaggaagccagatgtgtttgtgaagtaatgatggctcacacagcaaggatgggaggaaaagcatgcctgagagccaggaagactcagatgggacagaggctgtgccccagacacaggtgctgtcacccagccactcatgctgctcaatgcattccactaaatactcactaagaggatgattaatccaggacaggcacagaggccatcctccagaaaggggctccaagaccgagggaactgttctagagggaagcacgggaaggacatgatatggtgctcagatgtgcatcacgccccacaagcaattcccagctagactgtgccaactccacgcctttgcccttgcttaagagagtatagaagaattcaagtaagagtgatgttattatagagatagccttgc

SEQ ID NO: 16500 - DNA, 375 bp, Homo sapiens
ggggtttcaatatgttggccaggctggtcttgaactcctgacctcaggtgatctgcctgcttcagcctcccaaagtgctgggattacagacttgagccaccatgcccagcctgaatcattgtcttaaacttagtggtcacttctatgcttccttggccactcagttactggctttgctcccactgcccatgtgggatgtgggtttgattctgggcagccacttgtaggggagtggaggatgggtggagttggcctgctagaatcttctgtgactgagccggcagtgaccatcattctccactcctgtgatgagtgttcccttgatgagagtacttaggcagggatggggagagctgcgaacacaggtggaggtcc

SEQ ID NO: 16501 - DNA, 360 bp, Homo sapiens
ttatatatggggatcttttgctttgtgctcctggcatcaaattcagctataaagttgactcaaaccttccaaggatgggtattgttgtaaggtcctggtcagagcctggcagtacgtcagcctaccctgagtgcagagcttcaactacccgcctgctacaacagtgttttcatatttccatacctgagatatagtaaaaagtggttttaatacagaaacctggccaggcatggtggctcacacctgtaatcccagtactttgggaggctaaggagggaggattgcttgagcccaggagtttgagaccagcctggacaacatggtgagatccccattgctatatctcttaacatttattta

SEQ ID NO: 16502 - DNA, 428 bp, Homo sapiens
gcaagttatggaacttccctgtacactagattctttatctgaaaagtagaggtaataatagtgtatattttcccaggtgttatgagggctgtgtgaggtcatgtgtatgagggactcacacagtgcctgccacactgtaaggaataaaggtaagctgctgttggtatttttgttatttttattattgttgttattctgttgctgatattgctcttctgatctcttagatggctaataatttgtttgtaggtgtttatgtctggaacagaatacagagctctgtggatagcagtctgtttcaatatagtgatgtttgttaatttctataactgtgtcagctcatttgtacttggaaaactataagcagtatatttattccttaaattcagctatgtcatatttgaagtcaaaattgtgtatgttgtggg

SEQ ID NO: 16503 - DNA, 3585 bp, Homo sapiens
  misc_feature (4)..(5): n is a, c, g, or t
  misc_feature (2031)..(2031): n is a, c, g, or t
  misc_feature (2221)..(2221): n is a, c, g, or t
agcnnggtgaagggcggcgcgcttaggcaggcggtggcgcggctggagtgccgcggggagggctgtgccggttgctttctgcagccgcatctcggccagctctcctcgccgtccccggggcgctgtgcgtctccagtccgggaccgaagccgcctgccgtagcgggcggccagatccgcgtcccgcctcagcggccggaggacatgcgggagagagaatgagccagagggacacgctggtgcatctgtttgccggaggatgtggtggtacagtgggagctattctgacatgtccactggaagttgtaaaaacacgactgcagtcatcttctgtgacgctttatatttctgaagttcagctgaacaccatggctggagccagtgtcaaccgagtagtgtctcccggacctcttcattgcctaaaggtgatcttggaaaaagaagggcctcgttccttgtttagaggactaggccccaatttagtgggggtagccccttccagagcaatatactttgctgcttattcaaactgcaaggaaaagttgaatgatgtatttgatcctgattctacccaagtacatatgatttcagctgcaatggcaggtatgaatgtataatattaaaaaaaaaaaaaactttctgaaacctagaggcttaatattgaattataagtttgtagtgaaaagttgatgattaatgtgcttttcattgattagatgatttttacgtttatcgatataaaccaaattaggtatatgtaaaatctgtcatcagttgacatttttgtagtcaggagtttacatgctagggtacaagtaatatatttatattgccttgtgtagtccactgaatgtttagtgatcattgttaacagttttaagaatccaaccataattacactataaataagttatggagctgtaatttactcttctctcctcaatttctgttagtgccttttccctttttgctgcatgttttggcttctgtctgaaatgtgtcggcaattcttggtaaagtattcattttgtcctgtgctcaaatgctgaaatttttgtgagtgatgtattattattgacaattcagttactatgtgtattttttaaaattgtttattattctacataattcacactagacagcacctgaaatttagacactggctatgtgtacatgcttactatagaaatgtttccaggaactctctgtttctgtcatcactgataagtatatatgattctgaattaaaataactagttttaggtctttaccctgccataaagataaacagttggtttgaccaatctggttctggaatcatttgctgctatgcatgttagacaaagccacgaactttgattttccattgaaaattctccctaatatctgagatttattgtatatttactcatatctcacattttcaaattatgctgtaactttataaactgtagctgctttcatcagctattgatcaataaattgaatgtcaattatgtgcttaataatgagtgccttaaactgttaaacacttttggtttagaaataaagtgaatcaatttgacctatatacttcatgaagtaagtaagtttgaaatacaaatttctgaaaggtcaatagcccttatcgtattacaaattgtttttaaggctttttgtatttattaattgtcagttgattcactgaagctttaaaactggaagggacaatccaaaggtcaaaagagtgaaatacaatcatttaccaataaggaaaccttgggcaaattatgtaatttatgtgaacctctcttagcttacccatggaatgagtcaagtggtctacatagatttggattttgagaattagttctttcatttagtgttatagagattatcttgttacaactagaattatttttaatgtaatttttacagatgttgaatattagtagataggatttttcccctacgaatttggatgtaaggtaaaggttggtggccagtgacaaaccttataaccactttatcaggttctttaaaaatatatttntgaattaccagtgattatgtttttggcttataacctcagataattataaagaaatgttaatcttatttgaaagaattggaatctagaaagttagatgagcagtcattttatattgatatttgttatatcagtatagcaaatgcagaggttcagaatatctttatttccactggaacatcttatttcattngagtatctcatcagaatttattactgtatttgtatcacattgcaaagaatttcagtagaattgtcagtttgcacttttttctcaaatgtgtacaaatgttaacatatagttcatttttatctgtacattgatgccatttcccaacttgaattcctcaagttttggtaaacttacaatctcatacttgttcagaggttattgcactgtacacttactgtgtagaaaatactgtttgaatttgtttgcagttacattgttctgagaactgtgctctcagagcttctgtgcactattcatgagcattaacacttagccttgcagttttatacataactatatggttagtaaaactgaatggtccaatgcagactcattaaagtaggcttttgccccctttgttcttgaaataatctagaccagattactcggggttttttttaggattatttttataggtctaaatatgaatgatttgggggtatgaagtacttaaagatagttctgtgaaaaatcattttcagctgtctattcaagggaaaaaatgctaaccttgtcactttactacacaaaaccacactaaaataaaccattaatgatactgcctgcaagattttaacacaccagatagcacacacattaaggatttataaggcactgtacgtaatttttattccaagtgacctctcaattcattttcattttgcattttatccatatgaactcatgtttaatttagataataaaaatttattttattaaaaggacagtttatttaaagtgggtctttttatttgttgtagtgcatactataagaatttgtaagcctctaaagttgagctataaattttcatgcattaaaaatttgtttcagttgtgaggatatttaatcagattaaataatgttgactcttaatattttgcctgccttttttttctcctacacatgacctttgacagactaagtatatctcagctattgagggtatctgttttgttgcctgtatattttgtttaaattaacttgtatattcctttgtatacacctaggcacagatgtatgcaaaaaaaatttgttaaattacttctttctttatactaattctcaatttttaaaagattttatctggcatgtatatacttttatatagaacattataaatgtaaaggaaatgaattctaattttaattggattatgtattcatacagttattctcaatttttaaaatactaataatgtaatcattgaatgtttcctacatacgtagtgggttttatttgctcacagcatacagttatttttcaatttatgtttttctattagacttaaatttcattataataaaggcttttactcattaaatac

SEQ ID NO: 16504 - DNA, 720 bp, Homo sapiens
  misc_feature (4)..(5): n is a, c, g, or t
agcnnggtgaagggcggcgcgcttaggcaggcggtggcgcggctggagtgccgcggggagggctgtgccggttgctttctgcagccgcatctcggccagctctcctcgccgtccccggggcgctgtgcgtctccagtccgggaccgaagccgcctgccgtagcgggcggccagatccgcgtcccgcctcagcggccggaggacatgcgggagagagaatgagccagagggacacgctggtgcatctgtttgccggaggatgtggtggtacagtgggagctattctgacatgtccactggaagttgtaaaaacacgactgcagtcatcttctgtgacgctttatatttctgaagttcagctgaacaccatggctggagccagtgtcaaccgagtagtgtctcccggacctcttcattgcctaaaggtgatcttggaaaaagaagggcctcgttccttgtttagaggactaggccccaatttagtgggggtagccccttccagagcaatatactttgctgcttattcaaactgcaaggctgcaatggcaagcatttactggacattttttccgagaaagagtgagatcgtgtcatctcatgctccccattcgcaggttactttctgtagaaatatggctaactaaacttcgcttactggaatacagaaccaacccatttggctataaagatcggtacagctgatgcaggaccgggggaaagc

SEQ ID NO: 16505 - DNA, 1101 bp, Homo sapiens
  misc_feature (4)..(5): n is a, c, g, or t
agcnnggtgaagggcggcgcgcttaggcaggcggtggcgcggctggagtgccgcggggagggctgtgccggttgctttctgcagccgcatctcggccagctctcctcgccgtccccggggcgctgtgcgtctccagtccgggaccgaagccgcctgccgtagcgggcggccagatccgcgtcccgcctcagcggccggaggacatgcgggagagagaatgagccagagggacacgctggtgcatctgtttgccggaggatgtggtggtacagtgggagctattctgacatgtccactggaagttgtaaaaacacgactgcagtcatcttctgtgacgctttatatttctgaagttcagctgaacaccatggctggagccagtgtcaaccgagtagtgtctcccggacctcttcattgcctaaagtgagagcatagtattcaggagtgttttttagtttgtttgcgttagtgagttccagatgtttgtttacttatattctgccacattgaaaatgattttttataaacctatttacagaagttactctgaattgtactcataaggaatgataatccctaatggagaagaacagttagacagataagataaagtgtaattttacttccaaatcatgtgtatttagaatatttctacatttatccagtggagttttttctaaagctattataagtattttattttggattattcatttacttttgaaatgtgataatgtttaatgctaactcctttcgtgtatatttttaatgttccaagtaagtacatccaattaatgataatctgtgatttttatgtaacctaagtacaactgagacagcagagttctaatgctgttcagtatttgtttaacatttcctgatggtttggaaaagatttgtttttacagtttgccatacttcattatgttgcaattggatttgaaatttcaaaactattaaaattaggtttcgtatgtttatacttgtaaataatggaatgccttcgtgtctgccttatcagctcagtgtttgaacttagttcagtagtgtttattttgtaatagcaaataaactcattctgtgtatttacctttgttacta

SEQ ID NO: 16506 - DNA, 4639 bp, Homo sapiens
  misc_feature (4)..(5): n is a, c, g, or t
agcnnggtgaagggcggcgcgcttaggcaggcggtggcgcggctggagtgccgcggggagggctgtgccggttgctttctgcagccgcatctcggccagctctcctcgccgtccccggggcgctgtgcgtctccagtccgggaccgaagccgcctgccgtagcgggcggccagatccgcgtcccgcctcagcggccggaggacatgcgggagagagaatgagccagagggacacgctggtgcatctgtttgccggaggatgtggtggtacagtgggagctattctgacatgtccactggaagttgtaaaaacacgactgcagtcatcttctgtgacgctttatatttctgaagttcagctgaacaccatggctggagccagtgtcaaccgagtagtgtctcccggacctcttcattgcctaaaggtgatcttggaaaaagaagggcctcgttccttgtttagaggactaggccccaatttagtgggggtagccccttccagagcaatatactttgctgcttattcaaactgcaaggaaaagttgaatgatgtatttgatcctgattctacccaagtacatatgatttcagctgcaatggcaggttttactgcaatcacagcaaccaaccccatttggcttataaagactcggttacagcttgatgcaaggaaccgcggggaaaggcgaatgggtgcttttgaatgtgttcgtaaagtgtatcagacagatggactaaaaggattttataggggcatgtctgcttcatatgctggtatatcagagactgttatccattttgttatttatgaaagtataaaacaaaaactactggaatataagactgcttctacaatggaaaatgatgaagagtctgtgaaagaagcatcagattttgtgggaatgatgctagctgctgccacctcaaaaacttgtgccacaactatagcatatccacatgaagttgtaagaacaagactacgtgaagagggaacaaaatacagatctttttttcagactctatctttgcttgttcaagaagaaggttatgggtctctttatcgtggtctgacaactcatctagtgagacagattccaaacacagccattatgatggccacctatgaattggtggtttacctactcaatggatagcagcacgaggactgctgtactgcaaaaaaagaagaccaaaagattacagtggaccatgggatacagaagccagcatggcagacagaagaaaaatagtttgggaacatgtaactattctaagtggaagttttgttgtaggaattatagtaatcacaccacattacttggcctttcggtaatgtgaaaaaaaaaaaaaaacctcagagcctccaaggaaatgcctttagaagcactcctctctcaaaattgccattttctctaccatgtcccccagacacagttgggttttgttgatttatggcagtcttctaaacaaagccatccttaattttacatactgtattgtaactatccaaagatagtattggcagtcataaatttataacttctggcctttgtttaattccagtaaaataacagcaatgacaatgagatcgtcagtattattttcacatttccctgagaggacctggcacaatattttaaatttaattatttggcagtagtcactgtttttgacaaccaatgaaatagcgtctaaatatcttgtatattttttagcatcaaaatgttttggtttccactgctgacaggtgcttgttgtttagcctaatgtggatatttaaattgttaacataccaaacacacatggtaatagtttgggacaaaataactagtaaaatgttgatttctcggctatttcactgactgcggcatgtcctcgtgtcttctctgattttgtggtacatgaatgaatgcatttatctttttagtgacttactagttacgaacttgaattatcacctctttgtcatacttaagtatcatttacataaagtgtaaaagattttttcacttttgaatctttacctacttgctttcacattaagaatttgaacttttgagttttttccaggtctatatataatagattacatttattttgtaaagaaaatagtaatttaaagttttgccattttaaggtgacaatatttgggacagtataaatattatagacaagggcccccttgctgtctgctttagcaggtagtgacattaattgacttatagttttgtgtaaatgaacaaactgcttttgacaagaaatttattctgtcctagtttcctgcgtggtaaatcatagaaagattcaagttcatttgggttaaatgtgctaataggatgtagcttttaaattctgctattgagtcagctgtaccttttaatactttaaatgtgttatttgtatggcccttataaaggtgtttgctgtaattctgttaaaagacttcgcctatgccatactggtgtataaaaactgccgcaattggacgccggtgtggtactcatttcagtatacctgaactgtacattttgtgcaatggctttatctaaaagaatgacgcttcgtgaaagcactttgtggccttttttgggggggagggtgagagagtaggagagaataccatgttaagattaaaaaaaaaaacaaaaacattggtcatgtattaggcagaaacagtgttcataacatttttctgggttttaaatatgttgtttcggatatccttaatataaatgttttaggtattctgtgtaccctgtcgtacccccaacattatagaatattgcagtgtgtcattgcaagctttctctgctgtcaccagtgaaacatagtgccctgttaaattcccccactttaacttccttgtgatcaacagtaactggatgtttttgaggtgctcaattggaataaaaatattccaatctatttggagaccaaaggcaaaatcagttttcttacctttggaattattcgtaccttttatggtaaatttcagctttgacatgtattatgaggaacgtaccaaaaaccggtttgtaacaaatctgtagagaaggtctgaatctatcgtgtttgccttttcaggtgccatttctactgcctaatacagtgccatttgccttgtgaagacccataaacattcattgtgttgaatgtaagatagagactctccctagtcttactgatctcagtaccccacaaatgattaagaatgatatgaaaaccagcagctaaggaacatcttattatttagttgtagcatattcataacaagtgtccttcaaggataaacatatattctctatttgtatttagcaagtaaaacttgtgttgacctttagtgcattatattcagcttttaacagtattatgtatgtactggaaagcaaagaaatcttagagtcttggacattgtttatttgtgcaacaactagaaaggagcaatgaagtttatttcagttgtatttttccctaagcacaatctgcaatagtttatgtatgacagagataattcaaaaaggaaaactatatataaaagttgtatataaagtttgtctctgaaatatttctttgaagtttttaaaaaattgactcatgtttaaaaacaaaaacacatattcagagcattggacttttttaacttgttttcatctgtttatcatgacttttttatttctggtgtagagtccacattatttagtttgttgtacttttaaatttcaaagttcaaatctgaagaattagcgtttgtgatttcgggataccatgcagtggttttaatcccaggaaaaaaactatcaacaaaagttcgtttgattctcattatgtaactttgtagaaccatcctttctagatgggtccaccacagtgaatttgtaactttgaagtcaggatagaatatcattagattatctgtgagatagcattactatgttaggaccagcagagtttgggttggtaaaaataatgtttgctctattactgggttacagacatttcagcatttttaggttggttttaaatcactaaaaatatttattcggatttgaaggatttaagtgctaaaaatcaatccatttcttgcccttcaataattgtccatgcctgcctttgttgtttacatgctcttctgcccagactgttagtaatctagggaccccctttggagctgataagtacagttcagccttttctcctcaaatatataatgactttaacattcctaagaatataggtatttctgaatgatttaaatttgaggaattttaatacataaaatacaatgtacaaactttctgcccactcagatctcttctccatcatgtacttagtatttcccattaacctacacactgatttttatgctactccttgtagaaacaaaattctggtttgactcagtttttgtgtttataaacttttggaatgtgtaccccgtttatgtgaagaattatgacctatcagtcatagctaaatagtgaacctcaaaagtgttaacttttgactattcatgtgaggtttggtatcttgcatttatgtacatggctgtaaattatgtgcatttactctgtatttatgttatctagctgacttttacttgaattgttcaaattttaaaaattaaaatacgctcatgaaaa

SEQ ID NO: 16507 - DNA, 5357 bp, Homo sapiens
gtaaaatttgagttactcagttactgacatagaaaagaaccctgtgagaccaaattcagctttggaaacaatttagtgtaattattttgcatatgtagatacacctttgaaagccaagaaaggtttatgattggatctgtactatattaatttaaaaacaaattattcttaagtatattgtagcatttctgttcctgtaagtactttactcatcttaaatgtactgatcattagccacctttataaaaagaatgtgcctgacccactagtatttgatagaaatattaaaacagttaagatccttaaacatttctgcatataattttttattgagtaaatgtaacttaacgtaagtagttctatgaagtctgtgtaaattaaaaccctgttttgtgtagatgaagcaatctttataagtttctgtcatcaagactgtattttgtgtgctatttttccatagctaggaaggtagcaagtaaaacatatgcactatcctagaaacatactgttccaggtagatcttaatttactacctggaatgagccatcttaggtgaccaccattctgcaccaatacctagtacataatactttagttttaaagtaaactagagctgtcttctaccctgagtttattccatgtctataaaagagggaacttccaatttgtgactttttgaacttttgagtttttgtatgtgtttaagtaaatgacgataggcctgtcctattaaccctaacaaaaaccttactgtgatacggttattttaacagtattagtatgtatatatgtagaaagtattcatggggccaaacaacagtcttttccactatataatcaactaaagatcaaactattggtaaaatttgacatttgtgtagaattcattttgaatgtagtgatttgggatgctaatcaaaccccaggtaactgttttttttagctggttttaaggatcccaagtgcatgctttttagccgtagaatacacaaaatgtctatgtgtttgtagagatggatttctgaattcagcttagacagtagagagcaccctaaaggatattctaagtaggttgggaaagcaatttatattcattttgcttttaaaagaatctgttagttaaggacagaatttgagaattcatatagattggaagtgaagacaaatgtttgtcgtatgtgaaaagtgtaatatatacataaattagtagtttatttatatacattttcttgaatgtagatttatctaatttttaaaaccttaaagttaatagtgaattcttcatttttaccagagttcattttaaacatgtttgtttaggttttactgcaatcacagcaaccaaccccatttggcttataaagactcggttacagcttgatgcaaggaaccgcggggaaaggcgaatgggtgcttttgaatgtgttcgtaaagtgtatcagacagatggactaaaaggattttataggggcatgtctgcttcatatgctggtatatcagagactgttatccattttgttatttatgaaagtataaaacaaaaactactggaatataagactgcttctacaatggaaaatgatgaagagtctgtgaaagaagcatcagattttgtgggaatgatgctagctgctgccacctcaaaaacttgtgccacaactatagcatatccacatgaagttgtaagaacaagactacgtgaagagggaacaaaatacagatctttttttcagactctatctttgcttgttcaagaagaaggttatgggtctctttatcgtggtctgacaactcatctagtgagacagattccaaacacagccattatgatggccacctatgaattggtggtttacctactcaatggatagcagcacgaggactgctgtactgcaaaaaaagaagaccaaaagattacagtggaccatgggatacagaagccagcatggcagacagaagaaaaatagtttgggaacatgtaactattctaagtggaagttttgttgtaggaattatagtaatcacaccacattacttggcctttcggtaatgtgaaaaaaaaaaaaaaacctcagagcctccaaggaaatgcctttagaagcactcctctctcaaaattgccattttctctaccatgtcccccagacacagttgggttttgttgatttatggcagtcttctaaacaaagccatccttaattttacatactgtattgtaactatccaaagatagtattggcagtcataaatttataacttctggcctttgtttaattccagtaaaataacagcaatgacaatgagatcgtcagtattattttcacatttccctgagaggacctggcacaatattttaaatttaattatttggcagtagtcactgtttttgacaaccaatgaaatagcgtctaaatatcttgtatattttttagcatcaaaatgttttggtttccactgctgacaggtgcttgttgtttagcctaatgtggatatttaaattgttaacataccaaacacacatggtaatagtttgggacaaaataactagtaaaatgttgatttctcggctatttcactgactgcggcatgtcctcgtgtcttctctgattttgtggtacatgaatgaatgcatttatctttttagtgacttactagttacgaacttgaattatcacctctttgtcatacttaagtatcatttacataaagtgtaaaagattttttcacttttgaatctttacctacttgctttcacattaagaatttgaacttttgagttttttccaggtctatatataatagattacatttattttgtaaagaaaatagtaatttaaagttttgccattttaaggtgacaatatttgggacagtataaatattatagacaagggcccccttgctgtctgctttagcaggtagtgacattaattgacttatagttttgtgtaaatgaacaaactgcttttgacaagaaatttattctgtcctagtttcctgcgtggtaaatcatagaaagattcaagttcatttgggttaaatgtgctaataggatgtagcttttaaattctgctattgagtcagctgtaccttttaatactttaaatgtgttatttgtatggcccttataaaggtgtttgctgtaattctgttaaaagacttcgcctatgccatactggtgtataaaaactgccgcaattggacgccggtgtggtactcatttcagtatacctgaactgtacattttgtgcaatggctttatctaaaagaatgacgcttcgtgaaagcactttgtggccttttttgggggggagggtgagagagtaggagagaataccatgttaagattaaaaaaaaaaacaaaaacattggtcatgtattaggcagaaacagtgttcataacatttttctgggttttaaatatgttgtttcggatatccttaatataaatgttttaggtattctgtgtaccctgtcgtacccccaacattatagaatattgcagtgtgtcattgcaagctttctctgctgtcaccagtgaaacatagtgccctgttaaattcccccactttaacttccttgtgatcaacagtaactggatgtttttgaggtgctcaattggaataaaaatattccaatctatttggagaccaaaggcaaaatcagttttcttacctttggaattattcgtaccttttatggtaaatttcagctttgacatgtattatgaggaacgtaccaaaaaccggtttgtaacaaatctgtagagaaggtctgaatctatcgtgtttgccttttcaggtgccatttctactgcctaatacagtgccatttgccttgtgaagacccataaacattcattgtgttgaatgtaagatagagactctccctagtcttactgatctcagtaccccacaaatgattaagaatgatatgaaaaccagcagctaaggaacatcttattatttagttgtagcatattcataacaagtgtccttcaaggataaacatatattctctatttgtatttagcaagtaaaacttgtgttgacctttagtgcattatattcagcttttaacagtattatgtatgtactggaaagcaaagaaatcttagagtcttggacattgtttatttgtgcaacaactagaaaggagcaatgaagtttatttcagttgtatttttccctaagcacaatctgcaatagtttatgtatgacagagataattcaaaaaggaaaactatatataaaagttgtatataaagtttgtctctgaaatatttctttgaagtttttaaaaaattgactcatgtttaaaaacaaaaacacatattcagagcattggacttttttaacttgttttcatctgtttatcatgacttttttatttctggtgtagagtccacattatttagtttgttgtacttttaaatttcaaagttcaaatctgaagaattagcgtttgtgatttcgggataccatgcagtggttttaatcccaggaaaaaaactatcaacaaaagttcgtttgattctcattatgtaactttgtagaaccatcctttctagatgggtccaccacagtgaatttgtaactttgaagtcaggatagaatatcattagattatctgtgagatagcattactatgttaggaccagcagagtttgggttggtaaaaataatgtttgctctattactgggttacagacatttcagcatttttaggttggttttaaatcactaaaaatatttattcggatttgaaggatttaagtgctaaaaatcaatccatttcttgcccttcaataattgtccatgcctgcctttgttgtttacatgctcttctgcccagactgttagtaatctagggaccccctttggagctgataagtacagttcagccttttctcctcaaatatataatgactttaacattcctaagaatataggtatttctgaatgatttaaatttgaggaattttaatacataaaatacaatgtacaaactttctgcccactcagatctcttctccatcatgtacttagtatttcccattaacctacacactgatttttatgctactccttgtagaaacaaaattctggtttgactcagtttttgtgtttataaacttttggaatgtgtaccccgtttatgtgaagaattatgacctatcagtcatagctaaatagtgaacctcaaaagtgttaacttttgactattcatgtgaggtttggtatcttgcatttatgtacatggctgtaaattatgtgcatttactctgtatttatgttatctagctgacttttacttgaattgttcaaattttaaaaattaaaatacgctcatgaaaa

SEQ ID NO: 16508 - DNA, 4680 bp, Homo sapiens
atccttaattaaattattccccccccccccttgattacccggacgccgctggacctggccgcacgccgcaatctagcaggcgtcggggatccagggccgctttgaggagcctggcttcggatttcgcgtaggttgcatggcccaaggggacggggcggaaagtgcggaggctgaggacaaaatgggcgccggagactcctttagccctcgctccttgcagcgctcgcttgggcctctgcacgtcactcacgccccacctcggacctcgggccgctcatttccgggctcggctttgcaagatgtggtggtacagtgggagctattctgacatgtccactggaagttgtaaaaacacgactgcagtcatcttctgtgacgctttatatttctgaagttcagctgaacaccatggctggagccagtgtcaaccgagtagtgtctcccggacctcttcattgcctaaaggtgatcttggaaaaagaagggcctcgttccttgtttagaggactaggccccaatttagtgggggtagccccttccagagcaatatactttgctgcttattcaaactgcaaggaaaagttgaatgatgtatttgatcctgattctacccaagtacatatgatttcagctgcaatggcaggttttactgcaatcacagcaaccaaccccatttggcttataaagactcggttacagcttgatgcaaggaaccgcggggaaaggcgaatgggtgcttttgaatgtgttcgtaaagtgtatcagacagatggactaaaaggattttataggggcatgtctgcttcatatgctggtatatcagagactgttatccattttgttatttatgaaagtataaaacaaaaactactggaatataagactgcttctacaatggaaaatgatgaagagtctgtgaaagaagcatcagattttgtgggaatgatgctagctgctgccacctcaaaaacttgtgccacaactatagcatatccacatgaagttgtaagaacaagactacgtgaagagggaacaaaatacagatctttttttcagactctatctttgcttgttcaagaagaaggttatgggtctctttatcgtggtctgacaactcatctagtgagacagattccaaacacagccattatgatggccacctatgaattggtggtttacctactcaatggatagcagcacgaggactgctgtactgcaaaaaaagaagaccaaaagattacagtggaccatgggatacagaagccagcatggcagacagaagaaaaatagtttgggaacatgtaactattctaagtggaagttttgttgtaggaattatagtaatcacaccacattacttggcctttcggtaatgtgaaaaaaaaaaaaaaacctcagagcctccaaggaaatgcctttagaagcactcctctctcaaaattgccattttctctaccatgtcccccagacacagttgggttttgttgatttatggcagtcttctaaacaaagccatccttaattttacatactgtattgtaactatccaaagatagtattggcagtcataaatttataacttctggcctttgtttaattccagtaaaataacagcaatgacaatgagatcgtcagtattattttcacatttccctgagaggacctggcacaatattttaaatttaattatttggcagtagtcactgtttttgacaaccaatgaaatagcgtctaaatatcttgtatattttttagcatcaaaatgttttggtttccactgctgacaggtgcttgttgtttagcctaatgtggatatttaaattgttaacataccaaacacacatggtaatagtttgggacaaaataactagtaaaatgttgatttctcggctatttcactgactgcggcatgtcctcgtgtcttctctgattttgtggtacatgaatgaatgcatttatctttttagtgacttactagttacgaacttgaattatcacctctttgtcatacttaagtatcatttacataaagtgtaaaagattttttcacttttgaatctttacctacttgctttcacattaagaatttgaacttttgagttttttccaggtctatatataatagattacatttattttgtaaagaaaatagtaatttaaagttttgccattttaaggtgacaatatttgggacagtataaatattatagacaagggcccccttgctgtctgctttagcaggtagtgacattaattgacttatagttttgtgtaaatgaacaaactgcttttgacaagaaatttattctgtcctagtttcctgcgtggtaaatcatagaaagattcaagttcatttgggttaaatgtgctaataggatgtagcttttaaattctgctattgagtcagctgtaccttttaatactttaaatgtgttatttgtatggcccttataaaggtgtttgctgtaattctgttaaaagacttcgcctatgccatactggtgtataaaaactgccgcaattggacgccggtgtggtactcatttcagtatacctgaactgtacattttgtgcaatggctttatctaaaagaatgacgcttcgtgaaagcactttgtggccttttttgggggggagggtgagagagtaggagagaataccatgttaagattaaaaaaaaaaacaaaaacattggtcatgtattaggcagaaacagtgttcataacatttttctgggttttaaatatgttgtttcggatatccttaatataaatgttttaggtattctgtgtaccctgtcgtacccccaacattatagaatattgcagtgtgtcattgcaagctttctctgctgtcaccagtgaaacatagtgccctgttaaattcccccactttaacttccttgtgatcaacagtaactggatgtttttgaggtgctcaattggaataaaaatattccaatctatttggagaccaaaggcaaaatcagttttcttacctttggaattattcgtaccttttatggtaaatttcagctttgacatgtattatgaggaacgtaccaaaaaccggtttgtaacaaatctgtagagaaggtctgaatctatcgtgtttgccttttcaggtgccatttctactgcctaatacagtgccatttgccttgtgaagacccataaacattcattgtgttgaatgtaagatagagactctccctagtcttactgatctcagtaccccacaaatgattaagaatgatatgaaaaccagcagctaaggaacatcttattatttagttgtagcatattcataacaagtgtccttcaaggataaacatatattctctatttgtatttagcaagtaaaacttgtgttgacctttagtgcattatattcagcttttaacagtattatgtatgtactggaaagcaaagaaatcttagagtcttggacattgtttatttgtgcaacaactagaaaggagcaatgaagtttatttcagttgtatttttccctaagcacaatctgcaatagtttatgtatgacagagataattcaaaaaggaaaactatatataaaagttgtatataaagtttgtctctgaaatatttctttgaagtttttaaaaaattgactcatgtttaaaaacaaaaacacatattcagagcattggacttttttaacttgttttcatctgtttatcatgacttttttatttctggtgtagagtccacattatttagtttgttgtacttttaaatttcaaagttcaaatctgaagaattagcgtttgtgatttcgggataccatgcagtggttttaatcccaggaaaaaaactatcaacaaaagttcgtttgattctcattatgtaactttgtagaaccatcctttctagatgggtccaccacagtgaatttgtaactttgaagtcaggatagaatatcattagattatctgtgagatagcattactatgttaggaccagcagagtttgggttggtaaaaataatgtttgctctattactgggttacagacatttcagcatttttaggttggttttaaatcactaaaaatatttattcggatttgaaggatttaagtgctaaaaatcaatccatttcttgcccttcaataattgtccatgcctgcctttgttgtttacatgctcttctgcccagactgttagtaatctagggaccccctttggagctgataagtacagttcagccttttctcctcaaatatataatgactttaacattcctaagaatataggtatttctgaatgatttaaatttgaggaattttaatacataaaatacaatgtacaaactttctgcccactcagatctcttctccatcatgtacttagtatttcccattaacctacacactgatttttatgctactccttgtagaaacaaaattctggtttgactcagtttttgtgtttataaacttttggaatgtgtaccccgtttatgtgaagaattatgacctatcagtcatagctaaatagtgaacctcaaaagtgttaacttttgactattcatgtgaggtttggtatcttgcatttatgtacatggctgtaaattatgtgcatttactctgtatttatgttatctagctgacttttacttgaattgttcaaattttaaaaattaaaatacgctcatgaaaa

SEQ ID NO: 16509 - DNA, 4726 bp, Homo sapiens
  misc_feature (4)..(5): n is a, c, g, or t
agcnnggtgaagggcggcgcgcttaggcaggcggtggcgcggctggagtgccgcggggagggctgtgccggttgctttctgcagccgcatctcggccagctctcctcgccgtccccggggcgctgtgcgtctccagtccgggaccgaagccgcctgccgtagcgggcggccagatccgcgtcccgcctcagcggccggaggacatgcgggagagagaatgagccagagggacacgctggtgcatctgtttgccggaggatgtggtggtacagtgggagctattctgacatgtccactggaagttgtaaaaacacgactgcagtcatcttctgtgacgctttatatttctgaagttcagctgaacaccatggctggagccagtgtcaaccgagtagtgtctcccggacctcttcattgcctaaaggtgatcttggaaaaagaagggcctcgttccttgtttagaggactaggccccaatttagtgggggtagccccttccagagcaatatactttgctgcttattcaaactgcaaggaaaagttgaatgatgtatttgatcctgattctacccaagtacatatgatttcagctgcaatggcagaacacaagaaattaaatacaaaataatgcaaaatatttcataagtatggatgtgcaatattactggccatagtgcaaaaggtgaaaggttttactgcaatcacagcaaccaaccccatttggcttataaagactcggttacagcttgatgcaaggaaccgcggggaaaggcgaatgggtgcttttgaatgtgttcgtaaagtgtatcagacagatggactaaaaggattttataggggcatgtctgcttcatatgctggtatatcagagactgttatccattttgttatttatgaaagtataaaacaaaaactactggaatataagactgcttctacaatggaaaatgatgaagagtctgtgaaagaagcatcagattttgtgggaatgatgctagctgctgccacctcaaaaacttgtgccacaactatagcatatccacatgaagttgtaagaacaagactacgtgaagagggaacaaaatacagatctttttttcagactctatctttgcttgttcaagaagaaggttatgggtctctttatcgtggtctgacaactcatctagtgagacagattccaaacacagccattatgatggccacctatgaattggtggtttacctactcaatggatagcagcacgaggactgctgtactgcaaaaaaagaagaccaaaagattacagtggaccatgggatacagaagccagcatggcagacagaagaaaaatagtttgggaacatgtaactattctaagtggaagttttgttgtaggaattatagtaatcacaccacattacttggcctttcggtaatgtgaaaaaaaaaaaaaaacctcagagcctccaaggaaatgcctttagaagcactcctctctcaaaattgccattttctctaccatgtcccccagacacagttgggttttgttgatttatggcagtcttctaaacaaagccatccttaattttacatactgtattgtaactatccaaagatagtattggcagtcataaatttataacttctggcctttgtttaattccagtaaaataacagcaatgacaatgagatcgtcagtattattttcacatttccctgagaggacctggcacaatattttaaatttaattatttggcagtagtcactgtttttgacaaccaatgaaatagcgtctaaatatcttgtatattttttagcatcaaaatgttttggtttccactgctgacaggtgcttgttgtttagcctaatgtggatatttaaattgttaacataccaaacacacatggtaatagtttgggacaaaataactagtaaaatgttgatttctcggctatttcactgactgcggcatgtcctcgtgtcttctctgattttgtggtacatgaatgaatgcatttatctttttagtgacttactagttacgaacttgaattatcacctctttgtcatacttaagtatcatttacataaagtgtaaaagattttttcacttttgaatctttacctacttgctttcacattaagaatttgaacttttgagttttttccaggtctatatataatagattacatttattttgtaaagaaaatagtaatttaaagttttgccattttaaggtgacaatatttgggacagtataaatattatagacaagggcccccttgctgtctgctttagcaggtagtgacattaattgacttatagttttgtgtaaatgaacaaactgcttttgacaagaaatttattctgtcctagtttcctgcgtggtaaatcatagaaagattcaagttcatttgggttaaatgtgctaataggatgtagcttttaaattctgctattgagtcagctgtaccttttaatactttaaatgtgttatttgtatggcccttataaaggtgtttgctgtaattctgttaaaagacttcgcctatgccatactggtgtataaaaactgccgcaattggacgccggtgtggtactcatttcagtatacctgaactgtacattttgtgcaatggctttatctaaaagaatgacgcttcgtgaaagcactttgtggccttttttgggggggagggtgagagagtaggagagaataccatgttaagattaaaaaaaaaaacaaaaacattggtcatgtattaggcagaaacagtgttcataacatttttctgggttttaaatatgttgtttcggatatccttaatataaatgttttaggtattctgtgtaccctgtcgtacccccaacattatagaatattgcagtgtgtcattgcaagctttctctgctgtcaccagtgaaacatagtgccctgttaaattcccccactttaacttccttgtgatcaacagtaactggatgtttttgaggtgctcaattggaataaaaatattccaatctatttggagaccaaaggcaaaatcagttttcttacctttggaattattcgtaccttttatggtaaatttcagctttgacatgtattatgaggaacgtaccaaaaaccggtttgtaacaaatctgtagagaaggtctgaatctatcgtgtttgccttttcaggtgccatttctactgcctaatacagtgccatttgccttgtgaagacccataaacattcattgtgttgaatgtaagatagagactctccctagtcttactgatctcagtaccccacaaatgattaagaatgatatgaaaaccagcagctaaggaacatcttattatttagttgtagcatattcataacaagtgtccttcaaggataaacatatattctctatttgtatttagcaagtaaaacttgtgttgacctttagtgcattatattcagcttttaacagtattatgtatgtactggaaagcaaagaaatcttagagtcttggacattgtttatttgtgcaacaactagaaaggagcaatgaagtttatttcagttgtatttttccctaagcacaatctgcaatagtttatgtatgacagagataattcaaaaaggaaaactatatataaaagttgtatataaagtttgtctctgaaatatttctttgaagtttttaaaaaattgactcatgtttaaaaacaaaaacacatattcagagcattggacttttttaacttgttttcatctgtttatcatgacttttttatttctggtgtagagtccacattatttagtttgttgtacttttaaatttcaaagttcaaatctgaagaattagcgtttgtgatttcgggataccatgcagtggttttaatcccaggaaaaaaactatcaacaaaagttcgtttgattctcattatgtaactttgtagaaccatcctttctagatgggtccaccacagtgaatttgtaactttgaagtcaggatagaatatcattagattatctgtgagatagcattactatgttaggaccagcagagtttgggttggtaaaaataatgtttgctctattactgggttacagacatttcagcatttttaggttggttttaaatcactaaaaatatttattcggatttgaaggatttaagtgctaaaaatcaatccatttcttgcccttcaataattgtccatgcctgcctttgttgtttacatgctcttctgcccagactgttagtaatctagggaccccctttggagctgataagtacagttcagccttttctcctcaaatatataatgactttaacattcctaagaatataggtatttctgaatgatttaaatttgaggaattttaatacataaaatacaatgtacaaactttctgcccactcagatctcttctccatcatgtacttagtatttcccattaacctacacactgatttttatgctactccttgtagaaacaaaattctggtttgactcagtttttgtgtttataaacttttggaatgtgtaccccgtttatgtgaagaattatgacctatcagtcatagctaaatagtgaacctcaaaagtgttaacttttgactattcatgtgaggtttggtatcttgcatttatgtacatggctgtaaattatgtgcatttactctgtatttatgttatctagctgacttttacttgaattgttcaaattttaaaaattaaaatacgctcatgaaaa

SEQ ID NO: 16510 - DNA, 4484 bp, Homo sapiens
  misc_feature (4)..(5): n is a, c, g, or t
agcnnggtgaagggcggcgcgcttaggcaggcggtggcgcggctggagtgccgcggggagggctgtgccggttgctttctgcagccgcatctcggccagctctcctcgccgtccccggggcgctgtgcgtctccagtccgggaccgaagccgcctgccgtagcgggcggccagatccgcgtcccgcctcagcggccggaggacatgcgggagagagaatgagccagagggacacgctggtgcatctgtttgccggaggatgtggtggtacagtgggagctattctgacatgtccactggaagttgtaaaaacacgactgcagtcatcttctgtgacgctttatatttctgaagttcagctgaacaccatggctggagccagtgtcaaccgagtagtgtctcccggacctcttcattgcctaaaggtgatcttggaaaaagaagggcctcgttccttgtttagaggactaggccccaatttagtgggggtagccccttccagagcaatatactttgctgcttattcaaactgcaaggaaaagttgaatgatgtatttgatcctgattctacccaagtacatatgatttcagctgcaatggcaggttttactgcaatcacagcaaccaaccccatttggcttataaagactcggttacagcttgatgcaaggaaccgcggggaaaggcgaatgggtgcttttgaatgtgttcgtaaagtgtatcagacagatggactaaaaggattttataggggcatgtctgcttcatatgctggtatatcagagactgttatccattttgttatttatgaaagtataaaacaaaaactactggaatataagactgcttctacaatggaaaatgatgaagagtctgtgaaagaagcatcagattttgtgggaatgatgctagctgctgccacctcaaaaacttgtgccacaactatagcatatccacatgaagttgtaagaacaagactacgtgaagagggaacaaaatacagatctttttttcagactctatctttgcttgttcaagaagaaggttatgggtctctttatcgtggtctgacaactcatctagtgagacagattccaaacacagccattatgatggccacctatgaattggtggtttacctactcaatggatagcagcacgaggactgctgtactgcaaaaaaagaagaccaaaagattacagtggaccatgggatacagaagccagcatggcagacagaagaaaaatagtttgggaacatgtaactattctaagtggaagttttgttgtaggaattatagtaatcacaccacattacttggcctttcggtaatgtgaaaaaaaaaaaaaaacctcagagcctccaaggaaatgcctttagaagcactcctctctcaaaattgccattttctctaccatgtcccccagacacagttgggttttgttgatttatggcagtcttctaaacaaagccatccttaattttacatactgtattgtaactatccaaagatagtattggcagtcataaatttataacttctggcctttgtttaattccagtaaaataacagcaatgacaatgagatcgtcagtattattttcacatttccctgagaggacctggcacaatattttaaatttaattatttggcagtagtcactgtttttgacaaccaatgaaatagcgtctaaatatcttgtatattttttagcatcaaaatgttttggtttccactgctgacaggtgcttgttgtttagcctaatgtggatatttaaattgttaacataccaaacacacatggtaatagtttgggacaaaataactagtaaaatgttgatttctcggctatttcactgactgcggcatgtcctcgtgtcttctctgattttgtggtacatgaatgaatgcatttatctttttagtgacttactagttacgaacttgaattatcacctctttgtcatacttaagtatcatttacataaagtgtaaaagattttttcacttttgaatctttacctacttgctttcacattaagaatttgaacttttgagttttttccaggtctatatataatagattacatttattttgtaaagaaaatagtaatttaaagttttgccattttaaggtgacaatatttgggacagtataaatattatagacaagggcccccttgctgtctgctttagcaggtagtgacattaattgacttatagttttgtgtaaatgaacaaactgcttttgacaagaaatttattctgtcctagtttcctgcgtggtaaatcatagaaagattcaagttcatttgggttaaatgtgctaataggatgtagcttttaaattctgctattgagtcagctgtaccttttaatactttaaatgtgttatttgtatggcccttataaaggtgtttgctgtaattctgttaaaagacttcgcctatgccatactggtgtataaaaactgccgcaattggacgccggtgtggtactcatttcagtatacctgaactgtacattttgtgcaatggctttatctaaaagaatgacgcttcgtgaaagcactttgtggccttttttgggggggagggtgagagagtaggagagaataccatgttaagattaaaaaaaaaaacaaaaacattggtcatgtattaggcagaaacagtgttcataacatttttctgggttttaaatatgttgtttcggatatccttaatataaatgttttaggtattctgtgtaccctgtcgtacccccaacattatagaatattgcagtgtgtcattgcaagctttctctgctgtcaccagtgaaacatagtgccctgttaaattcccccactttaacttccttgtgatcaacagtaactggatgtttttgaggtgctcaattggaataaaaatattccaatctatttggagaccaaaggcaaaatcagttttcttacctttggaattattcgtaccttttatggtaaatttcagctttgacatgtattatgaggaacgtaccaaaaaccggtttgtaacaaatctgtagagaaggtctgaatctatcgtgtttgccttttcaggtgccatttctactgcctaatacagtgccatttgccttgtgaagacccataaacattcattgtgttgaatgtaagatagagactctccctagtcttactgatctcagtaccccacaaatgattaagaatgatatgaaaaccagcagctaaggaacatcttattatttagttgtagcatatttgtgcaacaactagaaaggagcaatgaagtttatttcagttgtatttttccctaagcacaatctgcaatagtttatgtatgacagagataattcaaaaaggaaaactatatataaaagttgtatataaagtttgtctctgaaatatttctttgaagtttttaaaaaattgactcatgtttaaaaacaaaaacacatattcagagcattggacttttttaacttgttttcatctgtttatcatgacttttttatttctggtgtagagtccacattatttagtttgttgtacttttaaatttcaaagttcaaatctgaagaattagcgtttgtgatttcgggataccatgcagtggttttaatcccaggaaaaaaactatcaacaaaagttcgtttgattctcattatgtaactttgtagaaccatcctttctagatgggtccaccacagtgaatttgtaactttgaagtcaggatagaatatcattagattatctgtgagatagcattactatgttaggaccagcagagtttgggttggtaaaaataatgtttgctctattactgggttacagacatttcagcatttttaggttggttttaaatcactaaaaatatttattcggatttgaaggatttaagtgctaaaaatcaatccatttcttgcccttcaataattgtccatgcctgcctttgttgtttacatgctcttctgcccagactgttagtaatctagggaccccctttggagctgataagtacagttcagccttttctcctcaaatatataatgactttaacattcctaagaatataggtatttctgaatgatttaaatttgaggaattttaatacataaaatacaatgtacaaactttctgcccactcagatctcttctccatcatgtacttagtatttcccattaacctacacactgatttttatgctactccttgtagaaacaaaattctggtttgactcagtttttgtgtttataaacttttggaatgtgtaccccgtttatgtgaagaattatgacctatcagtcatagctaaatagtgaacctcaaaagtgttaacttttgactattcatgtgaggtttggtatcttgcatttatgtacatggctgtaaattatgtgcatttactctgtatttatgttatctagctgacttttacttgaattgttcaaattttaaaaattaaaatacgctcatgaaaa

SEQ ID NO: 16511 - DNA, 4790 bp, Homo sapiens
  misc_feature (4)..(5): n is a, c, g, or t
agcnnggtgaagggcggcgcgcttaggcaggcggtggcgcggctggagtgccgcggggagggctgtgccggttgctttctgcagccgcatctcggccagctctcctcgccgtccccggggcgctgtgcgtctccagtccgggaccgaagccgcctgccgtagcgggcggccagatccgcgtcccgcctcagcggccggaggacatgcgggagagagaatgagccagagggacacgctggtgcatctgtttgccggaggatgtggtggtacagtgggagctattctgacatgtccactggaagttgtaaaaacacgactgcagtcatcttctgtgacgctttatatttctgaagttcagctgaacaccatggctggagccagtgtcaaccgagtagtgtctcccggacctcttcattgcctaaaggtgatcttggaaaaagaagggcctcgttccttgtttagaggactaggccccaatttagtgggggtagccccttccagagcaatatactttgctgcttattcaaactgcaaggaaaagttgaatgatgtatttgatcctgattctacccaagtacatatgatttcagctgcaatggcaggttttactgcaatcacagcaaccaaccccatttggcttataaagactcggttacagcttgatgcaaggaaccgcggggaaaggcgaatgggtgcttttgaatgtgttcgtaaagtgtatcagacagatggactaaaaggattttataggggcatgtctgcttcatatgctggtatatcagagactgttatccattttgttatttatgaaagtataaaacaaaaactactggaatataagactgcttctacaatggaaaatgatgaagagtctgtgaaagaagcatcagattttgtgggaatgatgctagctgctgccacctcaaaaacttgtgccacaactatagcatatccacatgaagttgtaagaacaagactacgtgaagagggaacaaaatacagatctttttttcagactctatctttgcttgttcaagaagaaggttatgggtctctttatcgtggtctgacaactcatctagtgagacagattccaaacacagccattatgatggccacctatgaattggtggtttacctactcaatggatagcagcacgaggactgctgtactgcaaaaaaagaagaccaaaagattacagtggaccatgggatacagaagccagcatggcagacagaagaaaaatagtttgggaacatgtaactattctaagtggaagttttgttgtaggaattatagtaatcacaccacattacttggcctttcggtaatgtgaaaaaaaaaaaaaaacctcagagcctccaaggaaatgcctttagaagcactcctctctcaaaattgccattttctctaccatgtcccccagacacagttgggttttgttgatttatggcagtcttctaaacaaagccatccttaattttacatactgtattgtaactatccaaagatagtattggcagtcataaatttataacttctggcctttgtttaattccagtaaaataacagcaatgacaatgagatcgtcagtattattttcacatttccctgagaggacctggcacaatattttaaatttaattatttggcagtagtcactgtttttgacaaccaatgaaatagcgtctaaatatcttgtatattttttagcatcaaaatgttttggtttccactgctgacaggtgcttgttgtttagcctaatgtggatatttaaattgttaacataccaaacacacatggtaatagtttgggacaaaataactagtaaaatgttgatttctcggctatttcactgactgcggcatgtcctcgtgtcttctctgattttgtggtacatgaatgaatgcatttatctttttagtgacttactagttacgaacttgaattatcacctctttgtcatacttaagtatcatttacataaagtgtaaaagattttttcacttttgaatctttacctacttgctttcacattaagaatttgaacttttgagttttttccaggtctatatataatagattacatttattttgtaaagaaaatagtaatttaaagttttgccattttaaggtgacaatatttgggacagtataaatattatagacaagggcccccttgctgtctgctttagcaggtagtgacattaattgacttatagttttgtgtaaatgaacaaactgcttttgacaagaaatttattctgtcctagtttcctgcgtggtaaatcatagaaagattcaagttcatttgggttaaatgtgctaataggatgtagcttttaaattctgctattgagtcagctgtaccttttaatactttaaatgtgttatttgtatggcccttataaaggtgtttgctgtaattctgttaaaagacttcgcctatgccatactggtgtataaaaactgccgcaattggacgccggtgtggtactcatttcagtatacctgaactgtacattttgtgcaatggctttatctaaaagaatgacgcttcgtgaaagcactttgtggccttttttgggggggagggtgagagagtaggagagaataccatgttaagattaaaaaaaaaaacaaaaacattggtcatgtattaggcagaaacagtgttcataacatttttctgggttttaaatatgttgtttcggatatccttaatataaatgttttaggtattctgtgtaccctgtcgtacccccaacattatagaatattgcagtgtgtcattgcaagctttctctgctgtcaccagtgaaacatagtgccctgttaaattcccccactttaacttccttgtgatcaacagtaactggatgtttttgaggtgctcaattggaataaaaatattccaatctatttggagaccaaaggcaaaatcagttttcttacctttggaattattcgtaccttttatggtaaatttcagctttgacatgtattatgaggaacgtaccaaaaaccggtttgtaacaaatctgtagagaaggtctgaatctatcgtgtttgccttttcaggtgccatttctactgcctaatacagtgccatttgccttgtgaagacccataaacattcattgtgttgaatgtaagatagagactctccctagtcttactgatctcagtaccccacaaatgattaagaatgatatgaaaaccagcagctaaggaacatcttattatttagttgtagcatattcataacaagtgtccttcaaggataaacatatattctctatttgtatttagcaagtaaaacttgtgttgacctttagtgcattatattcagcttttaacagtattatgtatgtactggaaagcaaagaaatcttagagtcttggacattgtttatttgtgcaacaactagaaaggagcaatgaagtttatttcagttgtatttttccctaagcacaatctgcaatagtttatgtatgacagagataattcaaaaaggaaaactatatataaaagttgtatataaagtttgtctctgaaatatttctttgaagtttttaaaaaattgactcatgtttaaaaacaaaaacacatattcagagcattggacttttttaacttgttttcatctgtttatcatgacttttttatttctggtgtagagtccacattatttagtttgttgtacttttaaatttcaaagttcaaatctgaagaattagcgtttgtgatttcgggataccatgcagtggttttaatcccaggaaaaaaactatcaacaaaagttcgtttgattctcattatgtaactttgtagaaccatcctttctagatgggtccaccacagtgaatttgtaactttgaagtcaggatagaatatcattagattatctgtgagatagcattactatgttaggaccagcagagtttgggttggtaaaaataatgtttgctctattactgggttacagacatttcagcatttttaggttggttttaaatcactaaaaatatttattcggatttgaaggatttaagtgctaaaaatcaatccatttcttgcccttcaataattgtccatgcctgcctttgttgtttacatgctcttctgcccagactgttagtaatctagggaccccctttggagctgataagtacagttcagccttttctcctcaaatatataatgactttaacattcctaagaatataggtatttctgaatgatttaaatttgaggaattttaatacataaaatacaatgtacaaactttctgcccactcagatctcttctccatcatgtacttagtatttcccattaacctacacactgatttttatgctactccttgtagaaacaaaattctggtttgactcagtttttgtgtttataaacttttggaatgtgtaccccgtttatgtgaagaattatgacctatcagtcatagctaaatagtgaacctcaaaagtgttaacttttgactattcatgtgaggtttggtatcttgcatttatgtacatggctgtaaattatgtgcatttactctgtatttatgttatctagctgacttttacttgaattgttcaaattttaaaaattaaaatacgctcatgaaaaaaaaaaaaaaaaaaaattgggggcgggccgaagattttcacactctctgggggggcccagaaggaaatgtatgcagacgggcacaagggggtcccaaaaacgggcgcgctgcaaccagtggtctgtctcgactcccccgccgggaggggaa

SEQ ID NO: 16512 - DNA, 3749 bp, Homo sapiens
  misc_feature (17)..(17): n is a, c, g, or t
attggccttaagcctgnctgcccaccctccaaaaacttgtgccacaacttataggcatatcccaccatgaagttgtaagaacaagactacgtgaagagggaacaaaatacagatctttttttcagactctatctttgcttgttcaagaagaaggttatgggtctctttatcgtggtctgacaactcatctagtgagacagattccaaacacagccattatgatggccacctatgaattggtggtttacctactcaatggatagcagcacgaggactgctgtactgcaaaaaaagaagaccaaaagattacagtggaccatgggatacagaagccagcatggcagacagaagaaaaatagtttgggaacatgtaactattctaagtggaagttttgttgtaggaattatagtaatcacaccacattacttggcctttcggtaatgtgaaaaaaaaaaaaaaacctcagagcctccaaggaaatgcctttagaagcactcctctctcaaaattgccattttctctaccatgtcccccagacacagttgggttttgttgatttatggcagtcttctaaacaaagccatccttaattttacatactgtattgtaactatccaaagatagtattggcagtcataaatttataacttctggcctttgtttaattccagtaaaataacagcaatgacaatgagatcgtcagtattattttcacatttccctgagaggacctggcacaatattttaaatttaattatttggcagtagtcactgtttttgacaaccaatgaaatagcgtctaaatatcttgtatattttttagcatcaaaatgttttggtttccactgctgacaggtgcttgttgtttagcctaatgtggatatttaaattgttaacataccaaacacacatggtaatagtttgggacaaaataactagtaaaatgttgatttctcggctatttcactgactgcggcatgtcctcgtgtcttctctgattttgtggtacatgaatgaatgcatttatctttttagtgacttactagttacgaacttgaattatcacctctttgtcatacttaagtatcatttacataaagtgtaaaagattttttcacttttgaatctttacctacttgctttcacattaagaatttgaacttttgagttttttccaggtctatatataatagattacatttattttgtaaagaaaatagtaatttaaagttttgccattttaaggtgacaatatttgggacagtataaatattatagacaagggcccccttgctgtctgctttagcaggtagtgacattaattgacttatagttttgtgtaaatgaacaaactgcttttgacaagaaatttattctgtcctagtttcctgcgtggtaaatcatagaaagattcaagttcatttgggttaaatgtgctaataggatgtagcttttaaattctgctattgagtcagctgtaccttttaatactttaaatgtgttatttgtatggcccttataaaggtgtttgctgtaattctgttaaaagacttcgcctatgccatactggtgtataaaaactgccgcaattggacgccggtgtggtactcatttcagtatacctgaactgtacattttgtgcaatggctttatctaaaagaatgacgcttcgtgaaagcactttgtggccttttttgggggggagggtgagagagtaggagagaataccatgttaagattaaaaaaaaaaacaaaaacattggtcatgtattaggcagaaacagtgttcataacatttttctgggttttaaatatgttgtttcggatatccttaatataaatgttttaggtattctgtgtaccctgtcgtacccccaacattatagaatattgcagtgtgtcattgcaagctttctctgctgtcaccagtgaaacatagtgccctgttaaattcccccactttaacttccttgtgatcaacagtaactggatgtttttgaggtgctcaattggaataaaaatattccaatctatttggagaccaaaggcaaaatcagttttcttacctttggaattattcgtaccttttatggtaaatttcagctttgacatgtattatgaggaacgtaccaaaaaccggtttgtaacaaatctgtagagaaggtctgaatctatcgtgtttgccttttcaggtgccatttctactgcctaatacagtgccatttgccttgtgaagacccataaacattcattgtgttgaatgtaagatagagactctccctagtcttactgatctcagtaccccacaaatgattaagaatgatatgaaaaccagcagctaaggaacatcttattatttagttgtagcatattcataacaagtgtccttcaaggataaacatatattctctatttgtatttagcaagtaaaacttgtgttgacctttagtgcattatattcagcttttaacagtattatgtatgtactggaaagcaaagaaatcttagagtcttggacattgtttatttgtgcaacaactagaaaggagcaatgaagtttatttcagttgtatttttccctaagcacaatctgcaatagtttatgtatgacagagataattcaaaaaggaaaactatatataaaagttgtatataaagtttgtctctgaaatatttctttgaagtttttaaaaaattgactcatgtttaaaaacaaaaacacatattcagagcattggacttttttaacttgttttcatctgtttatcatgacttttttatttctggtgtagagtccacattatttagtttgttgtacttttaaatttcaaagttcaaatctgaagaattagcgtttgtgatttcgggataccatgcagtggttttaatcccaggaaaaaaactatcaacaaaagttcgtttgattctcattatgtaactttgtagaaccatcctttctagatgggtccaccacagtgaatttgtaactttgaagtcaggatagaatatcattagattatctgtgagatagcattactatgttaggaccagcagagtttgggttggtaaaaataatgtttgctctattactgggttacagacatttcagcatttttaggttggttttaaatcactaaaaatatttattcggatttgaaggatttaagtgctaaaaatcaatccatttcttgcccttcaataattgtccatgcctgcctttgttgtttacatgctcttctgcccagactgttagtaatctagggaccccctttggagctgataagtacagttcagccttttctcctcaaatatataatgactttaacattcctaagaatataggtatttctgaatgatttaaatttgaggaattttaatacataaaatacaatgtacaaactttctgcccactcagatctcttctccatcatgtacttagtatttcccattaacctacacactgatttttatgctactccttgtagaaacaaaattctggtttgactcagtttttgtgtttataaacttttggaatgtgtaccccgtttatgtgaagaattatgacctatcagtcatagctaaatagtgaacctcaaaagtgttaacttttgactattcatgtgaggtttggtatcttgcatttatgtacatggctgtaaattatgtgcatttactctgtatttatgttatctagctgacttttacttgaattgttcaaattttaaaaattaaaatacgctcatgaaaa

SEQ ID NO: 16513 - DNA, 3788 bp, Homo sapiens
  misc_feature (4)..(5): n is a, c, g, or t
agcnnggtgaagggcggcgcgcttaggcaggcggtggcgcggctggagtgccgcggggagggctgtgccggttgctttctgcagccgcatctcggccagctctcctcgccgtccccggggcgctgtgcgtctccagtccgggaccgaagccgcctgccgtagcgggcggccagatccgcgtcccgcctcagcggccggaggacatgcgggagagagaatgagccagagggacacgctggtgcatctgtttgccggaggatgtggtggtacagtgggagctattctgacatgtccactggaagttgtaaaaacacgactgcagtcatcttctgtgacgctttatatttctgaagttcagctgaacaccatggctggagccagtgtcaaccgagtagtgtctcccggacctcttcattgcctaaaggtgatcttggaaaaagaagggcctcgttccttgtttagaggactaggccccaatttagtgggggtagccccttccagagcaatatactttgctgcttattcaaactgcaaggaaaagttgaatgatgtatttgatcctgattctacccaagtacatatgatttcagctgcaatggcaggttttactgcaatcacagcaaccaaccccatttggcttataaagactcggttacagcttgatgcaaggaaccgcggggaaaggcgaatgggtgcttttgaatgtgttcgtaaagtgtatcagacagatggactaaaaggattttataggggcatgtctgcttcatatgctggtatatcagagactgttatccattttgttatttatgaaagtataaaacaaaaactactggaatataagactgcttctacaatggaaaatgatgaagagtctgtgaaagaagcatcagattttgtgggaatgatgctagctgctgccacctcaaaaacttgtgccacaactatagcatatccacatgaagttgtaagaacaagactacgtgaagagggaacaaaatacagatctttttttcagactctatctttgcttgttcaagaagaaggttatgggtctctttatcgtggtctgacaactcatctagtgagacagattccaaacacagccattatgatggccacctatgaattggtggtttacctactcaatggatagcagcacgaggactgctgtactgcaaaaaaagaagaccaaaagattacagtggaccatgggatacagaagccagcatggcagacagaagaaaaatagtttgggaacatgtaactattctaagtggaagttttgttgtaggaattatagtaatcacaccacattacttggcctttcggtaatgtgaaaaaaaaaaaaaaacctcagagcctccaaggaaatgcctttagaagcactcctctctcaaaattgccattttctctaccatgtcccccagacacagttgggttttgttgatttatggcagtcttctaaacaaagccatccttaattttacatactgtattgtaactatccaaagatagtattggcagtcataaatttataacttctggcctttgtttaattccagtaaaataacagcaatgacaatgagatcgtcagtattattttcacatttccctgagaggacctggcacaatattttaaatttaattatttggcagtagtcactgtttttgacaaccaatgaaatagcgtctaaatatcttgtatattttttagcatcaaaatgttttggtttccactgctgacaggtgcttgttgtttagcctaatgtggatatttaaattgttaacataccaaacacacatggtaatagtttgggacaaaataactagtaaaatgttgatttctcggctatttcactgactgcggcatgtcctcgtgtcttctctgattttgtggtacatgaatgaatgcatttatctttttagtgacttactagttacgaacttgaattatcacctctttgtcatacttaagtatcatttacataaagtgtaaaagattttttcacttttgaatctttacctacttgctttcacattaagaatttgaacttttgagttttttccaggtctatatataatagattacatttattttgtaaagaaaatagtaatttaaagttttgccattttaaggtgacaatatttgggacagtataaatattatagacaagggcccccttgctgtctgctttagcaggtagtgacattaattgacttatagttttgtgtaaatgaacaaactgcttttgacaagaaatttattctgtcctagtttcctgcgtggtaaatcatagaaagattcaagttcatttgggttaaatgtgctaataggatgtagcttttaaattctgctattgagtcagctgtaccttttaatactttaaatgtgttatttgtatggcccttataaaggtgtttgctgtaattctgttaaaagacttcgcctatgccatactggtgtataaaaactgccgcaattggacgccggtgtggtactcatttcagtatacctgaactgtacattttgtgcaatggctttatctaaaagaatgacgcttcgtgaaagcactttgtggccttttttgggggggagggtgagagagtaggagagaataccatgttaagattaaaaaaaaaaacaaaaacattggtcatgtattaggcagaaacagtgttcataacatttttctgggttttaaatatgttgtttcggatatccttaatataaatgttttaggtattctgtgtaccctgtcgtacccccaacattatagaatattgcagtgtgtcattgcaagctttctctgctgtcaccagtgaaacatagtgccctgttaaattcccccactttaacttccttgtgatcaacagtaactggatgtttttgaggtgctcaattggaataaaaatattccaatctatttggagaccaaaggcaaaatcagttttcttacctttggaattattcgtaccttttatggtaaatttcagctttgacatgtattatgaggaacgtaccaaaaaccggtttgtaacaaatctgtagagaaggtctgaatctatcgtgtttgccttttcaggtgccatttctactgcctaatacagtgccatttgccttgtgaagacccataaacattcattgtgttgaatgtaagatagagactctccctagtcttactgatctcagtaccccacaaatgattaagaatgatatgaaaaccagcagctaaggaacatcttattatttagttgtagcatattcataacaagtgtccttcaaggataaacatatattctctatttgtatttagcaagtaaaacttgtgttgacctttagtgcattatattcagcttttaacagtattatgtatgtactggaaagcaaagaaatcttagagtcttggacattgtttatttgtgcaacaactagaaaggagcaatgaagtttatttcagttgtatttttccctaagcacaatctgcaatagtttatgtatgacagagataattcaaaaaggaaaactatatataaaagttgtatataaagtttgtctctgaaatatttctttgaagtttttaaaaaattgactcatgtttaaaaacaaaaacacatattcagagcattggacttttttaacttgttttcatctgtttatcatgacttttttatttctggtgtagagtccacattatttagtttgttgtacttttaaatttcaaagttcaaatctgaagtataaagctgaggtgcgtagcgacgccgcgggaagtatagctgaggacttg

SEQ ID NO: 16514 - DNA, 3048 bp, Homo sapiens
ggtaatgggcatatcgtgaccaggcgtcgacctggcacaatattttaaatttaattatttggcagtagtcactgtttttgacaaccaatgaaatagcgtctaaatatcttgtatattttttagcatcaaaatgttttggtttccactgctgacaggtgcttgttgtttagcctaatgtggatatttaaattgttaacataccaaacacacatggtaatagtttgggacaaaataactagtaaaatgttgatttctcggctatttcactgactgcggcatgtcctcgtgtcttctctgattttgtggtacatgaatgaatgcatttatctttttagtgacttactagttacgaacttgaattatcacctctttgtcatacttaagtatcatttacataaagtgtaaaagattttttcacttttgaatctttacctacttgctttcacattaagaatttgaacttttgagttttttccaggtctatatataatagattacatttattttgtaaagaaaatagtaatttaaagttttgccattttaaggtgacaatatttgggacagtataaatattatagacaagggcccccttgctgtctgctttagcaggtagtgacattaattgacttatagttttgtgtaaatgaacaaactgcttttgacaagaaatttattctgtcctagtttcctgcgtggtaaatcatagaaagattcaagttcatttgggttaaatgtgctaataggatgtagcttttaaattctgctattgagtcagctgtaccttttaatactttaaatgtgttatttgtatggcccttataaaggtgtttgctgtaattctgttaaaagacttcgcctatgccatactggtgtataaaaactgccgcaattggacgccggtgtggtactcatttcagtatacctgaactgtacattttgtgcaatggctttatctaaaagaatgacgcttcgtgaaagcactttgtggccttttttgggggggagggtgagagagtaggagagaataccatgttaagattaaaaaaaaaaacaaaaacattggtcatgtattaggcagaaacagtgttcataacatttttctgggttttaaatatgttgtttcggatatccttaatataaatgttttaggtattctgtgtaccctgtcgtacccccaacattatagaatattgcagtgtgtcattgcaagctttctctgctgtcaccagtgaaacatagtgccctgttaaattcccccactttaacttccttgtgatcaacagtaactggatgtttttgaggtgctcaattggaataaaaatattccaatctatttggagaccaaaggcaaaatcagttttcttacctttggaattattcgtaccttttatggtaaatttcagctttgacatgtattatgaggaacgtaccaaaaaccggtttgtaacaaatctgtagagaaggtctgaatctatcgtgtttgccttttcaggtgccatttctactgcctaatacagtgccatttgccttgtgaagacccataaacattcattgtgttgaatgtaagatagagactctccctagtcttactgatctcagtaccccacaaatgattaagaatgatatgaaaaccagcagctaaggaacatcttattatttagttgtagcatattcataacaagtgtccttcaaggataaacatatattctctatttgtatttagcaagtaaaacttgtgttgacctttagtgcattatattcagcttttaacagtattatgtatgtactggaaagcaaagaaatcttagagtcttggacattgtttatttgtgcaacaactagaaaggagcaatgaagtttatttcagttgtatttttccctaagcacaatctgcaatagtttatgtatgacagagataattcaaaaaggaaaactatatataaaagttgtatataaagtttgtctctgaaatatttctttgaagtttttaaaaaattgactcatgtttaaaaacaaaaacacatattcagagcattggacttttttaacttgttttcatctgtttatcatgacttttttatttctggtgtagagtccacattatttagtttgttgtacttttaaatttcaaagttcaaatctgaagaattagcgtttgtgatttcgggataccatgcagtggttttaatcccaggaaaaaaactatcaacaaaagttcgtttgattctcattatgtaactttgtagaaccatcctttctagatgggtccaccacagtgaatttgtaactttgaagtcaggatagaatatcattagattatctgtgagatagcattactatgttaggaccagcagagtttgggttggtaaaaataatgtttgctctattactgggttacagacatttcagcatttttaggttggttttaaatcactaaaaatatttattcggatttgaaggatttaagtgctaaaaatcaatccatttcttgcccttcaataattgtccatgcctgcctttgttgtttacatgctcttctgcccagactgttagtaatctagggaccccctttggagctgataagtacagttcagccttttctcctcaaatatataatgactttaacattcctaagaatataggtatttctgaatgatttaaatttgaggaattttaatacataaaatacaatgtacaaactttctgcccactcagatctcttctccatcatgtacttagtatttcccattaacctacacactgatttttatgctactccttgtagaaacaaaattctggtttgactcagtttttgtgtttataaacttttggaatgtgtaccccgtttatgtgaagaattatgacctatcagtcatagctaaatagtgaacctcaaaagtgttaacttttgactattcatgtgaggtttggtatcttgcatttatgtacatggctgtaaattatgtgcatttactctgtatttatgttatctagctgacttttacttgaattgttcaaattttaaaaattaaaatacgctcatgaaaa

SEQ ID NO: 16515 - DNA, 2772 bp, Homo sapiens
  misc_feature (4)..(5): n is a, c, g, or t
  misc_feature (2732)..(2732): n is a, c, g, or t
agcnnggtgaagggcggcgcgcttaggcaggcggtggcgcggctggagtgccgcggggagggctgtgccggttgctttctgcagccgcatctcggccagctctcctcgccgtccccggggcgctgtgcgtctccagtccgggaccgaagccgcctgccgtagcgggcggccagatccgcgtcccgcctcagcggccggaggacatgcgggagagagaatgagccagagggacacgctggtgcatctgtttgccggaggatgtggtggtacagtgggagctattctgacatgtccactggaagttgtaaaaacacgactgcagtcatcttctgtgacgctttatatttctgaagttcagctgaacaccatggctggagccagtgtcaaccgagtagtgtctcccggacctcttcattgcctaaaggtgatcttggaaaaagaagggcctcgttccttgtttagaggactaggccccaatttagtgggggtagccccttccagagcaatatactttgctgcttattcaaactgcaaggaaaagttgaatgatgtatttgatcctgattctacccaagtacatatgatttcagctgcaatggcaggttttactgcaatcacagcaaccaaccccatttggcttataaagactcggttacagcttgatgcaaggaaccgcggggaaaggcgaatgggtgcttttgaatgtgttcgtaaagtgtatcagacagatggactaaaaggattttataggggcatgtctgcttcatatgctggtatatcagagactgttatccattttgttatttatgaaagtataaaacaaaaactactggaatataagactgcttctacaatggaaaatgatgaagagtctgtgaaagaagcatcagattttgtgggaatgatgctagctgctgccacctcaaaaacttgtgccacaactatagcatatccacatgaagttgtaagaacaagactacgtgaagagggaacaaaatacagatctttttttcagactctatctttgcttgttcaagaagaaggttatgggtctctttatcgtggtctgacaactcatctagtgagacagattccaaacacagccattatgatggccacctatgaattggtggtttacctactcaatggatagcagcacgaggactgctgtactgcaaaaaaagaagaccaaaagattacagtggaccatgggatacagaagccagcatggcagacagaagaaaaatagtttgggaacatgtaactattctaagtggaagttttgttgtaggaattatagtaatcacaccacattacttggcctttcggtaatgtgaaaaaaaaaaaaaaacctcagagcctccaaggaaatgcctttagaagcactcctctctcaaaattgccattttctctaccatgtcccccagacacagttgggttttgttgatttatggcagtcttctaaacaaagccatccttaattttacatactgtattgtaactatccaaagatagtattggcagtcataaatttataacttctggcctttgtttaattccagtaaaataacagcaatgacaatgagatcgtcagtattattttcacatttccctgagaggacctggcacaatattttaaatttaattatttggcagtagtcactgtttttgacaaccaatgaaatagcgtctaaatatcttgtatattttttagcatcaaaatgttttggtttccactgctgacaggtgcttgttgtttagcctaatgtggatatttaaattgttaacataccaaacacacatggtaatagtttgggacaaaataactagtaaaatgttgatttctcggctatttcactgactgcggcatgtcctcgtgtcttctctgattttgtggtacatgaatgaatgcatttatctttttagtgacttactagttacgaacttgaattatcacctctttgtcatacttaagtatcatttacataaagtgtaaaagattttttcacttttgaatctttacctacttgctttcacattaagaatttgaacttttgagttttttccaggtctatatataatagattacatttattttgtaaagaaaatagtaatttaaagttttgccattttaaggtgacaatatttgggacagtataaatattatagacaagggcccccttgctgtctgctttagcaggtagtgacattaattgacttatagttttgtgtaaatgaacaaactgcttttgacaagaaatttattctgtcctagtttcctgcgtggtaaatcatagaaagattcaagttcatttgggttaaatgtgctaataggatgtagcttttaaattctgctattgagtcagctgtaccttttaatactttaaatgtgttatttgtatggcccttataaaggtgtttgctgtaattctgttaaaagacttcgcctatgccatactggtgtataaaaactgccgcaattggacgccggtgtggtactcatttcagtatacctgaactgtacattttgtgcaatggctttatctaaaagaatgacgcttcgtgaaagcactttgtggccttttttgggggggagggtgactctctttaccccccaaagttctacataaacaccccccacccccccttgctaagctaaaatgcgaaacctctaatacaacaacccagcggcctgcccagcctttccccgcccaccctaactgttttctatntgggctctttttttcgttgtcttacatacccacaccatat

SEQ ID NO: 16516 - DNA, 2711 bp, Homo sapiens
  misc_feature (4)..(5): n is a, c, g, or t
agcnnggtgaagggcggcgcgcttaggcaggcggtggcgcggctggagtgccgcggggagggctgtgccggttgctttctgcagccgcatctcggccagctctcctcgccgtccccggggcgctgtgcgtctccagtccgggaccgaagccgcctgccgtagcgggcggccagatccgcgtcccgcctcagcggccggaggacatgcgggagagagaatgagccagagggacacgctggtgcatctgtttgccggaggatgtggtggtacagtgggagctattctgacatgtccactggaagttgtaaaaacacgactgcagtcatcttctgtgacgctttatatttctgaagttcagctgaacaccatggctggagccagtgtcaaccgagtagtgtctcccggacctcttcattgcctaaaggtgatcttggaaaaagaagggcctcgttccttgtttagaggactaggccccaatttagtgggggtagccccttccagagcaatatactttgctgcttattcaaactgcaaggaaaagttgaatgatgtatttgatcctgattctacccaagtacatatgatttcagctgcaatggcaggttttactgcaatcacagcaaccaaccccatttggcttataaagactcggttacagcttgatgcaaggaaccgcggggaaaggcgaatgggtgcttttgaatgtgttcgtaaagtgtatcagacagatggactaaaaggattttataggggcatgtctgcttcatatgctggtatatcagagactgttatccattttgttatttatgaaagtataaaacaaaaactactggaatataagactgcttctacaatggaaaatgatgaagagtctgtgaaagaagcatcagattttgtgggaatgatgctagctgctgccacctcaaaaacttgtgccacaactatagcatatccacatgaagttgtaagaacaagactacgtgaagagggaacaaaatacagatctttttttcagactctatctttgcttgttcaagaagaaggttatgggtctctttatcgtggtctgacaactcatctagtgagacagattccaaacacagccattatgatggccacctatgaattggtggtttacctactcaatggatagcagcacgaggactgctgtactgcaaaaaaagaagaccaaaagattacagtggaccatgggatacagaagccagcatggcagacagaagaaaaatagtttgggaacatgtaactattctaagtggaagttttgttgtaggaattatagtaatcacaccacattacttggcctttcggtaatgtgaaaaaaaaaaaaaaacctcagagcctccaaggaaatgcctttagaagcactcctctctcaaaattgccattttctctaccatgtcccccagacacagttgggttttgttgatttatggcagtcttctaaacaaagccatccttaattttacatactgtattgtaactatccaaagatagtattggcagtcataaatttataacttctggcctttgtttaattccagtaaaataacagcaatgacaatgagatcgtcagtattattttcacatttccctgagaggacctggcacaatattttaaatttaattatttggcagtagtcactgtttttgacaaccaatgaaatagcgtctaaatatcttgtatattttttagcatcaaaatgttttggtttccactgctgacaggtgcttgttgtttagcctaatgtggatatttaaattgttaacataccaaacacacatggtaatagtttgggacaaaataactagtaaaatgttgatttctcggctatttcactgactgcggcatgtcctcgtgtcttctctgattttgtggtacatgaatgaatgcatttatctttttagtgacttactagttacgaacttgaattatcacctctttgtcatacttaagtatcatttacataaagtgtaaaagattttttcacttttgaatctttacctacttgctttcacattaagaatttgaacttttgagttttttccaggtctatatataatagattacatttattttgtaaagaaaatagtaatttaaagttttgccattttaaggtgacaatatttgggacagtataaatattatagacaagggcccccttgctgtctgctttagcaggtagtgacattaattgacttatagttttgtgtaaatgaacaaactgcttttgacaagaaatttattctgtcctagtttcctgcgtggtaaatcatagaaagattcaagttcatttgggttaaatgtgctaataggatgtagcttttaaattctgctattgagtcagctgtaccttttaatactttaaatgtgttatttgtatggcccttataaaggtgtttgctgtaattctgttaaaagacttcgcctatgccatactggtgtataaaaactgccgcaattggacgccggtgtggtactcatttcagtatacctgaactgtacattttgtgcaatggctttatctaaaagaatgacgcttcgtgaaagcactttgtggccttttttgggggggagggtgaatcaaaaaaatttgaccttctatgttcatattaaaatttctttctggcctgtggtttccatttttaagagaaaaataatttttggctaagtattcatgtaaaactggaca

SEQ ID NO: 16517 - DNA, 1986 bp, Homo sapiens
  misc_feature (4)..(5): n is a, c, g, or t
  misc_feature (1893)..(1893): n is a, c, g, or t
agcnnggtgaagggcggcgcgcttaggcaggcggtggcgcggctggagtgccgcggggagggctgtgccggttgctttctgcagccgcatctcggccagctctcctcgccgtccccggggcgctgtgcgtctccagtccgggaccgaagccgcctgccgtagcgggcggccagatccgcgtcccgcctcagcggccggaggacatgcgggagagagaatgagccagagggacacgctggtgcatctgtttgccggaggatgtggtggtacagtgggagctattctgacatgtccactggaagttgtaaaaacacgactgcagtcatcttctgtgacgctttatatttctgaagttcagctgaacaccatggctggagccagtgtcaaccgagtagtgtctcccggacctcttcattgcctaaaggtgatcttggaaaaagaagggcctcgttccttgtttagaggactaggccccaatttagtgggggtagccccttccagagcaatatactttgctgcttattcaaactgcaaggaaaagttgaatgatgtatttgatcctgattctacccaagtacatatgatttcagctgcaatggcaggttttactgcaatcacagcaaccaaccccatttggcttataaagactcggttacagcttgatgcaaggaaccgcggggaaaggcgaatgggtgcttttgaatgtgttcgtaaagtgtatcagacagatggactaaaaggattttataggggcatgtctgcttcatatgctggtatatcagagactgttatccattttgttatttatgaaagtataaaacaaaaactactggaatataagactgcttctacaatggaaaatgatgaagagtctgtgaaagaagcatcagattttgtgggaatgatgctagctgctgccacctcaaaaacttgtgccacaactatagcatatccacatgaagttgtaagaacaagactacgtgaagagggaacaaaatacagatctttttttcagactctatctttgcttgttcaagaagaaggttatgggtctctttatcgtggtctgacaactcatctagtgagacagattccaaacacagccattatgatggccacctatgaattggtggtttacctactcaatggatagcagcacgaggactgctgtactgcaaaaaaagaagaccaaaagattacagtggaccatgggatacagaagccagcatggcagacagaagaaaaatagtttgggaacatgtaactattctaagtggaagttttgttgtaggaattatagtaatcacaccacattacttggcctttcggtaatgtgaaaaaaaaaaaaaaacctcagagcctccaaggaaatgcctttagaagcactcctctctcaaaattgccattttctctaccatgtcccccagacacagttgggttttgttgatttatggcagtcttctaaacaaagccatccttaattttacatactgtattgtaactatccaaagatagtattggcagtcataaatttataacttctggcctttgtttaattccagtaaaataacagcaatgacaatgagatcgtcagtattattttcacatttccctgagaggacctggcacaatattttaaatttaattatttggcagtagtcactgtttttgacaaccaatgaaatagcgtctaaatatcttgtatattttttagcatcaaaatgttttggtttccactgctgacaggtgcttgttgtttagcctaatgtggatatttaaattgttaacataccaaacacacatggtaatagtttgggacaaaataactagtaaaatgttgatttctcggctatttcactgactgctgtactgcaaaaaaagaagaccaaaagnttacagtggaccatggggatacagaagccagcatggcagacagaaggaaaattagtttggggaccatgtaacttattctaagtgggagttttt

SEQ ID NO: 16518 - DNA, 1022 bp, Homo sapiens
  misc_feature (4)..(5): n is a, c, g, or t
agcnnggtgaagggcggcgcgcttaggcaggcggtggcgcggctggagtgccgcggggagggctgtgccggttgctttctgcagccgcatctcggccagctctcctcgccgtccccggggcgctgtgcgtctccagtccgggaccgaagccgcctgccgtagcgggcggccagatccgcgtcccgcctcagcggccggaggacatgcgggagagagaatgagccagagggacacgctggtgcatctgtttgccggaggatgtggtggtacagtgggagctattctgacatgtccactggaagttgtaaaaacacgactgcagtcatcttctgtgacgctttatatttctgaagttcagctgaacaccatggctggagccagtgtcaaccgagtagtgtctcccggacctcttcattgcctaaaggtgatcttggaaaaagaagggcctcgttccttgtttagaggactaggccccaatttagtgggggtagccccttccagagcaatatactttgctgcttattcaaactgcaaggaaaagttgaatgatgtatttgatcctgattctacccaagtacatatgatttcagctgcaatggcaggttttactgcaatcacagcaaccaaccccatttggcttataaagactcggttacagcttgatgcaaggaaccgcggggaaaggcgaatgggtgcttttgaatgtgttcgtaaagtgtatcagacagatggactaaaaggattttataggggcatgtctgcttcatatgctggtatatcagagactgttatccattttgttatttatgaaagtataaaacaaaaactactggaatataagactgcttctacaatggaaaatgatgaagagtctgtgaaagaagcatcagattttgtgggaatgatgctagctgctgccacctcaaaaacttgtgccacaactatagcatatccacatgaagttgtaaggacaagactacgtgtcagccattgacgggtcctctaagatctcaccaggttca

SEQ ID NO: 16519 - DNA, 3507 bp, Homo sapiens
  misc_feature (4)..(5): n is a, c, g, or t
  misc_feature (1953)..(1953): n is a, c, g, or t
  misc_feature (2143)..(2143): n is a, c, g, or t
agcnnggtgaagggcggcgcgcttaggcaggcggtggcgcggctggagtgccgcggggagggctgtgccggttgctttctgcagccgcatctcggccagctctcctcgccgtccccggggcgctgtgcgtctccagtccgggaccgaagccgcctgccgtagcgggcggccagatccgcgtcccgcctcagcggccggaggacatgcgggagagagaatgagccagagggacacgctggtgcatctgtttgccggaggatgtggtggtacagtgggagctattctgacatgtccactggaagttgtaaaaacacgactgcagtcatcttctgtgacgctttatatttctgaagttcagctgaacaccatggctggagccagtgtcaaccgagtagtgtctcccggacctcttcattgcctaaaagcaatatactttgctgcttattcaaactgcaaggaaaagttgaatgatgtatttgatcctgattctacccaagtacatatgatttcagctgcaatggcaggtatgaatgtataatattaaaaaaaaaaaaaactttctgaaacctagaggcttaatattgaattataagtttgtagtgaaaagttgatgattaatgtgcttttcattgattagatgatttttacgtttatcgatataaaccaaattaggtatatgtaaaatctgtcatcagttgacatttttgtagtcaggagtttacatgctagggtacaagtaatatatttatattgccttgtgtagtccactgaatgtttagtgatcattgttaacagttttaagaatccaaccataattacactataaataagttatggagctgtaatttactcttctctcctcaatttctgttagtgccttttccctttttgctgcatgttttggcttctgtctgaaatgtgtcggcaattcttggtaaagtattcattttgtcctgtgctcaaatgctgaaatttttgtgagtgatgtattattattgacaattcagttactatgtgtattttttaaaattgtttattattctacataattcacactagacagcacctgaaatttagacactggctatgtgtacatgcttactatagaaatgtttccaggaactctctgtttctgtcatcactgataagtatatatgattctgaattaaaataactagttttaggtctttaccctgccataaagataaacagttggtttgaccaatctggttctggaatcatttgctgctatgcatgttagacaaagccacgaactttgattttccattgaaaattctccctaatatctgagatttattgtatatttactcatatctcacattttcaaattatgctgtaactttataaactgtagctgctttcatcagctattgatcaataaattgaatgtcaattatgtgcttaataatgagtgccttaaactgttaaacacttttggtttagaaataaagtgaatcaatttgacctatatacttcatgaagtaagtaagtttgaaatacaaatttctgaaaggtcaatagcccttatcgtattacaaattgtttttaaggctttttgtatttattaattgtcagttgattcactgaagctttaaaactggaagggacaatccaaaggtcaaaagagtgaaatacaatcatttaccaataaggaaaccttgggcaaattatgtaatttatgtgaacctctcttagcttacccatggaatgagtcaagtggtctacatagatttggattttgagaattagttctttcatttagtgttatagagattatcttgttacaactagaattatttttaatgtaatttttacagatgttgaatattagtagataggatttttcccctacgaatttggatgtaaggtaaaggttggtggccagtgacaaaccttataaccactttatcaggttctttaaaaatatatttntgaattaccagtgattatgtttttggcttataacctcagataattataaagaaatgttaatcttatttgaaagaattggaatctagaaagttagatgagcagtcattttatattgatatttgttatatcagtatagcaaatgcagaggttcagaatatctttatttccactggaacatcttatttcattngagtatctcatcagaatttattactgtatttgtatcacattgcaaagaatttcagtagaattgtcagtttgcacttttttctcaaatgtgtacaaatgttaacatatagttcatttttatctgtacattgatgccatttcccaacttgaattcctcaagttttggtaaacttacaatctcatacttgttcagaggttattgcactgtacacttactgtgtagaaaatactgtttgaatttgtttgcagttacattgttctgagaactgtgctctcagagcttctgtgcactattcatgagcattaacacttagccttgcagttttatacataactatatggttagtaaaactgaatggtccaatgcagactcattaaagtaggcttttgccccctttgttcttgaaataatctagaccagattactcggggttttttttaggattatttttataggtctaaatatgaatgatttgggggtatgaagtacttaaagatagttctgtgaaaaatcattttcagctgtctattcaagggaaaaaatgctaaccttgtcactttactacacaaaaccacactaaaataaaccattaatgatactgcctgcaagattttaacacaccagatagcacacacattaaggatttataaggcactgtacgtaatttttattccaagtgacctctcaattcattttcattttgcattttatccatatgaactcatgtttaatttagataataaaaatttattttattaaaaggacagtttatttaaagtgggtctttttatttgttgtagtgcatactataagaatttgtaagcctctaaagttgagctataaattttcatgcattaaaaatttgtttcagttgtgaggatatttaatcagattaaataatgttgactcttaatattttgcctgccttttttttctcctacacatgacctttgacagactaagtatatctcagctattgagggtatctgttttgttgcctgtatattttgtttaaattaacttgtatattcctttgtatacacctaggcacagatgtatgcaaaaaaaatttgttaaattacttctttctttatactaattctcaatttttaaaagattttatctggcatgtatatacttttatatagaacattataaatgtaaaggaaatgaattctaattttaattggattatgtattcatacagttattctcaatttttaaaatactaataatgtaatcattgaatgtttcctacatacgtagtgggttttatttgctcacagcatacagttatttttcaatttatgtttttctattagacttaaatttcattataataaaggcttttactcattaaatac

SEQ ID NO: 16520 - DNA, 1109 bp, Homo sapiens
  misc_feature (4)..(5): n is a, c, g, or t
agcnnggtgaagggcggcgcgcttaggcaggcggtggcgcggctggagtgccgcggggagggctgtgccggttgctttctgcagccgcatctcggccagctctcctcgccgtccccggggcgctgtgcgtctccagtccgggaccgaagccgcctgccgtagcgggcggccagatccgcgtcccgcctcagcggccggaggacatgcgggagagagaatgagccagagggacacgctggtgcatctgtttgccggaggatgtggtggtacagtgggagctattctgacatgtccactggaagttgtaaaaacacgactgcagtcatcttctgtgacgctttatatttctgaagttcagctgaacaccatggctggagccagtgtcaaccgagtagtgtctcccggacctcttcattgcctaaaggtgatcttggaaaaagaagggcctcgttccttgtttagaggactaggccccaatttagtgggggtagccccttccagagcaatatactttgctgcttattcaaactgcaaggaaaagttgaatgatgtatttgatcctgattctacccaagtacatatgatttcagctgcaatggcagaacacaagaaattaaatacaaaataatgcaaaatatttcataagtatggatgtgcaatattactggccatagtgcaaaaggtgaaaggttttactgcaatcacagcaaccaaccccatttggcttataaagactcggttacagcttgatgcaaggaaccgcggggaaaggcgaatgggtgcttttgaatgtgttcgtaaagtgtatcagacagatggactaaaaggattttataggggcatgtctgcttcatatgctggtatatcagagactgttatccattttgttatttatgaaagtataaaacaaaaactactggaatataagactgcttctacaatggaaaatgatgaagagtctgtgaaagaagcatcagattttgtgggaatgatgctagctgctgccacctcaaaaacttgtgccacaactatagcatatccacatgaagttgtaaggacaagactacgtgtcagccattgacgggtcctctaagatctcaccaggttca

SEQ ID NO: 16521 - DNA, 3412 bp, Homo sapiens
  misc_feature (1858)..(1858): n is a, c, g, or t
  misc_feature (2048)..(2048): n is a, c, g, or t
gtttttatttttttttaatttcattttttctttttatcttcttggttaccaagttttagtgagttaagtggctgtcagagtattggaagggggtctgtttgaggatgaatggtaggaattttacatttgatgttgtcttattttaatgagtcaatacagaaagtacttcagagtatttatgaaaagtgtaaatctaatgttacatgagaatgtggctaggactttatggtttttaaatttctccattctaaaattatgaagatcaatttatatgtaaatcttacgcattaagaacatgcttattgataaatctaaatctctattttagagcaatatactttgctgcttattcaaactgcaaggaaaagttgaatgatgtatttgatcctgattctacccaagtacatatgatttcagctgcaatggcaggtatgaatgtataatattaaaaaaaaaaaaaactttctgaaacctagaggcttaatattgaattataagtttgtagtgaaaagttgatgattaatgtgcttttcattgattagatgatttttacgtttatcgatataaaccaaattaggtatatgtaaaatctgtcatcagttgacatttttgtagtcaggagtttacatgctagggtacaagtaatatatttatattgccttgtgtagtccactgaatgtttagtgatcattgttaacagttttaagaatccaaccataattacactataaataagttatggagctgtaatttactcttctctcctcaatttctgttagtgccttttccctttttgctgcatgttttggcttctgtctgaaatgtgtcggcaattcttggtaaagtattcattttgtcctgtgctcaaatgctgaaatttttgtgagtgatgtattattattgacaattcagttactatgtgtattttttaaaattgtttattattctacataattcacactagacagcacctgaaatttagacactggctatgtgtacatgcttactatagaaatgtttccaggaactctctgtttctgtcatcactgataagtatatatgattctgaattaaaataactagttttaggtctttaccctgccataaagataaacagttggtttgaccaatctggttctggaatcatttgctgctatgcatgttagacaaagccacgaactttgattttccattgaaaattctccctaatatctgagatttattgtatatttactcatatctcacattttcaaattatgctgtaactttataaactgtagctgctttcatcagctattgatcaataaattgaatgtcaattatgtgcttaataatgagtgccttaaactgttaaacacttttggtttagaaataaagtgaatcaatttgacctatatacttcatgaagtaagtaagtttgaaatacaaatttctgaaaggtcaatagcccttatcgtattacaaattgtttttaaggctttttgtatttattaattgtcagttgattcactgaagctttaaaactggaagggacaatccaaaggtcaaaagagtgaaatacaatcatttaccaataaggaaaccttgggcaaattatgtaatttatgtgaacctctcttagcttacccatggaatgagtcaagtggtctacatagatttggattttgagaattagttctttcatttagtgttatagagattatcttgttacaactagaattatttttaatgtaatttttacagatgttgaatattagtagataggatttttcccctacgaatttggatgtaaggtaaaggttggtggccagtgacaaaccttataaccactttatcaggttctttaaaaatatatttntgaattaccagtgattatgtttttggcttataacctcagataattataaagaaatgttaatcttatttgaaagaattggaatctagaaagttagatgagcagtcattttatattgatatttgttatatcagtatagcaaatgcagaggttcagaatatctttatttccactggaacatcttatttcattngagtatctcatcagaatttattactgtatttgtatcacattgcaaagaatttcagtagaattgtcagtttgcacttttttctcaaatgtgtacaaatgttaacatatagttcatttttatctgtacattgatgccatttcccaacttgaattcctcaagttttggtaaacttacaatctcatacttgttcagaggttattgcactgtacacttactgtgtagaaaatactgtttgaatttgtttgcagttacattgttctgagaactgtgctctcagagcttctgtgcactattcatgagcattaacacttagccttgcagttttatacataactatatggttagtaaaactgaatggtccaatgcagactcattaaagtaggcttttgccccctttgttcttgaaataatctagaccagattactcggggttttttttaggattatttttataggtctaaatatgaatgatttgggggtatgaagtacttaaagatagttctgtgaaaaatcattttcagctgtctattcaagggaaaaaatgctaaccttgtcactttactacacaaaaccacactaaaataaaccattaatgatactgcctgcaagattttaacacaccagatagcacacacattaaggatttataaggcactgtacgtaatttttattccaagtgacctctcaattcattttcattttgcattttatccatatgaactcatgtttaatttagataataaaaatttattttattaaaaggacagtttatttaaagtgggtctttttatttgttgtagtgcatactataagaatttgtaagcctctaaagttgagctataaattttcatgcattaaaaatttgtttcagttgtgaggatatttaatcagattaaataatgttgactcttaatattttgcctgccttttttttctcctacacatgacctttgacagactaagtatatctcagctattgagggtatctgttttgttgcctgtatattttgtttaaattaacttgtatattcctttgtatacacctaggcacagatgtatgcaaaaaaaatttgttaaattacttctttctttatactaattctcaatttttaaaagattttatctggcatgtatatacttttatatagaacattataaatgtaaaggaaatgaattctaattttaattggattatgtattcatacagttattctcaatttttaaaatactaataatgtaatcattgaatgtttcctacatacgtagtgggttttatttgctcacagcatacagttatttttcaatttatgtttttctattagacttaaatttcattataataaaggcttttactcattaaatac

SEQ ID NO: 16522 - DNA, 851 bp, Homo sapiens
atccttaattaaattattccccccccccccttgattacccggacgccgctggacctggccgcacgccgcaatctagcaggcgtcggggatccagggccgctttgaggagcctggcttcggatttcgcgtaggttgcatggcccaaggggacggggcggaaagtgcggaggctgaggacaaaatgggcgccggagactcctttagccctcgctccttgcagcgctcgcttgggcctctgcacgtcactcacgccccacctcggacctcgggccgctcatttccgggctcggctttgcaagatgtggtggtacagtgggagctattctgacatgtccactggaagttgtaaaaacacgactgcagtcatcttctgtgacgctttatatttctgaagttcagctgaacaccatggctggagccagtgtcaaccgagtagtgtctcccggacctcttcattgcctaaaggtgatcttggaaaaagaagggcctcgttccttgtttagaggactaggccccaatttagtgggggtagccccttccagagcaatatacactatgtacagactctgcgaatcagtccgctcggcgggcagcgtcctcgccaggtccaggcgccttggccggggaggagggggcaccagtagggaagggcgggctggtccaacaccttcttggcactcgaggagggcgggggaggaagtgccgatggcacctcccgatacaaaacatggagagaattctttaaataacggcacgaaactgagactgtcccccgaggaacctccgtgggcctcgggctgggggaggaccgcagtgcagtctctgcagtgaccgtaggcggtaccgaccga

SEQ ID NO: 16523 - DNA, 1142 bp, Homo sapiens
atccttaattaaattattccccccccccccttgattacccggacgccgctggacctggccgcacgccgcaatctagcaggcgtcggggatccagggccgctttgaggagcctggcttcggatttcgcgtaggttgcatggcccaaggggacggggcggaaagtgcggaggctgaggacaaaatgggcgccggagactcctttagccctcgctccttgcagcgctcgcttgggcctctgcacgtcactcacgccccacctcggacctcgggccgctcatttccgggctcggctttgcaagatgtggtggtacagtgggagctattctgacatgtccactggaagttgtaaaaacacgactgcagtcatcttctgtgacgctttatatttctgaagttcagctgaacaccatggctggagccagtgtcaaccgagtagtgtctcccggacctcttcattgcctaaagtgagagcatagtattcaggagtgttttttagtttgtttgcgttagtgagttccagatgtttgtttacttatattctgccacattgaaaatgattttttataaacctatttacagaagttactctgaattgtactcataaggaatgataatccctaatggagaagaacagttagacagataagataaagtgtaattttacttccaaatcatgtgtatttagaatatttctacatttatccagtggagttttttctaaagctattataagtattttattttggattattcatttacttttgaaatgtgataatgtttaatgctaactcctttcgtgtatatttttaatgttccaagtaagtacatccaattaatgataatctgtgatttttatgtaacctaagtacaactgagacagcagagttctaatgctgttcagtatttgtttaacatttcctgatggtttggaaaagatttgtttttacagtttgccatacttcattatgttgcaattggatttgaaatttcaaaactattaaaattaggtttcgtatgtttatacttgtaaataatggaatgccttcgtgtctgccttatcagctcagtgtttgaacttagttcagtagtgtttattttgtaatagcaaataaactcattctgtgtatttacctttgttacta

SEQ ID NO: 16524 - DNA, 328 bp, Homo sapiens
gtgattctagaggatcccgttcactttctacacctacacactgatttttatgctactccttgtagaaacaaaattctggtttgactcagtttttgtgtttataaacttttggaatgtgtaccccgtttatgtgaagaattatgacctatcagtcatagctaaatagtgaacctcaaaagtgttaacttttgactattcatgtgaggtttggtatcttgcatttatgtacatggctgtaaattatgtgcatttactctgtatttatgttatctagctgacttttacttgaattgttcaaattttaaaaattaaaatacgctcatgaaaa

SEQ ID NO: 16525 - DNA, 308 bp, Homo sapiens
gatttttatgctactccttgtagaaacaaaattctggtttgactcagtttttgtgtttataaacttttggaatgtgtaccccgtttatgtgaagaattatgacctatcagtcatagctaaatagtgaacctcaaaagtgttaacttttgactattcatgtgaggtttggtatcttgcatttatgtacatggctgtaaattatgtgcatttactctgtatttatgttatctagctgacttttacttgaattgttcaaattttaaaaattaaaatacgctcatgaaaatatggctttttctgtaatatat

SEQ ID NO: 16526 - DNA, 92 bp, Homo sapiens
ccatgctttatgtagcgacttgtttttgttttagaattactaatagaagggcgtttttaaagttcttaaattaaacattagcatattaagcc

SEQ ID NO: 16527 - DNA, 303 bp, Homo sapiens
ccaatcagacatgagttacctggagtacttctgatgatagttctccactcctgagtgggaaaaacaggaggaatggactctccttcctccagacatgttcatatttaaataagatgcctgaactactaccaccatcttttaagcaacccaaatatgaaattaacacatggaagagaacagaaccaataaaatctcagagaagttagagacattgtataccaagcttaatgcctgcattacccatgaaagttatgtgaaacttattaaaagtgtatggatgatataagaaaagttgagttgatt

SEQ ID NO: 16528 - DNA, 1090 bp, Homo sapiens
cgccaacattgggaaacctagtaaaaagtggaaatcgagcgttttaaataaaaaaaaaaaaaggtttctactagcaagactgatcgtaggcgaacttctcaaggaattttggaatattgtgccaaagtgagaatatttaatatttccaaaagtagacttaactaggaatacttaaagcagagactattggaaatgctttaatttgggatttcaggaaagggcttgaagagaaatattttatatgagcaagcctcttggaataattgaatcaccttaattttgtcactgttacttcgaagagaacgagaagagagaagatgggaaacgaaaggagaaagggaaaagaaatggggtggaaagaaaaaagcagaagagatcgccctataccagtaggcctagtaccctaggattctggcctctttctcccacctttggtgtttaagattaaggacagtgcattcctgcttttagaaatttaaatttaagtttgaagacttaattttaattactgtagtaggtaaagcaaagtcgttaaatacttgacatcaggatcccattggagtattgatttaggtcttttcaaaggtggtggtcctggttctctgcaccagccactggcggaatggcggaatggtgtatctaccaatgaacagatggactgggtgggcctcgggtacgggtggcttgagatgcaaatgcaagggtaggaaggcaccttcccccccaccactcccagcccaccccgccaatcttaaaacattgatctttataaaattcgcaaacgtcccacaggatttcattggcttaagagtattgtcaaatgaagacgccaggaagtattgagtttctgggtacataatactgtcctgagtgttgaaggaagaggactaatacgagattttaaaaaatggctgtggacaaccatccttcaggtgtgatggcaggacatcttgtatcacctgaaacttccttttttcgccgctaggtggtgggtgtgagtcttttgcggcctttaagtttctacggtgtttggaggaaatacgtttcagtttcaaataaatgaacaacgtgtaactctaagatgagtaaa

SEQ ID NO: 16529 - DNA, 423 bp, Homo sapiens
aatagtctggacacaaggacagtgtgctttggattagaggacatggtaagaaggcggcaggatgtgtgggatttgctacaggattgaacttaaggagatgaacttttcaatgggggagttttatatgcaactaatggtgaacttaggtagaggatggggaatagtagcatttaaaagcaaagaacatacagctctgggttgattgcttcagctttgcaactatccactgataacttggctttaaccaagttatgctgtatcttcaaaattttcatttgtaaaatggtgttattaacatccacctttgggattgctgagagaattaagtgagaaaaactctgttaaagggtttaggacaatatccagcgacagcaaatgctcaataaatgtcataattatttttctttgtaaaactttagacgt

SEQ ID NO: 16530 - DNA, 451 bp, Homo sapiens
aagaagtacttgagaatctatttcagttgcaaaatagttaacaaaatttgatttgagtagttctgaccttgctgtgctttggactcccatttgacagccctgaaggttcgtcattctaatttactcctgcccaaatggtgattttgacagtttaatccaaagtcttttaaagcaatgtctattcataccactttacaatctttatctaatctttagtgttctgaagatttaatttgctgacatttctaatttatggtctaaattatttgagagttttttgagattgagattaagcagatctcatagcagaatgggtactacaggagaagtcatagtatttcagtttcagtgtcttttggtttctgttggcttcctttcgaatcaaggctttactaagagagattggctcttaggagctcattgcctttttaaagcccaataattatatgtg

SEQ ID NO: 16531 - DNA, 403 bp, Homo sapiens
cttttccaaacattgctagacacatagtctcataaagaataaagaactaaagagaaaaattcttaccagaaatgagtatagtaaaatccacttgcttgttagtctctgctgtggtagggttttaaaattcatttaaaacaaaaactgaaaattagtaaagttaacattctttatcttgttttatttcattatgccatttttatcatgaagtactattaaatttagtagcaaacaaattctgtcgtgcagatgagttatactagtattcactcaggaagcataaagtcttatttctcctgatttacatgatagaatgattaccagatcaaagagaagaaaagttcatcattaccatcaatctctgggctcatacgttactgggtatagacctctgcgtgtcata

SEQ ID NO: 16532 - DNA, 293 bp, Homo sapiens
gaataatacttgctaccataaaagcacacattaagctcatagcccatggacctataaagcaactatgcaatcaagactacaaagtagtatatagtattctatgacatgaaaaaatactactatatagtattctatgacatggaaaaaaacctgacatatcatattatccttgaacaaaaaacagcctatgtgctctaattaaaagacatgaggtggcaaactggatttaaaaaaatctaaccttctgccgtcttcaagagacctatctcacatgtaatgccactcacaggcaa

SEQ ID NO: 16533 - DNA, 1462 bp, Homo sapiens
acctcgagacggaagtgagcgacacactctgcgtcctcgcctcaccaggaaactactaaagttcctggggaagcaaagtagaatttcataagaacaaaatggatggagaggagaaaacctatggtggctgtgaaggacctgatgccatgtatgtcaaattgatatcatctgatggccatgaatttattgtaaaaagagaacatgcattaacatcaggcacgataaaagccatgttgagtggcccaggtcagtttgctgagaacgaaaccaatgaggtcaattttagagagataccttcacatgtgctatcgaaagtatgcatgtattttacgtacaaggttcgctacactaacagctccaccgagattcctgaattcccaattgcacctgaaattgcactggaactgctgatggctgcgaacttcttagattgttaaataaaataaattataataaactgttaactcttttcagtatttaatacctgtagttcagttagtaactttttcatatatagcatgttgcctgtatgcagttgaactatataaagttcattgcaaagcagattatcttgtttttttgcatagcaatcaaagttgaaatttgtttgctacatcaacaaattaaggacattttcacaaactgagaaataaacaaatatgccaattcgtaggtggttttgccttatcctttgaatgtgacttaaaatcagcaatgatgatatagtaaatactgaaatttaggtgtaaatcaatacgttctacagggaaataatgaggctaagtatttttatgtttttagtggttttttagaaacctaatcttatagccgccattagcattactagagttatgcaaataattgcattataaacatgtttataacttagccaaaacattgatttttataactctccaagtatgagttgaaatttcttatgtcttttgataaactgcagtattctttaagtgtactttgtccttttgtttattgctacaatttaagaactttatttaaaaacaattttggaaggttactaggtacagcttttgcagaagaaactgaactgtagccagatggtcagcaagtaaactacatgacttagagttcttgtgcattatacattttgggtaattcaaagtactgtatttgcattgactataaagcgtcgtttgcaatatttattcttccttcatagtcccttgttgtgattatacttccagttgtttaaatgtattttaaaagactcactattaactttattcagatcttaaaagctacacctttttgaactattccagtctttctccatccaattagaatgttatggaataacatgtgaagagatacagtgaaaatcatattataatgcattgaagatatcctacatgaattatcttctattaaaatatgtcccaataaatatacccataatcagtgggtcttctactgaaatcaagct

SEQ ID NO: 16534 - DNA, 459 bp, Homo sapiens
acctcgagacggaagtgagcgacacactctgcgtcctcgcctcaccaggaaactactaaagttcctggggaagcaaagtagaatttcataagaacaaaatggatggagaggagaaaacctatggtggctgtgaaggacctgatgccatgtatgtcaaattgatatcatctgatggccatgaatttattgtaaaaagagaacatgcattaacatcaggcacgataaaagccatgttgagtggcccaggtcagtttgctgagaacgaaaccaatgaggtcaattttagagagataccttcacatgtgctatcgaaagtatgcatgtattttacgtacaaggttcgctacactaacagctccaccgagattcctgaattcccaattgcacctgaaattgcactggaactgctgatggctgcgaacttcttagattgttaaataaaataaattataataaact

SEQ ID NO: 16535 - DNA, 870 bp, Homo sapiens
acctcgagacggaagtgagcgacacactctgcgtcctcgcctcaccaggaaactactaaagttcctggggaagcaaagtagaatttcataagaacaaaatggatggagaggagaaaacctatggtggctgtgaaggacctgatgccatgtatgtcaaattgatatcatctgatggccatgaatttattgtaaaaagagaacatgcattaacatcaggcacgataaaagccatgttgagtggcccaggtcagtttgctgagaacgaaaccaatgaggtcaattttagagagataccttcacatgtgctatcgaaagtatgcatgtattttacgtacaaggttcgctacactaacagctccaccgagattcctgaattcccaattgcacctgaaattgcactggaactgctgatggctgcgaacttcttagattgttaaataaaataaattataataaactgttaactcttttcagtatttaatacctgtagttcagttagtaactttttcatatatagcatgttgcctgtatgcagttgaactatataaagttcattgcaaagcagattatcttgtttttttgcatagcaatcaaagttgaaatttgtttgctacatcaacaaattaaggacattttcacaaactgagaaataaacaaatatgccaaatcgtagtggttgctatcttgatggcttaatcgcatgatgttagtaatctgaattgggacactcgtcaggaaggggcagttggtcgggtaacacatcttcgcctggttagtgaatgctaagtttccacaggttcaccgagggatttggcggccaaaaagggcgcaaaggcggagcagtcgcccgcatcctccttggcattacgt

SEQ ID NO: 16536 - DNA, 625 bp, Homo sapiens
caaccccataggctaggtacgaggctgggtgttagctcgcctacaggtacggatctcccgcgcgtcgccgaaagcggctctgacccagcggaagtaattctttcgactgccccggaacccaccggagcaggcagctgggggtgggggggcggccctgggataggggctgtggcagtacgcggggacccggctgcggtggctgcgggactgacgagaaactactaaagttcctggggaagcaaagtagaatttcataagaacaaaatggatggagaggagaaaacctatggtggctgtgaaggacctgatgccatgtatgtcaaattgatatcatctgatggccatgaatttattgtaaaaagagaacatgcattaacatcaggcacgataaaagccatgttgagtggcccaggtcagtttgctgagaacgaaaccaatgaggtcaattttagagagataccttcacatgtgctatcgaaagtatgcatgtattttacgtacaaggttcgctacactaacagctccaccgagattcctgaattcccaattgcacctgaaattgcactggaactgctgatggctgcgaacttcttagattgttaaataaaataaattataataaact

SEQ ID NO: 16537 - DNA, 448 bp, Homo sapiens
agatttggcacgagtcggcacgaggcgggactgacgagaaactactaaagttcctggggaagcaaagtagaatttcataagaacaaaatggatggagaggagaaaacctatggtggctgtgaaggacctgatgccatgtatgtcaaattgatatcatctgatggccatgaatttattgtaaaaagagaacatgcattaacatcaggcacgataaaagccatgttgagtggcccaggtcagtttgctgagaacgaaaccaatgaggtcaattttagagagataccttcacatgtgctatcgaaagtatgcatgtattttacgtacaaggttcgctacactaacagctccaccgagattcctgaattcccaattgcacctgaaattgcactggaactgctgatggctgcgaacttcttagattgttaaataaaataaattataataaact

SEQ ID NO: 16538 - DNA, 452 bp, Homo sapiens
cttaatttgaaataacagccttaaatcctttacaagatggagaaactactaaagttcctggggaagcaaagtagaatttcataagaacaaaatggatggagaggagaaaacctatggtggctgtgaaggacctgatgccatgtatgtcaaattgatatcatctgatggccatgaatttattgtaaaaagagaacatgcattaacatcaggcacgataaaagccatgttgagtggcccaggtcagtttgctgagaacgaaaccaatgaggtcaattttagagagataccttcacatgtgctatcgaaagtatgcatgtattttacgtacaaggttcgctacactaacagctccaccgagattcctgaattcccaattgcacctgaaattgcactggaactgctgatggctgcgaacttcttagattgttaaataaaataaattataataaact

SEQ ID NO: 16539 - DNA, 370 bp, Homo sapiens
tactactactaaattcgcggccgcgtctgatgccatgtatgtcaaattgatatcatctgatggccatgaatttattgtaaaaagagaacatgcattaacatcaggcacgataaaagccatgttgagtggcccaggtcagtttgctgagaacgaaaccaatgaggtcaattttagagagataccttcacatgtgctatcgaaagtatgcatgtattttacgtacaaggttcgctacactaacagctccaccgagattcctgaattcccaattgcacctgaaattgcactggaactgctgatggctgcgaacttcttagattgttaaataaaataaattataataaactaaaaaaagtcgacgcggccgcgc

SEQ ID NO: 16540 - DNA, 839 bp, Homo sapiens
ataaatcgaattcacacttgcgtgtacttatactacctgttcaaaccggtcagtttgctgagaacgaaaccaatgaggtcaattttagagagataccttcacatgtgctatcgaaagtatgcatgtattttacgtacaaggttcgctacactaacagctccaccgagattcctgaattcccaattgcacctgaaattgcactggaactgctgatggctgcgaacttcttagattgttaaataaaataaattataataaactaaaaaacacccaaccagaaacccctcccaaattccacaacatcaatatttttttttcccctccccccaaaacccatctatacccataatttacggaggtttcccccctaaaaggagtaaataaatacgtctataaaaaaacactagggtacatttcatttttctgtttttttcccccaacacccctttacagcttgtacaaagattgtttttcttttacaaccgaacgcattttctgttcactacttacatccacactatgtcttccatgtaacatttcacaaccattgtgtttcacccacctaccctaccaggtttgtgggcccccttttatttttcccgtttcaccaacatctccacattgtttatcgcgttcactcactcctctctacttccttagtttacacatttccggccaactacaatcctgccgtggtttctttagtatataatacatggtcgtcccctctttacacaaccttgacaatagaaatttcccactaccgcatttccccagtttataaagttgattgtcacattactacctcttcaattactcctgcactaccccccccatat

SEQ ID NO: 16541 - DNA, 893 bp, Homo sapiens
  misc_feature (526)..(526): n is a, c, g, or t
ttgaggaaagaaaggatatgtgtaagtaagcaagtatagtttcaggaagtgataaatgtgaaaaaaatatagcaaggttaagggttagagtgactgggatggggtgtctaattttggtaggatcatcagggaaggaagacctctctgaggagttgatgttttacctggagacctaaatgatgaggatttaaaagcttttcggacaacagcaattacaaatgcaaagaccttgaggtaagagtgaacttgaccgatttcgaggaataccaaaaaggccagtgtgactggagcatagtgaaggaagagtggtgggagacaagatcagagtggtaagtagggaagtaaatcaaatgtccagttgagacatggtagcttgaactagaagtgtggagttgaaagtgagtagtagtctgatttggaatgtaatttgaagctggagccaaatgggttttgctttcttcccaggaaccaaacgaacaaaaaaaaatgttttttgaataacgaatcacttttccaaagtgctggnataacaggcatgaaccacaaatctggccagctatggtcatatttatgtgttaatgcatttcagctaaactgctgtcctagattctttattgttgttattaagtaagagcagaaaaagcccatccagtaatgcctgaatttcaagcctcagcgattaggaacataatagtacagtcactcaagatatatttattgagcatctacctaatcgccaggcactattctaggcctgctgtcaagaaacttgaggaaagaaaggatatgtgtaagtaagcaagtatagtttcaggaagtgataaatgtgaaaaaaatatagcaaggttaagggttagagtgactgggatggggtgtctatttgcagtaccatc

SEQ ID NO: 16542 - DNA, 1628 bp, Homo sapiens
caaccccataggctaggtacgaggctgggtgttagctcgcctacaggtacggatctcccgcgcgtcgccgaaagcggctctgacccagcggaagtaattctttcgactgccccggaacccaccggagcaggcagctgggggtgggggggcggccctgggataggggctgtggcagtacgcggggacccggctgcggtggctgcgggactgacgagaaactactaaagttcctggggaagcaaagtagaatttcataagaacaaaatggatggagaggagaaaacctatggtggctgtgaaggacctgatgccatgtatgtcaaattgatatcatctgatggccatgaatttattgtaaaaagagaacatgcattaacatcaggcacgataaaagccatgttgagtggcccaggtcagtttgctgagaacgaaaccaatgaggtcaattttagagagataccttcacatgtgctatcgaaagtatgcatgtattttacgtacaaggttcgctacactaacagctccaccgagattcctgaattcccaattgcacctgaaattgcactggaactgctgatggctgcgaacttcttagattgttaaataaaataaattataataaactgttaactcttttcagtatttaatacctgtagttcagttagtaactttttcatatatagcatgttgcctgtatgcagttgaactatataaagttcattgcaaagcagattatcttgtttttttgcatagcaatcaaagttgaaatttgtttgctacatcaacaaattaaggacattttcacaaactgagaaataaacaaatatgccaattcgtaggtggttttgccttatcctttgaatgtgacttaaaatcagcaatgatgatatagtaaatactgaaatttaggtgtaaatcaatacgttctacagggaaataatgaggctaagtatttttatgtttttagtggttttttagaaacctaatcttatagccgccattagcattactagagttatgcaaataattgcattataaacatgtttataacttagccaaaacattgatttttataactctccaagtatgagttgaaatttcttatgtcttttgataaactgcagtattctttaagtgtactttgtccttttgtttattgctacaatttaagaactttatttaaaaacaattttggaaggttactaggtacagcttttgcagaagaaactgaactgtagccagatggtcagcaagtaaactacatgacttagagttcttgtgcattatacattttgggtaattcaaagtactgtatttgcattgactataaagcgtcgtttgcaatatttattcttccttcatagtcccttgttgtgattatacttccagttgtttaaatgtattttaaaagactcactattaactttattcagatcttaaaagctacacctttttgaactattccagtctttctccatccaattagaatgttatggaataacatgtgaagagatacagtgaaaatcatattataatgcattgaagatatcctacatgaattatcttctattaaaatatgtcccaataaatatacccataatcagtgggtcttctactgaaatcaagct

SEQ ID NO: 16543 - DNA, 1767 bp, Homo sapiens
caaccccataggctaggtacgaggctgggtgttagctcgcctacaggtacggatctcccgcgcgtcgccgaaagcggctctgacccagcggaagtaattctttcgactgccccggaacccaccggagcaggcagctgggggtgggggggcggccctgggataggggctgtggcagtacgcggggacccggctgcggtggctgcgggactgacgaagtcttgctgtgtggcccaggctggagtgcccggctggtctcaaattcctgacctcaagtgatctccctcccaaagtgttgcgattgcaggtgtgagccactgcacctggctgctgagaaatctttgcctacagtgagggaaactactaaagttcctggggaagcaaagtagaatttcataagaacaaaatggatggagaggagaaaacctatggtggctgtgaaggacctgatgccatgtatgtcaaattgatatcatctgatggccatgaatttattgtaaaaagagaacatgcattaacatcaggcacgataaaagccatgttgagtggcccaggtcagtttgctgagaacgaaaccaatgaggtcaattttagagagataccttcacatgtgctatcgaaagtatgcatgtattttacgtacaaggttcgctacactaacagctccaccgagattcctgaattcccaattgcacctgaaattgcactggaactgctgatggctgcgaacttcttagattgttaaataaaataaattataataaactgttaactcttttcagtatttaatacctgtagttcagttagtaactttttcatatatagcatgttgcctgtatgcagttgaactatataaagttcattgcaaagcagattatcttgtttttttgcatagcaatcaaagttgaaatttgtttgctacatcaacaaattaaggacattttcacaaactgagaaataaacaaatatgccaattcgtaggtggttttgccttatcctttgaatgtgacttaaaatcagcaatgatgatatagtaaatactgaaatttaggtgtaaatcaatacgttctacagggaaataatgaggctaagtatttttatgtttttagtggttttttagaaacctaatcttatagccgccattagcattactagagttatgcaaataattgcattataaacatgtttataacttagccaaaacattgatttttataactctccaagtatgagttgaaatttcttatgtcttttgataaactgcagtattctttaagtgtactttgtccttttgtttattgctacaatttaagaactttatttaaaaacaattttggaaggttactaggtacagcttttgcagaagaaactgaactgtagccagatggtcagcaagtaaactacatgacttagagttcttgtgcattatacattttgggtaattcaaagtactgtatttgcattgactataaagcgtcgtttgcaatatttattcttccttcatagtcccttgttgtgattatacttccagttgtttaaatgtattttaaaagactcactattaactttattcagatcttaaaagctacacctttttgaactattccagtctttctccatccaattagaatgttatggaataacatgtgaagagatacagtgaaaatcatattataatgcattgaagatatcctacatgaattatcttctattaaaatatgtcccaataaatatacccataatcagtgggtcttctactgaaatcaagct

SEQ ID NO: 16544 - DNA, 1601 bp, Homo sapiens
acctcgagacggaagtgagcgacacactctgcgtcctcgcctcaccagagtcttgctgtgtggcccaggctggagtgcccggctggtctcaaattcctgacctcaagtgatctccctcccaaagtgttgcgattgcaggtgtgagccactgcacctggctgctgagaaatctttgcctacagtgagggaaactactaaagttcctggggaagcaaagtagaatttcataagaacaaaatggatggagaggagaaaacctatggtggctgtgaaggacctgatgccatgtatgtcaaattgatatcatctgatggccatgaatttattgtaaaaagagaacatgcattaacatcaggcacgataaaagccatgttgagtggcccaggtcagtttgctgagaacgaaaccaatgaggtcaattttagagagataccttcacatgtgctatcgaaagtatgcatgtattttacgtacaaggttcgctacactaacagctccaccgagattcctgaattcccaattgcacctgaaattgcactggaactgctgatggctgcgaacttcttagattgttaaataaaataaattataataaactgttaactcttttcagtatttaatacctgtagttcagttagtaactttttcatatatagcatgttgcctgtatgcagttgaactatataaagttcattgcaaagcagattatcttgtttttttgcatagcaatcaaagttgaaatttgtttgctacatcaacaaattaaggacattttcacaaactgagaaataaacaaatatgccaattcgtaggtggttttgccttatcctttgaatgtgacttaaaatcagcaatgatgatatagtaaatactgaaatttaggtgtaaatcaatacgttctacagggaaataatgaggctaagtatttttatgtttttagtggttttttagaaacctaatcttatagccgccattagcattactagagttatgcaaataattgcattataaacatgtttataacttagccaaaacattgatttttataactctccaagtatgagttgaaatttcttatgtcttttgataaactgcagtattctttaagtgtactttgtccttttgtttattgctacaatttaagaactttatttaaaaacaattttggaaggttactaggtacagcttttgcagaagaaactgaactgtagccagatggtcagcaagtaaactacatgacttagagttcttgtgcattatacattttgggtaattcaaagtactgtatttgcattgactataaagcgtcgtttgcaatatttattcttccttcatagtcccttgttgtgattatacttccagttgtttaaatgtattttaaaagactcactattaactttattcagatcttaaaagctacacctttttgaactattccagtctttctccatccaattagaatgttatggaataacatgtgaagagatacagtgaaaatcatattataatgcattgaagatatcctacatgaattatcttctattaaaatatgtcccaataaatatacccataatcagtgggtcttctactgaaatcaagct

SEQ ID NO: 16545 - DNA, 1742 bp, Homo sapiens
caaccccataggctaggtacgaggctgggtgttagctcgcctacaggtacggatctcccgcgcgtcgccgaaagcggctctgacccagcggaagtaattctttcgactgccccggaacccaccggagcaggcagctgggggtgggggggcggccctgggataggggctgtggcagtacgcggggacccggctgcggtggctgcgggactgacgagatcatcagggaaggaagacctctctgaggagttgatgttttacctggagacctaaatgatgaggatttaaaagcttttcggacaacagcaattacaaatgcaaagaccttgaggaaactactaaagttcctggggaagcaaagtagaatttcataagaacaaaatggatggagaggagaaaacctatggtggctgtgaaggacctgatgccatgtatgtcaaattgatatcatctgatggccatgaatttattgtaaaaagagaacatgcattaacatcaggcacgataaaagccatgttgagtggcccaggtcagtttgctgagaacgaaaccaatgaggtcaattttagagagataccttcacatgtgctatcgaaagtatgcatgtattttacgtacaaggttcgctacactaacagctccaccgagattcctgaattcccaattgcacctgaaattgcactggaactgctgatggctgcgaacttcttagattgttaaataaaataaattataataaactgttaactcttttcagtatttaatacctgtagttcagttagtaactttttcatatatagcatgttgcctgtatgcagttgaactatataaagttcattgcaaagcagattatcttgtttttttgcatagcaatcaaagttgaaatttgtttgctacatcaacaaattaaggacattttcacaaactgagaaataaacaaatatgccaattcgtaggtggttttgccttatcctttgaatgtgacttaaaatcagcaatgatgatatagtaaatactgaaatttaggtgtaaatcaatacgttctacagggaaataatgaggctaagtatttttatgtttttagtggttttttagaaacctaatcttatagccgccattagcattactagagttatgcaaataattgcattataaacatgtttataacttagccaaaacattgatttttataactctccaagtatgagttgaaatttcttatgtcttttgataaactgcagtattctttaagtgtactttgtccttttgtttattgctacaatttaagaactttatttaaaaacaattttggaaggttactaggtacagcttttgcagaagaaactgaactgtagccagatggtcagcaagtaaactacatgacttagagttcttgtgcattatacattttgggtaattcaaagtactgtatttgcattgactataaagcgtcgtttgcaatatttattcttccttcatagtcccttgttgtgattatacttccagttgtttaaatgtattttaaaagactcactattaactttattcagatcttaaaagctacacctttttgaactattccagtctttctccatccaattagaatgttatggaataacatgtgaagagatacagtgaaaatcatattataatgcattgaagatatcctacatgaattatcttctattaaaatatgtcccaataaatatacccataatcagtgggtcttctactgaaatcaagct

SEQ ID NO: 16546 - DNA, 1663 bp, Homo sapiens
caaccccataggctaggtacgaggctgggtgttagctcgcctacaggtacggatctcccgcgcgtcgccgaaagcggctctgacccagcggaagtaattctttcgactgccccggaacccaccggagcaggcagctgggggtgggggggcggccctgggataggggctgtggcagtacgcggggacccggctgcggtggctgcgggactgacgagtgagtctcgggctggggcggaaacggagctccgggaaactactaaagttcctggggaagcaaagtagaatttcataagaacaaaatggatggagaggagaaaacctatggtggctgtgaaggacctgatgccatgtatgtcaaattgatatcatctgatggccatgaatttattgtaaaaagagaacatgcattaacatcaggcacgataaaagccatgttgagtggcccaggtcagtttgctgagaacgaaaccaatgaggtcaattttagagagataccttcacatgtgctatcgaaagtatgcatgtattttacgtacaaggttcgctacactaacagctccaccgagattcctgaattcccaattgcacctgaaattgcactggaactgctgatggctgcgaacttcttagattgttaaataaaataaattataataaactgttaactcttttcagtatttaatacctgtagttcagttagtaactttttcatatatagcatgttgcctgtatgcagttgaactatataaagttcattgcaaagcagattatcttgtttttttgcatagcaatcaaagttgaaatttgtttgctacatcaacaaattaaggacattttcacaaactgagaaataaacaaatatgccaattcgtaggtggttttgccttatcctttgaatgtgacttaaaatcagcaatgatgatatagtaaatactgaaatttaggtgtaaatcaatacgttctacagggaaataatgaggctaagtatttttatgtttttagtggttttttagaaacctaatcttatagccgccattagcattactagagttatgcaaataattgcattataaacatgtttataacttagccaaaacattgatttttataactctccaagtatgagttgaaatttcttatgtcttttgataaactgcagtattctttaagtgtactttgtccttttgtttattgctacaatttaagaactttatttaaaaacaattttggaaggttactaggtacagcttttgcagaagaaactgaactgtagccagatggtcagcaagtaaactacatgacttagagttcttgtgcattatacattttgggtaattcaaagtactgtatttgcattgactataaagcgtcgtttgcaatatttattcttccttcatagtcccttgttgtgattatacttccagttgtttaaatgtattttaaaagactcactattaactttattcagatcttaaaagctacacctttttgaactattccagtctttctccatccaattagaatgttatggaataacatgtgaagagatacagtgaaaatcatattataatgcattgaagatatcctacatgaattatcttctattaaaatatgtcccaataaatatacccataatcagtgggtcttctactgaaatcaagct

SEQ ID NO: 16547 - DNA, 1574 bp, Homo sapiens
caaccccataggctaggtacgaggctgggtgttagctcgcctacaggtacggatctcccgcgcgtcgccgaaagcggctctgacccagcggaagtaattctttcgactgccccggaacccaccggagcaggcagctgggggtgggggggcggccctgggataggggctgtggcagtacgcggggacccggctgcggtggctgcgggactgacgaatggagaggagaaaacctatggtggctgtgaaggacctgatgccatgtatgtcaaattgatatcatctgatggccatgaatttattgtaaaaagagaacatgcattaacatcaggcacgataaaagccatgttgagtggcccaggtcagtttgctgagaacgaaaccaatgaggtcaattttagagagataccttcacatgtgctatcgaaagtatgcatgtattttacgtacaaggttcgctacactaacagctccaccgagattcctgaattcccaattgcacctgaaattgcactggaactgctgatggctgcgaacttcttagattgttaaataaaataaattataataaactgttaactcttttcagtatttaatacctgtagttcagttagtaactttttcatatatagcatgttgcctgtatgcagttgaactatataaagttcattgcaaagcagattatcttgtttttttgcatagcaatcaaagttgaaatttgtttgctacatcaacaaattaaggacattttcacaaactgagaaataaacaaatatgccaattcgtaggtggttttgccttatcctttgaatgtgacttaaaatcagcaatgatgatatagtaaatactgaaatttaggtgtaaatcaatacgttctacagggaaataatgaggctaagtatttttatgtttttagtggttttttagaaacctaatcttatagccgccattagcattactagagttatgcaaataattgcattataaacatgtttataacttagccaaaacattgatttttataactctccaagtatgagttgaaatttcttatgtcttttgataaactgcagtattctttaagtgtactttgtccttttgtttattgctacaatttaagaactttatttaaaaacaattttggaaggttactaggtacagcttttgcagaagaaactgaactgtagccagatggtcagcaagtaaactacatgacttagagttcttgtgcattatacattttgggtaattcaaagtactgtatttgcattgactataaagcgtcgtttgcaatatttattcttccttcatagtcccttgttgtgattatacttccagttgtttaaatgtattttaaaagactcactattaactttattcagatcttaaaagctacacctttttgaactattccagtctttctccatccaattagaatgttatggaataacatgtgaagagatacagtgaaaatcatattataatgcattgaagatatcctacatgaattatcttctattaaaatatgtcccaataaatatacccataatcagtgggtcttctactgaaatcaagct

SEQ ID NO: 16548 - DNA, 1090 bp, Homo sapiens
  misc_feature (837)..(837): n is a, c, g, or t
caaccccataggctaggtacgaggctgggtgttagctcgcctacaggtacggatctcccgcgcgtcgccgaaagcggctctgacccagcggaagtaattctttcgactgccccggaacccaccggagcaggcagctgggggtgggggggcggccctgggataggggctgtggcagtacgcggggacccggctgcggtggctgcgggactgacgagaaactactaaagttcctggggaagcaaagtagaatttcataagaacaaaatggatggagaggagaaaacctatggtggctgtgaaggacctgatgccatgtatgtcaaattgatatcatctgatggccatgaatttattgtaaaaagagaacatgcattaacatcaggcacgataaaagccatgttgagtggcccaggtcagtttgctgagaacgaaaccaatgaggtcaattttagagagataccttcacatgtgctatcgaaagtatgcatgtattttacgtacaaggttcgctacactaacagctccaccgagattcctgaattcccaattgcacctgaaattgcactggaactgctgatggctgcgaacttcttagattgttaaataaaataaattataataaactgttaactcttttcagtatttaatacctgtagttcagttagtaactttttcatatatagcatgttgcctgtatgcagttgaactatataaagttcattgcaaagcagattatcttgtttttttgcatagcaatcaaagttgaaatttgtttgctacatcaacaaattaaggacattttcacaaactgagaaataaacaaatatgccaacatcnataacaccggtgtttatcgatgccactctcttaaggtagcccaccgtggactaggtgtttatcgatgccacagaaatctgggatatatgtttcttggggatcaccagaaaatgtgttggtgcttgaggggaaatgtcatggaaagcaaggcaccggtcatcctcaaaatgattttggctggtatttccctgcggatgatcttccccaagatcgtgtcgccacccggccgagcgacctgtgcatccgataaaca

SEQ ID NO: 16549 - DNA, 859 bp, Homo sapiens
caaccccataggctaggtacgaggctgggtgttagctcgcctacaggtacggatctcccgcgcgtcgccgaaagcggctctgacccagcggaagtaattctttcgactgccccggaacccaccggagcaggcagctgggggtgggggggcggccctgggataggggctgtggcagtacgcggggacccggctgcggtggctgcgggactgacgagaaactactaaagttcctggggaagcaaagtagaatttcataagaacaaaatggatggagaggagaaaacctatggtggctgtgaaggacctgatgccatgtatgtcaaattgatatcatctgatggccatgaatttattgtaaaaagagaacatgcattaacatcaggcacgataaaagccatgttgagtggcccaggtcagtttgctgagaacgaaaccaatgaggtcaattttagagagataccttcacatgtgctatcgaaagtatgcatgtattttacgtacaaggttcgctacactaacagctccaccgagattcctgaattcccaattgcacctgaaattgcactggaactgctgatggctgcgaacttcttagattgttaaataaaataaattataataaactgttaactcttttcagtatttaatacctgtagttcagttagtaactttttcatatatagcatgttgcctgtatgcagttgaactatataaagttcattgcaaagcagattatcttgtttttttgcatagcaatcaaagttgaaatttgtttgctacatcaacaaattaaggacattttcacaaactgagaaataaacaaatatgccaaaaaaaaaagaaaaaattctacagggct

SEQ ID NO: 16550 - DNA, 1886 bp, Homo sapiens
caaccccataggctaggtacgaggctgggtgttagctcgcctacaggtacggatctcccgcgcgtcgccgaaagcggctctgacccagcggaagtaattctttcgactgccccggaacccaccggagcaggcagctgggggtgggggggcggccctgggataggggctgtggcagtacgcggggacccggctgcggtggctgcgggactgacgaagtcttgctgtgtggcccaggctggagtgcccggctggtctcaaattcctgacctcaagtgatctccctcccaaagtgttgcgattgcaggtgtgagccactgcacctggctgctgagaaatctttgcctacagtgagggaaactactaaagttcctggggaagcaaagtagaatttcataagaacaaaatggatggagaggagaaaacctatggtggctgtgaaggacctgatgccatgtatgtcaaattgatatcatctgatggccatgaatttattgtaaaaagagaacatgcattaacatcaggcacgataaaagccatgttgagtggcccagagagacagagtctcattctgttgcccaggctggagtgcaatggtgcggtctcagctcactgcaatctccgcctgctgggttcaggcaattctcctgcctcagagtagctggaattacaggtcagtttgctgagaacgaaaccaatgaggtcaattttagagagataccttcacatgtgctatcgaaagtatgcatgtattttacgtacaaggttcgctacactaacagctccaccgagattcctgaattcccaattgcacctgaaattgcactggaactgctgatggctgcgaacttcttagattgttaaataaaataaattataataaactgttaactcttttcagtatttaatacctgtagttcagttagtaactttttcatatatagcatgttgcctgtatgcagttgaactatataaagttcattgcaaagcagattatcttgtttttttgcatagcaatcaaagttgaaatttgtttgctacatcaacaaattaaggacattttcacaaactgagaaataaacaaatatgccaattcgtaggtggttttgccttatcctttgaatgtgacttaaaatcagcaatgatgatatagtaaatactgaaatttaggtgtaaatcaatacgttctacagggaaataatgaggctaagtatttttatgtttttagtggttttttagaaacctaatcttatagccgccattagcattactagagttatgcaaataattgcattataaacatgtttataacttagccaaaacattgatttttataactctccaagtatgagttgaaatttcttatgtcttttgataaactgcagtattctttaagtgtactttgtccttttgtttattgctacaatttaagaactttatttaaaaacaattttggaaggttactaggtacagcttttgcagaagaaactgaactgtagccagatggtcagcaagtaaactacatgacttagagttcttgtgcattatacattttgggtaattcaaagtactgtatttgcattgactataaagcgtcgtttgcaatatttattcttccttcatagtcccttgttgtgattatacttccagttgtttaaatgtattttaaaagactcactattaactttattcagatcttaaaagctacacctttttgaactattccagtctttctccatccaattagaatgttatggaataacatgtgaagagatacagtgaaaatcatattataatgcattgaagatatcctacatgaattatcttctattaaaatatgtcccaataaatatacccataatcagtgggtcttctactgaaatcaagct

SEQ ID NO: 16551 - DNA, 805 bp, Homo sapiens
caaccccataggctaggtacgaggctgggtgttagctcgcctacaggtacggatctcccgcgcgtcgccgaaagcggctctgacccagcggaagtaattctttcgactgccccggaacccaccggagcaggcagctgggggtgggggggcggccctgggataggggctgtggcagtacgcggggacccggctgcggtggctgcgggactgacgaatggagaggagaaaacctatggtggctgtgaaggacctgatgccatgtatgtcaaattgatatcatctgatggccatgaatttattgtaaaaagagaacatgcattaacatcaggcacgataaaagccatgttgagtggcccaggtcagtttgctgagaacgaaaccaatgaggtcaattttagagagataccttcacatgtgctatcgaaagtatgcatgtattttacgtacaaggttcgctacactaacagctccaccgagattcctgaattcccaattgcacctgaaattgcactggaactgctgatggctgcgaacttcttagattgttaaataaaataaattataataaactgttaactcttttcagtatttaatacctgtagttcagttagtaactttttcatatatagcatgttgcctgtatgcagttgaactatataaagttcattgcaaagcagattatcttgtttttttgcatagcaatcaaagttgaaatttgtttgctacatcaacaaattaaggacattttcacaaactgagaaataaacaaatatgccaaaaaaaaaagaaaaaattctacagggct

SEQ ID NO: 16552 - DNA, 764 bp, Homo sapiens
caaccccataggctaggtacgaggctgggtgttagctcgcctacaggtacggatctcccgcgcgtcgccgaaagcggctctgacccagcggaagtaattctttcgactgccccggaacccaccggagcaggcagctgggggtgggggggcggccctgggataggggctgtggcagtacgcggggacccggctgcggtggctgcgggactgacgaagtcttgctgtgtggcccaggctggagtgcccggctggtctcaaattcctgacctcaagtgatctccctcccaaagtgttgcgattgcaggtgtgagccactgcacctggctgctgagaaatctttgcctacagtgagggaaactactaaagttcctggggaagcaaagtagaatttcataagaacaaaatggatggagaggagaaaacctatggtggctgtgaaggacctgatgccatgtatgtcaaattgatatcatctgatggccatgaatttattgtaaaaagagaacatgcattaacatcaggcacgataaaagccatgttgagtggcccaggtcagtttgctgagaacgaaaccaatgaggtcaattttagagagataccttcacatgtgctatcgaaagtatgcatgtattttacgtacaaggttcgctacactaacagctccaccgagattcctgaattcccaattgcacctgaaattgcactggaactgctgatggctgcgaacttcttagattgttaaataaaataaattataataaact

SEQ ID NO: 16553 - DNA, 739 bp, Homo sapiens
caaccccataggctaggtacgaggctgggtgttagctcgcctacaggtacggatctcccgcgcgtcgccgaaagcggctctgacccagcggaagtaattctttcgactgccccggaacccaccggagcaggcagctgggggtgggggggcggccctgggataggggctgtggcagtacgcggggacccggctgcggtggctgcgggactgacgagatcatcagggaaggaagacctctctgaggagttgatgttttacctggagacctaaatgatgaggatttaaaagcttttcggacaacagcaattacaaatgcaaagaccttgaggaaactactaaagttcctggggaagcaaagtagaatttcataagaacaaaatggatggagaggagaaaacctatggtggctgtgaaggacctgatgccatgtatgtcaaattgatatcatctgatggccatgaatttattgtaaaaagagaacatgcattaacatcaggcacgataaaagccatgttgagtggcccaggtcagtttgctgagaacgaaaccaatgaggtcaattttagagagataccttcacatgtgctatcgaaagtatgcatgtattttacgtacaaggttcgctacactaacagctccaccgagattcctgaattcccaattgcacctgaaattgcactggaactgctgatggctgcgaacttcttagattgttaaataaaataaattataataaact

SEQ ID NO: 16554 - DNA, 718 bp, Homo sapiens
caaccccataggctaggtacgaggctgggtgttagctcgcctacaggtacggatctcccgcgcgtcgccgaaagcggctctgacccagcggaagtaattctttcgactgccccggaacccaccggagcaggcagctgggggtgggggggcggccctgggataggggctgtggcagtacgcggggacccggctgcggtggctgcgggactgacgaagataggatctcactgtgttgtccaggctggtctcagtctcctgggttcaggcagtactcctgcctcagccatccaaagtgctgggattacaggaaactactaaagttcctggggaagcaaagtagaatttcataagaacaaaatggatggagaggagaaaacctatggtggctgtgaaggacctgatgccatgtatgtcaaattgatatcatctgatggccatgaatttattgtaaaaagagaacatgcattaacatcaggcacgataaaagccatgttgagtggcccaggtcagtttgctgagaacgaaaccaatgaggtcaattttagagagataccttcacatgtgctatcgaaagtatgcatgtattttacgtacaaggttcgctacactaacagctccaccgagattcctgaattcccaattgcacctgaaattgcactggaactgctgatggctgcgaacttcttagattgttaaataaaataaattataataaact

SEQ ID NO: 16555 - DNA, 1197 bp, Homo sapiens
atagggacaaaatcttgctctgtcaccaaggctggagtgcagtggctgcatcatagctaagtgcagcttcgagctcctgggctcaaaccatcctcccaccatagcctcccgagtagccggctcgtgccgaattcggcacgagctgatggctgcgaacttcttagattgttaaataaaataaattataataaactgttaactcttttcagtatttaatacctgtagttcagttagtaactttttcatatatagcatgttgcctgtatgcagttgaactatataaagttcattgcaaagcagattatcttgtttttttgcatagcaatcaaagttgaaatttgtttgctacatcaacaaattaaggacattttcacaaactgagaaataaacaaatatgccaattcgtaggtggttttgccttatcctttgaatgtgacttaaaatcagcaatgatgatatagtaaatactgaaatttaggtgtaaatcaatacgttctacagggaaataatgaggctaagtatttttatgtttttagtggttttttagaaacctaatcttatagccgccattagcattactagagttatgcaaataattgcattataaacatgtttataacttagccaaaacattgatttttataactctccaagtatgagttgaaatttcttatgtcttttgataaactgcagtattctttaagtgtactttgtccttttgtttattgctacaatttaagaactttatttaaaaacaattttggaaggttactaggtacagcttttgcagaagaaactgaactgtagccagatggtcagcaagtaaactacatgacttagagttcttgtgcattatacattttgggtaattcaaagtactgtatttgcattgactataaagcgtcgtttgcaatatttattcttccttcatagtcccttgttgtgattatacttccagttgtttaaatgtattttaaaagactcactattaactttattcagatcttaaaagctacacctttttgaactattccagtctttctccatccaattagaatgttatggaataacatgtgaagagatacagtgaaaatcatattataatgcattgaagatatcctacatgaattatcttctattaaaatatgtcccaataaatatacccataatcagtgggtcttctactgaaatcaagct

SEQ ID NO: 16556 - DNA, 1197 bp, Homo sapiens
caaccccataggctaggtacgaggctgggtgttagctcgcctacaggtacggatctcccgcgcgtcgccgaaagcggctctgacccagcggaagtaattctttcgactgccccggaacccaccggagcaggcagctgggggtgggggggcggccctgggataggggctgtggcagtacgcggggacccggctgcggtggctgcgggactgacgagaaactactaaagttcctggggaagcaaagtagaatttcataagaacaaaatggatggagaggagaaaacctatggtggctgtgaaggacctgatgccatgtatgtcaaattgatatcatctgatggccatgaatttattgtaaaaagagaacatgcattaacatcaggcacgataaaagccatgttgagtggcccaggtcagtttgctgagaacgaaaccaatgaggtcaattttagagagataccttcacatgtgctatcgaaagtatgcatgtattttacgtacaaggttcgctacactaacagctccaccgagattcctgaattcccaattgcacctgaaattgcactggaactgctgatggctgcgaacttcttagattgttaaataaaataaattataataaactaaaaaagaaaagagagacaacacgaaagagacaaaagaagaaaggaacaggcgaagcagcgaaacagacacagcgcagcagcccagggcagcacgccacccgcgcccgcagccggccacccggcgaagcggaggacggaaggcggacaacggaagagaccggggcacacacccgacgcgacgcgccccaaacggcgcgagcccgccgaagcacggcgccacggagaagcgacatgaagaggagacaaaacagagaagtggtgatgaatccgagatcatcgcgtgagacgggaaggatataatacagatctgacggaacagaacataaaatagagtggatgcgaagagcaaacaagcatgtagatacggaggcaagaacacaaaagcgagaccgagcgatcagcgaccagaaccatagtcagagagccagaggacagacacacagagcaagccgccatagatgacaagagcctacatgaagataacgtgaaaaagacccgtgttgacagacagacaggagcacgacggactgcgacgtgcggagaagaaaacaaaacaaaaaacacatagcgg

SEQ ID NO: 16557 - DNA, 762 bp, Homo sapiens
caaccccataggctaggtacgaggctgggtgttagctcgcctacaggtacggatctcccgcgcgtcgccgaaagcggctctgacccagcggaagtaattctttcgactgccccggaacccaccggagcaggcagctgggggtgggggggcggccctgggataggggctgtggcagtacgcggggacccggctgcggtggctgcgggactgacgagaaactactaaagttcctggggaagcaaagtagaatttcataagaacaaaatggatggagaggagaaaacctatggtggctgtgaaggacctgatgccatgtatgtcaaattgatatcatctgatggccatgaatttattgtaaaaagagaacatgcattaacatcaggcacgataaaagccatgttgagtggcccaggtcagtttgctgagaacgaaaccaatgaggtcaattttagagagataccttcacatgtgctatcgaaagtatgcatgtattttacgtacaaggttcgctacactaacagctccaccgagattcctgaattcccaattgcacctgaaattgcactggaactgctgatggctgtaatcccagcactttcagaggacgaggcgggtagatcacttgaggccaggagtttgagaccagcctggccaccatggcaaaaccccatctctaccaaaaatgcaaaaattagctaggccatggtggcacacgcctgtaatcccagctacttgtgaggctgaggcatgagaatcgcttga

SEQ ID NO: 16558 - DNA, 607 bp, Homo sapiens
caaccccataggctaggtacgaggctgggtgttagctcgcctacaggtacggatctcccgcgcgtcgccgaaagcggctctgacccagcggaagtaattctttcgactgccccggaacccaccggagcaggcagctgggggtgggggggcggccctgggataggggctgtggcagtacgcggggacccggctgcggtggctgcgggactgacgagaaactactaaagttcctggggaagcaaagtagaatttcataagaacaaaatggatggagaggagaaaacctatggtggctgtgaaggacctgatgccatgtatgtcaaattgatatcatctgatggccatgaatttattgtaaaaagagaacatgcattaacatcaggcacgataaaagccatgttgagtggcccaggtcagtttgctgagaacgaaaccaatgaggtcaattttagagagataccttcacatgtgctatcgaaagtatgcatgtattttacgtacaaggttcgctacactaacagctccaccgagattcctgaattcccaattgcacctgaaattgcactggaactgctgatgggagcaaaactgcggggtaccgagctcg

SEQ ID NO: 16559 - DNA, 883 bp, Homo sapiens
caaccccataggctaggtacgaggctgggtgttagctcgcctacaggtacggatctcccgcgcgtcgccgaaagcggctctgacccagcggaagtaattctttcgactgccccggaacccaccggagcaggcagctgggggtgggggggcggccctgggataggggctgtggcagtacgcggggacccggctgcggtggctgcgggactgacgaagtcttgctgtgtggcccaggctggagtgcccggctggtctcaaattcctgacctcaagtgatctccctcccaaagtgttgcgattgcaggtgtgagccactgcacctggctgctgagaaatctttgcctacagtgagggaaactactaaagttcctggggaagcaaagtagaatttcataagaacaaaatggatggagaggagaaaacctatggtggctgtgaaggacctgatgccatgtatgtcaaattgatatcatctgatggccatgaatttattgtaaaaagagaacatgcattaacatcaggcacgataaaagccatgttgagtggcccagagagacagagtctcattctgttgcccaggctggagtgcaatggtgcggtctcagctcactgcaatctccgcctgctgggttcaggcaattctcctgcctcagagtagctggaattacaggtcagtttgctgagaacgaaaccaatgaggtcaattttagagagataccttcacatgtgctatcgaaagtatgcatgtattttacgtacaaggttcgctacactaacagctccaccgagattcctgaattcccaattgcacctgaaattgcactggaactgctgatggctgcgaacttcttagattgttaaataaaataaattataataaact

SEQ ID NO: 16560 - DNA, 673 bp, Homo sapiens
  misc_feature (448)..(448): n is a, c, g, or t
  misc_feature (520)..(520): n is a, c, g, or t
caaccccataggctaggtacgaggctgggtgttagctcgcctacaggtacggatctcccgcgcgtcgccgaaagcggctctgacccagcggaagtaattctttcgactgccccggaacccaccggagcaggcagctgggggtgggggggcggccctgggataggggctgtggcagtacgcggggacccggctgcggtggctgcgggactgacgagaaactactaaagttcctggggaagcaaagtagaatttcataagaacaaaatggatggagaggagaaaacctatggtggctgtgaaggacctgatgccatgtatgtcaaaaattgggatattcatccttgattgggccatgaaactttattggttaaaaacacggagaacaattgccattaagcattccagggcacggactaaaaagggccccatgttgggagtgggccccaanggtcaggtttggctgaggaacggaaagcccaatgagcgtcaaccttttagcaggagattacccttcgacatngttgcttattccggaacaggcttattgcaattgttcattctttaccgttacccaagggttccggcttacaaactaaaccaagcttcccaccggaagaattccgtgaaaatttccgcaaatttggcgaccctgaacattggccactggaaactg

SEQ ID NO: 16561 - DNA, 451 bp, Homo sapiens
gcatctttagtgtgctgggctcaactgggccaggaatggctaagaggctcactcacagagtggcctgggctcctcccctaaccccacagaatcagaacttccaggcctgggaactgcatttttaagagacagggtctcgatgtgtcacccaggttggagtgcagtgccacagttatagctcactgcagcctcaaactcctcgattcatgtgatccttctgcctcagccacccaggtagataggactacaggttacagatatatgccaccatgcctagctaattgttgtattttttgtagagacaaggtctcactttgttgcccagactggtctcaaactcctggccttaagtgaccctcctgcctgggcctcccagagtgctgagattccaggtatgagccactgcgcccagctgtaatctttgttcataataaactttccagccatctga

SEQ ID NO: 16562 - DNA, 462 bp, Homo sapiens
  misc_feature (4)..(4): n is a, c, g, or t
tctntccctcggttcaaagacatcatatttgcaataaagaaaacattaaatatttagtttggacttgaatatcaagtcgttgaaatttatttgaaatacttgctggcactgcacctggattcgtactgcaagacctgactattcataacggaaaccgatctcttagcgaacattcgttacttgggtcacctgattcatccaaaatattccagatacgcagcctggaacccagcaggaatgggggtcctcagcagaaatctttcagagagaggcccctcttctcaggtgcggagggatgaggaggaatcctgtagtcccaagtcacaaaaggaggatgttgactcttcagcaaacaccggagcctgaaaacaaaacaaaacaaaacaaaaaaacaatgaacttcaacgtaagggatgcttactagctcccagggttgaaataaagccgagactagacatcagt

SEQ ID NO: 16563 - DNA, 485 bp, Homo sapiens
tcctgtctcagcctcctgagtagctgggactacaggcgcctgccaccacacccagctaacttttgtatttttagtagagatggggtttcaccttgttggtcaagctggtctcaaactcctgacctcaggtgatccactcgcctctgcctcccaaagtgctgggattacaggcgtaagccaccacacccagcccaaaaaatgtttgtgcacagaactgtggatgtttgtcacagaactttccaaataaagaagttctgataaaagagaagatatttctcatttccataatctttaaggtgtgggggatacgtaatctggacttctcaaatggatgatttctaaatacgcgtcagatgaagtgattctaactttctctgtagtaatatcttattttgttttattcaaaaacaataaaccatgtagatttatttaggcaaaaaaaaaaggggggggcccggttaccccatttcgccctttagttgagt

SEQ ID NO: 16564 - DNA, 440 bp, Homo sapiens
acagcatgtaaatgggagtcagccaatttagaagatttccaaacaagagtcactgcttctcacatcctctgtctactctgaaactgccatgagctctttcaggagctcctgggtgctgcaggcccagatgagcaaacacacccagcccaaaaaatgtttgtgcacagaactgtggatgtttgtcacagaactttccaaataaagaagttctgataaaagagaagatatttctcatttccataatctttaaggtgtgggggatacgtaatctggacttctcaaatggatgatttctaaatacgcgtcagatgaagtgattctaactttctctgtagtaatatcttattttgttttattcaaaaacaataaaccatgtagatttatttaggcaaaaaaaaaaggggggggcccggttaccccatttcgccctttagttgagt

SEQ ID NO: 16565 - DNA, 878 bp, Homo sapiens
agtatttaaggccaggagtacaagaccagcctaggcaatatagtgatagcccatctctaaaaaaatttcaaaactaacctgatatggtggtgcacacctgtagtcctaactttttgggaggctgaggtggaaggatcccttaagctcataaggttgaggcttcagtgagctatgatggcaccacttcactactgcttgggccatagagtgagaccctgtctcttaaaataagggaatggaattgccgagtcatgcataacctctgtgttcaatcctttggggaactgccatactgttttcaaactggctagatcattttacattcccttttgtgtgtatgaagattccagtctctccacattctcatcagcacttatcttactttctgattctagccatcccaatgggtatgaagtggtatgtatctcattgtggttttgatttggatttccttgatgactaatgatgttatacatcttttcatgtgctaattggccgtttactgtacatttttcagaaatgcctatttataatagttcctttgctcattttaaagtacacttgtcttgttactcagttgtaagtgttctttatatattctagatacaagctccttattggatacatgatttgcaaatattttctccttaagtttttttatttttttaattgcattgttttaagggcatttgtgttggaaaaatattttaaaaccttagaaataattttctgaaagcaaatattgacttatacaatagtaatagtaaatgatttcattgactgtacttccagtaaacctcttgttggaaaggtggtatgaataactattatgaaggtaaaaagaaataaaatgaaaattggatgcctgctagttaaaa

SEQ ID NO: 16566 - DNA, 751 bp, Homo sapiens
agtatttaaggccaggagtacaagaccagcctaggcaatatagtgatagcccatctctaaaaaaatttcaaaactaacctgatatggtggtgcacacctgtagtcctaactttttgggaggctgaggtggaaggatcccttaagctcataaggttgaggcttcagtgagctatgatggcaccacttcactactgcttgggccatagagtgagaccctgtctcttaaaataagggaatggaattgccgagtcatgcataacctctgtgttcaatcctttggggaactgccatactgttttcaaactggctagatcattttacattcccttttgtgtgtatgaagattccagtctctccacattctcatcagcacttatcttactttctgattctagccatcccaatgggtatgaaagtgagatacttaacacccactagcatagccaaaataaaaaagatggataggctgggcacagtgactcatgcctgtaatcccaggcctgagttgggaggccaaatctgggaggattgcttgaacccaggaatttgagacctgtgcaacatagtgagacccagtctctaccaagaaataatttaaaaattagctgtgcatggtgtcgcatgcctgtagtctcagctactctggaggctgaggtggaaggattgcttgggcccaggaagtcaaggccacagtcacctgtgattgcatcactgcattctagcctgggcaacagagctgagaccctgtctc

SEQ ID NO: 16567 - DNA, 593 bp, Homo sapiens
attattttgaccagaaagtctgatctcccagcaggatcaacttttccttcctttgtctttctttctttcagccttactttgacattcagctgatcattccctgtcttatcttgcttgtgctcaccgctgtctgtccttttacgtgtggaggtcagaaacgtgtctggttcgtgtacatcacctcagcaccctgcacaggggatggcacaaaacagccactcaaaaagtaattgttgattacaattgatctgaccatttcttttggtgacccttttgtctttgtggtagaccaaagtcatgatctttgatccctcctgccatgttctcagaagccttgtgcttgggatttggacaaagtgaccctttttatagaggttatttttttcccattcctccagctccttctttgctgtttttctagtgcccatagtagcagatgcacatacttcaacaccctttcctaaaaattctgagctacccatacattattttattgttaaattgaaatggaaatttgctttgataagaatctctcagtaagagtctattatccgtgttatagatgtatctcctaccgtgcaaatgttagtttt

SEQ ID NO: 16568 - DNA, 162 bp, Homo sapiens
aaattgactgcaatggactatttaagcaccattctttcccctcccccatttttaaattttcgagacaaggtcaggctctgtcagccaggctggagtacagtggtgagctgagattgcgccattgcactccagcttgggcaacaagagtaaaactttgtctca

SEQ ID NO: 16569 - DNA, 277 bp, Homo sapiens
tatcaaaaacctctctgtcacacttacacacaaaagcctacaacacccccctccccccccacacacacaccctgaaggcttggactgaagagtgaaaaagagtccaacttgtagcaatctgtgggggtagatggaagagatggaagcagagatgcagtggctccagcataagaacttctttggtaacatctctgcatatcgcaagggctgcattgtgcaggacttgtaagaatgtaggcatttggatgtcattctaattggaatcggaaacaaatgg

SEQ ID NO: 16570 - DNA, 532 bp, Homo sapiens
gtattatttcactatgtaattagcataaaaattattactgaagtatgttatatatatgtatttgtgctaagcctcccaaatctggtatgtattttacacccactgtacatcttgattcagagtagctacatttcaaatgctcagtggccatataaagctagtggctactatgttgaacagtaaaggtagtacaaattcccaatgctcactttttcaatataaatgtaaatatgtatttagaagtagtcttaggctgggtgtggtggttcacgcctgcaatcccagcactttgggaggtgaaggtgggcggatcactcgaggccaggagtttgagaccagcctggccgacacagtgaaaccctgtctctaataaaaatagaaaaaattagctaggcatggtggtgcacacctgtaattccagctacttgtgaggctgaggcatgagaatcgcttgaacccaggaggccaaggttgtagtgaactgagatggcgccactgtattctagggcgacagagtgagactccgtctaag

SEQ ID NO: 16571 - DNA, 371 bp, Homo sapiens
catatctgagcctgtgtcttcttgttcccaaactcaaggaaataagtgatttagcagaaactaataaaaaacttggatctactgatattttaatctgtcttgaatatgtattttgttattttaatcaccaaaaatctggtaagggaattatgttacagagagaatttaataataactgtttcaaatgcctcatgttctcacttattcgtaggagctaagcgatgggtacacatggatgtacagagtggaatgatggacattggagactgtaaaatttaggagagtaggatggaggtgatagatgagaaattacccattgggtacaacttaaccgattcaggtgatgattacactaaaagtccagacttcac

SEQ ID NO: 16572 - DNA, 211 bp, Homo sapiens
agacacggggtttcaccatgtcggccaggctggtctcgaactcctgacctcaggtgatccacccgccttggcctcacaaagtgctgggattacaggcgtgagccactgcgcctagcctagagtacagactattaagtgaaatatgtttgcttactctaacaaccaaataaatctgatttaatttcaaagtaactgctttcaaactggcaag

SEQ ID NO: 16573 - DNA, 393 bp, Homo sapiens
cgaaagcacacgtggaatggctgagctccccatctgtgtaaagtttccaaggttcccgccccgggccgtgtgtgctgtccgccatgctccggccggtggtgtccagccccagggcgctgtgagcctgcatccctgccggaagagcccttccatggaggcagggcacagtgctcctaagaggcaggtgaacaagtagcaaatcctcaagaaatgctacaagcaagcacgccgccctcaggccaggcatcacggtgggtgaaatagaacgcaggcgaggatgttcagaaagaggccttttctgtggagtaagtttggcagtactcatcaaagcacattaaaaccacatattctttttgtgtgtgtgtgttcccgagacggagtcttgctctgtcg

SEQ ID NO: 16574 - DNA, 439 bp, Homo sapiens
atttcataaagaagaagggtatcagtgtaaacttctaaatgcaggacaaaatgcatgattggggatggagattggagtggacttgttcaaagagcagcagcaaatgagacattaaaggaatacataggaagccacttccaagtacttccatttttctttagttgtgattgtgagatggttccctactagttagagaaggaaaattttaaaatgctttgctaaacagatgatccttaaattggtcactgtataccgtgatgcagcctaatcaaaatggtattcctttgagtgagtgagccacagagactctcgccaaccccttgtgcagctttctattaacagtataaatactccattgttgtaaagcagtttatggttaacaaagcgctgtcacagacacgttatcttagttttgcagattgcctttgtacatgttatt

SEQ ID NO: 16575 - DNA, 360 bp, Homo sapiens
cctagaacaaccccttgggtttctctatcatattgacggtggtgttggtttctcgtgatacgtttaaatattcctccatttcttgctgcttcctatgaacttgtaattgaattcagaggagaggttggcaaaaggcggatagtaagcaccttatgcctttgggtccacgaggtctcagatggctgagttcagccttagtcacctcatgtcccatgttagctgttccttctctactctgtcctggttccaagccccagcctatttctgaaaagttaagtggtcagctgcatagatgaccatttagagggtgtagatttactctgaaatcccagagggttgtgctctgagtcttatcagtgc

SEQ ID NO: 16576 - DNA, 480 bp, Homo sapiens
ccagaaaggtcaggaatacttattgaatctaactttgtttttgttttgtttttttccttatgattaaaggtgggatgagagaaaattaaatgacacacacatgctaaaatatcaaggttccagatatgtcttgagaggggttgttgcagctgcaaaggagaagtgtatagtgataatgagtaaagatgcatgtgcagtttgttctattttaaggcaaaagttatatcagggatttttttcttagaaaggtgttgcagagatgtctggtacctagtttaaaaatgattccataatatgtagacttgggcagttcctttgggaggcacctccctctcaaaatttgaagattgtgcttggaaattactttacatgtatttgggctgtatgtcaatttgtacgaaattagactttcagaaaagtttatactggaaggttaataatttgtatctactgaggacttagagctagcaggcaaaatga

SEQ ID NO: 16577 - DNA, 510 bp, Homo sapiens
ataagatgtttgctggagaaacctattgtttactgaaagcactcaatgaagtcaaattactgaagcttttgcctacatcttggtcttttatgattaaaggtgggatgagagaaaattaaatgacacacacatgctaaaatatcaaggttccagatatgtcttgagaggggttgttgcagctgcaaaggagaagtgtatagtgataatgagtaaagatgcatgtgcagtttgttctattttaaggcaaaagttatatcagggatttttttcttagaaaggtgttgcagagatgtctggtacctagtttaaaaatgattccataatatgtagacttgggcagttcctttgggaggcacctccctctcaaaatttgaagattgtgcttggaaattactttacatgtatttgggctgtatgtcaatttgtacgaaattagactttcagaaaagtttatactggaaggttaataatttgtatctactgaggacttagagctagcaggcaaaatga

SEQ ID NO: 16578 - DNA, 488 bp, Homo sapiens
agagaaagctgggattgccagagaccactggctctctgggtggcttggatccaaagtcagaggagaggcagctggttgtggctcggtgattgggtgacccccttccctctgaccacaggcaggtgagcacagtcctgctttagccggggtccctcatggtggtctggtcctatactcttcctgtagtgcttggttagagtcgggcgggggttggctgcacatttatgcagtggccttttgacccttcagggtggtggtagtcttcaccttgagcttagcctgtgtttgatgagcacattgcagaccattaaattcacaaaccatttcattcttaactccccactacctcttattttttaaccacgacattgtgggaaatgtttgtcactccaaaactgtggaattttgccattctaaaattgtagcagctttggggaaattacttttataaaattacttttataaactccctggattgaaaaaataat

SEQ ID NO: 16579 - DNA, 447 bp, Homo sapiens
tgtggtggtgcacacctgtagtcccagctacttggaaggctgaggcaggaggatcacctgtgcccaggaattggacaccagtctgggcaacatagcgaaaccccatgtctctagagggaaacaaaacaaaaccgaagaatggaatagatctacatatactgatagggaaatgtctccaagatacccatgtggggaggaaaaggtgcagagcattgtgcagtccatgcacccattagtacataaaaatgaaaggtgcattttaatttaatctctcagcagaaggactgataattaagggacaatttttcagtgtataccttttagcattgttttaatatgtgtattactttgcaatgaatacatgtaattaaataaaaagccacatacatacacatacaaatgtgtgtaaagtgtccggaacagaataataacagctaacatttattg

SEQ ID NO: 16580 - DNA, 462 bp, Homo sapiens
atacataaaagtaataatgattttataatctaattaaaaattaataaattcacaaatttgatctaagttatttttaacaacaataaaaacatcatatataaaatctctccaaagcatacttgtctgcacaacattcactgcctgtttttctgtatgcagtggccttaagagacagggtagagagaagagaccaactgaattctataatcaaagttttttttacatctgtcctttcttccatgccttctctttttagaagtgtgctcacattgactgtacgcttcctgagggaagaggtctcatggtttgataatttcttcttcttttttcctctatagattcaggaatttgagataattcccaccttctattcaaggaagctatttattgaataggttctcaataaagtgtttttgattattgaaggaatgaacacaatacatataaaaaagctattttttt

SEQ ID NO: 16581 - DNA, 384 bp, Homo sapiens
agttttgcttctttgggtatgtggcacataatagatgcactaaataccatttcataagaatggccccaagaggcttctagctcgagaaacagacaaaccttgcaaactgtgatgaacataaccatttcagtgaggtggatttttaaaaactctaatccaaagcaaataatcactgctggcagttattcttctgtacttagattgataataaatattcttaaaatgcttaaaatgatctagagatgactggcaatttgtaccaaagttaatttacaacactgttttagtatattaaatggcagggtttttgctagcctgacgtttgatgtctttcttttaacatattcaatatctggggcacttcgtggaaatcctgttttctag

SEQ ID NO: 16582 - DNA, 870 bp, Homo sapiens
ttcctgtgcaggcttgtcacagtttggcttcatttggaggctggcaccagacccccgggctctgcgttgtatgtcttttgacctcaaatgagggggagagacgtggtgtttcccacagatagtgagtagtgagccacctggaatacttgttctgtgggatgttaatggtcgtttcatgaaaaggattttgtggtcatgtaagtttagcaaatgccaaagcaagccgagtgaaaggtgttgttatcatctctcctaagccgcttttctttgctgacctgctgagggagtctgcaagaggcgggggaggaaatgccccttcctgagcttgcctgcacccagcaccctttccatggaacacctcccaaggccagtatacgaaggatgatgctttgggagtgtggtgtctggcaacctgcgtctgccactttctgggcatgcacgtctggcacgtcttccttggccaagtagtgctggaagaagacacagggctggatgacaacccctgatgccaggcaagggccacgctagctgtcctcagctttatcagcaacacccttgtctctaggagtcccagccctcagccctttcctaaatgatgggaagtaattaaacagttcatgcatatccctacatttcagaaatcacacagagcccagtggtagttggtgcttggctctgagacctcagtcatactgtgtaagtttctgctggtttgaaggatggctggagactagtaaagtagcaggaaggctgattccactgggaactcccccagactttccatctgattccaccgtgaatgccatgacacttttgtattgttgttttaatgatacttagggataattgttgattcacatgcagttgtaa

SEQ ID NO: 16583 - DNA, 292 bp, Homo sapiens
cagtggaaatagatgtaacactatcgtttatccacaaaagcctcagtggtaacagaggctctacttcctaccttccacactttaaccaaagcaaaagtttacaacaaatagtacaaatggtgggcgaaatgacagagggagagagcagaagggtgataataaccccactgagtgatattaattaaattaaataaataaagcctaaggaaggtctttgtggtacccaactgccataacgttgattaaccctgctgtgtttcagcacgaggtcatgtaaaccctttgacaccat

SEQ ID NO: 16584 - DNA, 223 bp, Homo sapiens
gcagtttttggggttactcgtgattgctcctcggtccagagttcaggcagcaatctgagccactcaactgctcttctttacccctctacctctgcagttcattgggggacagagctgggccaggatcctgggacagaaggaggaggcgggcccaggaaagtccacttggggtaacacacaatttgtacataaaaaagaaatgttcacctctttgtatgtaccg

SEQ ID NO: 16585 - DNA, 427 bp, Homo sapiens
catagtacctactttgctgtgttctagggaaaactaaatgagatcatgcctagaaaatattctgtggcacatagtagcaccttaagaaattgtacccatcattattgtttttaggtttgtagagagtggcttaaaggtgggaagtgggggctgggcatggtgactcatgcctgtaatcccagcactttgggaggccaaggcgggcagatcacctgaggtcaggagttcgagaccagcctgaccaatatgatgaaaccccatctctactaaaaatacaaaaattagccgggcgtggtggcatgcacctgtaatctcagctactcgggaggctgaaacaggagaattgcttggacctgggaggcagaggttgcagtgagctcacaccattgcattccagcctgggcaacaaagcgagactccatctcaa

SEQ ID NO: 16586 - DNA, 122 bp, Homo sapiens
ttagtaattaaaggaaggtctgaatccacagacatagcaaagatggaggattatatatatataagggtaatagagagggacactgacattaaaaggaaatgtgtagccattactgtgccaga

SEQ ID NO: 16587 - DNA, 602 bp, Homo sapiens
tcagactagttcaaaaaaaataattcattgacctattaattaactttaatgtatagatcagctttcactggattttgcttcagtaacaacactctgtccccaaaatctcagtatcttacatgtataaaggtttatttcttacccacaatacatgccattcacagagtaggaagcctgcagttctcctctatatcagtttacatttctgaaccaggttgatggaatcacctctttctagtagaagagggtaaaaggcagctctgaaagcacacactcattcttccagttcctgctcagtggcagcatgtatcacttcagctgacaatggccaaatgtttacatcagtttccattggccaaaccagtcataaggtcaaatccagtattaactgtggtgacaggaattagcaatggagccagtctcagtttcctgatgtggaaagtctgcgggttaacctgtctcttagttctcttccattctatggctctgattttaaagtgttctttcctacctctgaatcagttaggatgttttggttacaagtcacagaaaaccctgactcaagagttttaaacaataagggggtttattttctgacatgg

SEQ ID NO: 16588 - DNA, 379 bp, Homo sapiens
tgtctcactgatccatgatttattactaagtgttgtttctctctgagcctatctgcatcactctaaagtcttcttttatcaccctcagacctcagagctctggttcccagaaaaatcatacagcaaataattttatctatggttcccagtaggtgctgaagtctgaactgtgtgaatgcatagagggccagaaatcctggatcctggaaacagatagcaggatagtttgggggcatggtaaatatgcctcagccagtttcatcctagaggtatttcaagaccagacagtattgctatggcaactaagttgtgtgttaaaaatacaggaggggcactagaattcagatgttctttggaaaagcaggaaaagttaaatgcc

SEQ ID NO: 16589 - DNA, 557 bp, Homo sapiens
gggtgaggcgcgcggggtccgggctgcggcttcccggtgcggccgcagtgggcaggctcgaggcgtctgccgcacctcagcccacgacctgccccgctgggaggtgcgggccgctggccaggccctgaccgcaacctggcccagaggccccagccctcaggcaaggttctccggtgaagccacagcctggccacctgtcttgatctccccaccgagaaggccccgcccctcccgctgcagccccacagcatgcagccccaggagagccacgtccactatagtaggtgggaggacggcagcagggacggagtcagcctaggggctgtgtccagcacagaagaggcctcacgctgccgcaggatctcccagaggctgtgcacgggcaagctgggcatcgccatgaaggtgctgggcggcgtggccctcttctggatcatcttcatcctgggctacctcacaggctactatgtgcacaagtgcaaataaatgctgccccgcatgcacgcggggggctggccgcacacgtgagagcacaggcctggagacaaaaaaaaaaa

SEQ ID NO: 16590 - DNA, 452 bp, Homo sapiens
cgcctgccctaacccctgctaccggccccatcaccctccaccccatcctggctgggagcccacggtccagcagctcagcaaaccgcagcctttggccttccctctggttggctgtgggcggggagagcttcctcttgactccagcagagcgcccaggcccctccccctgacccagaccaacggccacagtccacttagggggcccctcatgcggccctggcctggggctcacctccagttggttctcaccccaggatctcccagaggctgtgcacgggcaagctgggcatcgccatgaaggtgctgggcggcgtggccctcttctggatcatcttcatcctgggctacctcacaggctactatgtgcacaagtgcaaataaatgctgccccgcatgcacgcggggggctggccgcacacgtgagagcacaggcctggagacaaaaaaaaaaa

SEQ ID NO: 16591 - DNA, 778 bp, Homo sapiens
gggtgaggcgcgcggggtccgggctgcggcttcccggtgcggccgcagtgggcaggtgcgactgtgcgcggcctcgctggctgagaactggcgggggtgggggcgtgccctggactgacccccaccggcctaacccgcggtgcggggccagggccggaactgcccgcccggctccttgcccggctccttgtggctgctggggacccccgacaccagccactttcccttcccggcccttagcaagatcggcttctccggtcacctttatttttttaggctcgaggcgtctgccgcacctcagcccacgacctgccccgctgggaggtgcgggccgctggccaggccctgaccgcaacctggcccagaggccccagccctcaggcaaggttctccggtgaagccacagcctggccacctgtcttgatctccccaccgagaaggccccgcccctcccgctgcagccccacagcatgcagccccaggagagccacgtccactatagtaggtgggaggacggcagcagggacggagtcagcctaggggctgtgtccagcacagaagaggcctcacgctgccgcaggatctcccagaggctgtgcacgggcaagctgggcatcgccatgaaggtgctgggcggcgtggccctcttctggatcatcttcatcctgggctacctcacaggctactatgtgcacaagtgcaaataaatgctgccccgcatgcacgcggggggctggccgcacacgtgagagcacaggcctggagacaaaaaaaaaaa

SEQ ID NO: 16592 - DNA, 744 bp, Homo sapiens
gggtgaggcgcgcggggtccgggctgcggcttcccggtgcggccgcagtgggcaggtgcgactgtgcgcggcctcgctggctgagaactggcgggggtgggggcgtgccctggactgacccccaccggcctaacccgcggtgcggggccagggccggaactgcccgcccggctccttgcccggctccttgtggctgctggggacccccgacaccagccactttcccttcccggcccttagcaagatcggcttctccggtcacctttatttttttaggctcgaggcgtctgccgcacctcagcccacgacctgccccgctgggaggtgcgggccgctggccaggccctgaccgcaacctggcccagaggccccagccctcaggcaaggttctccggtgaagccacagcctggccacctgtcttgatctccccacagcatgcagccccaggagagccacgtccactatagtaggtgggaggacggcagcagggacggagtcagcctaggggctgtgtccagcacagaagaggcctcacgctgccgcaggatctcccagaggctgtgcacgggcaagctgggcatcgccatgaaggtgctgggcggcgtggccctcttctggatcatcttcatcctgggctacctcacaggctactatgtgcacaagtgcaaataaatgctgccccgcatgcacgcggggggctggccgcacacgtgagagcacaggcctggagacaaaaaaaaaaa

SEQ ID NO: 16593 - DNA, 1170 bp, Homo sapiens
ctgcatactttatattattaatttgtgtaatcctcctaacaaccctctgaggaaggtactcttatgattcccattttacaaataaagaaactgagactaagtgactcactcaaggtgtagcaggtagaaagtagtggaattaggatatgagttcagactccagaccctgttattagcccctgtctttggctatggattagtaaaggagagcacagccaagggtgggacaggcagctgtagtcctctggaccagcttcacatggatggggctgcattgttacaggtggcctaactcagacatggaaactgagtcgctgctgcccaactcatgccatgaaaccattttggcctgcacagcttataacagcactctagctctagctatgacactttatggtgttagtgggtttttttggtggttggtatggaggaggggctgggctacaagttttagattatgtttcttattgcgggtttttaaaaattcttgaattaggcctatttgctcttttgttctctattgagttagcaaattcagtttttccaagatgccctgaaagtatgatcatacatgtatacgaaatggtccttgggtccagctggcaactcctgtgcacccccgacctggattctgccttccttgaagtgagccttggaagaaacaagtgctcatgctccctgacattattagctgccacgatgaagcctcagtcccaaacaccccagcttcctgtctaactcaagagctaatcctgtgtttaaatcttaagagtgtttagatcttaggccatgccatgaattcccctggttgactgcatttgtgaaaatgagcttcccattattggctcttaagtaatggagatgagggggagtcctgctacacagataagtgcatcataaagttacataattaaaataactgagctctggcctatcaacaggcccatcagcagtccagaatagagtctagaaatggacacaaattaaatgagagtttgaaatatgataaaggtagcagttgaaattagtagagagatgatgatgtactcaaataaatagtgttggacaactggacaaatatatgggaaaccaaattggatttaattactctgtcaaaatcccgataaagcaaggatttaaatgtaaaaaatgaaataaaaaatgatagaa

SEQ ID NO: 16594 - DNA, 395 bp, Homo sapiens
cagggcatagtaaacctccagaaaaatattttttgagtaaaatgattgaggaaataagggcccagaggcaatagaaaagaactgggtctggagtcctgtggaagactggctgtggaacaggaatgaaaagctggtgctgatgcaggaagaaagcactaggctgctttcacaagtaatccagttcataagtggagaagacagagaatggaggaattccatatctgataaaggaggaaacaaggttatccactgtgagtgaggcagagtagggttagtggtttgtgggaaatgacttggagatgtgataaagatagctaattaagagccaagaaaaaaccatgtgtagctgttgaagatcctacagagacaaacactgggaagtggtacctggcctc

SEQ ID NO: 16595 - DNA, 958 bp, Homo sapiens
gaaaggaacattatttgtgacactgtgcagtgtatgagatgaagtgatgtaaaacatggggctactgttttctctccatctcccctcgccttgcctcgcctcacctcacctctcctctcttgtcctcttgttccctcccctcctcttccctcctctcctcccttctcttctcctcttctctcctttctcctatatttcctctccaaggcactgttttttgaagattcagctgccagggtaatggcaatgggtaaggtgtgaaggaagagtgagtcattccctttaatccttgctgacagttgcacagcactcagaccagccttgacttccctgacctcttgaactgtgagggtaaaggtgaaaatagaccatcaggtcagcccgctgctatctcaggcgggctggcgataattaccagtagggagcattttgcatccattagagatgaactggggaagagggacagattggatcaagtctaaatgtattttgagacacaaacatgctctcaagttggagaaaaatatttttttttctaattctccaagaaattttgtatgtctttgtttcaaatgggaaaaaaaaaaatggacacacgtccatcaggaatcaccatctttacattgtcagaataattctgtttaagttgttcttttcaaaggacaagaagaccttcctttgcacatactgtcctttaggggatttcctttctctgaatcttgttctcctgttataaacttgtttgactacacttcaaactaggccatcctcaaatacttggctcaaaatggatttctctcttggatgcagaagaaaaatgactacatttctgcatatttctcctgatttttattctttcccaaaaaaacagatgttattcagaccaaagtggttaccatagcatctccttattttaaaagttttatgtattactttattaaaggaagttttcataacg

SEQ ID NO: 16596 - DNA, 378 bp, Homo sapiens
caacacacatgtgtgtatgcacagactcactagcaagcaccaagaatcaggtgctgggctacagcctccatggttcaagctgtctagtaaccatagcaattgccgctgtcctcgtggcaaatgagatcacccagtacacacttgctccaagatttgagttacaagagatgaggcattttccacagagggccattaagtttggaattccctttccctggtctgacataaccctagagtattcatcttctgggtccttgcaaactacatcaagttgagttagccagtcatgattggtaagaaatcctaacaggcaggaagaaagtgctaaattaacttctacatgtgagcaattcgcaattttgtgggtggatttttttt

SEQ ID NO: 16597 - DNA, 433 bp, Homo sapiens
tagcagcacaggttcagcttttggctcctggggccaatggtccctgtaagtttgttgaaagcatcagtgccaaataaaacatggccttttaaagcaccgaattacgtgagcgcagagctgttaaaatcagtgtagcaaaaatccagctgggtttggccgtcgccacaaagtacaaaatgatgatcatttgtactgccaagacccagggttctccagatgtggtggactgagcagagttacttggatatacattcagttgcccattctttaaaataaggaatctgctattaagaagtgtatgaggctgggagcagtggctcacgcctgtaatcctaacactttgggaagccgagatgggtggatcacttgaggtcaggagtttgaaaccaacctggccaacatggtgaaaccccatctctactaaaaagtacaa

SEQ ID NO: 16598 - DNA, 366 bp, Homo sapiens
ccttgggcctgtcttgacttccttgaaatgtctcttttacctggcctccttctcatggctgtcatcaagcagccctgttgatcatgttcctgaggaaggacagaatggggttggggagattaatttgtcacccaggctggagtgcagtgacgcgatctcgactcactgcaacctctgcctcccgggttcaagcaattctcttcttcctgttggtgaatttctcccaggaggcatgagccaagatcctgtttcatgggtttctgggtataccccttgaaacaccagagtcaggagtcaggaacaacacctagtgtattagttggttttcacactgctgtaaataactgcccgagactggataattta

SEQ ID NO: 16599 - DNA, 378 bp, Homo sapiens
cacacacccctgacccccagcagcgtcctgaccccaggccgtcagtccacatgcaggcgtcgggtgcacatcagtgagggaaggaaggaacacaaggccaatgccgatcacaaaactgccccgagaaaacggagagaagcccctccattcagggagttccattcccaggatgtggcatcagagaaggaccgcccagatgcccggacccctgaacttctccccagcactgacagctgcaagcctggccacactcacagcacggagccccgcctgacgccgcggtcgcttgacttcacaatcacaggagcgtgacgcctacagcctaatgttgccgtgtagggcacagacttcttaaaaagaatcttcaggggatgtcgc

SEQ ID NO: 16600 - DNA, 287 bp, Homo sapiens
  misc_feature (239)..(239): n is a, c, g, or t
  misc_feature (260)..(260): n is a, c, g, or t
cccaccccagaccaaccacgaagaacccagcagaagcagaaaccacaaaacggcaaagctccctgctccttcaatagacagaagcacgaaacctcccctagatcgttcattagctccgtttgatagagaacccttcacactaggaaagaaaccaccattttttgacaagccctcgattccagcgggaaggtcactcggggagcatttacccaagattcaaaagcctcctttaccaccgnccacggaaagacatgaaaggngcagccccctgccaggggaagaagcca

SEQ ID NO: 16601 - DNA, 357 bp, Homo sapiens
ctccatctcaaaaaaaaaaaaaaaagaaaagaaaagaaaagtaacacttgttaaagaacatgtcaggctaaaaaaagaaggcattatttcaaaaatgtttatattacaataattaagatttttaggcttttaattggtacttttttcctttaacacacagagttttaatttaagtaaaacaagaaatcagacactatgattcctaaaaaaaatttactaatgcttttctagaaatagaattgttcctaagtttttctggtaacatctaggtgtagactgtgggctaaagtttaggcaaaagataaatttgagagatggtaattaagactgtaaaaagcaaatgaggtctctgtggga

SEQ ID NO: 16602 - DNA, 604 bp, Homo sapiens
tctccagagaccatttgtgggtatattttatattttaaaaataaagattttaaatggatatcaatgtttaatattcaaaacatgcacaatataatatcaaatttaaccttaatactttacatgaatatgagtcacttttggcttttctaagtccagcctcccattcttaattgacttggtttcaggtacatgacatgtatctaaatataaagtactgttatagtagaggtaggtggaattctaatattccctgctctttagatttatattttatttaatataaagtttattatttataccctttttaatgcaaagctaatatttagttatatgtatgatttttaataaaaattactttactttttcctatgaatttaaaacatttgatgttggcattttatacaggcaggttgccaaatttaattatgttacactaagttaaacacagcacttaattacctcaaatccagatttctcttaatctgtgtgtacataaaaggaataagtccaaattaatttatagtttagtgttgcactataggtaatattcttttgttatttctagtttttatggaatccttttctttcaagattctaaataata

SEQ ID NO: 16603 - DNA, 922 bp, Homo sapiens
attcaccgcctgtctttcctgaacacctcaccatgtgtacgggaaaatgtgcccgctgtgtggggctctccctcattaccctctgcctcgtctgcattgtggccaacgccctcctgctggtacctaatggggagacctcctggaccaacaccaaccatctcagcttgcaagtctggctcatgggcggcttcattggcgggggcctaatggtactgtgtccagggattgcagccgttcgggcagggggcaagggctgctgtggtgctgggtgctgtggaaaccgctgcaggatgctgcgctcggtcttctcctcggcgttcggggtgcttggtgccatctactgcctctcggtgtctggagctgggctccgaaatggacccagatgcttaatgaacggcgagtggggctaccacttcgaagacaccgcgtaaggtttagcctgtattcgtgtcctccattctctgcctcttccctcccgcccttcccccgtggactgggacacctgggcgggactcgacttcgagggcactcgctccacgtgggctacctgggccttagcaaatcccctgggacgtattcttgggggcggggtgcgcacgcgcacgctgccttctcccacgtggcctcacccctcccacaggggagcttacttgctcaaccgcactctatgggatcggtgcgaggcgccccctcgcgtggtcccctggaatgtgacgctcttctcgctgctggtggccgcctcctgcctggagatagtactgtgtgggatccagctggtgaacgcgaccattggtgtcttctgcggcgattgcaggaaaaaacaggacacacctcactgaggctccactgaccgccgggttacacctgctccttcctggacgctcactcccttgctcgctagaataaactgctttgcgctctc

SEQ ID NO: 16604 - DNA, 709 bp, Homo sapiens
attcaccgcctgtctttcctgaacacctcaccatgtgtacgggaaaatgtgcccgctgtgtggggctctccctcattaccctctgcctcgtctgcattgtggccaacgccctcctgctggtacctaatggggagacctcctggaccaacaccaaccatctcagcttgcaagtctggctcatgggcggcttcattggcgggggcctaatggtactgtgtccagggattgcagccgttcgggcagggggcaagggctgctgtggtgctgggtgctgtggaaaccgctgcaggatgctgcgctcggtcttctcctcggcgttcggggtgcttggtgccatctactgcctctcggtgtctggagctgggctccgaaatggacccagatgcttaatgaacggcgagtggggctaccacttcgaagacaccgcgggagcttacttgctcaaccgcactctatgggatcggtgcgaggcgccccctcgcgtggtcccctggaatgtgacgctcttctcgctgctggtggccgcctcctgcctggagatagtactgtgtgggatccagctggtgaacgcgaccattggtgtcttctgcggcgattgcaggaaaaaacaggacacacctcactgaggctccactgaccgccgggttacacctgctccttcctggacgctcactcccttgctcgctagaataaactgctttgcgctctc

SEQ ID NO: 16605 - DNA, 1189 bp, Homo sapiens
agggattctcagagggatctgtgactcaaaaaaagttgaggatcattgcttagccgggctctcatctcctgaatcagggatccagcacagcacaggaaatagaagtcagaaatagagaaagattgtatgggggaaggaaatgtgaagtgctgagatggtgccacagcatctttgggtccagagttctctctcagcttaggtaagaccatgtctgagatggaagagagaggggtagaaggagagcaggatggaatgtcctcagaaaggttctgtcaagcaggggtaggcagaaggtaggcagagtcaaattcttctccaatctgaagtagctcacagattgttccaccaatctgtgcaacctctctctaacctaggaggttgttgaggttagaacccagaaaagaactaggaaatgtgaagcctccatttcagagaatcctttgctggaagccaggcatttcactgaagtccatttactccctggaatttctgctcctttctatcagtccctgaggcagaggctgtaaggacattgggagaggggactgagaagaaagagtaaaaacaaagaaaaaccccaacatcctgaatcaggtgcattagagttaatgaagaatgtaaggaccaataacttagcccagtccccactgaaagttcagagtggatgcattggaagatttctcctttcttacaggtcgtgtcctgcaactgaaaggccctgggagagagagccgtgagggcatggcagtgaggatggcagtgtggtggaaagggggagttttcaatcagacagccatgagctcaaatagctagttactatttactaactagctctgtgcacttgagcacttactctctttgacctttagtttcaccagctaagatgcctctctactttatagggttgatgtaaggattaaataagaaaatatatataaagccactgacatagaataggccctcaataaatgttattttcttctctttgaactgctgtcccaccctgggcagagcctccattagattgtccccatgatgtggtaccatacatccctgcacatgggccacaaaacttctgcatacacaccacccactcatgtccttggctgcatttgcacactcatcagcacacacacagcagcctgtgccatcacagctgagctgagggcagtcttcccgacaggtaaga

SEQ ID NO: 16606 - DNA, 2036 bp, Homo sapiens
aggtagacattgataaatgtttctgatttacatttgttggaaatattatgactgttcacatctcaataggttgatttttctgtgttgtccaagttatagatttctaatgctaagtacagttccatgttggtagtgtgcgtagcacagtaagatgtttgtggtgccagtgggcttgtgtttatattgtgtagatgttctggaattccagctctagagaagatgtaaattaatagaaatcaccacttaataatatgtacacaggattgatattatgtggaagcatgattcaggaaagtagatgacttattcataaatatgaagcactgttacatgtaaggccatgttctagccacagtgaatgatagaaaaaggaaggaaggggcatggtgcctgggctcaaggaactcacagtttgatagaggaagcatcacagcaaaagttggggccacttacaccatggcagttacagaaggccaggagctcagtcatgagaacatcaccttcccctgcagaagagttgcgctaagttgcccagaatcatattctgtaccttcatctctcaaccttccccagtggcaggaaagggtcaagcaagacccattccctctctagtgggacaaactgattctgtttaactctcatatgcctgggagcaagctgaggtggaatttgggttcccctatctctactcctaattgtaaatgggctgtctagacatgtgttacattaatttgatgaactttgttctgaagaaatggaaggtctcccccccattttagaccaacactacctgtctccctgcattttatttgttttcacctggtacatgtaagtcaaaatgaataatcatgttctgaccaatgtgtcttttagatcacataacattgcctttatgaagattcatagaaaaaggtttttttatctagatctcagtgccaaggaaagctctgatcctaagcgcagtatgtgtacacacacacgtctacatgtgtgtgtagatctgtatgtatgtattacaaacactgtgatttttgtaacttaagctgctttttctctctttgttctggctgctggaaagttcaacaaaacttacagcccacctcaaccaactaccccaacctatatttatttaatttcatcttatttccttgtaaattgtgtcaaatcctgtttttgaaaagcagcatagactgacaacttttcactatcatcttatcgaaggcattttggaaactggggtcgtatgtcccacctaggcttgctttgttactgccacaaatacctccagttcttaccagtgatgttattatgcattcaacctaattcattcatctggaaagaaacagttttttaaaaagggaaacctcacacgtaaatggctcagggcagcctggccttggtggaatgagcatgagactggaagctgaaagaagcaagttttaatcttgtcactaaatgagtgttgtttgacacatcatagcctctctgggcctcggctcctcatctgaagagaagttgaacttaactgctaagttgctctggctctaatgtttcatgaggctgtggagcgtgatatagatgcggaagaggttagaagaccaggctgccggcccagctgtcctgtgcctgccacatctggccataccaaatccatcgcatgcttcaggaaagggaggggatgctgtgacagcaaactcagcccaggagcttgttggggaaggagaaagggcaagtccctcgtggtccacagcaggcaccccccaagcacctcgataaccagtggcaggtaggctgaagtgaaggaagcctctgtcaggaggtctggcgcccagtgacagacaagacagctgtgagggagctggggcagccctggctaaaggaatgtctgagtaacttgtgaaactggaagcctctgcctctgaatgcattccaagacctggtgcaaatggatgtccattcattgttttgtatcagtgttcacttagatgtcttcttgaaaacttgtttgtggaataaatgtctaaaataaatggctc

SEQ ID NO: 16607 - DNA, 1175 bp, Homo sapiens
gagcgtgaaggcctgggcgagcggaagggtgggagagaggggctaggccggggagggaagcgctggggccggggccggctttccaggagccggcgggagcggggtgcgtaagaggcgggcgaggaagaaccggcgggcaacgggaagggcagaggtggatctctccctcagcgacccctctcgccgagtgaagggtcgagggtttggggcacaaagggcgcagaacgttttttcctgtgagaggaacattaagactcctgggagggctggggctaacgcctccgagagccccacctggtcagcctagggttagacgtgtagccagggtgctgggagggggccgctgctgggccccagatagaggggtagaggccgctcaatcacggagccaggccccacctgctgtagaaaccgccaccgagagccggccgggcttgctgcacgctctggattccgcctgcctataggcgaggcacaagggactgcgagaccaggcctgaaggcagagaggtcagcaggctcgggggcctctgctccagcggacaacaagcgcaccgggcgggaacggccgcctccccaggcgctgcagcctagctctcatgtgacccacggaacttagcccctctgttctgtttgcatacctgcaaattgtgggcattcacgccgggactgccaactcaccaggttatttatagtgacaagagagtgagacagtgggcttgaaagtgttttccagaccaaggctctgtcccacatataggtggattaactgtctggcaaaggcaggaatccattgaagaggccatctccacattcagaaccaagaatgtggcagaaagaatgttctaggacttccaagcctcgtcattaagcaaaagcattaagcaaaccccacagcttctgctttgtactctggaaaatgccagccacccatgaggagagaccaccctgctagccacagggagaggctatgtgaaaagaaagagatgcctggccagctctagctcttcagctcatcccagctgagctaccagacacatgagtggaaaagcccttaggaagttccagctccagcagacaccatactgaacagaggagagataagccatccccacggagcactgccaaaatgacggcattgtgaacaaataaatgatcattgttttaaggcaaaa

SEQ ID NO: 16608 - DNA, 1103 bp, Homo sapiens
gagcgtgaaggcctgggcgagcggaagggtgggagagaggggctaggccggggagggaagcgctggggccggggccggctttccaggagccggcgggagcggggtgcgtaagaggcgggcgaggaagaaccggcgggcaacgggaagggcagaggtggatctctccctcagcgacccctctcgccgagtgaagggtcgagggtttggggcacaaagggcgcagaacgttttttcctgtgagaggaacattaagactcctgggagggctggggctaacgcctccgagagccccacctggtcagcctagggttagacgtgtagccagggtgctgggagggggccgctgctgggccccagatagaggggtagaggccgctcaatcacggagccaggccccacctgctgtagaaaccgccaccgagagccggccgggcttgctgcacgctctggattccgcctgcctataggcgaggcacaagggactgcgagaccaggcctgaaggcagagaggtcagcaggctcgggggcctctgctccagcggacaacaagcgcaccgggcgggaacggccgcctccccaggcgctgcagcctagctctcatgtgacccacggaacttagcccctctgttctgtttgcatacctgcaaattgtgggcattcacgccgggactgccaactcaccaggttatttatagtgacaagagagtgagacagtgggcttgaaagtgttttccagaccaaggctctgtcccacatataggtggattaactgtctggcaaaggcaggaatccattgaagaggccatctccacattcagaaccaagcttctgctttgtactctggaaaatgccagccacccatgaggagagaccaccctgctagccacagggagaggctatgtgaaaagaaagagatgcctggccagctctagctcttcagctcatcccagctgagctaccagacacatgagtggaaaagcccttaggaagttccagctccagcagacaccatactgaacagaggagagataagccatccccacggagcactgccaaaatgacggcattgtgaacaaataaatgatcattgttttaaggcaaaa

SEQ ID NO: 16609 - DNA, 604 bp, Homo sapiens
cagcttaagcagcaatatgctgagcggtgaggctgtgttgatgaagaaggaagcagcatcatacctggcatggaagctgtcaggaggtggaggttggggagaaaagagataatggtatggtgagatgtctactgaactgctcctgccaaggcccctccccatgtactctcaacgaaagttgcagagccacctctcaacaacccatgaagtgtctggagctccaccctctgctcaagaggaacggcacatgacccaggcctatgccaatcagcatttcacattcctcatggttggttcaaaggtgcaagaagagttgttgatttttcagcctgtccagctttgtagttgctgttaagatagaatggacttccaagctccttacgtgcagaagcagaaaccagaggtcctatcaaaatagttttaaattgtattaaacatacacaaaagtagagcaatgtgctgaatccctatgtatccatcacctaggttcaataattattataattttgctaattttgagaagcagtttaaaaactcatagagaccagtgcttaacagttaaaaaaacagggagttaaaatcgtcattcaaataatttgggagg

SEQ ID NO: 16610 - DNA, 706 bp, Homo sapiens
cgcagtgccggcgtcatggcggcctccgcgcacggctctgtctgggggccgttgcggcttggcatccccggcctgtgctgccgccggccgcctctgggtctgtacgcgcgcatgcggcggctgcccgggccggaggtgtctgggcggagcgtggctgcggccagcggaccgggcgcctggggcactgaccactactgcctggagctgctgcggaaacgggattatgaaggttatttatgctccctgctgctccctgcagaatcccgaagctctgtttttgcactgagggcctttaatgtggaactggctcaggctgattactcttgctgctgtcttgctgtactgtatgccactgggatctgaacactaaacattgctaagaaacccacccaccaccaggatatttggaagtaacttcacatatggaaaagttaaagactcagtctctgagaaaacaattggactgatgcgaatgcagttttggaaaaaaactgtggaagatatatactgtgacaatccaccacatcagcctgtggccattgaactatggaaggttgtcccagctttggacagcggaaactccttcacagcggctgctatgtccttgtgacacgcttccgtcattttttggagcactttcttattttctgacacaataagatattctaggatccttttgaatctctcccctgcctcacctttggaa

SEQ ID NO: 16611 - DNA, 1941 bp, Homo sapiens
caaaaaaataaacttaacattgatgcagtacttttatttgatctaccatctggtttccagttttctcaaatgacccagtaaggtcttttatggcattttttcccccttctgtatgggatctaatctaggatcatgtattacatttagttttctgtctctttagcctcctttattctggaacatttccatagcctttctttgcgttttgtgacattgacatattttaagcaatactattccttttaagaattaaaatgtttctcatttggggtttattttatttttcatcaggtttatattaaacttatggattcctagcgtaatattacctaagtggtctgtgtcctcttcagagtcagaaggaggcatgaaatatccgtctgactcccagcagtaatgttaattttagtcactgagtcaagatgttaatactttttcccttgctactaataagcagcctgtgaggagaccttttaagaccatgttcctcatcaaaatttacctcctagatttagcttgtgttggtgattcttgcctgaacctaagaaggccattttttttttttttagatggagtttcgctcttgtcgcccaggctagagtgtggtggtgtgatcttggctcactgcaacctctgcctctcaggtttaagcgattctcctgcctcagtctcctgagtagctgggattacaggcacccaccaccacacccggctaattttttgtatttttagtagagacggggtttcatcatgttagccaggctggtcttgaactcctgacctcaggtgatccaccctccttggcctcccaaagtttaaggtttacagatgtgagtcaccgtgcctgaccagaaggccattcttagtagtgagtgagggagacaatctaataatcttctttttaaaaattacttaaagaatgaatgaatgaatttatttaaaagtacatgcagtaaaattctctctttgttgtgttctataggttccaaaaaatgtagtcatgtatttatcaccatagtcataatacagaacagttacattaactcaaaaaattccctcaaagatactgattttttagacagtagacaatgcatttgctaaagtttttaaaccctgtttataggttaaagactcagtctctgagaaaacaattggactgatgcgaatgcagttttggaaaaaaactgtggaagatatatactgtgacaatccaccacatcagcctgtggccattgaactatggaaggctgttaaaagacataatctgactaaaagatggcttatgaaaatcgtcgatgaaagagaaaaaaatctggatgacaaagcatatcgtaatatcaaggaactggaaaattatgctgaaaacacacagagctctcttctttacttaacactagaaatattgggtataaaggatcttcatgcagatcatgctgcaagtcatattggaaaagcacaaggcattgtcacttgcttgagagcaacaccatatcatgggagcagaagaaaggtgttccttcccatggatatttgtatgctgcatggtgtttcacaagaggactttctacggaggaaccaagataaaaatgtgagagatgtaatatatgacattgccagtcaagcacacttgcacctaaagcatgctaggtcctttcacaaaactgttcctgtgaaagcatttcctgcttttcttcagacggtttctctagaggactttctaaagaaaattcagcgagtggattttgatatattccacccatctttacagcagaagaatacattacttccattatatttgtatattcagtcatggagaaaaacatattaaaataatttcatggcactgatgttaattctagtctattagttttataacaagttaggattcttatttaggaacaacaggaaatgactgttaaggagaaaatgaatttattgaat

SEQ ID NO: 16612 - DNA, 1912 bp, Homo sapiens
caaaaaaataaacttaacattgatgcagtacttttatttgatctaccatctggtttccagttttctcaaatgacccagtaaggtcttttatggcattttttcccccttctgtatgggatctaatctaggatcatgtattacatttagttttctgtctctttagcctcctttattctggaacatttccatagcctttctttgcgttttgtgacattgacatattttaagcaatactattccttttaagaattaaaatgtttctcatttggggtttattttatttttcatcaggtttatattaaacttatggattcctagcgtaatattacctaagtggtctgtgtcctcttcagagtcagaaggaggcatgaaatatccgtctgactcccagcagtaatgttaattttagtcactgagtcaagatgttaatactttttcccttgctactaataagcagcctgtgaggagaccttttaagaccatgttcctcatcaaaatttacctcctagatttagcttgtgttggtgattcttgcctgaacctaagaaggccattttttttttttttagatggagtttcgctcttgtcgcccaggctagagtgtggtggtgtgatcttggctcactgcaacctctgcctctcaggtttaagcgattctcctgcctcagtctcctgagtagctgggattacaggcacccaccaccacacccggctaattttttgtatttttagtagagacggggtttcatcatgttagccaggctggtcttgaactcctgacctcaggtgatccaccctccttggcctcccaaagtttaaggtttacagatgtgagtcaccgtgcctgaccagaaggccattcttagtagtgagtgagggagacaatctaataatcttctttttaaaaattacttaaagaatgaatgaatgaatttatttaaaagtacatgcagtaaaattctctctttgttgtgttctataggttccaaaaaatgtagtcatgtatttatcaccatagtcataatacagaacagttacattaactcaaaaaattccctcaaagatactgattttttagacagtagacaatgcatttgctaaagtttttaaaccctgtttataggttaaagactcagtctctgagaaaacaattggactgatgcgaatgcagttttggaaaaaaactgtggaagatatatactgtgacaatccaccacatcagcctgtggccattgaactatggaaggctgttaaaagacataatctgactaaaagatggcttatgaaaatcgtcgatgaaagagaaaaaaatctggatgacaaagcatatcgtaatatcaaggaactggaaaattatgctgaaaacacacagagctctcttctttacttaacactagaaatattgggtataaaggatcttcatgcagatcatgctgcaagtcatattggaaaagcacaaggcattgtcacttgcttgagagcaacaccatatcatgggagcagaagaaaggtgttccttcccatggatatttgtatgctgcatggtgtttcacaagaggactttctacggaggaaccaagataaaaatgtgagagatgtaatatatgacattgccagtcaagcacacttgcacctaaagcatgctaggtcctttcacaaaactgttcctgtgaaagcatttcctgcttttcttcagacggtttctctagaggactttctaaagaaaattcagcgagtggattttgatatattccacccatctttacagcagaagaatacattacttccattatatttgtatattcagtcatggagaaaaacatattaaaataatttcatggcactgtaaccatccttcaaaaaatttgagcaaagatagtaggcctaagtgcaatatagatggacttgcaga

SEQ ID NO: 16613 - DNA, 1892 bp, Homo sapiens
gagcgtgaaggcctgggcgagcggaagggtgggagagaggggctaggccggggagggaagcgctggggccggggccggctttccaggagccggcgggagcggggtgcgtaagaggcgggcgaggaagaaccggcgggcaacgggaagggcagaggtggatctctccctcagcgacccctctcgccgagtgaagggtcgagggtttggggcacaaagggcgcagaacgttttttcctgtgagaggaacattaagactcctgggagggctggggctaacgcctccgagagccccacctggtcagcctagggttagacgtgtagccagggtgctgggagggggccgctgctgggccccagatagaggggtagaggccgctcaatcacggagccaggccccacctgctgtagaaaccgccaccgagagccggccgggcttgctgcacgctctggattccgcctgcctataggcgaggcacaagggactgcgagaccaggcctgaaggcagagaggtcagcaggctcgggggcctctgctccagcggacaacaagcgcaccgggcgggaacggccgcctccccaggcgctgcagcctagctctcatgtgacccacggaacttagcccctctgttctgtttgcatacctgcaaattgtgggcattcacgccgggactgccaactcaccaggttatttatagtgacaagagagtgagacagtgggcttgaaagtgttttccagaccaaggctctgtcccacatataggtggattaactgtctggcaaaggcaggtctcttcttcggcctctctgacatggtgccagccctactggagtcagcaggagtccagcacaacagatggtggtcagtggtgacttcggcacaggcagttcgtgaggagtggttggtggccatggagtcctgactggagtaggttaaaaagaaggaggaaaatcacaagaaagagagactggaggaaacgggattatgaaggttatttatgctccctgctgctccctgcagaatcccgaagctctgtttttgcactgagggcctttaatgtggaactggctcaggctgttaaagactcagtctctgagaaaacaattggactgatgcgaatgcagttttggaaaaaaactgtggaagatatatactgtgacaatccaccacatcagcctgtggccattgaactatggaaggctgttaaaagacataatctgactaaaagatggcttatgaaaatcgtcgatgaaagagaaaaaaatctggatgacaaagcatatcgtaatatcaaggaactggaaaattatgctgaaaacacacagagctctcttctttacttaacactagaaatattgggtataaaggatcttcatgcagatcatgctgcaagtcatattggaaaagcacaaggcattgtcacttgcttgagagcaacaccatatcatgggagcagaagaaaggtgttccttcccatggatatttgtatgctgcatggtgtttcacaagaggactttctacggaggaaccaagataaaaatgtgagagatgtaatatatgacattgccagtcaagcacacttgcacctaaagcatgctaggtcctttcacaaaactgttcctgtgaaagcatttcctgcttttcttcagacggtttctctagaggactttctaaagaaaattcagcgagtggattttgatatattccacccatctttacagcagaagaatacattacttccattatatttgtatattcagtcatggagaaaaacatattaaaataatttcatggcactgatgttaattctagtctattagttttataacaagttaggattcttatttaggaacaacaggaaatgactgttaaggagaaaatgaatttattgaat

SEQ ID NO: 16614 - DNA, 2135 bp, Homo sapiens
gagcgtgaaggcctgggcgagcggaagggtgggagagaggggctaggccggggagggaagcgctggggccggggccggctttccaggagccggcgggagcggggtgcgtaagaggcgggcgaggaagaaccggcgggcaacgggaagggcagaggtggatctctccctcagcgacccctctcgccgagtgaagggtcgagggtttggggcacaaagggcgcagaacgttttttcctgtgagaggaacattaagactcctgggagggctggggctaacgcctccgagagccccacctggtcagcctagggttagacgtgtagccagggtgctgggagggggccgctgctgggccccagatagaggggtagaggccgctcaatcacggagccaggccccacctgctgtagaaaccgccaccgagagccggccgggcttgctgcacgctctggattccgcctgcctataggcgaggcacaagggactgcgagaccaggcctgaaggcagagaggtcagcaggctcgggggcctctgctccagcggacaacaagcgcaccgggcgggaacggccgcctccccaggcgctgcagcctagctctcatgtgacccacggaacttagcccctctgttctgtttgcatacctgcaaattgtgggcattcacgccgggactgccaactcaccaggttatttatagtgacaagagagtgagacagtgggcttgaaagtgttttccagaccaaggctctgtcccacatataggtggattaactgtctggcaaaggcaggtctcttcttcggcctctctgacatggtgccagccctactggagtcagcaggagtccagcacaacagatggtggtcagtggtgacttcggcacaggcagttcgtgaggagtggttggtggccatggagtcctgactggagtaggttaaaaagaaggaggaaaatcacaagaaagagagactggaggaaacgggattatgaaggttatttatgctccctgctgctccctgcagaatcccgaagctctgtttttgcactgagggcctttaatgtggaactggctcaggctgttaaagactcagtctctgagaaaacaattggactgatgcgaatgcagttttggaaaaaaactgtggaagatatatactgtgacaatccaccacatcagcctgtggccattgaactatggaaggtctgcacaccagcagaggcaggcccagtttctgggccccagattgacttcacagagccccagtaaagatggaaagccagaaccccccaactggggattgagaagaaaaagtggatgggaagctgctgttaaaagacataatctgactaaaagatggcttatgaaaatcgtcgatgaaagaagtctcactcttgtcgcccaggctggagtacaatggcacgaccttggctcactacaacctccacctcccgggttcaagtgattctcctgcctcagcttcctgagtagctgggattacaggaaaaaaatctggatgacaaagcatatcgtaatatcaaggaactggaaaattatgctgaaaacacacagagctctcttctttacttaacactagaaatattgggtataaaggatcttcatgcagatcatgctgcaagtcatattggaaaagcacaaggcattgtcacttgcttgagagcaacaccatatcatgggagcagaagaaaggtgttccttcccatggatatttgtatgctgcatggtgtttcacaagaggactttctacggaggaaccaagataaaaatgtgagagatgtaatatatgacattgccagtcaagcacacttgcacctaaagcatgctaggtcctttcacaaaactgttcctgtgaaagcatttcctgcttttcttcagacggtttctctagaggactttctaaagaaaattcagcgagtggattttgatatattccacccatctttacagcagaagaatacattacttccattatatttgtatattcagtcatggagaaaaacatattaaaataatttcatggcactgatgttaattctagtctattagttttataacaagttaggattcttatttaggaacaacaggaaatgactgttaaggagaaaatgaatttattgaat

SEQ ID NO: 16615 - DNA, 1326 bp, Homo sapiens
cgcagtgccggcgtcatggcggcctccgcgcacggctctgtctgggggccgttgcggcttggcatccccggcctgtgctgccgccggccgcctctgggtctgtacgcgcgcatgcggcggctgcccgggccggaggtgtctgggcggagcgtggctgcggccagcggaccgggcgcctggggcactgaccactactgcctggagctgctgcggaaacgggattatgaaggttatttatgctccctgctgctccctgcagaatcccgaagctctgtttttgcactgagggcctttaatgtggaactggctcaggctgttaaagactcagtctctgagaaaacaattggactgatgcgaatgcagttttggaaaaaaactgtggaagatatatactgtgacaatccaccacatcagcctgtggccattgaactatggaagtgattgccaaaagagggtttctgtaacaggagccacccacagacctgacagtggtacacctcttctcaggtctgcacaccagcagaggcaggcccagtttctgggccccagattgacttcacagagccccagtaaagatggaaagccagaaccccccaactggggattgagaagaaaaagtggatgggaagctgctgttaaaagacataatctgactaaaagatggcttatgaaaatcgtcgatgaaagagaaaaaaatctggatgacaaagcatatcgtaatatcaaggaactggaaaattatgctgaaaacacacagagctctcttctttacttaacactagaaatattgggtataaaggatcttcatgcagatcatgctgcaagtcatattggaaaagcacaaggcattgtcacttgcttgagagcaacaccatatcatgggagcagaagaaaggtgttccttcccatggatatttgtatgctgcatggtgtttcacaagaggactttctacggaggaaccaagataaaaatgtgagagatgtaatatatgacattgccagtcaagcacacttgcacctaaagcatgctaggtcctttcacaaaactgttcctgtgaaagcatttcctgcttttcttcagacggtttctctagaggactttctaaagaaaattcagcgagtggattttgatatattccacccatctttacagcagaagaatacattacttccattatatttgtatattcagtcatggagaaaaacatattaaaataatttcatggcactgatgttaattctagtctattagttttataacaagttaggattcttatttaggaacaacaggaaatgactgttaaggagaaaatgaatttattgaat

SEQ ID NO: 16616 - DNA, 1211 bp, Homo sapiens
caaaaaaataaacttaacattgatgcagtacttttatttgatctaccatctggtttccagttttctcaaatgacccagtaaggtcttttatggcattttttcccccttctgtatgggatctaatctaggatcatgtattacatttagttttctgtctctttagcctcctttattctggaacatttccatagcctttctttgcgttttgtgacattgacatattttaagcaatactattccttttaagaattaaaatgtttctcatttggggtttattttatttttcatcaggtttatattaaacttatggattcctagcgtaatattacctaagtggtctgtgtcctcttcagagtcagaaggaggcatgaaatatccgtctgactcccagcagttaaagactcagtctctgagaaaacaattggactgatgcgaatgcagttttggaaaaaaactgtggaagatatatactgtgacaatccaccacatcagcctgtggccattgaactatggaaggctgttaaaagacataatctgactaaaagatggcttatgaaaatcgtcgatgaaagagaaaaaaatctggatgacaaagcatatcgtaatatcaaggaactggaaaattatgctgaaaacacacagagctctcttctttacttaacactagaaatattgggtataaaggatcttcatgcagatcatgctgcaagtcatattggaaaagcacaaggcattgtcacttgcttgagagcaacaccatatcatgggagcagaagaaaggtgttccttcccatggatatttgtatgctgcatggtgtttcacaagaggactttctacggaggaaccaagataaaaatgtgagagatgtaatatatgacattgccagtcaagcacacttgcacctaaagcatgctaggtcctttcacaaaactgttcctgtgaaagcatttcctgcttttcttcagacggtttctctagaggactttctaaagaaaattcagcgagtggattttgatatattccacccatctttacagcagaagaatacattacttccattatatttgtatattcagtcatggagaaaaacatattaaaataatttcatggcactgatgttaattctagtctattagttttataacaagttaggattcttatttaggaacaacaggaaatgactgttaaggagaaaatgaatttattgaat

SEQ ID NO: 16617 - DNA, 1489 bp, Homo sapiens
gagcgtgaaggcctgggcgagcggaagggtgggagagaggggctaggccggggagggaagcgctggggccggggccggctttccaggagccggcgggagcggggtgcgtaagaggcgggcgaggaagaaccggcgggcaacgggaagggcagaggtggatctctccctcagcgacccctctcgccgagtgaagggtcgagggtttggggcacaaagggcgcagaacgttttttcctgtgagaggaacattaagactcctgggagggctggggctaacgcctccgagagccccacctggtcagcctagggttagacgtgtagccagggtgctgggagggggccgctgctgggccccagatagaggggtagaggccgctcaatcacggagccaggccccacctgctgtagaaaccgccaccgagagccggccgggcttgctgcacgctctggattccgcctgcctataggcgaggcacaagggactgcgagaccaggcctgaaggcagagaggtcagcaggctcgggggcctctgctccagcggacaacaagcgcaccgggcgggaacggccgcctccccaggcgctgcagcctagctctcatgtgacccacggaacttagcccctctgttctgtttgcatacctgcaaattgtgggcattcacgccgggactgccaactcaccaggttatttatagtgacaagagagtgagacagtgggcttgaaagtgttttccagaccaaggctctgtcccacatataggtggattaactgtctggcaaaggcaggtctcttcttcggcctctctgacatggtgccagccctactggagtcagcaggagtccagcacaacagatggtggtcagtggtgacttcggcacaggcagttcgtgaggagtggttggtggccatggagtcctgactggagtaggttaaaaagaaggaggaaaatcacaagaaagagagactggaggtggaggttggggagaaaagagataatggtatggtgagatgtctactgaactgctcctgccaaggcccctccccatgtactctcaacgaaagttgcagagccacctctcaacaacccatgaagtgtctggagctccaccctctgctcaagaggaacggcacatgacccaggcctatgccaatcagcatttcacattcctcatggttggttcaaaggtgcaagaagagttgttgatttttcagcctgtccagctttgtagttgctgttaagatagaatggacttccaagctccttacgtgcagaagcagaaaccagaggtcctatcaaaatagttttaaattgtattaaacatacacaaaagtagagcaatgtgctgaatccctatgtatccatcacctaggttcaataattattataattttgctaattttgagaagcagtttaaaaactcatagagaccagtgcttaacagttaaaaaaacagggagttaaaatcgtcattcaaataatttgggagg

SEQ ID NO: 16618 - DNA, 683 bp, Homo sapiens
gacctgttcaacttcttcacaaaataatttcttaaaagacaacttgagctccccctcatggtacactacatttggggggtcggggtggggatgtttcattttccctgattgaaacagcctgtttgcattccaccaaatctagtaataaggccaggcaaacgtgattttgctaatccttttgtcttaaccaaagctttttatattatgagcagaagaggcttggcttttctggtactagctctgtgatacccttttactggtctaatagaaacttcttggatgtctttttctttctctcttttaaaattctcacttaaatagaaaaccatctcagggaaactaaaatagcctaaatacttgtaattattctttagttagttttttttttttttaagtcttgatcattttatgatctggtgatcactattctcttttttccaggtttctctagaggactttctaaagaaaattcagcgagtggattttgatatattccacccatctttacagcagaagaatacattacttccattatatttgtatattcagtcatggagaaaaacatattaaaataatttcatggcactgatgttaattctagtctattagttttataacaagttaggattcttatttaggaacaacaggaaatgactgttaaggagaaaatgaatttattgaat

SEQ ID NO: 16619 - DNA, 335 bp, Homo sapiens
tccacatcttaatcactcacctggtttcctaaatgtgtctgtaccgaagagtcaccaaggggcacttattaaagtacagattccagggtctacctcagagatagcaaatcagggtctctaggggagggacctagtttctgtggtggtttccactcatgagcctctgctccaatgagctgtatttgcctgtctgtctccaatcttggggacagcagtttttcctatggcctcacctttcttacaggtgcaagaagagttgttgatttttcagcctgtccagctttgtagttgctgttaagatagaatggacttccaagctccttacgtgcagaagc

SEQ ID NO: 16620 - DNA, 478 bp, Homo sapiens
atttgtatgaaatgcccagaatagacaaatccatgaagatgaaaagtagattagtggtttgccagggctgaggagggggggaaatgggaagtgtctgcttaatggatgcaacttttcttttgggggtcattaaaatattctggaattagatagtagtgatagctgcacaactttgtgtatatactaaaaaccactgaattgtattatttgaagggataaattttatggtatgttaattatgtctcaaaaaaaaccataaaggatgcattttttttcctggaatcattgctgatgtcattttctttttttttttttttttttgagacagagtctcactcttgtcgcccaggctggagtacaatggcacgaccttggctcactacaacctccacctcccgggttcaagtgattctcctgcctcagcttcctgagtagctgggattacaggtgcctaccacaatgcccagctgacttcttt

SEQ ID NO: 16621 - DNA, 248 bp, Homo sapiens
taactgtcttttttttctgtctgttacaggaaacgggattatgaaggttatttatgctccctgctgctccctgcagaatcccgaagctctgtttttgcactgagggcctttaatgtggaactggctcaggctggtattaagataccttaaaatattatttgcgaaatggtgatataaggtgtttaatgctgaacaataaagaaatatagttgtaatttatatgttagatgtgtttaaggtctctgcta

SEQ ID NO: 16622 - DNA, 869 bp, Homo sapiens
cctggccaagtgcggctctgctctccccagtcccggtccgcgaccacccggagcccgctccgccggccttgcgcggcgcgcccagggaaggcatttccagcccgcccacccaggactgttctagaaaaagtcttaaaggcctaccctcctactgatgacccagagactgtccctgcccagtcactgctactgttgaccttggctcctgcccagggatggaggctctcaactgggctggttctacatggaggtctcttcttcggcctctctgacatggtgccagccctactggagtcagcaggagtccagcacaacagatggtggtcagtggtgacttcggcacaggcagttcgtgaggagtggttggtggccatggagtcctgactggagtaggttaaaaagaaggaggaaaatcacaagaaagagagactggaggtggaggttggggagaaaagagataatggtatggtgagatgtctactgaactgctcctgccaaggcccctccccatgtactctcaacgaaagttgcagccacccattctcattttgtggatataattccctgctttagttttctgagcacaagaaatcaactttggctgcacattggaatatctgagaagcttaaaaatactgatgtttggaccaggtgcagtggctcacgcctgtaatcccagcactttgggaggcagaggcagagccacctctcaacaacccatgaagtgtctggagctccaccctctgctcaagaggaacggcacatgacccaggcctatgccaatcagcatttcacattcctcatggttggttcaaagtgaagcaactttcccagaagcaccacagtggacttgttctcaagtctaattg

SEQ ID NO: 16623 - DNA, 1133 bp, Homo sapiens
cgcagtgccggcgtcatggcggcctccgcgcacggctctgtctgggggccgttgcggcttggcatccccggcctgtgctgccgccggccgcctctgggtctgtacgcgcgcatgcggcggctgcccgggccggaggtgtctgggcggagcgtggctgcggccagcggaccgggcgcctggggcactgaccactactgcctggagctgctgcggaaacgggattatgaaggttatttatgctccctgctgctccctgcagaatcccgaagctctgtttttgcactgagggcctttaatgtggaactggctcaggctgttaaagactcagtctctgagaaaacaattggactgatgcgaatgcagttttggaaaaaaactgtggaagatatatactgtgacaatccaccacatcagcctgtggccattgaactatggaaggctgttaaaagacataatctgactaaaagatggcttatgaaaatcgtcgatgaaagagaaaaaaatctggatgacaaagcatatcgtaatatcaaggaactggaaaattatgctgaaaacacacagagctctcttctttacttaacactagaaatattgggtataaaggatcttcatgcagatcatgctgcaagtcatattggaaaagcacaaggcattgtcacttgcttgagagcaacaccatatcatgggagcagaagaaaggtgttccttcccatggatatttgtatgctgcatggtgtttcacaagaggactttctacggaggaaccaagataaaaatgtgagagatgtaatatatgacattgccagtcaagcacacttgcacctaaagcatgctaggtcctttcacaaaactgttcctgtgaaagcatttcctgcttttcttcagacggtttctctagaggactttctaaagaaaattcagcgagtggattttgatatattccacccatctttacagcagaagaatacattacttccattatatttgtatattcagtcatggagaaaaacatattaaaataatttcatggcactgatgttaattctagtctattagttttataacaagttaggattcttatttaggaacaacaggaaatgactgttaaggagaaaatgaatttattgaat

SEQ ID NO: 16624 - DNA, 1334 bp, Homo sapiens
cctggccaagtgcggctctgctctccccagtcccggtccgcgaccacccggagcccgctccgccggccttgcgcggcgcgcccagggaaggcatttccagcccgcccacccaggtctcttcttcggcctctctgacatggtgccagccctactggagtcagcaggagtccagcacaacagatggtggtcagtggtgacttcggcacaggcagttcgtgaggagtggttggtggccatggagtcctgactggagtaggttaaaaagaaggaggaaaatcacaagaaagagagactggaggaaacgggattatgaaggttatttatgctccctgctgctccctgcagaatcccgaagctctgtttttgcactgagggcctttaatgtggaactggctcaggctgattactcttgctgctgtcttgctgtactgtatgccactgggatctgaacactaaacattgctaagaaacccacccaccaccaggatatttggaagtaacttcacatatggaaaagttaaagactcagtctctgagaaaacaattggactgatgcgaatgcagttttggaaaaaaactgtggaagatatatactgtgacaatccaccacatcagcctgtggccattgaactatggaaggctgttaaaagacataatctgactaaaagatggcttatgaaaatcgtcgatgaaagagaaaaaaatctggatgacaaagcatatcgtaatatcaaggaactggaaaattatgctgaaaacacacagagctctcttctttacttaacactagaaatattgggtataaaggatcttcatgcagatcatgctgcaagtcatattggaaaagcacaaggcattgtcacttgcttgagagcaacaccatatcatgggagcagaagaaaggtgttccttcccatggatatttgtatgctgcatggtgtttcacaagaggactttctacggaggaaccaagataaaaatgtgagagatgtaatatatgacattgccagtcaagcacacttgcacctaaagcatgctaggtcctttcacaaaactgttcctgtgaaagcatttcctgcttttcttcagacggtttctctagaggactttctaaagaaaattcagcgagtggattttgatatattccacccatctttacagcagaagaatacattacttccattatatttgtatattcagtcatggagaaaaacatattaaaataatttcatggcactgatgttaattctagtctattagttttataacaagttaggattcttatttaggaacaacaggaaatgactgttaaggagaaaatgaatttattgaat

SEQ ID NO: 16625 - DNA, 1067 bp, Homo sapiens
ccttggcctcccaaagtgctgggattacaggcatgagctaccgcgcccaacttgaagcctttttgttttcagttaattttagtcagtatttttttgtgcagcttggaaagtgaagagtaactgtcttttttttctgtctgttacaggaaacgggattatgaaggttatttatgctccctgctgctccctgcagaatcccgaagctctgtttttgcactgagggcctttaatgtggaactggctcaggctgttaaagactcagtctctgagaaaacaattggactgatgcgaatgcagttttggaaaaaaactgtggaagatatatactgtgacaatccaccacatcagcctgtggccattgaactatggaaggctgttaaaagacataatctgactaaaagatggcttatgaaaatcgtcgatgaaagagaaaaaaatctggatgacaaagcatatcgtaatatcaaggaactggaaaattatgctgaaaacacacagagctctcttctttacttaacactagaaatattgggtataaaggatcttcatgcagatcatgctgcaagtcatattggaaaagcacaaggcattgtcacttgcttgagagcaacaccatatcatgggagcagaagaaaggtgttccttcccatggatatttgtatgctgcatggtgtttcacaagaggactttctacggaggaaccaagataaaaatgtgagagatgtaatatatgacattgccagtcaagcacacttgcacctaaagcatgctaggtcctttcacaaaactgttcctgtgaaagcatttcctgcttttcttcagacggtttctctagaggactttctaaagaaaattcagcgagtggattttgatatattccacccatctttacagcagaagaatacattacttccattatatttgtatattcagtcatggagaaaaacatattaaaataatttcatggcactgatgttaattctagtctattagttttataacaagttaggattcttatttaggaacaacaggaaatgactgttaaggagaaaatgaatttattgaat

SEQ ID NO: 16626 - DNA, 943 bp, Homo sapiens
cctggccaagtgcggctctgctctccccagtcccggtccgcgaccacccggagcccgctccgccggccttgcgcggcgcgcccagggaaggcatttccagcccgcccacccaggtctcttcttcggcctctctgacatggtgccagccctactggagtcagcaggagtccagcacaacagatggtggtcagtggtgacttcggcacaggcagttcgtgaggagtggttggtggccatggagtcctgactggagtaggttaaaaagaaggaggaaaatcacaagaaagagagactggaggtggaggttggggagaaaagagataatggtatggtgagatgtctactgaactgctcctgccaaggcccctccccatgtactctcaacgaaagttgcagttttctgagcacaagaaatcaactttggctgcacattggaatatctgagaagcttaaaaatactgatgtttggaccaggtgcagtggctcacgcctgtaatcccagcactttgggaggcagaggcagagccacctctcaacaacccatgaagtgtctggagctccaccctctgctcaagaggaacggcacatgacccaggcctatgccaatcagcatttcacattcctcatggttggttcaaaggtgcaagaagagttgttgatttttcagcctgtccagctttgtagttgctgttaagatagaatggacttccaagctccttacgtgcagaagcagaaaccagaggtcctatcaaaatagttttaaattgtattaaacatacacaaaagtagagcaatgtgctgaatccctatgtatccatcacctaggttcaataattattataattttgctaattttgagaagcagtttaaaaactcatagagaccagtgcttaacagttaaaaaaacagggagttaaaatcgtcattcaaataatttgggagg

SEQ ID NO: 16627 - DNA, 555 bp, Homo sapiens
gtcaggagttcaagaccagcctggccaacatggcgaaaccccatctctactaaaaaaaagaaaaaacactgccatgtatgagaaagtgactcagttttcacttagctttcagatacattatgtacatgtttggggcatgagatttatcgttctaatgttatattgtagctgggactacaggcgcccaccaccacgcccggctaattttttgtatttttttttttagtagagacagggtttcaccatgttggccaggctggtctcaatctcctgacctcgtgatccgcgcgtctcggcctcccaaggtgctgggattacaggcgtgagccacaggtgcctggccttctgatacttttttttaaacaagctcttgagggctttattagtcatttagcccacatttattgaatccctgctgcctacagactttgtcagggtttcagagacaccgctacccatggcctctaggagcttacagtgtagagaggttcttttgactattttttgatgataggtgaaacttactgtccctgtatgtggcttctattgaataaa

SEQ ID NO: 16628 - DNA, 542 bp, Homo sapiens
gcaacgacccccacacgccacgttggagagctggggctgtatcttgagaccctgaaaggacactgcttggttcaaatcccactctaccacttagcagctctatgaccttgggcgattttattcatttctcttatgatgggtttcttcttccataaaatagggtaatagagagtaatgattgcactgggtcattgtgaaactaagtgacatggtgtctggcacacatcaagcactaagtaagcgttacgttttctgccaacctggacaagggggttacagtgaatatgaagagatgcaggggaattccagaaatactccggatcaacacacccttcacgcaaacgagtctttctcgtctatatcttaatcagaacctcactctctctacagcccatttccctatggcaaaggattgagtcctatccaagaatccaagactctgaactgaccctgtaccatcactgacaggggatggtggagggggtgactcactgtgaccatgggggacccaggctctacctttggtgcaactgaggattcat

SEQ ID NO: 16629 - DNA, 568 bp, Homo sapiens
aggctcaatgacaaatgatttttataaaactcaattggaagtgccattagacaaattggtttaagaagtatcctttaattgcacattctaatgtggacaagataatcattaggtgaatagattttaggcaaattagcttttaataaattggtttagggaaaattgctcttttactttttacatgttgggagcatagaaatagaatctggaaattatcccaatgaccccccaggatggacattggtccagatgctggatggaactgatgcatcctggccttgagtgctgcagtatccctgcctcaggcagcaccatacaccaagcgatttagcaccctgagccagtgattctcagctccttgtatatgctgagcatttgggaagaatcttttttttttgagatggagtctcactctgtcacccagactggagtgtagtggcacaatctcggctcactgcaacctccacctcctgggttcaagcgattctcctgcctcagcctcccgagtagctgggattgcaggcacgtgccaccacgcccagctaatttttgtatttttagtagagac

SEQ ID NO: 16630 - DNA, 755 bp, Homo sapiens
tgagtttcaaatggaccttaattcatctgcaaaatgagaataatcaaaactcaacaaagtctaattcatacggctgtgtagcatatgtgaaaatgctttgtaaacattagaagtcttactaccaaagtcagtgggccgacagcattagcatcacctgggagcttatcagaaacgcagaatctcagatcatacctgagagcgaatgaatcaaaatctgcattttgacaagactacccagatgatttgtatgcacattaaagtttgataagcactgctatcatacgcgttatctcagaaaactcagctggacaaagagtctaatgattagagccttaaaagtttcctaggggaaaaaacatagtatgtctagcaatttttaagccttggtggggagggctggtgagggcattgtgaaaaaggcaatggggaaaaaatgtgaaaattggataaagtatttttttaaaaagacaactgtactttcatgaatttctttgtttagtccttggaacaacactttgaggtagatactgttgtctctattaatttatagatgagaaaactgagtcttagaggggaaatggggggctgaattcaaactttgtttgttctaatttcaatttttagctgtattgctttcaactgtgccatactggcattgtttgtgagtaggaatcctcacaaaaggatcagatttaatatgttaaattaaggagtatttcacatggccagcagtttcaaacttataatttttaata

SEQ ID NO: 16631 - DNA, 318 bp, Homo sapiens
agcaaatgatgaccacaaataatccatgcaatatatgtgtattatttttcttgatctcacttaaccttgagaaagaaaataattgaccagacttgctttctgatgtgacacaaaggacaagcccacatcagcccataggctataaaaacaactgacagatataataatgcacaaccactcgatatctatgtgaccttaaacaagttgcacaacctccctgtgcctcaggttcccctctgtagcaaactggtaacactgctgcttcatggggtcattgaaggattgatcaatgaatttttctttgctgtggcatgggcg

SEQ ID NO: 16632 - DNA, 451 bp, Homo sapiens
gaatctcttttccctaggagtcctctctctcctagagtgcaagttgtctaccagtagctgtacctgcctgaacatccataaatctgacaacgaatgtaaggaatctgagaattctatcgaagatatttcattaccagaacgcactgcaatgcctcgtagcattgtccgtgcacacactgtgaattccctaaacaaaaaagtccaaacacgtcacgtaacctgggctctgtgatttggcaatctatttcttgcagtatatgctcatctttatggaaaaagctttgtgggtgtgtgctgtgtctccaaccatgttgtctctatttggaattatggttggggtttgtaaaaagatctggaagatggttttttaaaaaatcctggcctgctgaacgaatagtttcttctgcaacatttgttgttaatataataaatattatcatataaataaaac

SEQ ID NO: 16633 - DNA, 347 bp, Homo sapiens
ctgacttatttgagcagcactgttctggcctgctaactttagggttagtttgggaccaggtcggaaatcacaattgcatgaattgcacattggaggccagggtggtgcacctctgggcaaatgaatttcctctcttagcattgatttccccagctgtaaaatgtggataataatagattgatgtcctctctaaattttgcagctgtaaacagtcccagccctgcaaactgaaagtttgttgctcttccctttaaaattactgtagggaccagcccacagggtcagtgggtctctccctgtgtgcggcgacgagagagtgtagaaataaagacacaagacgaagagat

SEQ ID NO: 16634 - DNA, 393 bp, Homo sapiens
gggcagggacccggacaggctcagaaccataaactcactaggtcttcacgtattgaccttatgatcgttgattcagggaagcaattaaattcctctctcagacaaagaactaagagcttgaactctttttttaccaactccaggcacccgtgaatattaatcttttttcaaattaattgtaaacatttcttctgagagggagtgactccatcaacgtatctcctttaataaaatccgagtggaaatgatgctgccaagaaatgccttggccctgcagccgctgatcttcagatgcatcgggcggcaactcatctgttactgcttcccagtttcagaacgcccagctccccaggccttaaaacaaattggaaagcaggggaataaaaaaacaaa

SEQ ID NO: 16635 - DNA, 248 bp, Homo sapiens
ggacaacatagcaagagaccccatctccacaaaaataaaaaaataaaaaaaaatagccaggagtagtggcatgagcctgagcccaggaggtcaagctgtagtgagccatgatcatgccactgcactccagcctgggcgagatcgagaccatgtctctagagaaagaaaatgacaaggacagtgaacccaagaaagtcataagatgccagctgtgcagcaagcatggaaagcagccagtccaaattagg

SEQ ID NO: 16636 - DNA, 745 bp, Homo sapiens
gtttttgattttacaggcttataggtgaaagtgacttcccttgtctccaatgaggctttggactttggacttttgagttaatgccagaatgagttaagattttgggggcctattggaaaggcatgattgtagtttgcaatgtgagaaggacatgagatttggagaggccagaggtggaatggtatagttcagatatttgacccagcccaaatctcttgttgaattgtaatccccaatgctggaggtggggccttccttgtatgatgtgtttggaacatgcaggcaaattcctcatggcttggtgctgttttcatgatagtgagtgagttctcctgagatgtggtcatttaaaagtgtatggcacctccccccactctctatctctcttgctcctgctctgctatatgagacacctgttccccgtttgccttccaccatgattgaaagctttgtgagacctcctcagaagccaagcagatgccagtgccatgctgcctgtatagcctgcagaaccacaagccaagtaaacctcttttctttataaattacttagtctcagatatttctttacagcaatgtaagaatggcctaatacaatagcctaaactaatttgagggaggtgatgtgtctcttgctacacaaagtatggttcatggactaacagcattggcgtcaccaggaggttgtcagaagtacagactttcagttcccttcccagacctaataaatcagactctccaaaaa

SEQ ID NO: 16637 - DNA, 565 bp, Homo sapiens
gtttttgattttacaggcttataggtgaaagtgacttcccttgtctccaatgaggctttggactttggacttttgagttaatgccagaatgagttaagattttgggggcctattggaaaggcatgattgtagtttgcaatgtgagaaggacatgagatttggagaggccagaggtggaatggtatagttcagatatttgacccagcccaaatctcttgttgaattgtaatccccaatgctggaggtggggccagtgggaggtaattaaatcacggggatggagttcccccttgctgttctcttggtagtgagtgagtcctcatgagatctggttgtttaaaagtgtgtagcacctcccccttctctcttttcctcctgctcctgccacgtaagacaaagctgcttcccctttgccttctgccatgattgtaagtgtccggaagcctccccagccatgcttcctgtacagcctgcagaaccatgggtcaattaaactgtttttctgtataaagtaccgcagtctcaggtagtcactatagcaatgtgtgtccaatagtgaggccga

SEQ ID NO: 16638 - DNA, 776 bp, Homo sapiens
agcgctcgggctggagcgcctgaagccgcgaccgccgcctcagccgcctcagccgcggtcgccgccgcttcggctgacttaggctccgccgccgcctcctcacccgcctcgccccgaccccgcccgggcctcccggcctctccccgccggcccgcgggctcgccgtccggcgcagggcagaattcacctgcaaagtcatctcggtcagcacttttctttgtgggaaggttttatcttgaatgcagtttctttggactgtctacaagagagaagctccccacgtggttccgtatggacagtgtgtcaccctcggggagcaggtgggctggcaggacaggcggccccaggccgggagaaggagacactcccaggtactctcgtctacccctgctggtgacctgcctgcccggccccgttctgttccagatgatggctcacctgtgaccctgcctgccctgcccagcttcgcccccatgtctgcctgtccccaacctcagtgctgtcggctgacctacctcagcccacgccctgccctcttttttcccaccccacggggccgatcctgacttctggttgctccctttgcttgaccgttctcttgaggttcttaaccctgaactgcacccgactcccattgacctcactcactgtgggccgccacgagggcccctcagagacgatgctaacggcctctcagatgctgacctgcttcatgtctatttccttttacagggtaatttgtagtggaatgagaaaaaaaagttgtatttcttaaa

SEQ ID NO: 16639 - DNA, 261 bp, Homo sapiens
acggggtttcactgtgttagccaggatggtctcgatctcctgacctcatgatctgcccgcctcggcctcccaaagtgctgggattacaggcatgagccaccgtgcctggcctatttatttatttatgactgtctacaagagagaagctccccacgtggttccgtgtaagtagtgcttcttatgatgctgtcacaggcgatatttttagactaaacgactctttcggtgtcagcagagttgaaagtcttgctctcaagggaa

SEQ ID NO: 16640 - DNA, 435 bp, Homo sapiens
attattaaacatgtaacaaggcttccatgcaaatcacatcatttgatattataagtttctgaaatgtttgttaacataatcacttcattaattttttcttttgaagcttccatgttctttgcaggcccgttgaataaccactgtggaccaccagatgtctgtaaatgtcacttgaggaagccctgatctataatacatattgagaaaggagaattgaggcagcatttgggttaattaaaattacactgaagtgaaatagctaagctaagagaagccactcaccactgtcctgtcttcatgcatatacttctttctgcatattattattattattatttgaaacagaatctcactcagggtagagtgcagtggcacagtctcggctcactgcaacctctgcctcctgggttcaagcgattctcgtgcctcagcctc

SEQ ID NO: 16641 - DNA, 734 bp, Homo sapiens
taagattagttgcgcatagtggcgcacacctgtaatgccagctgctcgggaggctgaggtggaaggatctcctgacccataaaaaaaaaaaaaaagtgacagcagtgctttactattaactacactctagactttatttggattttgctgtttttccactgacatcctctttcggccccaggatccaagccagggtcccaccttgcattaataaccctctcagcttaaggagtgctggacaggtctcctgtagaacatccccagcctcaggtcatctggtgtatttctcatgattaaagaaaggttactggttttaggagagaatcccacagaggtgagcctgcctctcacaccacatcttggggcacctgagatgcacacgtggctagtgagtggaaccttcactaccgggtcaggacggtatctgccagggtttccctgggaagctactattgtttgtttctttattatttggaagcaagtctctaagcctaccccaccctcaccaggtggaggtaattaagctgtatgctgctctatcatattgttagttattatctagttattttatacattcttttcttattccatttgtggtttggtggaattttgttgtattgccatttgatacctttctcttcctcctttgtatgattgttttatagggcctgtgagttttgtacttttgtgtgtattatggcaaataccaacttgtttttatgttaagactcctt

SEQ ID NO: 16642 - DNA, 477 bp, Homo sapiens
ggagaccacatttcatctagccctcttttttaaaagtaaatacttttcagcacttacaggagttaactgagctggggcatcatggtgtatagacgccctgacactggtcatcttggaattcatttagtttgtcagtgggtgccctgacattctgtcacaacatcaatttgggaacatggcattatatttttatctttgaacttttttctttttggatgacatttgattaatgcgtcatcttggaacacattatcttttttcttggttatgtgatcaggaagattaatcagtttttcctgttcttggtataattcctgcttttcacatacctgtcccttacagttctctatatatacccttcccttattacacagagagaaatatctatctatactttttacacaaaatatacttcaaaagaaacaaaacagccacaattattaactttttaaataaatgagaatttaattatatcct

SEQ ID NO: 16643 - DNA, 490 bp, Homo sapiens
gtgctacaattctgtccaaaacattaatgaaaattacagactagagaccctgacttagatgggttgctgtgagtgtgaggatttgcagtgctgggggagaggagaagctgtgttagaaacaggaaacatttctatgtacgcatgtgtgggaaattgccaaaagagataccacacaaaaaagacttgaatcttcaaaactctggtaacttcctgtgatttcttttctcgttctaagtcaatattcactttcatcatgaattttgtattactaattttgtcatctcatttttaaaaagggcatcacccaaaattgcacagcattgagtttcacaaactcggctccttcctgacatacaagaataatcaggctggctgggcacagtggctcacacctgtaatcccagcactttaggaggccgaggccggcagatcacctgaggtcaggagttcgagaccagcctggccaacatggtaaaaccctgtctctact

SEQ ID NO: 16644 - DNA, 427 bp, Homo sapiens
gtctccaacccccctttcccagacttgccctgccaagctctcacagatcctgcacaaggcctgctgaaccttttgtttcccaaagagcacacttggtgcctttgcaaaggatgtcccctctgcctgagctagttgttcagaaaacttgttctttaagaaccagcacaaatattgttaccctaacctctagggagcttcatcagtactttgttcgtacctccaaatggcaactacaagggccatgtcggtctctctttgcaaatgaggaggtagaaactatattctagtcaactttgtgccaggcgctatggatgtaattcaagaaacacaattggagatggcaatctaaaggttactgggccactataggtatgaactgaggcctcaacctgcagcttcccacactcaactgacttaaagcatcaaa

SEQ ID NO: 16645 - DNA, 406 bp, Homo sapiens
tacctccttttcactgtctctcactgtcctcattcctgaacttcctcctcactcagcataaattccatagttggtcattttagcccctctcttgccctttcccttgatgttcctgctcctctgtcacttcattggactttcccagcaatgcctcagtccgtggcagattcaaccctctgcctctctgcatctgtacccatgcagatgaatgtggcctgggaaaaaatagacaaccatgctggtaggtttcacttaaagttacagccatgaatctcaaatgagcttgtaccatgcttccctggcccattcactctgcactctcctggactatctcatacattccccaccaaactcccaacagttctccatcatcattctcagctggtgactttattctgacttcact

SEQ ID NO: 16646 - DNA, 347 bp, Homo sapiens
taacatgtgatttgtgatctttctaggctgacaaatgaatctcctagagctctgctgtgttgctacagtggtctgagtcattgtgattagaaattatttaaattcatcatttttatagacaggcctgaacaacctagcagagtttttttaaaaaaattttactcaaaattaaatatcttattttgaaaactgtccttgtactataatagctagcagacgcttcaaatatttctctttcatgtagacaaatctatacatttctcctcagagaatatagatgtcaatgcctgcagataagcaatccaaataagtttaatggaaggcagttttatgtaattaagttgtga

SEQ ID NO: 16647 - DNA, 491 bp, Homo sapiens
gcacttcctatgtaaaggaattttcactgccttgagtaacagtggcaggtgggctggcttcatgggcatgtgcagacagcgccccatacttggtttcatgttctagtcttgttatcttgaaattcataatcatttggataaggagtcccacgtttttattttgcagtgggcccagcacattaagtagccagtcctgactagcagatagtagcattaattctatttgaagtcaaagtttgttgaaagtgtataagtggcctggctcggtggctcatgcctgtaatcccagcactttgggaggctgagatgggtggaacacctgaagtcaagagttcgagactagcctggctaacatggtgaaaccccgtatctactaaaatacaaaaaattagccaggtgtggtggtatgtgcctgtagtcccagctactcaggaggctgaggcaggagaatcgcctgaacccaggaggcagaggttgcagtgagctgagat

SEQ ID NO: 16648 - DNA, 548 bp, Homo sapiens
ggccaggcagtgggagcaggcacttctgagcctggagggagcagaggtgacttcttgggcccccaagagcacagggatgcctggtccgcaacagggcttgggcggctgaagctgcaccaggggagctccctccctaccaacttggagaaggcgggttcctgcttgtccctggcacctgcggctccatggagtgtgcagccctggccatgcctccgagatctgagtgggtgctgacagcgaggagaagccaggcagtgggagcaggcacttccaagcctgcagggggcaggagggccttgccaggccctcaagagcacagagacaccagggtctagaggcgtgccaggtagccgcagcggcacccagggcacccagggagggcagaggggcgtggggcgcctgcctgctccgtggagtgggaggccagcagtgcctccacactgcagccgccgtcttggcagtggccattctagatgggccgctgctgccgtcagaaccaatctttaaagaatttatattctgtaaggagaaagcaggaggggattcgg

SEQ ID NO: 16649 - DNA, 153 bp, Homo sapiens
aaataatagcattttggaggtgccctgtatttgagttataaataaggaaatatactgtgttatctgattaacagttaaatacgaaattatgtaatggaacaaactaattttgatgaaaagtcctgctttgtctagtatacatagatttattgt

SEQ ID NO: 16650 - DNA, 447 bp, Homo sapiens
accatgttggctaggttggtcttgaacccctaacctcaggtgatccaccctccttgacctcccaaagtgctgggattacaggcatgagccacagtccccggcccaatacttaacatctttgcatgataaaaacctgaacaagttaggtataaaaggaagatgtctcaacacattaaaggccctatatgaccggcccagagctgaaatcttaacaccgaagagttgaaggctttttctctaagatcaggaacaagacatggatgccattttttctccttctgttcagtgttgtactggaagtcatagcaagagcatttaggcaagagaaataaaagacatctaagtaggaaaagaagaaaaaacttgcctctcctgattatcttatcttatagctagaaaaccttaaagactccattaaaaaaaaaaaaactatagaactaataaaat

SEQ ID NO: 16651 - DNA, 315 bp, Homo sapiens
acataatgaatgaaatgatgaaatggaataatgaaacggaaatgatgagatgagatgcaatgagttgaaatgagatgaaatgatgaaatgatgagatgaaatgatatgagatgtgatgaaatgatgacatgaaatgatgacataaaatgagatgaaatgagatgagatgaaatgacataatgaatgaaatgatgaaatggaataatgaaacggaaatgatgagatgagatgcaatgagttgaaatgagatgaaatgatgaaatgatgagatgaaatgatatgagatgtgatgaaatgatgacatgaaatgatgac

SEQ ID NO: 16652 - DNA, 516 bp, Homo sapiens
aagataagcgaaaatacagcctttctcaagggccagcacagacggagataaagagagagccacaggcacactggccaagcatcagctcctcaagcatccatctcactattcagggtggggaaatacttgatacctcaagtcctctttatcatcgcagatgaaaactgacataggtgatttcctttcggagcatttagggagaatgcaagggaaattgacaacacacttggtgcaattgggtaaccagtctttgtgttgccctccaatgactcttgcttggaaatgattggaagcccatcgttttaagtcattggaacgactgtccccttcataaagcatgatgtagcaaaatgaaaagcatacttctggttaaaagtgtttttcaaaaaaagcttaccacattgaggaggtcatttcatatttcctgatattcagcaattttgctgtgagctttgtagagttgttctggtgcttagttcaaataagaaaggaattactgaaattgcacattaagtt

SEQ ID NO: 16653 - DNA, 456 bp, Homo sapiens
ccacatgtgcctggtacttaccacacgggacagtacagatatggagcacttccatcatggcacaaaattcttgtgaacagcattggcataacacaatctgtttttattcagcatacccctgcggctgcacattggtatcatctggaaactttggaaaagtcctgatgtctggctgggcttacctccaaaactctaagtcagtgggtcttgagtgaggtctgtcattgggatttttcaaaagctcccccaggtgattctaatgtgtagccagcactggtctactgagtctcaagcttatctcattataagaattatgaacggccggatgtggtggtttacgcctgtaatcctagcactttgggaggctgaggcaggtggattgcaaggtcaagagatcgagaccatcctggctaacacggtgaaaacccatctctactaaaaatataaaaattaact

SEQ ID NO: 16654 - DNA, 324 bp, Homo sapiens
caatcttcagctacagtttatctaattttgaatttcttctgctttattatttaaagtgctaacatcttaaaaagtccagagatcttaaatttggctgagagagtcttggagtttttatagaaatctgatagtacaacttgtgcaacctgtcagaagtcagttacagccagagtaggcagagagaagaagtagtgttagaagacctatgtagatttctgcacacagaaagaaggaagaaagatcaggctacctaacttttttggttctgtgttaactcctccgtgaacacccttcaatatgaatgggcttccatggcacccatcc

SEQ ID NO: 16655 - DNA, 364 bp, Homo sapiens
  misc_feature (336)..(336): n is a, c, g, or t
agatatttaaagatgatttggcaggcagggggctaggggatgggtgctggtgattggactggtatgagatcatagggttatcaatgctgtcttcatgtgctgaatcagttgctgggaaattggggagtcacaagaccaagtcagttccttggttgagttcatggaacactggtccatttggtgtcagttggtccacttgtaagcaaagtctgaaaaatatctcgaagaccagtcttaggttttacagtagtgtttgtgactgccagttactatgggaaagaaagctggggaaaaaatggccaggttactgttttaaacctattagctttagccagnaagagttttgcagggaggtgagatcacc

SEQ ID NO: 16656 - DNA, 438 bp, Homo sapiens
cctcaaagatcctccaccctggatgaggagtcaaagttgaagacagttgaaaaaaatagaacagtgattcttaacactggggaacattcaggaaatttcaggggacagtgactggggagtactcctggtgcttggtgggcagaggccagggaggctagatgtcctgggatacatgggacagcctttcaccagggaggtttgctgtgtgtcccacacaacttccaaaaagtcccagcagctattcacataggtgaaaaaacaaaatgcatttataattctctgagcctagaacccaactactttttacgtataagtattaaatatttttacatggttttaatccacaccaaattttctagtaatgcagcaatagtgtatattgtgaagatggcactttgttacatttgaaacctttcaaagaatcattcatcatatcag

SEQ ID NO: 16657 - DNA, 1906 bp, Homo sapiens
attagccgctaggaccttaggcgagaaaatgtggacgcatccccgccggccctgaggccagagaatcccccctcaactggttgcacctcatgtccctcccgcacacgttgactctccctcctaatccccaggaccccgagggctctcccacatctcccgcagcaagagccaccgatcccccttaagaagcgttgactgtacggcggcgccagagggccaaactaagttcggtttcgggaaacgctctcgggagcagttctgtaaatccctgctgggagcagagactgcgaaaagctgagtccgccgatcgtgcccgggacaaggctgccttccactcgccgcatctacctggtaggcggcatgcgcacgggcttagaggcttgagagcctctggaagagaaagggtcccaggaaggaaacctgcccccggcctaagtgtcggcgcccagatcaccacgaaccccgcacctaggcgccgcccaccaagttccaaagaagtccgaggcgacctgggagtcggtcggatcccagccgagaaaagaaacaagcaggatagcaattcttaggggagccaccctgggagttttaggcagcgtttgcctttccctggttttcttcaccaagccccatcctccccccgcataccacccccagtcaaaagagtgggagaaaatgcacagttcgaagtcggtgagagcaaaaatgggtctagtaaatcaacccgtggtggtagctaaaaggtttggggctgcaaagaaacaaactgtaagttttgagcaacaaactttttcttcaatctgtaatatgtcgaaatgggaagggggtgttgcaaaagccaactaccactgtcaaacttagcccgtttacaacatggggaaaggcgtatttcttactaatatctcaacaacgataacaatgctgtatccttccttaccttgatgttgaactgcgaatcctcctccggatcaatgtccaggaacttagaagaattggtgatattaggagttcagtacttctggaaaaaaatgcaaatggtttagccaggatctttcctgtctgattcgtcactattattatatctgatgatgcgaatggttggagcgattcaatcctaagtcattaatgagctattttataaacaccactgtctgaagatcttcatttacattttgctaaggatcacttcgctaacctcacaggcttgtgtcaacagcatgatttgcaggacttcagttacactcttataaacaacacggctgtattgttaatcggttaatattttataaagtgtaaatattttattatgttttgaagggaactattgattctaaattattaaacccctgagaaggactatttaaatgaaatatacaattaagtacaattaaatgtacattgtggttagtttgttttcagattctgcacccttttaaattcattgcttttctctttactggagtttcctcttgtccatttctgatactgaaaaaaatctatcatgttaggaaaaagcctaaattatttaaagttgcattaaacttagaggaaaatgtcaaatacgattaattatgaccagaaatgtattttggatgtttgtagagttgtatttcatatcacattttacaaatttcttccgatttaaaggagagttctaggaagttttgtgatctatgtccggtgtgggtttttgtcctctcgagttttgtctctaataaaggccttttttgtttcaaattacatacgctttttactgcacaatttttgtattgaccttatttcaactgaagcgattatttccagcaggtttaatttcgacaataagatatattttaatagttttacctttcgctagaattttgtattgtttaaaacagtaaatgaataaatttgctgatgattcaaaata

SEQ ID NO: 16658 - DNA, 2056 bp, Homo sapiens
aaccaccaggtgggccaccttccctaccgccaccccgaggttccagtggacatcaaaacctcggctccatcagaggctccaggactccgatcgggacagcgcggggggcgaggccagggtgagggcgcggcgaaggagagacgcacagcgcggggcgggcaaggagcctcccttccgcgccaaggccccccccaaccctcgaggcgcttggaccgtgggatagtcctccggcggcgcccgagctccggccccgcccccgctccgccccgcgcctgctattggcggaaagttccgggccgcgccgcgactggccgacacgccgcaggccccgcccccttcccgacccgctccaaggcggccccggcgctggggctgcgcggcaggcggagcggccgcgggcttgggggcttcgccggggccgggcggccggcgcccccggctgctcccgccgccgcccggacccgcgccccgccggggcagcggtggtgagagccccgactccccggacgccgcccgccgtgccatggggttcccggccgcggcgctgctctgcgcgctgtgctgcggcctcctggccccggctgcccgcgccggctactccgaggagcgctgcagctggaggggcagcggcctcacccaggagcccggcagcgtggggcagctggccctggcctgtgcggagggcgcggttgagtggctgtacccggctggggcgctgcgcctgaccctgggcggccccgatcccagagcgcggcccggcatcgcctgtctgcggccggtgcggcccttcgcgggcgcccaggtcttcgcggagcgcgcagggggcgccctggagctgctgctggccgagggcccgggcccggcagggggccgctgcgtgcgctggggtccccgcgagcgccgggccctcttcctgcaggccacgccgcaccaggacatcagccgccgcgtggccgccttccgctttgagctgcgcgaggacgggcgccccgagctgcccccgcaggcccacggtctcggcgtagacggtgcctgcaggccctgcagcgacgctgagctgctcctggccgcatgcaccagcgacttcgtaattcacgggatcatccatggggtcacccatgacgtggagctgcaggagtctgtcatcactgtggtggccgcccgtgtcctccgccagacaccgccgctgttccaggcggggcgatccggggaccaggggctgacctccattcgtaccccactgcgctgtggcgtccacccgggcccaggcaccttcctcttcatgggctggagccgctttggggaggcccggctgggctgtgccccacgattccaggagttccgccgtgcctacgaggctgcccgtgctgcccacctccacccctgcgaggtggcgctgcactgaggggctgggtgctggggaggggctggtaggagggagggtgggcccactgctttggaggtgatgggactatcaataagaactctgttcacgcaaaaaaaaaaaaaaaaaaaaaaaaaaaaaaaaaaaaaaaaaaaacaaagggggggcggaaaaaaaatacacccgaggggggccccaagaaaagcgaaaaccccaacgtttgtatggtgcacaaagagggggacgaccaaaaagagaggaacggaaacataaaagcaaatggacgaaaagagcggacagtaacaacacacaggagcaagagtgagaaaaaagtgcacaaacaggagtaaactataggagagagaaacacaaacaacggggggggagagcggaacgccaataagagtacgaaaacaaaatattactcaacaaagaaagaaaattatatgaaaacgcgcatagaaggagggaggaaaaatatataaacaattttgtaaaaagagggtgtataaaaatgggtgttttaaaacaaaatgagggcaggaaaataagagggagtggcaggtaataagaagaaaaagtatgttgccataaacaggagggatattaaattaatagaagagaaaaaattttattttaaaccagggggaagagatgagaaaaaaataaagt

SEQ ID NO: 16659 - DNA, 1998 bp, Homo sapiens
aaccaccaggtgggccaccttccctaccgccaccccgaggttccagtggacatcaaaacctcggctccatcagaggctccaggactccgatcgggacagcgcggggggcgaggccagggtgagggcgcggcgaaggagagacgcacagcgcggggcgggcaaggagcctcccttccgcgccaaggccccccccaaccctcgaggcgcttggaccgtgggatagtcctccggcggcgcccgagctccggccccgcccccgctccgccccgcgcctgctattggcggaaagttccgggccgcgccgcgactggccgacacgccgcaggccccgcccccttcccgacccgctccaaggcggccccggcgctggggctgcgcggcaggcggagcggccgcgggcttgggggcttcgccggggccggcggtggtgagagccccgactccccggacgccgcccgccgtgccatggggttcccggccgcggcgctgctctgcgcgctgtgctgcggcctcctggccccggctgcccgcgccggctactccgaggagcgctgcagctggaggggcagcggcctcacccaggagcccggcagcgtggggcagctggccctggcctgtgcggagggcgcggttgagtggctgtacccggctggggcgctgcgcctgaccctgggcggccccgatcccagagcgcggcccggcatcgcctgtctgcggccggtgcggcccttcgcgggcgcccaggtcttcgcggagcgcgcagggggcgccctggagctgctgctggccgagggcccgggcccggcagggggccgctgcgtgcgctggggtccccgcgagcgccgggccctcttcctgcaggccacgccgcaccaggacatcagccgccgcgtggccgccttccgctttgagctgcgcgaggacgggcgccccgagctgcccccgcaggcccacggtctcggcgtagacggtgcctgcaggccctgcagcgacgctgagctgctcctggccgcatgcaccagcgacttcgtaattcacgggatcatccatggggtcacccatgacgtggagctgcaggagtctgtcatcactgtggtggccgcccgtgtcctccgccagacaccgccgctgttccaggcggggcgatccggggaccaggggctgacctccattcgtaccccactgcgctgtggcgtccacccgggcccaggcaccttcctcttcatgggctggagccgctttggggaggcccggctgggctgtgccccacgattccaggagttccgccgtgcctacgaggctgcccgtgctgcccacctccacccctgcgaggtggcgctgcactgaggggctgggtgctggggaggggctggtaggagggagggtgggcccactgctttggaggtgatgggactatcaataagaactctgttcacgcaaaaaaaaaaaaaaaaaaaaaaaaaaaaaaaaaaaaaaaaaaaacaaagggggggcggaaaaaaaatacacccgaggggggccccaagaaaagcgaaaaccccaacgtttgtatggtgcacaaagagggggacgaccaaaaagagaggaacggaaacataaaagcaaatggacgaaaagagcggacagtaacaacacacaggagcaagagtgagaaaaaagtgcacaaacaggagtaaactataggagagagaaacacaaacaacggggggggagagcggaacgccaataagagtacgaaaacaaaatattactcaacaaagaaagaaaattatatgaaaacgcgcatagaaggagggaggaaaaatatataaacaattttgtaaaaagagggtgtataaaaatgggtgttttaaaacaaaatgagggcaggaaaataagagggagtggcaggtaataagaagaaaaagtatgttgccataaacaggagggatattaaattaatagaagagaaaaaattttattttaaaccagggggaagagatgagaaaaaaataaagt

SEQ ID NO: 16660 - DNA, 2129 bp, Homo sapiens
aaccaccaggtgggccaccttccctaccgccaccccgaggttccagtggacatcaaaacctcggctccatcagaggctccaggactccgatcgggacagcgcggggggcgaggccagggtgagggcgcggcgaaggagagacgcacagcgcggggcgggcaaggagcctcccttccgcgccaaggccccccccaaccctcgaggcgcttggaccgtgggatagtcctccggcggcgcccgagctccggccccgcccccgctccgccccgcgcctgctattggcggaaagttccgggccgcgccgcgactggccgacacgccgcaggccccgcccccttcccgacccgctccaaggcggccccggcgctggggctgcgcggcaggcggagcggccgcgggcttgggggcttcgccggggccgggcggccggcgcccccggctgctcccgccgccgcccggacccgcgccccgccggggcagcggtggtgagagccccgactccccggacgccgcccgccgtgccatggggttcccggccgcggcgctgctctgcgcgctgtgctgcggcctcctggccccggctgcccgcgccggctactccgaggagcgctgcagctggaggggcagcggcctcacccaggagcccggcagcgtggggcagctggccctggcctgtgcggagggcgcggttgagtggctgtacccggctggggcgctgcgcctgaccctgggcggccccgatcccagagcgcggcccggcatcgcctgtctgcggccggtgcggcccttcgcgggcgcccaggtcttcgcggagcgcgcagggggcgccctggagctgctgctggccgagggcccgggcccggcagggggccgctgcgtgcgctggggtccccgcgagcgccgggccctcttcctgcaggccacgccgcaccaggacatcagccgccgcgtggccgccttccgctttgagctgcgcgaggacgggcgccccgagctgcccccgcaggcccacggtctcggcgtagacggtgcctgcaggccctgcagcgacgctgagctgctcctggccgcatgcaccagcgacttcgtgtccccgccatggggggagcctggagcctgccttcccctgaatgcctaccgcagccacatgcctccccacagtaattcacgggatcatccatggggtcacccatgacgtggagctgcaggagtctgtcatcactgtggtggccgcccgtgtcctccgccagacaccgccgctgttccaggcggggcgatccggggaccaggggctgacctccattcgtaccccactgcgctgtggcgtccacccgggcccaggcaccttcctcttcatgggctggagccgctttggggaggcccggctgggctgtgccccacgattccaggagttccgccgtgcctacgaggctgcccgtgctgcccacctccacccctgcgaggtggcgctgcactgaggggctgggtgctggggaggggctggtaggagggagggtgggcccactgctttggaggtgatgggactatcaataagaactctgttcacgcaaaaaaaaaaaaaaaaaaaaaaaaaaaaaaaaaaaaaaaaaaaacaaagggggggcggaaaaaaaatacacccgaggggggccccaagaaaagcgaaaaccccaacgtttgtatggtgcacaaagagggggacgaccaaaaagagaggaacggaaacataaaagcaaatggacgaaaagagcggacagtaacaacacacaggagcaagagtgagaaaaaagtgcacaaacaggagtaaactataggagagagaaacacaaacaacggggggggagagcggaacgccaataagagtacgaaaacaaaatattactcaacaaagaaagaaaattatatgaaaacgcgcatagaaggagggaggaaaaatatataaacaattttgtaaaaagagggtgtataaaaatgggtgttttaaaacaaaatgagggcaggaaaataagagggagtggcaggtaataagaagaaaaagtatgttgccataaacaggagggatattaaattaatagaagagaaaaaattttattttaaaccagggggaagagatgagaaaaaaataaagt

SEQ ID NO: 16661 - DNA, 1636 bp, Homo sapiens
aaccaccaggtgggccaccttccctaccgccaccccgaggttccagtggacatcaaaacctcggctccatcagaggctccaggactccgatcgggacagcgcggggggcgaggccagggtgagggcgcggcgaaggagagacgcacagcgcggggcgggcaaggagcctcccttccgcgccaaggccccccccaaccctcgaggcgcttggaccgtgggatagtcctccggcggcgcccgagctccggccccgcccccgctccgccccgcgcctgctattggcggaaagttccgggccgcgccgcgactggccgacacgccgcaggccccgcccccttcccgacccgctccaaggcggccccggcgctggggctgcgcggcaggcggagcggccgcgggcttgggggcttcgccggggccgggcggccggcgcccccggctgctcccgccgccgcccggacccgcgccccgccggggcagcggtggtgagagccccgactccccggacgccgcccgccgtgccatggggttcccggccgcggcgctgctctgcgcgctgtgctgcggcctcctggccccggctgcccgcgccggctactccgaggagcgctgcagctggaggggcagcggcctcacccaggagcccggcagcgtggggcagctggccctggcctgtgcggagggcgcggttgagtggctgtacccggctggggcgctgcgcctgaccctgggcggccccgatcccagagcgcggcccggcatcgcctgtctgcggccggtgcggcccttcgcgggcgcccaggtcttcgcggagcgcgcagggggcgccctggagctgctgctggccgagggcccgggcccggcagggggccgctgcgtgcgctggggtccccgcgagcgccgggccctcttcctgcaggccacgccgcaccaggacatcagccgccgcgtggccgccttccgctttgagctgcgcgaggacgggcgccccgagctgcccccgcaggcccacggtctcggcgtagacggtgcctgcaggccctgcagcgacgctgagctgctcctggccgcatgcaccagcgacttcgtgtccccgccatggggggagcctggagcctgccttcccctgaatgcctaccgcagccacatgcctccccacagtaattcacgggatcatccatggggtcacccatgacgtggagctgcaggagtctgtcatcactgtggtggccgcccgtgtcctccgccagacaccgccgctgttccaggcggggcgatccggggaccaggggctgacctccattcgtaccccactgcgctgtggcgtccacccgggcccaggcaccttcctcttcatgggctggagccgctttggggaggcccggctgggctgtgccccacgattccaggagttccgccgtgcctacgaggctgcccgtgctgcccacctccacccctgcgaggtggcgctgcactgaggggctgggtgctggggaggggctggtaggaggtttgttttttttttgttttttttttttttttgttttttttttgttttttttttggattttgattttataattttgatattatatatataagatttaattatttattttatatggatttaattata

SEQ ID NO: 16662 - DNA, 1706 bp, Homo sapiens
aaccaccaggtgggccaccttccctaccgccaccccgaggttccagtggacatcaaaacctcggctccatcagaggctccaggactccgatcgggacagcgcggggggcgaggccagggtgagggcgcggcgaaggagagacgcacagcgcggggcgggcaaggagcctcccttccgcgccaaggccccccccaaccctcgaggcgcttggaccgtgggatagtcctccggcggcgcccgagctccggccccgcccccgctccgccccgcgcctgctattggcggaaagttccgggccgcgccgcgactggccgacacgccgcaggccccgcccccttcccgacccgctccaaggcggccccggcgctggggctgcgcggcaggcggagcggccgcgggcttgggggcttcgccggggccgggcggccggcgcccccggctgctcccgccgccgcccggacccgcgccccgccggggcagcggtggtgagagccccgactccccggacgccgcccgccgtgccatggggttcccggccgcggcgctgctctgcgcgctgtgctgcggcctcctggccccggctgcccgcgccggctactccgaggagcgctgcagctggaggggcagcggcctcacccaggagcccggcagcgtggggcagctggccctggcctgtgcggagggcgcggttgagtggctgtacccggctggggcgctgcgcctgaccctgggcggccccgatcccagagcgcggcccggcatcgcctgtctgcggccggtgcggcccttcgcgggcgcccaggtcttcgcggagcgcgcagggggcgccctggagctgctgctggccgagggcccgggcccggcagggggccgctgcgtgcgctggggtccccgcgagcgccgggccctcttcctgcaggccacgccgcaccaggacatcagccgccgcgtggccgccttccgctttgagctgcgcgaggacgggcgccccgagctgcccccgcaggcccacggtctcggcgtagacggtgcctgcaggccctgcagcgacgctgagctgctcctggccgcatgcaccagcgacttcggagggtgggcccactgctttggaggtgatgggactatcaataagaactctgttcacgcaaaaaaaaaaaaaaaaaaaaaaaaaaaaaaaaaaaaaaaaaaaacaaagggggggcggaaaaaaaatacacccgaggggggccccaagaaaagcgaaaaccccaacgtttgtatggtgcacaaagagggggacgaccaaaaagagaggaacggaaacataaaagcaaatggacgaaaagagcggacagtaacaacacacaggagcaagagtgagaaaaaagtgcacaaacaggagtaaactataggagagagaaacacaaacaacggggggggagagcggaacgccaataagagtacgaaaacaaaatattactcaacaaagaaagaaaattatatgaaaacgcgcatagaaggagggaggaaaaatatataaacaattttgtaaaaagagggtgtataaaaatgggtgttttaaaacaaaatgagggcaggaaaataagagggagtggcaggtaataagaagaaaaagtatgttgccataaacaggagggatattaaattaatagaagagaaaaaattttattttaaaccagggggaagagatgagaaaaaaataaagt

SEQ ID NO: 16663 - DNA, 2094 bp, Homo sapiens
aaccaccaggtgggccaccttccctaccgccaccccgaggttccagtggacatcaaaacctcggctccatcagaggctccaggactccgatcgggacagcgcggggggcgaggccagggtgagggcgcggcgaaggagagacgcacagcgcggggcgggcaaggagcctcccttccgcgccaaggccccccccaaccctcgaggcgcttggaccgtgggatagtcctccggcggcgcccgagctccggccccgcccccgctccgccccgcgcctgctattggcggaaagttccgggccgcgccgcgactggccgacacgccgcaggccccgcccccttcccgacccgctccaaggcggccccggcgctggggctgcgcggcaggcggagcggccgcgggcttgggggcttcgccggggccgggcggccggcgcccccggctgctcccgccgccgcccggacccgcgccccgccggggcagcggtggtgagagccccgactccccggacgccgcccgccgtgccatggggttcccggccgcggcgctgctctgcgcgctgtgctgcggcctcctggccccggctgcccgcgccggctactccgaggagcgctgcagctggaggggcagcggcctcacccaggagcccggcagcgtggggcagctggccctggcctgtgcggagggcgcggttgagtggctgtacccggctggggcgctgcgcctgaccctgggcggccccgatcccagagcgcggcccggcatcgcctgtctgcggccggtgcggcccttcgcgggcgcccaggtcttcgcggagcgcgcagggggcgccctggagctgctgctggccgagggcccgggcccggcagggggccgctgcgtgcgctggggtccccgcgagcgccgggccctcttcctgcaggccacgccgcaccaggacatcagccgccgcgtggccgccttccgctttgagctgcgcgaggacgggcgccccgagctgcccccgcaggcccacggtctcggcgtagacggtgcctgcaggccctgcagcgacgctgagctgctcctggccgcatgcaccagcgacttcgtaattcacgggatcatccatggggtcacccatgacgtggagctgcaggagtctgtcatcactgtggtggccgcccgtgtcctccgccagacaccgccgctgttccaggcggggcgatccggggaccaggggctgacctccattcgtaccccactgcgctgtggcgtccacccgggcccaggcaccttcctcttcatgggctggagccgctttggggaggcccggctgggctgtgccccacgattccaggagttccgccgtgcctacgaggctgcccgtgctgcccacctccacccctgcgaggtggcgctgcactgaggggctgggtgctggggaggggctggtaggagggagggtgggcccactgctttggaggtgatgggactatcaataagaactctgttcacgcaaaaaaaaaaaaaaaaaaaaaaaaaaaaaaaaaaaaaaaaaaaaaaaaaaaaaaaaaaaaaaaaaaaaaagagagggggggggcgcgcagaagtccccccccggggggcgcccaagaggggggccccacaaggaatgggggagaagaggggggccccacaaagggggaggacaaaaaaaaggacgcagggggggggcggcgtaaacaaagaggggagagagggggagaaacaagggagcgaccgggcggtaaacaaaggaaacaagccacaaaacaagagggcgggaggacaaacaaacgggcgcacacacacacaccacacacaggaaaccaaccagccccacggcgagggaacaccacaaacaaagccaccaacgccgaggcagcagaagaggggaggaggacacacccaacacacatagccgccgaattaattatggactagcgtagcgatgattagagaagaagaaataaatagtagcaggggaaagatatagtggctagtatatagatgtacctccggagcaaaaaaattttttatcacaaggcgggggggcatactcagaatagaaaaacaaacgaggaagaggaagcagaa

SEQ ID NO: 16664 - DNA, 1164 bp, Homo sapiens
acttcggctaggtacgaggctgggtttaaatcggccgaggggccacggtctcgtgcgtagacggtgcctgcaggccctgcagcgacgctgagctgctcctggccgcatgcaccagcgacttcgtgtccccgccatggggggagcctggagcctgccttcccctgaatgcctaccgcagccacatgcctccccacagtaattcacgggatcatccatggggtcacccatgacgtggagctgcaggagtctgtcatcactgtggtggccgcccgtgtcctccgccagacaccgccgctgttccaggcggggcgatccggggaccaggggctgacctccattcgtaccccactgcgctgtggcgtccacccgggcccaggcaccttcctcttcatgggctggagccgctttggggaggcccggctgggctgtgccccacgattccaggagttccgccgtgcctacgaggctgcccgtgctgcccacctccacccctgcgaggtggcgctgcactgaggggctgggtgctggggaggggctggtaggagggagggtgggcccactgctttggaggtgatgggactatcaataagaactctgttcacgcaaaaaaaaaaaaaaaaaaaaaaaaaaaaaaaaaaaaaaaaaaaacaaagggggggcggaaaaaaaatacacccgaggggggccccaagaaaagcgaaaaccccaacgtttgtatggtgcacaaagagggggacgaccaaaaagagaggaacggaaacataaaagcaaatggacgaaaagagcggacagtaacaacacacaggagcaagagtgagaaaaaagtgcacaaacaggagtaaactataggagagagaaacacaaacaacggggggggagagcggaacgccaataagagtacgaaaacaaaatattactcaacaaagaaagaaaattatatgaaaacgcgcatagaaggagggaggaaaaatatataaacaattttgtaaaaagagggtgtataaaaatgggtgttttaaaacaaaatgagggcaggaaaataagagggagtggcaggtaataagaagaaaaagtatgttgccataaacaggagggatattaaattaatagaagagaaaaaattttattttaaaccagggggaagagatgagaaaaaaataaagt

SEQ ID NO: 16665 - DNA, 1771 bp, Homo sapiens
aaccaccaggtgggccaccttccctaccgccaccccgaggttccagtggacatcaaaacctcggctccatcagaggctccaggactccgatcgggacagcgcggggggcgaggccagggtgagggcgcggcgaaggagagacgcacagcgcggggcgggcaaggagcctcccttccgcgccaaggccccccccaaccctcgaggcgcttggaccgtgggatagtcctccggcggcgcccgagctccggccccgcccccgctccgccccgcgcctgctattggcggaaagttccgggccgcgccgcgactggccgacacgccgcaggccccgcccccttcccgacccgctccaaggcggccccggcgctggggctgcgcggcaggcggagcggccgcgggcttgggggcttcgccggggccgggcggccggcgcccccggctgctcccgccgccgcccggacccgcgccccgccggggcagcggtggtgagagccccgactccccggacgccgcccgccgtgccatggggttcccggccgcggcgctgctctgcgcgctgtgctgcggcctcctggccccggctgcccgcgccggctactccgaggagcgctgcagctggaggggcagcggcctcacccaggagcccggcagcgtggggcagctggccctggcctgtgcggagggcgcggttgagtggctgtacccggctggggcgctgcgcctgaccctgggcggccccgatcccagagcgcggcccggcatcgcctgtctgcggccggtgcggcccttcgcgggcgcccaggtcttcgcggagcgcgcagggggcgccctggagctgctgctggccgagggcccgggcccggcagggggccgctgcgtgcgctggggtccccgcgagcgccgggccctcttcctgcaggccacgccgcaccaggacatcagccgccgcgtggccgccttccgctttgagctgcgcgaggacgggcgccccgagctgcccccgcaggcccacggtctcggcgtagacggtgcctgcaggccctgcagcgacgctgagctgctcctggccgcatgcaccagcgacttcgtaattcacgggatcatccatggggtcacccatgacgtggagctgcaggagtctgtcatcactgtggagggtgggcccactgctttggaggtgatgggactatcaataagaactctgttcacgcaaaaaaaaaaaaaaaaaaaaaaaaaaaaaaaaaaaaaaaaaaaacaaagggggggcggaaaaaaaatacacccgaggggggccccaagaaaagcgaaaaccccaacgtttgtatggtgcacaaagagggggacgaccaaaaagagaggaacggaaacataaaagcaaatggacgaaaagagcggacagtaacaacacacaggagcaagagtgagaaaaaagtgcacaaacaggagtaaactataggagagagaaacacaaacaacggggggggagagcggaacgccaataagagtacgaaaacaaaatattactcaacaaagaaagaaaattatatgaaaacgcgcatagaaggagggaggaaaaatatataaacaattttgtaaaaagagggtgtataaaaatgggtgttttaaaacaaaatgagggcaggaaaataagagggagtggcaggtaataagaagaaaaagtatgttgccataaacaggagggatattaaattaatagaagagaaaaaattttattttaaaccagggggaagagatgagaaaaaaataaagt

SEQ ID NO: 16666 - DNA, 306 bp, Homo sapiens
ggactgtctctagtttctagtgtttgtatgctaggttccagtaatcaaagatgccctttatgaaatttaagtcagatttttcgagaaaaaatttggatgggccatcaggtcaccatgggacttcccttagcctcatgcattctctgcgatggtttactttggggcctatgaatagggaagactgagatataggaaaaaccaaagtgtctgtgttcccccactctcacacccatgcagcataacacttctcacaccagatgtggggggatttctcctcacaccccaagcgagtctccagcagatacc

SEQ ID NO: 16667 - DNA, 365 bp, Homo sapiens
tgtgtgaataactgataagtgggattccaaacagaatccatgtagcgttttaatgaattcacatttggagaaaaaagtcacagactttcaaaacttacaggaatttggctgtcctagggcaactcctcacttaacagcaagaggggatgagaaggttgagtgactcacccagggaagtgactcacccagggaaggtcaagtgactcacccaaggttacttggtaagtaaagagagaagccagaagcctggggcctcctgacggctcctgcttctctttttactaaggtcttctgccatgggaagaaactctgaatgttagcaaccatctggatggtgttagttgtatgtctctctatgtatgttg

SEQ ID NO: 16668 - DNA, 264 bp, Homo sapiens
ctatttggcccttttcaaatgtttgccaacctttggtctagaaggttacattctggagcaaacagatcatagacagataaagaaaggcagatgctaaaatcagccgggcgtggtggcaggcacctgtagccccagctactcgggaggctgaggcaggagaatggtgtgaacccgggaggtggaggttgcagtgagccgagatcgcgctactgcactccactgggcgatagagcaagactccgtctcaaaaaaaaaaaaaaaaaa

SEQ ID NO: 16669 - DNA, 414 bp, Homo sapiens
gaaagtctgaactagagcccaggtctgctaagggcctacccagatatacttctttagagtgttttaaactggagcgatggctctcacatatacacactagactgtcttaatattggacggccacttcctagtcttccagcctaattcctggagtgaagcttaagacagtccatgaactgtctgccactggtcagtagaaaggtaaagcaggaagaccagaaactgagcaaaagcatttagaaattctcatgacaactcctaattgccgcaacatcctaaggcaacatcagtagacttgtcttgttgagcagagaatggaaaagtctgggtgttgttgatgtcacatggtggcttgtttgtggtacaagctgcatacgagtcaggcgtaccaagaccacatagatagtagactgc

SEQ ID NO: 16670 - DNA, 496 bp, Homo sapiens
tacgcgcctccttcagtaactttagaaaaactgaaagaataaacaaagccctgaaaccagcttcaaatgatctcgggctgtttcaccgacgtgctgactgagttcataagctagcgccttctttacgagataacctgtccagtgaataaaggagggcttcagccaacgctggggaggagcaacgggaaaggatgggatgggttgttcccatcagcacagcctgaactttcacacaccccgcgcgccctgctttgtgaaagactgaagggcatttagagacatggcccagttctagcagccagctcagggggaatgtaagaggacaccgtgtcagggccaaaaaccccatttctgcctgcgtgaaggaggttccagcagcagctgcagatagctgggaggactgtgtgggccacctaaggacacatcagatcctggcagtggaagtggggcagggtcggaggggagtctggactggtctgggcaacagaatgagacc

SEQ ID NO: 16671 - DNA, 302 bp, Homo sapiens
tttggtgtcttagcccatgggttttaaagtaaaacctctggccaactaaggatgggctgccctcctgcactgtgtgtagtggaagtgataaaacaaataccaggggttgcaatcctaggcatcaatggcaaattcagctccaactttcatgaggcctctcccttataccagcttctttgtgcatctgcctgggaccaggggtggactttccagtcttgcctgcagaaggttctgtaaagacacagaacagtacattgagtagattaatgccagcactgttctatgctccaaaccacagggtc

SEQ ID NO: 16672 - DNA, 445 bp, Homo sapiens
gccacatcaaagtccttcctgtgctgaggcttctgtgcttttcagaacataagctcagaggaaccggtggccattcaaaagagaaaggcctgtttgagagtgcagccagcactggaatgcagaactgagttgacagcaagagaatgagatctcttgagagaacagcagccctgtgctgctagaaggtagcagtactacacacatgcacaacagatgtaccccctgaatagttacgtgagacaataacctccttgccctttggttttcttttgtttaggccactttgaggtgggatggtttcactttaaaccagtgccctgagttttcaccataattataaaaacattgagcctcggtttcttatctgtaaaataggtctgatttcacctattctcatctataggctgtgagaaattaataagggaagacaggtaaagtacctggc

SEQ ID NO: 16673 - DNA, 175 bp, Homo sapiens
acaaatacagcaacgttacctatgcaagatgaatcacagagagaaataaaaaactgaaaaaaaaatagtgaacagagacccagtgatctgtgggataatatcaagcagtctatcatacatggagaaaaggataagggacagaaaaagtatttgaagaaataatagctgaaatatt

SEQ ID NO: 16674 - DNA, 363 bp, Homo sapiens
gcgagctgctaactcaggggcgagctgctaactcaggggcgagctgcaacgggcgagctgcattgaaggtgtgttacttgggtaatttttaaatgctattctctgaaataatgcactgtgtcttactactgccacagcagtgttcttgatgacatgacacccatgaaaaggagagaggcaggagggtacagtgtcaacctcgtgctggacacgttgctatgtcaactcgattgatcttcgtatagagcctcttccatcttttggcatccttcagagcccatggacatttccagtgatgtatcaagcacttataagagctgacagtacacccatgtttacagggtacactgcactattcacagc

SEQ ID NO: 16675 - DNA, 432 bp, Homo sapiens
atgaatcagtcaaggtccagtcaggagccagaaaccacaccagtaatttgaacagagaaattttgttttatttttatttatttatttattgagacagagttttagctcttgttgcccaggctagagtgcaatggctcaatctcggctcattgcaacctcctcctcctgggctcaagtgatcctcctgcctgggcctcccaaagtactgaaactataggcattagctacctctcccagcctcagaagcttttctacacccttcctaggggaatggggagataagtaggggtcacttagggagtaaatgattatgaaaaggggcatgggcttttgcaaaaataggcagtagcctgtccggaccaggtgccaagttccagcctcttctaggtttgactcctgttgcctgttaacctcccctgatagattaaaaaa

SEQ ID NO: 16676 - DNA, 153 bp, Homo sapiens
caggacgtgcaggtttggaacataggtacacgtgtgccacggtgctttgctgcacctatccaccagtcgtctaggtttgaagccccgcatgcgttggctatttgtcctaatgctctctctccccttgccccccacgccccgtcagggcccggc

SEQ ID NO: 16677 - DNA, 538 bp, Homo sapiens
aaatctaacttacagtaactaaaacaaattgggattttgctgactctgattgattgattgattgattgattgattgatttgccctcaaaaaatcaaaccaaacttggcattgcaagatggctgctactgctccagagagcaggcccatgttcacagtaggaagaagaaatatagtgtcaggcacatatttcctttttgtctagaaagcaaaacttgcctcaaatcctccttccccaagcaaactctccccttatatttcagcggctagaactggggcacgtggccactcctcgctgcaaggcaggctaagaatgtggaacaaggattgtagtcactgactcattcacatcagtggttcttaaccctggctgcacacagaaccagagggattcttcaacgtctggcttcacccccagagagtctaattctaatttatgcacatcagaatttaggagcactggcttaaaaccaaccttgattcatcatctgggtctggcatattgctccccaacaaacaaaatgagggtctcttggcaag

SEQ ID NO: 16678 - DNA, 362 bp, Homo sapiens
ataaacacacaaaactcacctatgttactatacaccaacaataaacaatctgaaaaggaaatgaagaaagcaattccatttacgatagcatctaaaagattaaaatacttaggaataaatttaacccaggagatgaatgacttgtacaataaaaactatgaaacatgactgaaagaaagtcaaaagatctaaataaatgaaagcacacccaatgttcatgggtttgaagacaatactattaagatggcaatgctttctaaagtgatctacagattcaatgtaatctttatcaaattccctagagcctcttttttgtttttgcaaactctcaaattcatatagagttacaaagagcaccaaat

SEQ ID NO: 16679 - DNA, 318 bp, Homo sapiens
ttcgttgagagcttactatgtaggagcatcaagcaaggtactctccatttaatccttacaagaaccctatgagtttggcactattattacccctattttacactttaggaagtcaaggttggtaaagctcagacatttacccgtgctcacagttaataagtgacagcacaggtatttaaacccagacaatctgactccagtatctgagctacaaggaagttcatagcagcattgtttgtggaaaaaaatagactgaatacaaacttaaataactgtggtttggggatctggtaaataaattatggcacatctacacag

SEQ ID NO: 16680 - DNA, 412 bp, Homo sapiens
acagttgaggagaaatgtgaggctagccttgcacgagagtcactctcctgaacaccttgatgcccttctgaaaatactggccatcagatttgtgctgcctggcaggaaactggaggatgcagctctgggcaaactgatccaagagggaaatccagtcagatgctggcatgggagagtccaggcccctttgtaacacaccctgcagtgatgcccacccatccacaaacccatacatatatgcaagattcttctatccagctttggagacctcactttgaataagaaaggacatcaaagatcaccagatatttgaggaaagtatctaaagtgaaagacaaagaccaaaacagacaggtgaaagtaaataaacaaagggaactcagaaacacacacacacactctactgagcaga

SEQ ID NO: 16681 - DNA, 354 bp, Homo sapiens
tcaccgtccataacaatagtgctattctaataagatttatcggagtactaaatgagataacatatgtaaaacacttggcacactgtttgcatagagtatatatccagtatgtctttctcccctaggctagggtttgaaggagacaaaccaagagctctagaactctttaggtaaaaacaatgaaaaatagggtcttagtacaactctgtcttttggcagataaggaaactaagaggtagagggatatgtccaaggtcacacagagagttagtagcagaaaccaagacctcttccttgacagatcagttcctctgccctttacagatgtgtgtaaagtgaacgttttggatggtg

SEQ ID NO: 16682 - DNA, 171 bp, Homo sapiens
attatatcaaaaagacacctacacttgtacatttaccgcagcactattgacaatagcgataatgaatggaatcaacctaagtgtccatcaatggattattgaataaagaaaatatggtatatataccatggaatactactgagtcataaaaaagaatgaaatcatgccttt

SEQ ID NO: 16683 - DNA, 347 bp, Homo sapiens
  misc_feature (160)..(160): n is a, c, g, or t
  misc_feature (337)..(337): n is a, c, g, or t
agtaatctgtgacaataacatataaagagggaaagacagatttataggagcatagtatatactattggatctaagctggtattattcaaactaggttgttacaaatttaaggctgggcgtggtggctcatgcctgtaatcccagctaatttttgtatttntagtagagacggtttcaccatgttggccaggctgatcttgaactcctgaccttgtgatctgcccacctcgaccgcccaaagcgttgggattacaggcatgaactactgcacccggccggaaattaacactcttaaatacaaatgagctaacaaagaattacaagagaaattagatantaccttaaga

SEQ ID NO: 16684 - DNA, 383 bp, Homo sapiens
attgtgcttgtggaaatacgtatgcattgttgaaagattggaaaacactcaaatgcccaaagaagaaaagttgcctgtaaccccagcccctccaggagagccactgttagagctttgccttcctattttccccttctacaagacagacagttaaataactcgtgttggatctattttttaaacaatattttaggggcaggtctcgctatgttgcccaggccgtagagcagtggcccacaggcaggccgagcatagctccctgcagccttgaactcctggcctcaggcaggagaattgcttgaacccagcaggcggaggttgcagtgagccaggatcgcaccattgcactccagcctaggcgacaagagcaaaactctgtctca

SEQ ID NO: 16685 - DNA, 311 bp, Homo sapiens
ggcattcctggcacccctaaaactaccccactgggggccatccaagcctgtgattaacaaaccctagttatttgctaggtagtttccacatggcatagtaggatatatatatgtgaggcacaatacagtgtttatgtgagaataatatagattatttgaatctaggctgcagaacctacctgaaaatgggttttacagttttgtgtaattgccttttctttgtgtttgcatagaaggcattgcatagctggaagatgatggcaattataatttattatgctgtaattgttacctaaatgtttttgaataag

SEQ ID NO: 16686 - DNA, 515 bp, Homo sapiens
acatctgcatttaaaacataaaggggcaaaagtgcatctagaacaagctgtattatctttgaaaatccactgtggacccaagggacattttgataagtcacactgagattggagatacagtgtttttagagaatgcacgactgatttaagaatgccttgttcagatgaagaaacagacttaggtggcatgatgaggtcattcaagtcgtaaaaatttaaaaattctttctgcaggagaagacaaggcttctggcagattttctgagtctatattcaagatccaccccactaactgagaatggctgccttgctgatttgactgttactgtagaactgaagataaagcgaattttggagttgtttgtgtgatctactagttactagaaaaatcacaggtttataatgcagctaatgggataaacagactttgattttagggcagtgaagactctctgcatgatggataatgatactatatatataaataaatgtatatatatataaaagaacaagct

SEQ ID NO: 16687 - DNA, 259 bp, Homo sapiens
ccacaccagaaagtgagttctcctagaaaatacttcagagcgccttagatagcgctgcctgacaaccatgaaaggcattattgggtggcactggttatacaagttttgtgaccctgtgaccccaagccattgtgactcagccaactggagcaatgtctccaacagcgttacagaaaatggggcagctgatggttcacatagcatcccccccggccggtgaactcagtcattctgtcagaaaaggcagcagggttcactc

SEQ ID NO: 16688 - DNA, 1210 bp, Homo sapiens
ttccaccgtgaggcgccccctggctctgtccacggtgctgaagacccagttggtgctaccatcgcgtgggcataagtttaggggacgagggagaggcaattgttgaaggttcgcagcttccaccctgacccctgtgcctgtgatagcagaaggctaggaactcaggcagggaccaagcagacacgacgcaggcgatactgtgcaatccgggctgccttcctgctggaggtgtttggttgctgttccaagaacaagtggggctctggcatccctattcgccttcctggtgcttctgaaaacccacctgaggagcctagaggccccattaatttcttttccatcacccgatgcagatctcagcacccagaagacctctggctaaacgcttattagcagtttcccaagtggcaggtttgtgtttatgtaaaatacaaatggagaactgctctttgcccgtgtttatggcaactctgtcactcccctgctatttctccctccccctcgcgagttcctgggggaaattcacagaacaaagcaccttgttttgcctttgcagagaatgaaaaaacacaggaccattccaagggcccagacctgtgatgcagggaaatcaatattttgcttacatcgagtgggggaatttgcatctaaactgaaggcaaaggagcttgtttggagcagagcaggtggcaggagccgagaattaacagataatttctcattgttcctggattcagcctccacactcggcaggcgcttctgcagcgtctctggcgccccggcagcagctccggacctggcatttctcaatctagcagtgtgaaggagctgctgccctgatagggctgcagaaacaggttagggcccctgggtcagtcaatagctattgaagttggattgtaggagttagcgtgtgtgggagagacagagatgagagagacagagagaaagaaacagagacagaaatagaggcaagagacagataccaatgagagagaccgaggatgagacagagatacagagagacagttataggaaatagagaacagagaaacagacagggagacagatgtacaggtaaagaaacacacattcagaaggagacattaaggtaaagcctcaccctagttgtcctctttagcccgctacctcccccagcccccaggtccattgctcgataccactgtggtcacataaccagccacaaagc

SEQ ID NO: 16689 - DNA, 549 bp, Homo sapiens
gcaaagcaaaaagaagaaaaacttaccaaatcatcctccagtattaaatttataaaggattccttcaagatcagcaaggaatgtcaaattcccctggtgtattatatcaacaggagccaaatgaaaaggatttcttgaaaaatgtgccatatgctcttgacttttcaattgcaatatggtcagagaaattataaataatttaaatcttgatatgattgtaagactttttatcagcatgctcaagccagaagactgttcttggggtgtgaaccacatggtgaaagcatttcatctagcattttagcaaccctccctcctgctattagggggttccaaatggacccgttaaacttccaggaaaatccccttttttgttaacacccctactgaaatttcctggtgtgtttatttaacttctcactagaggttccagtgaaggtaacaattggtgaatttgaattttcctacttttctcctgtttggcacaatacccaagggagaggtttcaataaaatagcctaactggcaaatgggagaaatcgacaaaga

SEQ ID NO: 16690 - DNA, 409 bp, Homo sapiens
cactggaagttttggcatacagcgaaactgaagcgtacttatacaatatcacattttatttttattgtttctaatagcattccaggttagaaatgtcaattatttgggaaagctgagggtctggtagataaagcatgcagcagagagctaggaggctggctatttccagtcgttatcctaacatgtcttgggcccccaagtcacgccacctccatggtacaatgggaactgtggcagaagtccacgctctctcccccaacacatggggataagagacaagagaggtgaaatgttctggaacatatccgatgttatacaagtataagctgtgagatgatccaaacgcaaatattgaatatttcattttctagaaagtataccaattcattccacccttctcaaacctaaa

SEQ ID NO: 16691 - DNA, 426 bp, Homo sapiens
cataggcccaagaatgcctgaaatgatcttgaaaaagaaacaaagtgagactattcactctacctgatatagctatggttatcaagatagtgtggtattaccagaggtatagacacattgatcaatagaatagaatggagaactcagaaatagacccacacaaatatatacaactgatttttgacaatggtgcaaaagctttgcataagaaacttttcaaaccagcctgggcaacatggcaaaaagtctctactagaaatacaaaaatgagctgggtatggtgacacgcacctgtggtcccagctactcgggaggctgaagagggaggatcacttaatcccaagaggctgaggctgcagtgagctgtgatcacaccactacactcccgcctaggtgacagagtgaaaccttgcctcaaaaaaaaaa

SEQ ID NO: 16692 - DNA, 1726 bp, Homo sapiens
aagcatggtatcaacgcagagggcccattacggccgggcatagctgacttcctattggtacagcttgaaaagcactttttactacatacacattttatgcttaaaaagttaacatgatacgaaactgtgattagaaaatatctggtctggatgtgattagtaaggatacaagataatgttctaagactgcctaatgctttttgtttgattttcatctgccaggcgttgttatgtgctatgagggtagcaagtacgtctttgtcttaatgatctaaggctggtgtagaaacaaagggcctaatgagaaccaatcatcatggaagtcagttgcgggggcagcccataaggaaagggaaagtgagtggggttgggcataggctgagtgaggtggcctgaatgacacctcttagaggactgtgaagtacaggcacagcccgactgcagggagggatgcacccatcatttacccatgggagcatctgtaggaccatctctctcccacttcttctcccctcccccaccgcatctggccagatggactgtcctacagcaatcgtttccatctgtcaccctcttccctctcctttcataccagtcactatcttgggtaacaaatttatacaggacagtggtacagaaatacatctttgctctgagaatacagcaaatattaacttaaattattataactgaacaaataataaaacctgaattttaatatcttcaaaaaaaaaatctgaattatttgtctaaattttagtatcacaatagcctagatgtaaaataaaatacaaatattttcctccactaataagagacatatacagaaaagcaaacatcaaaaggtacagaggacatgaagattctgtttttctcctccctttggagaaaaagttgacaatatttattctcaaagttcacctttgactggagggaaattcagcacgcctgtacttgaaaatgaattcttacatgttaaaataacttttaataagtttaacatctatcagtgaaataatgtttaatccttttaaacagatggtctttgctgaaaagaataaacccaactgaaaatagcattagaaagtacttaaaagaactatgtttgacagtttttggctcatagcacttttatgttaaattcatgtatactgtttacagacttcataatgaattttatattgtaccagtaagctctgcagaaggcattcaccattactgcatggaatgcccaaacatgcccatgaggaaaattaaaggtaaaacaatttaagtaaaagtctctctagaattctattactggctattttatcactacctggtaaaattaaaattaatctttcagtaaagccaactgatctaagagagaaatattacactttatattttaaaaattcacttaaaattggatgtgcttacagttctaacattgtccttgagagcagaagcgtgaggatcttctggtgagagcatgcatgccctactccatttgttgtctgcataggttagggctgctgctagctgctgtaatagacaccatccatttaagaaggctgcagcaccagaggccgatttcttgctcatgtaactgtcagcagtgagtcttcctggcaggagggcagctcccctccttgcagagattcagttacccagactcccttctgccctgggctctgccatcccctataataaccctcatgtcctctgcatccagcccatggagggg

SEQ ID NO: 16693 - DNA, 1465 bp, Homo sapiens
gtttctacaccagccttagatcattaaacaaagggcctaatgagaaccaatcatcatggaagtcagttgcgggggcagcccataaggaaagggaaagtgagtggggttgggcataggctgagtgaggtggcctgaatgacacctcttagaggactgtgaagtacaggcacagcccgactgcagggagggatgcacccatcatttacccatgggagcatctgtaggaccatctctctcccacttcttctcccctcccccaccgcatctggccagatggactgtcctacagcaatcgtttccatctgtcaccctcttccctctcctttcataccagtcactatcttgggtaacaaatttatacaggacagtggtacagaaatacatctttgctctgagaatacagcaaatattaacttaaattattataactgaacaaataataaaacctgaattttaatatcttcaaaaaaaaaatctgaattatttgtctaaattttagtatcacaatagcctagatgtaaaataaaatacaaatattttcctccactaataagagacatatacagaaaagcaaacatcaaaaggtacagaggacatgaagattctgtttttctcctccctttggagaaaaagttgacaatatttattctcaaagttcacctttgactggagggaaattcagcacgcctgtacttgaaaatgaattcttacatgttaaaataacttttaataagtttaacatctatcagtgaaataatgtttaatccttttaaacagatggtctttgctgaaaagaataaacccaactgaaaatagcattagaaagtacttaaaagaactatgtttgacagtttttggctcatagcacttttatgttaaattcatgtatactgtttacagacttcataatgaattttatattgtaccagtaagctctgcagaaggcattcaccattactgcatggaatgcccaaacatgcccatgaggaaaattaaaggtaaaacaatttaagtaaaagtctctctagaattctattactggctattttatcactacctggtaaaattaaaattaatctttcagtaaagccaactgatctaagagagaaatattacactttatattttaaaaattcacttaaaattggatgtgcttacagttctaacattgtccttgagagcagaagcgtgaggatcttctggtgagagcatgcatgccctactccatttgttgtctgcataggttagggctgctgctagctgctgtaatagacaccatccatttaagaaggctgcagcaccagaggccgatttcttgctcatgtaactgtcagcagtgagtcttcctggcaggagggcagctcccctccttgcagagattcagttacccagactcccttctgccctgggctctgccatcccctataataaccctcatgtcctctgcatccagcccatggagggg

SEQ ID NO: 16694 - DNA, 813 bp, Homo sapiens
tatgatttgtggacatactgttaatcttaactaggttagattccagacatcataggtcaataattgtctaattgctaaaatgtgttgcccatccttaatatggggataaggaaaaggctaggggaaggagagaaagctggacatctttaaaagccttcatattcatcaactcatgaacattacacacatattcaaaaacaagaaggatatgggttaaaatgagatactttataaggaactaaatgcttttaatgagaacaaatatgaaatcaagcttctgatggctgacccctttcttcaaatgtgggtactcttttaggaggagttacttgcagaccttcacggaacagttgcctttaaggatttcattctaagcaggggctacaggatgccacgtttccttgagaatatgtatatcgggaaggaatgtaaacgtgcatgtaataagactcctataaaacgaactcaagcatagaagaatcgtaggagaatgattaggcagattttattactacgtacttggctatttctctgtctccttttaaagattaaacagagtttatgatgagtgtcccactgtggatgttcaactttgacttggcaacatctgtaaatgtaatacctgatggttataagcatttctcaatggatttctgcttcagttaatcaacattttgtatactttatcacccatgagatcaatattcacatgtaatcttctcatatttttgtggcacgtgaatattatataggtatatcaactattggtaaaaataaataaaggcataaataaaaacagacttactctattgc

SEQ ID NO: 16695 - DNA, 1101 bp, Homo sapiens
cacttcttgtttagcttctctccttcgcgtcttgtactagggaccttcctgcgcgtatctcgccttctttctttgatcttctagtctttaatcttcaggatatccaccttgtagctatgttgtttctctaccttgtcgtgttggtttcgcgttgcttaccgcgcgctctggtgtcgtccacgctcgttgctgactgagcacgcgtgtcttgtggaccgtttctctcgccgttattatctcacatcgaatgcgttgtatccaagcgtcatgattctatgatctattaggtatctccctcctcttatgctttcagcattgtcgtcttatgggagttgcttcattctcttacttgtgctcatttctatgctttatttgatagtcctatgtttattttatgtaggttggaatgtcatttgtgtctaactacgattttttccactcttgtttgctctactctctatcgaggatgattgttttttcttttgatcgttgagcgagctgcttgcattttattctcatcgctcagatcttattcgttaattatcatggttcataatatctggcagcacaggaatatttacgtcgatgttggctttttttcccagcggatgttccttgcgaaagggggatgtactgtgcaagttttgtttgccaatctaatgaaggttctctcatttttttttagttccttgagaatatgtatatcgggaaggaatgtaaacgtgcatgtaataagactcctataaaacgaactcaagcatagaagaatcgtaggagaatgattaggcagattttattactacgtacttggctatttctctgtctccttttaaagattaaacagagtttatgatgagtgtcccactgtggatgttcaactttgacttggcaacatctgtaaatgtaatacctgatggttataagcatttctcaatggatttctgcttcagttaatcaacattttgtatactttatcacccatgagatcaatattcacatgtaatcttctcatatttttgtggcacgtgaatattatataggtatatcaactattggtaaaaataaataaaggcataaataaaaacagacttactctattgc

SEQ ID NO: 16696 - DNA, 4038 bp, Homo sapiens
tacgtatcgccagcccccatcccggtacatcacgtttacatgcatgcagccatacacgcccaaagaggacgagactggatgtgattgagctgactggcatctttagatggatggtcctcagtccagtccttccattttacaggcgaggaggcggaagcttggggaggctaagcgcgctgagctggcggcggagcggagcttccactagggctcccagtttccccgcaccgcgcccgccgtcctccgggccacccatcccacccgaacgcgccaccgctctagcccgcgctccagcccgcgcgtcaccgacgcccgcggcctctcccacctctaagttccaggaagctctcggcctctagctgaccgcgttgctgctgagcttccctggggaggaggcgccgaggtgcccggtgcgggccgaggcagggctgggcctcgcgggcagcaggcggaagaaggaagggcggtggggcaggtccggctgcgcggggcagttgtgcgcacttgggttcttcacgcgggacacacgtggaacgccgacgccgctgccccgctgccgctgtcaacgtgcaaggccgtgaacagaaagtgtagggacagaagagcgctggagtgctgtcccgggagggagcccggggctgcagcccaggggcggggagcggggcggggctgggaaagttgagtactggtcgctcagggccgggctccgccggagtgcccggcgcagaaaccgtaaaaggctggagcgggcggggtaggtgtggctctgtgtgcgtgacctgagccccggtcccagtccctgtagtctcctgcggccgcggcctctcagccatgggcgccgtctggtccgccctgctggttggagggggtctggccggagcacttttcgtttggctgctgcggggcggccctggcgacaccgggaaggacggggatgcggagcaggagaaagacgcccctcttgggggagctgcgattccgggaggccatcagagtggcagcagcggactgagccctggaccttccgggcaggagctggtcaccaaaccagagcatcttcaagaaagcaatggacatttgatttctaagaccaaagaccttggtaaactgcaagcagcatcatggagattgcagaatccttccagggaagtctgtgacaattcaagagaacatgttccttctggacagtttccagacacagaagctccagctacctctgagaccagtaactctaggagttactctgaagtttcaagaaatgaaagccttgaatctcctatgggagaatggggattccaaaaaggacaagagatatctgctaaagcagctacatgttttgcagagaagttgccttctagcaacctgctcaagaacagagctaaagaagaaatgagcctctctgatttgaacagtcaggaccgggttgaccacgaggagtgggaaatggtgcctaggcactcatcttggggggatgttggtgtgggtggcagtcttaaggctccagtgttaaacctaaaccagggaatggacaatggaagaagcactttggtggaagcaagaggtcagcaagtgcatgggaaaatggaaagggtagcagtgatgcctgcagggtctcagcaagttagtgtcaggttccaggtccattatgtcacaagcactgatgtgcaattcattgcagtaactggagaccatgagtgtcttgggagatggaacacttacatcccactccactataacaaggatgggttctggtctcattccattttcctgcctgcagatacagtggtggagtggaagtttgtgttggtagagaatgggggagttacccgctgggaagaatgcagcaatagattcctagaaactggccatgaggataaagtggttcacgcatggtgggggattcactgattcagtttgcaaagtaatggagaagctgtagaacaatgtggaagaggctgaggttgtggaacacactgaataaaataaaggcagtgtgactccaaattcagccatctgaattgtttaaatttgctagtggattttgtctactgtgcagaaatatatatgtctaatgtgcagaaatatatatgtgtgtatgtgtgtatatatatgcacacacacacagataatgcttccagtgaatgtgaacttcttttccctgtggcactgattgacagacttgtgctgatccattattactttagggcttgattctcttggggagtgacttggctaagcttcaggtgtaaactgtggtcacggagcaaaaacattaaccagctgcccagggttcaagcttgagcctttaggtgatctttaaactatggtagtaaaataagcctcactcaaacatagctgacttcctattggtacagcttgaaaagcactttttactacatacacattttatgcttaaaaagttaacatgatacgaaactgtgattagaaaatatctggtctggatgtgattagtaaggatacaagataatgttctaagactgcctaatgctttttgtttgattttcatctgccaggcgttgttatgtgctatgagggtagcaagtacgtctttgtcttaatgatctaaggctggtgtagaaacaaagggcctaatgagaaccaatcatcatggaagtcagttgcgggggcagcccataaggaaagggaaagtgagtggggttgggcataggctgagtgaggtggcctgaatgacacctcttagaggactgtgaagtacaggcacagcccgactgcagggagggatgcacccatcatttacccatgggagcatctgtaggaccatctctctcccacttcttctcccctcccccaccgcatctggccagatggactgtcctacagcaatcgtttccatctgtcaccctcttccctctcctttcataccagtcactatcttgggtaacaaatttatacaggacagtggtacagaaatacatctttgctctgagaatacagcaaatattaacttaaattattataactgaacaaataataaaacctgaattttaatatcttcaaaaaaaaaatctgaattatttgtctaaattttagtatcacaatagcctagatgtaaaataaaatacaaatattttcctccactaataagagacatatacagaaaagcaaacatcaaaaggtacagaggacatgaagattctgtttttctcctccctttggagaaaaagttgacaatatttattctcaaagttcacctttgactggagggaaattcagcacgcctgtacttgaaaatgaattcttacatgttaaaataacttttaataagtttaacatctatcagtgaaataatgtttaatccttttaaacagatggtctttgctgaaaagaataaacccaactgaaaatagcattagaaagtacttaaaagaactatgtttgacagtttttggctcatagcacttttatgttaaattcatgtatactgtttacagacttcataatgaattttatattgtaccagtaagctctgcagaaggcattcaccattactgcatggaatgcccaaacatgcccatgaggaaaattaaaggtaaaacaatttaagtaaaagtctctctagaattctattactggctattttatcactacctggtaaaattaaaattaatctttcagtaaagccaactgatctaagagagaaatattacactttatattttaaaaattcacttaaaattggatgtgcttacagttctaacattgtccttgagagcagaagcgtgaggatcttctggtgagagcatgcatgccctactccatttgttgtctgcataggttagggctgctgctagctgctgtaatagacaccatccatttaagaaggctgcagcaccagaggccgatttcttgctcatgtaactgtcagcagtgagtcttcctggcaggagggcagctcccctccttgcagagattcagttacccagactcccttctgccctgggctctgccatcccctataataaccctcatgtcctctgcatccagcccatggagggg

SEQ ID NO: 16697 - DNA, 4091 bp, Homo sapiens
agcccggacggtggccgcgaagctagggccaccatggcggaccgcaggcggcggctccggccggggacgttggccccggtgcgcgagggcgtgaactgcaggtccagatgtttcacaaagcacaagaacgggctgaagttccccacctctctgcacagccggcagttggtatttccaagaaaggggctggacgacttcaggaagggctgcccgccttgcactggtctggtgactcaggtccctgtggagggctttctgccccagatttatcacagagctccccaactggccccaaagaagaggcagatcaagctgctcaaggaagcagacgtgctttccaagctctcgccagcccagcaggctcggaaggcattcctggaggacgtggaggcccacctgaccccacatcccttagcgctctacctgaatctggaagaagctatgcccatagagctcttatcaaaggtgctggaagtgcttgatcctgaccggaagctggaggacacatgggcttattgtcaggacaccaggaaaggaatgaaggaacccacgaagcttttaaaaaaacattctacccaagtctacctgggaccttccaagaagacgtctgtgtcaaacgcaggccaatggctttatgaagaaaagccacataaaatggatttgctccatgaaaatggtcctcgtcctggtcttcatgaaaatgtatgcaaagcagttagtgacttctgcaagtgggttactacttttggaatttcggacatcgatgaagagttcatcttgaaacagtttgacattgactatgagaccaaaccaagccatgatgcgctccacacgatgaagctaaatcaggttcctctggagctaaagcgtagtgtggggctcagtaaactgcaggagacagagttcttccagaaactaggctatgagaggaaactccagaaaccacagaatccttataagccaaagtgggtgaagatgaggtatggagcatggtatttgaaccccaagttgtggaaaaagcaaagagtagacgagcctctggttgaccctgaggtctcacataaggctcaagaggagaattttaaaaaggagctgcaggaacagagcatcttcaagaaagcaatggacatttgatttctaagaccaaagaccttggtaaactgcaagcagcatcatggagattgcagaatccttccagggaagtctgtgacaattcaagagaacatgttccttctggacagtttccagacacagaagctccagctacctctgagaccagtaactctaggagttactctgaagtttcaagaaatgaaagccttgaatctcctatgggagaatggggattccaaaaaggacaagagatatctgctaaagcagctacatgttttgcagagaagttgccttctagcaacctgctcaagaacagagctaaagaagaaatgagcctctctgatttgaacagtcaggaccgggttgaccacgaggagtgggaaatggtgcctaggcactcatcttggggggatgttggtgtgggtggcagtcttaaggctccagtgttaaacctaaaccagggaatggacaatggaagaagcactttggtggaagcaagaggtcagcaagtgcatgggaaaatggaaagggtagcagtgatgcctgcagggtctcagcaagttagtgtcaggttccaggtccattatgtcacaagcactgatgtgcaattcattgcagtaactggagaccatgagtgtcttgggagatggaacacttacatcccactccactataacaaggatgggttctggtctcattccattttcctgcctgcagatacagtggtggagtggaagtttgtgttggtagagaatgggggagttacccgctgggaagaatgcagcaatagattcctagaaactggccatgaggataaagtggttcacgcatggtgggggattcactgattcagtttgcaaagtaatggagaagctgtagaacaatgtggaagaggctgaggttgtggaacacactgaataaaataaaggcagtgtgactccaaattcagccatctgaattgtttaaatttgctagtggattttgtctactgtgcagaaatatatatgtctaatgtgcagaaatatatatgtgtgtatgtgtgtatatatatgcacacacacacagataatgcttccagtgaatgtgaacttcttttccctgtggcactgattgacagacttgtgctgatccattattactttagggcttgattctcttggggagtgacttggctaagcttcaggtgtaaactgtggtcacggagcaaaaacattaaccagctgcccagggttcaagcttgagcctttaggtgatctttaaactatggtagtaaaataagcctcactcaaacatagctgacttcctattggtacagcttgaaaagcactttttactacatacacattttatgcttaaaaagttaacatgatacgaaactgtgattagaaaatatctggtctggatgtgattagtaaggatacaagataatgttctaagactgcctaatgctttttgtttgattttcatctgccaggcgttgttatgtgctatgagggtagcaagtacgtctttgtcttaatgatctaaggctggtgtagaaacaaagggcctaatgagaaccaatcatcatggaagtcagttgcgggggcagcccataaggaaagggaaagtgagtggggttgggcataggctgagtgaggtggcctgaatgacacctcttagaggactgtgaagtacaggcacagcccgactgcagggagggatgcacccatcatttacccatgggagcatctgtaggaccatctctctcccacttcttctcccctcccccaccgcatctggccagatggactgtcctacagcaatcgtttccatctgtcaccctcttccctctcctttcataccagtcactatcttgggtaacaaatttatacaggacagtggtacagaaatacatctttgctctgagaatacagcaaatattaacttaaattattataactgaacaaataataaaacctgaattttaatatcttcaaaaaaaaaatctgaattatttgtctaaattttagtatcacaatagcctagatgtaaaataaaatacaaatattttcctccactaataagagacatatacagaaaagcaaacatcaaaaggtacagaggacatgaagattctgtttttctcctccctttggagaaaaagttgacaatatttattctcaaagttcacctttgactggagggaaattcagcacgcctgtacttgaaaatgaattcttacatgttaaaataacttttaataagtttaacatctatcagtgaaataatgtttaatccttttaaacagatggtctttgctgaaaagaataaacccaactgaaaatagcattagaaagtacttaaaagaactatgtttgacagtttttggctcatagcacttttatgttaaattcatgtatactgtttacagacttcataatgaattttatattgtaccagtaagctctgcagaaggcattcaccattactgcatggaatgcccaaacatgcccatgaggaaaattaaaggtaaaacaatttaagtaaaagtctctctagaattctattactggctattttatcactacctggtaaaattaaaattaatctttcagtaaagccaactgatctaagagagaaatattacactttatattttaaaaattcacttaaaattggatgtgcttacagttctaacattgtccttgagagcagaagcgtgaggatcttctggtgagagcatgcatgccctactccatttgttgtctgcataggttagggctgctgctagctgctgtaatagacaccatccatttaagaaggctgcagcaccagaggccgatttcttgctcatgtaactgtcagcagtgagtcttcctggcaggagggcagctcccctccttgcagagattcagttacccagactcccttctgccctgggctctgccatcccctataataaccctcatgtcctctgcatccagcccatggagggg

SEQ ID NO: 16698 - DNA, 2422 bp, Homo sapiens
gacatggagagatataaacatataatgtctaaatgaaatgtatgatgtgcaattcattgcagtaactggagaccatgagtgtcttgggagatggaacacttacatcccactccactataacaaggatgggttctggtctcattccattttcctgcctgcagatacagtggtggagtggaagtttgtgttggtagagaatgggggagttacccgctgggaagaatgcagcaatagattcctagaaactggccatgaggataaagtggttcacgcatggtgggggattcactgattcagtttgcaaagtaatggagaagctgtagaacaatgtggaagaggctgaggttgtggaacacactgaataaaataaaggcagtgtgactccaaattcagccatctgaattgtttaaatttgctagtggattttgtctactgtgcagaaatatatatgtctaatgtgcagaaatatatatgtgtgtatgtgtgtatatatatgcacacacacacagataatgcttccagtgaatgtgaacttcttttccctgtggcactgattgacagacttgtgctgatccattattactttagggcttgattctcttggggagtgacttggctaagcttcaggtgtaaactgtggtcacggagcaaaaacattaaccagctgcccagggttcaagcttgagcctttaggtgatctttaaactatggtagtaaaataagcctcactcaaacatagctgacttcctattggtacagcttgaaaagcactttttactacatacacattttatgcttaaaaagttaacatgatacgaaactgtgattagaaaatatctggtctggatgtgattagtaaggatacaagataatgttctaagactgcctaatgctttttgtttgattttcatctgccaggcgttgttatgtgctatgagggtagcaagtacgtctttgtcttaatgatctaaggctggtgtagaaacaaagggcctaatgagaaccaatcatcatggaagtcagttgcgggggcagcccataaggaaagggaaagtgagtggggttgggcataggctgagtgaggtggcctgaatgacacctcttagaggactgtgaagtacaggcacagcccgactgcagggagggatgcacccatcatttacccatgggagcatctgtaggaccatctctctcccacttcttctcccctcccccaccgcatctggccagatggactgtcctacagcaatcgtttccatctgtcaccctcttccctctcctttcataccagtcactatcttgggtaacaaatttatacaggacagtggtacagaaatacatctttgctctgagaatacagcaaatattaacttaaattattataactgaacaaataataaaacctgaattttaatatcttcaaaaaaaaaatctgaattatttgtctaaattttagtatcacaatagcctagatgtaaaataaaatacaaatattttcctccactaataagagacatatacagaaaagcaaacatcaaaaggtacagaggacatgaagattctgtttttctcctccctttggagaaaaagttgacaatatttattctcaaagttcacctttgactggagggaaattcagcacgcctgtacttgaaaatgaattcttacatgttaaaataacttttaataagtttaacatctatcagtgaaataatgtttaatccttttaaacagatggtctttgctgaaaagaataaacccaactgaaaatagcattagaaagtacttaaaagaactatgtttgacagtttttggctcatagcacttttatgttaaattcatgtatactgtttacagacttcataatgaattttatattgtaccagtaagctctgcagaaggcattcaccattactgcatggaatgcccaaacatgcccatgaggaaaattaaaggtaaaacaatttaagtaaaagtctctctagaattctattactggctattttatcactacctggtaaaattaaaattaatctttcagtaaagccaactgatctaagagagaaatattacactttatattttaaaaattcacttaaaattggatgtgcttacagttctaacattgtccttgagagcagaagcgtgaggatcttctggtgagagcatgcatgccctactccatttgttgtctgcataggttagggctgctgctagctgctgtaatagacaccatccatttaagaaggctgcagcaccagaggccgatttcttgctcatgtaactgtcagcagtgagtcttcctggcaggagggcagctcccctccttgcagagattcagttacccagactcccttctgccctgggctctgccatcccctataataaccctcatgtcctctgcatccagcccatggagggg

SEQ ID NO: 16699 - DNA, 1706 bp, Homo sapiens
tacagacagtgcttaataaagagctgctgtttttattaacaaacttatctgtaggagctcgtccatggacaacatccagttcatacagatgcgtgcgcatttcgcagcagccatacacgcccaaagaggacgagactggatgtgattgagctgactggcatctttagatggatggtcctcagtccagtccttccattttacaggcgaggaggcggaagcttggggaggctaagcgcgctgagctggcggcggagcggagcttccactagggctcccagtttccccgcaccgcgcccgccgtcctccgggccacccatcccacccgaacgcgccaccgctctagcccgcgctccagcccgcgcgtcaccgacgcccgcggcctctcccacctctaagttccaggaagctctcggcctctagctgaccgcgttgctgctgagcttccctggggaggaggcgccgaggtgcccggtgcgggccgaggcagggctgggcctcgcgggcagcaggcggaagaaggaagggcggtggggcaggtccggctgcgcggggcagttgtgcgcacttgggttcttcacgcgggacacacgtggaacgccgacgccgctgccccgctgccgctgtcaacgtgcaaggccgtgaacagaaagtgtagggacagaagagcgctggagtgctgtcccgggagggagcccggggctgcagcccaggggcggggagcggggcggggctgggaaagttgagtactggtcgctcagggccgggctccgccggagtgcccggcgcagaaaccgtaaaaggctggagcgggcggggtaggtgtggctctgtgtgcgtgacctgagccccggtcccagtccctgtagtctcctgcggccgcggcctctcagccatgggcgccgtctggtccgccctgctggttggagggggtctggccggagcacttttcgtttggctgctgcggggcggccctggcgacaccgggaaggacggggatgcggagcaggagaaagacgcccctcttgggggagctgcgattccgggaggccatcagagtggcagcagcggactgagccctggaccttccgggcaggagctggtcaccaaaccaggtattcttccccccgtgactccagggcacatctgccagagctttgaggttcatcgaggaagggagcaaagagacaaacccacctggagctttcctaggggcccattcctgcggacgggctctcctaaggggactgggccatccccacgcccctcggtttcccaggctggttggtacgcgcaggcaggtttcttgtctggtcctccaagggccgcgcccttgccgagtccctcagcgcccgcgcctgaggacttggtcctgcccctccggcggggatgagctcctccacttggcggcgcttggtgcagtgcgggcggctgcagtggcggcgccccttcccggcctttggaaaggggggcttaggtttaggggatcctacaagcctcttcgatctctgcccaagcagggacattttctaagtcccaatccgggtagtctgacatcctcccatcgcacagcccatgaagagctgggtttgggaacacccgaactgcgggcgcctcctgctatctggatgcttctttaggaaggcaaagttcaggttggactctggccatgaaggctgtggctgaggccctggggatgtgccttggtc

SEQ ID NO: 16700 - DNA, 4099 bp, Homo sapiens
tacagacagtgcttaataaagagctgctgtttttattaacaaacttatctgtaggagctcgtccatggacaacatccagttcatacagatgcgtgcgcatttcgcagcagccatacacgcccaaagaggacgagactggatgtgattgagctgactggcatctttagatggatggtcctcagtccagtccttccattttacaggcgaggaggcggaagcttggggaggctaagcgcgctgagctggcggcggagcggagcttccactagggctcccagtttccccgcaccgcgcccgccgtcctccgggccacccatcccacccgaacgcgccaccgctctagcccgcgctccagcccgcgcgtcaccgacgcccgcggcctctcccacctctaagttccaggaagctctcggcctctagctgaccgcgttgctgctgagcttccctggggaggaggcgccgaggtgcccggtgcgggccgaggcagggctgggcctcgcgggcagcaggcggaagaaggaagggcggtggggcaggtccggctgcgcggggcagttgtgcgcacttgggttcttcacgcgggacacacgtggaacgccgacgccgctgccccgctgccgctgtcaacgtgcaaggccgtgaacagaaagtgtagggacagaagagcgctggagtgctgtcccgggagggagcccggggctgcagcccaggggcggggagcggggcggggctgggaaagttgagtactggtcgctcagggccgggctccgccggagtgcccggcgcagaaaccgtaaaaggctggagcgggcggggtaggtgtggctctgtgtgcgtgacctgagccccggtcccagtccctgtagtctcctgcggccgcggcctctcagccatgggcgccgtctggtccgccctgctggttggagggggtctggccggagcacttttcgtttggctgctgcggggcggccctggcgacaccgggaaggacggggatgcggagcaggagaaagacgcccctcttgggggagctgcgattccgggaggccatcagagtggcagcagcggactgagccctggaccttccgggcaggagctggtcaccaaaccagagcatcttcaagaaagcaatggacatttgatttctaagaccaaagaccttggtaaactgcaagcagcatcatggagattgcagaatccttccagggaagtctgtgacaattcaagagaacatgttccttctggacagtttccagacacagaagctccagctacctctgagaccagtaactctaggagttactctgaagtttcaagaaatgaaagccttgaatctcctatgggagaatggggattccaaaaaggacaagagatatctgctaaagcagctacatgttttgcagagaagttgccttctagcaacctgctcaagaacagagctaaagaagaaatgagcctctctgatttgaacagtcaggaccgggttgaccacgaggagtgggaaatggtgcctaggcactcatcttggggggatgttggtgtgggtggcagtcttaaggctccagtgttaaacctaaaccagggaatggacaatggaagaagcactttggtggaagcaagaggtcagcaagtgcatgggaaaatggaaagggtagcagtgatgcctgcagggtctcagcaagttagtgtcaggttccaggtccattatgtcacaagcactgatgtgcaattcattgcagtaactggagaccatgagtgtcttgggagatggaacacttacatcccactccactataacaaggatgggttctggtctcattccattttcctgcctgcagatacagtggtggagtggaagtttgtgttggtagagaatgggggagttacccgctgggaagaatgcagcaatagattcctagaaactggccatgaggataaagtggttcacgcatggtgggggattcactgattcagtttgcaaagtaatggagaagctgtagaacaatgtggaagaggctgaggttgtggaacacactgaataaaataaaggcagtgtgactccaaattcagccatctgaattgtttaaatttgctagtggattttgtctactgtgcagaaatatatatgtctaatgtgcagaaatatatatgtgtgtatgtgtgtatatatatgcacacacacacagataatgcttccagtgaatgtgaacttcttttccctgtggcactgattgacagacttgtgctgatccattattactttagggcttgattctcttggggagtgacttggctaagcttcaggtgtaaactgtggtcacggagcaaaaacattaaccagctgcccagggttcaagcttgagcctttaggtgatctttaaactatggtagtaaaataagcctcactcaaacatagctgacttcctattggtacagcttgaaaagcactttttactacatacacattttatgcttaaaaagttaacatgatacgaaactgtgattagaaaatatctggtctggatgtgattagtaaggatacaagataatgttctaagactgcctaatgctttttgtttgattttcatctgccaggcgttgttatgtgctatgagggtagcaagtacgtctttgtcttaatgatctaaggctggtgtagaaacaaagggcctaatgagaaccaatcatcatggaagtcagttgcgggggcagcccataaggaaagggaaagtgagtggggttgggcataggctgagtgaggtggcctgaatgacacctcttagaggactgtgaagtacaggcacagcccgactgcagggagggatgcacccatcatttacccatgggagcatctgtaggaccatctctctcccacttcttctcccctcccccaccgcatctggccagatggactgtcctacagcaatcgtttccatctgtcaccctcttccctctcctttcataccagtcactatcttgggtaacaaatttatacaggacagtggtacagaaatacatctttgctctgagaatacagcaaatattaacttaaattattataactgaacaaataataaaacctgaattttaatatcttcaaaaaaaaaatctgaattatttgtctaaattttagtatcacaatagcctagatgtaaaataaaatacaaatattttcctccactaataagagacatatacagaaaagcaaacatcaaaaggtacagaggacatgaagattctgtttttctcctccctttggagaaaaagttgacaatatttattctcaaagttcacctttgactggagggaaattcagcacgcctgtacttgaaaatgaattcttacatgttaaaataacttttaataagtttaacatctatcagtgaaataatgtttaatccttttaaacagatggtctttgctgaaaagaataaacccaactgaaaatagcattagaaagtacttaaaagaactatgtttgacagtttttggctcatagcacttttatgttaaattcatgtatactgtttacagacttcataatgaattttatattgtaccagtaagctctgcagaaggcattcaccattactgcatggaatgcccaaacatgcccatgaggaaaattaaaggtaaaacaatttaagtaaaagtctctctagaattctattactggctattttatcactacctggtaaaattaaaattaatctttcagtaaagccaactgatctaagagagaaatattacactttatattttaaaaattcacttaaaattggatgtgcttacagttctaacattgtccttgagagcagaagcgtgaggatcttctggtgagagcatgcatgccctactccatttgttgtctgcataggttagggctgctgctagctgctgtaatagacaccatccatttaagaaggctgcagcaccagaggccgatttcttgctcatgtaactgtcagcagtgagtcttcctggcaggagggcagctcccctccttgcagagattcagttacccagactcccttctgccctgggctctgccatcccctataataaccctcatgtcctctgcatccagcccatggagggg

SEQ ID NO: 16701 - DNA, 1598 bp, Homo sapiens
agcccggacggtggccgcgaagctagggccaccatggcggaccgcaggcggcggctccggccggggacgttggccccggtgcgcgagggcgtgaactgcaggtccagatgtttcacaaagcacaagaacgggctgaagttccccacctctctgcacagccggcagttggtatttccaagaaaggggctggacgacttcaggaagggctgcccgccttgcactggtctggtgactcaggtccctgtggagggctttctgccccagatttatcacagagctccccaactggccccaaagaagaggcagatcaagctgctcaaggaagcagacgtgctttccaagctctcgccagcccagcaggctcggaaggcattcctggaggacgtggaggcccacctgaccccacatcccttagcgctctacctgaatctggaagaagctatgcccatagagctcttatcaaaggtgctggaagtgcttgatcctgaccggaagctggaggacacatgggcttattgtcaggacaccaggaaaggaatgaaggaacccacgaagcttttaaaaaaacattctacccaagtctacctgggaccttccaagaagacgtctgtgtcaaacgcaggccaatggctttatgaagaaaagccacataaaatggatttgctccatgaaaatggtcctcgtcctggtcttcatgaaaatgtatgcaaagcagttagtgacttctgcaagtgggttactacttttggaatttcggacatcgatgaagagttcatcttgaaacagtttgacattgactatgagaccaaaccaagccatgatgcgctccacacgatgaagctaaatcaggttcctctggagctaaagcgtagtgtggggctcagtaaactgcaggagacagagttcttccagaaactaggctatgagaggaaactccagaaaccacagaatccttataagccaaagtgggtgaagatgaggtatggagcatggtatttgaaccccaagttgtggaaaaagcaaagagtagacgagcctctggttgaccctgaggtctcacataaggctcaagaggagaattttaaaaaggagctgcaggaacaggaggagttacttgcagaccttcacggaacagttgcctttaaggatttcattctaagcaggggctacaggatgccacgtttccttgagaatatgtatatcgggaaggaatgtaaacgtgcatgtaataagactcctataaaacgaactcaagcatagaagaatcgtaggagaatgattaggcagattttattactacgtacttggctatttctctgtctccttttaaagattaaacagagtttatgatgagtgtcccactgtggatgttcaactttgacttggcaacatctgtaaatgtaatacctgatggttataagcatttctcaatggatttctgcttcagttaatcaacattttgtatactttatcacccatgagatcaatattcacatgtaatcttctcatatttttgtggcacgtgaatattatataggtatatcaactattggtaaaaataaataaaggcataaataaaaacagacttactctattgc

SEQ ID NO: 16702 - DNA, 855 bp, Homo sapiens
agcccggacggtggccgcgaagctagggccaccatggcggaccgcaggcggcggctccggccggggacgttggccccggtgcgcgagggcgtgaactgcaggtccagatgtttcacaaagcacaagaacgggctgaagttccccacctctctgcacagccggcagttggtatttccaagaaaggggctggacgacttcaggaagggctgcccgccttgcactggtctggtgactcaggtccctgtggagggctttctgccccagatttatcacagagctccccaactggccccaaagaagaggcagatcaagctgctcaaggaagcagacgtgctttccaagctctcgccagcccagcaggctcggaaggcattcctggaggacgtggaggcccacctgaccccacatcccttagcgctctacctgaatctggaagaagctatgcccatagagctcttatcaaaggtgctggaagtgcttgatcctgaccggaagctggaggacacatgggcttattgtcaggacaccaggaaaggaatgaaggaacccacgaagcttttaaaaaaacattctacccaagtctacctgggaccttccaagaagacgtctgtgtcaaacgcaggccaatggctttatgaagaaaagccacataaaatggatttgctccatgaaaatggtcctcgtcctggtcttcatgaaaatgtatgcaaagcagttagtgacttctgcaagtgggttactacttttgtaagttagtggtaatatttaaacctacttttaaatgtcaagctcaaagttgcttttattaaaaaacagtattggataaaatctaagtcaaatcctcaaagtcgtaaa

SEQ ID NO: 16703 - DNA, 1761 bp, Homo sapiens
  misc_feature (1163)..(1163): n is a, c, g, or t
catatatacacccaggatatcattttatatatgtcacaattcatgaaatatcttatatttcatcttcaaacttatcctctggccctggaactattctaatcactgctcttgcttctggaatgcttagcttcatgccatagtagagcattttcagaaaactggtaagctcagctaaagctaatatggcatatatggatagaacatttgatgagtaaattccagttctgaaagtctactagtcgctgaaatacttagaataaaaaatgaggattgattttgtatgtgtcatgaaacagtagcatttctaggtcagcattttcccagctgtgttattctttcctgtttgtcaatgctcagtgcatcttagaggtaggaaattattctactgcttgtgaaactagaactagatagcacatagtaataacacagtgtgaatagttattaggacctattatagcacttttcctgtagaacgctctagctgttttcttccataacatgggtcaaattgtgcctctcttaaatgggaagcacacagggagagggttccatcagacagatgtaggctgcatgactatcaagaggtgagaaatggttcaactcagctggccaagacccactcacacccctgagacccagcctagccagagaacagctggctgatcttggcaggagttttagggcagatagttcatcaccacagcaccactaatccattcattttctttctcaatataaggacccttgagaatgttcccatctcccttctgtgcatttttgctggcttccatccctggggaatcagccacattttctcatgtgtcttcagggcatcttaggacataggaaggggaaagaaatgaaattttaccttcaaagatgagaatggaagagagaataaaggaaactgtcctggacctcacaggcaataaacaaacagttaactgaagacttcactctgattcaatccactcttctttttagtgatctgcctatctgtgatgtatctccaggcaaaaactttcatatacagtagtttaaaaatgagctgtttcttcctgcaggtctgactgcacaggcatattgagcgaggcaacttgaacaccaggctgaggccgattttgtgaagcatctttcactctttctcttttctggggatgtgngacaggttgtgggtgggtgagtgtgtgtgtatgctggacttctttggaagatgtgggacccaagaagtatcactgtgagagtttaaggagacagttaatgacatgtgtttacagccattgtcacacaacagcatctgtaagaagattggacgtgattatctggatctagcttgaagtagtcaaggcaaagatataattgtgtagtcttgaagccaaataaatccccaaatgaacaaaacaacccacaatgaattatatcatgtactttgcaaaggtagctaagcttagggaagacccggcactgcactaacctcatctctcttggttattcacaaaaacaatttgagtctaagggcaaggcacctttgtcagttgcccattccattactaatgttggactttctttttcattcaagcctgacaaaatgctgcaacctgacatcccagcaggcagttttcactattgtactaactactccatctgttatgaaggtcacaagaatgtatcttgttttaaatttttctatggagtgatttattgtcttggctataaatttgtaaagaaataaaacgctatttcttcatcgtctcctgaggt

SEQ ID NO: 16704 - DNA, 679 bp, Homo sapiens
aactcctgacctcgtgatccacccaccttggcctcccaaagtgctaggattacaggtgtgagccaccgtgcttggccaacccacccaaattgtgtaccctacaccatcctagtgcttgggagccaacacccactcacaggaggctaagggcaagtttaggtaactcttaacaccacgaattagttgcctgctggcaaactttcaaactccaaggcctgaaatttctggttgggagttcaccttcccagatgggacttcaggggatttcatttcacccccttcatccagtgctcacggagcctctgtgaaggtgcaggccccctggagaggagcccctgtggccctcaagcaaaagggcaaggcaggctggtgaagcaccccaaccctctggatcgaggggactcaattatgcgggataaaggccccctaatcctctcagtgctcccaaactcactctgcttctgaaagggatcttcgtacccctgggttcagagagtaggaagcccgcagggaccgagtatgcatgaaacaagcccaagtctgtgggggctgtacatggtcaagatcacagatttccagaccaagccagctccaccctagctgggatgcccaccctgagacacccctctctgctttcactggaataggatgccctgacttggccgggtggactgttgaa

SEQ ID NO: 16705 - DNA, 431 bp, Homo sapiens
atttaaatcactaaaaaaatctactttctataaagcatttggagcaatcttgcatataatactcatttgcttagctaactctttttttctgtagataagtaaggtaaatgttaggccactagacaaaattatcatacatcttcaatcatcaatgtccagagtaatgagtcaatatatgtatgtacgtatgtatatgcatttaaaaaaatcactcttttgacacatttcacttttctttgtaagtaatataggtgggctagatcaggggttgtcaagtcatattagaatcatctgaggagatgtgggcatctggcgatgcccataccaattaaaagagtttctaggggtgtggatggaaagtgggaactggtagttttacaaggtccctgtcaccagggttgagacaccatagcttagagtcctgtaacttg

SEQ ID NO: 16706 - DNA, 380 bp, Homo sapiens
gtgccatttgaatggcacaagaccagacagtgtatgtgggggagtgtttctcaaatcaaactggaaactctttaatttgtaagaaccattaagcagagagagaaaaaagaaaggaaaagaaaaaagatcctacagagaacaccctgttcagtttgggaacaggctacagctttggatttttcaaggcctagcattcccatcattctaaattttacttagctaatacaatagtagttgccagagctgatgacatagtattttgtcatgcttggctccgttcaagcattttagttttttagccattaccatggctagacccagtcaaaagaatttcattgtttaagattcccattctctagtttttactagtagccagccaa

SEQ ID NO: 16707 - DNA, 268 bp, Homo sapiens
tcctcagctcccttcggtgaactgaagattgcagagaactgagtttgcaacatcctaacttgtcttcaggctgcttgaggtgtcactaactcagtgtataaaagagcaaaactagatttgaccgcagtctgaaggaagccatgggaagcagtggtgatgcctcatgaaaactgcaaggagctacaaacgtgaagacccctgagacaagagattgcctgctgaggaatacaattgaacagctaaggcccagaggagaagtaggggtgtg

SEQ ID NO: 16708 - DNA, 165 bp, Homo sapiens
ccaggggctgcatgtggacccccccgggcggcccaggggaccccgggcccgacccaggggctgtggacgatgtacaggcaacagagctacgcactcctttccttttggaagcaagaagaaaatacgtgaaaacggaaattaaagatttaaaattttaaaaaaaaa

SEQ ID NO: 16709 - DNA, 511 bp, Homo sapiens
ttatgagaggattcatcgaaatacctgtgctttgtcatttaaaaagcatgggcatacacatgataatgctttacgtttctggatttaaagtgccttcacaatacagaactaggaaaaagaaggccatctttttaaatgaagatagttttaagagagcaataagagactattactttgttatgatagaaggttgggctgatgtcataatgatgttatgatgtcactgacatcatattatttcctcagtcatacctattaaccatttcttgagcatccactatgggcttaatagataagaaacactccataccctttaagagccctgaggtgtgtgtgtgtgaacagcattaaactttggagtcatgttacctgggtttaaatccaagttgcatgaatactggctttgtgtgaccttggacaaactatttcactgtgtcttgcctcagtttctccatctgtaaaatgataataaagctatctcacagcattattatgaagattaaatgcatta

SEQ ID NO: 16710 - DNA, 559 bp, Homo sapiens
atttgatatagggttatctccctccaaaaattagtcatcttcatgtccaaagttcaatgttaatttacccatagtcatgagggcagggatcagcagcatcacggtctgatgaacattttcagcactgtacccagtgctccatggatctcaggttatcttttattattaaacccatttaataagagagatggcagttgaaaaattgaaggatttagagctagaaggcatcactggagcagaaagaaacagcatagccttcaggtcaacttgatactcttcccccatctcattccttctcactagaatagccacattcataattggaagcctagccagctcaggccaaagttatcattagtccaaggaaaaatgaccaaaaaggacagcatagtgagttttgtataaaagctcatttaaagatcgtcttatttggagatggtgtgccctcattttagtgttacaatgtatttgagagctgatgctgataataaatggctattttattaaatgctctagtttggcaaaattaaaagttgacagttttgttgttcttcacaag

SEQ ID NO: 16711 - DNA, 774 bp, Homo sapiens
gtcgggagaccagccattcgatcccgccgcagatttcctttttttctggggaactgtatttttaataacaacaacattggttgcccttctgaaaaaagaaaacgaagtatcagtagtaaaagaagaaacacaagggatcacagatacttacaagctgctttttgcaattataaaaatgccagcagttctgacattttgccttctgattctaactgcaaagattggtttttcagcagcagatgctgtaacaggactgaaattggtagaagagggagtacccaaagaacatttagccttattggcagttccaatggttcctttgcagataatactgcctctgattatcagcaaatacactgcaggtccccagccattaaacacattttacaaagccatgccctacagattattgcttgggttagaatatgccctactggtttggtggactcctaaagtagaacatcaagggggattccctatatattactatatcgtagtcctgctgagttatgctttacatcaggttacagtgtacagcatgtatgtttctataatggctttcaatgcaaaggttagtgatccacttattggaggaacatacatgacccttttaaataccgtgtccaatctgggaggaaactggccttctacagtagctctttggcttgtagatcccctcacagtaaaagagtgtgtaggagcatcaaaccagaattgtcgaacacctgatgctgttgagcttgcaaaaaaggcgccgactggatcctcaagcgc

SEQ ID NO: 16712 - DNA, 3753 bp, Homo sapiens
  misc_feature (67)..(67): n is a, c, g, or t
agagaaagtgctctctgccgcattgatagcagcgagagctggaggtgttgggtcgggagaccagccnttcgatcccgccgcaggtaggagctggtttccatcctggcaccacggcacacacctccagcctcgagcccggcgctgctgcccgggggtctccttcaggctctttgacgccgttccagggggcacctatccaggcatcctctgggcctctagccagaggactggctcccggcttcagcactccgggctgcagtaagaagtgcccttatcgctctgagccctgccaccatcccgtgaaccaccgaaaccctggtccagcgcgacagccttggacctgggactggacggatccaaaacgctcagcctcggccccccacagacggggctctgcatcgtctctgatatgtcacccaccatctcccacaaggacagcagccggcaacggcggccagggaatttcagtcactctctggatatgaagagcggtcccctgccgccaggcggttgggatgacagtcatttggactcagcgggccgggaaggggacagagaagctcttctgggggataccggcactggcgacttcttaaaagccccacagagcttccgggccgaactaagcagcattttgctactactctttctttacgtgcttcagggtattcccctgggcttggcgggaagcatcccactcattttgcaaagcaaaaatgttagctatacagaccaagctttcttcagttttgtcttttggcccttcagtctcaaattactctgggccccgttggttgatgcggtctacgttaagaacttcggtcgtcgcaaatcttggcttgtcccgacacagtatatactaggactcttcatgatctatttatccactcaggtggaccgtttgcttgggaataccgatgacagaacacccgacgtgattgctctcactgtggcgttctttttgtttgaattcttggccgccactcaggacattgccgtcgatggttgggcgttaactatgttatccagggaaaatgtgggttatgcttctacttgcaattcggtgggccaaacagcgggttactttttgggcaatgttttgtttttggcccttgaatctgccgacttttgtaacaaatatttgcggtttcagcctcaacccagaggaatcgttactctttcagatttcctttttttctggggaactgtatttttaataacaacaacattggttgcccttctgaaaaaagaaaacgaagtatcagtagtaaaagaagaaacacaagggatcacagatacttacaagctgctttttgcaattataaaaatgccagcagttctgacattttgccttctgattctaactgcaaagattggtttttcagcagcagatgctgtaacaggactgaaattggtagaagagggagtacccaaagaacatttagccttattggcagttccaatggttcctttgcagataatactgcctctgattatcagcaaatacactgcaggtccccagccattaaacacattttacaaagccatgccctacagattattgcttgggttagaatatgccctactggtttggtggactcctaaagtagaacatcaagggggattccctatatattactatatcgtagtcctgctgagttatgctttacatcaggttacagtgtacagcatgtatgtttctataatggctttcaatgcaaaggttagtgatccacttattggaggaacatacatgacccttttaaataccgtgtccaatctgggaggaaactggccttctacagtagctctttggcttgtagatcccctcacagtaaaagagtgtgtaggagcatcaaaccagaattgtcgaacacctgatgctgttgagctttgcaaaaaactgggtggctcatgtgttacagccctggatggttattatgtggagtccattatttgtgttttcattggatttggttggtggttctttcttggtccaaaatttaaaaagttacaggatgaaggatcatcttcgtggaaatgcaaaaggaacaattaatatatatgctactggacattctagcaaggtaattgtagtttagttttaattcggagagcaatgataatcagtgcacaggagtataaaatattattttaaacagcgaaattaataatataaaatgccaaatggttgaaaaaatagaaacctttctgtatatttgatcatattttttttttgccttgtcaatgtatttaaagtttacttaaggtcaggaaattctaaaacaacttttctggccttgttatttgatgtatatcttttaaatttactgaccaaagcatgttttaagctgcaatgcagtagtcacgggtggtaaccatgtagtcaggtattgttattagtacctatcactgctgagctgtatttaaaattttggtacaatatataaaatggagaagagcttgatattcaggtactaaccacaactagtctgacattgttggcagttaaaatcttattttgaattgtaaattagttaaattttatgtggaatttgctgagaaaagaatatagactactgaaatgtcattttagttatttttcttatgaccacattgtacaaatgaatctgtgttaaaaagactattttaaatgtatttcctgcttttgtaagcattaaagatttataagaaaattattcaaactattttttataaaatgaaagttatgatttttaaacttattgattcctcttgcccctaccccctctttttggaagatattttgattccttataaacttttaccctaagcttatatatgttttctgtcacaagtgcttcctggcacacagacagccaatggaggggatcaaattcagtgttgtatgtatgtttatggcaacattttgaaaataaaaattaaatgtttttcttcaagtagtttttttttaattgctgagagaaaaaaacagtaaagctttctgattaagtaaaatttaaatgggcagtaccataatttaaaaaactaatactttaaagagagagacaaagatattttgtgcctttgacaaattaaatctaatagtggaaaaatgtttcttaattaagcactttactagtgaaaaagatctcacaatttatgccaaatcaggtactgtattttcatgtattaacacataaccttttgtttgaatactatagttttcagtggacagttgctattccaagaaaattaagcttttgagtactttagcaattcccagcgtattacatacacccagtgataaggttctttgcatgttttgtgttatgtattactctgactctttagagattatataaatcctccaaaagttagacgaaacaagatagtacattatgagtcttaattttatcattgtggaaaaatgtgtactaactcctgattttgttaattttataacataggttgaattttagagtggggtttttataagtaatggaggataaaatgggtgggagaaaatggcacacagcacctgaagaaagatggggcagtgacctctagaactcatgcattgccattggaaagcctgtgttgggcatcgatgtcagatcctgaagaatcacctggaaaaaatcccatcctagaggcaaggaggctacaccaaaccatacactacagtactttgtcacatggttgtccattatcatgtattagagtctaaatgattacttgaataaagaaaaaaaaccacttaactcttacata

SEQ ID NO: 16713 - DNA, 3741 bp, Homo sapiens
  misc_feature (67)..(67): n is a, c, g, or t
agagaaagtgctctctgccgcattgatagcagcgagagctggaggtgttgggtcgggagaccagccnttcgatcccgccgcaggtaggagctggtttccatcctggcaccacggcacacacctccagcctcgagcccggcgctgctgcccgggggtctccttcaggctctttgacgccgttccagggggcacctatccaggcatcctctgggcctctagccagaggactggctcccggcttcagcactccgggctgcagtaagaagtgcccttatcgctctgagccctgccaccatcccgtgaaccaccgaaaccctggtccagcgcgacagccttggacctgggactggacggatccaaaacgctcagcctcggccccccacagacggggctctgcatcgtctctgatatgtcacccaccatctcccacaaggacagcagccggcaacggcggccagggaatttcagtcactctctggatatgaagagcggtcccctgccgccaggcggttgggatgacagtcatttggactcagcgggccgggaaggggacagagaagctcttctgggggataccggcactggcgacttcttaaaagccccacagagcttccgggccgaactaagcagcattttgctactactctttctttacgtgcttcagggtattcccctgggcttggcgggaagcatcccactcattttgcaaagcaaaaatgttagctatacagaccaagctttcttcagttttgtcttttggcccttcagtctcaaattactctgggccccgttggttgatgcggtctacgttaagaacttcggtcgtcgcaaatcttggcttgtcccgacacagtatatactaggactcttcatgatctatttatccactcaggtggaccgtttgcttgggaataccgatgacagaacacccgacgtgattgctctcactgtggcgttctttttgtttgaattcttggccgccactcaggacattgccgtcgatggttgggcgttaactatgttatccagggaaaatgtgggttatgcttctacttgcaattcggtgggccaaacagcgggttactttttgggcaatgttttgtttttggcccttgaatctgccgacttttgtaacaaatatttgcggtttcagcctcaacccagaggaatcgttactctttcagatttcctttttttctggggaactgtatttttaataacaacaacattggttgcccttctgaaaaaagaaaacgaagtatcagtagtaaaagaagaaacacaagggatcacagatacttacaagctgctttttgcaattataaaaatgccagcagttctgacattttgccttctgattctaactgcaaagattggtttttcagcagcagatgctgtaacaggactgaaattggtagaagagggagtacccaaagaacatttagccttattggcagttccaatggttcctttgcagataatactgcctctgattatcagcaaatacactgcaggtccccagccattaaacacattttacaaagccatgccctacagattattgcttgggttagaatatgccctactggtttggtggactcctaaagtagaacatcaagggggattccctatatattactatatcgtagtcctgctgagttatgctttacatcaggttacagtgtacagcatgtatgtttctataatggctttcaatgcaaaggttagtgatccacttattggaggaacatacatgacccttttaaataccgtgtccaatctgggaggaaactggccttctacagtagctctttggcttgtagatcccctcacagtaaaagagtgtgtaggagcatcaaaccagaattgtcgaacacctgatgctgttgagctttgcaaaaaactgggtggctcatgtgttacagccctggatggttattatgtggagtccattatttgtgttttcattggatttggttggtggttctttcttggtccaaaatttaaaaagttacaggatgaaggatcatcttcgtggaaatgcaaaaggaacaattaatatatatgctactggacattctagcaaggtaattgtagtttagttttaattcggagagcaatgataatcagtgcacaggagtataaaatattattttaaacagcgaaattaataatataaaatgccaaatggttgaaaaaatagaaacctttctgtatatttgatcatattttttttttgccttgtcaatgtatttaaagtttacttaaggtcaggaaattctaaaacaacttttctggccttgttatttgatgtatatcttttaaatttactgaccaaagcatgttttaagctgcaatgcagtagtcacgggtggtaaccatgtagtcaggtattgttattagtacctatcactgctgagctgtatttaaaattttggtacaatatataaaatggagaagagcttgatattcaggtactaaccacaactagtctgacattgttggcagttaaaatcttattttgaattgtaaattagttaaattttatgtggaatttgctgagaaaagaatatagactactgaaatgtcattttagttatttttcttatgaccacattgtacaaatgaatctgtgttaaaaagactattttaaatgtatttcctgcttttgtaagcattaaagatttataagaaaattattcaaactattttttataaaatgaaagttatgatttttaaacttattgattcctcttgcccctaccccctctttttggaagatattttgattccttataaacttttaccctaagcttatatatgttttctgtcacaagtgcttcctggcacacagacagccaatggaggggatcaaattcagtgttgtatgtatgtttatggcaacattttgaaaataaaaattaaatgtttttcttcaagtagtttttttttaattgctgagagaaaaaaacagtaaagctttctgattaagtaaaatttaaatgggcagtaccataatttaaaaaactaatactttaaagagagagacaaagatattttgtgcctttgacaaattaaatctaatagtggaaaaatgtttcttaattaagcactttactagtgaaaaagatctcacaatttatgccaaatcaggtactgtattttcatgtattaacacataaccttttgtttgaatactatagttttcagtggacagttgctattccaagaaaattaagcttttgagtactttagcaattcccagcgtattacatacacccagtgataaggttctttgcatgttttgtgttatgtattactctgactctttagagattatataaatcctccaaaagttagacgaaacaagatagtacattatgagtcttaattttatcattgtggaaaaatgtgtactaactcctgattttgttaattttataacataggttgaattttagagtggggtttttataagtaatggaggataaaatgggtgggagaaaatggcacacagcacctgaagaaagatggggcagtgacctctagaactcatgcattgccattggaaagcctgtgttgggcatcgatgtcagatcctgaagaatcacctggaaaaaatcccatcctagaggcaaggaggctacaccaaaccatacactacagtactttgtcacatggttttctttattcaagtaatcatttagactctaatacatgataatggacaaccagtcgacg

SEQ ID NO: 16714 - DNA, 2938 bp, Homo sapiens
  misc_feature (67)..(67): n is a, c, g, or t
agagaaagtgctctctgccgcattgatagcagcgagagctggaggtgttgggtcgggagaccagccnttcgatcccgccgcaggtaggagctggtttccatcctggcaccacggcacacacctccagcctcgagcccggcgctgctgcccgggggtctccttcaggctctttgacgccgttccagggggcacctatccaggcatcctctgggcctctagccagaggactggctcccggcttcagcactccgggctgcagtaagaagtgcccttatcgctctgagccctgccaccatcccgtgaaccaccgaaaccctggtccagcgcgacagccttggacctgggactggacggatccaaaacgctcagcctcggccccccacagacggggctctgcatcgtctctgatatgtcacccaccatctcccacaaggacagcagccggcaacggcggccagggaatttcagtcactctctggatatgaagagcggtcccctgccgccaggcggttgggatgacagtcatttggactcagcgggccgggaaggggacagagaagctcttctgggggataccggcactggcgacttcttaaaagccccacagagcttccgggccgaactaagcagcattttgctactactctttctttacgtgcttcagggtattcccctgggcttggcgggaagcatcccactcattttgcaaagcaaaaatgttagctatacagaccaagctttcttcagttttgtcttttggcccttcagtctcaaattactctgggccccgttggttgatgcggtctacgttaagaacttcggtcgtcgcaaatcttggcttgtcccgacacagtatatactaggactcttcatgatctatttatccactcaggtggaccgtttgcttgggaataccgatgacagaacacccgacgtgattgctctcactgtggcgttctttttgtttgaattcttggccgccactcaggacattgccgtcgatggttgggcgttaactatgttatccagggaaaatgtgggttatgcttctacttgcaattcggtgggccaaacagcgggttactttttgggcaatgttttgtttttggcccttgaatctgccgacttttgtaacaaatatttgcggtttcagcctcaacccagaggaatcgttactctttcagatttcctttttttctggggaactgtatttttaataacaacaacattggttgcccttctgaaaaaagaaaacgaagtatcagtagtaaaagaagaaacacaagggatcacagatacttacaagctgctttttgcaattataaaaatgccagcagttctgacattttgccttctgattctaactgcaaagattggtttttcagcagcagatgctgtaacaggactgaaattggtagaagagggagtacccaaagaacatttagccttattggcagttccaatggttcctttgcagataatactgcctctgattatcagcaaatacactgcaggtccccagccattaaacacattttacaaagccatgccctacagattattgcttgggttagaatatgccctactggtttggtggactcctaaagtagaacatcaagggggattccctatatattactatatcgtagtcctgctgagttatgctttacatcaggttacagtgtacagcatgtatgtttctataatggctttcaatgcaaaggttagtgatccacttattggaggaacatacatgacccttttaaataccgtgtccaatctgggaggaaactggccttctacagtagctctttggcttgtagatcccctcacagtaaaagagtgtgtaggagcatcaaaccagaattgtcgaacacctgatgctgttgagctttgcaaaaaactgggtggctcatgtgttacagccctggatggttattatgtggagtccattatttgtgttttcattggatttggttggtggttctttcttggtccaaaatttaaaaagttacaggatgaaggatcatcttcgtggaaatgcaaaaggaacaattaatatatatgctactggacattctagcaaggtaattgtagtttagttttaattcggagagcaatgataatcagtgcacaggagtataaaatattattttaaacagcgaaattaataatataaaatgccaaatggttgaaaaaatagaaacctttctgtatatttgatcatattttttttttgccttgtcaatgtatttaaagtttacttaaggtcaggaaattctaaaacaacttttctggccttgttatttgatgtatatcttttaaatttactgaccaaagcatgttttaagctgcaatgcagtagtcacgggtggtaaccatgtagtcaggtattgttattagtacctatcactgctgagctgtatttaaaattttggtacaatatataaaatggagaagagcttgatattcaggtactaaccacaactagtctgacattgttggcagttaaaatcttattttgaattgtaaattagttaaattttatgtggaatttgctgagaaaagaatatagactactgaaatgtcattttagttatttttcttatgaccacattgtacaaatgaatctgtgttaaaaagactattttaaatgtatttcctgcttttgtaagcattaaagatttataagaaaattattcaaactattttttataaaatgaaagttatgatttttaaacttattgattcctcttgcccctaccccctctttttggaagatattttgattccttataaacttttaccctaagcttatatatgttttctgtcacaagtgcttcctggcacacagacagccaatggaggggatcaaattcagtgttgtatgtatgtttatggcaacattttgaaaataaaaattaaatgtttttcttca

SEQ ID NO: 16715 - DNA, 3450 bp, Homo sapiens
  misc_feature (67)..(67): n is a, c, g, or t
agagaaagtgctctctgccgcattgatagcagcgagagctggaggtgttgggtcgggagaccagccnttcgatcccgccgcaggtaggagctggtttccatcctggcaccacggcacacacctccagcctcgagcccggcgctgctgcccgggggtctccttcaggctctttgacgccgttccagggggcacctatccaggcatcctctgggcctctagccagaggactggctcccggcttcagcactccgggctgcagtaagaagtgcccttatcgctctgagccctgccaccatcccgtgaaccaccgaaaccctggtccagcgcgacagccttggacctgggactggacggatccaaaacgctcagcctcggccccccacagacggggctctgcatcgtctctgatatgtcacccaccatctcccacaaggacagcagccggcaacggcggccagggaatttcagtcactctctggatatgaagagcggtcccctgccgccaggcggttgggatgacagtcatttggactcagcgggccgggaaggggacagagaagctcttctgggggataccggcactggcgacttcttaaaagccccacagagcttccgggccgaactaagcagcattttgctactactctttctttacgtgcttcagggtattcccctgggcttggcgggaagcatcccactcattttgcaaagcaaaaatgttagctatacagaccaagctttcttcagttttgtcttttggcccttcagtctcaaattactctgggccccgttggttgatgcggtctacgttaagaacttcggtcgtcgcaaatcttggcttgtcccgacacagtatatactaggactcttcatgatctatttatccactcaggtggaccgtttgcttgggaataccgatgacagaacacccgacgtgattgctctcactgtggcgttctttttgtttgaattcttggccgccactcaggacattgccgtcgatggttgggcgttaactatgttatccagggaaaatgtgggttatgcttctacttgcaattcggtgggccaaacagcgggttactttttgggcaatgttttgtttttggcccttgaatctgccgacttttgtaacaaatatttgcggtttcagcctcaacccagaggaatcgttactctttcagatttcctttttttctggggaactgtatttttaataacaacaacattggttgcccttctgaaaaaagaaaacgaagtatcagtagtaaaagaagaaacacaagggatcacagatacttacaagctgctttttgcaattataaaaatgccagcagttctgacattttgccttctgattctaactgcaaaggttacagtgtacagcatgtatgtttctataatggctttcaatgcaaaggttagtgatccacttattggaggaacatacatgacccttttaaataccgtgtccaatctgggaggaaactggccttctacagtagctctttggcttgtagatcccctcacagtaaaagagtgtgtaggagcatcaaaccagaattgtcgaacacctgatgctgttgagctttgcaaaaaactgggtggctcatgtgttacagccctggatggttattatgtggagtccattatttgtgttttcattggatttggttggtggttctttcttggtccaaaatttaaaaagttacaggatgaaggatcatcttcgtggaaatgcaaaaggaacaattaatatatatgctactggacattctagcaaggtaattgtagtttagttttaattcggagagcaatgataatcagtgcacaggagtataaaatattattttaaacagcgaaattaataatataaaatgccaaatggttgaaaaaatagaaacctttctgtatatttgatcatattttttttttgccttgtcaatgtatttaaagtttacttaaggtcaggaaattctaaaacaacttttctggccttgttatttgatgtatatcttttaaatttactgaccaaagcatgttttaagctgcaatgcagtagtcacgggtggtaaccatgtagtcaggtattgttattagtacctatcactgctgagctgtatttaaaattttggtacaatatataaaatggagaagagcttgatattcaggtactaaccacaactagtctgacattgttggcagttaaaatcttattttgaattgtaaattagttaaattttatgtggaatttgctgagaaaagaatatagactactgaaatgtcattttagttatttttcttatgaccacattgtacaaatgaatctgtgttaaaaagactattttaaatgtatttcctgcttttgtaagcattaaagatttataagaaaattattcaaactattttttataaaatgaaagttatgatttttaaacttattgattcctcttgcccctaccccctctttttggaagatattttgattccttataaacttttaccctaagcttatatatgttttctgtcacaagtgcttcctggcacacagacagccaatggaggggatcaaattcagtgttgtatgtatgtttatggcaacattttgaaaataaaaattaaatgtttttcttcaagtagtttttttttaattgctgagagaaaaaaacagtaaagctttctgattaagtaaaatttaaatgggcagtaccataatttaaaaaactaatactttaaagagagagacaaagatattttgtgcctttgacaaattaaatctaatagtggaaaaatgtttcttaattaagcactttactagtgaaaaagatctcacaatttatgccaaatcaggtactgtattttcatgtattaacacataaccttttgtttgaatactatagttttcagtggacagttgctattccaagaaaattaagcttttgagtactttagcaattcccagcgtattacatacacccagtgataaggttctttgcatgttttgtgttatgtattactctgactctttagagattatataaatcctccaaaagttagacgaaacaagatagtacattatgagtcttaattttatcattgtggaaaaatgtgtactaactcctgattttgttaattttataacataggttgaattttagagtggggtttttataagtaatggaggataaaatgggtgggagaaaatggcacacagcacctgaagaaagatggggcagtgacctctagaactcatgcattgccattggaaagcctgtgttgggcatcgatgtcagatcctgaagaatcacctggaaaaaatcccatcctagaggcaaggaggctacaccaaaccatacactacagtactttgtcacatggttgtccattatcatgtattagagtctaaatgattacttgaataaagaaaaaaaaccacttaactcttacata

SEQ ID NO: 16716 - DNA, 1460 bp, Homo sapiens
cggacgcgtgggtcgcggacgcgtgggtttaaatttactgaccaaagcatgttttaagctgcaatgcagtagtcacgggtggtaaccatgtagtcaggtattgttattagtacctatcactgctgagctgtatttaaaattttggtacaatatataaaatggagaagagcttgatattcaggtactaaccacaactagtctgacattgttggcagttaaaatcttattttgaattgtaaattagttaaattttatgtggaatttgctgagaaaagaatatagactactgaaatgtcattttagttatttttcttatgaccacattgtacaaatgaatctgtgttaaaaagactattttaaatgtatttcctgcttttgtaagcattaaagatttataagaaaattattcaaactattttttataaaatgaaagttatgatttttaaacttattgattcctcttgcccctaccccctctttttggaagatattttgattccttataaacttttaccctaagcttatatatgttttctgtcacaagtgcttcctggcacacagacagccaatggaggggatcaaattcagtgttgtatgtatgtttatggcaacattttgaaaataaaaattaaatgtttttcttcaagtagtttttttttaattgctgagagaaaaaaacagtaaagctttctgattaagtaaaatttaaatgggcagtaccataatttaaaaaactaatactttaaagagagagacaaagatattttgtgcctttgacaaattaaatctaatagtggaaaaatgtttcttaattaagcactttactagtgaaaaagatctcacaatttatgccaaatcaggtactgtattttcatgtattaacacataaccttttgtttgaatactatagttttcagtggacagttgctattccaagaaaattaagcttttgagtactttagcaattcccagcgtattacatacacccagtgataaggttctttgcatgttttgtgttatgtattactctgactctttagagattatataaatcctccaaaagttagacgaaacaagatagtacattatgagtcttaattttatcattgtggaaaaatgtgtactaactcctgattttgttaattttataacataggttgaattttagagtggggtttttataagtaatggaggataaaatgggtgggagaaaatggcacacagcacctgaagaaagatggggcagtgacctctagaactcatgcattgccattggaaagcctgtgttgggcatcgatgtcagatcctgaagaatcacctggaaaaaatcccatcctagaggcaaggaggctacaccaaaccatacactacagtactttgtcacatggttgtccattatcatgtattagagtctaaatgattacttgaataaagaaaaaaaaccacttaactcttacata

SEQ ID NO: 16717 - DNA, 1926 bp, Homo sapiens
  misc_feature (67)..(67): n is a, c, g, or t
agagaaagtgctctctgccgcattgatagcagcgagagctggaggtgttgggtcgggagaccagccnttcgatcccgccgcaggtaggagctggtttccatcctggcaccacggcacacacctccagcctcgagcccggcgctgctgcccgggggtctccttcaggctctttgacgccgttccagggggcacctatccaggcatcctctgggcctctagccagaggactggctcccggcttcagcactccgggctgcagtaagaagtgcccttatcgctctgagccctgccaccatcccgtgaaccaccgaaaccctggtccagcgcgacagccttggacctgggactggacggatccaaaacgctcagcctcggccccccacagacggggctctgcatcgtctctgatatgtcacccaccatctcccacaaggacagcagccggcaacggcggccagggaatttcagtcactctctggatatgaagagcggtcccctgccgccaggcggttgggatgacagtcatttggactcagcgggccgggaaggggacagagaagctcttctgggggataccggcactggcgacttcttaaaagccccacagagcttccgggccgaactaagcagcattttgctactactctttctttacgtgcttcagggtattcccctgggcttggcgggaagcatcccactcattttgcaaagcaaaaatgttagctatacagaccaagctttcttcagttttgtcttttggcccttcagtctcaaattactctgggccccgttggttgatgcggtctacgttaagaacttcggtcgtcgcaaatcttggcttgtcccgacacagtatatactaggactcttcatgatctatttatccactcaggtggaccgtttgcttgggaataccgatgacagaacacccgacgtgattgctctcactgtggcgttctttttgtttgaattcttggccgccactcaggacattgccgtcgatggttgggcgttaactatgttatccagggaaaatgtgggttatgcttctacttgcaattcggtgggccaaacagcgggttactttttgggcaatgttttgtttttggcccttgaatctgccgacttttgtaacaaatatttgcggtttcagcctcaacccagaggaatcgttactctttcagatttcctttttttctggggaactgtatttttaataacaacaacattggttgcccttctgaaaaaagaaaacgaagtatcagtagtaaaagaagaaacacaagggatcacagatacttacaagctgctttttgcaattataaaaatgccagcagttctgacattttgccttctgattctaactgcaaagattggtttttcagcagcagatgctgtaacaggactgaaattggtagaagagggagtacccaaagaacatttagccttattggcagttccaatggttcctttgcagataatactgcctctgattatcagcaaatacactgcaggtccccagccattaaacacattttacaaagccatgccctacagattattgcttgggttagaatatgccctactggtttggtggactcctaaagtagaacatcaagggggattccctatatattactatatcgtagtcctgctgagttatgctttacatcaggttacagtgtacagcatgtatgtttctataatggctttcaatgcaaaggttagtgatccacttattggaggaacatacatgacccttttaaataccgtgtccaatctgggaggaaactggccttctacagtagctctttggcttgtagatcccctcacagtaaaagagtgtgtaggagcatcaaaccagaattgtcgaacacctgatgctgttgagcttgcaaaaaaggcgccgactggatcctcaagcgc

SEQ ID NO: 16718 - DNA, 391 bp, Homo sapiens
aaaatgtagaaattaatggggcatggtggtgcacgcctgtggtcttatctactcacaaggctgaggtgggaggattgcttgagcccaggagccagagaccgcagtgagccattatcacaccactgcatttcagccggggccacaagtgagaccgtgtctcaaaaaagaaaatgagtattgtttacagcaagaactgaaaattgtttttaatcctgttagtagcattagagagattaagatacattaacatattttgtcattggaattcagtgaaatactgaaatgttttaagaaaaatatatttttattctttataaagtagaagcatgttaattgctaaatactttcattttgaaattgtggagtatttattatagttttatttttacag

SEQ ID NO: 16719 - DNA, 2391 bp, Homo sapiens
  misc_feature (67)..(67): n is a, c, g, or t
agagaaagtgctctctgccgcattgatagcagcgagagctggaggtgttgggtcgggagaccagccnttcgatcccgccgcaggtaggagctggtttccatcctggcaccacggcacacacctccagcctcgagcccggcgctgctgcccgggggtctccttcaggctctttgacgccgttccagggggcacctatccaggcatcctctgggcctctagccagaggactggctcccggcttcagcactccgggctgcagtaagaagtgcccttatcgctctgagccctgccaccatcccgtgaaccaccgaaaccctggtccagcgcgacagccttggacctgggactggacggatccaaaacgctcagcctcggccccccacagacggggctctgcatcgtctctgatatgtcacccaccatctcccacaaggacagcagccggcaacggcggccagggaatttcagtcactctctggatatgaagagcggtcccctgccgccaggcggttgggatgacagtcatttggactcagcgggccgggaaggggacagagaagctcttctgggggataccggcactggcgacttcttaaaagccccacagagcttccgggccgaactaagcagcattttgctactactctttctttacgtgcttcagggtattcccctgggcttggcgggaagcatcccactcattttgcaaagcaaaaatgttagctatacagaccaagctttcttcagttttgtcttttggcccttcagtctcaaattactctgggccccgttggttgatgcggtctacgttaagaacttcggtcgtcgcaaatcttggcttgtcccgacacagtatatactaggactcttcatgatctatttatccactcaggtggaccgtttgcttgggaataccgatgacagaacacccgacgtgattgctctcactgtggcgttctttttgtttgaattcttggccgccactcaggacattgccgtcgatggttgggcgttaactatgttatccagggaaaatgtgggttatgcttctacttgcaattcggtgggccaaacagcgggttactttttgggcaatgttttgtttttggcccttgaatctgccgacttttgtaacaaatatttgcggtttcagcctcaacccagaggaatcgttactctttcagatttcctttttttctggggaactgtatttttaataacaacaacattggttgcccttctgaaaaaagaaaacgaagtatcagtagtaaaagaagaaacacaagggatcacagatacttacaagctgctttttgcaattataaaaatgccagcagttctgacattttgccttctgattctaactgcaaagattggtttttcagcagcagatgctgtaacaggactgaaattggtagaagagggagtacccaaagaacatttagccttattggcagttccaatggttcctttgcagataatactgcctctgattatcagcaaatacactgcaggtccccagccattaaacacattttacaaagccatgccctacagattattgcttgggttagaatatgccctactggtttggtggactcctaaagtagaacatcaagggggattccctatatattactatatcgtagtcctgctgagttatgctttacatcaggttacagtgtacagcatgtatgtttctataatggctttcaatgcaaaggttagtgatccacttattggaggaacatacatgacccttttaaataccgtgtccaatctgggaggaaactggccttctacagtagctctttggcttgtagatcccctcacagtaaaagagtgtgtaggagcatcaaaccagaattgtcgaacacctgatgctgttgagctttgcaaaaaactgggtggctcatgtgttacagccctggatggttattatgtggagtccattatttgtgttttcattggatttggttggtggttctttcttggtccaaaatttaaaaagttacaggatgaaggatcatcttcgtggaaatgcaaaaggaacaattaatatatatgctactggacattctagcaaggttgaattttagagtggggtttttataagtaatggaggataaaatgggtgggagaaaatggcacacagcacctgaagaaagatggggcagtgacctctagaactcatgcattgccattggaaagcctgtgttgggcatcgatgtcagatcctgaagaatcacctggaaaaaatcccatcctagaggcaaggaggctacaccaaaccatacactacagtactttgtcacatggttgtccattatcatgtattagagtctaaatgattacttgaataaagaaaaaaaaccacttaactcttacata

SEQ ID NO: 16720 - DNA, 3786 bp, Homo sapiens
  misc_feature (67)..(67): n is a, c, g, or t
agagaaagtgctctctgccgcattgatagcagcgagagctggaggtgttgggtcgggagaccagccnttcgatcccgccgcaggtaggagctggtttccatcctggcaccacggcacacacctccagcctcgagcccggcgctgctgcccgggggtctccttcaggctctttgacgccgttccagggggcacctatccaggcatcctctgggcctctagccagaggactggctcccggcttcagcactccgggctgcagtaagaagtgcccttatcgctctgagccctgccaccatcccgtgaaccaccgaaaccctggtccagcgcgacagccttggacctgggactggacggatccaaaacgctcagcctcggccccccacagacggggctctgcatcgtctctgatatgtcacccaccatctcccacaaggacagcagccggcaacggcggccagggaatttcagtcactctctggatatgaagagcggtcccctgccgccaggcggttgggatgacagtcatttggactcagcgggccgggaaggggacagagaagctcttctgggggataccggcactggcgacttcttaaaagccccacagagcttccgggccgaactaagcagcattttgctactactctttctttacgtgcttcagggtattcccctgggcttggcgggaagcatcccactcattttgcaaagcaaaaatgttagctatacagaccaagctttcttcagttttgtcttttggcccttcagtctcaaattactctgggccccgttggttgatgcggtctacgttaagaacttcggtcgtcgcaaatcttggcttgtcccgacacagtatatactaggactcttcatgatctatttatccactcaggtggaccgtttgcttgggaataccgatgacagaacacccgacgtgattgctctcactgtggcgttctttttgtttgaattcttggccgccactcaggacattgccgtcgatggttgggcgttaactatgttatccagggaaaatgtgggttatgcttctacttgcaattcggtgggccaaacagcgggttactttttgggcaatgttttgtttttggcccttgaatctgccgacttttgtaacaaatatttgcggtttcagcctcaacccagaggaatcgttactctttcagatttcctttttttctggggaactgtatttttaataacaacaacattggttgcccttctgaaaaaagaaaacgaagtatcagtagtaaaagaagaaacacaagggatcacagatacttacaagctgctttttgcaattataaaaatgccagcagttctgacattttgccttctgattctaactgcaaagattggtttttcagcagcagatgctgtaacaggactgaaattggtagaagagggagtacccaaagaacatttagccttattggcagttccaatggttcctttgcagataatactgcctctgattatcagcaaatacactgcaggtccccagccattaaacacattttacaaagccatgccctacagattattgcttgggttagaatatgccctactggtttggtggactcctaaagtagaacatcaagggggattccctatatattactatatcgtagtcctgctgagttatgctttacatcaggttacagtgtacagcatgtatgtttctataatggctttcaatgcaaaggttagtgatccacttattggaggaacatacatgacccttttaaataccgtgtccaatctgggaggaaactggccttctacagtagctctttggcttgtagatcccctcacagtaaaagagtgtgtaggagcatcaaaccagaattgtcgaacacctgatgctgttgagctttgcaaaaaactgggtggctcatgtgttacagccctggatggttattatgtggagtccattatttgtgttttcattggatttggttggtggttctttcttggtccaaaatttaaaaagttacaggatgaaggatcatcttcgtggaaatgcaaaaggaacaattaatatatatgctactggacattctagcaaggtaattgtagtttagttttaattcggagagcaatgataatcagtgcacaggagtataaaatattattttaaacagcgaaattaataatataaaatgccaaatggttgaaaaaatagaaacctttctgtatatttgatcatattttttttttgccttgtcaatgtatttaaagtttacttaaggtcaggaaattctaaaacaacttttctggccttgttatttgatgtatatcttttaaatttactgaccaaagcatgttttaagctgcaatgcagtagtcacgggtggtaaccatgtagtcaggtattgttattagtacctatcactgctgagctgtatttaaaattttggtacaatatataaaatggagaagagcttgatattcaggtactaaccacaactagtctgacattgttggcagttaaaatcttattttgaattgtaaattagttaaattttatgtggaatttgctgagaaaagaatatagactactgaaatgtcattttagttatttttcttatgaccacattgtacaaatgaatctgtgttaaaaagactattttaaatgtatttcctgcttttgtaagcattaaagatttataagaaaattattcaaactattttttataaaatgaaagttatgatttttaaacttattgattcctcttgcccctaccccctctttttggaagatattttgattccttataaacttttaccctaagcttatatatgttttctgtcacaagtgcttcctggcacacagacagccaatggaggggatcaaattcagtgttgtatgtatgtttatggcaacattttgaaaataaaaattaaatgtttttcttcaagtagtttttttttaattgctgagagaaaaaaacagtaaagctttctgattaagtaaaatttaaatgggcagtaccataatttaaaaaactaatactttaaagagagagacaaagatattttgtgcctttgacaaattaaatctaatagtggaaaaatgtttcttaattaagcactttactagtgaaaaagatctcacaatttatgccaaatcaggtactgtattttcatgtattaacacataaccttttgtttgaatactatagttttcagtggacagttgctattccaagaaaattaagcttttgagtactttagcaattcccagcgtattacatacacccagtgataaggttctttgcatgttttgtgttatgtattactctgactctttagagattatataaatcctccaaaagttagacgaaacaagatagtacattatgagtcttaattttatcattgtggaaaaatgtgtactaactcctgattttgttaattttataacataggttgaattttagagtggggtttttataagtaatggaggataaaatgggtgggagaaaatggcacacagcacctgaagaaagatggggcagtgacctctagaactcatgcattgccattggaaagcctgtgttgggcatcgatgtcagatcctgaagaatcacctggaaaaaatcccatcctagaggcaaggaggctacaccaaaccatacactacagtactttgtcacatggttgtccattatcatgtattagagtctaaatgattacttgaataaagaaaaaaaaccacttaactcttacataacacaaccacaaacaacaaacacaacaaaaaaa

SEQ ID NO: 16721 - DNA, 3610 bp, Homo sapiens
  misc_feature (67)..(67): n is a, c, g, or t
agagaaagtgctctctgccgcattgatagcagcgagagctggaggtgttgggtcgggagaccagccnttcgatcccgccgcaggtaggagctggtttccatcctggcaccacggcacacacctccagcctcgagcccggcgctgctgcccgggggtctccttcaggctctttgacgccgttccagggggcacctatccaggcatcctctgggcctctagccagaggactggctcccggcttcagcactccgggctgcagtaagaagtgcccttatcgctctgagccctgccaccatcccgtgaaccaccgaaaccctggtccagcgcgacagccttggacctgggactggacggatccaaaacgctcagcctcggccccccacagacggggctctgcatcgtctctgatatgtcacccaccatctcccacaaggacagcagccggcaacggcggccagggaatttcagtcactctctggatatgaagagcggtcccctgccgccaggcggttgggatgacagtcatttggactcagcgggccgggaaggggacagagaagctcttctgggggataccggcactggcgacttcttaaaagccccacagagcttccgggccgaactaagcagcattttgctactactctttctttacgtgcttcagggtattcccctgggcttggcgggaagcatcccactcattttgcaaagcaaaaatgttagctatacagaccaagctttcttcagttttgtcttttggcccttcagtctcaaattactctgggccccgttggttgatgcggtctacgttaagaacttcggtcgtcgcaaatcttggcttgtcccgacacagtatatactaggactcttcatgatctatttatccactcaggtggaccgtttgcttgggaataccgatgacagaacacccgacgtgattgctctcactgtggcgttctttttgtttgaattcttggccgccactcaggacattgccgtcgatggttgggcgttaactatgttatccagggaaaatgtgggttatgcttctacttgcaattcggtgggccaaacagcgggttactttttgggcaatgttttgtttttggcccttgaatctgccgacttttgtaacaaatatttgcggtttcagcctcaacccagaggaatcgttactctttcagatttcctttttttctggggaactgtatttttaataacaacaacattggttgcccttctgaaaaaagaaaacgaagtatcagtagtaaaagaagaaacacaagggatcacagatacttacaagctgctttttgcaattataaaaatgccagcagttctgacattttgccttctgattctaactgcaaagattggtttttcagcagcagatgctgtaacaggactgaaattggtagaagagggagtacccaaagaacatttagccttattggcagttccaatggttcctttgcagataatactgcctctgattatcagcaaatacactgcaggtccccagccattaaacacattttacaaagccatgccctacagattattgcttgggttagaatatgccctactggtttggtggactcctaaagtagaacatcaagggggattccctatatattactatatcgtagtcctgctgagttatgctttacatcaggttacagtgtacagcatgtatgtttctataatggctttcaatgcaaaggttagtgatccacttattggaggaacatacatgacccttttaaataccgtgtccaatctgggaggaaactggccttctacagtagctctttggcttgtagatcccctcacagtaaaagagtgtgtaggagcatcaaaccagaattgtcgaacacctgatgctgttgagctttgcaaaaaactgggtggctcatgtgttacagccctggatggttattatgtggagtccattatttgtgttttcattggatttggttggtggttctttcttggtccaaaatttaaaaagttacaggatgaaggatcatcttcgtggaaatgcaaaaggaacaattaatatatatgctactggacattctagcaaggtaattgtagtttagttttaattcggagagcaatgataatcagtgcacaggagtataaaatattattttaaacagcgaaattaataatataaaatgccaaatggttgaaaaaatagaaacctttctgtatatttgatcatattttttttttgccttgtcaatgtatttaaagtttacttaaggtcaggaaattctaaaacaacttttctggccttgttatttgatgtatatcttttaaatttactgaccaaagcatgttttaagctgcaatgcagtagtcacgggtggtaaccatgtagtcaggtattgttattagtacctatcactgctgagctgtatttaaaattttggtacaatatataaaatggagaagagcttgatattcaggtactaaccacaactagtctgacattgttggcagttaaaatcttattttgaattgtaaattagttaaattttatgtggaatttgctgagaaaagaatatagactactgaaatgtcattttagttatttttcttatgaccacattgtacaaatgaatctgtgttaaaaagactattttaaatgtatttcctgcttttgtaagcattaaagatttataagaaaattattcaaactattttttataaaatgaaagttatgatttttaaacttattgattcctcttgcccctaccccctctttttggaagatattttgattccttataaacttttaccctaagcttatatatgttttctgtcacaagtgcttcctggcacacagacagccaatggaggggatcaaattcagtgttgtatgtatgtttatggcaacattttgaaaataaaaattaaatgtttttcttcaagtagtttttttttaattgctgagagaaaaaaacagtaaagctttctgattaagtaaaatttaaatgggcagtaccataatttaaaaaactaatactttaaagagagagacaaagatattttgtgcctttgacaaattaaatctaatagtggaaaaatgtttcttaattaagcactttactagtgaaaaagatctcacaatttatgccaaatcaggtactgtattttcatgtattaacacataaccttttgtttgaatactatagttttcagtggacagttgctattccaagaaaattaagcttttgagtactttagcaattcccagcgtattacatacacccagtgataaggttctttgcatgttttgtgttatgtattactctgactctttagagattatataaatcctccaaaagttagacgaaacaagatagtacattatgagtcttaattttatcattgtggaaaaatgtgtactaactcctgattttgttaattttataacataggttgaattttagagtggggtttttataagtaatggaggataaaatgggtgggagaatgtgctgagcatatattactacctgaaagagcatagacctcattaactatttatttttctataagatgtataggttgagattttaagtctgaatattttatacat

SEQ ID NO: 16722 - DNA, 2280 bp, Homo sapiens
ttgtttttatattgcagattggtttttcagcagcagatgctgtaacaggactgaaattggtagaagagggagtacccaaagaacatttagccttattggcagttccaatggttcctttgcagataatactgcctctgattatcagcaaatacactgcaggtccccagccattaaacacattttacaaagccatgccctacaggttacagtgtacagcatgtatgtttctataatggctttcaatgcaaaggttagtgatccacttattggaggaacatacatgacccttttaaataccgtgtccaatctgggaggaaactggccttctacagtagctctttggcttgtagatcccctcacagtaaaagagtgtgtaggagcatcaaaccagaattgtcgaacacctgatgctgttgagctttgcaaaaaactgggtggctcatgtgttacagccctggatggttattatgtggagtccattatttgtgttttcattggatttggttggtggttctttcttggtccaaaatttaaaaagttacaggatgaaggatcatcttcgtggaaatgcaaaaggaacaattaatatatatgctactggacattctagcaaggtaattgtagtttagttttaattcggagagcaatgataatcagtgcacaggagtataaaatattattttaaacagcgaaattaataatataaaatgccaaatggttgaaaaaatagaaacctttctgtatatttgatcatattttttttttgccttgtcaatgtatttaaagtttacttaaggtcaggaaattctaaaacaacttttctggccttgttatttgatgtatatcttttaaatttactgaccaaagcatgttttaagctgcaatgcagtagtcacgggtggtaaccatgtagtcaggtattgttattagtacctatcactgctgagctgtatttaaaattttggtacaatatataaaatggagaagagcttgatattcaggtactaaccacaactagtctgacattgttggcagttaaaatcttattttgaattgtaaattagttaaattttatgtggaatttgctgagaaaagaatatagactactgaaatgtcattttagttatttttcttatgaccacattgtacaaatgaatctgtgttaaaaagactattttaaatgtatttcctgcttttgtaagcattaaagatttataagaaaattattcaaactattttttataaaatgaaagttatgatttttaaacttattgattcctcttgcccctaccccctctttttggaagatattttgattccttataaacttttaccctaagcttatatatgttttctgtcacaagtgcttcctggcacacagacagccaatggaggggatcaaattcagtgttgtatgtatgtttatggcaacattttgaaaataaaaattaaatgtttttcttcaagtagtttttttttaattgctgagagaaaaaaacagtaaagctttctgattaagtaaaatttaaatgggcagtaccataatttaaaaaactaatactttaaagagagagacaaagatattttgtgcctttgacaaattaaatctaatagtggaaaaatgtttcttaattaagcactttactagtgaaaaagatctcacaatttatgccaaatcaggtactgtattttcatgtattaacacataaccttttgtttgaatactatagttttcagtggacagttgctattccaagaaaattaagcttttgagtactttagcaattcccagcgtattacatacacccagtgataaggttctttgcatgttttgtgttatgtattactctgactctttagagattatataaatcctccaaaagttagacgaaacaagatagtacattatgagtcttaattttatcattgtggaaaaatgtgtactaactcctgattttgttaattttataacataggttgaattttagagtggggtttttataagtaatggaggataaaatgggtgggagaaaatggcacacagcacctgaagaaagatggggcagtgacctctagaactcatgcattgccattggaaagcctgtgttgggcatcgatgtcagatcctgaagaatcacctggaaaaaatcccatcctagaggcaaggaggctacaccaaaccatacactacagtactttgtcacatggttgtccattatcatgtattagagtctaaatgattacttgaataaagaaaaaaaaccacttaactcttacata

SEQ ID NO: 16723 - DNA, 2088 bp, Homo sapiens
  misc_feature (67)..(67): n is a, c, g, or t
agagaaagtgctctctgccgcattgatagcagcgagagctggaggtgttgggtcgggagaccagccnttcgatcccgccgcaggtaggagctggtttccatcctggcaccacggcacacacctccagcctcgagcccggcgctgctgcccgggggtctccttcaggctctttgacgccgttccagggggcacctatccaggcatcctctgggcctctagccagaggactggctcccggcttcagcactccgggctgcagtaagaagtgcccttatcgctctgagccctgccaccatcccgtgaaccaccgaaaccctggtccagcgcgacagccttggacctgggactggacggatccaaaacgctcagcctcggccccccacagacggggctctgcatcgtctctgatatgtcacccaccatctcccacaaggacagcagccggcaacggcggccagggaatttcagtcactctctggatatgaagagcggtcccctgccgccaggcggttgggatgacagtcatttggactcagcgggccgggaaggggacagagaagctcttctgggggataccggcactggcgacttcttaaaagccccacagagcttccgggccgaactaagcagcattttgctactactctttctttacgtgcttcagggtattcccctgggcttggcgggaagcatcccactcattttgcaaagcaaaaatgttagctatacagaccaagctttcttcagttttgtcttttggcccttcagtctcaaattactctgggccccgttggttgatgcggtctacgttaagaacttcggtcgtcgcaaatcttggcttgtcccgacacagtatatactaggactcttcatgatctatttatccactcaggtggaccgtttgcttgggaataccgatgacagaacacccgacgtgattgctctcactgtggcgttctttttgtttgaattcttggccgccactcaggacattgccgtcgatggttgggcgttaactatgttatccagggaaaatgtgggttatgcttctacttgcaattcggtgggccaaacagcgggttactttttgggcaatgttttgtttttggcccttgaatctgccgacttttgtaacaaatatttgcggtttcagcctcaacccagaggaatcgttactctttcagatttcctttttttctggggaactgtatttttaataacaacaacattggttgcccttctgaaaaaagaaaacgaagtatcagtagtaaaagaagaaacacaagggatcacagatacttacaagctgctttttgcaattataaaaatgccagcagttctgacattttgccttctgattctaactgcaaaggttacagtgtacagcatgtatgtttctataatggctttcaatgcaaaggttagtgatccacttattggaggaacatacatgacccttttaaataccgtgtccaatctgggaggaaactggccttctacagtagctctttggcttgtagatcccctcacagtaaaagagtgtgtaggagcatcaaaccagaattgtcgaacacctgatgctgttgagctttgcaaaaaactgggtggctcatgtgttacagccctggatggttattatgtggagtccattatttgtgttttcattggatttggttggtggttctttcttggtccaaaatttaaaaagttacaggatgaaggatcatcttcgtggaaatgcaaaaggaacaattaatatatatgctactggacattctagcaaggttgaattttagagtggggtttttataagtaatggaggataaaatgggtgggagaaaatggcacacagcacctgaagaaagatggggcagtgacctctagaactcatgcattgccattggaaagcctgtgttgggcatcgatgtcagatcctgaagaatcacctggaaaaaatcccatcctagaggcaaggaggctacaccaaaccatacactacagtactttgtcacatggttgtccattatcatgtattagagtctaaatgattacttgaataaagaaaaaaaaccacttaactcttacata

SEQ ID NO: 16724 - DNA, 1858 bp, Homo sapiens
  misc_feature (67)..(67): n is a, c, g, or t
agagaaagtgctctctgccgcattgatagcagcgagagctggaggtgttgggtcgggagaccagccnttcgatcccgccgcaggtaggagctggtttccatcctggcaccacggcacacacctccagcctcgagcccggcgctgctgcccgggggtctccttcaggctctttgacgccgttccagggggcacctatccaggcatcctctgggcctctagccagaggactggctcccggcttcagcactccgggctgcagtaagaagtgcccttatcgctctgagccctgccaccatcccgtgaaccaccgaaaccctggtccagcgcgacagccttggacctgggactggacggatccaaaacgctcagcctcggccccccacagacggggctctgcatcgtctctgatatgtcacccaccatctcccacaaggacagcagccggcaacggcggccagggaatttcagtcactctctggatatgaagagcggtcccctgccgccaggcggttgggatgacagtcatttggactcagcgggccgggaaggggacagagaagctcttctgggggataccggcactggcgacttcttaaaagccccacagagcttccgggccgaactaagcagcattttgctactactctttctttacgtgcttcagggtattcccctgggcttggcgggaagcatcccactcattttgcaaagcaaaaatgttagctatacagaccaagctttcttcagttttgtcttttggcccttcagtctcaaattactctgggccccgttggttgatgcggtctacgttaagaacttcggtcgtcgcaaatcttggcttgtcccgacacagtatatactaggactcttcatgatctatttatccactcaggtggaccgtttgcttgggaataccgatgacagaacacccgacgtgattgctctcactgtggcgttctttttgtttgaattcttggccgccactcaggacattgccgtcgatggttgggcgttaactatgttatccagggaaaatgtgggttatgcttctacttgcaattcggtgggccaaacagcgggttactttttgggcaatgttttgtttttggcccttgaatctgccgacttttgtaacaaatatttgcggtttcagcctcaacccagaggaatcgttactctttcagatttcctttttttctggggaactgtatttttaataacaacaacattggttgcccttctgaaaaaagaaaacgaagtatcagtagtaaaagaagaaacacaagggatcacagatacttacaagctgctttttgcaattataaaaatgccagcagttctgacattttgccttctgattctaactgcaaaggttacagtgtacagcatgtatgtttctataatggctttcaatgcaaaggttagtgatccacttattggaggaacatacatgacccttttaaataccgtgtccaatctgggaggaaactggccttctacagtagctctttggcttgtagatcccctcacagtaaaagagtgtgtaggagcatcaaaccagaattgtcgaacacctgatgctgttgagctttgcaaaaaactgggtggctcatgtgttacagccctggatggttattatgtggagtccattatttgtgttttcattggatttggttggtggttctttcttggtccaaaatttaaaaagttacaggatgaaggatcatcttcgtggaaatgcaaaaggaacaattaatatatatgactacagtactttgtcacatggttgtccattatcatgtattagagtctaaatgattacttgaataaagaaaaaaaaccacttaactcttacata

SEQ ID NO: 16725 - DNA, 333 bp, Homo sapiens
gaagtccttgccctcatgccatgtcctggagatttctgatgatatgggctcaggtgcaattattagttcccaaagaagccaggactagactgccaaattaagaggggaaaagaagactaccataagctcaggttcccctaagcctgagaaagcccactgattatgtcctaacagaggggactgcattacaattaatgagggctaattgagtctgatgtgagtagactcttctttagccatcaatctgcctgtggattttgagaaccctcaattttttatatttagtaccatgttcctgacactccagcagtgattttgtctggactgatgggt

SEQ ID NO: 16726 - DNA, 467 bp, Homo sapiens
attatgcagtttaatgtgcagtgcaagtgttttctgccctggggtctggcgcaggccactccagtcctcagggggatccctcagtgcagctgggtcactttcttctcagctctgcttacttttgaaattaagattgttccttgacacttttatggctgttgcgtaggcagagttgagtggctgtgacagagactgggtgaccctcaagcctgaatcatttgcagggtcccccctgagaagtgtgcggccctggcgtccctctctccagccctgccctgggcctggcttgtgaacctgtgatgtcgggactgcagggcccctgctgggccgttttcttaccaggcaaaattcctgcttcacagagttgatgccaggggtgtcaaatcttttgttttccctgggccacattggaagaagaattgtcttgggccacataaaatagaataacactaacaatagttgagcta

SEQ ID NO: 16727 - DNA, 475 bp, Homo sapiens
gcagtagctcccccatgtagtatagttttgtcaaacaggtttgagctataaatgtcagaaaatgtaagatgtttctgaaattcaagtatgaatcagtgaaggttggaaaatttgtttccaaataggattttatcagagacatttttgacatataaaactaacaacgtctctaataagagacccgtttttggcatataaaaccaggtattcgtatattcgagggtttggccctcttctgtggtacccctgtgtgtgtatcctgggaagtcaaggtgggaacaggtatggtcttggctttgtgctctgaagtcttctttttgccttatcacctggcttttggttaagagtcccttgggttgggccaggcgcggtggctcatgcctgtaatcccagcactttgggaggctcaggtgggtggtgagccaagattgcgccactgcactccagcctgggcgacagagcaagactccatctc

SEQ ID NO: 16728 - DNA, 787 bp, Homo sapiens
aatcctgaggcaagacaagttagatacctagatgatttgggatattacatatatgtaatttttttactttttattttgaaataattttcaactttgcaaaaaattgcaaggaatagtacaaagaactcctatctacccatcaccaagattcatcggtcatcaacatgttgccgcattatcttttgcattctctctctatatatatgcttattattttttatgagccatttgggagtaagttgcagatatgtcccctttatgtgattattatttttttttttgagacaaggtctcgccctgtcgccctgtttagagtgcagaggcacgatctcagctgactgcaacctccgcctcccaggctcaaatgatcctcccgcctcaacctctcaagtagctgggaccacaggcgtgtgccaccacacccagctaatttttgtattctttgtagagacggggttttgccttattgtccaggctggtctcgaactcctgggctcaagcaatctgcccaccttggcttcccaaagtgctggaatcacaagtgtaagccactccaccaggccccctttatgtgacttaagatcaaaatgaaaacaaaaattttcctttgtaaaaatcagaacattatacataaggctataatcccctttggctgaccactcttcatcctagtccccttcgtcttgccagaggtgattcttccagaccctttaaggatttacttaaatacttgtacatttacatatgtgtattcatagaaaatgcacagtattgtttgtgtgggttt

SEQ ID NO: 16729 - DNA, 510 bp, Homo sapiens
aataaacattcaaatagcttgctgtaaagttttgtatcatacaaaatctgttacatatatatatattatgagatgcttcagttcaaataacagtgcagtaattcacctatatctaaaagactgccaaattattaaatgtcaggtattgcacttctattctgagtggcagtttacacattttaaattacatcaagggtaaatcaatagtatggaaatcttaatttggtccactttaaatgtaatttcaaggatttctcatttgacctatttacacatgcatccagaaaaaagtaacaaaaaatgtagtcaagttatgtttatttccaaaaaaggcatttaccctagaagaaagtagaatctgttaatacagtttaaagtctgtggagttaaaaaaaataacaaaaaatcaatttgtgattatttctttaagtaaaatataagacattaagtttgcctgtaatcttatggcattactaaactggacaaacaaaataaatactctttgtcgga

SEQ ID NO: 16730 - DNA, 572 bp, Homo sapiens
attggataattggttagaaatagtagatgagtaggtatattaaatgttgaatggatggtcagtattgattctactcttggattctgactaggatatttactctctctctctcagaaacatctatatctttaatattacttgctattgtatttactaactgtcacaagaatagcctgttccacatataaaatacagagttggttctcatgttttttgttgaagggaattcggataactagtgagttgtttgtcattttcatttaagacagaagttaaattctaaaagtatgtcactcagtgaatttttaaaaattatatcttttaataactttaagattgattcttcatctattcatgtctctgttttaaggatgtgggtggtatttatataattcctaattgattctataaaaagtattttaaacaaaagggttatatagaggttatagttattagataatcttgtcagaaacagtgccatttagaatacttggttcagcaaactgtttaatgtcagccaaagtgatttaaaagctttatttaggattaatccatcatctgcttaaatttat

SEQ ID NO: 16731 - DNA, 2071 bp, Homo sapiens
aagcaaagcagctcttatttgaaaaaccactgggttccgagttcattactacaggaaaaactgttctcttctgtggcacagagaaccctgcttcaaagcagaagtagcagttccggagtccagctggctaaaactcatcccagaggataatggcaacccatgccttagaaatcgctgggctgtttcttggtggtgttggaatggtgggcacagtggctgtcactgtcatgcctcagtggagagtgtcggccttcattgaaaacaacatcgtggtttttgaaaacttctgggaaggactgtggatgaattgcgtgaggcaggctaacatcaggatgcagtgcaaaatctatgattccctgctggctctttctccggacctacaggcagccagaggactgatgtgtgctgcttccgtgatgtccttcttggctttcatgatggccatccttggcatgaaatgcaccaggtgcacgggggacaatgagaaggtgaaggctcacattctgctgacggctggaatcatcttcatcatcacgggcatggtggtgctcatccctgtgagctgggttgccaatgccatcatcagagatttctataactcaatagtgaatgttgcccaaaaacgtgagcttggagaagctctctacttaggatggaccacggcactggtgctgattgttggaggagctctgttctgctgcgttttttgttgcaacgaaaagagcagtagctacagatactcgataccttcccatcgcacaacccaaaaaagttatcacaccggaaagaagtcaccgagcgtctactccagaagtcagtatgtgtagttgtgtatgtttttttaactttactataaagccatgcaaatgacaaaaatctatattactttctcaaaatggaccccaaagaaactttgatttactgttcttaactgcctaatcttaattacaggaactgtgcatcagctatttatgattctataagctatttcagcagaatgagatattaaacccaatgctttgattgttctagaaagtatagtaatttgttttctaaggtggttcaagcatctactctttttatcatttacttcaaaatgacattgctaaagactgcattattttactactgtaatttctccacgacatagcattatgtacatagatgagtgtaacatttatatctcacatagagacatgcttatatggttttatttaaaatgaaatgccagtccattacactgaataaatagaactcaactattgcttttcagggaaatcatggatagggttgaagaaggttactattaattgtttaaaaacagcttagggattaatgtcctccatttataatgaagattaaaatgaaggctttaatcagcattgtaaaggaaattgaatggctttctgatatgctgttttttagcctaggagttagaaatcctaacttctttatcctcttctcccagaggctttttttttcttgtgtattaaattaacatttttaaaaagcagatattttgtcaaggggctttgcattcaaactgcttttccagggctatactcagaagaaagataaaagtgtgatctaagaaaaagtgatggttttaggaaagtgaaaatatttttgtttttgtatttgaagaagaatgatgcattttgacaagaaatcatatatgtatggatatattttaataagtatttgagtacagactttgaggtttcatcaatataaataaaagagcagaaaaatatgtcttggttttcatttgcttaccaaaaaaacaacaacaaaaaaagttgtcctttgagaacttcacctgctcctatgtgggtacctgagtcaaaattgtcatttttgttctgtgaaaaataaatttccttcttgtaccatttctgtttagttttactaaaatctgtaaatactgtatttttctgtttattccaaatttgatgaaactgacaatccaatttgaaagtttgtgtcgacgtctgtctagcttaaatgaatgtgttctatttgctttatacatttatattaataaattgtacatttttctaattatttgaca

SEQ ID NO: 16732 - DNA, 6149 bp, Homo sapiens
  misc_feature (1497)..(1497): n is a, c, g, or t
  misc_feature (1778)..(1778): n is a, c, g, or t
ctgggcaccccagcaaaccatattatgctccaggggcgcccactccaagacccctccatgggaagctggaatccctgcatggctgtgtgcaggcattgctccgggagccagcccagccagggctttgggaacagcttgggcaactgtacgagtcagagcacgatagtgaggaggccacacgctgctaccacagcgcccttcgatacggaggaagcttcgctgagctggggccccgcattggccgactgcagcaggcccagctctggaactttcatactggctcctgccagcaccgagccaaggtcctgcccccactggagcaagtgtggaacttgctacaccttgagcacaaacggaactatggagccaagcggggaggtcccccggtgaagcgagctgctgaacccccagtggtgcagcctgtgcctcctgcagcactctcaggcccctcaggggaggagggcctcagccctggaggcaagcgaaggagaggctgcaactctgaacagactggccttcccccagggctgccactgcctccaccaccattaccaccaccaccaccaccaccaccaccaccaccaccaccaccacccctgcctggcctggctaccagccccccatttcagctaaccaagccagggctgtggagtaccctgcatggagatgcctggggcccagagcgcaagggttcagcacccccagagcgccaggagcagcggcactcgctgcctcacccatatccatacccagctccagcgtacaccgcgcacccccctggccaccggctggtcccggctgctcccccaggcccaggcccccgccccccaggagcagagagccatggctgcctgcctgccacccgtccccccggaagtgaccttagagagagcagagttcagaggtcgcggatggactccagcgtttcaccagcagcaaccaccgcctgcgtgccttacgccccttcccggccccctggcctccccggcaccaccaccagcagcagcagtagcagcagcagcaacactggtctccggggcgtggagccgaacccaggcattcccggcgctgaccattaccaaactcccgcgctggaggtctctcaccatggccgcctggggccctcggcacacagcagtcggaaaccgttcttgggggctcccgctgccactccccacctatccctgccacctggaccttcctcaccccctccacccccctgtccccgcctcttacgccccccaccaccccctgcctggttgaagggtccggcctgccgggcagcccgagaggatggagagatcttagaagagctcttctttgggactgagggacccccccgccctgccccaccacccctcccccatcgcgagggcttcttggggcctccggcctcccgcttttctgtgggcactcaggattctcacacccctcccactcccccaaccccaaccaccagcagtagcaacagcaacagtggcagccacagcagcagcnctgctgggcctgtgtcctttcccccaccaccctatctggccagaagtatagacccccttccccggcctcccagcccagcacagaacccccaggacccacctcttgtacccctgactcttgccctgcctccagcccctccttcctcctgccaccaaaatacctcaggaagcttcaggcgcccggagagcccccggcccagggtctccttcccaaagacccccgaggtggggccggggccacccccaggccccctgagtaaagccccccagcctgtgccgccnggggttggggagctgcctgcccgaggccctcgactctttgattttccccccactccgctggaggaccagtttgaggagccagccgaattcaagatcctacctgatgggctggccaacatcatgaagatgctggacgaatccattcgcaaggaagaggaacagcaacaacacgaagcaggcgtggccccccaacccccgctgaaggagccctttgcatctctgcagtctcctttccccaccgacacagcccccaccactactgctcctgctgtcgccgtcaccaccaccaccaccaccaccaccaccaccacggccacccaggaagaggagaagaagccaccaccagccctaccaccaccaccgcctctagccaagttccctccaccctctcagccacagccaccaccacccccaccccccagcccggccagcctgctcaaatccttggcctccgtgctggagggacaaaagtactgttatcgggggactggagcagctgtttccacccggcctgggcccttgcccaccactcagtattcccctggccccccatcaggtgctaccgccctgccgcccacctcagcggcccctagcgcccagggctccccacagccctctgcttcctcgtcatctcagttctctacctcaggcgggccctgggcccgggagcgcagggcgggcgaagagccagtcccgggccccatgacccccacccaaccgcccccacccctatctctgccccctgctcgctctgagtctgaggtgctagaagagatcagccgggcttgcgagacccttgtggagcgggtgggccggagtgccactgacccagccgacccagtggacacagcagagccagcggacagtgggactgagcgactgctgccccccgcacaggccaaggaggaggctggcggggtggcggcagtgtcaggcagctgtaagcggcgacagaaggagcatcagaaggagcatcggcggcacaggcgggcctgtaaggacagtgtgggtcgtcggccccgtgagggcagggcaaaggccaaggccaaggtccccaaagaaaagagccgccgggtgctggggaacctggacctgcagagcgaggagatccaggtcgtgagaagtcccggcccgatcttggcggggcctccaaggccaagccacccacagctccagcccctccatcagctcctgcaccttctgcccagcccacacccccgtcagcctctgtccctggaaagaaggctcgggaggaagccccagggccaccgggtgtcagccgggccgacatgctgaagctgcgctcacttagtgaggggccccccaaggagctgaagatccggctcatcaaggtagagagtggtgacaaggagacctttatcgcctctgaggtggaagagcggcggctgcgcatggcagacctcaccatcagccactgtgctgctgacgtcgtgcgcgccagcaggaatgccaaggtgaaagggaagtttcgagagtcctacctttcccctgcccagtctgtgaaaccgaagatcaacactgaggagaagctgccccgggaaaaactcaacccccctacacccagcatctatctggagagcaaacgggatgccttctcacctgtcctgctgcagttctgtacagaccctcgaaatcccatcacagtgatccggggcctggcgggctccctgcggctcaacttgggcctcttctccaccaagaccctggtggaagcgagtggcgaacacaccgtggaagttcgcacccaggtgcagcagccctcagatgagaactgggatctgacaggcactcggcagatctggccttgtgagagctcccgttcccacaccaccattgccaagtacgcacagtaccaggcctcatccttccaggagtctctgcaggaggagaaggagagtgaggatgaggagtcagaggagccagacagcaccactggaacccctcctagcagcgcaccagacccgaagaaccatcacatcatcaagtttggcaccaacatcgacttgtctgatgctaagcggtggaagccccagctgcaggagctgctgaagctgcccgccttcatgcgggtaacatccacgggcaacatgctgagccacgtgggccacaccatcctgggcatgaacacggtgcagctgtacatgaaggtgcccggcagccgaacgccaggccaccaggagaataacaacttctgctccgtcaacatcaacattggcccaggcgactgcgagtggttcgcggtgcacgagcactactgggagaccatcagcgctttctgtgatcggcacggcgtggactacttgacgggttcctggtggccaatcctggatgatctctatgcatccaatattcctgtgtaccgcttcgtgcagcgacccggagacctcgtgtggattaatgcggggactgtgcactgggtgcaggccaccggctggtgcaacaacattgcctggaacgtggggcccctcaccgcctatcagtaccagctggccctggaacgatacgagtggaatgaggtgaagaacgtcaaatccatcgtgcccatgattcacgtgtcatggaacgtggctcgcacggtcaaaatcagcgaccccgacttgttcaagatgatcaagttctgcctgctgcagtccatgaagcactgccaggtgcaacgcgagagcctggtgcgggcagggaagaaaatcgcttaccagggccgtgtcaaggacgagccagcctactactgcaacgagtgcgatgtggaggtgtttaacatcctgttcgtgacaagtgagaatggcagccgcaacacgtacctggtacactgcgagggctgtgcccggcgccgcagcgcaggcctgcagggcgtggtggtgctggagcagtaccgcactgaggagctggctcaggcctacgacgccttcacgctggtgagggcccggcgggcgcgcgggcagcggaggagggcactggggcaggctgcagggacgggcttcgggagcccggccgcgcctttccctgagcccccgccggctttctccccccaggccccagccagcacgtcgcgatgaggccggacgccccgcccgcctgcctgcccgcgcaaggcgccgcggggccaccagcacatgcctgggctggacctaggtcccgcctgtggccgagaagggggtcgggcccagcccttccaccccattggcagctcccctcacttaatttattaagaaaaactttttttttttttttagcaaatatgaggaaaaaaggaaaaaaaatgggagacgggggagggggctggcagcccctcgcccaccagcgcctcccctcaccgactttggcctttttagcaacagacacaaggaccaggctccggcggcggcgggggtcacatacgggttccctcaccctgccagccgcccgcccgcccggcgcagatgcacgcggctcgtgtatgtacatagacgttacggcagccgaggtttttaatgagattctttctatgggctttacccctcccccggaacctccttttttacttccaatgctagctgtgacccctgtacatgtctctttattcacttggttatgatttgtattttttgttcttttcttgtttttttgtttttaatttataacagtcccactcacctctatttattcatttttgggaaaacccgacctcccacacccccaagccatcctgcccgcccctccagggaccgcccgtcgccgggctctccccgcgccccagtgtgtgtccgggcccggcccgaccgtctccacccgtccgcccgcggctccagccgggttctcatggtgctcaaacccgctcccctcccctacgtcctgcactttctcggaccagtccccccactcccgacccgaccccagccccacctgagggtgagcaactcctgtactgtaggggaagaagtgggaactgaaatggtattttgtaaaaaaaataaataaaataaaaaaattaaaggttttaaagaaagaactatgaggaaaaggaaccccgtccttcccagccccggccaactttaaaaaacacagaccttcacccccacccccttttctttttaagtgtgaaacaacccagggccagggcctcactggggcagggacaccccggggtgagtttctctggggctttattttcgttttgttggttgttttttctccacgctggggctgcggaggggtggggggtttacagtcccgcaccctcgcactgcactgtctctctgccccaggggcagaggggtcttcccaaccctacccctattttcggtgatttttgtgtgagaatattaatattaaaaataaacggagaaaaaaaatcctcgtgcgctaacggctggt

SEQ ID NO: 16733 - DNA, 389 bp, Homo sapiens
gtctcccattttttttccttttttcctcatatttgctaaaaaaaaaaaaaaaaagttgcggccaactttaaaaaacacagaccttcacccccacccccttttctttttaagtgtgaaacaacccagggccagggcctcactggggcagggacaccccggggtgagtttctctggggctttattttcgttttgttggttgttttttctccacgctggggctgcggaggggtggggggtttacagtcccgcaccctcgcactgcactgtctctctgccccaggggcagaggggtcttcccaaccctacccctattttcggtgatttttgtgtgagaatattaatattaaaaataaacggagaaaaaaaatcctcgtgcgctaacggctggt

SEQ ID NO: 16734 - DNA, 6032 bp, Homo sapiens
  misc_feature (1497)..(1497): n is a, c, g, or t
  misc_feature (1778)..(1778): n is a, c, g, or t
ctgggcaccccagcaaaccatattatgctccaggggcgcccactccaagacccctccatgggaagctggaatccctgcatggctgtgtgcaggcattgctccgggagccagcccagccagggctttgggaacagcttgggcaactgtacgagtcagagcacgatagtgaggaggccacacgctgctaccacagcgcccttcgatacggaggaagcttcgctgagctggggccccgcattggccgactgcagcaggcccagctctggaactttcatactggctcctgccagcaccgagccaaggtcctgcccccactggagcaagtgtggaacttgctacaccttgagcacaaacggaactatggagccaagcggggaggtcccccggtgaagcgagctgctgaacccccagtggtgcagcctgtgcctcctgcagcactctcaggcccctcaggggaggagggcctcagccctggaggcaagcgaaggagaggctgcaactctgaacagactggccttcccccagggctgccactgcctccaccaccattaccaccaccaccaccaccaccaccaccaccaccaccaccaccacccctgcctggcctggctaccagccccccatttcagctaaccaagccagggctgtggagtaccctgcatggagatgcctggggcccagagcgcaagggttcagcacccccagagcgccaggagcagcggcactcgctgcctcacccatatccatacccagctccagcgtacaccgcgcacccccctggccaccggctggtcccggctgctcccccaggcccaggcccccgccccccaggagcagagagccatggctgcctgcctgccacccgtccccccggaagtgaccttagagagagcagagttcagaggtcgcggatggactccagcgtttcaccagcagcaaccaccgcctgcgtgccttacgccccttcccggccccctggcctccccggcaccaccaccagcagcagcagtagcagcagcagcaacactggtctccggggcgtggagccgaacccaggcattcccggcgctgaccattaccaaactcccgcgctggaggtctctcaccatggccgcctggggccctcggcacacagcagtcggaaaccgttcttgggggctcccgctgccactccccacctatccctgccacctggaccttcctcaccccctccacccccctgtccccgcctcttacgccccccaccaccccctgcctggttgaagggtccggcctgccgggcagcccgagaggatggagagatcttagaagagctcttctttgggactgagggacccccccgccctgccccaccacccctcccccatcgcgagggcttcttggggcctccggcctcccgcttttctgtgggcactcaggattctcacacccctcccactcccccaaccccaaccaccagcagtagcaacagcaacagtggcagccacagcagcagcnctgctgggcctgtgtcctttcccccaccaccctatctggccagaagtatagacccccttccccggcctcccagcccagcacagaacccccaggacccacctcttgtacccctgactcttgccctgcctccagcccctccttcctcctgccaccaaaatacctcaggaagcttcaggcgcccggagagcccccggcccagggtctccttcccaaagacccccgaggtggggccggggccacccccaggccccctgagtaaagccccccagcctgtgccgccnggggttggggagctgcctgcccgaggccctcgactctttgattttccccccactccgctggaggaccagtttgaggagccagccgaattcaagatcctacctgatgggctggccaacatcatgaagatgctggacgaatccattcgcaaggaagaggaacagcaacaacacgaagcaggcgtggccccccaacccccgctgaaggagccctttgcatctctgcagtctcctttccccaccgacacagcccccaccactactgctcctgctgtcgccgtcaccaccaccaccaccaccaccaccaccaccacggccacccaggaagaggagaagaagccaccaccagccctaccaccaccaccgcctctagccaagttccctccaccctctcagccacagccaccaccacccccaccccccagcccggccagcctgctcaaatccttggcctccgtgctggagggacaaaagtactgttatcgggggactggagcagctgtttccacccggcctgggcccttgcccaccactcagtattcccctggccccccatcaggtgctaccgccctgccgcccacctcagcggcccctagcgcccagggctccccacagccctctgcttcctcgtcatctcagttctctacctcaggcgggccctgggcccgggagcgcagggcgggcgaagagccagtcccgggccccatgacccccacccaaccgcccccacccctatctctgccccctgctcgctctgagtctgaggtgctagaagagatcagccgggcttgcgagacccttgtggagcgggtgggccggagtgccactgacccagccgacccagtggacacagcagagccagcggacagtgggactgagcgactgctgccccccgcacaggccaaggaggaggctggcggggtggcggcagtgtcaggcagctgtaagcggcgacagaaggagcatcagaaggagcatcggcggcacaggcgggcctgtaaggacagtgtgggtcgtcggccccgtgagggcagggcaaaggccaaggccaaggtccccaaagaaaagagccgccgggtgctggggaacctggacctgcagagcgaggagatccaggtcgtgagaagtcccggcccgatcttggcggggcctccaaggccaagccacccacagctccagcccctccatcagctcctgcaccttctgcccagcccacacccccgtcagcctctgtccctggaaagaaggctcgggaggaagccccagggccaccgggtgtcagccgggccgacatgctgaagctgcgctcacttagtgaggggccccccaaggagctgaagatccggctcatcaaggtagagagtggtgacaaggagacctttatcgcctctgaggtggaagagcggcggctgcgcatggcagacctcaccatcagccactgtgctgctgacgtcgtgcgcgccagcaggaatgccaaggtgaaagggaagtttcgagagtcctacctttcccctgcccagtctgtgaaaccgaagatcaacactgaggagaagctgccccgggaaaaactcaacccccctacacccagcatctatctggagagcaaacgggatgccttctcacctgtcctgctgcagttctgtacagaccctcgaaatcccatcacagtgatccggggcctggcgggctccctgcggctcaacttgggcctcttctccaccaagaccctggtggaagcgagtggcgaacacaccgtggaagttcgcacccaggtgcagcagccctcagatgagaactgggatctgacaggcactcggcagatctggccttgtgagagctcccgttcccacaccaccattgccaagtacgcacagtaccaggcctcatccttccaggagtctctgcaggaggagaaggagagtgaggatgaggagtcagaggagccagacagcaccactggaacccctcctagcagcgcaccagacccgaagaaccatcacatcatcaagtttggcaccaacatcgacttgtctgatgctaagcggtggaagccccagctgcaggagctgctgaagctgcccgccttcatgcgggtaacatccacgggcaacatgctgagccacgtgggccacaccatcctgggcatgaacacggtgcagctgtacatgaaggtgcccggcagccgaacgccaggccaccaggagaataacaacttctgctccgtcaacatcaacattggcccaggcgactgcgagtggttcgcggtgcacgagcactactgggagaccatcagcgctttctgtgatcggcacggcgtggactacttgacgggttcctggtggccaatcctggatgatctctatgcatccaatattcctgtgtaccgcttcgtgcagcgacccggagacctcgtgtggattaatgcggggactgtgcactgggtgcaggccaccggctggtgcaacaacattgcctggaacgtggggcccctcaccgcctatcagtaccagctggccctggaacgatacgagtggaatgaggtgaagaacgtcaaatccatcgtgcccatgattcacgtgtcatggaacgtggctcgcacggtcaaaatcagcgaccccgacttgttcaagatgatcaagttctgcctgctgcagtccatgaagcactgccaggtgcaacgcgagagcctggtgcgggcagggaagaaaatcgcttaccagggccgtgtcaaggacgagccagcctactactgcaacgagtgcgatgtggaggtgtttaacatcctgttcgtgacaagtgagaatggcagccgcaacacgtacctggtacactgcgagggctgtgcccggcgccgcagcgcaggcctgcagggcgtggtggtgctggagcagtaccgcactgaggagctggctcaggcctacgacgccttcacgctggccccagccagcacgtcgcgatgaggccggacgccccgcccgcctgcctgcccgcgcaaggcgccgcggggccaccagcacatgcctgggctggacctaggtcccgcctgtggccgagaagggggtcgggcccagcccttccaccccattggcagctcccctcacttaatttattaagaaaaactttttttttttttttagcaaatatgaggaaaaaaggaaaaaaaatgggagacgggggagggggctggcagcccctcgcccaccagcgcctcccctcaccgactttggcctttttagcaacagacacaaggaccaggctccggcggcggcgggggtcacatacgggttccctcaccctgccagccgcccgcccgcccggcgcagatgcacgcggctcgtgtatgtacatagacgttacggcagccgaggtttttaatgagattctttctatgggctttacccctcccccggaacctccttttttacttccaatgctagctgtgacccctgtacatgtctctttattcacttggttatgatttgtattttttgttcttttcttgtttttttgtttttaatttataacagtcccactcacctctatttattcatttttgggaaaacccgacctcccacacccccaagccatcctgcccgcccctccagggaccgcccgtcgccgggctctccccgcgccccagtgtgtgtccgggcccggcccgaccgtctccacccgtccgcccgcggctccagccgggttctcatggtgctcaaacccgctcccctcccctacgtcctgcactttctcggaccagtccccccactcccgacccgaccccagccccacctgagggtgagcaactcctgtactgtaggggaagaagtgggaactgaaatggtattttgtaaaaaaaataaataaaataaaaaaattaaaggttttaaagaaagaactatgaggaaaaggaaccccgtccttcccagccccggccaactttaaaaaacacagaccttcacccccacccccttttctttttaagtgtgaaacaacccagggccagggcctcactggggcagggacaccccggggtgagtttctctggggctttattttcgttttgttggttgttttttctccacgctggggctgcggaggggtggggggtttacagtcccgcaccctcgcactgcactgtctctctgccccaggggcagaggggtcttcccaaccctacccctattttcggtgatttttgtgtgagaatattaatattaaaaataaacggagaaaaaaaatcctcgtgcgctaacggctggt

SEQ ID NO: 16735 - DNA, 2677 bp, Homo sapiens
tgcaggtggctacccccggggttacttgggcctcttctccaccaagaccctggtggaagcgagtggcgaacacaccgtggaagttcgcacccaggtgcagcagccctcagatgagaactgggatctgacaggcactcggcagatctggccttgtgagagctcccgttcccacaccaccattgccaagtacgcacagtaccaggcctcatccttccaggagtctctgcaggaggagaaggagagtgaggatgaggagtcagaggagccagacagcaccactggaacccctcctagcagcgcaccagacccgaagaaccatcacatcatcaagtttggcaccaacatcgacttgtctgatgctaagcggtcagtggggctgaggccagggaagttggggcaggagtgctgctaggacctcgtggcgggggcggggtgtagcctctcgtcgcacttccgcaccgcaggtggaagccccagctgcaggagctgctgaagctgcccgccttcatgcgggtaacatccacgggcaacatgctgagccacgtgggccacaccatcctgggcatgaacacggtgcagctgtacatgaaggtgcccggcagccgaacgccaggccaccaggagaataacaacttctgctccgtcaacatcaacattggcccaggcgactgcgagtggttcgcggtgcacgagcactactgggagaccatcagcgctttctgtgatcggcacggcgtggactacttgacgggttcctggtggccaatcctggatgatctctatgcatccaatattcctgtgtaccgcttcgtgcagcgacccggagacctcgtgtggattaatgcggggactgtgcactgggtgcaggccaccggctggtgcaacaacattgcctggaacgtggggcccctcaccgcctatcagtaccagctggccctggaacgatacgagtggaatgaggtgaagaacgtcaaatccatcgtgcccatgattcacgtgtcatggaacgtggctcgcacggtcaaaatcagcgaccccgacttgttcaagatgatcaagttctgcctgctgcagtccatgaagcactgccaggtgcaacgcgagagcctggtgcgggcagggaagaaaatcgcttaccagggccgtgtcaaggacgagccagcctactactgcaacgagtgcgatgtggaggtgtttaacatcctgttcgtgacaagtgagaatggcagccgcaacacgtacctggtacactgcgagggctgtgcccggcgccgcagcgcaggcctgcagggcgtggtggtgctggagcagtaccgcactgaggagctggctcaggcctacgacgccttcacgctggccccagccagcacgtcgcgatgaggccggacgccccgcccgcctgcctgcccgcgcaaggcgccgcggggccaccagcacatgcctgggctggacctaggtcccgcctgtggccgagaagggggtcgggcccagcccttccaccccattggcagctcccctcacttaatttattaagaaaaactttttttttttttttagcaaatatgaggaaaaaaggaaaaaaaatgggagacgggggagggggctggcagcccctcgcccaccagcgcctcccctcaccgactttggcctttttagcaacagacacaaggaccaggctccggcggcggcgggggtcacatacgggttccctcaccctgccagccgcccgcccgcccggcgcagatgcacgcggctcgtgtatgtacatagacgttacggcagccgaggtttttaatgagattctttctatgggctttacccctcccccggaacctccttttttacttccaatgctagctgtgacccctgtacatgtctctttattcacttggttatgatttgtattttttgttcttttcttgtttttttgtttttaatttataacagtcccactcacctctatttattcatttttgggaaaacccgacctcccacacccccaagccatcctgcccgcccctccagggaccgcccgtcgccgggctctccccgcgccccagtgtgtgtccgggcccggcccgaccgtctccacccgtccgcccgcggctccagccgggttctcatggtgctcaaacccgctcccctcccctacgtcctgcactttctcggaccagtccccccactcccgacccgaccccagccccacctgagggtgagcaactcctgtactgtaggggaagaagtgggaactgaaatggtattttgtaaaaaaaataaataaaataaaaaaattaaaggttttaaagaaagaactatgaggaaaaggaaccccgtccttcccagccccggccaactttaaaaaacacagaccttcacccccacccccttttctttttaagtgtgaaacaacccagggccagggcctcactggggcagggacaccccggggtgagtttctctggggctttattttcgttttgttggttgttttttctccacgctggggctgcggaggggtggggggtttacagtcccgcaccctcgcactgcactgtctctctgccccaggggcagaggggtcttcccaaccctacccctattttcggtgatttttgtgtgagaatattaatattaaaaataaacggagaaaaaaaatcctcgtgcgctaacggctggt

SEQ ID NO: 16736 - DNA, 2365 bp, Homo sapiens
tcatcgagctcgccctattataggctctggaaggatgaggagtcagaggagccagacagcaccactggaacccctcctagcagcgcaccagacccgaagaaccatcacatcatcaagtttggcaccaacatcgacttgtctgatgctaagcggtggaagccccagctgcaggagctgctgaagctgcccgccttcatgcgggtaacatccacgggcaacatgctgagccacgtgggccacaccatcctgggcatgaacacggtgcagctgtacatgaaggtgcccggcagccgaacgccaggccaccaggagaataacaacttctgctccgtcaacatcaacattggcccaggcgactgcgagtggttcgcggtgcacgagcactactgggagaccatcagcgctttctgtgatcggcacggcgtggactacttgacgggttcctggtggccaatcctggatgatctctatgcatccaatattcctgtgtaccgcttcgtgcagcgacccggagacctcgtgtggattaatgcggggactgtgcactgggtgcaggccaccggctggtgcaacaacattgcctggaacgtggggcccctcaccgcctatcagtaccagctggccctggaacgatacgagtggaatgaggtgaagaacgtcaaatccatcgtgcccatgattcacgtgtcatggaacgtggctcgcacggtcaaaatcagcgaccccgacttgttcaagatgatcaagttctgcctgctgcagtccatgaagcactgccaggtgcaacgcgagagcctggtgcgggcagggaagaaaatcgcttaccagggccgtgtcaaggacgagccagcctactactgcaacgagtgcgatgtggaggtgtttaacatcctgttcgtgacaagtgagaatggcagccgcaacacgtacctggtacactgcgagggctgtgcccggcgccgcagcgcaggcctgcagggcgtggtggtgctggagcagtaccgcactgaggagctggctcaggcctacgacgccttcacgctggccccagccagcacgtcgcgatgaggccggacgccccgcccgcctgcctgcccgcgcaaggcgccgcggggccaccagcacatgcctgggctggacctaggtcccgcctgtggccgagaagggggtcgggcccagcccttccaccccattggcagctcccctcacttaatttattaagaaaaactttttttttttttttagcaaatatgaggaaaaaaggaaaaaaaatgggagacgggggagggggctggcagcccctcgcccaccagcgcctcccctcaccgactttggcctttttagcaacagacacaaggaccaggctccggcggcggcgggggtcacatacgggttccctcaccctgccagccgcccgcccgcccggcgcagatgcacgcggctcgtgtatgtacatagacgttacggcagccgaggtttttaatgagattctttctatgggctttacccctcccccggaacctccttttttacttccaatgctagctgtgacccctgtacatgtctctttattcacttggttatgatttgtattttttgttcttttcttgtttttttgtttttaatttataacagtcccactcacctctatttattcatttttgggaaaacccgacctcccacacccccaagccatcctgcccgcccctccagggaccgcccgtcgccgggctctccccgcgccccagtgtgtgtccgggcccggcccgaccgtctccacccgtccgcccgcggctccagccgggttctcatggtgctcaaacccgctcccctcccctacgtcctgcactttctcggaccagtccccccactcccgacccgaccccagccccacctgagggtgagcaactcctgtactgtaggggaagaagtgggaactgaaatggtattttgtaaaaaaaataaataaaataaaaaaattaaaggttttaaagaaagaactatgaggaaaaggaaccccgtccttcccagccccggccaactttaaaaaacacagaccttcacccccacccccttttctttttaagtgtgaaacaacccagggccagggcctcactggggcagggacaccccggggtgagtttctctggggctttattttcgttttgttggttgttttttctccacgctggggctgcggaggggtggggggtttacagtcccgcaccctcgcactgcactgtctctctgccccaggggcagaggggtcttcccaaccctacccctattttcggtgatttttgtgtgagaatattaatattaaaaataaacggagaaaaaaaatcctcgtgcgctaacggctggt

SEQ ID NO: 16737 - DNA, 2974 bp, Homo sapiens
  misc_feature (1497)..(1497): n is a, c, g, or t
  misc_feature (1778)..(1778): n is a, c, g, or t
ctgggcaccccagcaaaccatattatgctccaggggcgcccactccaagacccctccatgggaagctggaatccctgcatggctgtgtgcaggcattgctccgggagccagcccagccagggctttgggaacagcttgggcaactgtacgagtcagagcacgatagtgaggaggccacacgctgctaccacagcgcccttcgatacggaggaagcttcgctgagctggggccccgcattggccgactgcagcaggcccagctctggaactttcatactggctcctgccagcaccgagccaaggtcctgcccccactggagcaagtgtggaacttgctacaccttgagcacaaacggaactatggagccaagcggggaggtcccccggtgaagcgagctgctgaacccccagtggtgcagcctgtgcctcctgcagcactctcaggcccctcaggggaggagggcctcagccctggaggcaagcgaaggagaggctgcaactctgaacagactggccttcccccagggctgccactgcctccaccaccattaccaccaccaccaccaccaccaccaccaccaccaccaccaccacccctgcctggcctggctaccagccccccatttcagctaaccaagccagggctgtggagtaccctgcatggagatgcctggggcccagagcgcaagggttcagcacccccagagcgccaggagcagcggcactcgctgcctcacccatatccatacccagctccagcgtacaccgcgcacccccctggccaccggctggtcccggctgctcccccaggcccaggcccccgccccccaggagcagagagccatggctgcctgcctgccacccgtccccccggaagtgaccttagagagagcagagttcagaggtcgcggatggactccagcgtttcaccagcagcaaccaccgcctgcgtgccttacgccccttcccggccccctggcctccccggcaccaccaccagcagcagcagtagcagcagcagcaacactggtctccggggcgtggagccgaacccaggcattcccggcgctgaccattaccaaactcccgcgctggaggtctctcaccatggccgcctggggccctcggcacacagcagtcggaaaccgttcttgggggctcccgctgccactccccacctatccctgccacctggaccttcctcaccccctccacccccctgtccccgcctcttacgccccccaccaccccctgcctggttgaagggtccggcctgccgggcagcccgagaggatggagagatcttagaagagctcttctttgggactgagggacccccccgccctgccccaccacccctcccccatcgcgagggcttcttggggcctccggcctcccgcttttctgtgggcactcaggattctcacacccctcccactcccccaaccccaaccaccagcagtagcaacagcaacagtggcagccacagcagcagcnctgctgggcctgtgtcctttcccccaccaccctatctggccagaagtatagacccccttccccggcctcccagcccagcacagaacccccaggacccacctcttgtacccctgactcttgccctgcctccagcccctccttcctcctgccaccaaaatacctcaggaagcttcaggcgcccggagagcccccggcccagggtctccttcccaaagacccccgaggtggggccggggccacccccaggccccctgagtaaagccccccagcctgtgccgccnggggttggggagctgcctgcccgaggccctcgactctttgattttccccccactccgctggaggaccagtttgaggagccagccgaattcaagatcctacctgatgggctggccaacatcatgaagatgctggacgaatccattcgcaaggaagaggaacagcaacaacacgaagcaggcgtggccccccaacccccgctgaaggagccctttgcatctctgcagtctcctttccccaccgacacagcccccaccactactgctcctgctgtcgccgtcaccaccaccaccaccaccaccaccaccaccacggccacccaggaagaggagaagaagccaccaccagccctaccaccaccaccgcctctagccaagttccctccaccctctcagccacagccaccaccacccccaccccccagcccggccagcctgctcaaatccttggcctccgtgctggagggacaaaagtactgttatcgggggactggagcagctgtttccacccggcctgggcccttgcccaccactcagtattcccctggccccccatcaggtgctaccgccctgccgcccacctcagcggcccctagcgcccagggctccccacagccctctgcttcctcgtcatctcagttctctacctcaggcgggccctgggcccgggagcgcagggcgggcgaagagccagtcccgggccccatgacccccacccaaccgcccccacccctatctctgccccctgctcgctctgagtctgaggtgctagaagagatcagccgggcttgcgagacccttgtggagcgggtgggccggagtgccactgacccagccgacccagtggacacagcagagccagcggacagtgggactgagcgactgctgccccccgcacaggccaaggaggaggctggcggggtggcggcagtgtcaggcagctgtaagcggcgacagaaggagcatcagaaggagcatcggcggcacaggcgggcctgtaaggacagtgtgggtcgtcggccccgtgagggcagggcaaaggccaaggccaaggtccccaaagaaaagagccgccgggtgctggggacccactgcccaatgcccccaagtgatgcatgcccccaggaggcagcacaaaaagtccaagagaaccagggggactaagaaaatcagctccttggccaccagagctagccgta

SEQ ID NO: 16738 - DNA, 5880 bp, Homo sapiens
  misc_feature (1497)..(1497): n is a, c, g, or t
  misc_feature (1778)..(1778): n is a, c, g, or t
ctgggcaccccagcaaaccatattatgctccaggggcgcccactccaagacccctccatgggaagctggaatccctgcatggctgtgtgcaggcattgctccgggagccagcccagccagggctttgggaacagcttgggcaactgtacgagtcagagcacgatagtgaggaggccacacgctgctaccacagcgcccttcgatacggaggaagcttcgctgagctggggccccgcattggccgactgcagcaggcccagctctggaactttcatactggctcctgccagcaccgagccaaggtcctgcccccactggagcaagtgtggaacttgctacaccttgagcacaaacggaactatggagccaagcggggaggtcccccggtgaagcgagctgctgaacccccagtggtgcagcctgtgcctcctgcagcactctcaggcccctcaggggaggagggcctcagccctggaggcaagcgaaggagaggctgcaactctgaacagactggccttcccccagggctgccactgcctccaccaccattaccaccaccaccaccaccaccaccaccaccaccaccaccaccacccctgcctggcctggctaccagccccccatttcagctaaccaagccagggctgtggagtaccctgcatggagatgcctggggcccagagcgcaagggttcagcacccccagagcgccaggagcagcggcactcgctgcctcacccatatccatacccagctccagcgtacaccgcgcacccccctggccaccggctggtcccggctgctcccccaggcccaggcccccgccccccaggagcagagagccatggctgcctgcctgccacccgtccccccggaagtgaccttagagagagcagagttcagaggtcgcggatggactccagcgtttcaccagcagcaaccaccgcctgcgtgccttacgccccttcccggccccctggcctccccggcaccaccaccagcagcagcagtagcagcagcagcaacactggtctccggggcgtggagccgaacccaggcattcccggcgctgaccattaccaaactcccgcgctggaggtctctcaccatggccgcctggggccctcggcacacagcagtcggaaaccgttcttgggggctcccgctgccactccccacctatccctgccacctggaccttcctcaccccctccacccccctgtccccgcctcttacgccccccaccaccccctgcctggttgaagggtccggcctgccgggcagcccgagaggatggagagatcttagaagagctcttctttgggactgagggacccccccgccctgccccaccacccctcccccatcgcgagggcttcttggggcctccggcctcccgcttttctgtgggcactcaggattctcacacccctcccactcccccaaccccaaccaccagcagtagcaacagcaacagtggcagccacagcagcagcnctgctgggcctgtgtcctttcccccaccaccctatctggccagaagtatagacccccttccccggcctcccagcccagcacagaacccccaggacccacctcttgtacccctgactcttgccctgcctccagcccctccttcctcctgccaccaaaatacctcaggaagcttcaggcgcccggagagcccccggcccagggtctccttcccaaagacccccgaggtggggccggggccacccccaggccccctgagtaaagccccccagcctgtgccgccnggggttggggagctgcctgcccgaggccctcgactctttgattttccccccactccgctggaggaccagtttgaggagccagccgaattcaagatcctacctgatgggctggccaacatcatgaagatgctggacgaatccattcgcaaggaagaggaacagcaacaacacgaagcaggcgtggccccccaacccccgctgaaggagccctttgcatctctgcagtctcctttccccaccgacacagcccccaccactactgctcctgctgtcgccgtcaccaccaccaccaccaccaccaccaccaccacggccacccaggaagaggagaagaagccaccaccagccctaccaccaccaccgcctctagccaagttccctccaccctctcagccacagccaccaccacccccaccccccagcccggccagcctgctcaaatccttggcctccgtgctggagggacaaaagtactgttatcgggggactggagcagctgtttccacccggcctgggcccttgcccaccactcagtattcccctggccccccatcaggtgctaccgccctgccgcccacctcagcggcccctagcgcccagggctccccacagccctctgcttcctcgtcatctcagttctctacctcaggcgggccctgggcccgggagcgcagggcgggcgaagagccagtcccgggccccatgacccccacccaaccgcccccacccctatctctgccccctgctcgctctgagtctgaggtgctagaagagatcagccgggcttgcgagacccttgtggagcgggtgggccggagtgccactgacccagccgacccagtggacacagcagagccagcggacagtgggactgagcgactgctgccccccgcacaggccaaggaggaggctggcggggtggcggcagtgtcaggcagctgtaagcggcgacagaaggagcatcagaaggagcatcggcggcacaggcgggcctgtaaggacagtgtgggtcgtcggccccgtgagggcagggcaaaggccaaggccaaggtccccaaagaaaagagccgccgggtgctggggaacctggacctgcagagcgaggagatccaggtcgtgagaagtcccggcccgatcttggcggggcctccaaggccaagccacccacagctccagcccctccatcagctcctgcaccttctgcccagcccacacccccgtcagcctctgtccctggaaagaaggctcgggaggaagccccagggccaccgggtgtcagccgggccgacatgctgaagctgcgctcacttagtgaggggccccccaaggagctgaagatccggctcatcaaggtagagagtggtgacaaggagacctttatcgcctctgaggtggaagagcggcggctgcgcatggcagacctcaccatcagccactgtgctgctgacgtcgtgcgcgccagcaggaatgccaaggtgaaagggaagtttcgagagtcctacctttcccctgcccagtctgtgaaaccgaagatcaacactgaggagaagctgccccgggaaaaactcaacccccctacacccagcatctatctggagagcaaacgggatgccttctcacctgtcctgctgcagttctgtacagaccctcgaaatcccatcacagtgatccggggcctggcgggctccctgcggctcaacttgggcctcttctccaccaagaccctggtggaagcgagtggcgaacacaccgtggaagttcgcacccaggtgcagcagccctcagatgagaactgggatctgacaggcactcggcagatctggccttgtgagagctcccgttcccacaccaccattgccaagtacgcacagtaccaggcctcatccttccaggagtctctgcaggaggagaaggagagtgaggatgaggagtcagaggagccagacagcaccactggaacccctcctagcagcgcaccagacccgaagaaccatcacatcatcaagtttggcaccaacatcgacttgtctgatgctaagcggtggaagccccagctgcaggagctgctgaagctgcccgccttcatgcgggtaacatccacgggcaacatgctgagccacgtgggccacaccatcctgggcatgaacacggtgcagctgtacatgaaggtgcccggcagccgaacgccaggccaccaggagaataacaacttctgctccgtcaacatcaacattggcccaggcgactgcgagtggttcgcggtgcacgagcactactgggagaccatcagcgctttctgtgatcggcacggcgtggactacttgacgggttcctggtggccaatcctggatgatctctatgcatccaatattcctgtgtaccgcttcgtgcagcgacccggagacctcgtgtggattaatgcggggactgtgcactgggtgcaggccaccggctggtgcaacaacattgcctggaacgtggggcccctcaccgcctatcagtaccagctggccctggaacgatacgagtggaatgaggtgaagaacgtcaaatccatcgtgcccatgattcacgtgtcatggaacgtggctcgcacggtcaaaatcagcgaccccgacttgttcaagatgatcaagttctgcctgctgcagtccatgaagcactgccaggtgcaacgcgagagcctggtgcgggcagggaagaaaatcgcttaccagggccgtgtcaaggacgagccagcctactactgcaacgagtgcgatgtggaggtgtttaacatcctgttcgtgacaagtgagaatggcagccgcaacacgtacctggtacactgcgagggctgtgcccggcgccgcagcgcaggcctgcagggcgtggtggtgctggagcagtaccgcactgaggagctggctcaggcctacgacgccttcacgctggccccagccagcacgtcgcgatgaggccggacgccccgcccgcctgcctgcccgcgcaaggcgccgcggggccaccagcacatgcctgggctggacctaggtcccgcctgtggccgagaagggggtcgggcccagcccttccaccccattggcagctcccctcacttaatttattaagaaaaactttttttttttttttagcaaatatgaggaaaaaaggaaaaaaaatgggagacgggggagggggctggcagcccctcgcccaccagcgcctcccctcaccgactttggcctttttagcaacagacacaaggaccaggctccggcggcggcgggggtcacatacgggttccctcaccctgccagccgcccgcccgcccggcgcagatgcacgcggctcgtgtatgtacatagacgttacggcagccgaggtttttaatgagattctttctatgggctttacccctcccccggaacctccttttttacttccaatgctagctgtgacccctgtacatgtctctttattcacttggttatgatttgtattttttgttcttttcttgtttttttgtttttaatttataacagtcccactcacctctatttattcatttttgggaaaacccgctcccctcccctacgtcctgcactttctcggaccagtccccccactcccgacccgaccccagccccacctgagggtgagcaactcctgtactgtaggggaagaagtgggaactgaaatggtattttgtaaaaaaaataaataaaataaaaaaattaaaggttttaaagaaagaactatgaggaaaaggaaccccgtccttcccagccccggccaactttaaaaaacacagaccttcacccccacccccttttctttttaagtgtgaaacaacccagggccagggcctcactggggcagggacaccccggggtgagtttctctggggctttattttcgttttgttggttgttttttctccacgctggggctgcggaggggtggggggtttacagtcccgcaccctcgcactgcactgtctctctgccccaggggcagaggggtcttcccaaccctacccctattttcggtgatttttgtgtgagaatattaatattaaaaataaacggagaaaaaaaatcctcgtgcgctaacggctggt

SEQ ID NO: 16739 - DNA, 431 bp, Homo sapiens
tgcacaaaacctcacatctgctgatctaattgctgagagagacctgtcccaggagagtgagctgtttgtgcagctggctgctgtaacagaagttctttttcctaactctgttagttctgaaaggactttgaatttgtagtgccttctagtttatgttcttttagaaatgagtaaaggagaggcttaagttgacacagtttgcaggtccggctttgaaagaatgtttgtcaaaaaccaaagctcaaactatttttgcagtttttctgaaagtatgaaaaatttcaaaacagtaacaaagccaagtccccagaaactgagtagaaatagaagttaagtggtttgttgttgttctcaaattgttgggactcttagtgtaatttttaaaagtagttcttgtataaatagcaaatgattcattctaatttttctgt

SEQ ID NO: 16740 - DNA, 429 bp, Homo sapiens
aaccaaaaaaaactatgaaaaccagaatttagactcagtcattatactagagattagaatgaaacgaccccaaacaacccatttcttacctggtctctgagaataagtttatacttttagttttctgagaatatttctcagaatatgtgagttttctgagcacatttttcagcatggggtatggtagataaatcacagggccaaggtttggcagggatagatgggatcattgtgtaccctattgttcttctgatttccaggagaacagaatgagcccatgcaaaacataaacttatgatgattaaaaaaaacacacctatccattcactcatcaataaaaacatattatgatggttatcaagctgtgtcctatgagtgataaaatatttgtaaaatataaaattaaatggcatctattgtgaactctat

SEQ ID NO: 16741 - DNA, 402 bp, Homo sapiens
tttgagttggaaatactagtatgtaataatataaaacacattttatgttttatctttaaaaattatttcccaattctgtccatgaaaagaccttaaatcaaggagcaagccagggacagtgagcagtttgttatctctaaatatttccccatgaaaggaaccagggctccttgaagaaatgggtttctccagatctgggatgggaaatgtataagatgagcctgggtcatctaggcttcttaccagaaagcaaggtagctatcaaacacttacctaaggccagttggggtggctcatgcctgtgattccagtgctttaagggttacaggctgaggagggcagattgcttgaggtcagaagtgtgaaaccagcctgggcaacagagaaagaccccatgtctac

SEQ ID NO: 16742 - DNA, 2146 bp, Homo sapiens
ccgctggtccgccatcgcggacgcagcctcgtgccgggagtcgccgcattgtggtccgcttctctgcactatgtcgggtggcctcctgaaggcgctgcgcagcgactcctacgtggagctgagccagtaccgggaccagcacttccggggtgacaatgaagaacaagaaaaattactgaagaaaagctgtacgttatatgttggaaatctttctttttacacaactgaagaacaaatctatgaactcttcagcaaaagtggtgacataaagaaaatcattatgggtctggataaaatgaagaaaacagcatgtggattctgttttgtggaatattactcacgcgcagatgcggaaaacgccatgcggtacataaatgggacgcgtctggatgaccgaatcattcgcacagactgggacgcaggctttaaggagggcaggcaatacggccgtgggcgatctgggggccaggttcgggatgagtatcggcaggactacgatgctgggagaggaggctatggaaaactggcacagaaccagtgagtggtgagagctctgtcagtgacaaacactcctttggcctgttgaatttgctgaagaacatcacctaaagtctgcacacgagcccatttttaccaagatttgatcagtgtctttactgagctggaagcctctgaaagttattaaaggacagaatccaaaagaatgcctttaattcttgtctgagaatcttggccatgtgtcagattatcagaacaattttgttaccaggtcagaaattgtgttctttgacaacagattggatctgtaatgttgattagtctttagccataaccactacacttttagaaagacagaaaaatgtaagaatttgtttttaccataatgagtcttaagtaggttcatgatctacattggggcctgggattatttttttaattttaagtttgcatgagatagcctaataaatggaggtggggccaggcatggtggctcacacgtgtaatcccaacactttgggaggctgaggaggaaggatagcttgaggccaggagtttgagactagactgggcaacatagcaagaccccgtctctacaaagcaaaacgaaaaacaacaaatggagttgtgctatgttgtattgctttgcacaaaattaggaacaggtgtttgacaattgaatttgttttctgtgaattctaacctctaaaggcatgcttagaggtcaaggaccttcctgtgtagttggtgcaaaagcaatctccacaggacagcactgcttccatgcttcatacatcaggaaatgaggccagaacttgagtatttactaacacgtttttcaaaagatgtcagtgttatacctaaagctaaaaaaaagcaagggtttgtcatagagggaacctctaaataatttcaggggtaggggagatgttgtcaataggaaatgggataaaatatcaagagacaatgaaaacactgccttgacatgaggaccagcaagtttattcttttcattttcagtgatgttgggaatggactgggttttaaaagggagcttgaagagggaatgtttgacagtcacagaaggttcctgcagcagatgcctcttttagccatttctcatttttttcctcaaattttacctactgaggctcaagccttcacagtgagctgatggtctctacaggggaggggagtctagggaatttatttggtatttgtaaggcaagaggtgatttctctctaatatatctgagttattgctcatttaaaactgttaagtccagtataattttccctgatatgaaaaaatgtgcatttttttcacttagcaacaaagtaccttctaatttccaatagtccgtgaaagttggggctgaagtacctaagtgtgaatgtctctcccgttaaactgagtgtagaaatctgaatttttaaaagagctgtaactagttgtaagtgcttaggaagaaactttgcaaacatttaatgaggatacactgttcatttttaaaattccttcacactgtaatttaatgtgttttatattcttttgtagtaaaacaacataactcagatttctacaggagacagtggttttatttggattgtcttctgtaataggtttcaataaagctggatgaactta

SEQ ID NO: 16743 - DNA, 838 bp, Homo sapiens
ccgctggtccgccatcgcggacgcagcctcgtgccgggagtcgccgcattgtggtccgcttctctgcactatgtcgggtggcctcctgaaggcgctgcgcagcgactcctacgtggagctgagccagtaccgggaccagcacttccggggtgacaatgaagaacaagaaaaattactgaagaaaagctgtacgttatatgttggaaatctttctttttacacaactgaagaacaaatctatgaactcttcagcaaaagtggtgacataaagaaaatcattatgggtctggataaaatgaagaaaacagcatgtggattctgttttgtggagtatccttcccatggatctaatgtagctgctgaaccagggtagagctgagagtggtagctcacaagcgtccctgcactcgtccctacgttttccttcatctccctcctactttccacccagtgtgtctctgcccttatactgtaaagctgatactatttatattctcttctgaaatccatgctttatggttctttaacaaaaagtttttcaagaatgtttgcccttcacgtaaaaaaaaaaaatccaaagaatgtggtgaaaatacaaaaatctcgtactgttctaaacccctaatgccctttgccagaggcagtcagttagcagtttcttgggcgtctttcaagaagtaaccctgtgggtgtgcggtagtgtatttcatgtgctgtttttaaaatcatttttttattttttattgttccatttcagcatatgtaggtctttttttaaaatagctgtacagctggccatggtggctggtgtttgtagtgccagctgctcaggaagctg

SEQ ID NO: 16744 - DNA, 738 bp, Homo sapiens
agcaaggctctgaagttgcttaacttttgtctctatttgaaattctagggtgacaatgaagaacaagaaaaattactgaagaaaagctgtacgttatatgttggaaatctttctttttacacaactgaagaacaaatctatgaactcttcagcaaaagtggtgacataaagaaaatcattatgggtctggataaaatgaagaaaacagcatgtggattctgttttgtggagtatccttcccatggatctaatgtagctgctgaaccagggtagagctgagagtggtagctcacaagcgtccctgcactcgtccctacgttttccttcatctccctcctactttccacccagtgtgtctctgcccttatactgtaaagctgatactatttatattctcttctgaaatccatgctttatggttctttaacaaaaagtttttcaagaatgtttgcccttcacgtaaaaaaaaaaaatccaaagaatgtggtgaaaatacaaaaatctcgtactgttctaaacccctaatgccctttgccagaggcagtcagttagcagtttcttgggcgtctttcaagaagtaaccctgtgggtgtgcggtagtgtatttcatgtgctgtttttaaaatcatttttttattttttattgttccatttcagcatatgtaggtctttttttaaaatagctgtacagctggccatggtggctggtgtttgtagtgccagctgctcaggaagctg

SEQ ID NO: 16745 - DNA, 2202 bp, Homo sapiens
ccgctggtccgccatcgcggacgcagcctcgtgccgggagtcgccgcattgtggtccgcttctctgcactatgtcgggtggcctcctgaaggcgctgcgcagcgactcctacgtggagctgagccagtaccgggaccagcacttccgggtgagggaggccgggccgcgagacgggaaggccctgggcaagaacgctgagaaacgggtgacaatgaagaacaagaaaaattactgaagaaaagctgtacgttatatgttggaaatctttctttttacacaactgaagaacaaatctatgaactcttcagcaaaagtggtgacataaagaaaatcattatgggtctggataaaatgaagaaaacagcatgtggattctgttttgtggaatattactcacgcgcagatgcggaaaacgccatgcggtacataaatgggacgcgtctggatgaccgaatcattcgcacagactgggacgcaggctttaaggagggcaggcaatacggccgtgggcgatctgggggccaggttcgggatgagtatcggcaggactacgatgctgggagaggaggctatggaaaactggcacagaaccagtgagtggtgagagctctgtcagtgacaaacactcctttggcctgttgaatttgctgaagaacatcacctaaagtctgcacacgagcccatttttaccaagatttgatcagtgtctttactgagctggaagcctctgaaagttattaaaggacagaatccaaaagaatgcctttaattcttgtctgagaatcttggccatgtgtcagattatcagaacaattttgttaccaggtcagaaattgtgttctttgacaacagattggatctgtaatgttgattagtctttagccataaccactacacttttagaaagacagaaaaatgtaagaatttgtttttaccataatgagtcttaagtaggttcatgatctacattggggcctgggattatttttttaattttaagtttgcatgagatagcctaataaatggaggtggggccaggcatggtggctcacacgtgtaatcccaacactttgggaggctgaggaggaaggatagcttgaggccaggagtttgagactagactgggcaacatagcaagaccccgtctctacaaagcaaaacgaaaaacaacaaatggagttgtgctatgttgtattgctttgcacaaaattaggaacaggtgtttgacaattgaatttgttttctgtgaattctaacctctaaaggcatgcttagaggtcaaggaccttcctgtgtagttggtgcaaaagcaatctccacaggacagcactgcttccatgcttcatacatcaggaaatgaggccagaacttgagtatttactaacacgtttttcaaaagatgtcagtgttatacctaaagctaaaaaaaagcaagggtttgtcatagagggaacctctaaataatttcaggggtaggggagatgttgtcaataggaaatgggataaaatatcaagagacaatgaaaacactgccttgacatgaggaccagcaagtttattcttttcattttcagtgatgttgggaatggactgggttttaaaagggagcttgaagagggaatgtttgacagtcacagaaggttcctgcagcagatgcctcttttagccatttctcatttttttcctcaaattttacctactgaggctcaagccttcacagtgagctgatggtctctacaggggaggggagtctagggaatttatttggtatttgtaaggcaagaggtgatttctctctaatatatctgagttattgctcatttaaaactgttaagtccagtataattttccctgatatgaaaaaatgtgcatttttttcacttagcaacaaagtaccttctaatttccaatagtccgtgaaagttggggctgaagtacctaagtgtgaatgtctctcccgttaaactgagtgtagaaatctgaatttttaaaagagctgtaactagttgtaagtgcttaggaagaaactttgcaaacatttaatgaggatacactgttcatttttaaaattccttcacactgtaatttaatgtgttttatattcttttgtagtaaaacaacataactcagatttctacaggagacagtggttttatttggattgtcttctgtaataggtttcaataaagctggatgaactta

SEQ ID NO: 16746 - DNA, 2142 bp, Homo sapiens
ctttgagggtgttcggatgtaaagatcggagaattgctggatttcagaagagggaaatttttagtccggactatatcacagtatattttgtggaaaaaggggaggcagcagatattcaaagtagacttttcagtatcagcggagggtgacaatgaagaacaagaaaaattactgaagaaaagctgtacgttatatgttggaaatctttctttttacacaactgaagaacaaatctatgaactcttcagcaaaagtggtgacataaagaaaatcattatgggtctggataaaatgaagaaaacagcatgtggattctgttttgtggaatattactcacgcgcagatgcggaaaacgccatgcggtacataaatgggacgcgtctggatgaccgaatcattcgcacagactgggacgcaggctttaaggagggcaggcaatacggccgtgggcgatctgggggccaggttcgggatgagtatcggcaggactacgatgctgggagaggaggctatggaaaactggcacagaaccagtgagtggtgagagctctgtcagtgacaaacactcctttggcctgttgaatttgctgaagaacatcacctaaagtctgcacacgagcccatttttaccaagatttgatcagtgtctttactgagctggaagcctctgaaagttattaaaggacagaatccaaaagaatgcctttaattcttgtctgagaatcttggccatgtgtcagattatcagaacaattttgttaccaggtcagaaattgtgttctttgacaacagattggatctgtaatgttgattagtctttagccataaccactacacttttagaaagacagaaaaatgtaagaatttgtttttaccataatgagtcttaagtaggttcatgatctacattggggcctgggattatttttttaattttaagtttgcatgagatagcctaataaatggaggtggggccaggcatggtggctcacacgtgtaatcccaacactttgggaggctgaggaggaaggatagcttgaggccaggagtttgagactagactgggcaacatagcaagaccccgtctctacaaagcaaaacgaaaaacaacaaatggagttgtgctatgttgtattgctttgcacaaaattaggaacaggtgtttgacaattgaatttgttttctgtgaattctaacctctaaaggcatgcttagaggtcaaggaccttcctgtgtagttggtgcaaaagcaatctccacaggacagcactgcttccatgcttcatacatcaggaaatgaggccagaacttgagtatttactaacacgtttttcaaaagatgtcagtgttatacctaaagctaaaaaaaagcaagggtttgtcatagagggaacctctaaataatttcaggggtaggggagatgttgtcaataggaaatgggataaaatatcaagagacaatgaaaacactgccttgacatgaggaccagcaagtttattcttttcattttcagtgatgttgggaatggactgggttttaaaagggagcttgaagagggaatgtttgacagtcacagaaggttcctgcagcagatgcctcttttagccatttctcatttttttcctcaaattttacctactgaggctcaagccttcacagtgagctgatggtctctacaggggaggggagtctagggaatttatttggtatttgtaaggcaagaggtgatttctctctaatatatctgagttattgctcatttaaaactgttaagtccagtataattttccctgatatgaaaaaatgtgcatttttttcacttagcaacaaagtaccttctaatttccaatagtccgtgaaagttggggctgaagtacctaagtgtgaatgtctctcccgttaaactgagtgtagaaatctgaatttttaaaagagctgtaactagttgtaagtgcttaggaagaaactttgcaaacatttaatgaggatacactgttcatttttaaaattccttcacactgtaatttaatgtgttttatattcttttgtagtaaaacaacataactcagatttctacaggagacagtggttttatttggattgtcttctgtaataggtttcaataaagctggatgaactta

SEQ ID NO: 16747 - DNA, 2637 bp, Homo sapiens
ccgctggtccgccatcgcggacgcagcctcgtgccgggagtcgccgcattgtggtccgcttctctgcactatgtcgggtggcctcctgaaggcgctgcgcagcgactcctacgtggagctgagccagtaccgggaccagcacttccgggtgagggaggccgggccgcgagacgggaaggccctgggcaagaacgctgagaaacggtttgctcttgtctcattgtgtcgcctcccattcagctgaaatccgcaaacgccaagtggggccccggtgcctgctggcgaggcagggaatgggtgctggaagggcgcttggatatcactgaagccacttgctctggaagacggggaactggaggctcgcttatcccattcgctcgcagccgctccctgtaccccagccagtgccgagaggtttgagcggtggtggtggtggcggctcccgtttccacggttgtgcctccgcagacgactacgtagcaagggggaggggtgcccttctctctcccagagtaggcagaggcgccttcctgatgcagatgcggggctttttgctttgttttttaaatcggcgaagcagtgcccttcggcgattcgggccccttctctgggaggatggtgttacggaagctgtacgcgggtgacaatgaagaacaagaaaaattactgaagaaaagctgtacgttatatgttggaaatctttctttttacacaactgaagaacaaatctatgaactcttcagcaaaagtggtgacataaagaaaatcattatgggtctggataaaatgaagaaaacagcatgtggattctgttttgtggaatattactcacgcgcagatgcggaaaacgccatgcggtacataaatgggacgcgtctggatgaccgaatcattcgcacagactgggacgcaggctttaaggagggcaggcaatacggccgtgggcgatctgggggccaggttcgggatgagtatcggcaggactacgatgctgggagaggaggctatggaaaactggcacagaaccagtgagtggtgagagctctgtcagtgacaaacactcctttggcctgttgaatttgctgaagaacatcacctaaagtctgcacacgagcccatttttaccaagatttgatcagtgtctttactgagctggaagcctctgaaagttattaaaggacagaatccaaaagaatgcctttaattcttgtctgagaatcttggccatgtgtcagattatcagaacaattttgttaccaggtcagaaattgtgttctttgacaacagattggatctgtaatgttgattagtctttagccataaccactacacttttagaaagacagaaaaatgtaagaatttgtttttaccataatgagtcttaagtaggttcatgatctacattggggcctgggattatttttttaattttaagtttgcatgagatagcctaataaatggaggtggggccaggcatggtggctcacacgtgtaatcccaacactttgggaggctgaggaggaaggatagcttgaggccaggagtttgagactagactgggcaacatagcaagaccccgtctctacaaagcaaaacgaaaaacaacaaatggagttgtgctatgttgtattgctttgcacaaaattaggaacaggtgtttgacaattgaatttgttttctgtgaattctaacctctaaaggcatgcttagaggtcaaggaccttcctgtgtagttggtgcaaaagcaatctccacaggacagcactgcttccatgcttcatacatcaggaaatgaggccagaacttgagtatttactaacacgtttttcaaaagatgtcagtgttatacctaaagctaaaaaaaagcaagggtttgtcatagagggaacctctaaataatttcaggggtaggggagatgttgtcaataggaaatgggataaaatatcaagagacaatgaaaacactgccttgacatgaggaccagcaagtttattcttttcattttcagtgatgttgggaatggactgggttttaaaagggagcttgaagagggaatgtttgacagtcacagaaggttcctgcagcagatgcctcttttagccatttctcatttttttcctcaaattttacctactgaggctcaagccttcacagtgagctgatggtctctacaggggaggggagtctagggaatttatttggtatttgtaaggcaagaggtgatttctctctaatatatctgagttattgctcatttaaaactgttaagtccagtataattttccctgatatgaaaaaatgtgcatttttttcacttagcaacaaagtaccttctaatttccaatagtccgtgaaagttggggctgaagtacctaagtgtgaatgtctctcccgttaaactgagtgtagaaatctgaatttttaaaagagctgtaactagttgtaagtgcttaggaagaaactttgcaaacatttaatgaggatacactgttcatttttaaaattccttcacactgtaatttaatgtgttttatattcttttgtagtaaaacaacataactcagatttctacaggagacagtggttttatttggattgtcttctgtaataggtttcaataaagctggatgaactta

SEQ ID NO: 16748 - DNA, 2004 bp, Homo sapiens
ccgctggtccgccatcgcggacgcagcctcgtgccgggagtcgccgcattgtggtccgcttctctgcactatgtcgggtggcctcctgaaggcgctgcgcagcgactcctacgtggagctgagccagtaccgggaccagcacttccggggtgacaatgaagaacaagaaaaattactgaagaaaagctatattactcacgcgcagatgcggaaaacgccatgcggtacataaatgggacgcgtctggatgaccgaatcattcgcacagactgggacgcaggctttaaggagggcaggcaatacggccgtgggcgatctgggggccaggttcgggatgagtatcggcaggactacgatgctgggagaggaggctatggaaaactggcacagaaccagtgagtggtgagagctctgtcagtgacaaacactcctttggcctgttgaatttgctgaagaacatcacctaaagtctgcacacgagcccatttttaccaagatttgatcagtgtctttactgagctggaagcctctgaaagttattaaaggacagaatccaaaagaatgcctttaattcttgtctgagaatcttggccatgtgtcagattatcagaacaattttgttaccaggtcagaaattgtgttctttgacaacagattggatctgtaatgttgattagtctttagccataaccactacacttttagaaagacagaaaaatgtaagaatttgtttttaccataatgagtcttaagtaggttcatgatctacattggggcctgggattatttttttaattttaagtttgcatgagatagcctaataaatggaggtggggccaggcatggtggctcacacgtgtaatcccaacactttgggaggctgaggaggaaggatagcttgaggccaggagtttgagactagactgggcaacatagcaagaccccgtctctacaaagcaaaacgaaaaacaacaaatggagttgtgctatgttgtattgctttgcacaaaattaggaacaggtgtttgacaattgaatttgttttctgtgaattctaacctctaaaggcatgcttagaggtcaaggaccttcctgtgtagttggtgcaaaagcaatctccacaggacagcactgcttccatgcttcatacatcaggaaatgaggccagaacttgagtatttactaacacgtttttcaaaagatgtcagtgttatacctaaagctaaaaaaaagcaagggtttgtcatagagggaacctctaaataatttcaggggtaggggagatgttgtcaataggaaatgggataaaatatcaagagacaatgaaaacactgccttgacatgaggaccagcaagtttattcttttcattttcagtgatgttgggaatggactgggttttaaaagggagcttgaagagggaatgtttgacagtcacagaaggttcctgcagcagatgcctcttttagccatttctcatttttttcctcaaattttacctactgaggctcaagccttcacagtgagctgatggtctctacaggggaggggagtctagggaatttatttggtatttgtaaggcaagaggtgatttctctctaatatatctgagttattgctcatttaaaactgttaagtccagtataattttccctgatatgaaaaaatgtgcatttttttcacttagcaacaaagtaccttctaatttccaatagtccgtgaaagttggggctgaagtacctaagtgtgaatgtctctcccgttaaactgagtgtagaaatctgaatttttaaaagagctgtaactagttgtaagtgcttaggaagaaactttgcaaacatttaatgaggatacactgttcatttttaaaattccttcacactgtaatttaatgtgttttatattcttttgtagtaaaacaacataactcagatttctacaggagacagtggttttatttggattgtcttctgtaataggtttcaataaagctggatgaactta

SEQ ID NO: 16749 - DNA, 2097 bp, Homo sapiens
gacggtaactgacctgagccaataaggcgtgacgaaacggggtgtacagattgagatgaacaatgaatcaatttacctgaagcacaaagggcatgattcgtgtatctggtaggaaatgcttgctttctaacacaacttgaagaacgaccactctatgaactcttcagtcctgagtggtgtaccataatggaagatatcagttgagtgcggttctggagtatctatgcaagcaagagacatgccattctggatctctggattttcgtgctatatagtctcacatattactcacgcgcagatgcggaaaacgccatgcggtacataaatgggacgcgtctggatgaccgaatcattcgcacagactgggacgcaggctttaaggagggcaggcaatacggccgtgggcgatctgggggccaggttcgggatgagtatcggcaggactacgatgctgggagaggaggctatggaaaactggcacagaaccagtgagtggtgagagctctgtcagtgacaaacactcctttggcctgttgaatttgctgaagaacatcacctaaagtctgcacacgagcccatttttaccaagatttgatcagtgtctttactgagctggaagcctctgaaagttattaaaggacagaatccaaaagaatgcctttaattcttgtctgagaatcttggccatgtgtcagattatcagaacaattttgttaccaggtcagaaattgtgttctttgacaacagattggatctgtaatgttgattagtctttagccataaccactacacttttagaaagacagaaaaatgtaagaatttgtttttaccataatgagtcttaagtaggttcatgatctacattggggcctgggattatttttttaattttaagtttgcatgagatagcctaataaatggaggtggggccaggcatggtggctcacacgtgtaatcccaacactttgggaggctgaggaggaaggatagcttgaggccaggagtttgagactagactgggcaacatagcaagaccccgtctctacaaagcaaaacgaaaaacaacaaatggagttgtgctatgttgtattgctttgcacaaaattaggaacaggtgtttgacaattgaatttgttttctgtgaattctaacctctaaaggcatgcttagaggtcaaggaccttcctgtgtagttggtgcaaaagcaatctccacaggacagcactgcttccatgcttcatacatcaggaaatgaggccagaacttgagtatttactaacacgtttttcaaaagatgtcagtgttatacctaaagctaaaaaaaagcaagggtttgtcatagagggaacctctaaataatttcaggggtaggggagatgttgtcaataggaaatgggataaaatatcaagagacaatgaaaacactgccttgacatgaggaccagcaagtttattcttttcattttcagtgatgttgggaatggactgggttttaaaagggagcttgaagagggaatgtttgacagtcacagaaggttcctgcagcagatgcctcttttagccatttctcatttttttcctcaaattttacctactgaggctcaagccttcacagtgagctgatggtctctacaggggaggggagtctagggaatttatttggtatttgtaaggcaagaggtgatttctctctaatatatctgagttattgctcatttaaaactgttaagtccagtataattttccctgatatgaaaaaatgtgcatttttttcacttagcaacaaagtaccttctaatttccaatagtccgtgaaagttggggctgaagtacctaagtgtgaatgtctctcccgttaaactgagtgtagaaatctgaatttttaaaagagctgtaactagttgtaagtgcttaggaagaaactttgcaaacatttaatgaggatacactgttcatttttaaaattccttcacactgtaatttaatgtgttttatattcttttgtagtaaaacaacataactcagatttctacaggagacagtggttttatttggattgtcttctgtaataggtttcaataaagctggatgaactta

SEQ ID NO: 16750 - DNA, 2240 bp, Homo sapiens
ccgctggtccgccatcgcggacgcagcctcgtgccgggagtcgccgcattgtggtccgcttctctgcactatgtcgggtggcctcctgaaggcgctgcgcagcgactcctacgtggagctgagccagtaccgggaccagcacttccggggtgacaatgaagaacaagaaaaattactgaagaaaagctgtacgttatatgttggaaatctttctttttacacaactgaagaacaaatctatgaactcttcagcaaaagtggtgacataaagaaaatcattatgggtctggataaaatgaagaaaacagcatgtggattctgttttgtggaatattactcacgcgcagatgcggaaaacgccatgcggtacataaatgggacgcgtctggatgaccgaatcattcgcacagactgggacgcaggctttaaggagggcaggcaatacggccgtgggcgatctgggggccaggttcgggatgagtatcggcaggactacgatgctgggagaggaggctatggaaaactggcacagaaccagtgagtggtgagagctctgtcagtgacaaacactcctttggcctgttgaatttgctgaagaacatcacctaaagtctgcacacgagcccatttttaccaagatttgatcagtgtctttactgagctggaagcctctgaaagttattaaaggacagaatccaaaagaatgcctttaattcttgtctgagaatcttggccatgtgtcagattatcagaacaattttgttaccaggtcagaaattgtgttctttgacaacagattggatctgtaatgttgattagtctttagccataaccactacacttttagaaagacagaaaaatgtaagaatttgtttttaccataatgagtcttaagtaggttcatgatctacattggggcctgggattatttttttaattttaagtttgcatgagatagcctaataaatggaggtggggccaggcatggtggctcacacgtgtaatcccaacactttgggaggctgaggaggaaggatagcttgaggccaggagtttgagactagactgggcaacatagcaagaccccgtctctacaaagcaaaacgaaaaacaacaaatggagttgtgctatgttgtattgctttgcacaaaattaggaacaggtgtttgacaattgaatttgttttctgtgaattctaacctctaaaggcatgcttagaggtcaaggaccttcctgtgtagttggtgcaaaagcaatctccacaggacagcactgcttccatgcttcatacatcaggaaatgaggccagaacttgagtatttactaacacgtttttcaaaagatgtcagtgttatacctaaagctaaaaaaaagcaagggtttgtcatagagggaacctctaaataatttcaggggtaggggagatgttgtcaataggaaatgggataaaatatcaagagacaatgaaaacactgccttgacatgaggaccagcaagtttattcttttcattttcagtgatgttgggaatggactgggttttaaaagggagcttgaagagggaatgtttgacagtcacagaaggttcctgcagcagatgcctcttttagccatttctcatttttttcctcaaattttacctactgaggctcaagccttcacagtgagctgatggtctctacaggggaggggagtctagggaatttatttggtatttgtaaggcaagaggtgatttctctctaatatatctgagttattgctcatttaaaactgttaagtccagtataattttccctgatatgaaaaaatgtgcatttttttcacttagcaacaaagtaccttctaatttccaatagtccgtgaaagttggggctgaagtacctaagtgtgaatgtctctcccgttaaactgagtgtagaaatctgaatttttaaaagagctgtaactagttgtaagtgcttaggaagaaactttgcaaacatttaatgaggatacactgttcatttttaaaattccttcacactgtaatttaatgtgttttatattcttttgtagtaaaacaacataactcagatttctacaggagacagtggttttatttggattgtcttctgtaataggtttcaataaagctggatgaacttatatcgttgttgctgcctgtttcctggcctataaagagggttgtgttctggaattcctgtactctggatacacatgaatgagttccagggggatt

SEQ ID NO: 16751 - DNA, 2269 bp, Homo sapiens
  misc_feature (2269)..(2269): n is a, c, g, or t
ccgctggtccgccatcgcggacgcagcctcgtgccgggagtcgccgcattgtggtccgcttctctgcactatgtcgggtggcctcctgaaggcgctgcgcagcgactcctacgtggagctgagccagtaccgggaccagcacttccggggtgacaatgaagaacaagaaaaattactgaagaaaagctgtacgttatatgttggaaatctttctttttacacaactgaagaacaaatctatgaactcttcagcaaaagtggtgacataaagaaaatcattatgggtctggataaaatgaagaaaacagcatgtggattctgttttgtggaatattactcacgcgcagatgcggaaaacgccatgcggtacataaatgggacgcgtctggatgaccgaatcattcgcacagactgggacgcaggctttaaggagggcaggcaatacggccgtgggcgatctgggggccaggttcgggatgagtatcggcaggactacgatgctgggagaggaggctatggaaaactggcacagaaccagtgagtggtgagagctctgtcagtgacaaacactcctttggcctgttgaatttgctgaagaacatcacctaaagtctgcacacgagcccatttttaccaagatttgatcagtgtctttactgagctggaagcctctgaaagttattaaaggacagaatccaaaagaatgcctttaattcttgtctgagaatcttggccatgtgtcagattatcagaacaattttgttaccaggtcagaaattgtgttctttgacaacagattggatctgtaatgttgattagtctttagccataaccactacacttttagaaagacagaaaaatgtaagaatttgtttttaccataatgagtcttaagtaggttcatgatctacattggggcctgggattatttttttaattttaagtttgcatgagatagcctaataaatggaggtggggccaggcatggtggctcacacgtgtaatcccaacactttgggaggctgaggaggaaggatagcttgaggccaggagtttgagactagactgggcaacatagcaagaccccgtctctacaaagcaaaacgaaaaacaacaaatggagttgtgctatgttgtattgctttgcacaaaattaggaacaggtgtttgacaattgaatttgttttctgtgaattctaacctctaaaggcatgcttagaggtcaaggaccttcctgtgtagttggtgcaaaagcaatctccacaggacagcactgcttccatgcttcatacatcaggaaatgaggccagaacttgagtatttactaacacgtttttcaaaagatgtcagtgttatacctaaagctaaaaaaaagcaagggtttgtcatagagggaacctctaaataatttcaggggtaggggagatgttgtcaataggaaatgggataaaatatcaagagacaatgaaaacactgccttgacatgaggaccagcaagtttattcttttcattttcagtgatgttgggaatggactgggttttaaaagggagcttgaagagggaatgtttgacagtcacagaaggttcctgcagcagatgcctcttttagccatttctcatttttttcctcaaattttacctactgaggctcaagccttcacagtgagctgatggtctctacaggggaggggagtctagggaatttatttggtatttgtaaggcaagaggtgatttctctctaatatatctgagttattgctcatttaaaactgttaagtccagtataattttccctgatatgaaaaaatgtgcatttttttcacttagcaacaaagtaccttctaatttccaatagtccgtgaaagttggggctgaagtacctaagtgtgaatgtctctcccgttaaactgagtgtagaaatctgaatttttaaaagagctgtaactagttgtaagtgcttaggaagaaactttgcaaacatttaatgaggatacactgttcatttttaaaattccttcacactgtaatttaatgtgttttatattcttttgtagtaaaacaacataactcagatttctacaggagacagtggttttatttggattgtcttctgtaataggtttcaataaagctggatgaacttaactttaccaacaacccacaagaccagcaccaacacaaaccacgacacaaccacgcaaccacacaaaaatagcacaagcagacacccaccacacacacgcaccagcaacaccgcacgagcaccn

SEQ ID NO: 16752 - DNA, 1909 bp, Homo sapiens
ctaacaagcaaccattcttgaacttctgctagggctaggtatcttccacctgcaggaacatctaaaatgaaagcaaaacgcactgaagtgagctgaagtgcatatgtcctgcttgaaatgttcacattgtggcatctgaacaggtttcactgtttgtctaacatgtttgtgggaggcatatttgttacaccattcttttccatactgtaactctggattctttccattaaaggttcgggatgagtatcggcaggactacgatgctgggagaggaggctatggaaaactggcacagaaccagtgagtggtgagagctctgtcagtgacaaacactcctttggcctgttgaatttgctgaagaacatcacctaaagtctgcacacgagcccatttttaccaagatttgatcagtgtctttactgagctggaagcctctgaaagttattaaaggacagaatccaaaagaatgcctttaattcttgtctgagaatcttggccatgtgtcagattatcagaacaattttgttaccaggtcagaaattgtgttctttgacaacagattggatctgtaatgttgattagtctttagccataaccactacacttttagaaagacagaaaaatgtaagaatttgtttttaccataatgagtcttaagtaggttcatgatctacattggggcctgggattatttttttaattttaagtttgcatgagatagcctaataaatggaggtggggccaggcatggtggctcacacgtgtaatcccaacactttgggaggctgaggaggaaggatagcttgaggccaggagtttgagactagactgggcaacatagcaagaccccgtctctacaaagcaaaacgaaaaacaacaaatggagttgtgctatgttgtattgctttgcacaaaattaggaacaggtgtttgacaattgaatttgttttctgtgaattctaacctctaaaggcatgcttagaggtcaaggaccttcctgtgtagttggtgcaaaagcaatctccacaggacagcactgcttccatgcttcatacatcaggaaatgaggccagaacttgagtatttactaacacgtttttcaaaagatgtcagtgttatacctaaagctaaaaaaaagcaagggtttgtcatagagggaacctctaaataatttcaggggtaggggagatgttgtcaataggaaatgggataaaatatcaagagacaatgaaaacactgccttgacatgaggaccagcaagtttattcttttcattttcagtgatgttgggaatggactgggttttaaaagggagcttgaagagggaatgtttgacagtcacagaaggttcctgcagcagatgcctcttttagccatttctcatttttttcctcaaattttacctactgaggctcaagccttcacagtgagctgatggtctctacaggggaggggagtctagggaatttatttggtatttgtaaggcaagaggtgatttctctctaatatatctgagttattgctcatttaaaactgttaagtccagtataattttccctgatatgaaaaaatgtgcatttttttcacttagcaacaaagtaccttctaatttccaatagtccgtgaaagttggggctgaagtacctaagtgtgaatgtctctcccgttaaactgagtgtagaaatctgaatttttaaaagagctgtaactagttgtaagtgcttaggaagaaactttgcaaacatttaatgaggatacactgttcatttttaaaattccttcacactgtaatttaatgtgttttatattcttttgtagtaaaacaacataactcagatttctacaggagacagtggttttatttggattgtcttctgtaataggtttcaataaagctggatgaactta

SEQ ID NO: 16753 - DNA, 2103 bp, Homo sapiens
ccgctggtccgccatcgcggacgcagcctcgtgccgggagtcgccgcattgtggtccgcttctctgcactatgtcgggtggcctcctgaaggcgctgcgcagcgactcctacgtggagctgagccagtaccgggaccagcacttccggggtgacaatgaagaacaagaaaaattactgaagaaaagctgtacgttatatgttggaaatctttctttttacacaactgaagaacaaatctatgaactcttcagcaaaagtggtgacataaagaaaatcattatgggtctggataaaatgaagaaaacagcatgtggattctgttttgtggaatattactcacgcgcagatgcggaaaacgccatgcggtacataaatgggacgcgtctggatgaccgaatcattcgcacagactgggacgcaggctttaaggagggcaggcaatacggccgtgggcgatctgggggccaggttcgggatgagtatcggcaggactacgatgctgggagaggaggctatggaaaactggcactttggcctgttgaatttgctgaagaacatcacctaaagtctgcacacgagcccatttttaccaagatttgatcagtgtctttactgagctggaagcctctgaaagttattaaaggacagaatccaaaagaatgcctttaattcttgtctgagaatcttggccatgtgtcagattatcagaacaattttgttaccaggtcagaaattgtgttctttgacaacagattggatctgtaatgttgattagtctttagccataaccactacacttttagaaagacagaaaaatgtaagaatttgtttttaccataatgagtcttaagtaggttcatgatctacattggggcctgggattatttttttaattttaagtttgcatgagatagcctaataaatggaggtggggccaggcatggtggctcacacgtgtaatcccaacactttgggaggctgaggaggaaggatagcttgaggccaggagtttgagactagactgggcaacatagcaagaccccgtctctacaaagcaaaacgaaaaacaacaaatggagttgtgctatgttgtattgctttgcacaaaattaggaacaggtgtttgacaattgaatttgttttctgtgaattctaacctctaaaggcatgcttagaggtcaaggaccttcctgtgtagttggtgcaaaagcaatctccacaggacagcactgcttccatgcttcatacatcaggaaatgaggccagaacttgagtatttactaacacgtttttcaaaagatgtcagtgttatacctaaagctaaaaaaaagcaagggtttgtcatagagggaacctctaaataatttcaggggtaggggagatgttgtcaataggaaatgggataaaatatcaagagacaatgaaaacactgccttgacatgaggaccagcaagtttattcttttcattttcagtgatgttgggaatggactgggttttaaaagggagcttgaagagggaatgtttgacagtcacagaaggttcctgcagcagatgcctcttttagccatttctcatttttttcctcaaattttacctactgaggctcaagccttcacagtgagctgatggtctctacaggggaggggagtctagggaatttatttggtatttgtaaggcaagaggtgatttctctctaatatatctgagttattgctcatttaaaactgttaagtccagtataattttccctgatatgaaaaaatgtgcatttttttcacttagcaacaaagtaccttctaatttccaatagtccgtgaaagttggggctgaagtacctaagtgtgaatgtctctcccgttaaactgagtgtagaaatctgaatttttaaaagagctgtaactagttgtaagtgcttaggaagaaactttgcaaacatttaatgaggatacactgttcatttttaaaattccttcacactgtaatttaatgtgttttatattcttttgtagtaaaacaacataactcagatttctacaggagacagtggttttatttggattgtcttctgtaataggtttcaataaagctggatgaactta

SEQ ID NO: 16754 - DNA, 1661 bp, Homo sapiens
aagctgaggaccatcgttgcaacgatggtcctcagctaattcaacagaaccagtgagtggtgagagctctgtcagtgacaaacactcctttggcctgttgaatttgctgaagaacatcacctaaagtctgcacacgagcccatttttaccaagatttgatcagtgtctttactgagctggaagcctctgaaagttattaaaggacagaatccaaaagaatgcctttaattcttgtctgagaatcttggccatgtgtcagattatcagaacaattttgttaccaggtcagaaattgtgttctttgacaacagattggatctgtaatgttgattagtctttagccataaccactacacttttagaaagacagaaaaatgtaagaatttgtttttaccataatgagtcttaagtaggttcatgatctacattggggcctgggattatttttttaattttaagtttgcatgagatagcctaataaatggaggtggggccaggcatggtggctcacacgtgtaatcccaacactttgggaggctgaggaggaaggatagcttgaggccaggagtttgagactagactgggcaacatagcaagaccccgtctctacaaagcaaaacgaaaaacaacaaatggagttgtgctatgttgtattgctttgcacaaaattaggaacaggtgtttgacaattgaatttgttttctgtgaattctaacctctaaaggcatgcttagaggtcaaggaccttcctgtgtagttggtgcaaaagcaatctccacaggacagcactgcttccatgcttcatacatcaggaaatgaggccagaacttgagtatttactaacacgtttttcaaaagatgtcagtgttatacctaaagctaaaaaaaagcaagggtttgtcatagagggaacctctaaataatttcaggggtaggggagatgttgtcaataggaaatgggataaaatatcaagagacaatgaaaacactgccttgacatgaggaccagcaagtttattcttttcattttcagtgatgttgggaatggactgggttttaaaagggagcttgaagagggaatgtttgacagtcacagaaggttcctgcagcagatgcctcttttagccatttctcatttttttcctcaaattttacctactgaggctcaagccttcacagtgagctgatggtctctacaggggaggggagtctagggaatttatttggtatttgtaaggcaagaggtgatttctctctaatatatctgagttattgctcatttaaaactgttaagtccagtataattttccctgatatgaaaaaatgtgcatttttttcacttagcaacaaagtaccttctaatttccaatagtccgtgaaagttggggctgaagtacctaagtgtgaatgtctctcccgttaaactgagtgtagaaatctgaatttttaaaagagctgtaactagttgtaagtgcttaggaagaaactttgcaaacatttaatgaggatacactgttcatttttaaaattccttcacactgtaatttaatgtgttttatattcttttgtagtaaaacaacataactcagatttctacaggagacagtggttttatttggattgtcttctgtaataggtttcaataaagctggatgaactta

SEQ ID NO: 16755 - DNA, 1240 bp, Homo sapiens
tcacggattactcaatgggacaatattgcaagtacacatgttgtatataaaatctatttttaaaaatctaaaatgggcatggtggctcacacgtgtaatcccaacactttgggaggctgaggaggaaggatagcttgaggccaggagtttgagactagactgggcaacatagcaagaccccgtctctacaaagcaaaacgaaaaacaacaaatggagttgtgctatgttgtattgctttgcacaaaattaggaacaggtgtttgacaattgaatttgttttctgtgaattctaacctctaaaggcatgcttagaggtcaaggaccttcctgtgtagttggtgcaaaagcaatctccacaggacagcactgcttccatgcttcatacatcaggaaatgaggccagaacttgagtatttactaacacgtttttcaaaagatgtcagtgttatacctaaagctaaaaaaaagcaagggtttgtcatagagggaacctctaaataatttcaggggtaggggagatgttgtcaataggaaatgggataaaatatcaagagacaatgaaaacactgccttgacatgaggaccagcaagtttattcttttcattttcagtgatgttgggaatggactgggttttaaaagggagcttgaagagggaatgtttgacagtcacagaaggttcctgcagcagatgcctcttttagccatttctcatttttttcctcaaattttacctactgaggctcaagccttcacagtgagctgatggtctctacaggggaggggagtctagggaatttatttggtatttgtaaggcaagaggtgatttctctctaatatatctgagttattgctcatttaaaactgttaagtccagtataattttccctgatatgaaaaaatgtgcatttttttcacttagcaacaaagtaccttctaatttccaatagtccgtgaaagttggggctgaagtacctaagtgtgaatgtctctcccgttaaactgagtgtagaaatctgaatttttaaaagagctgtaactagttgtaagtgcttaggaagaaactttgcaaacatttaatgaggatacactgttcatttttaaaattccttcacactgtaatttaatgtgttttatattcttttgtagtaaaacaacataactcagatttctacaggagacagtggttttatttggattgtcttctgtaataggtttcaataaagctggatgaactta

SEQ ID NO: 16756 - DNA, 564 bp, Homo sapiens
  misc_feature (3)..(3): n is a, c, g, or t
  misc_feature (12)..(12): n is a, c, g, or t
  misc_feature (26)..(26): n is a, c, g, or t
  misc_feature (37)..(37): n is a, c, g, or t
aanggactgggntttttatttagctngaagagggaangtttttttcctcaaattttacctactgaggctcaagccttcacagtgagctgatggtctctacaggggaggggagtctagggaatttatttggtatttgtaaggcaagaggtgatttctctctaatatatctgagttattgctcatttaaaactgttaagtccagtataattttccctgatatgaaaaaatgtgcatttttttcacttagcaacaaagtaccttctaatttccaatagtccgtgaaagttggggctgaagtacctaagtgtgaatgtctctcccgttaaactgagtgtagaaatctgaatttttaaaagagctgtaactagttgtaagtgcttaggaagaaactttgcaaacatttaatgaggatacactgttcatttttaaaattccttcacactgtaatttaatgtgttttatattcttttgtagtaaaacaacataactcagatttctacaggagacagtggttttatttggattgtcttctgtaataggtttcaataaagctggatgaactta

SEQ ID NO: 16757 - DNA, 499 bp, Homo sapiens
atctagaggatcccgttcaacttctacagccactacagggaggggagtctagggaatttatttggtatttgtaaggcaagaggtgatttctctctaatatatctgagttattgctcatttaaaactgttaagtccagtataattttccctgatatgaaaaaatgtgcatttttttcacttagcaacaaagtaccttctaatttccaatagtccgtgaaagttggggctgaagtacctaagtgtgaatgtctctcccgttaaactgagtgtagaaatctgaatttttaaaagagctgtaactagttgtaagtgcttaggaagaaactttgcaaacatttaatgaggatacactgttcatttttaaaattccttcacactgtaatttaatgtgttttatattcttttgtagtaaaacaacataactcagatttctacaggagacagtggttttatttggattgtcttctgtaataggtttcaataaagctggatgaactta

SEQ ID NO: 16758 - DNA, 694 bp, Homo sapiens
ccgctggtccgccatcgcggacgcagcctcgtgccgggagtcgccgcattgtggtccgcttctctgcactatgtcgggtggcctcctgaaggcgctgcgcagcgactcctacgtggagctgagccagtaccgggaccagcacttccggggtgacaatgaagaacaagaaaaattactgaagaaaagctgtacgttatatgttggaaatctttctttttacacaactgaagaacaaatctatgaactcttcagcaaaagtggtgacataaagaaaatcattatgggtctggataaaatgaagaaaacagcatgtggattctgttttgtggaatattactcacgcgcagatgcggaaaacgccatgcggtacataaatgggacgcgtctggatgaccgaatcattcgcacagactgggacgcaggctttaaggagggcaggcaatacggccgtgggcgatctgggggccaggttcgggatgagtatcggcaggactacgatgctgggagaggaggctatggaaaactggcacagaaccagtgagtggtgagagctctgtcagtgacaaacactcctttggcctgttgaatttgctgaagaacatcacctaaagtctgcacacgagcccatttttaccaagatttgatcagtgtcttaccagcttcatgcgggtaccggccgatcgacgtggggaaa

SEQ ID NO: 16759 - DNA, 789 bp, Homo sapiens
  misc_feature (749)..(749): n is a, c, g, or t
  misc_feature (777)..(777): n is a, c, g, or t
  misc_feature (781)..(781): n is a, c, g, or t
ccgctggtccgccatcgcggacgcagcctcgtgccgggagtcgccgcattgtggtccgcttctctgcactatgtcgggtggcctcctgaaggcgctgcgcagcgactcctacgtggagctgagccagtaccgggaccagcacttccggggtgacaatgaagaacaagaaaaattactgaagaaaagctatattactcacgcgcagatgcggaaaacgccatgcggtacataaatgggacgcgtctggatgaccgaatcattcgcacagactgggacgcaggctttaaggagggcaggcaatacggccgtgggcgatctgggggccaggttcgggatgagtatcggcaggactacgatgctgggagaggaggctatggaaaactggcacagaaccagtgagtggtgagagctctgtcagtgacaaacactcctttggcctgttgaatttgctgaagaacatcacctaaagtctgcacacgagcccatttttaccaagatttgatcagtgtctttactgagctggaagcctctgaaagttattaaaggacagaatccaaaagaatgcctttaattcttgtctgagaatcttggccatgtgtcagattatcagaacaattttgttaccaggtcagaaattgtgttctttgacaacagattggatctgtaatgttgattagtctttagccataaccactacacttttagaaagacagaaaaatgtaagaatttgtttttaccataatgagttncccttttttttaaaaaaaggggtttttnaaangggggggg

SEQ ID NO: 16760 - DNA, 4665 bp, Homo sapiens
  misc_feature (3148)..(3148): n is a, c, g, or t
  misc_feature (3242)..(3242): n is a, c, g, or t
gcgcggccgggactttggctttgacaccgactgcgagcgggagccgtgcggctggtgctgggtctggactggctctggcggatccccgcccgagttgggcgcaggactttttgccggggtaaacgcaactgcggcggcgccgccgcaagccccggtgcagcctcggcggcgggtttcgccgccgctgccgccgcctccgagcagccctgcggcttctattcactctgggagagcgatgctaagtttctcccatagaaagagccgggacacgcagaccgaagcggcgtagtcggcttccagggcctgaccagtgacccacacccgcgcggacgcctaggctggaggcagggggcccgtgctgtcccgggctgggctcaggcttccgagccgcaggtggaagaggaaccggcgccccgcagagcggccgagaggcggccaagtgaaaggtaattttggacacgccaggcatggaagattcggtgtttgtctatagtaacctcttcagtccctgaatcctgcaccttccgtttttctgtgcttgtacggcctactgggcttcctccctagccagagagctcttctgcagtggtgcggccttcccgggagcctgatcctggcggaccatggggagcaccctgggctgccaccgctccatccccagggacccctcggacctgtcccatagccgcaagttcagcgcagcctgtaacttcagcaacattctagtgaatcaggagcggctcaacatcaacactgccacggaggaggagctgatgaccctgcctggggtgacgcgtgccgtggcacgcagcatcgtggagtaccgagagtatatcggtggcttcaagaaggtggaggacctggcattggtcagtggtgtaggcgccaccaagctggagcaggtcaagtttgagatctgtgtgagcagcaagggcagctcagcgcagcactctcccagttccctgcggcgggacctgctagcggagcagcagcctcaccacctggccacagctgtgcccctcaccccacgtgttaacatcaacacagccaccccggcccagctcatgagcgtgcgaggcctctcggagaaaatggccctcagcatcgtggacttccgccgtgagcatgggccctttcgcagcgttgaggacctagtgaggatggatggtatcaatgccgccttcctggacaggatccggcaccaggtgtttgctgagaggtccaggcccccatccacccacacgaacgggggactgaccttcaccgccaagcctcacccgagccccacttccctgagcctgcagagtgaggacctggacctgccgccaggggggcccacccagattatctccactcggccgtccgtggaggcctttggaggcacaagggatgggaggcctgtgctgaggctggccacctggaacttgcagggctgttccgtggagaaggccaacaaccccggggtgcgagaggtggtgtgcatgacactcctggaaaacagcatcaagcttctagctgtgcaagaactgcttgacagagaggccttggaaaagttctgcacggagctaaaccagccgaccctgcccaacatccgcaagtggaaggggccccggggatgctggaaggctgttgttgctgagaagccctcgaatcagctccagaagggagctgggtatgcaggattcctatgggacgcggctgccggcatggagctgagagacgcgggttcacaggagagctcgccaagcaacgggcacgggaagctggcgggccccagcccatacctcgggaggttcaaggtgggaagtcacgacctgacccttgttaaccttcacctggcagccctgaccctcctggggagcgagaatcccagcaagaatcacagtgatggccaccggttggcgagctttgcacagaccctacaggaaaccctgaaaggagaaaaggatgtcattatcttaggggattttggccaagggccagacagcaatgactatgatatcctgaggaaagaaaagttccaccacctgatccccgcgcacaccttcaccaacatcagcaccaagaaccctcaaggctcgaagtctctggacaacatctggatcagtaaaagcttaaagaaggttttcacaggtcactgggctgtggtgagagaaggcctcacgaacccttggattccggataactggtcttggggcggggtggcttctgaacactgcccagtgctagccgagttctacactgaaaaggactggagcaagaaggacgcccctcggaacggcagcggggtggccttggagcgaagtgaagccaacatcaagcacgagcgatgatgacaccaaatccatgtgtccaccctgggacccaggagggcacagccaaggaatgagccctgtggggtgacgcttcagggcagagctgccttttaatttttattctcagagcatcagcacttgaggccttgccccacgccttctctgtggaccattcaggacctccagtgggggtggcgtgccaggcgcgtaccccaccaggtgggcaaagcagaaacctgcggggagcggagacgccttttatctctggatgccacagacctgagcagcattgggctggctgtccgctgctgactggatggcagcacaaagacaatatgagcagagggaggagaagaaggggtgctcaggctgcgggccacagtccagcagcgccagaagcactcatttctgaccaccaggctatgacgttcctgctgcgcattacagaaagcttttaactgtgatcaggcagtctgctcagatacattgagtggcgatttttagttttgttttgaaaaaataaacagattaacctgcctcgctgcagtgagagcatgggacaagtccgccacagccctcccccgcccccttcccccgccccccaacgcgcagtgtgtatttgcaccacggcaggtgcctctgtgtggagctagggtcaagccctgagcagcttcacttcccctgcgccttttatgtccccaccttgaggccttgcagaggcgcctctcaaggccccatcagctcgccgggacctctgtgaagcctctctgtcatctccccttcccagcccctccttcatcccctgcctccttcaccagcctggcttttgcctngagcactatttgtttagttctctttgcaggacaagaattctctcagggtggtatcacctcctccctcctccccactcactccagtttttagccnggagcctcctgtggttgactatcaggaatgtgtgctgtgtcaggatacataggaagttgacctcggggtatcatggagagtgtccctcctagtggctggaggtagggacagttggttgtggggctggagagaggttgtggggaggaagcgaggatgcgtgcctgccactaggcatctgcatccccgagcccaagccaggagggatttcccttaggcaacaccatcccagggagatctgccacaatttgcgtttcacagctgaagacgccgaggcttagagagctcgacctcctcaaggtcacaccactgggtaaatagagggatgcagactcaggttttgctatgtgctcacatttcaactttatgcttaacatgaatggaaaaatatgaaagtaaatagtgaaaaggtgagttatgagcttagattacctagattattccagtatcccatggaagctgaggacttattccgctttccacaccgaacactaaatgtggaccagtatcaagaaccctcctgtccccacgcagtgtaaacccagtggcttctctgacctggagctgatgggccgtgaagggggcccatttttctccaaaggccatccttttggggccacctggctccaaggagcatcgctggtcttggggacgggaagggaaccctcttccaggagctctaagggtacttgggaatcaattgtgtccattctgaggtctctccagtgggagggcggcagctcctgtccctgggttcaggctgtgcttctggaagcatcgaaatgggatgtctgagccttgaggaaaagcagcagggttagcattaaagtcaagaggggcagctcaggatgctaccagggagcacatcgtttctggtgcctcatctaaaggtaaaacctcccctacattcaccagccggatgtcccaaatccctttagccagattgctttttgcaaccaaagctgtggacagaaaagcctccttaagtgagctgaggggacaggaaatccaatcagatgacctttgtgttcgtaatcgggcttgagccagaggctggggagctgagtcccagccaaacctcactggcccttttgcttttcacgcccagggctcagtggcccaggaagtgtgctgggcagcctgttcttactccagctcaacccattgggtgttggctgtttttggttttagttgttgttttgtattttgttgttttaattaataggctttatttgtaagagcagttttatgtttacagaaaaattaggcacaaagggattcccatatccctcctcttctttgcatatttccccctctaattagcatgttgcattagcatggcactttgttacaactgatgaacttgtattcattattagctacagtgttcatagtttatattaaagttcactctttgtgttgtgca

SEQ ID NO: 16761 - DNA, 4943 bp, Homo sapiens
  misc_feature (3148)..(3148): n is a, c, g, or t
  misc_feature (3242)..(3242): n is a, c, g, or t
gcgcggccgggactttggctttgacaccgactgcgagcgggagccgtgcggctggtgctgggtctggactggctctggcggatccccgcccgagttgggcgcaggactttttgccggggtaaacgcaactgcggcggcgccgccgcaagccccggtgcagcctcggcggcgggtttcgccgccgctgccgccgcctccgagcagccctgcggcttctattcactctgggagagcgatgctaagtttctcccatagaaagagccgggacacgcagaccgaagcggcgtagtcggcttccagggcctgaccagtgacccacacccgcgcggacgcctaggctggaggcagggggcccgtgctgtcccgggctgggctcaggcttccgagccgcaggtggaagaggaaccggcgccccgcagagcggccgagaggcggccaagtgaaaggtaattttggacacgccaggcatggaagattcggtgtttgtctatagtaacctcttcagtccctgaatcctgcaccttccgtttttctgtgcttgtacggcctactgggcttcctccctagccagagagctcttctgcagtggtgcggccttcccgggagcctgatcctggcggaccatggggagcaccctgggctgccaccgctccatccccagggacccctcggacctgtcccatagccgcaagttcagcgcagcctgtaacttcagcaacattctagtgaatcaggagcggctcaacatcaacactgccacggaggaggagctgatgaccctgcctggggtgacgcgtgccgtggcacgcagcatcgtggagtaccgagagtatatcggtggcttcaagaaggtggaggacctggcattggtcagtggtgtaggcgccaccaagctggagcaggtcaagtttgagatctgtgtgagcagcaagggcagctcagcgcagcactctcccagttccctgcggcgggacctgctagcggagcagcagcctcaccacctggccacagctgtgcccctcaccccacgtgttaacatcaacacagccaccccggcccagctcatgagcgtgcgaggcctctcggagaaaatggccctcagcatcgtggacttccgccgtgagcatgggccctttcgcagcgttgaggacctagtgaggatggatggtatcaatgccgccttcctggacaggatccggcaccaggtgtttgctgagaggtccaggcccccatccacccacacgaacgggggactgaccttcaccgccaagcctcacccgagccccacttccctgagcctgcagagtgaggacctggacctgccgccaggggggcccacccagattatctccactcggccgtccgtggaggcctttggaggcacaagggatgggaggcctgtgctgaggctggccacctggaacttgcagggctgttccgtggagaaggccaacaaccccggggtgcgagaggtggtgtgcatgacactcctggaaaacagcatcaagcttctagctgtgcaagaactgcttgacagagaggccttggaaaagttctgcacggagctaaaccagccgaccctgcccaacatccgcaagtggaaggggccccggggatgctggaaggctgttgttgctgagaagccctcgaatcagctccagaagggagctgggtatgcaggattcctatgggacgcggctgccggcatggagctgagagacgcgggttcacaggagagctcgccaagcaacgggcacgggaagctggcgggccccagcccatacctcgggaggttcaaggtgggaagtcacgacctgacccttgttaaccttcacctggcagccctgaccctcctggggagcgagaatcccagcaagaatcacagtgatggccaccggttggcgagctttgcacagaccctacaggaaaccctgaaaggagaaaaggatgtcattatcttaggggattttggccaagggccagacagcaatgactatgatatcctgaggaaagaaaagttccaccacctgatccccgcgcacaccttcaccaacatcagcaccaagaaccctcaaggctcgaagtctctggacaacatctggatcagtaaaagcttaaagaaggttttcacaggtcactgggctgtggtgagagaaggcctcacgaacccttggattccggataactggtcttggggcggggtggcttctgaacactgcccagtgctagccgagttctacactgaaaaggactggagcaagaaggacgcccctcggaacggcagcggggtggccttggagcgaagtgaagccaacatcaagcacgagcgatgatgacaccaaatccatgtgtccaccctgggacccaggagggcacagccaaggaatgagccctgtggggtgacgcttcagggcagagctgccttttaatttttattctcagagcatcagcacttgaggccttgccccacgccttctctgtggaccattcaggacctccagtgggggtggcgtgccaggcgcgtaccccaccaggtgggcaaagcagaaacctgcggggagcggagacgccttttatctctggatgccacagacctgagcagcattgggctggctgtccgctgctgactggatggcagcacaaagacaatatgagcagagggaggagaagaaggggtgctcaggctgcgggccacagtccagcagcgccagaagcactcatttctgaccaccaggctatgacgttcctgctgcgcattacagaaagcttttaactgtgatcaggcagtctgctcagatacattgagtggcgatttttagttttgttttgaaaaaataaacagattaacctgcctcgctgcagtgagagcatgggacaagtccgccacagccctcccccgcccccttcccccgccccccaacgcgcagtgtgtatttgcaccacggcaggtgcctctgtgtggagctagggtcaagccctgagcagcttcacttcccctgcgccttttatgtccccaccttgaggccttgcagaggcgcctctcaaggccccatcagctcgccgggacctctgtgaagcctctctgtcatctccccttcccagcccctccttcatcccctgcctccttcaccagcctggcttttgcctngagcactatttgtttagttctctttgcaggacaagaattctctcagggtggtatcacctcctccctcctccccactcactccagtttttagccnggagcctcctgtggttgactatcaggaatgtgtgctgtgtcaggatacataggaagttgacctcggggtatcatggagagtgtccctcctagtggctggaggtagggacagttggttgtggggctggagagaggttgtggggaggaagcgaggatgcgtgcctgccactaggcatctgcatccccgagcccaagccaggagggatttcccttaggcaacaccatcccagggagatctgccacaatttgcgtttcacagctgaagacgccgaggcttagagagctcgacctcctcaaggtcacaccactgggtaaatagagggatgcagactcaggttttgctatgtgctcacatttcaactttatgcttaacatgaatggaaaaatatgaaagtaaatagtgaaaaggtgagttatgagcttagattacctagattattccagtatcccatggaagctgaggacttattccgctttccacaccgaacactaaatgtggaccagtatcaagaaccctcctgtccccacgcagtgtaaacccagtggcttctctgacctggagctgatgggccgtgaagggggcccatttttctccaaaggccatccttttggggccacctggctccaaggagcatcgctggtcttggggacgggaagggaaccctcttccaggagctctaagggtacttgggaatcaattgtgtccattctgaggtctctccagtgggagggcggcagctcctgtccctgggttcaggctgtgcttctggaagcatcgaaatgggatgtctgagccttgaggaaaagcagcagggttagcattaaagtcaagaggggcagctcaggatgctaccagggagcacatcgtttctggtgcctcatctaaaggtaaaacctcccctacattcaccagccggatgtcccaaatccctttagccagattgctttttgcaaccaaagctgtggacagaaaagcctccttaagtgagctgaggggacaggaaatccaatcagatgacctttgtgttcgtaatcgggcttgagccagaggctggggagctgagtcccagccaaacctcactggcccttttgcttttcacgcccagggctcagtggcccaggaagtgtgctgggcagcctgttcttactccagctcaacccattgggtgttggctgtttttggttttagttgttgttttgtattttgttgttttaattaataggctttatttgtaagagcagttttatgtttacagaaaaattaggcacaaagggattcccatatccctcctcttctttgcatatttccccctctaattagcatgttgcattagcatggcactttgttacaactgatgaacttgtattcattattagctacagtgttcatagtttatattaaagttcactctttgtgttgtgcatcctatgggttttgacaaatgtagaatgacatgtatcaccatgctacagaatcattcagaatagttcctctgatgtaaaaatgcccttgtggtggggcatggtggctcgagcccgtaatcccagcactttgggaggtggaggcgggcagatcatttgaggtcaggagttcgagaccagcttgaccaacatggtgaaaccccatctctactaaaagtacaaaatttagccagatgtggtggcgcatgcctgtattcgcagctacttgggaggctgaagc

SEQ ID NO: 16762 - DNA, 2032 bp, Homo sapiens
tggtctccatattttgaagtggatagttgttccactcctcatcctactgtgtgcaattttattttgcctcagtgacagtcactttacagccatattggtgcaacatgcattagcaaaagaagtgcatgccgcgtgcacgtgtgtgggtgcggcagcagctctccgcagcaagaggtaaacaagacaagcactacggtggttcaagttgaagctggaggtcattttttgcccctgtaagctgagccctgaagaagaaagtcaccatgtatccatctttgttacctttttggatttgacgctgatccagatcctcctgggaccttcaatccgctgcttttacaaggatgaaaaggattctgatgactttttttgaactgtttgggcaggaatgctacagagagaatcaatttctgtgaactgagagtccccaggtgataatttggtgtttcacacacaggcagttttctttttaatgtgtggtgcttgtttagtcatctggctcttgcaaaccctagtgtttgaaaaacagggatgtagttcagcagtgtctgaataaggctgatgactcagaatcatgcagtgcctggcttctcaggccgccgccagccgggactgctttaggcgcgaacccacgcttctgacctgtgctctgtctttgcagttctttctgcacggagctaaaccagccgaccctgcccaacatccgcaagtggaaggggccccggggatgctggaaggctgttgttgctgagaagccctcgaatcagctccagaaggtaccctcgtctgcaaagcctggcctttcccttcatttaatttatacatacttttcccctaatcaagggcatttaaaaatttcctttgccaatatccccggttcaattttgtatttctgcccaatttttaaatccttgccattcatttccaaatgccctggttttcggttcacgtttagattggtaatggactcctgccaagaaggaaatgagagccttagggtgttgggagagaggaggggagaaaggcaacaaatgggtatttctgtcctttgtccttctaatcccttcgccacagttctgtcttctgccaagtttgtgcagagctcattactcgttgactgaaaatttcagattcaccttagttcacacatgaagtatttgcttctagtggtagaaattatgcacataatttcaacatagaaatgttctattgaaatgttcagcagattttggttttgaattttctttcatcagtatcacccatatgagcaggtaagggtaaatctctgtaaatacacgttttccctcatattattattcaaggccagatttattcaccttgcaatgcttaacatcaatggagttttagatttttaaacagactcctgataataaccaggagttgaaaatgtattattacataattttcctataaatgcagatttttaaatccctagtatacctaacatgcttacaaacacatgtgatttatacttaatatgattatgtttataatgtaggctcttaaatcataaatgtatactggattaaaagtggccatttttttgacagtaagcccctactctctttttagctactacttaaagaggtacatgtaaatcttctgtctctgggttttatgtttgggggtgtaaatggctcctgccagctgacagtgagtcagcacacttcagagaaggctggagataaagctgaatttgaatgcatctagttcagggttctcccttccagtccacgtggaaataataagaataataccaccttccttttttgatcgcactttacatgtatgtaggtgtctgagcttcacaagccttttatagtccattcagcactgcattcattcaacaaatcattaatgaaaggtggctatgtaccaggcatattgtttcatgccaggtacacactggtgagaaaaactccatgcctgcatgttttcactctttgcaagacacagtggggatcccggctggagcctgacctggcccctcccgcagggagtgcacagcccg

SEQ ID NO: 16763 - DNA, 944 bp, Homo sapiens
tggtctccatattttgaagtggatagttgttccactcctcatcctactgtgtgcaattttattttgcctcagtgacagtcactttacagccatattggtgcaacatgcattagcaaaagaagtgcatgccgcgtgcacgtgtgtgggtgcggcagcagctctccgcagcaagaggtaaacaagacaagcactacggtggttcaagttgaagctggaggtcattttttgcccctgtaagctgagccctgaagaagaaagtcaccatgtatccatctttgttacctttttggatttgacgctgatccagatcctcctgggaccttcaatccgctgcttttacaaggatgaaaaggattctgatgactttttttgaactgtttgggcaggaatgctacagagagaatcaatttctgtgaactgagagtccccaggtgataatttggtgtttcacacacaggcagttttctttttaatgtgtggtgcttgtttagtcatctggctcttgcaaaccctagtgtttgaaaaacagggatgtagttcagcagtgtctgaataaggctgatgactcagaatcatgcagtgcctggcttctcaggccgccgccagccgggactgctttaggcgcgaacccacgcttctgacctgtgctctgtctttgcagttctgggaagctggcgggccccagcccatacctcgggaggttcaaggtgggaagtcacgacctgacccttgttaaccttcacctggcagccctgaccctcctggggagcgagaatcccagcaagaatcacagtgatggccaccggttggcgagctttgcacagaccctacaggaaaccctgaaaggtaggacattgtcttttgctgtgactcggccactgttttgcagagcagcagggctgcctcttctgagccatctctgaccacttgggctggctgtttgt

SEQ ID NO: 16764 - DNA, 3777 bp, Homo sapiens
  misc_feature (2260)..(2260): n is a, c, g, or t
  misc_feature (2354)..(2354): n is a, c, g, or t
tggtctccatattttgaagtggatagttgttccactcctcatcctactgtgtgcaattttattttgcctcagtgacagtcactttacagccatattggtgcaacatgcattagcaaaagaagtgcatgccgcgtgcacgtgtgtgggtgcggcagcagctctccgcagcaagaggtaaacaagacaagcactacggtggttcaagttgaagctggaggtcattttttgcccctgtaagctgagccctgaagaagaaagtcaccatgtatccatctttgttacctttttggatttgacgctgatccagatcctcctgggaccttcaatccgctgcttttacaaggatgaaaaggattctgatgactttttttgaactgtttgggcaggaatgctacagagagaatcaatttctgtgaactgagagtccccaggtgataatttggtgtttcacacacaggcagttttctttttaatgtgtggtgcttgtttagtcatctggctcttgcaaaccctagtgtttgaaaaacagggatgtagttcagcagtgtctgaataaggctgatgactcagaatcatgcagtgcctggcttctcaggccgccgccagccgggactgctttaggcgcgaacccacgcttctgacctgtgctctgtctttgcagttctttctgcacggagctaaaccagccgaccctgcccaacatccgcaagtggaaggggccccggggatgctggaaggctgttgttgctgagaagccctcgaatcagctccagaagggagctgggtatgcaggattcctatgggacgcggctgccggcatggagctgagagacgcgggttcacaggagagctcgccaagcaacgggcacgggaagctggcgggccccagcccatacctcgggaggttcaaggtgggaagtcacgacctgacccttgttaaccttcacctggcagccctgaccctcctggggagcgagaatcccagcaagaatcacagtgatggccaccggttggcgagctttgcacagaccctacaggaaaccctgaaaggagaaaaggatgtcattatcttaggggattttggccaagggccagacagcaatgactatgatatcctgaggaaagaaaagttccaccacctgatccccgcgcacaccttcaccaacatcagcaccaagaaccctcaaggctcgaagtctctggacaacatctggatcagtaaaagcttaaagaaggttttcacaggtcactgggctgtggtgagagaaggcctcacgaacccttggattccggataactggtcttggggcggggtggcttctgaacactgcccagtgctagccgagttctacactgaaaaggactggagcaagaaggacgcccctcggaacggcagcggggtggccttggagcgaagtgaagccaacatcaagcacgagcgatgatgacaccaaatccatgtgtccaccctgggacccaggagggcacagccaaggaatgagccctgtggggtgacgcttcagggcagagctgccttttaatttttattctcagagcatcagcacttgaggccttgccccacgccttctctgtggaccattcaggacctccagtgggggtggcgtgccaggcgcgtaccccaccaggtgggcaaagcagaaacctgcggggagcggagacgccttttatctctggatgccacagacctgagcagcattgggctggctgtccgctgctgactggatggcagcacaaagacaatatgagcagagggaggagaagaaggggtgctcaggctgcgggccacagtccagcagcgccagaagcactcatttctgaccaccaggctatgacgttcctgctgcgcattacagaaagcttttaactgtgatcaggcagtctgctcagatacattgagtggcgatttttagttttgttttgaaaaaataaacagattaacctgcctcgctgcagtgagagcatgggacaagtccgccacagccctcccccgcccccttcccccgccccccaacgcgcagtgtgtatttgcaccacggcaggtgcctctgtgtggagctagggtcaagccctgagcagcttcacttcccctgcgccttttatgtccccaccttgaggccttgcagaggcgcctctcaaggccccatcagctcgccgggacctctgtgaagcctctctgtcatctccccttcccagcccctccttcatcccctgcctccttcaccagcctggcttttgcctngagcactatttgtttagttctctttgcaggacaagaattctctcagggtggtatcacctcctccctcctccccactcactccagtttttagccnggagcctcctgtggttgactatcaggaatgtgtgctgtgtcaggatacataggaagttgacctcggggtatcatggagagtgtccctcctagtggctggaggtagggacagttggttgtggggctggagagaggttgtggggaggaagcgaggatgcgtgcctgccactaggcatctgcatccccgagcccaagccaggagggatttcccttaggcaacaccatcccagggagatctgccacaatttgcgtttcacagctgaagacgccgaggcttagagagctcgacctcctcaaggtcacaccactgggtaaatagagggatgcagactcaggttttgctatgtgctcacatttcaactttatgcttaacatgaatggaaaaatatgaaagtaaatagtgaaaaggtgagttatgagcttagattacctagattattccagtatcccatggaagctgaggacttattccgctttccacaccgaacactaaatgtggaccagtatcaagaaccctcctgtccccacgcagtgtaaacccagtggcttctctgacctggagctgatgggccgtgaagggggcccatttttctccaaaggccatccttttggggccacctggctccaaggagcatcgctggtcttggggacgggaagggaaccctcttccaggagctctaagggtacttgggaatcaattgtgtccattctgaggtctctccagtgggagggcggcagctcctgtccctgggttcaggctgtgcttctggaagcatcgaaatgggatgtctgagccttgaggaaaagcagcagggttagcattaaagtcaagaggggcagctcaggatgctaccagggagcacatcgtttctggtgcctcatctaaaggtaaaacctcccctacattcaccagccggatgtcccaaatccctttagccagattgctttttgcaaccaaagctgtggacagaaaagcctccttaagtgagctgaggggacaggaaatccaatcagatgacctttgtgttcgtaatcgggcttgagccagaggctggggagctgagtcccagccaaacctcactggcccttttgcttttcacgcccagggctcagtggcccaggaagtgtgctgggcagcctgttcttactccagctcaacccattgggtgttggctgtttttggttttagttgttgttttgtattttgttgttttaattaataggctttatttgtaagagcagttttatgtttacagaaaaattaggcacaaagggattcccatatccctcctcttctttgcatatttccccctctaattagcatgttgcattagcatggcactttgttacaactgatgaacttgtattcattattagctacagtgttcatagtttatattaaagttcactctttgtgttgtgca

SEQ ID NO: 16765 - DNA, 3573 bp, Homo sapiens
  misc_feature (2056)..(2056): n is a, c, g, or t
  misc_feature (2150)..(2150): n is a, c, g, or t
tggtctccatattttgaagtggatagttgttccactcctcatcctactgtgtgcaattttattttgcctcagtgacagtcactttacagccatattggtgcaacatgcattagcaaaagaagtgcatgccgcgtgcacgtgtgtgggtgcggcagcagctctccgcagcaagaggtaaacaagacaagcactacggtggttcaagttgaagctggaggtcattttttgcccctgtaagctgagccctgaagaagaaagtcaccatgtatccatctttgttacctttttggatttgacgctgatccagatcctcctgggaccttcaatccgctgcttttacaaggatgaaaaggattctgatgactttttttgaactgtttgggcaggaatgctacagagagaatcaatttctgtgaactgagagtccccaggtgataatttggtgtttcacacacaggcagttttctttttaatgtgtggtgcttgtttagtcatctggctcttgcaaaccctagtgtttgaaaaacagggatgtagttcagcagtgtctgaataaggctgatgactcagaatcatgcagtgcctggcttctcaggccgccgccagccgggactgctttaggcgcgaacccacgcttctgacctgtgctctgtctttgcagttctgggaagctggcgggccccagcccatacctcgggaggttcaaggtgggaagtcacgacctgacccttgttaaccttcacctggcagccctgaccctcctggggagcgagaatcccagcaagaatcacagtgatggccaccggttggcgagctttgcacagaccctacaggaaaccctgaaaggagaaaaggatgtcattatcttaggggattttggccaagggccagacagcaatgactatgatatcctgaggaaagaaaagttccaccacctgatccccgcgcacaccttcaccaacatcagcaccaagaaccctcaaggctcgaagtctctggacaacatctggatcagtaaaagcttaaagaaggttttcacaggtcactgggctgtggtgagagaaggcctcacgaacccttggattccggataactggtcttggggcggggtggcttctgaacactgcccagtgctagccgagttctacactgaaaaggactggagcaagaaggacgcccctcggaacggcagcggggtggccttggagcgaagtgaagccaacatcaagcacgagcgatgatgacaccaaatccatgtgtccaccctgggacccaggagggcacagccaaggaatgagccctgtggggtgacgcttcagggcagagctgccttttaatttttattctcagagcatcagcacttgaggccttgccccacgccttctctgtggaccattcaggacctccagtgggggtggcgtgccaggcgcgtaccccaccaggtgggcaaagcagaaacctgcggggagcggagacgccttttatctctggatgccacagacctgagcagcattgggctggctgtccgctgctgactggatggcagcacaaagacaatatgagcagagggaggagaagaaggggtgctcaggctgcgggccacagtccagcagcgccagaagcactcatttctgaccaccaggctatgacgttcctgctgcgcattacagaaagcttttaactgtgatcaggcagtctgctcagatacattgagtggcgatttttagttttgttttgaaaaaataaacagattaacctgcctcgctgcagtgagagcatgggacaagtccgccacagccctcccccgcccccttcccccgccccccaacgcgcagtgtgtatttgcaccacggcaggtgcctctgtgtggagctagggtcaagccctgagcagcttcacttcccctgcgccttttatgtccccaccttgaggccttgcagaggcgcctctcaaggccccatcagctcgccgggacctctgtgaagcctctctgtcatctccccttcccagcccctccttcatcccctgcctccttcaccagcctggcttttgcctngagcactatttgtttagttctctttgcaggacaagaattctctcagggtggtatcacctcctccctcctccccactcactccagtttttagccnggagcctcctgtggttgactatcaggaatgtgtgctgtgtcaggatacataggaagttgacctcggggtatcatggagagtgtccctcctagtggctggaggtagggacagttggttgtggggctggagagaggttgtggggaggaagcgaggatgcgtgcctgccactaggcatctgcatccccgagcccaagccaggagggatttcccttaggcaacaccatcccagggagatctgccacaatttgcgtttcacagctgaagacgccgaggcttagagagctcgacctcctcaaggtcacaccactgggtaaatagagggatgcagactcaggttttgctatgtgctcacatttcaactttatgcttaacatgaatggaaaaatatgaaagtaaatagtgaaaaggtgagttatgagcttagattacctagattattccagtatcccatggaagctgaggacttattccgctttccacaccgaacactaaatgtggaccagtatcaagaaccctcctgtccccacgcagtgtaaacccagtggcttctctgacctggagctgatgggccgtgaagggggcccatttttctccaaaggccatccttttggggccacctggctccaaggagcatcgctggtcttggggacgggaagggaaccctcttccaggagctctaagggtacttgggaatcaattgtgtccattctgaggtctctccagtgggagggcggcagctcctgtccctgggttcaggctgtgcttctggaagcatcgaaatgggatgtctgagccttgaggaaaagcagcagggttagcattaaagtcaagaggggcagctcaggatgctaccagggagcacatcgtttctggtgcctcatctaaaggtaaaacctcccctacattcaccagccggatgtcccaaatccctttagccagattgctttttgcaaccaaagctgtggacagaaaagcctccttaagtgagctgaggggacaggaaatccaatcagatgacctttgtgttcgtaatcgggcttgagccagaggctggggagctgagtcccagccaaacctcactggcccttttgcttttcacgcccagggctcagtggcccaggaagtgtgctgggcagcctgttcttactccagctcaacccattgggtgttggctgtttttggttttagttgttgttttgtattttgttgttttaattaataggctttatttgtaagagcagttttatgtttacagaaaaattaggcacaaagggattcccatatccctcctcttctttgcatatttccccctctaattagcatgttgcattagcatggcactttgttacaactgatgaacttgtattcattattagctacagtgttcatagtttatattaaagttcactctttgtgttgtgca

SEQ ID NO: 16766 - DNA, 2852 bp, Homo sapiens
gcgcggccgggactttggctttgacaccgactgcgagcgggagccgtgcggctggtgctgggtctggactggctctggcggatccccgcccgagttgggcgcaggactttttgccggggtaaacgcaactgcggcggcgccgccgcaagccccggtgcagcctcggcggcgggtttcgccgccgctgccgccgcctccgagcagccctgcggcttctattcactctgggagagcgatgctaagtttctcccatagaaagagccgggacacgcagaccgaagcggcgtagtcggcttccagggcctgaccagtgacccacacccgcgcggacgcctaggctggaggcagggggcccgtgctgtcccgggctgggctcaggcttccgagccgcaggtggaagaggaaccggcgccccgcagagcggccgagaggcggccaagtgaaaggtaattttggacacgccaggcatggaagattcggtgtttgtctatagtaacctcttcagtccctgaatcctgcaccttccgtttttctgtgcttgtacggcctactgggcttcctccctagccagagagctcttctgcagtggtgcggccttcccgggagcctgatcctggcggaccatggggagcaccctgggctgccaccgctccatccccagggacccctcggacctgtcccatagccgcaagttcagcgcagcctgtaacttcagcaacattctagtgaatcaggagcggctcaacatcaacactgccacggaggaggagctgatgaccctgcctggggtgacgcgtgccgtggcacgcagcatcgtggagtaccgagagtatatcggtggcttcaagaaggtggaggacctggcattggtcagtggtgtaggcgccaccaagctggagcaggtcaagtttgagatctgtgtgagcagcaagggcagctcagcgcagcactctcccagttccctgcggcgggacctgctagcggagcagcagcctcaccacctggccacagctgtgcccctcaccccacgtgttaacatcaacacagccaccccggcccagctcatgagcgtgcgaggcctctcggagaaaatggccctcagcatcgtggacttccgccgtgagcatgggccctttcgcagcgttgaggacctagtgaggatggatggtatcaatgccgccttcctggacaggatccggcaccaggtgtttgctgagaggtccaggcccccatccacccacacgaacgggggactgaccttcaccgccaagcctcacccgagccccacttccctgagcctgcagagtgaggacctggacctgccgccaggggggcccacccagattatctccactcggccgtccgtggaggcctttggaggcacaagggatgggaggcctgtgctgaggctggccacctggaacttgcagggctgttccgtggagaaggccaacaaccccggggtgcgagaggtggtgtgcatgacactcctggaaaacagcatcaagcttctagctgtgcaagaactgcttgacagagaggccttggaaaagttctgcacggagctaaaccagccgaccctgcccaacatccgcaagtggaaggggccccggggatgctggaaggctgttgttgctgagaagccctcgaatcagctccagaagggagctgggtatgcaggattcctatgggacgcggctgccggcatggagctgagagacgcgggttcacaggagagctcgccaagcaacgggcacgggaagctggcgggccccagcccatacctcgggaggttcaaggtgggaagtcacgacctgacccttgttaaccttcacctggcagccctgaccctcctggggagcgagaatcccagcaagaatcacagtgatggccaccggttggcgagctttgcacagaccctacaggaaaccctgaaaggagaaaaggatgtcattatcttaggggattttggccaagggccagacagcaatgactatgatatcctgaggaaagaaaagttccaccacctgatccccgcgcacaccttcaccaacatcagcaccaagaaccctcaaggctcgaagtctctggacaacatctggatcagtaaaagcttaaagaaggttttcacaggtcactgggctgtggtgagagaaggcctcacgaacccttggattccggataactggtcttggggcggggtggcttctgaacactgcccagtgctagccgagttctacactgaaaaggactggagcaagaaggacgcccctcggaacggcagcggggtggccttggagcgaagtgaagccaacatcaagcacgagcgatgatgacaccaaatccatgtgtccaccctgggacccaggagggcacagccaaggaatgagccctgtggggtgacgcttcagggcagagctgccttttaatttttattctcagagcatcagcacttgaggccttgccccacgccttctctgtggaccattcaggacctccagtgggggtggcgtgccaggcgcgtaccccaccaggtgggcaaagcagaaacctgcggggagcggagacgccttttatctctggatgccacagacctgagcagcattgggctggctgtccgctgctgactggatggcagcacaaagacaatatgagcagagggaggagaagaaggggtgctcaggctgcgggccacagtccagcagcgccagaagcactcatttctgaccaccaggctatgacgttcctgctgcgcattacagaaagcttttaactgtgatcaggcagtctgctcagatacattgagtggcgatttttagttttgttttgaaaaaataaacagattaacctgc

SEQ ID NO: 16767 - DNA, 1314 bp, Homo sapiens
gcgcggccgggactttggctttgacaccgactgcgagcgggagccgtgcggctggtgctgggtctggactggctctggcggatccccgcccgagttgggcgcaggactttttgccggggtaaacgcaactgcggcggcgccgccgcaagccccggtgcagcctcggcggcgggtttcgccgccgctgccgccgcctccgagcagccctgcggcttctattcactctgggagagcgatgctaagtttctcccatagaaagagccgggacacgcagaccgaagcggcgtagtcggcttccagggcctgaccagtgacccacacccgcgcggacgcctaggctggaggcagggggcccgtgctgtcccgggctgggctcaggcttccgagccgcaggtggaagaggaaccggcgccccgcagagcggccgagaggcggccaagtgaaaggtaattttggacacgccaggcatggaagattcggtgtttgtctatagtaacctcttcagtccctgaatcctgcaccttccgtttttctgtgcttgtacggcctactgggcttcctccctagccagagagctcttctgcagtggtgcggccttcccgggagcctgatcctggcggaccatggggagcaccctgggctgccaccgctccatccccagggacccctcggacctgtcccatagccgcaagttcagcgcagcctgtaacttcagcaacattctagtgaatcaggaccttttatctctggatgccacagacctgagcagcattgggctggctgtccgctgctgactggatggcagcacaaagacaatatgagcagagggaggagaagaaggggtgctcaggctgcgggccacagtccagcagcgccagaagcactcatttctgaccaccaggctatgacgttcctgctgcgcattacagaaagcttttaactgtgatcaggcagtctgctcagatacattgagtggcgatttttagttttgttttgaaaaaataaacagattaacctgcaaaaaaaaaaaaacgaaacaacacaaaaagaaacaacaaaaacaaacaccaccaacaagacaacaaagcaaaaaaaagacataaaaaacaaaacaaaaaacagagcgggggcagcagcacaaacgaaaaatctgcaccccgaaggggggcccacgaaactaagagcagacaaggagcccaggaagaacaacaagaggggccgcccccacacaagaagagacgacatcataacaaaaaccaaccaacaagaggcgccagaagacaaacaacacgagcaagcacacgcacaaccccg

SEQ ID NO: 16768 - DNA, 212 bp, Homo sapiens
gtgaggacaggaaccaccatgggtgttgggtgtgaaggcaacttgtgcgtgacctcatctatggatgcaaatgaatggattcttttgcgggtagggagggtgcaagagtttttaatcaatgttcttgaagcctcagccaataccgtcacctgagaatgggctgtccttctgctccagaattttctgaatacagctgggcttgtgacccatgt

SEQ ID NO: 16769 - DNA, 410 bp, Homo sapiens
aggaattttaatttccccctgtgagtattgtgagtgggggtaggggctctggggtctgttttgctctgacaccaattttactcacttaaatttgtctttattcatagagatttttgttcaccaagaatgggtgctgatggtagcatgtaggggtaaagtgggtaatagaccagtgaagttgtggattaaaaagcatatatcctcaagacagttggtgggcaacaccatttctatataaggaaaactgtatctcattactgttaggagtttgttaatggaattaagaaacacagtctatcgttgtgctacctataaacttctgaagtcctctgttatgtatagtgctatccacatgtaaaggtcccaactgacaaaataacttacaaaggaactacttttttcttcactag

SEQ ID NO: 16770 - DNA, 654 bp, Homo sapiens
ccgttttcctcttaggaccattcattgtgttaggaccgcggaacaaggaaggaccggttggggccatgtgaataatttagtagggtctggaatcctgcagagcgaatgcctcagagtagaaagtaaatagacggtgttgatattagcgcagagctgggcatctggaaatatcaagtcagaacattagggccgataacctatgcaggagtcagcatttctgttttcacctttgtcgtgtttaagtcagtattgttggaacttttcttacatttttctacaagacattttctgatttcccagttgttagccagcaactaatgatgcgagcagttatcaattaaacagctgttaactcttgccttcattcacagatacaatgttgcgcattcaaaatgtgaagaccgttctcttaggttctttttttattttcctggcaaaagagaccaaatgggtgtgacctgctcaggcatacccgctgcctgcagctgaatcacaggccttcattcgcttcctgttagctcagataagctgggaggagacagtgacagcctaaaagtaaatttctgtttgaagtgagataaaaatctttcactttcttctgtaagtctttcctggtccctttagttgttgttgggaaggaaatgcttgattatt

SEQ ID NO: 16771 - DNA, 434 bp, Homo sapiens
ggaaggcattcactgcctccatatgccctctgagaagcagcattttctctgcagagcctgcagacaaggttatctccacttggaaacaaataaacaaaccaaagcaaactctgtccagggtcctgaaagcaagagcacgtctctagcctcagtggtgaagagcatatcttctgccacctgtggacaaatgttcacattctatgggcccaggtggacatttgcagagagcagcccccaagcctgctttccaccccacctttactgagaagctagggccctgaccaatggtagaggctactatgtaggaagtgcctgtacttaagaggcaagggtgtggtgttgtgaaaaaaatatccaatttcatgcaccaatgcccagattttgtgtgatgataacccttcaagtgtagggatagaaaaaggggatcactaaca

SEQ ID NO: 16772 - DNA, 407 bp, Homo sapiens
ggtagagatggagtgtcgctatgttgcctaggcttgtctcaagctcctgggctcaagcaatcctcccgccttggcctcctaaagcacagggttttacaggcatgggccaccacgcccagccagcagctggactgtatatattctctgggctaggttctaatgccatctgacatttgagcctcacaacccttgccaactgggggaccttggtcacgacacttcatcttttgaggtgcttccttgtctacaaactggttgggggatgtttccagcttcgtaggattgctgggacaattaaggaagacagtgtgtgccaagcagcatgtggctattatccctgtttcccaggtgagaaacagggtcagtgatagagctgggatgtgtgcctgcaggctcaccagccagtc

SEQ ID NO: 16773 - DNA, 523 bp, Homo sapiens
gtgagactccttctcaaaaaaaaaaaaaaaaagacttggtcaatatctctttttgttcctaaagaactgacattttacttaggtgatattttattagattttaggtgcactaactggtacatttcacctattgtatgtatatttaaatttagaggagaaacgtttcaatatgacattgttttccagttagttattggagggcacaggagactgcagacagtcagctaaggacaggctgatgactctcggtggcctctcacagaacattccctcagcatgtgccttgtgtgttatcccattaaatagctaatcctcttattgtcctttctcttaggacagccttttgttagaaacctttgtcccaggccctgagggatccttcctctggtctttatgagacaagagctgtgtgctgctcagtagcagatcacaggctcctctgtggacttcacaccttttctgaataatgcgaggcagtattaaagggggagacgaggtgtgatcacttccattttttcactgt

SEQ ID NO: 16774 - DNA, 242 bp, Homo sapiens
tgcacacttctccttgtgtctccaaaaggattccatgtgaaataggagtagagacctccaatacctcgcccatctgttaaaactgcagcgtgggtaccctggcaggctcattagctgccgtggactgctgcggagtggctggagactgtcaggctacgctgggccgatcttctgggtaggtgtatctacacccgtgtatctagtgatttactctcctctggaagagaaacgcgggcacaccc

SEQ ID NO: 16775 - DNA, 322 bp, Homo sapiens
tcaaaccattttctttcttttttttaactaacccagcacaaagctgattttttttttagttttcttactgttgagaccttgattagtaaactggacaaagaacttgaacagatagttcacaaagaaagagaacttggtaaactgtggaaatgttcaggttggcagtaataaaaccactttttaattagctgctgtactacctggttattttttatctttatatttcagtaatgtatgttttactcgatggagcagtctactgtgcaagtgggagaatatgataaagttggaggagcagataaatagaatattgacattatga

SEQ ID NO: 16776 - DNA, 1977 bp, Homo sapiens
cggggcagccagccccgccccattgacgtgcagaccttgaatcgaaacccaggctcctgcaggcactggcacagctacagcgagggcctcggccatccaagggtctcccaggtgaccttccctccaccccaggaagctatgacagaggccgggaagctgcccctaccgctacccccacggctggactggtttgtgcacacccagatgggccagctggcccaagacggggtccccgagtggttccatggtgcaatctcaagagaggatgctgagaacttgctggagtcacagccactgggatcctttctcatcagggtcagtcacagccatgtgggctacacactctcctacaaagcccaaagcagctgctgccatttcatggtgaagctcttggatgatgggactttcatgatccccggggagaaggtggcccacacctcgctggacgccctggtcaccttccaccagcagaagccaattgagccgcgcagggagctgctgacacagccctgcaggcagaaggatcccgcaaacgtggattacgaggatctcttcctctactccaacgcagtggccgaggaagctgcctgcccggtgtctgcccctgaggaggcctccccaaagccagtcctgtgtcaccaatcaaaggaaaggaagccgtcagcagagatgaacagaataaccaccaaggaagccacttcctcctgccccccaaaatcccctcttggagagacccgccagaaactctggaggagcctcaaaatgctccccgagagaggccagagggtccggcagcagctaaaaagccacctcgccactgtgaacttgtcgtcactcttggatgtccggagatccacggtgatctcaggccctgggaccggaaaaggcagccaagatcactcaggggatcccacctcgggggacagaggctacacggatccctgtgtggccacatctctcaaaagcccctcacagccccaggcaccaaaagacagaaaggtccccaccaggaaggccgagaggtcggtcagctgcattgaggtgaccccaggggacaggagttggcaccaaatggtagtgagagccctatcctcccaggagtccaagccagagcaccagggcttggcagagcctgagaacgaccagctcccggaggagtaccaacaaccgccaccctttgcccctgggtactgctagagaacaggtccaccctggctctgggactcgctgccaggggctgccacactcctgaatgccttaacatttcttccatggccccacaccatggcatccgggggtcttcgggaacccgggaaatggaataaagatgtttttggggtctgttcctgcactcacccatggggtgagctggttattttagcaacaatcatcagagtgacgctgatggtttggggcaccagctatacatcagccccagtgccagaccttctattcattattttacgcctcagagcaaggccctcagggagggtcatcctccatgttttgaagaagagactgaggttcagagaggataagaggcgtgaccaaggccacagagctatgggtgtcagcaccaggatttgaagccaggtgaatccgagcccttttcccatatcatctgtttgttctgttgtctaaaagcacactgcaagccgggctcagtggctcatgcctgtagtcccagcactctgtggggccgaggcaggcagatcgcttgaggtcaggagttcgagaccagcctggccaacatggtgaaaccccgtctatactaaaaaattcaaaaattacccggacgtggtggcgcatgcctgtaatcccagctacttgggagcctgaggcgggagaattgcttgaacccgggaggcagaggttgcagtgagccgagatcgcatcactgcagtccagcctggatgacagagtgagactccatctcaaaaaataaataaataaataaaaatgaaattaaaaaataaa

SEQ ID NO: 16777 - DNA, 2016 bp, Homo sapiens
  misc_feature (18)..(19): n is a, c, g, or t
  misc_feature (29)..(29): n is a, c, g, or t
cacaaggaggtcatccannggtctcccangtgaccttccctccaccccaggaagctatgacagaggccgggaagctgcccctaccgctacccccacggctggactggtttgtgcacacccagatgggccagctggcccaagacggggtccccgagtggttccatggtgcaatctcaagagaggatgctgagaacttgctggagtcacagccactgggatcctttctcatcagggtcagtcacagccatgtgggctacacactctcctacaaagcccaaagcagctgctgccatttcatggtgaagctcttggatgatgggactttcatgatccccggggagaaggtggcccacacctcgctggacgccctggtcaccttccaccagcagaagccaattgagccgcgcagggagctgctgacacagccctgcaggcagaaggatcccgcaaacgtggattacgaggatctcttcctctactccaacgcagtggccgaggaagctgcctgcccggtgtctgcccctgaggagacggagtcttgctttgtcgaccaagctggagtggaatggcacagtctaggctcgctgcaacctccgcctcccaggttcaagcgattctcctgcctcagcctcctgagtagctgggactacagcctccccaaagccagtcctgtgtcaccaatcaaaggaaaggaagccgtcagcagagatgaacagaataaccaccaaggaagccacttcctcctgccccccaaaatcccctcttggagagacccgccagaaactctggaggagcctcaaaatgctccccgagagaggccagagggtccggcagcagctaaaaagccacctcgccactgtgaacttgtcgtcactcttggatgtccggagatccacggtgatctcaggccctgggaccggaaaaggcagccaagatcactcaggggatcccacctcgggggacagaggctacacggatccctgtgtggccacatctctcaaaagcccctcacagccccaggcaccaaaagacagaaaggtccccaccaggaaggccgagaggtcggtcagctgcattgaggtgaccccaggggacaggagttggcaccaaatggtagtgagagccctatcctcccaggagtccaagccagagcaccagggcttggcagagcctgagaacgaccagctcccggaggagtaccaacaaccgccaccctttgcccctgggtactgctagagaacaggtccaccctggctctgggactcgctgccaggggctgccacactcctgaatgccttaacatttcttccatggccccacaccatggcatccgggggtcttcgggaacccgggaaatggaataaagatgtttttggggtctgttcctgcactcacccatggggtgagctggttattttagcaacaatcatcagagtgacgctgatggtttggggcaccagctatacatcagccccagtgccagaccttctattcattattttacgcctcagagcaaggccctcagggagggtcatcctccatgttttgaagaagagactgaggttcagagaggataagaggcgtgaccaaggccacagagctatgggtgtcagcaccaggatttgaagccaggtgaatccgagcccttttcccatatcatctgtttgttctgttgtctaaaagcacactgcaagccgggctcagtggctcatgcctgtagtcccagcactctgtggggccgaggcaggcagatcgcttgaggtcaggagttcgagaccagcctggccaacatggtgaaaccccgtctatactaaaaaattcaaaaattacccggacgtggtggcgcatgcctgtaatcccagctacttgggagcctgaggcgggagaattgcttgaacccgggaggcagaggttgcagtgagccgagatcgcatcactgcagtccagcctggatgacagagtgagactccatctcaaaaaataaataaataaataaaaatgaaattaaaaaataaa

SEQ ID NO: 16778 - DNA, 2289 bp, Homo sapiens
cttccctcccttctctacccaggtgaccttccctccaccccaggaagctatgacagaggccgggaagctgcccctaccgctacccccacggctggactggtttgtgcacacccagatgggccagctggcccaagacggggtccccgagtggttccatggtgcaatctcaagagaggatgctgagaacttgctggagtcacagccactgggatcctttctcatcagggtcagtcacagccatgtgggctacacactctcctacaagtaaggcctgggccgggatccagggcaggggcaggtgggctcttgggtttccttggagggggcaaggggtgcttcatgtcatagcttctcagaaagcagcagtaactgaggctgtggatctgagaacgggagctgctagccaagcaatgagtgaagcttttgtccgtagtggcatgttttatctgaggccagcctttgtactcctgtgttataaatgggggaaactgaggcacagcgaggttagtaacctgctgggtgttgcatggccagtgagtgaagaagcctgcatgggaacctggggtagtctggctgtagcagtgacgctgccggcccaagggctggggacttggggcagggatgagggggagtaggatgtcccagcccccgcagtgtctccgcagagcccaaagcagctgctgccatttcatggtgaagctcttggatgatgggactttcatgatccccggggagaaggtggcccacacctcgctggacgccctggtcaccttccaccagcagaagccaattgagccgcgcagggagctgctgacacagccctgcaggcagaaggatcccgcaaacgtggattacgaggatctcttcctctactccaacgcagtggccgaggaagctgcctgcccggtgtctgcccctgaggaggcctccccaaagccagtcctgtgtcaccaatcaaaggaaaggaagccgtcagcagagatgaacagaataaccaccaaggaagccacttcctcctgccccccaaaatcccctcttggagagacccgccagaaactctggaggagcctcaaaatgctccccgagagaggccagagggtccggcagcagctaaaaagccacctcgccactgtgaacttgtcgtcactcttggatgtccggagatccacggtgatctcaggccctgggaccggaaaaggcagccaagatcactcaggggatcccacctcgggggacagaggctacacggatccctgtgtggccacatctctcaaaagcccctcacagccccaggcaccaaaagacagaaaggtccccaccaggaaggccgagaggtcggtcagctgcattgaggtgaccccaggggacaggagttggcaccaaatggtagtgagagccctatcctcccaggagtccaagccagagcaccagggcttggcagagcctgagaacgaccagctcccggaggagtaccaacaaccgccaccctttgcccctgggtactgctagagaacaggtccaccctggctctgggactcgctgccaggggctgccacactcctgaatgccttaacatttcttccatggccccacaccatggcatccgggggtcttcgggaacccgggaaatggaataaagatgtttttggggtctgttcctgcactcacccatggggtgagctggttattttagcaacaatcatcagagtgacgctgatggtttggggcaccagctatacatcagccccagtgccagaccttctattcattattttacgcctcagagcaaggccctcagggagggtcatcctccatgttttgaagaagagactgaggttcagagaggataagaggcgtgaccaaggccacagagctatgggtgtcagcaccaggatttgaagccaggtgaatccgagcccttttcccatatcatctgtttgttctgttgtctaaaagcacactgcaagccgggctcagtggctcatgcctgtagtcccagcactctgtggggccgaggcaggcagatcgcttgaggtcaggagttcgagaccagcctggccaacatggtgaaaccccgtctatactaaaaaattcaaaaattacccggacgtggtggcgcatgcctgtaatcccagctacttgggagcctgaggcgggagaattgcttgaacccgggaggcagaggttgcagtgagccgagatcgcatcactgcagtccagcctggatgacagagtgagactccatctcaaaaaataaataaataaataaaaatgaaattaaaaaataaa

SEQ ID NO: 16779 - DNA, 1343 bp, Homo sapiens
cggggcagccagccccgccccattgacgtgcagaccttgaatcgaaacccaggctcctgcaggcactggcacagctacagcgagggcctcggccatccaagggtctcccaggtgaccttccctccaccccaggaagctatgacagaggccgggaagctgcccctaccgctacccccacggctggactggtttgtgcacacccagatgggccagctggcccaagacggggtccccgagtggttccatggtgcaatctcaagagaggatgctgagaacttgctggagtcacagccactgggatcctttctcatcagggtcagtcacagccatgtgggctacacactctcctacaaagcccaaagcagctgctgccatttcatggtgaagctcttggatgatgggactttcatgatccccggggagaaggtggcccacacctcgctggacgccctggtcaccttccaccagcagaagccaattgagccgcgcagggagctgctgacacagccctgcaggcagaaggatcccgcaaacgtggattacgaggatctcttcctctactccaacgcagtggccgaggaagctgcctgcccggtgtctgcccctgaggaggcctccccaaagccagtcctgtgtcaccaatcaaaggaaaggaagccgtcagcagagatgaacagaataaccaccaaggaagccacttcctcctgccccccaaaatcccctcttggagagacccgccagaaactctggaggagcctcaaaatgctccccgagagaggccagagggtccggcagcagctaaaaagccacctcgccactgtgaacttgtcgtcactcttggatgtccggagatccacggtgatctcaggccctgggaccggaaaaggcagccaagatcactcaggggatcccacctcgggggacagaggctacacggatccctgtgtggccacatctctcaaaagcccctcacagccccaggcaccaaaagacagaaaggtccccaccaggaaggccgagaggtcggtcagctgcattgaggtgaccccaggggacaggagttggcaccaaatggtagtgagagccctatcctcccaggagtccaagccagagcaccagggcttggcagagcctgagaacgaccagctcccggaggagtaccaacaaccgccaccctttgcccctgggtactgctagagaacaggtccaccctggctctgggactcgctgccaggggctgccacactcctgaatgccttaacatttcttccatggccccacaccatggcatccgggggtcttcgggaacccgggaaatggaataaagatgtttttggggtctg

SEQ ID NO: 16780 - DNA, 1324 bp, Homo sapiens
cttccctcccttctctacccaggtgaccttccctccaccccaggaagctatgacagaggccgggaagctgcccctaccgctacccccacggctggactggtttgtgcacacccagatgggccagctggcccaagacggggtccccgagtggttccatggtgcaatctcaagagaggatgctgagaacttgctggagtcacagccactgggatcctttctcatcagggtcagtcacagccatgtgggctacacactctcctacaagtaaggcctgggccgggatccagggcaggggcaggtgggctcttgggtttccttggagggggcaaggggtgcttcatgtcatagcttctcagaaagcagcagtaactgaggctgtggatctgagaacgggagctgctagccaagcaatgagtgaagcttttgtccgtagtggcatgttttatctgaggccagcctttgtactcctgtgttataaatgggggaaactgaggcacagcgaggttagtaacctgctgggtgttgcatggccagtgagtgaagaagcctgcatgggaacctggggtagtctggctgtagcagtgacgctgccggcccaagggctggggacttggggcagggatgagggggagtaggatgtcccagcccccgcagtgtctccgcagagcccaaagcagctgctgccatttcatggtgaagctcttggatgatgggactttcatgatccccggggagaaggtggcccacacctcgctggacgccctggtcaccttccaccagcagaagccaattgagccgcgcagggagctgctgacacagccctgcaggcagaaggatcccgcaaacgtggattacgaggatctcttcctctactccaacgcagtggccgaggaagctgcctgcccggtgtctgcccctgaggaggtatgtatatgacaggaggctggcacctcccacctggctgaggggcaggagtggaggtggtcaacagcttccagaggaggctccttctagaatgagaatgcgatcctacagcttggtgctttaaacctttccagtgcttttgcaacaccgagattaaaattcaaactacaatctgaggtcctctttctgcctgtcacctacccagcgccagccctgctgccataccgtctgttgttcagacacaccaagctagcctcggggtctctgcgtgtgccggccccacctcaggtcctttgcacaaactgtgtgcctgcccctagatttcccatgtcttcattcatttctctttcaagtgcctccttccccagccccagacctaaagcaacaccttctggattct

SEQ ID NO: 16781 - DNA, 930 bp, Homo sapiens
  misc_feature (18)..(19): n is a, c, g, or t
  misc_feature (29)..(29): n is a, c, g, or t
cacaaggaggtcatccannggtctcccangtgaccttccctccaccccaggaagctatgacagaggccgggaagctgcccctaccgctacccccacggctggactggtttgtgcacacccagatgggccagctggcccaagacggggtccccgagtggttccatggtgcaatctcaagagaggatgctgagaacttgctggagtcacagccactgggatcctttctcatcagggtcagtcacagccatgtgggctacacactctcctacaaagcccaaagcagctgctgccatttcatggtgaagctcttggatgatgggactttcatgatccccggggagaaggtggcccacacctcgctggacgccctggtcaccttccaccagcagaagccaattgagccgcgcagggagctgctgacacagccctgcaggcagaaggatcccgcaaacgtggattacgaggatctcttcctctactccaacgcagtggccgaggaagctgcctgcccggtgtctgcccctgaggaggtatgtatatgacaggaggctggcacctcccacctggctgaggggcaggagtggaggtggtcaacagcttccagaggaggctccttctagaatgagaatgcgatcctacagcttggtgctttaaacctttccagtgcttttgcaacaccgagattaaaattcaaactacaatctgaggtcctctttctgcctgtcacctacccagcgccagccctgctgccataccgtctgttgttcagacacaccaagctagcctcggggtctctgcgtgtgccggccccacctcaggtcctttgcacaaactgtgtgcctgcccctagatttcccatgtcttcattcatttctctttcaagtgcctccttccccagccccagacctaaagcaacaccttctggattct

SEQ ID NO: 16782 - DNA, 420 bp, Homo sapiens
tgtgggtggggcatattttcttataacgcttagtgggcgtggcctaggtactaagaaactgctattcaagggatggtccctgagacctgccttccagggtccgtgcaggacctttccccctccctagtgctgagctacaggccccttccgccctgcagaaggatcccgcaaacgtggattacgaggatctcttcctctactccaacgcagtggccgaggaagctgcctgcccggtgtctgcccctgaggaggtatgtatatgacaggaggctggcacctcccacctggctgaggggcaggagtggaggtggtcaacagcttccagaggaggctccttctagaatgagaatgcgatcctacagcttggtgctttaaacctttccagtgcttttgcaacaccgagattaaaattcaaactac

SEQ ID NO: 16783 - DNA, 812 bp, Homo sapiens
gaaattgatccagacccattcccatctcccagcttcctccagggcggggcactagagtgcatcatcaaacgaggaaattgatccagaccccttcccatctcccagcttcctccagggggacactagagtgcatcatcaaacgaggaaattggtccagaccccttcccatctcccagcttcctccagggggacactagagtgcatcatcaaacgaggaaattgatccattccccacaggatccacctgccaacttagcactgctggcattcatggtagtaactaaggggaatccctccaagcagcatggtggaatggagagagcaagcagactctagcttctgacaccatcacctatgaactgtgtgacccatgtaattcatgtaagctgctgtgtcttagagtccatgcctctaaagtaagaatcatcatgatgcttagttcacagagaattaagtgagctgacataggagagtgcctgatataacgcaggactcagtaattgttagtttcctttctcttttggtagatgaaccacagtttacaagcagagtctgagaaggttcttagaggagcaggcactcgtgcttgtccctgactaagctcagaccattgtctctgtagacactaaagatcaccaagtgcagccctgcacagcccatcccagtgagtactaggctaggtttttaatcctagctcaggcacttattagctgtaggagtttgagcagttttttaatctccttggattcagttttctcatctgtaaaattgggttaaggataattctttccttagagtaagaaaaggaaagg

SEQ ID NO: 16784 - DNA, 503 bp, Homo sapiens
cagagtctcgctctgtcgccaggctggagtgcagtggcgcgatctcagctcactgcaagctccgcctcccaggttcacgccattctcctgcctcagccttccgagtagctgggattacaggctcccaccaccatgcccggctaatttttttgtgttttttagtagagacggggtttcaccgtgttagccaggatggtctcgatctcctgacctcgtgatccgcttgcctcggcctcccaaagtgctgggattacaggcatgagccaccacgcccggcctcatcaatagtattttcaaagcactctatatgctttgtcgtctaccacgttttgcaatgtgcttggcataaaccaatgcccccatggaaagataatacattggaagagtgcaactgggcaaaggtgaagttaaaggaagtatctgaaattccaggaggactcagggtagttgtcggtataaaaccctgcctcacagatcgtttggcttggggctctctctgcagc

SEQ ID NO: 16785 - DNA, 673 bp, Homo sapiens
aagctttctgtcatcaactattgggttataggaaagataggataaattctttctgtttatttccctgcttttgtggtaatgaattgatttccaacaccctccaacagtgacagttttattgttattacctttatggactgagatatttaaacatactttatatattttaatccattatatatgttacgtctgtatgtatgtatattgaacactgaacattattccatctttgtcctgtcaaagctttctcaggcttgctccttagtccttttgctataatcacagcagtcttttttaagcttccatgtttcctgtgaaacagcatttcgggttcattttgtacatttcatgcttcagacctggaatcagccactttcccaggaagttctggtagtgttagcaggaaagcaggaaaatagtgtttgaggataatattctagtactaatagcactcattgctactgaattgttcattgtttcttaggccttttcagtggacagagctaagaaataggagtgtgtgtgtgtgcgtgtgtgtgtgtgaagaaagtgcttcaaaccataaaatgtgttttagggtcttctgaaagttgctgcataattttaaagagttttaagctaggctttataccacattccccttaactacattatgaggtatccttatcttctg

SEQ ID NO: 16786 - DNA, 758 bp, Homo sapiens
acaagtcctgcatgttgcctctgatgggacaagatgactgtttttacctccatatcagtggtttagcatttagctacggtgtataaatgaggtaatgagagggacattcaacaaacaaaagaattccaacatccatccaaatagcatttaagaactgcccccactcccttgcctttagatttttccttcagtgtctgtctcaaatgatggggtcagactgttcattatgtctgatttcttctccccagctccattgcctgtatccattccttccttcttcttagagttggtggtggccagactagaccagggagggtgctgctgacaatgacattgtaattgtagaaatcgtgtgcctgacacaggtctaaggactttccaaagtattagtcagtcagtcagtcctcacacaggattgtaggtactgtcataactccatttcatagttgaggaaaccaaggaccaaagagaaataactcacatgaagtcacacacttgataagtgatgggatgtctcatcccaagccctgccctcttaaccaagatggccttgtgtctgatccatgtcagaaaacagaatagccgacataaactcatttgttagccaggtgtggtagcccacgcctgttgtcccagctactccagaggctgaagcaggaggatttttgagcccaggagtctgaggctgcagtgagctatcattgtgccactgtactccagcctggacaacagattgaggccttgactctaaaaaaaaa

SEQ ID NO: 16787 - DNA, 258 bp, Homo sapiens
gactgttggggctcagtgagttacacaatcctagttattctcaaaattaagtcatggctgtgctccccagtggcacagctctgaaaacaaattgggagcctggtagattagacctgcagtgcaatggatcatccctcttactttctggtgcaccacatatagtcagtctcctagggtttagaataagggccaaaacaggccgggcgcggtgctcatgcctgtaatcccaacactttgggaggccgaggcgggcgtatc

SEQ ID NO: 16788 - DNA, 671 bp, Homo sapiens
ttaggattttgcagcctggactgggcttggctggagtccctcttctggtctgcccggtggtcactcacgtgactacagccagctggtcagcggcctgcctggaacagccccaccagggtcccagggccgggccccgctgtcacctgggttctcttccgtgtcgtccccacgcctcctcaggtccccacagcagcgtggccacacatttgatggcctcaggggaccaaagtagaagcactgagacatcctgaggcttgggccgggactgacgtggtacccctcacaccacactttgtgtactggggcaagtccaggcccagccagtgccagtgctgacttctctcagtgcctgcttcactctgtctcgtcagcacccccttttgcactgcctcccccgtctgcccaaagttcacccacacaccctgctccgctggccaccaccccgatcccagccatgtcctcatcctggctgtggccatctgcctgcaatctcttccctgtaagacctcagttggaccaggtgcccacctgctctgagctctccagagcacaggtggaggccatggtctccgcagaccccgcgggcctgtcaccggtcgagggtcttgactgcacattgtccaggttcttggccttttgaacaaagaattggacaaaacacccagcaaagc

SEQ ID NO: 16789 - DNA, 697 bp, Homo sapiens
ggttcaaatgattttcctgcctcacctcccaagtggttgggactacaggcgcctgccaccatgcccggctaatttttgtatttttagtagagacggtttcaccatgttgcctagggtagtctcaaactcctgagctcaggcagtcatcctgcctaggcctcccaaagcgctaggattacaggtgtgagtcactgtgcccggccgatatgcctgttttttaatcaaccaatttttaaaaaatttaccagagccaactcggaattaacatttgtaactgctaatattgagtatatgtatgtgtttacttaacaagtaaactctttacttgcactatatcatttaattcttaaaaccaccctatgaaattggttcagtaatatattcccattttacagatgagggaactgaagcatcaaactgaaccgcgacttgtccaaagtcacatagtaagtggaggtggaactgggctttaaatccaagcctacatacagactagagttcacacttttaggcttggcataaactgcctataaactataaaaaagtaaaactccataaaatctcaggtacttggactaccttcagtctgagaggtgggggatgggggagacagcaaatttttatgtttattaaaggctggaatattaaagcaaaaacaaagttcctttttcttttttttaatttaaatttgtatttt

SEQ ID NO: 16790 - DNA, 370 bp, Homo sapiens
ctcatggtacccctggcctgttctggtagattcactcatgcatcatcaccagtcctgtggggaagtggaaatttggtgtacataccaggtgcactttcattcttctcaaaatgttatgacaaatagcaaagagaacaccttttcttttatcattagctcatccttaagcatctcgttaggggtaaagcaattaaaaaaaaaaaacaagttttagctggacgtggtggcgtgcccctgtcatcctagctgctctggaggctgaagtgagagggtcccttgagtccaggagttggaggctgcagtgagctatgattatgccactgcactccagcctgggtaacagagcaagactctcatctctgaaaaaaaa

SEQ ID NO: 16791 - DNA, 433 bp, Homo sapiens
gagaactgccctggggccaggcctggaggagatgagatacctggggatgaggcggccatcgcacagcgggacacatggggctgggaagtgcagggacaggatgcgggtagagatgtgggggccagcctcagcagcataagaggacgggagtggaggggactgtgccagagagtgagcggggaaggtgaggtggggacagcccagcggtcacagtgggcagggtaagggccactccatatgggacagtgtggctgtgaaagccagacgggccgggagcggtggctcaagcctgtaatcctagcactttgagaggccaaggcaaggaggatcccttgagcccaggaggtcgaggctgcaataagctatgatcatgccactgctctccagcctgcgcgacagagtgaggccctatctctaaaaaagtaaagtcaga

SEQ ID NO: 16792 - DNA, 809 bp, Homo sapiens
tgaagatagggatgggcagatgctcggcctgggctggactgcaggtcaggtgagcgggccgaaagaggggagaggaaactaagtggggagaggaggctggatgagtggggtcgggagggccaggctcccgtggaggcctagaatcacagtggcagctgtgcttcccaggggctgcctggcagcaggaccacgtggggctcccccacttagtgcttcttttcacaggaagactcttgaaaggatgctttctgttcctgtggacatgtacacagggttcattactcacaggtgatttacagttggcacttttataataaaatcctctttgtagtgtatttatgattcattaaccatgtaaaaccctgtggacgttaagtaaatactgtggactcttgatctctcacggctgtgaaaggaggcgtggggaggagagagcaacttagcctcgaggtggtgcggccaggtgaacggggaggaccatctgtagcagtgctgtccaatagaagcaaaaagaggccacatatgcaagtttagatttttctagtaaacacattttaaaaataaaagtaaaagcagtttttactaacatgtatttaatttaatgaaatacatccaaagtattagatttcaacatgaaatcaatatttgaaaaatcattagtgaactattttgcattcttccttcacactaagccccagtgtctgtgtgtcctttatgcagccaccacatctccactcgcatgagccgtgtggcaggtgcccggtggccacgcgcagctgctgtgagggacagtgcgtggcgatagcctt

SEQ ID NO: 16793 - DNA, 1025 bp, Homo sapiens
atcgcttgaacccaagaggtggaggctgcagtgagccaagattgagccatggcactccagcctggggacaagagagacttcgtctcaaaaaaaaaaaaaaacaaaaaaacatactttttgaaaattagtggtctgtaattgtaatcttgcagtagttgtttattgaatactagcataagtaaggattgaatgggatagtaaaggttgtctttgcccttgaggaactcaggctcattgaggggggtaccgttccttgaatgtttcctttttttctgcagcaaatacacacattcaaaacatctactgcacacaagcaaactcagagaggaccagcctggctgagaggagttgaccatccccctcaggactgacttcctttccttcaacattattatataattaaagtcctagactatatagaagtgacaggtatgctctctatgcatttattattatgggaggtgttttacttggaagcagtactttctccatgttaagtgctttgagctctgaagggccatcttaatccattctctctgacctcagaggttgtcaagacctatagaagagtttctatcaagccacattaggaaaaatgtggatgtctactttttggcttcactttttttaggatttgtatttaaggtaatttctttgagaacaggtaaaaggaaatggttcaattaaaaaggaaagggtcatttaagtaagttactaatttttgtgaacacctatatgtcttagatatgacctgatgggcagagaaggcatactagctttaaattaggattaaatcccggttttacaattaccatgtattgcatttcccaaaataaactactctgaatcttggtttccttatccataatgtagggatgataaaacttgcagtataagctaatgttttaggatgcatttggagactgcattataaggttacagagaagataacaacagaaacatttgagagcttactttgcgcctgacactgtgctaagagatttcaagtattaatatagttataa

SEQ ID NO: 16794 - DNA, 526 bp, Homo sapiens
ggtcaggctggtctcgaactcctgacctcatgatccacccaccttggcctcacaaagtgctgggatttcaggtgtgaaggtgtgagccaccgcatctggccttccttgtggtttttttgtttgtttgttttgttttgtttttttgagatggagtctcactctgtcacccaggctggagtgcagtggtgcaatctcggctcattgcaacccctgcctcccctcaggagtgtgagccagggtgatctcccactcctgacctcaagggttcaagtgattctcgtgcctcagcctcccgagtagctgggactacaggcacttgccaccatgtctggctaatttttgtatttttagtagagacagggtttcagcatgttgcccaggttggtcttgaactcctggcctcaagtgatccacccaccttggcctcccaaagtgctgggattacaggcgtgagccaccacacccagccccagcagaggtttcgaggtagaatttctcccagaatgctgtggctcttctgtctgtc

SEQ ID NO: 16795 - DNA, 377 bp, Homo sapiens
acagacccagggggaaatggagcaaaccaaagcagtgattacttggatctctatactggacaggctcactgtagcaaaagagatgcttagaagcagactcagctgtaggacatgaaagagaatctaaccatatttttgaggcatggtggtgtccaaaatgtatggtgataggagatgggaagcagcgaagataaaaagttatccttgtggtgttccaacttgaaacagtgggttaatgtctggtagtcaggttaaacacagagagctaccattttggaggttggctgtcaagatatagacacttggatgttaggaaataagatagagatccagttactgagtaaaatcacttatatgattatcttctttaaaaaaaa

SEQ ID NO: 16796 - DNA, 358 bp, Homo sapiens
aaatatgaatgcatggtccattcaaaggaaaaaacaaaatccccagaaatagtctctgaagaaatataggcactgagcttactagataaagacttttaaatagctgacttaaattttctcaaggagctaaagaaaaacatgaatggatgactaaaataaatcaggaatattatatatgaacaaaatgagaatatcaacaaagagataatatattttaaaaagaagtaaacaaattatggagctaaaacatacaataacaactgaaaatttcactagaagggttcaacagcagatttgaagaaacagaagaactaatcatagaacttgaagacaagtcatttgacattattgaatctga

SEQ ID NO: 16797 - DNA, 111 bp, Homo sapiens
gaaggcattccagagatctttgaggctgtccctcccatcacaggcccagggctctaggaggtcagattggttttcaggagggtttgtggggtggtactaattctgtaggca

SEQ ID NO: 16798 - DNA, 169 bp, Homo sapiens
cacacaatattcaagctattctgtaaactccccgtagcagaaattttgtcttatttactactaaatccccagtatctagtataatgtgatctatgatggatactaaagagatattataataaataattacccatttttacagaaaattatgttttttatcatcccgcat

SEQ ID NO: 16799 - DNA, 400 bp, Homo sapiens
aatactggtaagcatgtaaaagggtggtaaatatataggctttaagtttagatagatctaaatattattaaaattaccaaattattgtttttaaaaagtattagtttcctaggacaaatagagatttttagataaggctggatttgtaatactttaagcaacaggtcacagtgcttaagtatttaatgccgatttggcaagcagctgatgttttatataatgctgtcgggtattttatatttgcgtgtattttctgatgcactggatccagcacttcatgtcacgtcatatatctgtttataatgtatacaaatgtattttcatatatatttgatgtttgatggctttgaaactttaatcttgaaatagattttaaatttttattaaaactatttaaata

SEQ ID NO: 16800 - DNA, 261 bp, Homo sapiens
ttttttttttttttttttttgagacggagtctcgctctgtcgcccaggccggactgcggactgtactttgcttttttctagaattcaatttttaagtttacaaccccaattccttataaaagaaacaggatgactaatattcattgaaatcaccatggataatcttatgtaatccctacaataaccacacaagataaatactactactatcaccatgttacagtgaacagaagcataattacattaaataacttgcccaga

SEQ ID NO: 16801 - DNA, 690 bp, Homo sapiens
gcctgaccatggtggcgtatgggcttgtggagtgcgtggagtccaagaacccgatcagaccccacgctccaggacaggtcaaccaggcagaggatgaagaaatacaaacaaaaatgtgagagcagtgaggtccgaggaggatgaactcagaaagcaccagccagagaattttcttagaagatgcctcaggacatagagcggctcctcatcaccatctcagcacaatttggccattctgaagagatcatgttatttcactctttatgtattttttttctattctaacaaatttttcgtccaccatcttaacagagatcaagtgtatacatgaaggtatcagttcatttaattttagatgcaaaagaaaaaggtctaacgtacaatcagccaattagaatttgcctgaaatcatagactcaccctagttttattgctgtagttgtttttaagaattggaagcctgcttaaaaaatgtagttgagccccataattttacaaatgggcgaacttttaaacttctaactctacttggatcaaaacctcatacattttacaaaggggtcctgacaagtcagctgactcaacctcacagagtcagggggtgacaaagccagactggggctcaggattcctgaaacgtgtggggtctgcgtttctaaataaagacggttatttaatggaaaaaactcc

SEQ ID NO: 16802 - DNA, 629 bp, Homo sapiens
attcttttgcctaattcttgtttatctgtcaagattcaattcaggtgtcatttcccctgcaaactatttcttgatctgccaaaaagtatctctccttatgctgtcctggcatctgtctactgggcatttactgttgtgtattggaactgtgtgatgacttgtcttgcacatttctctcttatctgctcagagccagagatcatgtcatactatgtctgaatctttttaatgctgatattctgatatatgctttgcatatagaaaataataaaggtttattgaaactgataaaaataatctttttatatttagtcattcagaatcagctaggcagtccacttctgactaaaaaaatgaagttatttttctgtgtgtgtagtagaagttcagtaattcttctgaatactctattgtttttaagatcttgctatattaattttcataattgcatatttaagtctacttaatttcttcatatgacaaacaattttcattttattttgagctaataaggttaacatgattatgagttgtttacattttgtgaaaagttttactttttaagtgatcaaacatctggtattttccaatagtggcagaagtagtattacatcactgttagagtagca

SEQ ID NO: 16803 - DNA, 355 bp, Homo sapiens
agagagcttgtgcaggaaaactcccccttaaaataaccatcagatctcctgagacagactatcatgagaacagcacgggaaagacctgccctcgtgattccattacctcccaccgggtccctcccacaacacgtgggaattcaagatgagatttaggtggagacgcagtcaaaccatatcagaagataaacattaaatagcaaaaagacatcaaatattcataaattaacatataatccaatgatatctcaattaaaaatttaatagctttttaaatctgaggaatgcaggagctgattctaaagtttttaataataaaaagcacaagaatagccaaaacatttaaaaaagaaaa

SEQ ID NO: 16804 - DNA, 588 bp, Homo sapiens
atatgtgggttggtcaagcaatgaatacctactcagtaaaaatacaaaattaaattctattggtctagatacagggtttctcaacagcagcactattgacatttggggccagataattgactttgttggtggtggctgtcctgcacattggaggatattgctgcaatcctggcctttacccactaccagtagcatcctccccgaagatgtcacaaccaaaagtgtctccagacattgccaaatatcccctggggagcaaaaatgcctgccccgggttaagaagcactgagaatttctagtagggagattaaaaagcaatactcagaagggagaaaaatagactttatcctgtaagtaacattaagatagaaacattttatagaattcccatgtacttcttacccaagagaaaagagtggttttgtccaccaaaaatagttacaagaatgttcatagcaactttattcataattataaataatggaaactacaaaaatgctcgacaccaaaatgaataaataaattggaggatgtacatacaatggaatactgctctcagcaatgaataaagtgaacatttaacgcaga

SEQ ID NO: 16805 - DNA, 649 bp, Homo sapiens
tttcattgaccattatattagggttggtatgctggtaaaaagttttcttagtttttcttcatcaaagaatgtcgtaattttttttttcatgtctgaagagtatttttactggatataggatgtgggttcacagttcttttatttaagcacttcaaaaagtacttccagtggggcgccaagatggccaactaaaagcagctatggtgtgtggctcttacagagaggaacgaaagggacgagtaaatgcagcacctttaactgaaacatccaggtacttgcattgggactgatcagggaaacaactcaacccacagagaatggagaagagcaggacagggcagggcagggcaacagcttacctgggagcaacatggatacaagagaacctacccctgcccagggaagcagtgagtgaatatgtgaccctgggaaaccatgcccctcccacagatctttacaagtccggtcaggagatccccttgtgaatccattccaccagggccttcggtctgacacacagaactgtgtatagtctcaacagaaaagctgctcaggcatgcatggagacccgggaactttacatactctggctctagtatccctaacaaaggtgattgcaacttaggcagggcgggagcttggacatcca

SEQ ID NO: 16806 - DNA, 716 bp, Homo sapiens
  misc_feature (711)..(711): n is a, c, g, or t
caaaatctgagccagatcaatttaggaagtttattttcccaaagttaagaatgcacgcaagtgaaatggcctcaggaagtcctgacatgtgcctaaggtggttgggacacagctcggttttatacattttagggagacatgagacatcaatcaacatatgtaagatgaacattggctcagtctggaaaggtgggacaactcgaagcaaggagggagcccccaggttataggtagatgagagacaaatggtcgcattctttcgagtttctgatgagcctctccaaagggggaatcagatatgcatttatctcagtgagcagggggtgattttgagtagaatgggggcaggttggccctaagccgttcccagcttgactttcccctttagcctagtgatttgggggccccaaggtttattttcctttcgcgtagcttcgccactaatgtgtcctggtgtcttctctcctcagcctgtttctcatcctggaaactgaggtgtgctggcgcagggcgatagcgcagtggggtggggttgggaggaaacccttatctgtggccgatggccctccgttgttctattattaaaactctgggaaactgctattcttaatttatttttaaagaccctgagaagcaaatctttaatttttttgtttttgtgagatcgcaccattgcactccagcctgggtaacaagagtagattccatctntaatt

SEQ ID NO: 16807 - DNA, 488 bp, Homo sapiens
agtaaaaaaaagctgaatacaaaaaaagctgaatatgtgttttatatccttgtgaattcaaagtaaaaaggaaaaaaaactcaaaaaccaaatatatgtatgcagtttgagcccaaatttttaattaagtaaccatataattacatgtagacatgtataaaccttgagatatgtaaagaccagaaaaatatttaaaagttaatagttacatcatctgtggtcacaacaccctgaaaatgcctaatattggaaacttaagcaggattgatccaggttattacttggatgggagaccagatgctataggctgaaaaaagaaagcataagtacgcacaagttaatacttaataattatctcctaatgataggactataagttctatctcttttctttacattgttcagtattttcaaatttccctttgaaaatgtgttatgtacttgaattattagaaaaaataaatgtcatttaaaaagcaaaaaaaaac

SEQ ID NO: 16808 - DNA, 234 bp, Homo sapiens
tgaatcctaaaaattagcaattgatagaattttaaataagtgagcatgcaaaggaagatatgattataaattgtgataaggattgtaatggaaaaataaaaacatatgagaaagggtaaagggaccaattttatatcaaatcaagaagtatcttataggaagtaatattcaaattgtgatctgaaggatagataaaaatttctagaacacagggcagagattaaattggttaga

SEQ ID NO: 16809 - DNA, 488 bp, Homo sapiens
gacaaattcattcttcatcttagccagcgccatggagtgagtccagctctctgtgtctggccccgctgtgaaccccctgaggctatccacagttggatatcttcctgttccttccctgccctaccctcttcaaatgcaaacttgggggggctcaagattattccataccctttatctccaagctagtccatgcctgttggtatagacatctaccctacacacacctgcccgcaccctctctattctcatctccttttttgttcttcatctcaaacctccacactgctgctcaaaaatgaacaaaggtgaatgaggaaaccagggcatcatgacacctaaaagatctttgtgacttcccagttgttgaaagacatgattgggaaagagtggctgagtgtgcaaggtggattccaacccagatcctccggggcttgtaagagttgagagaaaagcagtaagtgtcccaataaatctttattgatttaaaa

SEQ ID NO: 16810 - DNA, 1012 bp, Homo sapiens
gggggctgtatgtggaattgcaaggccaaagacatctcgggtcaactcttctcaggaccagatccaagtcgccagtgagaacacacattcaggcagcctccaccagcgccctgcctcaggagcgaggctccctgcttcatgtgggcaagagctgcccttgttttcccagcgggcagttgggggtctggagcctaggaagcaaagtgaagcacacactcctgcttccttccttccctgcagttgagacgggagtcttactttgttgcccaggctggtctcaaactcctggcttcaagcaatccttccactttggccttccaaagtgctgggattacaggcatgagccaccatgcccagcctccttctcttactagctgagaactaagagaagacactctggagacagaggaggaaacagtgacgatgccacatgatgaatacataatggagggtgaagacaaggctccgtcaggggcaccaaggagggaaacccagttctgtggggaaggtatggggcagcttcacaagcccagtgtctgctccctttgtgggagacgtgttgtttcagcatccattcccccttcttttaggaaaagtgcttgaatttccttttcatggaaccacccacctccctctcatccatgcattctattcccagtatcaggggtagacaagtgacttcaggcttggccaattagggttctgactcttggtcaaatcagagtgaatcctgagtcatttgtaaactccaaggaaagggcttgctttgttttctgttgaatgcagtgctctgagatagccggaaatgaaactgctctcttgccacactgaaggctagagaagggcctggccaggaaatgatgccagtgatcaggggtggagctggaagagggggagtgaggaggcccagacatcttgggagccccaaattcacctcaggatttaacttctccgctgctcagccaataaattcctttcttccatgacaaaaaaacaacacaaaaaacgggcg

SEQ ID NO: 16811 - DNA, 937 bp, Homo sapiens
gggattacaggcgcccaccaccacgcccggctaatttttgtatttttaatggagacggggtttcaccttgttggccaggctggtctcaaactcctgacctcaagtgatccacccacctcagcttcccaaagtgctggaattacaggcgtgagccctcgcgcccagttcaacatctttcttaagtgggcccaaggttggggggaaaatctcaccgtagagatatttgttagatatcgagcatgtgctgaagaaggcatctgtgatgattaattttatgtgtcagttggactggaccatggggtgcccagatatcagcttgaacattactctgggtccatctgtgagggcgtggggtaggactggcatttatgttggtggagcaagtaaagcaggctgcctccctaacgcaggggatcctcatccatcagctgagggcccaaatagaacaaaaggctgagttggagggcgcccctcctgcatgaccaactttcaagtggtgacatcagctttcttcctgtttttggacttgaactgaaacatcagctcttcctggatcttcagcctgctggccttcagactagaactacaacctcggctctcctgggtctcggcttgctgactcaccctgcagaacttgggacttgtcagcctctacatttgtatgagccaattccttataatgtctttctgtatatatacatatatctccacatcttattgttctgcttctctggagaaccctgagtaatacagcatcattccaagatcagcagaaatgttagtgcttctggggaattactgcaaagggtacctgaatagcagcacatgctctcagtacccccgccttctgttgtctgctgttgcctgctccctccccaccctttgggttgatttcaggatagagatatggggatgggactggggttgggtgtgcggt

SEQ ID NO: 16812 - DNA, 770 bp, Homo sapiens
gggggctgtatgtggaattgcaaggccaaagacatctcgggtcaactcttctcaggaccagatccaagtcgccagtgagaacacacattcaggcagcctccaccagcgccctgcctcaggagcgaggctccctgcttcatgtgggcaagagctgcccttgttttcccagcgggcagttgggggtctggagcctaggaagcaaagtgaagcacacactcctgcttccttccttccctgcagttggggatcctcatccatcagctgagggcccaaatagaacaaaaggctgagttggagggcgcccctcctgcatgaccaactttcaagtggtgacatcagctttcttcctgtttttggacttgaactgaaacatcagctcttcctggatcttcagcctgctggccttcagactagaactacaacctcggctctcctgggtctcggcttgctgactcaccctgcagaacttgggacttgtcagcctctacatttgtatgagccaattccttataatgtctttctgtatatatacatatatctccacatcttattgttctgcttctctggagaaccctgagtaatacagcatcattccaagatcagcagaaatgttagtgcttctggggaattactgcaaagggtacctgaatagcagcacatgctctcagtacccccgccttctgttgtctgctgttgcctgctccctccccaccctttgggttgatttcaggatagagatatggggatgggactggggttgggtgtgcggt

SEQ ID NO: 16813 - DNA, 269 bp, Homo sapiens
agagagttcggaagcactcttattatcttagcagcagcatgtgtggaaatcatttctcattacagcggagggcaggcattgtgcagagggttaagtgggcctgcttgaagttggttgttgttagctctcatgtctatgccttggtccctttcccctcaggacttggagagcaagctgtttgagtctgatgcaacccctgggctttgactatcatgccaaaaggcagcaaataagtgccttttcttcccttcagaatacatggacaatcc

SEQ ID NO: 16814 - DNA, 676 bp, Homo sapiens
gactatcatgccaaaaggcagcaaataagtgccttttcttcccttcagaatacatggacaatccaaagctctattagtctattattcagaatgaaaagtgtttacaatattcgtcctcttactcctcagtatgtgagactgttcctcgtagcaggtaatttcttccgaattcaaaaactcctcatggaagcatctgtttttgtcatcaaggagggggctgtatgtggaattgcaaggccaaagacatctcgggtcaactcttctcaggaccagatccaagtcgccagtgagaacacacattcaggcagcctccaccagcgccctgcctcaggagcgaggctccctgcttcatgtgggcaagagctgcccttgttttcccagcgggcagttgggggtctggagcctaggaagcaaagtgaagcacacactcctgcttccttccttccctgcagttggtgagtatctggctcagtttaggttaatatcatctcttcagcctggcccagtttaccactatgggaaggagcccagcagcaggggctgccagacctggaaatagatctgctcattgcagtgtggcaggtgcagagaaacagagccagctatagctggaagagaatcttagggcacagagatgcaccaacatgtatgaacaagtcgagacccaagtaccaag

SEQ ID NO: 16815 - DNA, 603 bp, Homo sapiens
agcacctggcttcataaccatctactgatagatgaatgaagccatttaattgtatgggtagaaccacacaaaatatgttggaagcaagtctcacttctctggaattaaatgtttctttggcactacgagatcttactgttcaagctgtgagatttaaagggaaaatgcttcctgctaattattaacagttgccctgtaagagcagagccattatggggtcccgaaccctggcatgctgcccctcccagcagtgagcaacggcagcaagccgggaggaactttaaggcaactgtggccctggcacccacggacctcagattacccaaagagggttgcagtatcagggccaatggagtagggagtgggtaaaaggatttgaaatgagattataggacctaaaagattcttgcttttgttcaggaaataatttaccggttttctttaaggcagtgagacaatccagttgagggtctggagtggtagatcattgccgtgggcctcttcagatacttaaaaataagttgatctgtagttgtgtttgttgggcttcttgtttgtttttttatttaaaaaaaaaaaaggaaagaagaaagacaggaatgg

SEQ ID NO: 16816 - DNA, 304 bp, Homo sapiens
acaagttccactcagttcccacaggttctactcatcctagcaagttccttgcttcccccatttcccatgtcttccctttccaactgccagacacaaaagaaaccgcctcctataatccctataataagccccttattttgaatattaagatatgtgtatgtgtattagatcctagtggttcttttctgatcagaccctgattaaccataccatcctacctaatgctattcccccatcctagttctatcatattatccctttttttgtttgttgtacttagctggtttatctttgtcatctctca

SEQ ID NO: 16817 - DNA, 268 bp, Homo sapiens
tgagtctgtagagtgaagattgcttcctccaagtattcttagtcttaaagacggcacatgaaacatgtcatatttgagaagatacattataaacacatttcttatttgtttcttataatattcttttagaagcagaaagcaggctgggcacgttggttcacacctataatcccagtactttgcaaggccaaggcaggtggatcacttgaggtcaggatttcgagaccagcctgatcaacatggtgaaaccccgtctctactaaaacta

SEQ ID NO: 16818 - DNA, 462 bp, Homo sapiens
aaaacctcattaataattttatttgattacattttgaaaagaatgtattttggatacattggcttaaacaaaacatgattaaaattaacaccatgggtttctttttgcttgcttaacatggctactagggaacctaaaatgacatctatggccagcattctggctcacgttgcattcctgttggacagtgctgtcctggagagttgttcttatacatcacaaattgggcttttctgagtccaaagtgaaaaggaagtcaggtcggtttaggtgttctcattattcatgaagagagaggatgctcctttctcaggagagtcaagcctttcctatcacttgggcataaaaaggcctcgttgggagttgtcaagcactgaaatcctcgtgattggggcatgcattcttgtccccattttacggatgcagaaatcaaggctcagagaagtcaagtggctcacaagt

SEQ ID NO: 16819 - DNA, 723 bp, Homo sapiens
cactaatagatccaaaaggagaggtagactacaatatgataatagtaggagagctaataccccactctcaaaaacagacagatcatccatacagtaaatcaacaaagaaacagtggagttaaactacatactagatctaataggcctaactgcaatttacagaacatttcacccaacggctacagaatattcttttcatcagcacatggaacactctccagaataaactatactttaggccacaaaacaagcttgaaaaaattgtaaaaaatagaaattatattaagtatcttttctgaacacaatagaactagaaatcaataacaagaggaacctcagaaaatacaaacacatgtaagttaaacaacatgttcctgaaagactaatggatcaatgaagaaattaagaaggaaatttaaaaattgcttgaaacgaatgaaaatggcaatacaatgtaacaaaatttatgggatatgacaaaagcagtactaagaatgaagtttataacataaacacctatgtcaaaaaaaaaaaaaaaaaaaggaaagactccaaatgaacaatctaatgatacacctcaaggacctagataataaaaaacaagccaaaccctaaattagtagaagaaaacaaacaataaagatcagagcagaaataaaattgagactaaaaaaaatacagactatcaatgaaacgaaacacttgctttttgaaaagatagta

SEQ ID NO: 16820 - DNA, 951 bp, Homo sapiens
tggctaggtagaggctggggtgaatcggccgaggagagaaagttgaagagtcccagacctactagcattttgcaactatgcttgtaaagtcctcggaaagtttcctcgcgtaccagacagcggcgggggctgatagcaattttagtttttggcctccctatcctctcacatgagaacactgcctggatgcatctcatgatctctggagaatttccccatctttctcttctttccatcgtgtggattcaatagtgtggatttgaaggctgccctgcccccgactctcctgccgcacccctggccattgtaccttttgatgtttagaagttcgtggaagtagacgctgaggtgtgcagaggagctggtggataacagagaatgccagggaagatgagtgctgggtcagggtacttggatgaaacggtgcaggccaggcgggccctaataaaaccctctgccaggtctgggagtcccaggccatctgctcaacgctctgtggtttgtcagacctgcaagcaagccccctgctggggaagcctaggtgtccttgagctgaaccgcactgaagaactcttgtcctcactggctgatgcagcagaactcttgggaaatgtcttagtcctgcagaatcaggagtcaccagatgatgcagagttgagatcatcattgcaaagttctctgttcctgaggaactaaatttaaggaaaaaatgggattttgttttagagttggaaaaaaagcctgattaaagagtttctgcctgttaaaacacaacccacaacacacaacaaaaaaacactcccgggcctcaactcccggggcggggcacaaacgcggccccgaatggcgccggggccatacctgtccctggacccagcttcttgtccacaggggcaactccgccgtccccattcgggacgcgcttaactcgcaaacccggtacccgctagc

SEQ ID NO: 16821 - DNA, 2522 bp, Homo sapiens
cagaggatagaacgttaggctaggtacgaggcctgggtggtagcgagtggccttcccggttggcgcgcgcccggggcggcggcgctggaggagctcgagacggagcctagttatgtctgggaggcgaacgcggtccggaggagccgctcagcgctccgggccaagggccccatctcctactaagcctctgcggaggtcccagcggaaatcaggctctgaactcccgagcatcctccctgaaatctggccgaagacacccagtgcggctgcagtcagaaagcccatcgtcttaaagaggatcgtggcccatgctgtagaggtcccagctgtccaatcacctcgcaggagccctaggatttcctttttcttggagaaagaaaacgagccccctggcagggagcttactaaggaggaccttttcaagacacacagcgtccctgccacccccaccagcactcctgtgccgaaccctgaggccgagtccagctccaaggaaggagagctggacgccagagacttggaaatgtctaagaaagtcaggcgttcctacagccggctggagaccctgggctctgcctctacctccaccccaggccgccggtcctgctttggcttcgaggggctgctgggggcagaagacttgtccggagtctcgccagtggtgtgctccaaactcaccgaggtccccagggtttgtgcaaagccctgggccccagacatgactctccctggaatctccccaccacccgagaaacagaaacgtaagaagaagaaaatgccagagatcttgaaaacggagctggatgagtgggctgcggccatgaatgccgagtttgaagctgctgagcagtttgatctcctggttgaatgagatgcagtggggggtgcacctggccagactctccctcctgtcctgtacatagccacctccctgtggagaggacacttagggtcccctcccctggtcttgttacctgtgtgtgtgctggtgctgcgcatgaggactgtctgcctttgagggcttgggcagcagcggcagccatcttggttttaggaaatggggccgcctggcccagccactcactggtgtcctgtctcttgtcgtcctgtccttcctatctccccaaagtaccatagccagtttccagatgggccacagactggggaggagaatcagtggcccagccagaagttaaagggctgagggttgaggtgagaggcacctctgctcttgttgggaggggtggctgcttggaaataggcccagggctctgccagcctcggcctctccctcctgagttgccttctgttggtggctttcttcttgaacccacctgtgtaaagaggttttcagttccgtgggtttcccctttgattctgtaaatagtcccagagagaattcgtgggctgagggcaattctgtcttggaggaagaagctggacattcagcctgtggagtctgagttttgaaggatgtagggagccttagttgggtctcagaccataagtgtgtactacacagaagctgtgttttctagttctggtctgctgttgagatgtttggtaaatgccaggttgatagggcgctggctgcttggagcaaagggtgcatttcagggtgtggccaccaggtgctgtgagtttctgtggctcatggcctctgggctggtcccttgcacagggcccacgctggagtcttaccactctgctgcaggggtggaaggtggcccctcttgtcacccatacccatttcttacaaaataagttacaccgagtctacttggccctagaagagaaagttgaagagtcccagacctactagcattttgcaactatgcttgtaaagtcctcggaaagtttcctcgcgtaccagacagcggcgggggctgatagcaattttagtttttggcctccctatcctctcacatgagaacactgcctggatgcatctcatgatctctggagaatttccccatctttctcttctttccatcgtgtggattcaatagtgtggatttgaaggctgccctgcccccgactctcctgccgcacccctggccattgtaccttttgatgtttagaagttcgtggaagtagacgctgaggtgtgcagaggagctggtggataacagagaatgccagggaagatgagtgctgggtcagggtacttggatgaaacggtgcaggccaggcgggccctaataaaaccctctgccaggtctgggagtcccaggccatctgctcaacgctctgtggtttgtcagacctgcaagcaagccccctgctggggaagcctaggtgtccttgagctgaaccgcactgaagaactcttgtcctcactggctgatgcagcagaactcttgggaaatgtcttagtcctgcagaatcaggagtcaccagatgatgcagagttgagatcatcattgcaaagttctctgttcctgaggaactaaatttaaggaaaaaatgggattttgttttagagttggaaaaaaagcctgattaaagagtttctgcctgtt

SEQ ID NO: 16822 - DNA, 2553 bp, Homo sapiens
  misc_feature (44)..(44): n is a, c, g, or t
  misc_feature (67)..(67): n is a, c, g, or t
ccacccccccccccacctcccccccccccccccccccccctccnctacggctaggtacgaggctggngtgttagcgagtggccttcccggttggcgcgcgcccggggcggcggcgctggaggagctcgagacggagcctagttatgtctgggaggcgaacgcggtccggaggagccgctcagcgctccgggccaagggccccatctcctactaagcctctgcggaggtcccagcggaaatcaggctctgaactcccgagcatcctccctgaaatctggccgaagacacccagtgcggctgcagtcagaaagcccatcgtcttaaagaggatcgtggcccatgctgtagaggtcccagctgtccaatcacctcgcaggagccctaggatttcctttttcttggagaaagaaaacgagccccctggcagggagcttactaaggaggaccttttcaagacacacagcgtccctgccacccccaccagcactcctgtgccgaaccctgaggccgagtccagctccaaggaaggagagctggacgccagagacttggaaatgtctaagaaagtcaggcgttcctacagccggctggagaccctgggctctgcctctacctccaccccaggccgccggtcctgctttggcttcgaggggctgctgggggcagaagacttgtccggagtctcgccagtggtgtgctccaaactcaccgaggtccccagggtttgtgcaaagccctgggccccagacatgactctccctggaatctccccaccacccgagaaacagaaacgtaagaagaagaaaatgccagagatcttgaaaacggagctggatgagtgggctgcggccatgaatgccgagtttgaagctgctgagcagtttgatctcctggttgaatgagatgcagtggggggtgcacctggccagactctccctcctgtcctgtacatagccacctccctgtggagaggacacttagggtcccctcccctggtcttgttacctgtgtgtgtgctggtgctgcgcatgaggactgtctgcctttgagggcttgggcagcagcggcagccatcttggttttaggaaatggggccgcctggcccagccactcactggtgtcctgtctcttgtcgtcctgtccttcctatctccccaaagtaccatagccagtttccagatgggccacagactggggaggagaatcagtggcccagccagaagttaaagggctgagggttgaggtgagaggcacctctgctcttgttgggaggggtggctgcttggaaataggcccagggctctgccagcctcggcctctccctcctgagttgccttctgttggtggctttcttcttgaacccacctgtgtaaagaggttttcagttccgtgggtttcccctttgattctgtaaatagtcccagagagaattcgtgggctgagggcaattctgtcttggaggaagaagctggacattcagcctgtggagtctgagttttgaaggatgtagggagccttagttgggtctcagaccataagtgtgtactacacagaagctgtgttttctagttctggtctgctgttgagatgtttggtaaatgccaggttgatagggcgctggctgcttggagcaaagggtgcatttcagggtgtggccaccaggtgctgtgagtttctgtggctcatggcctctgggctggtcccttgcacagggcccacgctggagtcttaccactctgctgcaggggtggaaggtggcccctcttgtcacccatacccatttcttacaaaataagttacaccgagtctacttggccctagaagagaaagttgaagagtcccagacctactagcattttgcaactatgcttgtaaagtcctcggaaagtttcctcgcgtaccagacagcggcgggggctgatagcaattttagtttttggcctccctatcctctcacatgagaacactgcctggatgcatctcatgatctctggagaatttccccatctttctcttctttccatcgtgtggattcaatagtgtggatttgaaggctgccctgcccccgactctcctgccgcacccctggccattgtaccttttgatgtttagaagttcgtggaagtagacgctgaggtgtgcagaggagctggtggataacagagaatgccagggaagatgagtgctgggtcagggtacttggatgaaacggtgcaggccaggcgggccctaataaaaccctctgccaggtctgggagtcccaggccatctgctcaacgctctgtggtttgtcagacctgcaagcaagccccctgctggggaagcctaggtgtccttgagctgaaccgcactgaagaactcttgtcctcactggctgatgcagcagaactcttgggaaatgtcttagtcctgcagaatcaggagtcaccagatgatgcagagttgagatcatcattgcaaagttctctgttcctgaggaactaaatttaaggaaaaaatgggattttgttttagagttggaaaaaaagcctgattaaagagtttctgcctgtt

SEQ ID NO: 16823 - DNA, 2708 bp, Homo sapiens
cagaggatagaacgttaggctaggtacgaggcctgggtggtagcgagtggccttcccggttggcgcgcgcccggggcggcggcgctggaggagctcgagacggagcctagttatgtctgggaggcgaacgcggtccggaggagccgctcagcgctccgggccaagggccccatctcctactaagcctctgcggaggtcccagcggaaatcaggctctgaactcccgagcatcctccctgaaatctggccgaagacacccagtgcggctgcagtcagaaagcccatcgtcttaaagaggatcgtggcccatgctgtagaggtcccagctgtccaatcacctcgcaggagccctaggatttcctttttcttggagaaagaaaacgagccccctggcagggagcttactaaggaggaccttttcaagacacacagcgtccctgccacccccaccagcactcctgtgccgaaccctgaggccgagtccagctccaaggaaggagagctggacgccagagacttggaaatgtctaagaaagtcaggcgttcctacagccggctggagaccctgggctctgcctctacctccaccccaggccgccggtcctgctttggcttcgaggggctgctgggggcagaagacttgtccggagtctcgccagtggtgtgctccaaactcaccgaggtccccagggtttgtgcaaagccctgggccccagacatgactctccctggaatctccccaccacccgagaaacagaaacgtaagaagaagaaaatgccagagatcttgaaaacggagctggatgagtgggctgcggccatgaatgccgagtttgaagctgctgagcagtttgatctcctggttgaatgagatgcagtggggggtgcacctggccagactctccctcctgtcctgtacatagccacctccctgtggagaggacacttagggtcccctcccctggtcttgttacctgtgtgtgtgctggtgctgcgcatgaggactgtctgcctttgagggcttgggcagcagcggcagccatcttggttttaggaaatggggccgcctggcccagccactcactggtgtcctgtctcttgtcgtcctgtccttcctatctccccaaagtaccatagccagtttccagatgggccacagactggggaggagaatcagtggcccagccagaagttaaagggctgagggttgaggtgagaggcacctctgctcttgttgggaggggtggctgcttggaaataggcccagggctctgccagcctcggcctctccctcctgagttgccttctgttggtggctttcttcttgaacccacctgtgtaaagaggttttcagttccgtgggtttcccctttgattctgtaaatagtcccagagagaattcgtgggctgagggcaattctgtcttggaggaagaagctggacattcagcctgtggagtctgagttttgaaggatgtagggagccttagttgggtctcagaccataagtgtgtactacacagaagctgtgttttctagttctggtctgctgttgagatgtttggtaaatgccaggttgatagggcgctggctgcttggagcaaagggtgcatttcagggtgtggccaccaggtgctgtgagtttctgtggctcatggcctctgggctggtcccttgcacagggcccacgctggagtcttaccactctgctgcaggggtggaaggtggcccctcttgtcacccatacccatttcttacaaaataagttacaccgagtctacttggccctagaagagaaagttgaagagtcccagacctactagcattttgcaactatgcttgtaaagtcctcggaaagtttcctcgcgtaccagacagcggcgggggctgatagcaattttagtttttggcctccctatcctctcacatgagaacactgcctggatgcatctcatgatctctggagaatttccccatctttctcttctttccatcgtgtggattcaatagtgtggatttgaaggctgccctgcccccgactctcctgccgcacccctggccattgtaccttttgatgtttagaagttcgtggaagtagacgctgaggtgtgcagaggagctggtggataacagagaatgccagggaagatgagtgctgggtcagggtacttggatgaaacggtgcaggccaggcgggccctaataaaaccctctgccaggtctgggagtcccaggccatctgctcaacgctctgtggtttgtcagacctgcaagcaagccccctgctggggaagcctaggtgtccttgagctgaaccgcactgaagaactcttgtcctcactggctgatgcagcagaactcttgggaaatgtcttagtcctgcagaatcaggagtcaccagatgatgcagagttgagatcatcattgcaaagttctctgttcctgaggaactaaatttaaggaaaaaatgggattttgttttagagttggaaaaaaagcctgattaaagagtttctgcctgttaaaacacaacccacaacacacaacaaaaaaacactcccgggcctcaactcccggggcggggcacaaacgcggccccgaatggcgccggggccatacctgtccctggacccagcttcttgtccacaggggcaactccgccgtccccattcgggacgcgcttaactcgcaaacccggtacccgctagc

SEQ ID NO: 16824 - DNA, 2502 bp, Homo sapiens
ggtaattcgaacgttttttgcagcgagtggccttcccggttggcgcgcgcccggggcggcggcgctggaggagctcgagacggagcctagttatgtctgggaggcgaacgcggtccggaggagccgctcagcgctccgggccaagggccccatctcctactaagcctctgcggaggtcccagcggaaatcaggctctgaactcccgagcatcctccctgaaatctggccgaagacacccagtgcggctgcagtcagaaagcccatcgtcttaaagaggatcgtggcccatgctgtagaggtcccagctgtccaatcacctcgcaggagccctaggatttcctttttcttggagaaagaaaacgagccccctggcagggagcttactaaggaggaccttttcaagacacacagcgtccctgccacccccaccagcactcctgtgccgaaccctgaggccgagtccagctccaaggaaggagagctggacgccagagacttggaaatgtctaagaaagtcaggcgttcctacagccggctggagaccctgggctctgcctctacctccaccccaggccgccggtcctgctttggcttcgaggggctgctgggggcagaagacttgtccggagtctcgccagtggtgtgctccaaactcaccgaggtccccagggtttgtgcaaagccctgggccccagacatgactctccctggaatctccccaccacccgagaaacagaaacgtaagaagaagaaaatgccagagatcttgaaaacggagctggatgagtgggctgcggccatgaatgccgagtttgaagctgctgagcagtttgatctcctggttgaatgagatgcagtggggggtgcacctggccagactctccctcctgtcctgtacatagccacctccctgtggagaggacacttagggtcccctcccctggtcttgttacctgtgtgtgtgctggtgctgcgcatgaggactgtctgcctttgagggcttgggcagcagcggcagccatcttggttttaggaaatggggccgcctggcccagccactcactggtgtcctgtctcttgtcgtcctgtccttcctatctccccaaagtaccatagccagtttccagatgggccacagactggggaggagaatcagtggcccagccagaagttaaagggctgagggttgaggtgagaggcacctctgctcttgttgggaggggtggctgcttggaaataggcccagggctctgccagcctcggcctctccctcctgagttgccttctgttggtggctttcttcttgaacccacctgtgtaaagaggttttcagttccgtgggtttcccctttgattctgtaaatagtcccagagagaattcgtgggctgagggcaattctgtcttggaggaagaagctggacattcagcctgtggagtctgagttttgaaggatgtagggagccttagttgggtctcagaccataagtgtgtactacacagaagctgtgttttctagttctggtctgctgttgagatgtttggtaaatgccaggttgatagggcgctggctgcttggagcaaagggtgcatttcagggtgtggccaccaggtgctgtgagtttctgtggctcatggcctctgggctggtcccttgcacagggcccacgctggagtcttaccactctgctgcaggggtggaaggtggcccctcttgtcacccatacccatttcttacaaaataagttacaccgagtctacttggccctagaagagaaagttgaagagtcccagacctactagcattttgcaactatgcttgtaaagtcctcggaaagtttcctcgcgtaccagacagcggcgggggctgatagcaattttagtttttggcctccctatcctctcacatgagaacactgcctggatgcatctcatgatctctggagaatttccccatctttctcttctttccatcgtgtggattcaatagtgtggatttgaaggctgccctgcccccgactctcctgccgcacccctggccattgtaccttttgatgtttagaagttcgtggaagtagacgctgaggtgtgcagaggagctggtggataacagagaatgccagggaagatgagtgctgggtcagggtacttggatgaaacggtgcaggccaggcgggccctaataaaaccctctgccaggtctgggagtcccaggccatctgctcaacgctctgtggtttgtcagacctgcaagcaagccccctgctggggaagcctaggtgtccttgagctgaaccgcactgaagaactcttgtcctcactggctgatgcagcagaactcttgggaaatgtcttagtcctgcagaatcaggagtcaccagatgatgcagagttgagatcatcattgcaaagttctctgttcctgaggaactaaatttaaggaaaaaatgggattttgttttagagttggaaaaaaagcctgattaaagagtttctgcctgtt

SEQ ID NO: 16825 - DNA, 1520 bp, Homo sapiens
cagaggatagaacgttaggctaggtacgaggcctgggtggtagcgagtggccttcccggttggcgcgcgcccggggcggcggcgctggaggagctcgagacggagcctagttatgtctgggaggcgaacgcggtccggaggagccgctcagcgctccgggccaagggccccatctcctactaagcctctgcggaggtcccagcggaaatcaggctctgaactcccgagcatcctccctgaaatctggccgaagacacccagtgcggctgcagtcagaaagcccatcgtcttaaagaggatcgtggcccatgctgtagaggtcccagctgtccaatcacctcgcaggagccctaggatttcctttttcttggagaaagaaaacgagccccctggcagggagcttactaaggaggaccttttcaagacacacagcgtccctgccacccccaccagcactcctgtgccgaaccctgaggccgagtccagctccaaggaaggagagctggacgccagagacttggaaatgtctaagaaagtcaggcgttcctacagccggctggagaccctgggctctgcctctacctccaccccaggccgccggtcctgctttggcttcgaggggctgctgggggcagaagacttgtccggagtctcgccagtggtgtgctccaaactcaccgaggtccccagggtttgtgcaaagccctgggccccagacatgactctccctggaatctccccaccacccgagaaacagaaacgtaagaagaagaaaatgccagagatcttgaaaacggagctggatgagtgggctgcggccatgaatgccgagtttgaagctgctgagcagtttgatctcctggttgaatgagatgcagtggggggtgcacctggccagactctccctcctgtcctgtacatagccacctccctgtggagaggacacttagggtcccctcccctggtcttgttacctgtgtgtgtgctggtgctgcgcatgaggactgtctgcctttgagggctgccctgcccccgactctcctgccgcacccctggccattgtaccttttgatgtttagaagttcgtggaagtagacgctgaggtgtgcagaggagctggtggataacagagaatgccagggaagatgagtgctgggtcagggtacttggatgaaacggtgcaggccaggcgggccctaataaaaccctctgccaggtctgggagtcccaggccatctgctcaacgctctgtggtttgtcagacctgcaagcaagccccctgctggggaagcctaggtgtccttgagctgaaccgcactgaagaactcttgtcctcactggctgatgcagcagaactcttgggaaatgtcttagtcctgcagaatcaggagtcaccagatgatgcagagttgagatcatcattgcaaagttctctgttcctgaggaactaaatttaaggaaaaaatgggattttgttttagagttggaaaaaaagcctgattaaagagtttctgcctgtt

SEQ ID NO: 16826 - DNA, 2731 bp, Homo sapiens
cagaggatagaacgttaggctaggtacgaggcctgggtggtagcgagtggccttcccggttggcgcgcgcccggggcggcggcgctggaggagctcgagacggagcctagttatgtctgggaggcgaacgcggtccggaggagccgctcagcgctccggtgagcggagggcgcgcgggagacgtgaggtcgagccgtttgggggacgcagtccggtgaaagatggcctcttccctcccgctgccgccgccggaggaggcgcccttaaaagggcttgtttgggaatcttctcgctgtctctagaacctgttctctggactctaaggtctagagtcctcctctaccacttaacttttttctctttccagggccaagggccccatctcctactaagcctctgcggaggtcccagcggaaatcaggctctgaactcccgagcatcctccctgaaatctggccgaagacacccagtgcggctgcagtcagaaagcccatcgtcttaaagaggatcgtggcccatgctgtagaggtcccagctgtccaatcacctcgcaggagccctaggatttcctttttcttggagaaagaaaacgagccccctggcagggagcttactaaggaggaccttttcaagacacacagcgtccctgccacccccaccagcactcctgtgccgaaccctgaggccgagtccagctccaaggaaggagagctggacgccagagacttggaaatgtctaagaaagtcaggcgttcctacagccggctggagaccctgggctctgcctctacctccaccccaggccgccggtcctgctttggcttcgaggggctgctgggggcagaagacttgtccggagtctcgccagtggtgtgctccaaactcaccgaggtccccagggtttgtgcaaagccctgggccccagacatgactctccctggaatctccccaccacccgagaaacagaaacgtaagaagaagaaaatgccagagatcttgaaaacggagctggatgagtgggctgcggccatgaatgccgagtttgaagctgctgagcagtttgatctcctggttgaatgagatgcagtggggggtgcacctggccagactctccctcctgtcctgtacatagccacctccctgtggagaggacacttagggtcccctcccctggtcttgttacctgtgtgtgtgctggtgctgcgcatgaggactgtctgcctttgagggcttgggcagcagcggcagccatcttggttttaggaaatggggccgcctggcccagccactcactggtgtcctgtctcttgtcgtcctgtccttcctatctccccaaagtaccatagccagtttccagatgggccacagactggggaggagaatcagtggcccagccagaagttaaagggctgagggttgaggtgagaggcacctctgctcttgttgggaggggtggctgcttggaaataggcccagggctctgccagcctcggcctctccctcctgagttgccttctgttggtggctttcttcttgaacccacctgtgtaaagaggttttcagttccgtgggtttcccctttgattctgtaaatagtcccagagagaattcgtgggctgagggcaattctgtcttggaggaagaagctggacattcagcctgtggagtctgagttttgaaggatgtagggagccttagttgggtctcagaccataagtgtgtactacacagaagctgtgttttctagttctggtctgctgttgagatgtttggtaaatgccaggttgatagggcgctggctgcttggagcaaagggtgcatttcagggtgtggccaccaggtgctgtgagtttctgtggctcatggcctctgggctggtcccttgcacagggcccacgctggagtcttaccactctgctgcaggggtggaaggtggcccctcttgtcacccatacccatttcttacaaaataagttacaccgagtctacttggccctagaagagaaagttgaagagtcccagacctactagcattttgcaactatgcttgtaaagtcctcggaaagtttcctcgcgtaccagacagcggcgggggctgatagcaattttagtttttggcctccctatcctctcacatgagaacactgcctggatgcatctcatgatctctggagaatttccccatctttctcttctttccatcgtgtggattcaatagtgtggatttgaaggctgccctgcccccgactctcctgccgcacccctggccattgtaccttttgatgtttagaagttcgtggaagtagacgctgaggtgtgcagaggagctggtggataacagagaatgccagggaagatgagtgctgggtcagggtacttggatgaaacggtgcaggccaggcgggccctaataaaaccctctgccaggtctgggagtcccaggccatctgctcaacgctctgtggtttgtcagacctgcaagcaagccccctgctggggaagcctaggtgtccttgagctgaaccgcactgaagaactcttgtcctcactggctgatgcagcagaactcttgggaaatgtcttagtcctgcagaatcaggagtcaccagatgatgcagagttgagatcatcattgcaaagttctctgttcctgaggaactaaatttaaggaaaaaatgggattttgttttagagttggaaaaaaagcctgattaaagagtttctgcctgtt

SEQ ID NO: 16827 - DNA, 2315 bp, Homo sapiens
  misc_feature (44)..(44): n is a, c, g, or t
  misc_feature (67)..(67): n is a, c, g, or t
ccacccccccccccacctcccccccccccccccccccccctccnctacggctaggtacgaggctggngtgttagcgagtggccttcccggttggcgcgcgcccggggcggcggcgctggaggagctcgagacggagcctagttatgtctgggaggcgaacgcggtccggaggagccgctcagcgctccgggccaagggccccatctcctactaagcctctgcggaggtcccagcggaaatcaggctctgaactcccgagcatcctccctgaaatctggccgaagacacccagtgcggctgcagtcagaaagcccatcgtcttaaagaggatcgtggcccatgctgtagaggtcccagctgtccaatcacctcgcaggagccctagggccgccggtcctgctttggcttcgaggggctgctgggggcagaagacttgtccggagtctcgccagtggtgtgctccaaactcaccgaggtccccagggtttgtgcaaagccctgggccccagacatgactctccctggaatctccccaccacccgagaaacagaaacgtaagaagaagaaaatgccagagatcttgaaaacggagctggatgagtgggctgcggccatgaatgccgagtttgaagctgctgagcagtttgatctcctggttgaatgagatgcagtggggggtgcacctggccagactctccctcctgtcctgtacatagccacctccctgtggagaggacacttagggtcccctcccctggtcttgttacctgtgtgtgtgctggtgctgcgcatgaggactgtctgcctttgagggcttgggcagcagcggcagccatcttggttttaggaaatggggccgcctggcccagccactcactggtgtcctgtctcttgtcgtcctgtccttcctatctccccaaagtaccatagccagtttccagatgggccacagactggggaggagaatcagtggcccagccagaagttaaagggctgagggttgaggtgagaggcacctctgctcttgttgggaggggtggctgcttggaaataggcccagggctctgccagcctcggcctctccctcctgagttgccttctgttggtggctttcttcttgaacccacctgtgtaaagaggttttcagttccgtgggtttcccctttgattctgtaaatagtcccagagagaattcgtgggctgagggcaattctgtcttggaggaagaagctggacattcagcctgtggagtctgagttttgaaggatgtagggagccttagttgggtctcagaccataagtgtgtactacacagaagctgtgttttctagttctggtctgctgttgagatgtttggtaaatgccaggttgatagggcgctggctgcttggagcaaagggtgcatttcagggtgtggccaccaggtgctgtgagtttctgtggctcatggcctctgggctggtcccttgcacagggcccacgctggagtcttaccactctgctgcaggggtggaaggtggcccctcttgtcacccatacccatttcttacaaaataagttacaccgagtctacttggccctagaagagaaagttgaagagtcccagacctactagcattttgcaactatgcttgtaaagtcctcggaaagtttcctcgcgtaccagacagcggcgggggctgatagcaattttagtttttggcctccctatcctctcacatgagaacactgcctggatgcatctcatgatctctggagaatttccccatctttctcttctttccatcgtgtggattcaatagtgtggatttgaaggctgccctgcccccgactctcctgccgcacccctggccattgtaccttttgatgtttagaagttcgtggaagtagacgctgaggtgtgcagaggagctggtggataacagagaatgccagggaagatgagtgctgggtcagggtacttggatgaaacggtgcaggccaggcgggccctaataaaaccctctgccaggtctgggagtcccaggccatctgctcaacgctctgtggtttgtcagacctgcaagcaagccccctgctggggaagcctaggtgtccttgagctgaaccgcactgaagaactcttgtcctcactggctgatgcagcagaactcttgggaaatgtcttagtcctgcagaatcaggagtcaccagatgatgcagagttgagatcatcattgcaaagttctctgttcctgaggaactaaatttaaggaaaaaatgggattttgttttagagttggaaaaaaagcctgattaaagagtttctgcctgtt

SEQ ID NO: 16828 - DNA, 1731 bp, Homo sapiens
cagaggatagaacgttaggctaggtacgaggcctgggtggtagcgagtggccttcccggttggcgcgcgcccggggcggcggcgctggaggagctcgagacggagcctagttatgtctgggaggcgaacgcggtccggaggagccgctcagcgctccgggccaagggccccatctcctactaagcctctgcggaggtcccagcggaaatcaggctctgaactcccgagcatcctccctgaaatctggccgaagacacccagtgcggctgcagtcagaaagcccatcgtcttaaagaggatcgtggcccatgctgtagaggtcccagctgtccaatcacctcgcaggagccctaggatttcctttttcttggagaaagaaaacgagccccctggcagggagcttactaaggaggaccttttcaagacacacagcgtccctgccacccccaccagcactcctgtgccgaaccctgaggccgagtccagctccaaggaaggagagctggacgccagagacttggaaatgtctaagaaagtcaggcgttcctacagccggctggagaccctgggctctgcctctacctccaccccaggccgccggtcctgctttggcttcgaggggctgctgggggcagaagacttgtccggagtctcgccagtggtgtgctccaaactcaccgaggtccccagggtttgtgcaaagccctgggccccagacatgactctccctggaatctccccaccacccgagaaacagaaacgtaagaagaagaaaatgccagagatcttgaaaacggagctggatgagtgggctgcggccatgaatgccgagtttgaagctgctgagcagtttgatctcctggttgaatgagatgcagtggggggtgcacctggccagactctccctcctgtcctgtacatagccacctccctgtggagaggacacttagggtcccctcccctggtcttgttacctgtgtgtgtgctggtgctgcgcatgaggactgtctgcctttgagggcttgggcagcagcggcagccatcttggttttaggaaatggggccgcctggcccagccactcactggtgtcctgtctcttgtcgtcctgtccttcctatctccccaaagtaccatagccagtttccagatgggccacagactggggaggagaatcagtggcccagccagaagttaaagggctgagggttgaggtgagaggcacctctgctcttgttgggaggggtggctgcttggaaataggcccagggctctgccagcctcggcctctccctcctgagttgccttctgttggtggctttcttcttgaacccacctgtgtaaagaggttttcagttccgtgggtttcccctttgattctgtaaatagtcccagagagaattcgtgggctgagggcaattctgtcttggaggaagaagctggacattcagcctgtggagtctgaggtttgtcagacctgcaagcaagccccctgctggggaagcctaggtgtccttgagctgaaccgcactgaagaactcttgtcctcactggctgatgcagcagaactcttgggaaatgtcttagtcctgcagaatcaggagtcaccagatgatgcagagttgagatcatcattgcaaagttctctgttcctgaggaactaaatttaaggaaaaaatgggattttgttttagagttggaaaaaaagcctgattaaagagtttctgcctgtt

SEQ ID NO: 16829 - DNA, 1622 bp, Homo sapiens
gctggtaccggtctgggatgtatgggactccctgtggagaggacacttagggtcccctcccctggtcttgttacctgtgtgtgtgctggtgctgcgcatgaggactgtctgcctttgagggcttgggcagcagcggcagccatcttggttttaggaaatggggccgcctggcccagccactcactggtgtcctgtctcttgtcgtcctgtccttcctatctccccaaagtaccatagccagtttccagatgggccacagactggggaggagaatcagtggcccagccagaagttaaagggctgagggttgaggtgagaggcacctctgctcttgttgggaggggtggctgcttggaaataggcccagggctctgccagcctcggcctctccctcctgagttgccttctgttggtggctttcttcttgaacccacctgtgtaaagaggttttcagttccgtgggtttcccctttgattctgtaaatagtcccagagagaattcgtgggctgagggcaattctgtcttggaggaagaagctggacattcagcctgtggagtctgagttttgaaggatgtagggagccttagttgggtctcagaccataagtgtgtactacacagaagctgtgttttctagttctggtctgctgttgagatgtttggtaaatgccaggttgatagggcgctggctgcttggagcaaagggtgcatttcagggtgtggccaccaggtgctgtgagtttctgtggctcatggcctctgggctggtcccttgcacagggcccacgctggagtcttaccactctgctgcaggggtggaaggtggcccctcttgtcacccatacccatttcttacaaaataagttacaccgagtctacttggccctagaagagaaagttgaagagtcccagacctactagcattttgcaactatgcttgtaaagtcctcggaaagtttcctcgcgtaccagacagcggcgggggctgatagcaattttagtttttggcctccctatcctctcacatgagaacactgcctggatgcatctcatgatctctggagaatttccccatctttctcttctttccatcgtgtggattcaatagtgtggatttgaaggctgccctgcccccgactctcctgccgcacccctggccattgtaccttttgatgtttagaagttcgtggaagtagacgctgaggtgtgcagaggagctggtggataacagagaatgccagggaagatgagtgctgggtcagggtacttggatgaaacggtgcaggccaggcgggccctaataaaaccctctgccaggtctgggagtcccaggccatctgctcaacgctctgtggtttgtcagacctgcaagcaagccccctgctggggaagcctaggtgtccttgagctgaaccgcactgaagaactcttgtcctcactggctgatgcagcagaactcttgggaaatgtcttagtcctgcagaatcaggagtcaccagatgatgcagagttgagatcatcattgcaaagttctctgttcctgaggaactaaatttaaggaaaaaatgggattttgttttagagttggaaaaaaagcctgattaaagagtttctgcctgtt

SEQ ID NO: 16830 - DNA, 1399 bp, Homo sapiens
  misc_feature (42)..(42): n is a, c, g, or t
  misc_feature (47)..(47): n is a, c, g, or t
  misc_feature (51)..(51): n is a, c, g, or t
  misc_feature (54)..(54): n is a, c, g, or t
  misc_feature (57)..(58): n is a, c, g, or t
  misc_feature (70)..(70): n is a, c, g, or t
  misc_feature (72)..(72): n is a, c, g, or t
  misc_feature (74)..(74): n is a, c, g, or t
  misc_feature (80)..(80): n is a, c, g, or t
  misc_feature (91)..(91): n is a, c, g, or t
  misc_feature (121)..(121): n is a, c, g, or t
  misc_feature (124)..(124): n is a, c, g, or t
  misc_feature (140)..(141): n is a, c, g, or t
  misc_feature (157)..(157): n is a, c, g, or t
aaagcattatatggcggagtaatcgatggaatactccatggncattnaaanagngannatgtcctctgcnanancatcantgaaacccatnaaaaaaaatcagctctgatcttagtttttnctngccttctgctagcttnngaatgtgtttgctctngcgtctctagttcttttaattgtgatgttagggtgtcaattttagatctttcctgctttctctgtggacatttagtgctatatatttccctttgattctgtaaatagtcccagagagaattcgtgggctgagggcaattctgtcttggaggaagaagctggacattcagcctgtggagtctgagttttgaaggatgtagggagccttagttgggtctcagaccataagtgtgtactacacagaagctgtgttttctagttctggtctgctgttgagatgtttggtaaatgccaggttgatagggcgctggctgcttggagcaaagggtgcatttcagggtgtggccaccaggtgctgtgagtttctgtggctcatggcctctgggctggtcccttgcacagggcccacgctggagtcttaccactctgctgcaggggtggaaggtggcccctcttgtcacccatacccatttcttacaaaataagttacaccgagtctacttggccctagaagagaaagttgaagagtcccagacctactagcattttgcaactatgcttgtaaagtcctcggaaagtttcctcgcgtaccagacagcggcgggggctgatagcaattttagtttttggcctccctatcctctcacatgagaacactgcctggatgcatctcatgatctctggagaatttccccatctttctcttctttccatcgtgtggattcaatagtgtggatttgaaggctgccctgcccccgactctcctgccgcacccctggccattgtaccttttgatgtttagaagttcgtggaagtagacgctgaggtgtgcagaggagctggtggataacagagaatgccagggaagatgagtgctgggtcagggtacttggatgaaacggtgcaggccaggcgggccctaataaaaccctctgccaggtctgggagtcccaggccatctgctcaacgctctgtggtttgtcagacctgcaagcaagccccctgctggggaagcctaggtgtccttgagctgaaccgcactgaagaactcttgtcctcactggctgatgcagcagaactcttgggaaatgtcttagtcctgcagaatcaggagtcaccagatgatgcagagttgagatcatcattgcaaagttctctgttcctgaggaactaaatttaaggaaaaaatgggattttgttttagagttggaaaaaaagcctgattaaagagtttctgcctgtt

SEQ ID NO: 16831 - DNA, 765 bp, Homo sapiens
tggctaggtagaggctggggtgaatcggccgaggagagaaagttgaagagtcccagacctactagcattttgcaactatgcttgtaaagtcctcggaaagtttcctcgcgtaccagacagcggcgggggctgatagcaattttagtttttggcctccctatcctctcacatgagaacactgcctggatgcatctcatgatctctggagaatttccccatctttctcttctttccatcgtgtggattcaatagtgtggatttgaaggctgccctgcccccgactctcctgccgcacccctggccattgtaccttttgatgtttagaagttcgtggaagtagacgctgaggtgtgcagaggagctggtggataacagagaatgccagggaagatgagtgctgggtcagggtacttggatgaaacggtgcaggccaggcgggccctaataaaaccctctgccaggtctgggagtcccaggccatctgctcaacgctctgtggtttgtcagacctgcaagcaagccccctgctggggaagcctaggtgtccttgagctgaaccgcactgaagaactcttgtcctcactggctgatgcagcagaactcttgggaaatgtcttagtcctgcagaatcaggagtcaccagatgatgcagagttgagatcatcattgcaaagttctctgttcctgaggaactaaatttaaggaaaaaatgggattttgttttagagttggaaaaaaagcctgattaaagagtttctgcctgtt

SEQ ID NO: 16832 - DNA, 753 bp, Homo sapiens
cagaggatagaacgttaggctaggtacgaggcctgggtggtagcgagtggccttcccggttggcgcgcgcccggggcggcggcgctggaggagctcgagacggagcctagttatgtctgggaggcgaacgcggtccggaggagccgctcagcgctccggtgagcggagggcgcgcgggagacgtgaggtcgagccgtttgggggacgcagtccggtgaaagatggcctcttccctcccgctgccgccgccggaggaggcgcccttaaaagggcttgtttgggaatcttctcgctgtctctagaacctgttctctggactctaaggtctagagtcctcctctaccacttaacttttttctctttccagggccaagggccccatctcctactaagcctctgcggaggtcccagcggaaatcaggctctgaactcccgagcatcctccctgaaatctggccgaagacacccagtgcggctgcagtcagaaagcccatcgtcttaaagaggatcgtggcccatgctgtagaggtcccagctgtccaatcacctcgcaggagccctaggtctcttaggggcagacaaagagcccactccaagctggccaacaagccagtggtgcagcctgttgaggagcaagaacccaagggccctcaggcttccgaggagcggaacttggagccaccttcctcagaacaactggaacccaccgtcacgttcctgtttacactcctgaacacctctgagcccactgag

SEQ ID NO: 16833 - DNA, 2209 bp, Homo sapiens
gcgtgcagcgggcgggtcccccgcccggctaatgttttggccgcttcaagatggcggtgcaggagtcggcggctcagttgtccatgaccctgaaggtccaggagtacccgaccctcaaggtgccctacgagacgctgaacaaacgctttcgcgccgctcagaagaacattgaccgggagaccagccacgtcaccatggtggtggccgagctggagaagacgttgagcggctgccccgccgtggactccgtggtcagcctgctggacggcgtggtggagaagctcagcgtcctcaagaggaaggcggtggaatccatccaggccgaggacgagagcgccaagctgtgcaagcgccggatcgagcacctcaaagagcatagcagcgaccagcccgcggcggccagcgtgtggaagaggaagcgcatggatcgcatgatggtggagcacctgctgcgttgcggctactacaacacggctgtcaagctggcgcgccagagcggcatcgaggacctagtgaatattgagatgttcctgacggccaaagaggtggaggagtccctggagaggcgtgagacggccacctgcctggcctggtgccatgacaacaagtcccggctccggaagatgaagagctgcctggagttcagcctcagaatccaggagttcattgaactcatccggcagaataagagactggacgctgtgagacatgcaagaaagcacttcagccaagcagaagggagccagctggacgaggtgcgccaggccatgggcatgctggccttcccgcccgacacgcacatctccccgtacaaggaccttctggaccctgcacggtggcggatgctgatccagcagttccggtacgacaactaccgactacaccagctgggaaacaattctgtgttcaccctcaccctgcaggctggcctctcagccatcaagacaccacagtgctacaaggaggacggcagctccaagagccctgactgccctgtgtgcagccgctccctgaacaagctggcgcagcccctgcccatggcccactgtgccaactcccgcctggtctgcaagatttctggcgacgtgatgaacgagaacaatccgcccatgatgctgcccaacggctacgtctacggctacaattctctgctttctatccgtcaagatgataaagtcgtgtgcccgagaaccaaagaagtcttccacttctcacaagccgagaaggtgtacatcatgtaggccccacgtcgtgaagcgcacgcctcggggacgggctgcagtgggcggggaggccacgccttcctcctgtcccacgctccagcctgccgcggcgtttctgtttcttgcgaccaaagatccgtgagcaacgataaatactcttaggaagagagaaaataaggtttcataagtttgtacttgaaaacatttggattggtaggattttgtaacacgtcaaccatttgatgcttctgaaaagtactttcaacttgcgaaggaaactcttctttaaagactgacctaaacaccgagggaaacttaagaacgtttaaaatataggagtccgtgatttccctgtgttttcagtttctttccttctgtgaacgatgagacttggagaacgggctggtccttcaccacttcctgttggccctggcctggccggggaaggtggcagcggcaccggactgacctgcagtgacccgcgatgccgcgccacgagggacacttatggcttcattcgagagctgctgccaaaacgcctggcgccgccaccgtcgggggctggcttcgaggacgcccgcctgcctcgcgggtcgtgtccgcgggactgtgttcgtacgtgcatagtttcgatatcacatcgcggggctgtgttcgtagctgcgtcgtttcgatatcacaccctctgtgtgccgccttacttcctgcttcgagaatgtataacgtggaaatccacgggaccaaatttctgcagaggccttgccggatggttccataactgtagagtctaattgctatccattacagaaattaatcgttcagttgaaagaagtactgatgacttttcaaaacaaatgaaccaccgtagctgacagagaaccgtatcgtagaggtttgtagttagtgcttatttttgcatgttgatgttgactagctaataaactgtaaatgtaaaccatgcgaataaaatggttttctatttctca

SEQ ID NO: 16834 - DNA, 2086 bp, Homo sapiens
gcgtgcagcgggcgggtcccccgcccggctaatgttttggccgcttcaagatggcggtgcaggagtcggcggctcagttgtccatgaccctgaaggtccaggagtacccgaccctcaaggtgccctacgagacgctgaacaaacgctttcgcgccgctcagaagaacattgaccgggagaccagccacgtcaccatggtggtggccgagctggagaagacgttgagcggctgccccgccgtggactccgtggtcagcctgctggacggcgtggtggagaagctcagcgtcctcaagaggaaggcggtggaatccatccaggccgaggacgagagcgccaagctgtgcaagcgccggatcgagcacctcaaagagcatagcagcgaccagcccgcggcggccagcgtgtggaagaggaagcgcatggatcgcatgatggtggagcacctgctgcgttgcggctactacaacacggctgtcaagctggcgcgccagagcggcatcgagagctgcctggagttcagcctcagaatccaggagttcattgaactcatccggcagaataagagactggacgctgtgagacatgcaagaaagcacttcagccaagcagaagggagccagctggacgaggtgcgccaggccatgggcatgctggccttcccgcccgacacgcacatctccccgtacaaggaccttctggaccctgcacggtggcggatgctgatccagcagttccggtacgacaactaccgactacaccagctgggaaacaattctgtgttcaccctcaccctgcaggctggcctctcagccatcaagacaccacagtgctacaaggaggacggcagctccaagagccctgactgccctgtgtgcagccgctccctgaacaagctggcgcagcccctgcccatggcccactgtgccaactcccgcctggtctgcaagatttctggcgacgtgatgaacgagaacaatccgcccatgatgctgcccaacggctacgtctacggctacaattctctgctttctatccgtcaagatgataaagtcgtgtgcccgagaaccaaagaagtcttccacttctcacaagccgagaaggtgtacatcatgtaggccccacgtcgtgaagcgcacgcctcggggacgggctgcagtgggcggggaggccacgccttcctcctgtcccacgctccagcctgccgcggcgtttctgtttcttgcgaccaaagatccgtgagcaacgataaatactcttaggaagagagaaaataaggtttcataagtttgtacttgaaaacatttggattggtaggattttgtaacacgtcaaccatttgatgcttctgaaaagtactttcaacttgcgaaggaaactcttctttaaagactgacctaaacaccgagggaaacttaagaacgtttaaaatataggagtccgtgatttccctgtgttttcagtttctttccttctgtgaacgatgagacttggagaacgggctggtccttcaccacttcctgttggccctggcctggccggggaaggtggcagcggcaccggactgacctgcagtgacccgcgatgccgcgccacgagggacacttatggcttcattcgagagctgctgccaaaacgcctggcgccgccaccgtcgggggctggcttcgaggacgcccgcctgcctcgcgggtcgtgtccgcgggactgtgttcgtacgtgcatagtttcgatatcacatcgcggggctgtgttcgtagctgcgtcgtttcgatatcacaccctctgtgtgccgccttacttcctgcttcgagaatgtataacgtggaaatccacgggaccaaatttctgcagaggccttgccggatggttccataactgtagagtctaattgctatccattacagaaattaatcgttcagttgaaagaagtactgatgacttttcaaaacaaatgaaccaccgtagctgacagagaaccgtatcgtagaggtttgtagttagtgcttatttttgcatgttgatgttgactagctaataaactgtaaatgtaaaccatgcgaataaaatggttttctatttctca

SEQ ID NO: 16835 - DNA, 2009 bp, Homo sapiens
gcgtgcagcgggcgggtcccccgcccggctaatgttttggccgcttcaagatggcggtgcaggagtcggcggctcagttgtccatgaccctgaaggtccaggagtacccgaccctcaaggtgccctacgagacgctgaacaaacgctttcgcgccgctcagaagaacattgaccgggagaccagccacgtcaccatggtggtggccgagctggagaagacgttgagcggctgccccgccgtggactccgtggtcagcctgctggacggcgtggtggagaagctcagcgtcctcaagaggaaggcggtggaatccatccaggccgaggacgagagcgccaagctgtgcaagcgccggatcgagcacctcaaagagcatagcagcgaccagcccgcggcggccagcgtgtggaagaggaagcgcatggatcgcatgatggtggagcacctgctgcgttgcggctactacaacacggctgtcaagctggcgcgccagagcggcatcgagacatgcaagaaagcacttcagccaagcagaagggagccagctggacgaggtgcgccaggccatgggcatgctggccttcccgcccgacacgcacatctccccgtacaaggaccttctggaccctgcacggtggcggatgctgatccagcagttccggtacgacaactaccgactacaccagctgggaaacaattctgtgttcaccctcaccctgcaggctggcctctcagccatcaagacaccacagtgctacaaggaggacggcagctccaagagccctgactgccctgtgtgcagccgctccctgaacaagctggcgcagcccctgcccatggcccactgtgccaactcccgcctggtctgcaagatttctggcgacgtgatgaacgagaacaatccgcccatgatgctgcccaacggctacgtctacggctacaattctctgctttctatccgtcaagatgataaagtcgtgtgcccgagaaccaaagaagtcttccacttctcacaagccgagaaggtgtacatcatgtaggccccacgtcgtgaagcgcacgcctcggggacgggctgcagtgggcggggaggccacgccttcctcctgtcccacgctccagcctgccgcggcgtttctgtttcttgcgaccaaagatccgtgagcaacgataaatactcttaggaagagagaaaataaggtttcataagtttgtacttgaaaacatttggattggtaggattttgtaacacgtcaaccatttgatgcttctgaaaagtactttcaacttgcgaaggaaactcttctttaaagactgacctaaacaccgagggaaacttaagaacgtttaaaatataggagtccgtgatttccctgtgttttcagtttctttccttctgtgaacgatgagacttggagaacgggctggtccttcaccacttcctgttggccctggcctggccggggaaggtggcagcggcaccggactgacctgcagtgacccgcgatgccgcgccacgagggacacttatggcttcattcgagagctgctgccaaaacgcctggcgccgccaccgtcgggggctggcttcgaggacgcccgcctgcctcgcgggtcgtgtccgcgggactgtgttcgtacgtgcatagtttcgatatcacatcgcggggctgtgttcgtagctgcgtcgtttcgatatcacaccctctgtgtgccgccttacttcctgcttcgagaatgtataacgtggaaatccacgggaccaaatttctgcagaggccttgccggatggttccataactgtagagtctaattgctatccattacagaaattaatcgttcagttgaaagaagtactgatgacttttcaaaacaaatgaaccaccgtagctgacagagaaccgtatcgtagaggtttgtagttagtgcttatttttgcatgttgatgttgactagctaataaactgtaaatgtaaaccatgcgaataaaatggttttctatttctca

SEQ ID NO: 16836 - DNA, 2046 bp, Homo sapiens
tcgagcggccgcccgggcaggtggagtcggcggctcagttgtccatgaccctgaaggtccaggagtacccgaccctcaaggtgccctacgagacgctgaacaaacgctttcgcgccgctcagaagaacattgaccgggagaccagccacgtcaccatggtggtggccgagctggagaagacgttgagcggctgccccgccgtggactccgtggtcagcctgctggacggcgtggtggagaagctcagcgtcctcaagaggaaggcggtggaatccatccaggccgaggacgagagcgccaagctgtgcaagcgccggatcgagcacctcaaagagcatagcagcgaccagcccgcggcggccagcgtgtggaagaggaagcgcatggatcgcatgatggtggagcacctgctgcgttgcggctactacaacacggctgtcaagctggcgcgccagagcggcatcgagagctgcctggagttcagcctcagaatccaggagttcattgaactcatccggcagaataagagactggacgctgtgagacatgcaagaaagcacttcagccaagcagaagggagccagctggacgaggtgcgccaggccatgggcatgctggccttcccgcccgacacgcacatctccccgtacaaggaccttctggaccctgcacggtggcggaaccttctggaccctgcacggtggcggatgctgatccagcagttccggtacgacaactaccgactacaccagctgggaaacaattctgtgttcaccctcaccctgcaggctggcctctcagccatcaagacaccacagtgctacaaggaggacggcagctccaagagccctgactgccctgtgtgcagccgctccctgaacaagctggcgcagcccctgcccatggcccactgtgccaactcccgcctggtctgcaagatttctggcgacgtgatgaacgagaacaatccgcccatgatgctgcccaacggctacgtctacggctacaattctctgctttctatccgtcaagatgataaagtcgtgtgcccgagaaccaaagaagtcttccacttctcacaagccgagaaggtgtacatcatgtaggccccacgtcgtgaagcgcacgcctcggggacgggctgcagtgggcggggaggccacgccttcctcctgtcccacgctccagcctgccgcggcgtttctgtttcttgcgaccaaagatccgtgagcaacgataaatactcttaggaagagagaaaataaggtttcataagtttgtacttgaaaacatttggattggtaggattttgtaacacgtcaaccatttgatgcttctgaaaagtactttcaacttgcgaaggaaactcttctttaaagactgacctaaacaccgagggaaacttaagaacgtttaaaatataggagtccgtgatttccctgtgttttcagtttctttccttctgtgaacgatgagacttggagaacgggctggtccttcaccacttcctgttggccctggcctggccggggaaggtggcagcggcaccgcgccacgagggacacttatggcttcattcgagagctgctgccaaaacgcctggcgccgccaccgtcgggggctggcttcgaggacgcccgcctgcctcgcgggtcgtgtccgcgggactgtgttcgtacgtgcatagtttcgatatcacatcgcggggctgtgttcgtagctgcgtcgtttcgatatcacaccctctgtgtgccgccttacttcctgcttcgagaatgtataacgtggaaatccacgggaccaaatttctgcagaggccttgccggatggttccataactgtagagtctaattgctatccattacagaaattaatcgttcagttgaaagaagtactgatgacttttcaaaacaaatgaaccaccgtagctgacagagaaccgtatcgtagaggtttgtagttagtgcttatttttgcatgttgatgttgactagctaataaactgtaaatgtaaaccatgcgaataaaatggttttctatttctca

SEQ ID NO: 16837 - DNA, 601 bp, Homo sapiens
gcgtgcagcgggcgggtcccccgcccggctaatgttttggccgcttcaagatggcggtgcaggagtcggcggctcagttgtccatgaccctgaaggtccaggagtacccgaccctcaaggtgccctacgagacgctgaacaaacgctttcgcgccgctcagaagaacattgaccgggagaccagccacgtcaccatggtggtggccgagctggagaagacgttgagcggctgccccgccgtggactccgtggtcagcctgctggacggcgtggtggagaagctcagcgtcctcaagaggaaggttggtcccgcctggcggtccctcttcagtctggggcatggacaccccttttgtctcgaaaatgagtcctaagacaggcaagctgcaatgatgggaacgcgggaggtgcggttgggggcccccttccctgctgtctgccttctggggccactgtcggctgagcaggccagcttcctgttcctgtagggaccgtgttgtcttgctccaggagtgtccagagtccaggccacagggagaccaggatgtatagcaggttgattgattttttttttttttttttttttttgagacagagtccc

SEQ ID NO: 16838 - DNA, 250 bp, Homo sapiens
gctcggtaccccctagttttagaagtttcaatagcagtatcatctaataagccaaagagctttggttgaaaaaaaaaatttgttagagggataaaataaccgaatgtgagtgtcttctggtaacagaaagttctgaccgagccatacacaaccctctgtgtgccgccttacttcctgcttcgagaatgtataacgtggaaatccacgttttagaagtttcaatagcaatttatacatattaccactgctg

SEQ ID NO: 16839 - DNA, 3634 bp, Homo sapiens
  misc_feature (975)..(975): n is a, c, g, or t
  misc_feature (977)..(977): n is a, c, g, or t
gcgtgcagcgggcgggtcccccgcccggctaatgttttggccgcttcaagatggcggtgcaggagtcggcggctcagttgtccatgaccctgaaggtccaggagtacccgaccctcaaggtgccctacgagacgctgaacaaacgctttcgcgccgctcagaagaacattgaccgggagaccagccacgtcaccatggtggtggccgagctggagaagacgttgagcggctgccccgccgtggactccgtggtcagcctgctggacggcgtggtggagaagctcagcgtcctcaagaggaaggcggtggaatccatccaggccgaggacgagagcgccaagctgtgcaagcgccggatcgagcacctcaaagagcatagcagcgaccagcccgcggcggccagcgtgtggaagaggaagcgcatggatcgcatgatggtggagcacctgctgcgttgcggctactacaacacggctgtcaagctggcgcgccagagcggcatcgaggacctagtgaatattgagatgttcctgacggccaaagaggtggaggagtccctggagaggcgtgagacggccacctgcctggcctggtgccatgacaacaagtcccggctccggaagatgaagagctgcctggagttcagcctcagaatccaggagttcattgaactcatccggcagaataagagactggacgctgtgagacatgcaagaaagcacttcagccaagcagaagggagccagctggacgaggtgcgccaggccatgggcatgctggccttcccgcccgacacgcacatctccccgtacaaggaccttctggaccctgcacggtggcggatgctgatccagcagttccggtacgacaactaccgactacaccagctgggaaacaattctgtgttcaccctcaccctgcaggctggcctctcagccatcaagacaccgtatcctacctcccgtgcgcagtgcngnttggctggggttgcatctttggtcatattttaacacgctgaccctgcactttgccactcttgtcctcccaccacagacagccccgagctcccgtgtgctgcacttgcgtggtgtctggatggtcggggtggggccgtgttgaggggcctcggatgcgtcgtgcagccttcactctgggaagtggcgcgcttcctctctcatcatctcagaggccgccatgggcattgatctaaaagcccgattttgatgtgttctggcagccggcagattaccattcagaatagttttcccgtgtgattaccaagaaccttgcctgtgactgactctgtcccgcctgtgactgactctgtcccacctgtgaccgactctgtctgcctgtgactctgtccctgcctgtgactgactccatcctgcctgtgactctgtcccacctgcgactcactgagttcctgcctgtgactcactcggctcccgcctgcaacggacttggtccctgcctgcgactcactgtggccctgcctgtgactgagtctgtcccgtttgtgactgattccttcctgtgactgactctgtcccacctgcaactgacttcttcctgcctgtgacagactctgcccctgcctgcgactgagtctgtcccttcctgcaactgagtccatcccgcctgtgactctgtcctcgcctgtgactgactctgcccctgccctgtgactgtctcacctgtgactgactccgtcctgcctgtgactcagcctcttactgactctacccctgcctgtgactgactctgccctctcctgtgactgactctgtccccacctgtgactgactctgtccccacctgtgactgactgtcctcctgcaactgactctgtccccgcctatgaatgtctttcatgtgacctgcctcaggcccagagggcagtgagtgtttcgcgattgctgctggtacctggctgtgccggggtatgaatgagactcaggccccctcccttgtcccctctttgtggaactctgggcgagagggctggcgtgcttgcccactgcctgttcctaggtgccagcagaacgtccctgctgggtggctcttgtcctgcctggagaggttgcgtggccggggagagggcggcgggcgacggagccactctgtgcctgtggtcctggtgctggaggccggggtgagaaggcgcaggcttcttgtctccaccgaggcctcagtggggctgtttagctgtcgagtgcagcacttcctgtgcctcgaaagacagccccgtgtagtcagcatggcgcccacatagccagaagggcacgcagcccagggcagagtggccacagggggctgggctcaccccggctgccctgagtggcccccaacccttccttgacccgatgctcagacagtgctacaaggaggacggcagctccaagagccctgactgccctgtgtgcagccgctccctgaacaagctggcgcagcccctgcccatggcccactgtgccaactcccgcctggtctgcaagatttctggcgacgtgatgaacgagaacaatccgcccatgatgctgcccaacggctacgtctacggctacaattctctgctttctatccgtcaagatgataaagtcgtgtgcccgagaaccaaagaagtcttccacttctcacaagccgagaaggtgtacatcatgtaggccccacgtcgtgaagcgcacgcctcggggacgggctgcagtgggcggggaggccacgccttcctcctgtcccacgctccagcctgccgcggcgtttctgtttcttgcgaccaaagatccgtgagcaacgataaatactcttaggaagagagaaaataaggtttcataagtttgtacttgaaaacatttggattggtaggattttgtaacacgtcaaccatttgatgcttctgaaaagtactttcaacttgcgaaggaaactcttctttaaagactgacctaaacaccgagggaaacttaagaacgtttaaaatataggagtccgtgatttccctgtgttttcagtttctttccttctgtgaacgatgagacttggagaacgggctggtccttcaccacttcctgttggccctggcctggccggggaaggtggcagcggcaccggactgacctgcagtgacccgcgatgccgcgccacgagggacacttatggcttcattcgagagctgctgccaaaacgcctggcgccgccaccgtcgggggctggcttcgaggacgcccgcctgcctcgcgggtcgtgtccgcgggactgtgttcgtacgtgcatagtttcgatatcacatcgcggggctgtgttcgtagctgcgtcgtttcgatatcacaccctctgtgtgccgccttacttcctgcttcgagaatgtataacgtggaaatccacgggaccaaatttctgcagaggccttgccggatggttccataactgtagagtctaattgctatccattacagaaattaatcgttcagttgaaagaagtactgatgacttttcaaaacaaatgaaccaccgtagctgacagagaaccgtatcgtagaggtttgtagttagtgcttatttttgcatgttgatgttgactagctaataaactgtaaatgtaaaccatgcgaataaaatggttttctatttctca

SEQ ID NO: 16840 - DNA, 2155 bp, Homo sapiens
gcgtgcagcgggcgggtcccccgcccggctaatgttttggccgcttcaagatggcggtgcaggagtcggcggctcagttgtccatgaccctgaaggtccaggagtacccgaccctcaaggtgccctacgagacgctgaacaaacgctttcgcgccgctcagaagaacattgaccgggagaccagccacgtcaccatggtggtggccgagctggagaagacgttgagcggctgccccgccgtggactccgtggtcagcctgctggacggcgtggtggagaagctcagcgtcctcaagaggaaggcggtggaatccatccaggccgaggacgagagcgccaagctgtgcaagcgccggatcgagcacctcaaagagcatagcagcgaccagcccgcggcggccagcgtgtggaagaggaagcgcatggatcgcatgatggtggagcacctgctgcgttgcggctactacaacacggctgtcaagctggcgcgccagagcggcatcgaggacctagtgaatattgagatgttcctgacggccaaagaggtggaggagtccctggagaggcgtgagacggccacctgcctggcctggtgccatgacaacaagtcccggctccggaagatgaagagctgcctggagttcagcctcagaatccaggagttcattgaactcatccggcagaataagagactggacgctgtgagacatgcaagaaagcacttcagccaagcagaagggagccagctggacgaggtgcgccaggccatgggcatgctggccttcccgcccgacacgcacatctccccgtacaaggaccttctggaccctgcacggtggcggatgctgatccagcagttccggtacgacaactaccgactacaccagctgggaaacaattctgtgttcaccctcaccctgcaggctggcctctcagccatcaagacaccacagtgctacaaggaggacggcagctccaagagccctgactgccctgtgtgcagccgctccctgaacaagctggcgcagcccctgcccatggcccactgtgccaactcccgcctggtctgcaagatttctggcgacgtgatgaacgagaacaatccgcccatgatgctgcccaacggctacgtctacggctacaattctctgctttctatccgtcaagatgataaagtcgtgtgcccgagaaccaaagaagtcttccacttctcacaagccgagaaggtgtacatcatgtaggccccacgtcgtgaagcgcacgcctcggggacgggctgcagtgggcggggaggccacgccttcctcctgtcccacgctccagcctgccgcggcgtttctgtttcttgcgaccaaagatccgtgagcaacgataaatactcttaggaagagagaaaataaggtttcataagtttgtacttgaaaacatttggattggtaggattttgtaacacgtcaaccatttgatgcttctgaaaagtactttcaacttgcgaaggaaactcttctttaaagactgacctaaacaccgagggaaacttaagaacgtttagatgagacttggagaacgggctggtccttcaccacttcctgttggccctggcctggccggggaaggtggcagcggcaccggactgacctgcagtgacccgcgatgccgcgccacgagggacacttatggcttcattcgagagctgctgccaaaacgcctggcgccgccaccgtcgggggctggcttcgaggacgcccgcctgcctcgcgggtcgtgtccgcgggactgtgttcgtacgtgcatagtttcgatatcacatcgcggggctgtgttcgtagctgcgtcgtttcgatatcacaccctctgtgtgccgccttacttcctgcttcgagaatgtataacgtggaaatccacgggaccaaatttctgcagaggccttgccggatggttccataactgtagagtctaattgctatccattacagaaattaatcgttcagttgaaagaagtactgatgacttttcaaaacaaatgaaccaccgtagctgacagagaaccgtatcgtagaggtttgtagttagtgcttatttttgcatgttgatgttgactagctaataaactgtaaatgtaaaccatgcgaataaaatggttttctatttctca

SEQ ID NO: 16841 - DNA, 2152 bp, Homo sapiens
gcgtgcagcgggcgggtcccccgcccggctaatgttttggccgcttcaagatggcggtgcaggagtcggcggctcagttgtccatgaccctgaaggtccaggagtacccgaccctcaaggtgccctacgagacgctgaacaaacgctttcgcgccgctcagaagaacattgaccgggagaccagccacgtcaccatggtggtggccgagctggagaagacgttgagcggctgccccgccgtggactccgtggtcagcctgctggacggcgtggtggagaagctcagcgtcctcaagaggaaggcggtggaatccatccaggccgaggacgagagcgccaagctgtgcaagcgccggatcgagcacctcaaagagcatagcagcgaccagcccgcggcggccagcgtgtggaagaggaagcgcatggatcgcatgatggtggagcacctgctgcgttgcggctactacaacacggctgtcaagctggcgcgccagagcggcatcgaggacctagtgaatattgagatgttcctgacggccaaagaggtggaggagtccctggagaggcgtgagacggccacctgcctggcctggtgccatgacaacaagtcccggctccggaagatgaagagctgcctggagttcagcctcagaatccaggagttcattgaactcatccggcagaataagagactggacgctgtgagacatgcaagaaagcacttcagccaagcagaagggagccagctggacgaggtgcgccaggccatgggcatgctggccttcccgcccgacacgcacatctccccgtacaaggaccttctggaccctgcacggtggcggatgctgatccagcagttccggtacgacaactaccgactacaccagctgggaaacaattctgtgttcaccctcaccctgcaggctggcctctcagccatcaagacaccacagtgctacaaggaggacggcagctccaagagccctgactgccctgtgtgcagccgctccctgaacaagctggcgcagcccctgcccatggcccactgtgccaactcccgcctggtctgcaagatttctggcgacgtgatgaacgagaacaatccgcccatgatgctgcccaacggctacgtctacggctacaattctctgctttctatccgtcaagatgataaagtcgtgtgcccgagaaccaaagaagtcttccacttctcacaagccgagaaggtgtacatcatgtaggccccacgtcgtgaagcgcacgcctcggggacgggctgcagtgggcggggaggccacgccttcctcctgtcccacgctccagcctgccgcggcgtttctgtttcttgcgaccaaagatccgtgagcaacgataaatactcttaggaagagagaaaataaggtttcataagtttgtacttgaaaacatttggattggtaggattttgtaacacgtcaaccatttgatgcttctgaaaagtactttcaacttgcgaaggaaactcttctttaaagactgacctaaacaccgagggaaacttaagaacgtttaaaatataggagtccgtgatttccctgtgttttcagtttctttccttctgtgaacgatgagacttggagaacgggctggtccttcaccacttcctgttggccctggcgccacgagggacacttatggcttcattcgagagctgctgccaaaacgcctggcgccgccaccgtcgggggctggcttcgaggacgcccgcctgcctcgcgggtcgtgtccgcgggactgtgttcgtacgtgcatagtttcgatatcacatcgcggggctgtgttcgtagctgcgtcgtttcgatatcacaccctctgtgtgccgccttacttcctgcttcgagaatgtataacgtggaaatccacgggaccaaatttctgcagaggccttgccggatggttccataactgtagagtctaattgctatccattacagaaattaatcgttcagttgaaagaagtactgatgacttttcaaaacaaatgaaccaccgtagctgacagagaaccgtatcgtagaggtttgtagttagtgcttatttttgcatgttgatgttgactagctaataaactgtaaatgtaaaccatgcgaataaaatggttttctatttctca

SEQ ID NO: 16842 - DNA, 2132 bp, Homo sapiens
gcgtgcagcgggcgggtcccccgcccggctaatgttttggccgcttcaagatggcggtgcaggagtcggcggctcagttgtccatgaccctgaaggtccaggagtacccgaccctcaaggtgccctacgagacgctgaacaaacgctttcgcgccgctcagaagaacattgaccgggagaccagccacgtcaccatggtggtggccgagctggagaagacgttgagcggctgccccgccgtggactccgtggtcagcctgctggacggcgtggtggagaagctcagcgtcctcaagaggaaggcggtggaatccatccaggccgaggacgagagcgccaagctgtgcaagcgccggatcgagcacctcaaagagcatagcagcgaccagcccgcggcggccagcgtgtggaagaggaagcgcatggatcgcatgatggtggagcacctgctgcgttgcggctactacaacacggctgtcaagctggcgcgccagagcggcatcgaggacctagtgaatattgagatgttcctgacggccaaagaggtggaggagtccctggagaggcgtgagacggccacctgcctggcctggtgccatgacaacaagtcccggctccggaagatgaagacatgcaagaaagcacttcagccaagcagaagggagccagctggacgaggtgcgccaggccatgggcatgctggccttcccgcccgacacgcacatctccccgtacaaggaccttctggaccctgcacggtggcggatgctgatccagcagttccggtacgacaactaccgactacaccagctgggaaacaattctgtgttcaccctcaccctgcaggctggcctctcagccatcaagacaccacagtgctacaaggaggacggcagctccaagagccctgactgccctgtgtgcagccgctccctgaacaagctggcgcagcccctgcccatggcccactgtgccaactcccgcctggtctgcaagatttctggcgacgtgatgaacgagaacaatccgcccatgatgctgcccaacggctacgtctacggctacaattctctgctttctatccgtcaagatgataaagtcgtgtgcccgagaaccaaagaagtcttccacttctcacaagccgagaaggtgtacatcatgtaggccccacgtcgtgaagcgcacgcctcggggacgggctgcagtgggcggggaggccacgccttcctcctgtcccacgctccagcctgccgcggcgtttctgtttcttgcgaccaaagatccgtgagcaacgataaatactcttaggaagagagaaaataaggtttcataagtttgtacttgaaaacatttggattggtaggattttgtaacacgtcaaccatttgatgcttctgaaaagtactttcaacttgcgaaggaaactcttctttaaagactgacctaaacaccgagggaaacttaagaacgtttaaaatataggagtccgtgatttccctgtgttttcagtttctttccttctgtgaacgatgagacttggagaacgggctggtccttcaccacttcctgttggccctggcctggccggggaaggtggcagcggcaccggactgacctgcagtgacccgcgatgccgcgccacgagggacacttatggcttcattcgagagctgctgccaaaacgcctggcgccgccaccgtcgggggctggcttcgaggacgcccgcctgcctcgcgggtcgtgtccgcgggactgtgttcgtacgtgcatagtttcgatatcacatcgcggggctgtgttcgtagctgcgtcgtttcgatatcacaccctctgtgtgccgccttacttcctgcttcgagaatgtataacgtggaaatccacgggaccaaatttctgcagaggccttgccggatggttccataactgtagagtctaattgctatccattacagaaattaatcgttcagttgaaagaagtactgatgacttttcaaaacaaatgaaccaccgtagctgacagagaaccgtatcgtagaggtttgtagttagtgcttatttttgcatgttgatgttgactagctaataaactgtaaatgtaaaccatgcgaataaaatggttttctatttctca

SEQ ID NO: 16843 - DNA, 2422 bp, Homo sapiens
gcgtgcagcgggcgggtcccccgcccggctaatgttttggccgcttcaagatggcggtgcaggagtcggcggctcagttgtccatgaccctgaaggtccaggagtacccgaccctcaaggtgccctacgagacgctgaacaaacgctttcgcgccgctcagaagaacattgaccgggagaccagccacgtcaccatggtggtggccgagctggagaagacgttgagcggctgccccgccgtggactccgtggtcagcctgctggacggcgtggtggagaagctcagcgtcctcaagaggaaggcggtggaatccatccaggccgaggacgagagcgccaagctgtgcaagcgccggatcgagcacctcaaagagcatagcagcgaccagcccgcggcggccagcgtgtggaagaggaagcgcatggatcgcatgatggtggagcacctgctgcgttgcggctactacaacacggctgtcaagctggcgcgccagagcggcatcgaggacctagtgaatattgagatgttcctgacggccaaagaggtggaggagtccctggagaggcgtgagacggccacctgcctggcctggtgccatgacaacaagtcccggctccggaagatgaagagctgcctggagttcagcctcagaatccaggagttcattgaactcatccggcagaataagagactggacgctgtgagacatgcaagaaagcacttcagccaagcagaagggagccagctggacgaggtgcgccaggccatgggcatgctggccttcccgcccgacacgcacatctccccgtacaaggaccttctggaccctgcacggtggcggatgctgatccagcagttccggtacgacaactaccgactacaccagctgggaaacaattctgtgttcaccctcaccctgcaggctggcctctcagccatcaagacaccacagtgctacaaggaggacggcagctccaagagccctgactgccctgtgtgcagccgctccctgaacaagctggcgcagcccctgcccatggcccactgtgccaactcccgcctggtctgcaagatttctggcgacgtgatgaacgagaacaatccgcccatgatgctgcccaacggctacgtctacggctacaattctctgctttctatccgtcaagatgataaagtcgtgtgcccgagaaccaaagaagtcttccacttctcacaagccgagaaggtgtacatcatgtaggccccacgtcgtgaagcgcacgcctcggggacgggctgcagtgggcggggaggccacgccttcctcctgtcccacgctccagcctgccgcggcgtttctgtttcttgcgaccaaagatccgtgagcaacgataaatactcttaggaagagagaaaataaggtttcataagtttgtacttgaaaacatttggattggtaggattttgtaacacgtcaaccatttgatgcttctgaaaagtactttcaacttgcgaaggaaactcttctttaaagactgacctaaacaccgagggaaacttaagaacgtttaaaatataggagtccgtgatttccctgtgttttcagtttctttccttctgtgaacgatgagacttggagaacgggctggtccttcaccacttcctgttggccctggcctggccggggaaggtggcagcggcaccggactgacctgcagtgacccgcgatgccgcgccacgagggacacttatggcttcattcgagagctgctgccaaaacgcctggcgccgccaccgtcgggggctggcttcgaggacgcccgcctgcctcgcgggtcgtgtccgcgggactgtgttcgtacgtgcatagtttcgatatcacatcgcggggctgtgttcgtagctgcgtcgtttcgatatcacaccctctgtgtgccgccttacttcctgcttcgagaatgtataacgtggaaatccacgggaccaaatttctgcagaggccttgccggatggttccataactgtagagtctaattgctatccattacagaaattaatcgttcagttgaaagaagtactgatgacttttcaaaacaaatgaaccaccgtagctgacagagaaccgtatcgtagaggtttgtagttagtgcttatttttgcatgttgatgttgactagctaataaactgtaaatgtaaaccatgcgaataaaatggttttctatttctcaaaaaaaaaaaaaaaaaggggggcggtaaaaattccggggggccaggttagctgtccagttttggaaggggcctaaggggcgttaagaaaggggcgggtttacctcggggaaggtttggttggggagcttttggggtatggacccagatagcggaaaatgttggtcgtttttggtttgtatatttaaaattaataaggtttttaggcgttattt

SEQ ID NO: 16844 - DNA, 1966 bp, Homo sapiens
tcgagcggccgcccgggcaggtggagtcggcggctcagttgtccatgaccctgaaggtccaggagtacccgaccctcaaggtgccctacgagacgctgaacaaacgctttcgcgccgctcagaagaacattgaccgggagaccagccacgtcaccatggtggtggccgagctggagaagacgttgagcggctgccccgccgtggactccgtggtcagcctgctggacggcgtggtggagaagctcagcgtcctcaagaggaaggacctagtgaatattgagatgttcctgacggccaaagaggtggaggagtccctggagaggcgtgagacggccacctgcctggcctggtgccatgacaacaagtcccggctccggaagatgaagagctgcctggagttcagcctcagaatccaggagttcattgaactcatccggcagaataagagactggacgctgtgagacatgcaagaaagcacttcagccaagcagaagggagccagctggacgaggtgcgccaggccatgggcatgctggccttcccgcccgacacgcacatctccccgtacaaggaccttctggaccctgcacggtggcggatgctgatccagcagttccggtacgacaactaccgactacaccagctgggaaacaattctgtgttcaccctcaccctgcaggctggcctctcagccatcaagacaccacagtgctacaaggaggacggcagctccaagagccctgactgccctgtgtgcagccgctccctgaacaagctggcgcagcccctgcccatggcccactgtgccaactcccgcctggtctgcaagatttctggcgacgtgatgaacgagaacaatccgcccatgatgctgcccaacggctacgtctacggctacaattctctgctttctatccgtcaagatgataaagtcgtgtgcccgagaaccaaagaagtcttccacttctcacaagccgagaaggtgtacatcatgtaggccccacgtcgtgaagcgcacgcctcggggacgggctgcagtgggcggggaggccacgccttcctcctgtcccacgctccagcctgccgcggcgtttctgtttcttgcgaccaaagatccgtgagcaacgataaatactcttaggaagagagaaaataaggtttcataagtttgtacttgaaaacatttggattggtaggattttgtaacacgtcaaccatttgatgcttctgaaaagtactttcaacttgcgaaggaaactcttctttaaagactgacctaaacaccgagggaaacttaagaacgtttaaaatataggagtccgtgatttccctgtgttttcagtttctttccttctgtgaacgatgagacttggagaacgggctggtccttcaccacttcctgttggccctggcctggccggggaaggtggcagcggcaccggactgacctgcagtgacccgcgatgccgcgccacgagggacacttatggcttcattcgagagctgctgccaaaacgcctggcgccgccaccgtcgggggctggcttcgaggacgcccgcctgcctcgcgggtcgtgtccgcgggactgtgttcgtacgtgcatagtttcgatatcacatcgcggggctgtgttcgtagctgcgtcgtttcgatatcacaccctctgtgtgccgccttacttcctgcttcgagaatgtataacgtggaaatccacgggaccaaatttctgcagaggccttgccggatggttccataactgtagagtctaattgctatccattacagaaattaatcgttcagttgaaagaagtactgatgacttttcaaaacaaatgaaccaccgtagctgacagagaaccgtatcgtagaggtttgtagttagtgcttatttttgcatgttgatgttgactagctaataaactgtaaatgtaaaccatgcgaataaaatggttttctatttctca

SEQ ID NO: 16845 - DNA, 2209 bp, Homo sapiens
tgaatcgagctcggtccgatttgctcctagacggggacttggtccctgcctgcgactcactgtggccctgcctgtgactgagtctgtcccgtttgtgactgattccttcctgtgactgactctgtcccacctgcaactgacttcttcctgcctgtgacagactctgcccctgcctgcgactgagtctgtcccttcctgcaactgagtccatcccgcctgtgactctgtcctcgcctgtgactgactctgcccctgccctgtgactgtctcacctgtgactgactccgtcctgcctgtgactcagcctcttactgactctacccctgcctgtgactgactctgccctctcctgtgactgactctgtccccacctgtgactgactctgtccccacctgtgactgactgtcctcctgcaactgactctgtccccgcctatgaatgtctttcatgtgacctgcctcaggcccagagggcagtgagtgtttcgcgattgctgctggtacctggctgtgccggggtatgaatgagactcaggccccctcccttgtcccctctttgtggaactctgggcgagagggctggcgtgcttgcccactgcctgttcctaggtgccagcagaacgtccctgctgggtggctcttgtcctgcctggagaggttgcgtggccggggagagggcggcgggcgacggagccactctgtgcctgtggtcctggtgctggaggccggggtgagaaggcgcaggcttcttgtctccaccgaggcctcagtggggctgtttagctgtcgagtgcagcacttcctgtgcctcgaaagacagccccgtgtagtcagcatggcgcccacatagccagaagggcacgcagcccagggcagagtggccacagggggctgggctcaccccggctgccctgagtggcccccaacccttccttgacccgatgctcagacagtgctacaaggaggacggcagctccaagagccctgactgccctgtgtgcagccgctccctgaacaagctggcgcagcccctgcccatggcccactgtgccaactcccgcctggtctgcaagatttctggcgacgtgatgaacgagaacaatccgcccatgatgctgcccaacggctacgtctacggctacaattctctgctttctatccgtcaagatgataaagtcgtgtgcccgagaaccaaagaagtcttccacttctcacaagccgagaaggtgtacatcatgtaggccccacgtcgtgaagcgcacgcctcggggacgggctgcagtgggcggggaggccacgccttcctcctgtcccacgctccagcctgccgcggcgtttctgtttcttgcgaccaaagatccgtgagcaacgataaatactcttaggaagagagaaaataaggtttcataagtttgtacttgaaaacatttggattggtaggattttgtaacacgtcaaccatttgatgcttctgaaaagtactttcaacttgcgaaggaaactcttctttaaagactgacctaaacaccgagggaaacttaagaacgtttaaaatataggagtccgtgatttccctgtgttttcagtttctttccttctgtgaacgatgagacttggagaacgggctggtccttcaccacttcctgttggccctggcctggccggggaaggtggcagcggcaccggactgacctgcagtgacccgcgatgccgcgccacgagggacacttatggcttcattcgagagctgctgccaaaacgcctggcgccgccaccgtcgggggctggcttcgaggacgcccgcctgcctcgcgggtcgtgtccgcgggactgtgttcgtacgtgcatagtttcgatatcacatcgcggggctgtgttcgtagctgcgtcgtttcgatatcacaccctctgtgtgccgccttacttcctgcttcgagaatgtataacgtggaaatccacgggaccaaatttctgcagaggccttgccggatggttccataactgtagagtctaattgctatccattacagaaattaatcgttcagttgaaagaagtactgatgacttttcaaaacaaatgaaccaccgtagctgacagagaaccgtatcgtagaggtttgtagttagtgcttatttttgcatgttgatgttgactagctaataaactgtaaatgtaaaccatgcgaataaaatggttttctatttctca

SEQ ID NO: 16846 - DNA, 2613 bp, Homo sapiens
  misc_feature (975)..(975): n is a, c, g, or t
  misc_feature (977)..(977): n is a, c, g, or t
  misc_feature (2597)..(2597): n is a, c, g, or t
gcgtgcagcgggcgggtcccccgcccggctaatgttttggccgcttcaagatggcggtgcaggagtcggcggctcagttgtccatgaccctgaaggtccaggagtacccgaccctcaaggtgccctacgagacgctgaacaaacgctttcgcgccgctcagaagaacattgaccgggagaccagccacgtcaccatggtggtggccgagctggagaagacgttgagcggctgccccgccgtggactccgtggtcagcctgctggacggcgtggtggagaagctcagcgtcctcaagaggaaggcggtggaatccatccaggccgaggacgagagcgccaagctgtgcaagcgccggatcgagcacctcaaagagcatagcagcgaccagcccgcggcggccagcgtgtggaagaggaagcgcatggatcgcatgatggtggagcacctgctgcgttgcggctactacaacacggctgtcaagctggcgcgccagagcggcatcgaggacctagtgaatattgagatgttcctgacggccaaagaggtggaggagtccctggagaggcgtgagacggccacctgcctggcctggtgccatgacaacaagtcccggctccggaagatgaagagctgcctggagttcagcctcagaatccaggagttcattgaactcatccggcagaataagagactggacgctgtgagacatgcaagaaagcacttcagccaagcagaagggagccagctggacgaggtgcgccaggccatgggcatgctggccttcccgcccgacacgcacatctccccgtacaaggaccttctggaccctgcacggtggcggatgctgatccagcagttccggtacgacaactaccgactacaccagctgggaaacaattctgtgttcaccctcaccctgcaggctggcctctcagccatcaagacaccgtatcctacctcccgtgcgcagtgcngnttggctggggttgcatctttggtcatattttaacacgctgaccctgcactttgccactcttgtcctcccaccacagacagccccgagctcccgtgtgctgcacttgcgtggtgtctggatggtcggggtggggccgtgttgaggggcctcggatgcgtcgtgcagccttcactctgggaagtggcgcgcttcctctctcatcatctcagaggccgccatgggcattgatctaaaagcccgattttgatgtgttctggcagccggcagattaccattcagaatagttttcccgtgtgattaccaagaaccttgcctgtgactgactctgtcccgcctgtgactgactctgtcccacctgtgaccgactctgtctgcctgtgactctgtccctgcctgtgactgactccatcctgcctgtgactctgtcccacctgcgactcactgagttcctgcctgtgactcactcggctcccgcctgcaacggacttggtccctgcctgcgactcactgtggccctgcctgtgactgagtctgtcccgtttgtgactgattccttcctgtgactgactctgtcccacctgcaactgacttcttcctgcctgtgacagactctgcccctgcctgcgactgagtctgtcccttcctgcaactgagtccatcccgcctgtgactctgtcctcgcctgtgactgactctgcccctgccctgtgactgtctcacctgtgactgactccgtcctgcctgtgactcagcctcttactgactctacccctgcctgtgactgactctgccctctcctgtgactgactctgtccccacctgtgactgactctgtccccacctgtgactgactgtcctcctgcaactgactctgtccccgcctatgaatgtctttcatgtgacctgcctcaggcccagagggcagtgagtgtttcgcgattgctgctggtacctggctgtgccggggtatgaatgagactcaggccccctcccttgtcccctctttgtggaactctgggcgagagggctggcgtgcttgcccactgcctgttcctaggtgccagcagaacgtccctgctgggtggctcttgtcctgcctggagaggttgcgtggccggggagagggcggcgggcgacggagccactctgtgcctgtggtcctggtgctggaggccggggtgagaaggcgcaggcttcttgtctccaccgaggcctcagtggggctgtttagctgtcgagtgcagcacttcctgtgcctcgaaagacagccccgtgtagtcagcatggcgcccacatagccagaagggcacgcagcccagggcagagtggccacagggggctgggctcaccccggctgccctgagtggcccccaacccttccttgacccgatgctcagacagtgctacaaggaggacggcagctccaagagccctgactgccctgtgtgcagccgctccctgaacaagctggcgcagcccctgcccatggcccactgtgccaactcccgcctggtctgcaagatttctggcgacgtgatgaacgagaacaatccgcccatgatgctgcccaacggctacgtctacggctacaattctctgctttctatccgtctaggagcntaatcggtaccgagcc

SEQ ID NO: 16847 - DNA, 638 bp, Homo sapiens
gcgtgcagcgggcgggtcccccgcccggctaatgttttggccgcttcaagatggcggtgcaggagtcggcggctcagttgtccatgaccctgaaggtccaggagtacccgaccctcaaggtgccctacgagacgctgaacaaacgctttcgcgccgctcagaagaacattgaccgggagaccagccacgtcaccatggtggtggccgagctggagaagacgttgagcggctgccccgccgtggactccgtggtcagcctgctggacggcgtggtggagaagctcagcgtcctcaagaggaaggcggtggaatccatccaggccgaggacgagagcgccaagctgtgcaagcgccggatcgagcacctcaaagagcatagcagcgaccagcccgcggcggccagcgtgtggaagaggaagcgcatggatcgcatgatggtggagcacctgctgcgttgcggctactacaacacggctgtcaagctggcgcgccagagcggcatcgaggacctagtgaatattgagatgttcctgacggccaaagaggtggaggagtccctggagaggcgtgagacggccacctgccatgttcctggggtgcccgttttacccaagcagtatccgccgcgagtagttgca

SEQ ID NO: 16848 - DNA, 313 bp, Homo sapiens
tcctttctcccttgcctccacccctcgcgatgtagccccatcccctgcccttctctgcttcccattgttctagaacattccagcatggaaaccccgctgtgcaaggcccctgcactggccgcagaagccgcacctatctgctgaggaacccggttgctgcctggagtgggtgtcgagtactgcctggcagcatagccatgcttcttgaggcattttagcaccctgtaccccaggtactgttccatatgcccctccttctccatgagccccccatgcctgccccgtccttgtgctctgcccgcggcttggccct

SEQ ID NO: 16849 - DNA, 2330 bp, Homo sapiens
tcgagcggccgcccgggcaggtggagtcggcggctcagttgtccatgaccctgaaggtccaggagtacccgaccctcaagaacattccagcatggaaaccccgctgtgcaaggcccctgcactggccgcagaagccgcacctatctgctgaggaacccggttgctgcctggagtgggtgtcgagtactgcctggcagcatagccatgcttcttgaggcattttagcaccctgtaccccaggtgccctacgagacgctgaacaaacgctttcgcgccgctcagaagaacattgaccgggagaccagccacgtcaccatggtggtggccgagctggagaagacgttgagcggctgccccgccgtggactccgtggtcagcctgctggacggcgtggtggagaagctcagcgtcctcaagaggaaggcggtggaatccatccaggccgaggacgagagcgccaagctgtgcaagcgccggatcgagcacctcaaagagcatagcagcgaccagcccgcggcggccagcgtgtggaagaggaagcgcatggatcgcatgatggtggagcacctgctgcgttgcggctactacaacacggctgtcaagctggcgcgccagagcggcatcgaggacctagtgaatattgagatgttcctgacggccaaagaggtggaggagtccctggagaggcgtgagacggccacctgcctggcctggtgccatgacaacaagtcccggctccggaagatgaagagctgcctggagttcagcctcagaatccaggagttcattgaactcatccggcagaataagagactggacgctgtgagacatgcaagaaagcacttcagccaagcagaagggagccagctggacgaggtgcgccaggccatgggcatgctggccttcccgcccgacacgcacatctccccgtacaaggaccttctggaccctgcacggtggcggatgctgatccagcagttccggtacgacaactaccgactacaccagctgggaaacaattctgtgttcaccctcaccctgcaggctggcctctcagccatcaagacaccacagtgctacaaggaggacggcagctccaagagccctgactgccctgtgtgcagccgctccctgaacaagctggcgcagcccctgcccatggcccactgtgccaactcccgcctggtctgcaagatttctggcgacgtgatgaacgagaacaatccgcccatgatgctgcccaacggctacgtctacggctacaattctctgctttctatccgtcaagatgataaagtcgtgtgcccgagaaccaaagaagtcttccacttctcacaagccgagaaggtgtacatcatgtaggccccacgtcgtgaagcgcacgcctcggggacgggctgcagtgggcggggaggccacgccttcctcctgtcccacgctccagcctgccgcggcgtttctgtttcttgcgaccaaagatccgtgagcaacgataaatactcttaggaagagagaaaataaggtttcataagtttgtacttgaaaacatttggattggtaggattttgtaacacgtcaaccatttgatgcttctgaaaagtactttcaacttgcgaaggaaactcttctttaaagactgacctaaacaccgagggaaacttaagaacgtttaaaatataggagtccgtgatttccctgtgttttcagtttctttccttctgtgaacgatgagacttggagaacgggctggtccttcaccacttcctgttggccctggcctggccggggaaggtggcagcggcaccggactgacctgcagtgacccgcgatgccgcgccacgagggacacttatggcttcattcgagagctgctgccaaaacgcctggcgccgccaccgtcgggggctggcttcgaggacgcccgcctgcctcgcgggtcgtgtccgcgggactgtgttcgtacgtgcatagtttcgatatcacatcgcggggctgtgttcgtagctgcgtcgtttcgatatcacaccctctgtgtgccgccttacttcctgcttcgagaatgtataacgtggaaatccacgggaccaaatttctgcagaggccttgccggatggttccataactgtagagtctaattgctatccattacagaaattaatcgttcagttgaaagaagtactgatgacttttcaaaacaaatgaaccaccgtagctgacagagaaccgtatcgtagaggtttgtagttagtgcttatttttgcatgttgatgttgactagctaataaactgtaaatgtaaaccatgcgaataaaatggttttctatttctca

SEQ ID NO: 16850 - DNA, 3511 bp, Homo sapiens
  misc_feature (852)..(852): n is a, c, g, or t
  misc_feature (854)..(854): n is a, c, g, or t
gcgtgcagcgggcgggtcccccgcccggctaatgttttggccgcttcaagatggcggtgcaggagtcggcggctcagttgtccatgaccctgaaggtccaggagtacccgaccctcaaggtgccctacgagacgctgaacaaacgctttcgcgccgctcagaagaacattgaccgggagaccagccacgtcaccatggtggtggccgagctggagaagacgttgagcggctgccccgccgtggactccgtggtcagcctgctggacggcgtggtggagaagctcagcgtcctcaagaggaaggcggtggaatccatccaggccgaggacgagagcgccaagctgtgcaagcgccggatcgagcacctcaaagagcatagcagcgaccagcccgcggcggccagcgtgtggaagaggaagcgcatggatcgcatgatggtggagcacctgctgcgttgcggctactacaacacggctgtcaagctggcgcgccagagcggcatcgagagctgcctggagttcagcctcagaatccaggagttcattgaactcatccggcagaataagagactggacgctgtgagacatgcaagaaagcacttcagccaagcagaagggagccagctggacgaggtgcgccaggccatgggcatgctggccttcccgcccgacacgcacatctccccgtacaaggaccttctggaccctgcacggtggcggatgctgatccagcagttccggtacgacaactaccgactacaccagctgggaaacaattctgtgttcaccctcaccctgcaggctggcctctcagccatcaagacaccgtatcctacctcccgtgcgcagtgcngnttggctggggttgcatctttggtcatattttaacacgctgaccctgcactttgccactcttgtcctcccaccacagacagccccgagctcccgtgtgctgcacttgcgtggtgtctggatggtcggggtggggccgtgttgaggggcctcggatgcgtcgtgcagccttcactctgggaagtggcgcgcttcctctctcatcatctcagaggccgccatgggcattgatctaaaagcccgattttgatgtgttctggcagccggcagattaccattcagaatagttttcccgtgtgattaccaagaaccttgcctgtgactgactctgtcccgcctgtgactgactctgtcccacctgtgaccgactctgtctgcctgtgactctgtccctgcctgtgactgactccatcctgcctgtgactctgtcccacctgcgactcactgagttcctgcctgtgactcactcggctcccgcctgcaacggacttggtccctgcctgcgactcactgtggccctgcctgtgactgagtctgtcccgtttgtgactgattccttcctgtgactgactctgtcccacctgcaactgacttcttcctgcctgtgacagactctgcccctgcctgcgactgagtctgtcccttcctgcaactgagtccatcccgcctgtgactctgtcctcgcctgtgactgactctgcccctgccctgtgactgtctcacctgtgactgactccgtcctgcctgtgactcagcctcttactgactctacccctgcctgtgactgactctgccctctcctgtgactgactctgtccccacctgtgactgactctgtccccacctgtgactgactgtcctcctgcaactgactctgtccccgcctatgaatgtctttcatgtgacctgcctcaggcccagagggcagtgagtgtttcgcgattgctgctggtacctggctgtgccggggtatgaatgagactcaggccccctcccttgtcccctctttgtggaactctgggcgagagggctggcgtgcttgcccactgcctgttcctaggtgccagcagaacgtccctgctgggtggctcttgtcctgcctggagaggttgcgtggccggggagagggcggcgggcgacggagccactctgtgcctgtggtcctggtgctggaggccggggtgagaaggcgcaggcttcttgtctccaccgaggcctcagtggggctgtttagctgtcgagtgcagcacttcctgtgcctcgaaagacagccccgtgtagtcagcatggcgcccacatagccagaagggcacgcagcccagggcagagtggccacagggggctgggctcaccccggctgccctgagtggcccccaacccttccttgacccgatgctcagacagtgctacaaggaggacggcagctccaagagccctgactgccctgtgtgcagccgctccctgaacaagctggcgcagcccctgcccatggcccactgtgccaactcccgcctggtctgcaagatttctggcgacgtgatgaacgagaacaatccgcccatgatgctgcccaacggctacgtctacggctacaattctctgctttctatccgtcaagatgataaagtcgtgtgcccgagaaccaaagaagtcttccacttctcacaagccgagaaggtgtacatcatgtaggccccacgtcgtgaagcgcacgcctcggggacgggctgcagtgggcggggaggccacgccttcctcctgtcccacgctccagcctgccgcggcgtttctgtttcttgcgaccaaagatccgtgagcaacgataaatactcttaggaagagagaaaataaggtttcataagtttgtacttgaaaacatttggattggtaggattttgtaacacgtcaaccatttgatgcttctgaaaagtactttcaacttgcgaaggaaactcttctttaaagactgacctaaacaccgagggaaacttaagaacgtttaaaatataggagtccgtgatttccctgtgttttcagtttctttccttctgtgaacgatgagacttggagaacgggctggtccttcaccacttcctgttggccctggcctggccggggaaggtggcagcggcaccggactgacctgcagtgacccgcgatgccgcgccacgagggacacttatggcttcattcgagagctgctgccaaaacgcctggcgccgccaccgtcgggggctggcttcgaggacgcccgcctgcctcgcgggtcgtgtccgcgggactgtgttcgtacgtgcatagtttcgatatcacatcgcggggctgtgttcgtagctgcgtcgtttcgatatcacaccctctgtgtgccgccttacttcctgcttcgagaatgtataacgtggaaatccacgggaccaaatttctgcagaggccttgccggatggttccataactgtagagtctaattgctatccattacagaaattaatcgttcagttgaaagaagtactgatgacttttcaaaacaaatgaaccaccgtagctgacagagaaccgtatcgtagaggtttgtagttagtgcttatttttgcatgttgatgttgactagctaataaactgtaaatgtaaaccatgcgaataaaatggttttctatttctca

SEQ ID NO: 16851 - DNA, 1228 bp, Homo sapiens
gcgtgcagcgggcgggtcccccgcccggctaatgttttggccgcttcaagatggcggtgcaggagtcggcggctcagttgtccatgaccctgaaggtccaggagtacccgaccctcaaggtgccctacgagacgctgaacaaacgctttcgcgccgctcagaagaacattgaccgggagaccagccacgtcaccatggtggtggccgagctggagaagacgttgagcggctgccccgccgtggactccgtggtcagcctgctggacggcgtggtggagaagctcagcgtcctcaagaggaaggcggtggaatccatccaggccgaggacgagagcgccaagctgtgcaagcgccggatcgagcacctcaaagagcatagcagcgaccagcccgcggcggccagcgtgtggaagaggaagcgcatggatcgcatgatggtggagcacctgctgcgttgcggctactacaacacggctgtcaagctggcgcgccagagcggcatcgaggacctagtgaatattgagatgttcctgacggccaaagaggtggaggagtccctggagaggcgtgagacggccacctgcctggcctggtgccatgacaacaagtcccggctccggaagatgaagagctgcctggagttcagcctcagaatccaggagttcattgaactcatccggcagaataagagactggacgctgtgagacatgcaagaaagcacttcagccaagcagaagggagccagctggacgaggtgcgccaggccatgggcatgctggccttcccgcccgacacgcacatctccccgtacaaggaccttctggaccctgcacggtggcggatgctgatccagcagttccggtacgacaactaccgactacaccagctgggaaacaattctgtgttcaccctcaccctgcaggctggcctctcagccatcaagacaccacagtgctacaaggaggacggcagctccaagagccctgactgccctgtgtgcagccgctccctgaacaagctggcgcagcccctgcccatggcccactgtgccaactcccgcctggtctgcaagatttctggcgacgtgatgaacgagaacaatccgcccatgatgctgcccaacggctacgtctacggctacaatgtgaggggggcagggcaggggggccaggctggcacgcatcgccatcgggacagggctgtgtgggacgggcagggcaggggggc

SEQ ID NO: 16852 - DNA, 680 bp, Homo sapiens
tcgagcggccgcccgggcaggtggagtcggcggctcagttgtccatgaccctgaaggtccaggagtacccgaccctcaagaacattccagcatggaaaccccgctgtgcaaggcccctgcactggccgcagaagccgcacctatctgctgaggaacccggttgctgcctggagtgggtgtcgagtactgcctggcagcatagccatgcttcttgaggcattttagcaccctgtaccccaggagtttcctgacctggggatgaaggccagggtcgttacagtggctcccaggccctttgccctgtagggtgctgggcccagtggcctttctgccgccattcagccaggccagcatgccgagcccagggttttactgccaccttcctctgtctggagcgctccttccacagatgtccatggtcccatgtcctcaccttcaatctttgccaacgtccgtggtcccatgtcctcacctccttcaatcttcgctgagctgtcagcttgtgaagcttctctgactccactgttgaaactgcagccccagcatctcccacttctgcccttttccctcgtgagtcgtgaccgctgtctcacataacggtattttgcttgtttctgaccactgggattataagctcttttgaaggatagagaagaaataaattctccaattaacaaatg

SEQ ID NO: 16853 - DNA, 414 bp, Homo sapiens
atcatctcagctagctgatatcctactctatgagatggtaacattagtttttccattttacagatgagaaaactgagattatgccactgcactccagcttaggtgacagagtgagaccctatctcaaaaaaagaaaaaaaccaaaaaggtagaaaaaggtagaatagagaccaggccatttcctttccttcgatccctccaaataccatgattccttgtcatttctacttggattccctccaccacacctctttggacctcaaaagcatagatttcaattgtcataatctttggtttggcacattctcatcattagttcatactttgttataatgtatgcattataagcatttttttttttttgatacagagtcatgctctgtcacccaggctggagtgcagtggcatgatctc

SEQ ID NO: 16854 - DNA, 237 bp, Homo sapiens
cctgacctgaggtgatctgcccgcctcggcctcccaaagtgctgggattacacgcatgaggcactgtgcctggccaattttaaaatatatttttaagaatgctgatatcaagtatcttcatagattgagaaaaccacagtttggtgcttatatatgacttttaaaaactctcaggaaactaagagtagacagaaagtttcttaacttcataattgctacaccccaaaagccgactgc

SEQ ID NO: 16855 - DNA, 317 bp, Homo sapiens
ctcatgtctatattgagttcatttcatccggttgtcttcataaagagtgacaaaaacagaaggaaacagtacaaaaaattcagattaatttcagagtcttgagtgtattgcgcaattttaggatgttgactgatccttcatcagagattgaaccatgatggtggaagaattacaaagctgtgaaagagattgctgtaagaacaagaattaacactttagaagacaaaatgatttgtagtctctttagttatctaaagtagtatgtatgtaggtaggtaattggtgttcacgaacatgatcaaattggtactgtggag

SEQ ID NO: 16856 - DNA, 380 bp, Homo sapiens
caacatttggatacgaaagcaggagtgcctgtcctcacccaggtccatagggttggagccctagctagggacttgcttttctttaccgggcacttccctgaccccgtatcaacattacttgattaaaatttcaactttgctacttatttgcaaccttatttgtaaccttgggcaagctaattgacttttcttcctcttcagtaaaatgtctctgtgtacatgtgtgtaagtttgcaatgtaaataatagtttttggccgggcgcggtggctcacgcctgtaatcccagcactctgggaggcagagacgggcggatcacgaggtcaggagatcgagaccatcctggctaacacggtgaaaccccgtctctactaaaaatac

SEQ ID NO: 16857 - DNA, 747 bp, Homo sapiens
gcctgacatgagaaaagccctcttgcagatacctcatctccctgctcccttcccctccatctcactcactgttttcagcacctgcacccagcatgcaaatgctgctgtcgagggaaagaaactcaagaaagcagcctcccagcactccactctcaatgcacttatgatcacaaaccacgaatgggcattcccccacacttcctagtaatctcgctgtgactctcccctgtgccctccctctgcttactcttgacagataacctaacctcatttgtcccagagaacaccaagccatcaaaccctaactccctcagagctccttcaacaaatctacaaaccttccacgcccttcttctccttgtctccagcctcatggagtacacattcctgctcttagcaaaggccaagccctccaccaccaccatgcccaagaacttaattcctaccactacccttcttcctgcagcatcaatcagtctttactttgctacaggatcatccccaacagcatgtagacacgttctattgaatcttcaccctaaagattcgcacatgcgtgtgcgcctttgacccccatatatccttctagctaatgacacaattcctctataggaattatctgtgctaatgcttctcaaactttaatgcatagtttacctgggaatcttgtgaaaacgcatattctgattcagtaggtctggagtggagcccaagatttggcaccactaacctagtctctaatcatgt

SEQ ID NO: 16858 - DNA, 138 bp, Homo sapiens
gggagtgaaagcagttgggtttggcttaacccattttgacagtgttactagaggcctttacaatgattgttggtggggagcataatttgacttctttcttgaaccctaagaaaggaccctgggttccatcagggaaaa

SEQ ID NO: 16859 - DNA, 2582 bp, Homo sapiens
gcggccggggaaaaacccggatgagctgggcagcagtgttggcagtcgcggctgcgagatttgggcacttttgggggtgccggtggcccgggccgatggcgcaaggttgggcaggcttctctgaggaggaactgaggagactaaagcagactaaagatccatttgaaccacagcgacgtctccccgcgaagaaaagtcgacaacaacttcagcgagaaaaagcccttgtagagcaaagccaaaaacttgggcttcaagatggatcaacctcattacttccagagcagctgctttcagcaccaaaacagagagttaacgttcaaaaaccacctttttcttcccctactcttccgagtcatttcactctcacctcccccgttggtgatggacaaccacagggcattgaaagtcagccaaaggaactgggacttgagaattcccatgatggtcacaacaatgttgagattctacctccaaagccagattgcaaattggagaaaaagaaagtggaattgttagcaagaaaaatctcgttgggaagtcctccaacaagaacaacggctaatggaagagaaaaataaacgtaaaaaagctcttttggctaaagctattgcagaaagatccaaaagaactcaggcagagaccatgaaactaaagcggatccagaaggagttgcaggctttagatgacatggtgtcagctgacattggaattctcaggaaccggattgatcaggccagcttagactattcatacgctcggaagcggtttgacagggctgaagcagagtacattgcagcaaagctagatatacagcgcaagactgagataaaagagcaactcactgaacacctttgtacgatcatacagcaaaatgagctccgaaaggccaagaagttggaggagttgatgcaacaactagatgtagaagccgatgaagagactttggagcttgaggtggaggtcgagagattgctacacgaacaagaagtagaatcaaggagaccagtggttcgtttagagaggccatttcagcctgcggaggagagtgtgacattagaatttgctaaagagaacagaaagtgtcaagaacaagctgtttccccaaaggtagatgaccagtgtggaaattccagtagcatcccctttcttagtccaaactgcccaaatcaagaaggtaatgacatttcagctgctttggccacatgaagttctggtattcttttgagctaatatggtattgagtaaagtatactttttgcagtagatcatgccctgacctccaataaaaacctctttaaaacaatgctgatttttgaattcatgattagttttagtaaattaataggtttggccattctaaaatccaaaattatgataactgtatttctaggggtatgtttcaccttgattttggcccggttctttcagtgttccgtttaccctttttactgaaagtaagtgacttaaaaggatggaagaaaaactacatggttggagtgtttttagatcagataaatatagaaaagtaaaatggaaaatgatactcaatacctagttaaactcatttcacttctcctgggagacgtattaagactggaagtcctattttatttaatcagtatcagtaaaaagaccaaaaattaccagtgtgaacaagagaaaaacaggaatagaagaaaaaagttgcaggttgaattatctatctggatattactagagttgtaaaacacaacttggaaactggaatttatgtgaagaaccaaacaacttaaaccagcatcacttttgtcttcaatttgccttccagtgattttagtttacaacctgcgttttgttatttgaaacacacacacttatatataaacacatgtaattttactattttattgtctttcctttaatcgatgaattgattaaatttagacaattaaaacatttctaaagtgagactgaaaataatatagaaaatctcattgctacttgtgattatcaaaaaaagtatgtattttctttctaaagttatctataaatatgtttttgatatgttggacatgaattaccctgtcatgaagcgtttaaattgttaaaatgctgattttcttattagtttgttaattgcctgttactagtacttgaccaatacattgtgctatatgtaaatgtgtaaataaatattgtaattttctcacaaagtctgtgaatatcacattatgatttatttatcagaaattccaaaaagtaaaaatattacctttgaggactttttttttttaaaaaaagaattattatcagagaacataagcacaagtataagattgtatccataaaagtttctgaaaaacttagggacatcctgtttttaaatgggtttgtttgagggtattatcttctggtaatatagatgagctttatatttttatattatgtaatttgagttgaaagtataacattttactactgacttctctaaacagaagcatttctatagatagttgtgcttttatatatgaaatacataaaagccaacagtttcattgtctaacacacttctttttctaaggaataaacaagtctgatgt

SEQ ID NO: 16860 - DNA, 682 bp, Homo sapiens
ggtaccggtcaggaattcccgggtcaactactactactaaattagcggccgcgtgaaaataatatagaaaatctcattgctacttgtgattatcaaaaaaagtatgtattttctttctaaagttatctataaatatgtttttgatatgttggacatgaattaccctgtcatgaagcgtttaaattgttaaaatgctgattttcttattagtttgttaattgcctgttactagtacttgaccaatacattgtgctatatgtaaatgtgtaaataaatattgtaattttctcacaaagtctgtgaatatcacattatgatttatttatcagaaattccaaaaagtaaaaatattacctttgaggactttttttttttaaaaaaagaattattatcagagaacataagcacaagtataagattgtatccataaaagtttctgaaaaacttagggacatcctgtttttaaatgggtttgtttgagggtattatcttctggtaatatagatgagctttatatttttatattatgtaatttgagttgaaagtataacattttactactgacttctctaaacagaagcatttctatagatagttgtgcttttatatatgaaatacataaaagccaacagtttcattgtctaacacacttctttttctaaggaataaacaagtctgatgt

SEQ ID NO: 16861 - DNA, 908 bp, Homo sapiens
gcggccggggaaaaacccggatgagctgggcagcagtgttggcagtcgcggctgcgagatttgggcacttttgggggtgccggtggcccgggccgatggcgcaaggttgggcaggcttctctgaggaggaactgaggagactaaagcagactaaagacaaaagaaaagtcaacaaaagacatgaatagatatttcctagaaaaggaaatatgaagagatgctcatcaccaccaaggagcagagaattacaaatcaagaatacagtgagatccatttgaaccacagcgacgtctccccgcgaagaaaagtcgacaacaacttcagcgagaaaaagcccttgtagagcaaagccaaaaacttgggcttcaagatggatcaacctcattacttccagagcagctgctttcagcaccaaaacagagagttaacgttcaaaaaccacctttttcttcccctactcttccgagtcatttcactctcacctcccccgttggtgatggacaaccacagggcattgaaagtcagccaaaggaactgggacttgagaattcccatgatggtcacaacaatgttgagattctacctccaaagccagattgcaaattggagaaaaagaaagtggaattgttagcaagaaaaatctcgttgggaagtcctccaacaagaacaacggctaatggaagagaaaaataaacgtaaaaaagctcttttggctaaagctattgcagaaagatccaaaagaactcaggcagagaccatgaaactaaagcggatccagaaggagttgcaggctttagatgacatggtgtcagctgacattggaattctcaggaaccggattgatcaggccagcttagactattcatacgctcggtgagttggggaaattgaatctgaacaaggagtat

SEQ ID NO: 16862 - DNA, 205 bp, Homo sapiens
ctctagaggataccttctttattgacagtgtggaaattccagtagcatcccctttcttagtccaaactgcccaaatcaagaaggtaatgacatttcagctgctttggccacatgaagttctggtattcttttgagctaatatggtattgagtaaagtatactttttgcagtagatcatgccctgacctccaataaaaacctcttt

SEQ ID NO: 16863 - DNA, 2882 bp, Homo sapiens
gcggccggggaaaaacccggatgagctgggcagcagtgttggcagtcgcggctgcgagatttgggcacttttgggggtgccggtggcccgggccgatggcgcaaggttgggcaggcttctctgaggaggaactgaggagactaaagcagactaaagggtacaagtgccctggcctctggtctgactccagtagactcatgaggagacaaaccacaaagttatgtgatagtagatattgcaagaacttgcttcagagacaagaggaacctcactctgccggggattggatggagcttgggaagatttcacaaagtttgtgtgttagcagaggcgcattttccaggacaaaagaaaagtcaacaaaagacatgaatagatatttcctagaaaaggaaatatgaagagatgctcatcaccaccaaggagcagagaattacaaatcaagaatacagtgagatccatttgaaccacagcgacgtctccccgcgaagaaaagtcgacaacaacttcagcgagaaaaagcccttgtagagcaaagccaaaaacttgggcttcaagatggatcaacctcattacttccagagcagctgctttcagcaccaaaacagagagttaacgttcaaaaaccacctttttcttcccctactcttccgagtcatttcactctcacctcccccgttggtgatggacaaccacagggcattgaaagtcagccaaaggaactgggacttgagaattcccatgatggtcacaacaatgttgagattctacctccaaagccagattgcaaattggagaaaaagaaagtggaattgttagcaagaaaaatctcgttgggaagtcctccaacaagaacaacggctaatggaagagaaaaataaacgtaaaaaagctcttttggctaaagctattgcagaaagatccaaaagaactcaggcagagaccatgaaactaaagcggatccagaaggagttgcaggctttagatgacatggtgtcagctgacattggaattctcaggaaccggattgatcaggccagcttagactattcatacgctcggaagcggtttgacagggctgaagcagagtacattgcagcaaagctagatatacagcgcaagactgagataaaagagcaactcactgaacacctttgtacgatcatacagcaaaatgagctccgaaaggccaagaagttggaggagttgatgcaacaactagatgtagaagccgatgaagagactttggagcttgaggtggaggtcgagagattgctacacgaacaagaagtagaatcaaggagaccagtggttcgtttagagaggccatttcagcctgcggaggagagtgtgacattagaatttgctaaagagaacagaaagtgtcaagaacaagctgtttccccaaaggtagatgaccagtgtggaaattccagtagcatcccctttcttagtccaaactgcccaaatcaagaaggtaatgacatttcagctgctttggccacatgaagttctggtattcttttgagctaatatggtattgagtaaagtatactttttgcagtagatcatgccctgacctccaataaaaacctctttaaaacaatgctgatttttgaattcatgattagttttagtaaattaataggtttggccattctaaaatccaaaattatgataactgtatttctaggggtatgtttcaccttgattttggcccggttctttcagtgttccgtttaccctttttactgaaagtaagtgacttaaaaggatggaagaaaaactacatggttggagtgtttttagatcagataaatatagaaaagtaaaatggaaaatgatactcaatacctagttaaactcatttcacttctcctgggagacgtattaagactggaagtcctattttatttaatcagtatcagtaaaaagaccaaaaattaccagtgtgaacaagagaaaaacaggaatagaagaaaaaagttgcaggttgaattatctatctggatattactagagttgtaaaacacaacttggaaactggaatttatgtgaagaaccaaacaacttaaaccagcatcacttttgtcttcaatttgccttccagtgattttagtttacaacctgcgttttgttatttgaaacacacacacttatatataaacacatgtaattttactattttattgtctttcctttaatcgatgaattgattaaatttagacaattaaaacatttctaaagtgagactgaaaataatatagaaaatctcattgctacttgtgattatcaaaaaaagtatgtattttctttctaaagttatctataaatatgtttttgatatgttggacatgaattaccctgtcatgaagcgtttaaattgttaaaatgctgattttcttattagtttgttaattgcctgttactagtacttgaccaatacattgtgctatatgtaaatgtgtaaataaatattgtaattttctcacaaagtctgtgaatatcacattatgatttatttatcagaaattccaaaaagtaaaaatattacctttgaggactttttttttttaaaaaaagaattattatcagagaacataagcacaagtataagattgtatccataaaagtttctgaaaaacttagggacatcctgtttttaaatgggtttgtttgagggtattatcttctggtaatatagatgagctttatatttttatattatgtaatttgagttgaaagtataacattttactactgacttctctaaacagaagcatttctatagatagttgtgcttttatatatgaaatacataaaagccaacagtttcattgtctaacacacttctttttctaaggaataaacaagtctgatgt

SEQ ID NO: 16864 - DNA, 2694 bp, Homo sapiens
gcggccggggaaaaacccggatgagctgggcagcagtgttggcagtcgcggctgcgagatttgggcacttttgggggtgccggtggcccgggccgatggcgcaaggttgggcaggcttctctgaggaggaactgaggagactaaagcagactaaagacaaaagaaaagtcaacaaaagacatgaatagatatttcctagaaaaggaaatatgaagagatgctcatcaccaccaaggagcagagaattacaaatcaagaatacagtgagatccatttgaaccacagcgacgtctccccgcgaagaaaagtcgacaacaacttcagcgagaaaaagcccttgtagagcaaagccaaaaacttgggcttcaagatggatcaacctcattacttccagagcagctgctttcagcaccaaaacagagagttaacgttcaaaaaccacctttttcttcccctactcttccgagtcatttcactctcacctcccccgttggtgatggacaaccacagggcattgaaagtcagccaaaggaactgggacttgagaattcccatgatggtcacaacaatgttgagattctacctccaaagccagattgcaaattggagaaaaagaaagtggaattgttagcaagaaaaatctcgttgggaagtcctccaacaagaacaacggctaatggaagagaaaaataaacgtaaaaaagctcttttggctaaagctattgcagaaagatccaaaagaactcaggcagagaccatgaaactaaagcggatccagaaggagttgcaggctttagatgacatggtgtcagctgacattggaattctcaggaaccggattgatcaggccagcttagactattcatacgctcggaagcggtttgacagggctgaagcagagtacattgcagcaaagctagatatacagcgcaagactgagataaaagagcaactcactgaacacctttgtacgatcatacagcaaaatgagctccgaaaggccaagaagttggaggagttgatgcaacaactagatgtagaagccgatgaagagactttggagcttgaggtggaggtcgagagattgctacacgaacaagaagtagaatcaaggagaccagtggttcgtttagagaggccatttcagcctgcggaggagagtgtgacattagaatttgctaaagagaacagaaagtgtcaagaacaagctgtttccccaaaggtagatgaccagtgtggaaattccagtagcatcccctttcttagtccaaactgcccaaatcaagaaggtaatgacatttcagctgctttggccacatgaagttctggtattcttttgagctaatatggtattgagtaaagtatactttttgcagtagatcatgccctgacctccaataaaaacctctttaaaacaatgctgatttttgaattcatgattagttttagtaaattaataggtttggccattctaaaatccaaaattatgataactgtatttctaggggtatgtttcaccttgattttggcccggttctttcagtgttccgtttaccctttttactgaaagtaagtgacttaaaaggatggaagaaaaactacatggttggagtgtttttagatcagataaatatagaaaagtaaaatggaaaatgatactcaatacctagttaaactcatttcacttctcctgggagacgtattaagactggaagtcctattttatttaatcagtatcagtaaaaagaccaaaaattaccagtgtgaacaagagaaaaacaggaatagaagaaaaaagttgcaggttgaattatctatctggatattactagagttgtaaaacacaacttggaaactggaatttatgtgaagaaccaaacaacttaaaccagcatcacttttgtcttcaatttgccttccagtgattttagtttacaacctgcgttttgttatttgaaacacacacacttatatataaacacatgtaattttactattttattgtctttcctttaatcgatgaattgattaaatttagacaattaaaacatttctaaagtgagactgaaaataatatagaaaatctcattgctacttgtgattatcaaaaaaagtatgtattttctttctaaagttatctataaatatgtttttgatatgttggacatgaattaccctgtcatgaagcgtttaaattgttaaaatgctgattttcttattagtttgttaattgcctgttactagtacttgaccaatacattgtgctatatgtaaatgtgtaaataaatattgtaattttctcacaaagtctgtgaatatcacattatgatttatttatcagaaattccaaaaagtaaaaatattacctttgaggactttttttttttaaaaaaagaattattatcagagaacataagcacaagtataagattgtatccataaaagtttctgaaaaacttagggacatcctgtttttaaatgggtttgtttgagggtattatcttctggtaatatagatgagctttatatttttatattatgtaatttgagttgaaagtataacattttactactgacttctctaaacagaagcatttctatagatagttgtgcttttatatatgaaatacataaaagccaacagtttcattgtctaacacacttctttttctaaggaataaacaagtctgatgt

SEQ ID NO: 16865 - DNA, 2575 bp, Homo sapiens
tgtttttcccctagactttcaagatagagaatggggtaggagaaccactagaattatcaacgtttaatgttaattttttattttcttagaggaattataattatttgctgcccacacaaaggaattttcctctattttcttttacatagatccatttgaaccacagcgacgtctccccgcgaagaaaagtcgacaacaacttcagcgagaaaaagcccttgtagagcaaagccaaaaacttgggcttcaagatggatcaacctcattacttccagagcagctgctttcagcaccaaaacagagagttaacgttcaaaaaccacctttttcttcccctactcttccgagtcatttcactctcacctcccccgttggtgatggacaaccacagggcattgaaagtcagccaaaggaactgggacttgagaattcccatgatggtcacaacaatgttgagattctacctccaaagccagattgcaaattggagaaaaagaaagtggaattgttagcaagaaaaatctcgttgggaagtcctccaacaagaacaacggctaatggaagagaaaaataaacgtaaaaaagctcttttggctaaagctattgcagaaagatccaaaagaactcaggcagagaccatgaaactaaagcggatccagaaggagttgcaggctttagatgacatggtgtcagctgacattggaattctcaggaaccggattgatcaggccagcttagactattcatacgctcggaagcggtttgacagggctgaagcagagtacattgcagcaaagctagatatacagcgcaagactgagataaaagagcaactcactgaacacctttgtacgatcatacagcaaaatgagctccgaaaggccaagaagttggaggagttgatgcaacaactagatgtagaagccgatgaagagactttggagcttgaggtggaggtcgagagattgctacacgaacaagaagtagaatcaaggagaccagtggttcgtttagagaggccatttcagcctgcggaggagagtgtgacattagaatttgctaaagagaacagaaagtgtcaagaacaagctgtttccccaaaggtagatgaccagtgtggaaattccagtagcatcccctttcttagtccaaactgcccaaatcaagaaggtaatgacatttcagctgctttggccacatgaagttctggtattcttttgagctaatatggtattgagtaaagtatactttttgcagtagatcatgccctgacctccaataaaaacctctttaaaacaatgctgatttttgaattcatgattagttttagtaaattaataggtttggccattctaaaatccaaaattatgataactgtatttctaggggtatgtttcaccttgattttggcccggttctttcagtgttccgtttaccctttttactgaaagtaagtgacttaaaaggatggaagaaaaactacatggttggagtgtttttagatcagataaatatagaaaagtaaaatggaaaatgatactcaatacctagttaaactcatttcacttctcctgggagacgtattaagactggaagtcctattttatttaatcagtatcagtaaaaagaccaaaaattaccagtgtgaacaagagaaaaacaggaatagaagaaaaaagttgcaggttgaattatctatctggatattactagagttgtaaaacacaacttggaaactggaatttatgtgaagaaccaaacaacttaaaccagcatcacttttgtcttcaatttgccttccagtgattttagtttacaacctgcgttttgttatttgaaacacacacacttatatataaacacatgtaattttactattttattgtctttcctttaatcgatgaattgattaaatttagacaattaaaacatttctaaagtgagactgaaaataatatagaaaatctcattgctacttgtgattatcaaaaaaagtatgtattttctttctaaagttatctataaatatgtttttgatatgttggacatgaattaccctgtcatgaagcgtttaaattgttaaaatgctgattttcttattagtttgttaattgcctgttactagtacttgaccaatacattgtgctatatgtaaatgtgtaaataaatattgtaattttctcacaaagtctgtgaatatcacattatgatttatttatcagaaattccaaaaagtaaaaatattacctttgaggactttttttttttaaaaaaagaattattatcagagaacataagcacaagtataagattgtatccataaaagtttctgaaaaacttagggacatcctgtttttaaatgggtttgtttgagggtattatcttctggtaatatagatgagctttatatttttatattatgtaatttgagttgaaagtataacattttactactgacttctctaaacagaagcatttctatagatagttgtgcttttatatatgaaatacataaaagccaacagtttcattgtctaacacacttctttttctaaggaataaacaagtctgatgt

SEQ ID NO: 16866 - DNA, 2449 bp, Homo sapiens
gacgtggtgtagcggaaggcgctatccatttgaaccacagcgacgtctccccgcgaagaaaagtcgacaacaacttcagcgagaaaaagcccttgtagagcaaagccaaaaacttgggcttcaagatggatcaacctcattacttccagagcagctgctttcagcaccaaaacagagagttaacgttcaaaaaccacctttttcttcccctactcttccgagtcatttcactctcacctcccccgttggtgatggacaaccacagggcattgaaagtcagccaaaggaactgggacttgagaattcccatgatggtcacaacaatgttgagattctacctccaaagccagattgcaaattggagaaaaagaaagtggaattgttagcaagaaaaatctcgttgggaagtcctccaacaagaacaacggctaatggaagagaaaaataaacgtaaaaaagctcttttggctaaagctattgcagaaagatccaaaagaactcaggcagagaccatgaaactaaagcggatccagaaggagttgcaggctttagatgacatggtgtcagctgacattggaattctcaggaaccggattgatcaggccagcttagactattcatacgctcggaagcggtttgacagggctgaagcagagtacattgcagcaaagctagatatacagcgcaagactgagataaaagagcaactcactgaacacctttgtacgatcatacagcaaaatgagctccgaaaggccaagaagttggaggagttgatgcaacaactagatgtagaagccgatgaagagactttggagcttgaggtggaggtcgagagattgctacacgaacaagaagtagaatcaaggagaccagtggttcgtttagagaggccatttcagcctgcggaggagagtgtgacattagaatttgctaaagagaacagaaagtgtcaagaacaagctgtttccccaaaggtagatgaccagtgtggaaattccagtagcatcccctttcttagtccaaactgcccaaatcaagaaggtaatgacatttcagctgctttggccacatgaagttctggtattcttttgagctaatatggtattgagtaaagtatactttttgcagtagatcatgccctgacctccaataaaaacctctttaaaacaatgctgatttttgaattcatgattagttttagtaaattaataggtttggccattctaaaatccaaaattatgataactgtatttctaggggtatgtttcaccttgattttggcccggttctttcagtgttccgtttaccctttttactgaaagtaagtgacttaaaaggatggaagaaaaactacatggttggagtgtttttagatcagataaatatagaaaagtaaaatggaaaatgatactcaatacctagttaaactcatttcacttctcctgggagacgtattaagactggaagtcctattttatttaatcagtatcagtaaaaagaccaaaaattaccagtgtgaacaagagaaaaacaggaatagaagaaaaaagttgcaggttgaattatctatctggatattactagagttgtaaaacacaacttggaaactggaatttatgtgaagaaccaaacaacttaaaccagcatcacttttgtcttcaatttgccttccagtgattttagtttacaacctgcgttttgttatttgaaacacacacacttatatataaacacatgtaattttactattttattgtctttcctttaatcgatgaattgattaaatttagacaattaaaacatttctaaagtgagactgaaaataatatagaaaatctcattgctacttgtgattatcaaaaaaagtatgtattttctttctaaagttatctataaatatgtttttgatatgttggacatgaattaccctgtcatgaagcgtttaaattgttaaaatgctgattttcttattagtttgttaattgcctgttactagtacttgaccaatacattgtgctatatgtaaatgtgtaaataaatattgtaattttctcacaaagtctgtgaatatcacattatgatttatttatcagaaattccaaaaagtaaaaatattacctttgaggactttttttttttaaaaaaagaattattatcagagaacataagcacaagtataagattgtatccataaaagtttctgaaaaacttagggacatcctgtttttaaatgggtttgtttgagggtattatcttctggtaatatagatgagctttatatttttatattatgtaatttgagttgaaagtataacattttactactgacttctctaaacagaagcatttctatagatagttgtgcttttatatatgaaatacataaaagccaacagtttcattgtctaacacacttctttttctaaggaataaacaagtctgatgt

SEQ ID NO: 16867 - DNA, 2529 bp, Homo sapiens
gcggccggggaaaaacccggatgagctgggcagcagtgttggcagtcgcggctgcgagatttgggcacttttgggggtgccggtggcccgggccgatggcgcaaggttgggcaggcttctctgaggaggaactgaggagactaaagcagactaaagatccatttgaaccacagcgacgtctccccgcgaagaaaagtcgacaacaacttcagcgagaaaaagcccttgtagagcaaagccaaaaacttgggcttcaagatggatcaacctcattacttccagagcagctgctttcagcaccaaaacagagagttaacgttcaaaaaccacctttttcttcccctactcttccgagtcatttcactctcacctcccccgttggtgatggacaaccacagggcattgaaagtcagccaaaggaactgggacttgagaattcccatgatggtcacaacaatgttgagattctacctccaaagccagattgcaaattggagaaaaagaaagtggaattgttagcaagaaaaatctcgttgggaagtcctccaacaagaacaacggctaatggaagagaaaaataaacgtaaaaaagctcttttggctaaagctattgcagaaagatccaaaagaactcaggcagagaccatgaaactaaagcggatccagaaggagttgcaggctttagatgacatggtgtcagctgacattggaattctcaggaaccggattgatcaggccagcttagactattcatacgctcggaagcggtttgacagggctgaagcagagtacattgcagcaaagctagatatacagcgcaagactgagataaaagagcaactcactgaacacctttgtacgatcatacagcaaaatgagctccgaaaggccaagaagttggaggagttgatgcaacaactagatgtagaagccgatgaagagactttggagcttgaggtggaggtcgagagattgctacacgaacaagaagtagaatcaaggagaccagtggttcgtttagagaggccatttcagcctgcggaggagagtgtgacattagaatttgctaaagagaacagaaagtgtcaagaacaagctgtttccccaaaggtagatgaccagtgtggaaattccagtagcatcccctttcttagtccaaactgcccaaatcaagaaggtaatgacatttcagctgctttggccacatgaagttctggtattcttttgagctaatatggtattgagtaaagtatactttttgcagtagatcatgccctgacctccaataaaaacctctttaaaacaatgctgatttttgaattcatgattagttttagtaaattaataggtttggccattctaaaatccaaaattatgataactgtatttctaggggtatgtttcaccttgattttggcccggttctttcagtgttccgtttaccctttttactgaaagtaagtgacttaaaaggatggaagaaaaactacatggttggagtgtttttagatcagataaatatagaaaagtaaaatggaaaatgatactcaatacctagttaaactcatttcacttctcctgggagacgtattaagactggaagtcctattttatttaatcagtatcagtaaaaagaccaaaaattaccagtgtgaacaagagaaaaacaggaatagaagaaaaaagttgcaggttgaattatctatctggatattactagagttcagcatcacttttgtcttcaatttgccttccagtgattttagtttacaacctgcgttttgttatttgaaacacacacacttatatataaacacatgtaattttactattttattgtctttcctttaatcgatgaattgattaaatttagacaattaaaacatttctaaagtgagactgaaaataatatagaaaatctcattgctacttgtgattatcaaaaaaagtatgtattttctttctaaagttatctataaatatgtttttgatatgttggacatgaattaccctgtcatgaagcgtttaaattgttaaaatgctgattttcttattagtttgttaattgcctgttactagtacttgaccaatacattgtgctatatgtaaatgtgtaaataaatattgtaattttctcacaaagtctgtgaatatcacattatgatttatttatcagaaattccaaaaagtaaaaatattacctttgaggactttttttttttaaaaaaagaattattatcagagaacataagcacaagtataagattgtatccataaaagtttctgaaaaacttagggacatcctgtttttaaatgggtttgtttgagggtattatcttctggtaatatagatgagctttatatttttatattatgtaatttgagttgaaagtataacattttactactgacttctctaaacagaagcatttctatagatagttgtgcttttatatatgaaatacataaaagccaacagtttcattgtctaacacacttctttttctaaggaataaacaagtctgatgt

SEQ ID NO: 16868 - DNA, 1299 bp, Homo sapiens
gcggccggggaaaaacccggatgagctgggcagcagtgttggcagtcgcggctgcgagatttgggcacttttgggggtgccggtggcccgggccgatggcgcaaggttgggcaggcttctctgaggaggaactgaggagactaaagcagactaaagatccatttgaaccacagcgacgtctccccgcgaagaaaagtcgacaacaacttcagcgagaaaaagcccttgtagagcaaagccaaaaacttgggcttcaagatggatcaacctcattacttccagagcagctgctttcagcaccaaaacagagagttaacgttcaaaaaccacctttttcttcccctactcttccgagtcatttcactctcacctcccccgttggtgatggacaaccacagggcattgaaagtcagccaaaggaactgggacttgagaattcccatgatggtcacaacaatgttgagattctacctccaaagccagattgcaaattggagaaaaagaaagtggaattgttagcaagaaaaatctcgttgggaagtcctccaacaagaacaacggctaatggaagagaaaaataaacgtaaaaaagctcttttggctaaagctattgcagaaagatccaaaagaactcaggcagagaccatgaaactaaagcggatccagaaggagttgcaggctttagatgacatggtgtcagctgacattggaattctcaggaaccggattgatcaggccagcttagactattcatacgctcggaagcggtttgacagggctgaagcagagtacattgcagcaaagctagatatacagcgcaagactgagataaaagagcaactcactgaacacctttgtacgatcatacagcaaaatgagctccgaaaggccaagaagttggaggagttgatgcaacaactagatgtagaagccgatgaagagactttggagcttgaggtggaggtcgagagattgctacacgaacaagaagtagaatcaaggagaccagtggttcgtttagagaggccatttcagcctgcggaggagagtgtgacattagaatttgctaaagagaacagaaagtgtcaagaacaagctgtttccccaaaggtagatgaccagtgtggaaattccagtagcatcccctttcttagtccaaactgcccaaatcaagaaggtaatgacatttcagctgctttggccacatgaagttctggtattcttttgagctaatatggtattgagtaaagtatactttttgcagtagatcatgccctgacctccaataaaaacctcttt

SEQ ID NO: 16869 - DNA, 471 bp, Homo sapiens
tcctctattttcttttacatagatccatttgaaccacagcgacgtctccccgcgaagaaaagtcgacaacaacttcagcgagaaaaagcccttgtagagcaaagccaaaaacttgggcttcaagatggatcaacctcattacttccagagcagctgctttcagcaccaaaacagagagttaacgttcaaaaaccacctttttcttcccctactcttccgagtcatttcactctcacctcccccgttggtgatggacaaccacagggcattgaaagtcagccaaaggaactgggacttgagaattcccatgatggtcacaacaatgttgagattctacctccaaagccagattgcaaattggagaaaaagaaagtggaattgttagtaagtctatgtgaaaagtccatgagacttttcatttaacccgttttttcccaatgggctttaaggaaatataatttgtttatttta

SEQ ID NO: 16870 - DNA, 213 bp, Homo sapiens
aaacagataatgagtctccattttggtctcatttgcatattcagctcttacacacaaaacaatagactacaatgacactgattttcttttctacttgagaatcagcactaaccagctgtcaacgaatatttcgattaaacacttttctttgttggggaactttggggcacattctttgtataaacatattgttttctttgatttcaagggact

SEQ ID NO: 16871 - DNA, 425 bp, Homo sapiens
gtatttttaaaaatgctgaaattttggtttcctagattattttcctatagtgtgtgaaattatagatgacatacacatacacatagtatgtataattatagattatatatccaagctgaaaaataaatacagagtaggtactttcttctcaaaaagtaatcaaattatgactgggcgcagtggctcatgcctgtaataccagcactttgggaggccgaggtgggcagatcacctgaggtcgggagttcaagaccagcctagccaacatggtgaaaccccatgtctactaaaaatacaaaaaaattagccaggcatggtggcacgcacttatagtcctggctactcaggaggctgaatcacttgaactcaggaggcagagatcacaccactgtactccagcctgggcaacagaaagactctgtctc

SEQ ID NO: 16872 - DNA, 465 bp, Homo sapiens
tatattactgcttctgttgttttctcttgtcatatctatatgattatagataatatacttacatctctactgctgcttttggtaacaggatttagtatcttgactcctttccatgaaaggacaaaagactgaggaaattaccccataaattaaacttaaatgaaaggagccaattccttaagagacacaaaccgccaaaactcacttaaaaattgataagctgaatagtgctgtatctattaaagaaatatcattcctacttataaaaaaaaacttccaacaaaaaaaaaactcccaactctgtctctacaaaaaaattagccagcttggtggcacttacctgtagtcccagctattcaggaggctgagatgggaggatcacctaaacccagaaggtcaagactagtgagccatgattacactactgcattccagcccaggcaagggagcaagaccctgtctcaa

SEQ ID NO: 16873 - DNA, 543 bp, Homo sapiens
ctccgtctcaaaacaaaaaaaaaaaaaagaaagaaagaaagaaagaaaaacaaacaaaaaaaagaattatcaggtacaaaatgtcaatagtgccaagagtgagaaacccttctctaagcctgtgctattcaatacagtagctgctagctacatatggctaatgagcacaggaattgtggataggctgaattaagatgtgttgtaagtgtaaaatacatattacattttagtgattgagtaaaaaaagaatatgaaacattatgaactttgttttgttttcttttttagaccgagtttcacttttgtcatccaggctcgagtgcaatggtatgaccttggctcattgcaacctctaagcctgtgctattcaatacggtagctactagccacatatggctaatgagcacaggaattgtggctaggctgaattaagatgtgttgcacgtgtaaaatacatattacattttaatgactgagtaaaaaaaagaatatgaaatacatgaacttttttcttttcttttcttttttgagacgaagttttgc

SEQ ID NO: 16874 - DNA, 287 bp, Homo sapiens
atgtgcccccaaacctaaaatcaaaaaaaatatgtgtagaaaacaaagagcaaaatgaaggacctaaaacctaaaaaccatttatagtcaatatataaaaaggcttaataccccagttaaaatcagatatggataaattttataaaaacaaagtaaacaaagagggtactgactcttgtgatagttggataccaagaaccatccctcactggggcatgctgtggctcacacctgttataccaacactttgggaacccaaggcaggagaggattgcttgagcccagga

SEQ ID NO: 16875 - DNA, 163 bp, Homo sapiens
aaatcatccccatccccccagtccatgggaaaattgtcttccacaaaatcagtctctggtgccaaaaaaattggggactgctgattagatatatagcttatagtggtaacaggagccatttagattagaaccatttcattttaatgtgaagaaacaaagactt

SEQ ID NO: 16876 - DNA, 781 bp, Homo sapiens
tgcaccacatagctctcggtgtcaacctctgaagcacaccttttcaggcaaccgtaacagttggcactgtcagcaggatgtctagatgttggtcaccatgcaatgggtcagctttccctttctctcaggtgctaacctgctctgctacctggtggccagcatgctctttgagctgctgctgcttgctgctctgtgttccattgctgaggccgaacaaacttgtgttccagatttagccaaccgaagatggcagtttctataagtctttggcatttaggagcaggagtatcggatttgggccctccttaaaatggtctgggctaggagttttcactttgcctttctatgtagaatgaagctgggactgatgctaggtgttggccttgtcctgtaggtctggtggtgggggctggtggtgagattttatcttgtgcatgttggggccccattagtggtcattcctgaaagagcagtcatttgaaaatgagaaagagcctggcgcagtggtggtggctcacgcttgtaatcccaccactttgggaggccaaggcagacagatcacctgaggtcagaagtttgagaccagcctggccattatggtgaaaccccatctctactaaaaatacaaaaattagctgggcatagtggtggacgcctgtaatgccagctactcgggaggctgaggcagtagaatctcttgaacctgggaggcagaggttgcagtgagccgagatcgcaccactgcactccagcctgggcgacagagtaagactccgtctca

SEQ ID NO: 16877 - DNA, 458 bp, Homo sapiens
atgctggttattagtacaatcacaggtgtcttaaatattcttgaggatattttaggaagtaggaagaataatgatgatgatgaagatgataatgatgatggtagtggtggtggtggcagctaatttaacagtgtactggctgcattctaagactttgcatggattaactcatttaaccttctcaacagcttctaaggtgggtgttattatcaccgccatatttcagatgatgaaactaaggtgcagagtgtttaagttactagcaggtggcagaactggactacaactcaggcagtctctaagtttctaccacagcctctcaataaagttctttactcttggatgggtatagtggcccatgcctgtaatcccagcactttgggaggccaaggcaggagaacagcttgaggccaggaggttgagaacagcctgggtaacatagcaagatctctatctac

SEQ ID NO: 16878 - DNA, 447 bp, Homo sapiens
ccccaagaggtcaataaaaagtaaagagtgtactccagtttgacttattctttttaaaattaactgtaaaactgcctcaggcaggtccttcaggaggtattccacatcaaggcattatcatcataggagatgacagctccatgtctgcactacccctcagaccttccagggggacaagatgtggaagtggaagacagtgatactgatgatcctgaccctgtgtaggcctaggctaacataacaaacacgtttaaaaagcaaaaaataaaaacttttttttctttttctttaaaaaaaaaagtttggtcttgaactcctgcctcaagcaatcctcccatctcaagcctcccgaagtgttgggattacaggtgtgacccactacgcccagccaaaaacttttaaaaatagaaaaaagcttacagaataaggatataaagaaaatgtttt

SEQ ID NO: 16879 - DNA, 416 bp, Homo sapiens
attaggcactgatcattgagccatcctggagtttaacaccatgttagagtcacagtcacccttgcagcttctcctgaaagacacccggctgtcacatctgcattgcatttccttgtttattggtgcttcgttagtgcacagattggatgcatgtttcccacacccatcctcaactgtgaactgccagctgaagtattaggtttctatgattcagtccattcaccactcttgcctcttccagcgctgatgcactaaagcaaaatataacccagtgtatgcctttcgacatttctgtcctgtattggtgctcttgtgggaatggagaggttatttttgaagatgatagtatttttaggtgaacatctcagctaatagaaacatgaactgtgtctttaatattcaatcacagaagcaac

SEQ ID NO: 16880 - DNA, 1398 bp, Homo sapiens
gtgagaatgaaagtggatgcccgcgaatcccggaagtcagactgtttttttcagttccctggaggctttttgatactgattcgcgtacacccgttgtttggaagctctcagcgggacaatgctgacccagctgaaagcaaaatcagaggggaagcttgcaaaacagatttgcaaagttgtgttggatcattttgaaaaacagtattccaaagaactcggagatgcctggaatacagtaagggagatactaacatctccatcatgctggcaatatgctgtcctgcttaaccgattcaattatccttttgaactggaaaaggatttacatttgaagggctatcacacactctctcagggatctttacccaactatcctaaatcagtgaagtgttaccttagcagaactccgggccgaatcccttcagaaagacaccaaattggaaacctgaaaaaatattatctcctaaatgctgcttctcttctcccagtgttggctctggaattaagggatggggagaaggttctggatctctgtgctgctcctggagggaaatcaatagctctgctgcagtgtgcttgtccaggttatcttcattgtaatgaatatgatagtctgagattgaggtggctaaggcagacgttggaatctttcatcccacagcctttgataaatgtaattaaagtgtctgaattggatggcagaaaaatgggagatgcccagcctgaaatgtttgacaaggtgttagtggatgctccgtgttcaaatgatcgaagctggttgttttcttctgactctcagaaggcatcctgtaggataagtcaaaggaggaatttgcctcttctacagatagagctgttaaggtctgcaattaaggccttacgtcctggagggatacttgtatactctacatgcacgctttccaaggcagaaaatcaagatgtgatcagtgaaattttaaactcccacggtaacatcatgcctatggacattaaaggaatagcaaggacttgctcccacgacttcacatttgctcccactggccaggaatgtgggctcttagtgattccagataagggcaaagcctggggcccaatgtatgtagccaaattgaagaaatcatggagcacaggaaaatggtgacatgaatttgtaaactgtgtttatgtgttattatatttatatttctgaactcagtacatgttaatatttaaataattatgcagtaactttctctgggtctgtttggaatcctatttagttaatactttagcatcttagaatctaggcttgagaattgttcaggtgtatttttttcctagaaatatatctgtaacaatgatttaaggtggtgcagatggtgtttgttctatattataaatctgctgtctttgcttggc

SEQ ID NO: 16881 - DNA, 2424 bp, Homo sapiens
  misc_feature (5)..(5): n is a, c, g, or t
  misc_feature (18)..(18): n is a, c, g, or t
  misc_feature (26)..(26): n is a, c, g, or t
  misc_feature (935)..(935): n is a, c, g, or t
tattncggaacgaggccncgtgcgtnggactctcagaaggcatcctgtaggataagtcaaaggaggaatttgcctcttctacagatagagctgttaaggtctgcaattaaggccttacgtcctggagggatacttgtatactctacatgcacgctttccaaggcagaaaatcaagatgtgatcagtgaaattttaaactcccacggtaacatcatgcctatggacattaaaggaatagcaaggacttgctcccacgacttcacatttgctcccactggccaggaatgtgggctcttagtgattccagataagggcaaagcctggggcccaatgtatgtagccaaattgaagaaatcatggagcacaggaaaatggtgacatgaatttgtaaactgtgtttatgtgttattatatttatatttctgaactcagtacatgttaatatttaaataattatgcagtaactttctctgggtctgtttggaatcctatttagttaatactttagcatcttagaatctaggcttgagaattgttcaggtgtatttttttcctagaaatatatctgtaacaatgatttaaggtggtgcagatggtgtttgttctatattataaatctgctgtctttgcttggcattttatagttaaattaattagaatatgtggttttatgcataacgtgtttagttctgtattctttctatgatagtgctttgaaccttcaaaaattcacattttccagcgctccgaccattttcccgcttatcaaatgtacaaatttgttcaaggtttttttttccccccaacttttgtaactgattgtctcagaactgattggtattctgagactaactttttaagcagcactatttctagttctggcaaaatagtttttttatttgcaatgttgttttctgttaaagactatattatgnttactgcaaaggtcagtgactctactgacaccagctttatttcccccactttttttgcattcacaaatacaaattgaaagggtaaattatattgaaaggcctttagaacagcagattcacatgcacatgtttgactttcgacattcagcttatagaattatggagtctatccagcaggctataaagcaagtacttgagacaaaaccggaatgattaataactgcaatcactgaactatatttggagagttttgttacataattgcagtcataatgagcactacagaatctgattatcttacattcacaatctggaggggctttttatttcactttgttataaaatgttctctgagaatatgatgccacatattaatgcacaagagggagatgcctaatgagagtggactgtgtgattaccagaacccagtgccatttactaagtggctctccatgtttacataaatcctgggaatactgtatacatttcttcttatgtacttagggttttagcttcagtcagcatcacactttttctccagaaattacttcacttagagtacaaacatatttttccaactattaagaaaaattatgcagcacatctcaaaaaatagcatctctttggaaaatagcctttaaaaaaaaacaactttatctgattatagaaatacaaaattctgctaaagctgaatacttttgaattgttcattatgttctgtgcctttaaactagagactatttgcttattaatattttttgttttgcaagcatatgtaacccggtttatatcatcaggaagtcttaggaagaatttttttttctgtaccttcagtctgttaatcatttgttttcctttatgtccaattgatatgtttaaagtaaagctaaagtccaggcacggtggcttatgcctgtaatcccagcactttgtcaggccgaggcagggggcatctcctgaggtcagaagttcgagactagcctgcccaacatggtaaaaccccgactctactaaaaatgcaaaaaaattagacaggcatggtggctggcaccagcaatcccagctacttaggaggctgaggcaggagaatcacttgaacccaggaggcagaggttgcagttagccaagatctcgccattgcactccagcctgggcgacaagagtgaaaccccgtagcaaaaaaataataataatagtaattaaataaaaataaagtaacgctagaactgttggaccaaatcaagtatatgggtaaatacagaagaataatgatggtggaaaagatgttttcttttttaagttatcattattagtttgttttttttatcttcagacactataggttttaaaaataggtttcttttatgtaggttaatcacagagtaaatctgcacactgtactttgttaaatgtcggtattttcccagtataatgcgatgaagcttaatctgaatacttggtatgctattgaatttactttcctatgatt

SEQ ID NO: 16882 - DNA, 3187 bp, Homo sapiens
  misc_feature (1698)..(1698): n is a, c, g, or t
gtgagaatgaaagtggatgcccgcgaatcccggaagtcagactgtttttttcagttccctggaggctttttgatactgattcgcgtacacccgttgtttggaagctctcagcgggacaatgctgacccagctgaaagcaaaatcagaggggaagcttgcaaaacagatttgcaaagttgtgttggatcattttgaaaaacagtattccaaagaactcggagatgcctggaatacagtaagggagatactaacatctccatcatgctggcaatatgctgtcctgcttaaccgattcaattatccttttgaactggaaaaggatttacatttgaagggctatcacacactctctcagggatctttacccaactatcctaaatcagtgaagtgttaccttagcagaactccgggccgaatcccttcagaaagacaccaaattggaaacctgaaaaaatattatctcctaaatgctgcttctcttctcccagtgttggctctggaattaagggatggggagaaggttctggatctctgtgctgctcctggagggaaatcaatagctctgctgcagtgtgcttgtccaggttatcttcattgtaatgaatatgatagtctgagattgaggtggctaaggcagacgttggaatctttcatcccacagcctttgataaatgtaattaaagtgtctgaattggatggcagaaaaatgggagatgcccagcctgaaatgtttgacaaggtgttagtggatgctccgtgttcaaatgatcgaagctggttgttttcttctgactctcagaaggcatcctgtaggataagtcaaaggaggaatttgcctcttctacagatagagctgttaaggtctgcaattaaggccttacgtcctggagggatacttgtatactctacatgcacgctttccaaggcagaaaatcaagatgtgatcagtgaaattttaaactcccacggtaacatcatgcctatggacattaaaggaatagcaaggacttgctcccacgacttcacatttgctcccactggccaggaatgtgggctcttagtgattccagataagggcaaagcctggggcccaatgtatgtagccaaattgaagaaatcatggagcacaggaaaatggtgacatgaatttgtaaactgtgtttatgtgttattatatttatatttctgaactcagtacatgttaatatttaaataattatgcagtaactttctctgggtctgtttggaatcctatttagttaatactttagcatcttagaatctaggcttgagaattgttcaggtgtatttttttcctagaaatatatctgtaacaatgatttaaggtggtgcagatggtgtttgttctatattataaatctgctgtctttgcttggcattttatagttaaattaattagaatatgtggttttatgcataacgtgtttagttctgtattctttctatgatagtgctttgaaccttcaaaaattcacattttccagcgctccgaccattttcccgcttatcaaatgtacaaatttgttcaaggtttttttttccccccaacttttgtaactgattgtctcagaactgattggtattctgagactaactttttaagcagcactatttctagttctggcaaaatagtttttttatttgcaatgttgttttctgttaaagactatattatgnttactgcaaaggtcagtgactctactgacaccagctttatttcccccactttttttgcattcacaaatacaaattgaaagggtaaattatattgaaaggcctttagaacagcagattcacatgcacatgtttgactttcgacattcagcttatagaattatggagtctatccagcaggctataaagcaagtacttgagacaaaaccggaatgattaataactgcaatcactgaactatatttggagagttttgttacataattgcagtcataatgagcactacagaatctgattatcttacattcacaatctggaggggctttttatttcactttgttataaaatgttctctgagaatatgatgccacatattaatgcacaagagggagatgcctaatgagagtggactgtgtgattaccagaacccagtgccatttactaagtggctctccatgtttacataaatcctgggaatactgtatacatttcttcttatgtacttagggttttagcttcagtcagcatcacactttttctccagaaattacttcacttagagtacaaacatatttttccaactattaagaaaaattatgcagcacatctcaaaaaatagcatctctttggaaaatagcctttaaaaaaaaacaactttatctgattatagaaatacaaaattctgctaaagctgaatacttttgaattgttcattatgttctgtgcctttaaactagagactatttgcttattaatattttttgttttgcaagcatatgtaacccggtttatatcatcaggaagtcttaggaagaatttttttttctgtaccttcagtctgttaatcatttgttttcctttatgtccaattgatatgtttaaagtaaagctaaagtccaggcacggtggcttatgcctgtaatcccagcactttgtcaggccgaggcagggggcatctcctgaggtcagaagttcgagactagcctgcccaacatggtaaaaccccgactctactaaaaatgcaaaaaaattagacaggcatggtggctggcaccagcaatcccagctacttaggaggctgaggcaggagaatcacttgaacccaggaggcagaggttgcagttagccaagatctcgccattgcactccagcctgggcgacaagagtgaaaccccgtagcaaaaaaataataataatagtaattaaataaaaataaagtaacgctagaactgttggaccaaatcaagtatatgggtaaatacagaagaataatgatggtggaaaagatgttttcttttttaagttatcattattagtttgttttttttatcttcagacactataggttttaaaaataggtttcttttatgtaggttaatcacagagtaaatctgcacactgtactttgttaaatgtcggtattttcccagtataatgcgatgaagcttaatctgaatacttggtatgctattgaatttactttcctatgatt

SEQ ID NO: 16883 - DNA, 3133 bp, Homo sapiens
  misc_feature (1644)..(1644): n is a, c, g, or t
gtgagaatgaaagtggatgcccgcgaatcccggaagtcagactgtttttttcagttccctggaggctttttgatactgattcgcgtacacccgttgtttggaagctctcagcgggacaatgctgacccagctgaaagcaaaatcagaggggaagcttgcaaaacagatttgcaaagttgtgttggatcattttgaaaaacagtattccaaagaactcggagatgcctggaatacagtaagggagatactaacatctccatcatgctggcaatatgctgtcctgcttaaccgattcaattatccttttgaactggaaaaggatttacatttgaagggctatcacacactctctcagggatctttacccaactatcctaaatcagtgaagtgttaccttagcagaactccgggccgaatcccttcagaaagacaccaaattggaaacctgaaaaaatattatctcctaaatgctgcttctcttctcccagtgttggctctggaattaagggatggggagaaggttctggatctctgtgctgctcctggagggaaatcaatagctctgctgcagtgtgcttgtccaggttatcttcattgtaatgaatatgatagtctgagattgaggtggctaaggcagacgttggaatctttcatcccacagcctttgataaatgtaattaaagtgtctgaattggatggcagaaaaatgggagatgcccagcctgaaatgtttgacaaggtgttagtggatgctccgtgttcaaatgatcgaagctggttgttttcttctgactctcagaaggcatcctgtaggataagtcaaaggaggaatttgcctcttctacagatagagctgttaaggtctgcaattaaggccttacgtcctggagggatacttgtatactctacatgcacgctttccaaggcagtggacattaaaggaatagcaaggacttgctcccacgacttcacatttgctcccactggccaggaatgtgggctcttagtgattccagataagggcaaagcctggggcccaatgtatgtagccaaattgaagaaatcatggagcacaggaaaatggtgacatgaatttgtaaactgtgtttatgtgttattatatttatatttctgaactcagtacatgttaatatttaaataattatgcagtaactttctctgggtctgtttggaatcctatttagttaatactttagcatcttagaatctaggcttgagaattgttcaggtgtatttttttcctagaaatatatctgtaacaatgatttaaggtggtgcagatggtgtttgttctatattataaatctgctgtctttgcttggcattttatagttaaattaattagaatatgtggttttatgcataacgtgtttagttctgtattctttctatgatagtgctttgaaccttcaaaaattcacattttccagcgctccgaccattttcccgcttatcaaatgtacaaatttgttcaaggtttttttttccccccaacttttgtaactgattgtctcagaactgattggtattctgagactaactttttaagcagcactatttctagttctggcaaaatagtttttttatttgcaatgttgttttctgttaaagactatattatgnttactgcaaaggtcagtgactctactgacaccagctttatttcccccactttttttgcattcacaaatacaaattgaaagggtaaattatattgaaaggcctttagaacagcagattcacatgcacatgtttgactttcgacattcagcttatagaattatggagtctatccagcaggctataaagcaagtacttgagacaaaaccggaatgattaataactgcaatcactgaactatatttggagagttttgttacataattgcagtcataatgagcactacagaatctgattatcttacattcacaatctggaggggctttttatttcactttgttataaaatgttctctgagaatatgatgccacatattaatgcacaagagggagatgcctaatgagagtggactgtgtgattaccagaacccagtgccatttactaagtggctctccatgtttacataaatcctgggaatactgtatacatttcttcttatgtacttagggttttagcttcagtcagcatcacactttttctccagaaattacttcacttagagtacaaacatatttttccaactattaagaaaaattatgcagcacatctcaaaaaatagcatctctttggaaaatagcctttaaaaaaaaacaactttatctgattatagaaatacaaaattctgctaaagctgaatacttttgaattgttcattatgttctgtgcctttaaactagagactatttgcttattaatattttttgttttgcaagcatatgtaacccggtttatatcatcaggaagtcttaggaagaatttttttttctgtaccttcagtctgttaatcatttgttttcctttatgtccaattgatatgtttaaagtaaagctaaagtccaggcacggtggcttatgcctgtaatcccagcactttgtcaggccgaggcagggggcatctcctgaggtcagaagttcgagactagcctgcccaacatggtaaaaccccgactctactaaaaatgcaaaaaaattagacaggcatggtggctggcaccagcaatcccagctacttaggaggctgaggcaggagaatcacttgaacccaggaggcagaggttgcagttagccaagatctcgccattgcactccagcctgggcgacaagagtgaaaccccgtagcaaaaaaataataataatagtaattaaataaaaataaagtaacgctagaactgttggaccaaatcaagtatatgggtaaatacagaagaataatgatggtggaaaagatgttttcttttttaagttatcattattagtttgttttttttatcttcagacactataggttttaaaaataggtttcttttatgtaggttaatcacagagtaaatctgcacactgtactttgttaaatgtcggtattttcccagtataatgcgatgaagcttaatctgaatacttggtatgctattgaatttactttcctatgatt

SEQ ID NO: 16884 - DNA, 415 bp, Homo sapiens
caatgtcaactctgaatgcaaagagaaataacagagacatagtccctgtcctaaatagattttaatctactgtgaccattctgaaaatgtggtccaagattaatagcaacaccatctgcctgttagaaatgtacattttccttctccacccagaaacctggagttgaagcccaataatctgtgtttgaacaagttctctggatgactctgatgcacaataatgttttaaaaaacactggggtagttgtttccccagaagaatgaagatctctgttatacttccttattccttatttgttgttgttcttgttttgagacagtttcactctgtcacgcagagcttgcagtgagctgagatcgcaccactgcactctggtctgggcgacagagtgagactccgtctcaaaaaaaaaaa

SEQ ID NO: 16885 - DNA, 371 bp, Homo sapiens
caatgtcaactctgaatgcaaagagaaataacagagacatagtccctgtcctaaatagattttaatctactgtgaccattctgaaaatgtggtccaagattaatagcaacaccatctgcctcagcctcccaaagtgctgggattacaggcatgagccaccacactcggccattattttgtgtttgaataaaagtctcagtgctttttaaatgtgtacataagcctgaatttcggtttaggggacagaagtaaccagactgtttggggcacagtcagagttgttatttgcatttttcgcccttttgaaatagcttcaccactttcattagatctgtagttcctgaatcacagaaaggtttgtaatctttttt

SEQ ID NO: 16886 - DNA, 5923 bp, Homo sapiens
ccctttcttctcttccagggctccgctttatttgctctcagaagtcggtttcctttccttttcttcagtgaatcggagctcagagcgttgcttcggtttccctccagacagttaggaatctgaaataaacaggaaagcactatgtcttcaatgtggtctgaatatacaattggtggggtgaagatttactttccttataaagcttacccgtcacagcttgctatgatgaattctattctcagaggattaaacagcaagcaacattgtttgttggagagtcccacaggaagtggaaaaagcttagccttactttgttctgctttagcatggcaacaatctcttagtgggaaaccagcagatgagggcgtaagtgaaaaagctgaagtacaattgtcatgttgttgtgcatgccattcaaaggattttacaaacaatgacatgaaccaaggaacttcacgtcatttcaactatccaagcacaccaccttctgaaagaaatggcacttcatcaacttgtcaagactcccctgaaaaaaccactctggctgcaaagttatctgctaagaaacaggcatccatatacagagatgaaaatgatgattttcaagtagagaagaaaagaattcgacccttagaaactacacagcagattagaaaacgtcattgctttggaacagaagtacacaatttggatgcaaaagttgattcaggaaagactgtaaaactcaactctccactggaaaagataaactccttttcgccacagaaaccccctggccactgttctaggtgctgttgttctactaaacaaggaaacagtcaagagtcatcgaataccattaagaaggatcatacagggaaatccaagatacccaaaatatattttgggacacgcacacacaagcagattgctcagattactagagagctccggaggacggcatattcaggggttccaatgactattctttccagcagggatcatacttgtgtccatcctgaggtagtcggtaacttcaacagaaatgagaagtgcatggaattgctagatgggaaaaacggaaaatcctgctatttttatcatggagttcataaaattagtgatcagcacacattacagactttccaagggatgtgcaaagcctgggatatagaagaacttgtcagcctggggaagaaactaaaggcctgtccatattacacagcccgagaactaatacaagatgctgacatcatattttgtccctacaactatcttctagatgcacaaataagggaaagtatggatttaaatctgaaagaacaggttgtcattttagatgaagctcataacatcgaggactgtgctcgggaatcagcaagttacagtgtaacagaagttcagcttcggtttgctcgggatgaactagatagtatggtcaacaataatataaggaagaaagatcatgaacccctacgagctgtgtgctgtagcctcattaattggttagaagcaaacgctgaatatcttgtagaaagagattatgaatcagcttgtaaaatatggagtggaaatgaaatgctcttaactttacacaaaatgggtatcaccactgctacttttcccattttgcagggacatttttctgctgttcttcaaaaagaggaaaaaatctcaccaatttatggtaaagaggaggcaagagaagtacctgttattagtgcatcaactcaaataatgcttaaaggactttttatggtacttgactatctttttaggcaaaatagcagatttgcagatgattataaaattgcgattcaacagacttactcctggacaaatcagattgatatttcagacaaaaatgggttgttggttctaccaaaaaataagaaacgttcacgacagaaaactgcagttcatgtgctaaacttttggtgcttaaatccagctgtggccttttcagatattaatggcaaagttcagaccattgttttgacatctggtacattatcaccaatgaaatccttttcgtcagaacttggtgttacatttactatccagctggaggctaatcatatcattaaaaattcacaggtttgggttggtaccattgggtcaggccccaagggtcggaatctctgtgctaccttccagaatactgaaacatttgagttccaagatgaagtgggagcacttttgttatctgtgtgccagactgtgagccaaggaattttgtgtttcttgccatcttacaagttattagaaaaattaaaagaacgttggctctctactggtttatggcataatctggagttggtgaagacagtcattgtagaaccacagggaggagaaaaaacaaattttgatgaattactgcaggtgtactatgacgcaatcaaatacaaaggagagaaagatggagctctcctggtagcagtttgtcgtggtaaagtgagtgagggtctggatttctcagatgacaatgcccgtgctgtcataacaataggaattccttttccaaatgtgaaagatctacaggttgaactaaaacgacaatacaatgaccaccattcaaaattgagaggtcttctacctggccgtcagtggtatgaaattcaagcatacagggccttaaaccaggcccttggtagatgtattagacacagaaatgattggggagctcttattctagtggatgatcgctttaggaataacccaagtcgctatatatctggactttctaaatgggtacggcagcagattcagcaccattcaacctttgaaagtgcactggagtccttggctgaattttccaaaaagcatcaaaaagttcttaatgtatccataaaggacagaaccaatatacaggacaatgagtctacacttgaagtgacctctttaaagtacagtaccccaccttatttactggaagcagcaagtcatctatcaccagaaaattttgtggaagatgaagcaaagatatgtgtccaggaactacagtgtcctaaaattattaccaaaaattcacctctaccaagtagcattatctccagaaaggagaaaaatgatccagtattcctggaagaagcagggaaagcagaaaaaattgtgatttccagatccacaagcccaactttcaacaaacaaacaaagagagttagctggtcaagctttaattctttgggacagtattttactggtaaaataccgaaggcaacacctgagctcgggtcatcagagaatagtgcctctagtcctccccgtttcaaaacagagaagatggaaagtaaaactgttttgcccttcactgataaatgtgaatcctcaaatctgacagtaaacacatcgtttggatcatgccctcaatcagaaaccattatttcatcattaaagattgatgccacccttactagaaaaaatcattctgaacatccgctctgttctgaagaagccctggatccagacattgaattgtctctagtaagtgaagaagataaacagtccacttcaaatagagattttgaaacagaagcagaagatgaatctatctattttacacctgaactttacgatcctgaagatacagatgaagaaaaaaatgacctagctgaaactgatagaggaaatagattggctaacaattcagattgcattttagctaaagacctttttgaaattagaactataaaagaagtagattcagccagagaagtgaaagctgaggattgcatagatacaaagttgaatggaattctgcatattgaagaaagtaaaattgatgacattgatggtaatgtaaaaacaacttggataaatgaactggaactgggaaaaactcatgaaatagaaataaagaactttaaaccatctccttccaaaaataaaggcatgtttcctggttttaagtaataatacttaactctcaagctaagtaaaaatatgtcatcatgcttatgttaaactctgttgtaagtaataatttgtaaattgaataagtggcatactttttaaaaaactattttatgttcagaaatgtaaatgttattattcttgagtttttgggtttctttttttgagacagagtcttggtctgttgcccaggctggaatgcagtggtgtgctctgggctcactgcaaccttcacctccaggttcaagtgattctcctgcctcagccttctgagtagctgggactacaggtgtgcaccaccatgcccagctagtttttgtatttttagtagagatggggtttcaccatgttggccaggctggtctcgaactcctggcctcgtgatctgcccttctctgcctccctaagttgctgggattacaggtgtgagccacagtgcctggcccattcttgagttttgataaagtaattcatacaaagtattgtcctcaaataagtcttccttagctaaatgcaatttaaaattattcaaagatcctagggcacttctagtttcacgtaaatattcatattaggtggttctcttcatccatttgttttcacactgatacataaaaattaacagcagtctaatctagtgacacctcagtcatatttcgctatagattttacctcaaatcagtccaagactttttcagagatcaccatttgtcttgaaaggtttatttcgttattaaactgcctacttataagtaattaagagaaattaagaaagtagtatgcatttttaattgaaattgttttacattctttgtataataaacctaaaaccaaacatgtcataaacaaattgacgtaaagatataaaatgccaaatgaagtattccaaattttctattctaattatttagcttcaccatcattgtggaaaaaaatactagatcctgcttagtattatatatttttcctagtggatcagtgagtaataagtaccaaacactagactagaaggtaatttctacattgtttagaaagggtgaaacaatttatcccctctggtattgttctagcataagctttagttatacaatgattaagatagaaaacttcatatataaatttgataagcaaacccacatttatagctgcagctaaaatatgtttccttagggcacagtaatcctttctgtgaattttgaccttgtttgtgtttttgtgaatgaagctatatgtctaatcaaaaatgattataaaagaggctcatctctgacatcattccaaaaatacattcattgatctctttttaagaaaacatctgttattcactgggcattgggactttttgtgagtaatttgaattgaaattttatgagctatccaagaattctgtatggtctattattttcaagtcaaaatttccagtaaggatttactttacatttcatttggataaatgaatcattatataggtatgtctttgcttccattttgagacatttagatttttacagcctgtttctatagcatttgatgttacaactctaagcgtagttcaaagacatttaaattgacaagttaccagttaaagaatttagaatatattagatcccatctagtattatatattttttctagttgatcattgagcagtaaataccaaatactcgattagaaggtaatttttacattgttttgaaagggtgaaacaatttatctcctctggtattattcttaaaccacagatagggatagtagggtagtgaaacgaataaatacctggtagaagacaagagacttgggctctacacctggctctgccactgatttgctaagtcatattggcaatcaccacacccttcagggaattagtttcatctgtaaaatgcagcggttagtactataaaatcatacaaatttctttgtgctttgagaatctataaaggaatgtctgttgatattctgagtcgattttcatttgcttttgttccagaacggttaaaataaagcatattatttcatttaaaaagtaaag

SEQ ID NO: 16887 - DNA, 5675 bp, Homo sapiens
ccctttcttctcttccagggctccgctttatttgctctcagaagtcggtttcctttccttttcttcagtgaatcggagctcagagcgttgcttcggtttccctccagacagttaggaatctgaaataaacaggaaagcactatgtcttcaatgtggtctgaatatacaattggtggggtgaagatttactttccttataaagcttacccgtcacagcttgctatgatgaattctattctcagaggattaaacagcaagcaacattgtttgttggagagtcccacaggaagtggaaaaagcttagccttactttgttctgctttagcatggcaacaatctcttagtgggaaaccagcagatgagggcgtaagtgaaaaagctgaagtacaattgtcatgttgttgtgcatgccattcaaaggattttacaaacaatgacatgaaccaaggaacttcacgtcatttcaactatccaagcacaccaccttctgaaagaaatggcacttcatcaacttgtcaagccccctggccactgttctaggtgctgttgttctactaaacaaggaaacagtcaagagtcatcgaataccattaagaaggatcatacagggaaatccaagatacccaaaatatattttgggacacgcacacacaagcagattgctcagattactagagagctccggaggacggcatattcaggggttccaatgactattctttccagcagggatcatacttgtgtccatcctgaggtagtcggtaacttcaacagaaatgagaagtgcatggaattgctagatgggaaaaacggaaaatcctgctatttttatcatggagttcataaaattagtgatcagcacacattacagactttccaagggatgtgcaaagcctgggatatagaagaacttgtcagcctggggaagaaactaaaggcctgtccatattacacagcccgagaactaatacaagatgctgacatcatattttgtccctacaactatcttctagatgcacaaataagggaaagtatggatttaaatctgaaagaacaggttgtcattttagatgaagctcataacatcgaggactgtgctcgggaatcagcaagttacagtgtaacagaagttcagcttcggtttgctcgggatgaactagatagtatggtcaacaataatataaggaagaaagatcatgaacccctacgagctgtgtgctgtagcctcattaattggttagaagcaaacgctgaatatcttgtagaaagagattatgaatcagcttgtaaaatatggagtggaaatgaaatgctcttaactttacacaaaatgggtatcaccactgctacttttcccattttgcagggacatttttctgctgttcttcaaaaagaggaaaaaatctcaccaatttatggtaaagaggaggcaagagaagtacctgttattagtgcatcaactcaaataatgcttaaaggactttttatggtacttgactatctttttaggcaaaatagcagatttgcagatgattataaaattgcgattcaacagacttactcctggacaaatcagattgatatttcagacaaaaatgggttgttggttctaccaaaaaataagaaacgttcacgacagaaaactgcagttcatgtgctaaacttttggtgcttaaatccagctgtggccttttcagatattaatggcaaagttcagaccattgttttgacatctggtacattatcaccaatgaaatccttttcgtcagaacttggtgttacatttactatccagctggaggctaatcatatcattaaaaattcacaggtttgggttggtaccattgggtcaggccccaagggtcggaatctctgtgctaccttccagaatactgaaacatttgagttccaagatgaagtgggagcacttttgttatctgtgtgccagactgtgagccaaggaattttgtgtttcttgccatcttacaagttattagaaaaattaaaagaacgttggctctctactggtttatggcataatctggagttggtgaagacagtcattgtagaaccacagggaggagaaaaaacaaattttgatgaattactgcaggtgtactatgacgcaatcaaatacaaaggagagaaagatggagctctcctggtagcagtttgtcgtggtaaagtgagtgagggtctggatttctcagatgacaatgcccgtgctgtcataacaataggaattccttttccaaatgtgaaagatctacaggttgaactaaaacgacaatacaatgaccaccattcaaaattgagaggtcttctacctggccgtcagtggtatgaaattcaagcatacagggccttaaaccaggcccttggtagatgtattagacacagaaatgattggggagctcttattctagtggatgatcgctttaggaataacccaagtcgctatatatctggactttctaaatgggtacggcagcagattcagcaccattcaacctttgaaagtgcactggagtccttggctgaattttccaaaaagcatcaaaaagttcttaatgtatccataaaggacagaaccaatatacaggacaatgagtctacacttgaagtgacctctttaaagtacagtaccccaccttatttactggaagcagcaagtcatctatcaccagaaaattttgtggaagatgaagcaaagatatgtgtccaggaactacagtgtcctaaaattattaccaaaaattcacctctaccaagtagcattatctccagaaaggagaaaaatgatccagtattcctggaagaagcagggaaagcagaaaaaattgtgatttccagatccacaagcccaactttcaacaaacaaacaaagagagttagctggtcaagctttaattctttgggacagtattttactggtaaaataccgaaggcaacacctgagctcgggtcatcagagaatagtgcctctagtcctccccgtttcaaaacagagaagatggaaagtaaaactgttttgcccttcactgataaatgtgaatcctcaaatctgacagtaaacacatcgtttggatcatgccctcaatcagaaaccattatttcatcattaaagattgatgccacccttactagaaaaaatcattctgaacatccgctctgttctgaagaagccctggatccagacattgaattgtctctagtaagtgaagaagataaacagtccacttcaaatagagattttgaaacagaagcagaagatgaatctatctattttacacctgaactttacgatcctgaagatacagatgaagaaaaaaatgacctagctgaaactgatagaggaaatagattggctaacaattcagattgcattttagctaaagacctttttgaaattagaactataaaagaagtagattcagccagagaagtgaaagctgaggattgcatagatacaaagttgaatggaattctgcatattgaagaaagtaaaattgatgacattgatggtaatgtaaaaacaacttggataaatgaactggaactgggaaaaactcatgaaatagaaataaagaactttaaaccatctccttccaaaaataaaggcatgtttcctggttttaagtaataatacttaactctcaagctaagtaaaaatatgtcatcatgcttatgttaaactctgttgtaagtaataatttgtaaattgaataagtggcatactttttaaaaaactattttatgttcagaaatgtaaatgttattattcttgagtttttgggtttctttttttgagacagagtcttggtctgttgcccaggctggaatgcagtggtgtgctctgggctcactgcaaccttcacctccaggttcaagtgattctcctgcctcagccttctgagtagctgggactacaggtgtgcaccaccatgcccagctagtttttgtatttttagtagagatggggtttcaccatgttggccaggctggtctcgaactcctggcctcgtgatctgcccttctctgcctccctaagttgctgggattacaggtgtgagccacagtgcctggcccattcttgagttttgataaagtaattcatacaaagtattgtcctcaaataagtcttccttagctaaatgcaatttaaaattattcaaagatcctagggcacttctagtttcacgtaaatattcatattaggtggttctcttcatccatttgttttcacactgatacataaaaattaacagcagtctaatctagtgacacctcagtcatatttcgctatagattttacctcaaatcagtccaagactttttcagagatcaccatttgtcttgaaaggtttatttcgttattaaactgcctacttataagtaattaagagaaattaagaaagtagtatgcatttttaattgaaattgttttacattctttgtataataaacctaaaaccaaacatgtcataaacaaattgacgtaaagatataaaatgccaaatgaagtattccaaattttctattctaattatttagcttcaccatcattgtggaaaaaaatactagatcctgcttagtattatatatttttcctagtggatcagtgagtaataagtaccaaacactagactagaaggtaatttctacattgtttagaaagggtgaaacaatttatcccctctggtattgttctagcataagctttagttatacaatgattaagatagaaaacttcatatataaatttgataagcaaacccacatttatagctgcagctaaaatatgtttccttagggcacagtaatcctttctgtgaattttgaccttgtttgtgtttttgtgaatgaagctatatgtctaatcaaaaatgattataaaagaggctcatctctgacatcattccaaaaatacattcattgatctctttttaagaaaacatctgttattcactgggcattgggactttttgtgagtaatttgaattgaaattttatgagctatccaagaattctgtatggtctattattttcaagtcaaaatttccagtaaggatttactttacatttcatttggataaatgaatcattatataggtatgtctttgcttccattttgagacatttagatttttacagcctgtttctatagcatttgatgttacaactctaagcgtagttcaaagacatttaaattgacaagttaccagttaaagaatttagaatatattagatcccatctagtattatatattttttctagttgatcattgagcagtaaataccaaatactcgattagaaggtaatttttacattgttttgaaagggtgaaacaatttatctcctctggtattattcttaaaccacagatagggatagtagggtagtgaaacgaataaatacctggtagaagacaagagacttgggctctacacctggctctgccactgatttgctaagtcatattggcaatcaccacacccttcagggaattagtttcatctgtaaaatgcagcggttagtactataaaatcatacaaatttctttgtgctttgagaatctataaaggaatgtctgttgatattctgagtcgattttcatttgcttttgttccagaacggttaaaataaagcatattatttcatttaaaaagtaaag

SEQ ID NO: 16888 - DNA, 3231 bp, Homo sapiens
ccctttcttctcttccagggctccgctttatttgctctcagaagtcggtttcctttccttttcttcagtgaatcggagctcagagcgttgcttcggtttccctccagacagttaggaatctgaaataaacaggaaagcactatgtcttcaatgtggtctgaatatacaattggtggggtgaagatttactttccttataaagcttacccgtcacagcttgctatgatgaattctattctcagaggattaaacagcaagcaacattgtttgttggagagtcccacaggaagtggaaaaagcttagccttactttgttctgctttagcatggcaacaatctcttagtgggaaaccagcagatgagggcgtaagtgaaaaagctgaagtacaattgtcatgttgttgtgcatgccattcaaaggattttacaaacaatgacatgaaccaaggaacttcacgtcatttcaactatccaagcacaccaccttctgaaagaaatggcacttcatcaacttgtcaagccccctggccactgttctaggtgctgttgttctactaaacaaggaaacagtcaagagtcatcgaataccattaagaaggatcatacagggaaatccaagatacccaaaatatattttgggacacgcacacacaagcagattgctcagattactagagagctccggaggacggcatattcaggggttccaatgactattctttccagcagggatcatacttgtgtccatcctgaggtagtcggtaacttcaacagaaatgagaagtgcatggaattgctagatgggaaaaacggaaaatcctgctatttttatcatggagttcataaaattagtgatcagcacacattacagactttccaagggatgtgcaaagcctgggatatagaagaacttgtcagcctggggaagaaactaaaggcctgtccatattacacagcccgagaactaatacaagatgctgacatcatattttgtccctacaactatcttctagatgcacaaataagggaaagtatggatttaaatctgaaagaacaggttgtcattttagatgaagctcataacatcgaggactgtgctcgggaatcagcaagttacagtgtaacagaagttcagcttcggtttgctcgggatgaactagatagtatggtcaacaataatataaggaagaaagatcatgaacccctacgagctgtgtgctgtagcctcattaattggttagaagcaaacgctgaatatcttgtagaaagagattatgaatcagcttgtaaaatatggagtggaaatgaaatgctcttaactttacacaaaatgggtatcaccactgctacttttcccattttgcagggacatttttctgctgttcttcaaaaagaggaaaaaatctcaccaatttatggtaaagaggaggcaagagaagtacctgttattagtgcatcaactcaaataatgcttaaaggactttttatggtacttgactatctttttaggcaaaatagcagatttgcagatgattataaaattgcgattcaacagacttactcctggacaaatcagattgatatttcagacaaaaatgggttgttggttctaccaaaaaataagaaacgttcacgacagaaaactgcagttcatgtgctaaacttttggtgcttaaatccagctgtggccttttcagatattaatggcaaagttcagaccattgttttgacatctggtacattatcaccaatgaaatccttttcgtcagaacttggtgttacatttactatccagctggaggctaatcatatcattaaaaattcacaggtttgggttggtaccattgggtcaggccccaagggtcggaatctctgtgctaccttccagaatactgaaacatttgagttccaagatgaagtgggagcacttttgttatctgtgtgccagactgtgagccaaggaattttgtgtttcttgccatcttacaagttattagaaaaattaaaagaacgttggctctctactggtttatggcataatctggagttggtgaagacagtcattgtagaaccacagggaggagaaaaaacaaattttgatgaattactgcaggtgtactatgacgcaatcaaatacaaaggagagaaagatggagctctcctggtagcagtttgtcgtggtaaagtgagtgagggtctggatttctcagatgacaatgcccgtgctgtcataacaataggaattccttttccaaatgtgaaagatctacaggttgaactaaaacgacaatacaatgaccaccattcaaaattgagaggtcttctacctggccgtcagtggtatgaaattcaagcatacagggccttaaaccaggcccttggtaggtaagtggagtgaaatttaatataatattatctgtgacagggctatatatataaatctagtcttgctactttactctttataataaacttggtaaaattttatttaactggaaccataggaactggtatgtattcaatgatagctgtcacaagtagaatttgaaaagagtaagaagaataagttattcccaaaacaaaactcacaatttgctaaagtttaaagaaattttgtgattgatctaacaatgaatagcacacaaagatgctcagtaaatattaaagaaagcttatcaaatcaaaaaagttttgtcttgtgaacatcaaagctcagataacaattttatagataaacagacctctctcctcacctcccccaaaatgtcagggaagaaaattgatataccagccagtgtgaggagatattctatttgaaagtgtactttcagtacggaatctgtgtatctgttaaaatatcatcaaatagaaacaaaatctattttactgcccagtgagcttctgtagttgcacaatttttcattctgcttctatgtaaagaagacatctgacagaaaaaaaaatcattttcattttaatgttatttgtaagctttagataacaatgtgattacaatctatattttcttgtgccttttatgtatagtgataatgttgaaggataacattgaaactgaaggatatttaataattaaagaaaaaataaaataattaattattattattattattattgttttagacagcctcactgtgttgcccaggctggagtgcatgagccaaaatcatgccactgcattccagcctgggcaacagagccagaccatgtctc

SEQ ID NO: 16889 - DNA, 2630 bp, Homo sapiens
ccctttcttctcttccagggctccgctttatttgctctcagaagtcggtttcctttccttttcttcagtgaatcggagctcagagcgttgcttcggtttccctccagacagttaggaatctgaaataaacaggaaagcactatgtcttcaatgtggtctgaatatacaattggtggggtgaagatttactttccttataaagcttacccgtcacagcttgctatgatgaattctattctcagaggattaaacagcaagcaacattgtttgttggagagtcccacaggaagtggaaaaagcttagccttactttgttctgctttagcatggcaacaatctcttagtgggaaaccagcagatgagggcgtaagtgaaaaagctgaagtacaattgtcatgttgttgtgcatgccattcaaaggattttacaaacaatgacatgaaccaaggaacttcacgtcatttcaactatccaagcacaccaccttctgaaagaaatggcacttcatcaacttgtcaagccccctggccactgttctaggtgctgttgttctactaaacaaggaaacagtcaagagtcatcgaataccattaagaaggatcatacagggaaatccaagatacccaaaatatattttgggacacgcacacacaagcagattgctcagattactagagagctccggaggacggcatattcaggggttccaatgactattctttccagcagggatcatacttgtgtccatcctgaggtagtcggtaacttcaacagaaatgagaagtgcatggaattgctagatgggaaaaacggaaaatcctgctatttttatcatggagttcataaaattagtgatcagcacacattacagactttccaagggatgtgcaaagcctgggatatagaagaacttgtcagcctggggaagaaactaaaggcctgtccatattacacagcccgagaactaatacaagatgctgacatcatattttgtccctacaactatcttctagatgcacaaataagggaaagtatggatttaaatctgaaagaacaggttgtcattttagatgaagctcataacatcgaggactgtgctcgggaatcagcaagttacagtgtaacagaagttcagcttcggtttgctcgggatgaactagatagtatggtcaacaataatataaggaagaaagatcatgaacccctacgagctgtgtgctgtagcctcattaattggttagaagcaaacgctgaatatcttgtagaaagagattatgaatcagcttgtaaaatatggagtggaaatgaaatgctcttaactttacacaaaatgggtatcaccactgctacttttcccattttgcagggacatttttctgctgttcttcaaaaagaggaaaaaatctcaccaatttatggtaaagaggaggcaagagaagtacctgttattagtgcatcaactcaaataatgcttaaaggactttttatggtacttgactatctttttaggcaaaatagcagatttgcagatgattataaaattgcgattcaacagacttactcctggacaaatcagattgatatttcagacaaaaatgggttgttggttctaccaaaaaataagaaacgttcacgacagaaaactgcagttcatgtgctaaacttttggtgcttaaatccagctgtggccttttcagatattaatggcaaagttcagaccattgttttgacatctggtacattatcaccaatgaaatccttttcgtcagaacttggtgttacatttactatccagctggaggctaatcatatcattaaaaattcacaggtttgggttggtaccattgggtcaggccccaagggtcggaatctctgtgctaccttccagaatactgaaacatttgagttccaagatgaagtgggagcacttttgttatctgtgtgccagactgtgagccaaggaattttgtgtttcttgccatcttacaagttattagaaaaattaaaagaacgttggctctctactggtttatggcataatctggagttggtgaagacagtcattgtagaaccacagggaggagaaaaaacaaattttgatgaattactgcaggtgtactatgacgcaatcaaatacaaaggagagaaagatggagctctcctggtagcagtttgtcgtggtaaagtgagtgagggtctggatttctcagatgacaatgcccgtgctgtcataacaataggaattccttttccaaatgtgaaagatctacagttaaccagtgctactgctgagggcactaatggctatgcccaaagctgggtctcctattctaaaatggctgatgctgccttgactacagctactgatgaaacagttgacatctacccaagaaatctactgtcaccatcaacagcattggtgctgcattccactgaagtagagtgctactgatggcactgctgttggtactggtattgtctccttttaatgtcttatcattttactctagctctacattattgcactaaggctgctttgttaaagtggaaagaatccttttcccttctttagaccacatcttcttccaatatcttaataaaatacaattttgttccctaaaactaattat

SEQ ID NO: 16890 - DNA, 3183 bp, Homo sapiens
ccctttcttctcttccagggctccgctttatttgctctcagaagtcggtttcctttccttttcttcagtgaatcggagctcagagcgttgcttcggtttccctccagacagttaggaatctgaaataaacaggaaagcactatgtcttcaatgtggtctgaatatacaattggtggggtgaagatttactttccttataaagcttacccgtcacagcttgctatgatgaattctattctcagaggattaaacagcaagcaacattgtttgttggagagtcccacaggaagtggaaaaagcttagccttactttgttctgctttagcatggcaacaatctcttagtgggaaaccagcagatgagggcgtaagtgaaaaagctgaagtacaattgtcatgttgttgtgcatgccattcaaaggattttacaaacaatgacatgaaccaaggaacttcacgtcatttcaactatccaagcacaccaccttctgaaagaaatggcacttcatcaacttgtcaagccccctggccactgttctaggtgctgttgttctactaaacaaggaaacagtcaagagtcatcgaataccattaagaaggatcatacagggaaatccaagatacccaaaatatattttgggacacgcacacacaagcagattgctcagattactagagagctccggaggacggcatattcaggggttccaatgactattctttccagcagggatcatacttgtgtccatcctgaggtagtcggtaacttcaacagaaatgagaagtgcatggaattgctagatgggaaaaacggaaaatcctgctatttttatcatggagttcataaaattagtgatcagcacacattacagactttccaagggatgtgcaaagcctgggatatagaagaacttgtcagcctggggaagaaactaaaggcctgtccatattacacagcccgagaactaatacaagatgctgacatcatattttgtccctacaactatcttctagatgcacaaataagggaaagtatggatttaaatctgaaagaacaggttgtcattttagatgaagctcataacatcgaggactgtgctcgggaatcagcaagttacagtgtaacagaagttcagcttcggtttgctcgggatgaactagatagtatggtcaacaataatataaggaagaaagatcatgaacccctacgagctgtgtgctgtagcctcattaattggttagaagcaaacgctgaatatcttgtagaaagagattatgaatcagcttgtaaaatatggagtggaaatgaaatgctcttaactttacacaaaatgggtatcaccactgctacttttcccattttgcagggacatttttctgctgttcttcaaaaagaggaaaaaatctcaccaatttatggtaaagaggaggcaagagaagtacctgttattagtgcatcaactcaaataatgcttaaaggactttttatggtacttgactatctttttaggcaaaatagcagatttgcagatgattataaaattgcgattcaacagacttactcctggacaaatcagattgatatttcagacaaaaatgggttgttggttctaccaaaaaataagaaacgttcacgacagaaaactgcagttcatgtgctaaacttttggtgcttaaatccagctgtggccttttcagatattaatggcaaagttcagaccattgttttgacatctggtacattatcaccaatgaaatccttttcgtcagaacttggtgttacatttactatccagctggaggctaatcatatcattaaaaattcacaggtttgggttggtaccattgggtcaggccccaagggtcggaatctctgtgctaccttccagaatactgaaacatttgagttccaagatgaagtgggagcacttttgttatctgtgtgccagactgtgagccaaggaattttgtgtttcttgccatcttacaagttattagaaaaattaaaagaacgttggctctctactggtttatggcataatctggagttggtgaagacagtcattgtagaaccacagggaggagaaaaaacaaattttgatgaattactgcaggtgtactatgacgcaatcaaatacaaaggagagaaagatggagctctcctggtagcagtttgtcgtggtaaagtgagtgagggtctggatttctcagatgacaatgcccgtgctgtcataacaataggaattccttttccaaatgtgaaagatctacaggttgaactaaaacgacaatacaatgaccaccattcaaaattgagaggtcttctacctggccgtcagtggtatgaaattcaagcatacagggccttaaaccaggcccttggtaggtaagtggagtgaaatttaatataatattatctgtgacagggctatatatataaatctagtcttgctactttactctttataataaacttggtaaaattttatttaactggaaccataggaactggtatgtattcaatgatagctgtcacaagtagaatttgaaaagagtaagaagaataagttattcccaaaacaaaactcacaatttgctaaagtttaaagaaattttgtgattgatctaacaatgaatagcacacaaagatgctcagtaaatattaaagaaagcttatcaaatcaaaaaagttttgtcttgtgaacatcaaagctcagataacaattttatagataaacagacctctctcctcacctcccccaaaatgtcagggaagaaaattgatataccagccagtgtgaggagatattctatttgaaagtgtactttcagtacggaatctgtgtatctgttaaaatatcatcaaatagaaacaaaatctattttactgcccagtgagcttctgtagttgcacaatttttcattctgcttctatgtaaagaagacatctgacagaaaaaaaaatcattttcattttaatgttatttgtaagctttagataacaatgtgattacaatctatattttcttgtgccttttatgtatagtgataatgttgaatctaggccaggcacggtggctcacgtgtgtaatcctagcactttgggaggccaacacgggcagattacctgaggtcaggagttcgagaccagcctggccaacatggtgaaaccccgtctctacta

SEQ ID NO: 16891 - DNA, 989 bp, Homo sapiens
aattttttaaatatattttaaaattattaggttgaactaaaacgacaatacaatgaccaccattcaaaattgagaggtcttctacctggccgtcagtggtatgaaattcaagcatacagggccttaaaccaggcccttggtaggtaagtggagtgaaatttaatataatattatctgtgacagggctatatatataaatctagtcttgctactttactctttataataaacttggtaaaattttatttaactggaaccataggaactggtatgtattcaatgatagctgtcacaagtagaatttgaaaagagtaagaagaataagttattcccaaaacaaaactcacaatttgctaaagtttaaagaaattttgtgattgatctaacaatgaatagcacacaaagatgctcagtaaatattaaagaaagcttatcaaatcaaaaaagttttgtcttgtgaacatcaaagctcagataacaattttatagataaacagacctctctcctcacctcccccaaaatgtcagggaagaaaattgatataccagccagtgtgaggagatattctatttgaaagtgtactttcagtacggaatctgtgtatctgttaaaatatcatcaaatagaaacaaaatctattttactgcccagtgagcttctgtagttgcacaatttttcattctgcttctatgtaaagaagacatctgacagaaaaaaaaatcattttcattttaatgttatttgtaagctttagataacaatgtgattacaatctatattttcttgtgccttttatgtatagtgataatgttgaaggataacattgaaactgaaggatatttaataattaaagaaaaaataaaataattaattattattattattattattgttttagacagcctcactgtgttgcccaggctggagtgcatgagccaaaatcatgccactgcattccagcctgggcaacagagccagaccatgtctc

SEQ ID NO: 16892 - DNA, 360 bp, Homo sapiens
ccaccttagcttcccgagtagctgggactataggcatgtgtcaccatgcccggctaatttttgtattttttgtagagacggggtttcaccatattgcccaggctggtctcagactcctagactcaagcgatcttcctgcttcagcctcccaaagtgctgggattacaggtgtgagccactttgcccagcctcttctaaagataattttatttatctaatgttgttttcttttaggccttttcagatattaatggcaaagttcagaccattgttttgacatctggtacattatcaccaatgaaatccttttcgtcagaacttggtgttacatttactatccagctggaggctaatcatatc

SEQ ID NO: 16893 - DNA, 422 bp, Homo sapiens
tctgaccagctcatcctatagtctctgaagccacaggattgttgtctgtgccttcctgtgattcatagcacggagcaaaggatcaaaacagcttgagctggaaataacttcatttacttttttaaaaaagtaataagcgggccgggtgcggtggctcacgcctgtaatcccagcacttcaggaggccgaggtgggcagatcacgatgtcaggagatcaagaccatcctagcgaacacggtgaaaccccgtctctactaaaaacacaaaaaaattagctgggcgtggtggcaggcgcctgtagttccagctactcgggaggctgaggcaggagaatggcacgaaccccggggggcggagcttgcggtgagcggacgtcacaccactgcactccagcctaggcaacagagcgatactccatctc

SEQ ID NO: 16894 - DNA, 392 bp, Homo sapiens
cttaaaattcagttaaactgacgcctccagcaggcacggtctcgctctgttgccatgctggagtgcagtggtgcactcatggctgactgtagccttggattcctgggctcaagtgatcttcctgcctcagcctgccaaacagctgggactacagattgcaatgagaaattagagttcaactatttgggtttttattgcctgctctgctagtgaaagcacatacaaccccaggcaagttaataccctgttttcaccaaatgaaaaaggaactatgtatggctcaacatgttccagaaaaaatgattttgtactcacagagtgtgtaatgtgtatacatagacccatatggaagctaccacactgtattaaagacaaagtataaaaacattacc

SEQ ID NO: 16895 - DNA, 356 bp, Homo sapiens
ttgattgtccttgttttatttctctggtgccctgccatgcgctccattccccactccctactctcttatgctgaaaccacatccctcccgctccacactctgaggtccaaaagcagtatcaaccagagaaccatattcattaaatcccagtcctgtgagatgccttgtacaggcctctcattttatgggtgtggagaggaatggccaagaggaccagagactctttaactcctattggcaacagactcaaaacaaagaccagtcttctaagctcctcatacagagtctgtttctgctacagtgattctgtgctattaagagagatcacaaattacctatggtccccccccaaaaaa

SEQ ID NO: 16896 - DNA, 439 bp, Homo sapiens
cattcaaacaaaagatgctcccttcactcaggaacccccaagggatttaggagctccgtgtcaggaactggggggcagagaccaaatatacgtttcttattctaccacagtgtcatatgaaggggaggacaacactgcctttctgtgtcttgccccatagagggcgcacaatgcatggaaataaatgtttctgaatcaacagcaaacaggcttcatcgggtaggagagcgctgagccctccagggacaatgcacatcaatgatgtcccactgtcctttggtgctggggctctaaggcctccactgggtcaggctcctgaagggagacccattctccaaagacccccgagggtcaccactccctgtccaggggtgtggcctcatagctccttttgaacaggggcacaggaaggacggctttagagcattcaaaaaataac

SEQ ID NO: 16897 - DNA, 449 bp, Homo sapiens
tatcaccacaatttaattttggccatttctattatccaagtgcccaagttcttcctgcttattcacagttaatccccattctaatctcctttcctaccctagccccaggtaactactaaactgctttctgtctttatacattgtccttttctgaacatttcatataagtagaattattcatgtagacatcttttatgtctggttcctttcacttagcataacacttagcataacccataataatctggcataacctgtagtgaggtttctgccagattattattagacaaacagaatagacatattttactcctaaagagactatggaacactgggaaaacaacacgtgtgataaggatgtggtgtgaggactatccaaaggtgtagagggagacaaggaaattgagggggacccaaggatagggacagggttggcagggaaaaagagt

SEQ ID NO: 16898 - DNA, 779 bp, Homo sapiens
ctgcgcatgctcgccggcccccgccccgcgcacggcgtcagcgtctagacgcaggccctcctggtgagatcccatcacgtcccctggcctccagtgtcatctgctctgcatgatatctccagggggacctctctgctgggctccaggccgcatggctgtgggtgaccagcatcatgtcccaccgggtcccctgcagtcccagtgcacctgcctgctcatccagggacctgtcctcactgcctgctgcctgcactgtgtggaaggacagaggctaaacgacgaagcctcgagctctggtctcatggaaatggcagcctgcccaccacccacgcttgcccagcctttcttcacgcattaaaacgtggagagtggaatcttctgggcccaggtaatgcgcctttgctccgacattcccttcactactcactggcgagctcagttggaaattcactcccaataggagttccacggcagacacatcgtgagtcatggcagaactttgtcttttaattgcagaatgttaaagaaagagtcactcaggtagcaaagattggcttttcaggggcgattttatggagctattaactcagagacaccattacttaaatgtaatttttattattacaattaaagactgatttgattttaaaaaaaaaaaaaaactgcccgcgtttacacgtcttacttggaaaccctgcgtacccaactaatgcttgagacatcccctttgcagctgcgtataccaaaggccgaacgacgcctccaacatgtcactgaag

SEQ ID NO: 16899 - DNA, 402 bp, Homo sapiens
ctgcgcatgctcgccggcccccgccccgcgcacggcgtcagcgtctagacgcaggccctcctggtgagatcccatcacgtcccctggcctccagtgtcatctgctctgcatgatatctccagggggacctctctgctgggctccaggccgcatggctgtgggtgaccagcatcatgtcccaccgggtcccctgcagtcccagtgcacctgcctgctcatccagggacctgtcctcactgcctgctgcctgcactgtgtggaaggacagaggctaaacgacgaagcctcgagctctggtctcatggaaatggcagcctgcccaccacccacgcttgcccagcctttcttcacgcagtgcgtaaaacacttttgaaaatacaagtattatcctgtcctgttaaa

SEQ ID NO: 16900 - DNA, 487 bp, Homo sapiens
ccgggaacgcacggacacgggccagggggcggggcgattggggaggaatgaatggcggggggtcttcctgagctccgcggctcaccctccccaacacacaacacacacacacacacagagcaataagtttctctcactcaaatgtgggcggggcgggcctagcctgtcgctggtggggggagtggtgagggggcgctctcagggatgggggcggggttcggagacagtgtggggaggggaggtctgcaaatcgtccaactctggtgctaatggcgggtcttctcagcccacccgcagggcagggagggaggggtcggcgtggccccttccccaagcctcccccacgcccaccctgggtgcatgaaccgcccaatgcagaagctgccgcatgtcacccccctctccccaaagaaaaagtgtcatgcccccttcccacccaccctcactccccaccaaaataaacgtttccttttcatttaaaaaaaac

SEQ ID NO: 16901 - DNA, 440 bp, Homo sapiens
tctgactgggactattgactaatgcctatacatagctccattggcctgggcttcctcaaagcatgtctgcttcagcatagtcacacttcgcatatgatgcaccatggttctacagctcattccagtggacgagaacattggtcaagaagctgcattgcctttcatcacatagccttagaaatcaccgtgtcacttccactgttttctattggttgaagctatcctagtcccacccagattcatagaaagcaatcatagagtccgcgtcttgataagaagagtgtcagagaatttgcagctgttttaaaatcactgcaggaccccattctccatgatgtgattattacacattgcatgcctgtatcaaaacatctcatgtgccccctcaatatatatacctaaatatacctgttatgtacccagaaaaattaaaaaataaa

SEQ ID NO: 16902 - DNA, 465 bp, Homo sapiens
gccttgggcagcatctctggcagtggcccctctacagctatcccacctgcaggttgggtcctccatggctctgtcatcggctggttggtcctgggtctcgagctttagccctgccttcttcctttgtccttttagctgatgggtggaagaagcttcctgctgatgctgatctctgagtttcttccctgtcccctgggtagagcatcagatttaaaagccaaggcaagacaaaaaatgagagaatggtagcaaagatccaacactttacaagaccgcctgagaaaagggaggagggggtggttcgacaccagggcctgcacactgagtgtgtgatgttgcagctctgcaggcacagattaagcagctaagatgccatcaatgcttggaaagcagccggtgcctcttgtcctgagcttatttgtctggaatatgattcccttgaacctgactagctcatccacgggg

SEQ ID NO: 16903 - DNA, 419 bp, Homo sapiens
agcgttaacgctgttatatacgttgcccctaaaattaaaagatctgcagagtgttgtgcctcttttttggttataggtgtcatgaggtgcagtaacttggaggtgcatatcggaggggatgtctttatgtaatccagactgctgaactcgtagaaactatggcccctgaatgacaagctctctgttgtgtatatttcatatgaagttatctaaaatgtgttcattttctgttcactgtatccaaccagcctcatgtcaacatagtgtatgagtgcagtctgagggtcaggtcctctggggatgatgttaaggtggagaactgaatattacatccctttttgaaggagggaaaagagcctgtgcaggtgacaacaaagtcaacacatttgtgggtcttttagcccaaagacctcgccccc

SEQ ID NO: 16904 - DNA, 747 bp, Homo sapiens
ctccttgtcccttgtctagatcctagtcattctctacaacacagttcaaacatcgctgcctcaaggaaaccctgcctcaccacatcatcagccctcagcttccgtcccagccccggccaagtgatcttcctctctgttcccatgactctgggaaatcaggtccagactacataaaggattatttacccaaaattcatcagcacacctcctatgtaggagaacagcatctggcgttagaaaaaactggagatctcagatatttatggaggcctgcctcaaatagaagcttgccagcaaaatataaacatgagtacgtcggtgaaattggttggagaataccacagtataattttatcaacaaatcaagactggagagtggctttcatatcaaggcaaccaaaacctcatgtcctggatatgcaaggaaaacagagtcgcgcttcttttgcctggcatatgagtgctttcgaggacactgatcagagaaattccaaatgggctattcttgttaggcagtgtaagtcatcattgccaagagcttccaaaccacctaagctgccgaagctaccaaaaaaggaaaagaaaaggaaacattaacctctaaatcagcataactcaacctgcttttagaaggagaaactgcctactactgtataacaaaaaataagatcataataatccacaagtgcttctcatattgccccaggacagatgtcttgcaagagtacgcttcagcttaaagcccaa

SEQ ID NO: 16905 - DNA, 795 bp, Homo sapiens
  misc_feature (264)..(264): n is a, c, g, or t
  misc_feature (272)..(272): n is a, c, g, or t
  misc_feature (300)..(300): n is a, c, g, or t
ctccttgtcccttgtctagatcctagtcattctctacaacacagttcaaacatcgctgcctcaaggaaaccctgcctcaccacatcatcagccctcagcttccgtcccagccccggccaagtgatcttcctctctgttcccatgactctgggaaatcaggtccagactacataaaggattatttacccaaaattcatcagcacacctcctatgtaggagaacagcatctggcgttttatttaaaagggaaaaaaacaacacaanacccttgngcaaggaatttctcctttcccccaaaanggaaatatttatggaggcctgcctcaaatagaagcttgccagcaaaatataaacatgagtacgtcggtgaaattggttggagaataccacagtataattttatcaacaaatcaagactggagagtggctttcatatcaaggcaaccaaaacctcatgtcctggatatgcaaggaaaacagagtcgcgcttcttttgcctggcatatgagtgctttcgaggacactgatcagagaaattccaaatgggctattcttgttaggcagtgtaagtcatcattgccaagagcttccaaaccacctaagctgccgaagctaccaaaaaaggaaaagaaaaggaaacattaacctctaaatcagcataactcaacctgcttttagaaggagaaactgcctactactgtataacaaaaaataagatcataataatccacaagtgcttctcatattgccccaggacagatgtcttgcaagagtacgcttcagcttaaagcccaa

SEQ ID NO: 16906 - DNA, 803 bp, Homo sapiens
  misc_feature (396)..(396): n is a, c, g, or t
  misc_feature (398)..(399): n is a, c, g, or t
  misc_feature (409)..(409): n is a, c, g, or t
  misc_feature (411)..(411): n is a, c, g, or t
  misc_feature (414)..(415): n is a, c, g, or t
  misc_feature (418)..(421): n is a, c, g, or t
  misc_feature (424)..(425): n is a, c, g, or t
  misc_feature (427)..(427): n is a, c, g, or t
  misc_feature (430)..(432): n is a, c, g, or t
  misc_feature (437)..(438): n is a, c, g, or t
  misc_feature (441)..(441): n is a, c, g, or t
  misc_feature (445)..(445): n is a, c, g, or t
  misc_feature (448)..(448): n is a, c, g, or t
ctccttgtcccttgtctagatcctagtcattctctacaacacagttcaaacatcgctgcctcaaggaaaccctgcctcaccacatcatcagccctcagcttccgtcccagccccggccaagtgatcttcctctctgttcccatgactctgggaaatcaggtccagactacataaaggattatttacccaaaattcatcagcacacctcctatgtaggagaacagcatctggcgttagaaaaaactggagatctcagatatttatggaggcctgcctcaaatagaagcttgccagcaaaatataaacatgagtacgtcggtgaaattggttggagaataccacagtataattttatcaacaaatcaagactggagagtggctttcatatcaagatgnannactaagtagncntcnnttnnnncannanccnnnagatnncanaacncangcaaccaaaacctcatgtcctggatatgcaaggaaaacagagtcgcgcttcttttgcctggcatatgagtgctttcgaggacactgatcagagaaattccaaatgggctattcttgttaggcagtgtaagtcatcattgccaagagcttccaaaccacctaagctgccgaagctaccaaaaaaggaaaagaaaaggaaacattaacctctaaatcagcataactcaacctgcttttagaaggagaaactgcctactactgtataacaaaaaataagatcataataatccacaagtgcttctcatattgccccaggacagatgtcttgcaagagtacgcttcagcttaaagcccaa

SEQ ID NO: 16907 - DNA, 836 bp, Homo sapiens
ccaagtgattgttttatgtttattctgttttgggttgaactatagtttgcttggagaaaataatgtctgttaaatttgcgttagaggataattgtttactgagccaaataatctttcttgtgagaacctattctgggtttcccctgggccctctgctgtggtttcggcgggagttggtttgtgtggattttcaggactgctgacttgatcagacaggcacaacacagtcccggccctcaggcaggccttctccctggtctgatgctgaactgcatggcgtctgttcagatgaagattcttttgccacctccttaaatgaaagaacgatactgaatgtggcttagaaacagctttgccagccgtgcagaatgattgtaagtagtggttgcccgaaaagtatttgcttggaataccactcactgataacactggtgaacctggaaggaattatacggagtgaaaaaaggcaccactcactgataacacgaatgaacctggaaggaattatacggagtgaaaaaaggctccgctcactgataacgcgggtgaacctggaaggaattacacggagtgaaaaaagaccctgctcactggtaaggcgggtgaacccagaaggaattacacagagtggaaaaaagactccgctcactgataacgcgggtgaacccagaaggaattacacggagtggaaaaaaggccccgctcactgataacgcgggtgaacccagaaggaattatacggagtgaaaaaaggccgagctgaaagatcacatgccgtatgattttttttttatacagcattctctaaagacaaaaattaaagagatggaacacag

SEQ ID NO: 16908 - DNA, 497 bp, Homo sapiens
gccacactcgtgttggttgttggttgtttaatcctcctgacaacctattaacacggcttctcttcactatcagcaaccccattctgcagccgggaaaactaaggccacacggatcacaaaatgcaagagctgagatacaaacccagagctagctgaccgtagagtgcaggttctcccaacggctgtgtgtgcctactcaccctgcccgacccctgctcccatgcacacacacacacttcctccatgctccaggctgtggctgcaatgaattcttcttaacctatccatcttttgtgccagatacatgcagtacctacaccccaccccccgcctttttttttttttgacacagagtctcactctgtcgcccaggctggagtacagtggtgtgatctcgactcaatgcaacctccacctcccaggctgaggaaggagaatcgcttgaacccaggaggcgagattgcagtgggtggagattgcgccattgcactacagcc

SEQ ID NO: 16909 - DNA, 419 bp, Homo sapiens
ttcacataaccatatctaaagaaatctatagattcccaacatatgtaattaaaaaataatgtgtaagatagtataagcatcaacagatcagatttttaatcttggaacttcgtaaagtctacaaattgtcattcagcaaatttctcagttctttggctttaaattatttcttttaataaaaaaaattgtttaagagacgctgggtgccaggtatggggatggcactgtaatttaaaaagggtgatcaggaagacctcgttgaaaagtgtcacttcttttttttttttaatgtataattatcattttatttgtaattgttaattacaagtaaaaatgaaattataaataagtaaatcatactccttaatggcataaataaaaagtgcctcgcttaaattaataaaattttcctgaccata

SEQ ID NO: 16910 - DNA, 522 bp, Homo sapiens
gaaattgtttcttaaattgcaataggacaccaagatttttctcaaggttcaagagaaaacttttctgttttgagaagtttgaaaactaaaacaaagaaagcattcatatgataagagaagaaagtgagaagacacgagtcctctgtcctcttagccaggctctaatgggttcagcccatggaggtaggaattagaaaacatcatagaccatatcgacttgaactgcttagaaattcagccacagattttctgaagcgtgagaacggactaatacaaaaaatcacttttgttatgcattagcaaagaacttggaggcattttgcccatgccttatggatctttggaactttgaacttaagagtgatggattagggtatctggtagaagaaatttctaaggagcaactgattcaagatgtggccaggctgcttctaaaagcctatattcgtatgtgcgagcaaaaaatgacctgaaactggaacttatatttaaaagaaaaacagagtgtaaaagattggacaa

SEQ ID NO: 16911 - DNA, 378 bp, Homo sapiens
actaacaaaaggagatgaagcctccaaataaatacttttttaaggacttggaatttatatcagtcggacataggttcttgtttttttaaccctaagcttatgtattcccttagttttgaggaatttcccctcactgtgagttttgggggatgatgaaataggaaaaaagttgtattgtatttctacttaaagaggaaagaaacaactagtgttagttaaataatggtaaatagatgcttttcaggtttctgttcctcactccaatctcctgattctagaatgcccgtaaaaattttataatcttactctcaagatacattctaccagggtgggcaattgttaaagtgttttatttactttttaacctttgggcccttt

SEQ ID NO: 16912 - DNA, 377 bp, Homo sapiens
caggaaggaatgttgggtcctaacgcatgcttaaaatgtctatttctcatctttaacagttcagtatcaggcgcactgggcacaatagcccaccacaggtactgttaacccatggcctgatctggctcaggtcagaagaacaggacatgtttccccctcctactctactctcaatgataattagctcggtccggctctaagttccttccagatcctcgccggcgccttccctgcccacacgcgccttcctctgcgagcggcaggacccaggagctggagcccgcgtgccagggacagacgcccgagatgattaggttgggggcgcggcagcccagcgccctggagtgcaccaagacccccgactcctcacccccgag

SEQ ID NO: 16913 - DNA, 591 bp, Homo sapiens
gttagagcaggaagaagttctcaccccgtagtagggaagcatcaacacgagactaaatacagttcaggtcccaccaaacaccactgaataacaagacccagagccagatgtgggggctcacacctgtaatcccagaactttgggaagccaaggcaggcagaccagttgagcccaggaggtcgagactagcctgagcaacacggtgaaaccccatctctacaaaaatccaaaaagtcgccaatgtggtgatgcgtgcctgtggccccagctattggggaggctgaggtgggagaatcacttgagcccagggggccgagactgcagagagccaagatcacaccactacactccagcccgtgcgacacagtgagaccctgcctgaaaaaaaaggaccacacagtttccaagtaacttaatcacattcgagaaacaaatgcaaagatatgtataggtttacaaaaatatccagcaccaaacaaggtagaatacaaaatattgaatatccgggaaaaacaaaaaacaaaaaaacaggcatgtccccgtacatcgttagaagcttgaattcgagcagtagtagtagtaggcggccgc

SEQ ID NO: 16914 - DNA, 399 bp, Homo sapiens
agtttccaagtaacttaatcacattcgagaaacaaatgcaaagatatgtataggtttacaaaaatatccagcaccaaacaaggtagaatacaaaatattgaatatccgggaaaaacaaaaaacaaaaaaacaggcatgaaaagaggcaggacattatgacccatatggagagatgggaaaaatcaatcaaaattgacctggggccgggcacagtggctcacgcctgtaatcccagcactctgggaggccgaggagggcgaatcacttcagaccagaagttcacaaccagcctggacaacatggtgaaaccccatctctactaaaaataaaaaaactagccaggcgtggtggcaggcaacctgtagccccagttactcagaaggctgaggcaggagaatc

SEQ ID NO: 16915 - DNA, 775 bp, Homo sapiens
aatatgaaatggtacagccattatggaaaagtgtggtgattcctcataaaattaaaatggaaataccatgatccagcaatcccagtcgacatatatactcaaaaaaattaaaagcagggtcttgaagagatacttgtgttccatggtgatagcagccattgttcacaatagctaaaacatagaagcagcccaatcggccatcagtagatgaatggataagcaaaatgtagtatatccatgcaatggaatattattccacttcaaggaagaaaattctgacactggctacagcatgaatgaaccttgaggacgttatgcagttttacaggatgagttatggagctggatagtggtgatggtggcacattaaggatgtatttaatactgttcttaaatggtacacttaaaaatggtaaattttatgtgtattttacaatctttttttaaattgaagaaaaatcctgtagataaattagaaaattcttcccttcataggtttatctgcatttgattctcccatacttgtacaaggatttatttgtattcaaatggacaaattacgcaataggaaatatttgaaaatatttatcatgggtaattgctattttcattgacttcctaagattttatgtaataatcatttgagtcaatattggtagctaatgtactaatctaatattgaaatcagattgatatctttgttacttaaagataatttgattggatcagcagttatttcaaattgattaaacaaaaaattataaaacacctagtt

SEQ ID NO: 16916 - DNA, 423 bp, Homo sapiens
gaaaaaaccccacacatttggtcacagaagtcttctgtgttgattactgtggtgttagagtaaaggaaaaacacagtttgagagtttttctgtaacagtagttatagaaatgggatacaagtcctggacttctgactctaacacctaaatattacagggaagcaatataatacttcaaagcacaagcttattagtcagaaatacttgacaggtttgactctcaggtcctccatttcctacctatataatcttttttcttggattgtttcttaaactttcttttgttactataaaattccccaaacaaaaagaaatgctaatcattccattatcaaccacaacggttctcaacacggaatatcaaaatcacctataaagccttcccaaataaacatataccagaggtagggtatacaaacagtg

SEQ ID NO: 16917 - DNA, 472 bp, Homo sapiens
gtcatgtattctactgtgtttaatttgaccaaatattgatagattgctccaaaatatggtagttttactgaggggtgtgtgccttgtgctgaagatggatacagggatgaggtggaccgtggaggccctggcagcagatgagagagagtcagggacatctcaacagatgaggccaaactgcataaggaagaggctgggtgtggtggcttaggcctatacaaccagcactttgggaggctgaggcgggtggatcacttgaggtcagagttcgagaccagcctgaccaacatggcgaaaccctgtctctactaaaaagacaaaaattagctgggcgttatggcaccggcctgtagtcccagctacttgggaggttgaggcaggagaatcgctggaaccccggaggcagaggttgcagtgagccgagatggccccactgcactccagcctgggcgacagagtgagactctgtctc

SEQ ID NO: 16918 - DNA, 570 bp, Homo sapiens
aataatattgagtaatttctagttagacgctgtaaacctgtgctattacggatttctcttcttcccatttttacagggctgctcgctccactgtctgtgaccttttgcagggattttgttcctctaaatcttaaatgttgcagttggcttaggtcggagagcaatcagggaatcaggaagccttctaaacctattattacaaattgcatctataaagaaagattaagaaagattgttgtctctggctcacactatcgattaaacacacatatacgctctgtccagtagcagatactgtgctcccaaggtcggcattgcctgggtgggaaatggctcaaacacaatccagggaagctctctatgatatgtgtttgacatccccctctagtttctttgtgtgtgtgtgttttatacatatcacaagcttactggtaatggtaacatttgccttgcccagcgagcaagacccactggtttttgagaaagtgggtccaaagatttctgtaggccttgtaggcctgattaaggttcatttttcatctattaattctcattatttggaaaaaaaaa

SEQ ID NO: 16919 - DNA, 211 bp, Homo sapiens
aggtgacacatgaaagcacagagtgggtggcagttcaagcctgcgagggccgagcctttccactgctgcagctgttagtggctggcacagggcaggatggcagacctagtgcagcacaaacaaaccacgcagtcagccagctctccagccaactgtgtctacttctaaagtagaagttagacaaaacatggggttcacttagactggggtc

SEQ ID NO: 16920 - DNA, 202 bp, Homo sapiens
ccctttagatggctttaggttggcattctctttcatgagaatcacattaaaagtacaggaaatacttgtgcattctttcttttcataaactgtgaatgtgggccatttgtaatgtagctacctcttcttgaggactcatctcagtggccaatggacaacagccttatacctttaggctctaactgttctaggcatgaatcca

SEQ ID NO: 16921 - DNA, 2920 bp, Homo sapiens
  misc_feature (1433)..(1433): n is a, c, g, or t
  misc_feature (1532)..(1532): n is a, c, g, or t
  misc_feature (1611)..(1611): n is a, c, g, or t
aataacataatcaaagaggaaaaaccagcattggtgaattcatcccttcctttcaacttggcctctctcacccactttacttttagtgcagagttcagtgatggctagcagctgtcccctgatatttgttattccaagtatccattcataggtctggggagaggttgtggcaagctttccctaaataaatcacacccttatcttctaagcttgagcagtggagggagacttttcattcgaggtgggtggctgaacatcatcattcctgttctggacttcttgtaatcatgttggattcagagggcaccactctctcttgtacagatctgacctaacatagacatagactatagcagagatgaatccaggctataacatttaacaagaccttattaaaagcttcaagatgttagcctttatctgttccatatctagcttacttggttgtttttgggggatcacatgtctgtcctccaaactggaaacgtctaactctccaggagatgcagtagcattatttgttggacagtggcacctactggtagtttgtaatgtttatagcctagtgtgaaaggcattgtaaatgtatacctagcaaaaaggggagtagagcaaaatttccagagttttacaaatgaaatgaaggatgatatgggggagagtcctttggggccaaggagagagagcacagactagaaagtaatacaagcagaaagaaggatgtcagcccatgtctgtgtggtagaggtcatctttccatctcactgggattgtccctgaaagtgtctcactgcttaggtctccttgcctgtctaaggcttggagaccttccagtatctcatgccttattctagatctgcttttttccccgaggtgaaaaaacctgttcaaatggtcactcacaacttttgtggccttactttttgtctccgaaaggacaaacatatcagaactaacatccacccagaagaagggctgatcagttcctttcaacacagcatggatgaaaacccaggttagcgttagtgcttcttgaattggaagtattctaacctctatgtacctaccaatgtaagaactgagggcccttttaagggaacttacattcctaaagttcaagtcaagttgtcatgaagagtacttaatgaggcatacttttaatctttgaatcgtagtgttgtagggctaaaagaaacctcaggccaggctgcatggtggctcacgcctgtaatcccagtactttgggagaccaaggcaggctgatcacctaaggccagtaatttgagaccagcccaaccaacctggtgaaaccctgtctccactaaaaatacaaaattagcctggtgtggtgatgcatgcgtgtaatcctaactactcgggaggctaaggcagaagaattgtttgaacccgggaggcggaggtttcagtgagcngagatcatgccattgcactccagcctgggtgacaggagccaaactccgtctcaaaaaaaaaaaaaaaaaaaaaaaaaattagccaggcgtggtggtagncgcctgttgtcccagctgctggggaggctgaggcaggataattgcttgaacctgggaggcagaggttgcagtgagccgngattgtgccactgcactccagcttgggtgacagagccagactgtctcaaaagaaaaaaagcaaaaaagaaaaaacagaaaagaaacctcagagatctgtcattttccacctattacattcattttatgatacagaaatggtcattcagttgcagatagtacatgactgttgggatcaggcccccaaatctggccataaactggcccccaaactggccataaacaaaatccctgcagcaccgtgacctgtttgtgatggccatgacacccatgctgaagattgtgggtttaccggaatgagggcaaggaacacctggcccacccagggtggaaaaccgcttaaaggcgttcctgaaccacagacaatagcatgagcgatctgtgccttaagggcttgctcctgctgctgataactagccagacccatccctttatttcggcccatccctttgtttcccgtaaggaatacttttagttaatctatcatctatagaaagaatgcttatcactggcttgctgtcagtaaatatgtgggtgaatgtctgtttgaggctctcagctctgaaggccgtgagacccctgatttcccactccacactatatttctgtgtgtgtctttaattcctctagtgctgctgtgttaaggtctccgtgaccgagctggtcttagcacgtgacttttctcgggtgatagctttaatagtatcagcagagcagggaacagaatctagtttaatgtgtcctaatccagtggttttttttaaccacaaaatactgcctttgagaaaaggccaggccagcagagtcagaagttgagcctgggatttgcatagtcacaaggtctttcttgcaaaccatttctactgtagtttattgtgtttttctgtttttgttttttgggttaaaatgcatcgatttttatgctgacagtttgtgagagttactgggaagtattctatgctaattttgctagagtttgaaaagaacttaaaggataattgtgtctatctttgagaagataacatgaacttttacatgtttttgacaatttttattcattctgcttttattacaagtgtgagatgaggttttcttcctaggatactctctgaggcacttttgaaaatacttttgttggctgggcacagtggctcacgcctgtaatcctagcactttgggaggctgaggtgggtggatcacctgaggtcaggagttcaggaccatcctggccaacctggtgaaaccctgcctcaggctccccagtagctgagactacaggcacacgccaccatgcccagctaatttttgta

SEQ ID NO: 16922 - DNA, 336 bp, Homo sapiens
tgtccacagagcatctagaggtgacctcttcatgtgactggggcttatcacaatatgacatcagtatctgaatggatatactatgagaggtattatccttagagctaggtgaaagctggatgccttattctcacctaacttccaaaataatgcattatcatttgatcatattctattgattacaagaagttataagccctgctcagattcaacaagaaaggattttgatgaagggaacagagtggaagagtgtattagttgggagatactgtgatggtggctaaattttgaaaatataatctgtcacacacatggtatatgcagaggaatataaat

SEQ ID NO: 16923 - DNA, 2464 bp, Homo sapiens
  misc_feature (105)..(105): n is a, c, g, or t
ttagaaatgtttttcttttcccagaattgtgtgagtttgttttgaagccttgaataccggtacatggttaacaggcagcttgtgcccaatcccaaagcgggaagnaaggcctggctttggctcactgatgataaagtctcctcccactgcctttcagcagctctgccgaagagctgatcaagatgctgcaaacccagcttccccagaccggccaagagggaagaatgatgagcgtgttttaaattacaaagagagagcagcgcaggcagtttctggtctgggtgataaattgaaatccataaatatagcagtgctaatttgaagttccgtaattgtttgtgccatgagaatgtgtacatttgaaaggattttataaagcaattactagaaatgcctcccttgagagctgtatgactggaggtgttttcagtctgaggggggcagcataaacccaaacctcttctagatgaatggcagggtggcgggaggggtcatgaaatcatggggaagaggtgaaggatttgagagctactaacctgacatctaactgaatgcctaagaaattgcagggcaatttcaggaaataggaaaaataattttgaaaacattcaaagcctccagactttcggtgtgtgactgatcttttttctaatctctttaaacttctttccacctattgccttaatagcaggtgcttcctcttagggtccccccaaattatttacctcgagttccctaatgaaattactttgcattaatttgtcataaagggagaagtgctagaaataccgaggcattgataatttcatggagtagcaatgaatgtcagtcacagtttcctctccccgttgcccggggctgtgccttcaaagcaggtgacagactgcaaggtgtaaacaagctttataatgccatataaatcaaaccgggctcattttacctaacaacagaaccatgtttgtttgcttttttgtaaaatggactacttcagtgaaaaattgattccacgtagttctaataactctgtgaccttggacattggctttttatagacacagctcttcccacctgctggtatggacaccagtttgtacagactgttgtcacacaccctggctcaaagtcaaaagagaattttaattactcatcaagctgccaaattctactaattgcccccttgtcagcatatttcattaattgctgaaaggtaaatgagttacatattttgtttggaccacgtcacctgtacattttcaaagcctcggattgtttatcttgcaaggagagaaggggcctcttctccacagatgcagctcaaattagcaaaactgaactgtagagtttcaggcctttcccttccttaaaatgctgatagatttctagaccagactttgatatttattggcttcttggtcttgctgtttaaacacacccattgccctttctttcttaggccctgtaagcaaagctggagtagcgtcttgggaaaaggccaactgaccaccctaattttgtcgttccaagtctgcagagcgcacatattaagtagttgttaactgacatctttaggctccgtgagtgaaatgcagcaagcctgcccccagcagcctgtgggctaatcctgagctgttccttcgtttaggtacacaggtgaccctgaagttcccactcggccctctgttttctgagtcctgtctcctctgtagcacagtggggattgttctgaaccgtggcacgccttcttggcgaggcaggctctcttatggaaccatagtctgttacctcatttcttccaactgctctgtcccctaaatgtgtgttcccaggtgcagtgcagcaagggtgctcgctgttggcctttgagagtggaggtggctgtatcggagtgtgctccccctactttttcccttgccccgagtggcagttcttttcctctctgttgccggatgctgtctagggcctgttagttgctatttccttgcctccgctccccttcccactagccttctaactaccttttattctcggctccaactctttcaatgatgaggtgaatgctttttctgttccacgtcactgcaaagtcaaggtgtccagcatgctctcacttataactgcctcacccgatctcacgcacagtgcgagagctgaaggtaagccccggatgttgccagattacggtggacaaataaaaaacaactctccaacagcaactcacaaatgcatgaaatgttttaacctctagacagactgccagaatttctctcttctaattcctacttgtagtgataacatttttctttttgtgatttttttttttaaataatagtgtagtaccttgaaacaactgcagttctaactcattgtcaccatttctgtttgacacgttccacttcctttgcaattattgtatttagttgtgcactagtgtcaataaaattgacatttgtgaagcaaaaaaaag

SEQ ID NO: 16924 - DNA, 2408 bp, Homo sapiens
  misc_feature (5)..(5): n is a, c, g, or t
  misc_feature (16)..(16): n is a, c, g, or t
  misc_feature (45)..(45): n is a, c, g, or t
  misc_feature (61)..(61): n is a, c, g, or t
  misc_feature (113)..(113): n is a, c, g, or t
  misc_feature (120)..(120): n is a, c, g, or t
  misc_feature (235)..(235): n is a, c, g, or t
taaancccaaaattancccttcaagagtggcccaacataaccccnaagagccctctgggangttaagaattacggcccctaaaagtcggcaccacaagttgcaaacctgctgnccccagncctctgtttgtccacctaaatacctaaattccaacccttatctccctatttgaaggagaaagtaagatccttcccacatccttggcttgaaaagcaaatagtcaagttttccaancccgccaagcttggcacgagtgctaatttgaagttccgtaattgtttgtgccatgagaatgtgtacatttgaaaggattttataaagcaattactagaaatgcctcccttgagagctgtatgactggaggtgttttcagtctgaggggggcagcataaacccaaacctcttctagatgaatggcagggtggcgggaggggtcatgaaatcatggggaagaggtgaaggatttgagagctactaacctgacatctaactgaatgcctaagaaattgcagggcaatttcaggaaataggaaaaataattttgaaaacattcaaagcctccagactttcggtgtgtgactgatcttttttctaatctctttaaacttctttccacctattgccttaatagcaggtgcttcctcttagggtccccccaaattatttacctcgagttccctaatgaaattactttgcattaatttgtcataaagggagaagtgctagaaataccgaggcattgataatttcatggagtagcaatgaatgtcagtcacagtttcctctccccgttgcccggggctgtgccttcaaagcaggtgacagactgcaaggtgtaaacaagctttataatgccatataaatcaaaccgggctcattttacctaacaacagaaccatgtttgtttgcttttttgtaaaatggactacttcagtgaaaaattgattccacgtagttctaataactctgtgaccttggacattggctttttatagacacagctcttcccacctgctggtatggacaccagtttgtacagactgttgtcacacaccctggctcaaagtcaaaagagaattttaattactcatcaagctgccaaattctactaattgcccccttgtcagcatatttcattaattgctgaaaggtaaatgagttacatattttgtttggaccacgtcacctgtacattttcaaagcctcggattgtttatcttgcaaggagagaaggggcctcttctccacagatgcagctcaaattagcaaaactgaactgtagagtttcaggcctttcccttccttaaaatgctgatagatttctagaccagactttgatatttattggcttcttggtcttgctgtttaaacacacccattgccctttctttcttaggccctgtaagcaaagctggagtagcgtcttgggaaaaggccaactgaccaccctaattttgtcgttccaagtctgcagagcgcacatattaagtagttgttaactgacatctttaggctccgtgagtgaaatgcagcaagcctgcccccagcagcctgtgggctaatcctgagctgttccttcgtttaggtacacaggtgaccctgaagttcccactcggccctctgttttctgagtcctgtctcctctgtagcacagtggggattgttctgaaccgtggcacgccttcttggcgaggcaggctctcttatggaaccatagtctgttacctcatttcttccaactgctctgtcccctaaatgtgtgttcccaggtgcagtgcagcaagggtgctcgctgttggcctttgagagtggaggtggctgtatcggagtgtgctccccctactttttcccttgccccgagtggcagttcttttcctctctgttgccggatgctgtctagggcctgttagttgctatttccttgcctccgctccccttcccactagccttctaactaccttttattctcggctccaactctttcaatgatgaggtgaatgctttttctgttccacgtcactgcaaagtcaaggtgtccagcatgctctcacttataactgcctcacccgatctcacgcacagtgcgagagctgaaggtaagccccggatgttgccagattacggtggacaaataaaaaacaactctccaacagcaactcacaaatgcatgaaatgttttaacctctagacagactgccagaatttctctcttctaattcctacttgtagtgataacatttttctttttgtgatttttttttttaaataatagtgtagtaccttgaaacaactgcagttctaactcattgtcaccatttctgtttgacacgttccacttcctttgcaattattgtatttagttgtgcactagtgtcaataaaattgacatttgtgaagcaaaaaaaag

SEQ ID NO: 16925 - DNA, 691 bp, Homo sapiens
atatctatatatagatattcacaccaaaacattcgtaacaaaacaagaaatacaacaattacagtcctcgtttctgtagctggtcacatggtggttgctggtattcatggttgcctctttccactacccattctgtattccctttgcactcatctcgcaagctgatcgtggtttacctggtggggtgacccaaaccttcattcttcaggggtgtgggccattcatagtcctgtatggattgttgtcatttttatcgactgtaatcacagggcagggtacagagatgtcctaagggatctccttaagccagacatactcctccttacctccattgtgtagcagttccagttcctcttgggcaggatcaattaccccagccaacactgtaactcccttccttgcctattgattcagaggtgtgaggagcccaaagtggctgggtggctgtcttaacttccagttcagtggaatgattgtaatttttcatcctctaaataatgagtagggatacatttattctaaaatgcatattatgaatattatgcagcagattcattcaccttgtgataaagtgaaatagggtgttaagcagaaataacatgcagatatcttttatcatcaaattagggagcaagattctctgatgcagtattcctcagtcttaaaccctgtattgatgccttttcatgaa

SEQ ID NO: 16926 - DNA, 905 bp, Homo sapiens
atcagggcacagggcagggcaggagcaagagcctcaggcctctccagaagaaatcagcctgtctgggtgctgttctcagctggggttgctgggaaagagtgagggatgtctgctgtacagaaaacatcagcctggaagactgcttatgaatccacctgctgccacttgctgccacggttcctattctcacctggcctgcgtcaattcagttaaaccaagtccatccttcatgcagttttcctgcacaaagtgacttccgtgggtacccccagctccttgcacatcttctgtgatggacttgaaattccagggcagctttttcttctaccagtatacccgtgactttccccctactgcccacctggtagggactcaaggaaagagaagtaacttaaatattagctcaggaaaacaagcagaaatataaatcctcccaccttcaagttaaattcaacacaggtgtcttttaggttatcctctatagcatatatgcctgggctactttccattgttggtaattgataacttggtacaatgtatatttactaagcctaaaaagaaaagaaaaactcaaaaaagggggcaaagtataaaatgtttccagagattccattcccttttgctgctggtgcttgggattggggatggaggagttctaaccaagagcaaacggcttcgctttggaaactgttgggtggccctaaattttagagtccaaaacagtgggtcttaaactgtaggttgcattagaatgacctggaagactcgttaaaatacagattcctgggccccactctcaaagtttctgactcattaggtctgggggagaacccaataattcacatttcttacacgttcccacatgacgttgaggctgcttgctctgagactacacactttaagaa

SEQ ID NO: 16927 - DNA, 286 bp, Homo sapiens
ccttgaagacattatggtaagtggaaaaagtcactcacaaaagtacaaatattgtatgattccatatctgtggagtacctagagtaatccaactcatagagaacagtggttgccagggactgggagagggagtaacagggagttagtgtttaatgggattggaatttcagtttaggaagatgaaacagttctagagatggacgatggtgatggttgtacaacaatgtgattatacttaatgcaacagaactttacacttaaaatgataaaaatgctaaatcttgtg

SEQ ID NO: 16928 - DNA, 511 bp, Homo sapiens
ccaccatcatgtatgtggtctgtcattgatcaaaacatcattatgtggcacatgactgtagtttaacacctaatatcttaataagatctcatctgcccagtggaagaggatgccaaggtaatacagaaaaggatctagctatagctgaaattatcctaaattagaaaaacaaacaaactattaacctttgagagataattatttaaggtacatagaatatcatgttctctatctgtgtgactttgtatgtcttggggcaagacactcagcttctggcgttttaaccaccttatctgcaaattaaacatttttgctctctgaagagtttactacctgccctcttagggatcccttcaacatgtaggaactgtgattctgtagtatataaaagagcagagaggaactttagtttaaacctggcacctttagtgcaagcatttagctctgttccctcctaaaattccactgcaaggacaacaagggcagttagataaaccctcaaagaataaga

SEQ ID NO: 16929 - DNA, 246 bp, Homo sapiens
  misc_feature (196)..(196): n is a, c, g, or t
aacttagccaggtgtggtggctcacacctgtagtctcagctacttgggaggatgaggtggggggattacttgagcctgggaggttgaggctgcagtcagctgtgatggcaccactgacctccagcctggggacacagcaagtgtccgctattccccactgcaaaaaattaaaagtgtgtaaactaggataaaatantttgcaactcataggattgacaaagggttactatctttactatttattga

SEQ ID NO: 16930 - DNA, 417 bp, Homo sapiens
ccagcctgggtgacagtgagactgtctcaaaaaaaagaaaagaaaacccacaaaacccacaaaatatcccccacaaccaaatatataactagaacctcctcatatatttggaaattaagaaatacgctgctaggcgggcatggtggctcatgcctgtaatcccagcacttcaggaggccaagtcgggaggatcttgagttcaggagcttgagaccagcctgagcaacatagcaagaccctctcaacaaaacatgtaacacaatttagccaggtgtggtggcatgttcctctagttccagctacttcggaggctgaagtgggaagatcgcttgagcctaagagttggaggctgcagtcagccctgattgcaccactgcactccagcttggctgacacagcaagaccctgtctctaaaa

SEQ ID NO: 16931 - DNA, 457 bp, Homo sapiens
ccgccacctcctggcacaccccatttggtctctgtccactcctgtcacctgctgtttttgaagcaaattttggaattgtgtcattttatttgtcagtatttcagtatgtaaagtccatagagatacggagttcgaaaaagttttaaatgttattatgaaaattttaggctgggcacggtgtctcacgtctgtaatcccagcactttgggagccaaggcgggtggatcgcatgagcccaggagttcgagaccagcctgagcagtgtggtgaaaccccatctctacaaaaaagtgcaaaaattagctgggcgtggtggttcatgtctgtagtcccagttacttgggaggctgagtaggaggatcgattgtcctgggtgattgaggctatagtgagctgtgattgcactactgcactccagtgtgggcagcagagccagaccctgtctcagcaaaaaaaa

SEQ ID NO: 16932 - DNA, 405 bp, Homo sapiens
tgcatgaccgcgctgtggggcccaaggcttgcccttgcccgccagctgtgcacagaccctgggcctctgtcatggtgggggctgtgtgtgtataggcgtgtgcatgtgtgatgtggcacgtttattttaagcaaaagccatgtttttctgtgtgccccatgccaggcctcacgtgagcaggtgaacagttagacacccgaaaggcccaggctggagtgcagtggtgccatcacggctcactgcagtcttgacctccaagggcccaggaaatcctcccacctcattacttgggaggctgagtaggaggatcgattgtcctgggtgattgaggctatagtgagctgtgattgcactactgcactccagtgtgggcagcagagccagaccctgtctcagcaaaaaaaa

SEQ ID NO: 16933 - DNA, 375 bp, Homo sapiens
tgcatgaccgcgctgtggggcccaaggcttgcccttgcccgccagctgtgcacagaccctgggcctctgtcatggtgggggctgtgtgtgtataggcgtgtgcatgtgtgatgtggcacgtttattttaagcaaaagccatgtttttctgtgtgccccatgccaggcctcacgtgagcaggtgaacagttagacacccgaaaggcccaggctggagtgcagtggtgccatcacggctcactgcagtcttgacctccaagggcccaggaaatcctcccacctcagtcccccaagtagctgggactacaggcgcacgccactatgcccttgtattttttgtagagacagggtttcactatgttgccaaggctggtct

SEQ ID NO: 16934 - DNA, 415 bp, Homo sapiens
gggggatctgccaccattctgtttggctcttttggtttgtatgttcctttcagacttgatgagctttcacatttgtttcaactcagattaaacagctcacactgtttcatcattttaaatgctgtaaaacaaggccaggtgcggtggctcacacctgtaaccctaacactttgggaggccaaggtggacggatcacctgaggtcaggaattctagaccagcctggccaacatggtgaaaccccatctctactaaaaatacaaaaattagtggggtgtggtggcacacgcctgtaatcccagctacccaggaggctgaggcaggagagtctctggtaccaggaagcagaggctgcagtgagccaaaatcgcgcctctgcactacaacctggggacagagggagactctgtcacaca

SEQ ID NO: 16935 - DNA, 346 bp, Homo sapiens
tgttcaatctcattagggattgggaaaatctaagttgaaataaaaatgagataacaattccagctgggtgcagtggcccacacctgtaatcccagcactttgggaggctgaggtgggtggatcacctgaggtcaggagtttgagaccagcctggccaacattgtgaaagcccgtacctactaaagatacacaaaattggccaggtgtggtggcgggcacctgtaatcccagctactcgggaggctgaggcaggagaattgcttgaacccaggaggcagaggttgcagtgagccaagattgcaccattgcactccagcctgggtgacaagagcgaaactccatctca

SEQ ID NO: 16936 - DNA, 489 bp, Homo sapiens
cttataacctcttcatctcttaatgaagagtaaagaccctggtctaggacacctctgcatggtgccagagcccctttaacctttcactccaaacatatcctgagcataagcccatggagaaaaggatagacagtgaacactaaagaggcagagaagccaaaaatcactgcagacttagtttttccatttcctttgctctcactggatgtgtccccacccaacattcccaggtttctgcctttactcagatgcgacccctctgctgcagtgccaaagagctgagagcccctgttccaacccgggagatcctgttcccctcgtaccactgttcactctggcctgggctggggtctctgggtttatgcctcctcttaccctggttttggagacccttgcactgggtttcagaccctgttatctaaggacacattaggtacctcctttccagctgtcctccgccccagctcttcctttccagctgtcctctgc

SEQ ID NO: 16937 - DNA, 421 bp, Homo sapiens
aaatgatctgtttgctcagcactgatttctgagaaactgtggtctgagtgaatgagatattggcccaaaaatatactgtattaaatcagtttctattttctattattgacttgttggattttcctgggaatttgtatttctggggattctctagggatatttagctctaagtagatccttatgggcttttaaccaagtgactcagagtgaatgtttcagcaagaatagtgtctgagataagcaggagttggaaatgccctggattaagctatctatttaatcttgtggttaactttcaaaaagagggggagccatggctggatcacagaatcctttgagtatctgagaaagacagtaggttttctccctatatacagagagaaattagcttgtaacttcaagatattcagggaccctgcga

SEQ ID NO: 16938 - DNA, 499 bp, Homo sapiens
acaaaaaagtgggaaacttactgtaatagatgtcaagatatattgtgaaagcttcactaattacgacgttggtatagatgtgtacagatagaccaatagatcaatggaacagaatagagtccagaaacaaacctgtgtctatatagatacttgatttatgacaaaggtggcattggagggcagtttcaaaagaacagtcatttcaataaagagtactgagtcagctggacatctgaatataaaaaaagagaagcctgatccttatttaaccccatacacaaaaatccattccaggagaattacaaatctgtatgtgaaagacgaaacaataaaacttttagaagataatactatagaatatctttatgaccttggctttagacatagtattaattataactgaaaagcttaataattaaacaattaaaaggaagaactttatcataatatgcccttaagacagtgaaagggcagattacagtgtgggaagatatttgca

SEQ ID NO: 16939 - DNA, 352 bp, Homo sapiens
caaactggtatgaataacattttgttatgcaaatgggcttaagagagattagatgattggtcctaggctagataagtaataaatagtagagctaagattatagccatgatcggccgggcgctggtggctcacgcctgtaatcccagtgctttgggaggctgaggtgggtggatcatgaggtcgaaagatcgagaccatcctggccaacattgtgaaaccccatctctactaaaaatacaaacattagctgggcgtggtggcacgcacctgtggtcccagctacttgggaggctgaggcaggagaatcgcttgaacccgggaggcagaggttgcagtgagccgagatcgcacc

SEQ ID NO: 16940 - DNA, 306 bp, Homo sapiens
ggggttagttttaaaagaaaaggaaaatgtgctaagtagaatggctaaattataaatttaatcaaacctgcaatttaaataagcccccaataataataggctgaaagcttgtcaggctgtgttggctctggttcattttacatggattatgacaatggaaccactaagcgtggccctttaagtgcttttgcccattagcttcatcaagtaattgcaggcttggcggcatcaataacaacaaaagttgacactttgggaaagagaagtgaatctttccccttccagatctggcaggaaagaaaagtg

SEQ ID NO: 16941 - DNA, 1719 bp, Homo sapiens
  misc_feature (2)..(2): n is a, c, g, or t
  misc_feature (6)..(6): n is a, c, g, or t
  misc_feature (8)..(10): n is a, c, g, or t
cntcgngnnngtggaaagttgattattcaaagcatctctgatggctactgcttgaatgtccttactgcaggggctccagtcttttgggggctgcatctgcactgcagagggctggctcggacatctgtggatttcagtcaacagaggagagattggaagaagcatgtttctttcagagtagatagtggattcactgaatccccccgccactagtaaatctcttctagtaagccatttgcatccttttttgttggtttttaatccttgcggagttctcagcgatgctacgagcaatgtgcttgcacttaaggtgatggactgtaaatgcctgaaaaaggaagaagcagttgtcaaagcaaattaattattaatgtttatagttttcctgtcttaagggttttcagaatctcagttgttcagtgtttgaagctgtaatgtctccaactgtaattactcagtgaatgggaggcagtgtgattgtcacccacaagcatccccaccaggaatggatgagtcgtgaccctttggagaggcaagtggagcttttaccttgagagccattcgtcctgccagggtcaggcagtgggaggaggcaggaaaagggcttgttgctctgaaaataagaccatctcccaaaccaccctacaccctacttcttccaggtgggaaagacccacagggtttcaggagagtccactgggaatgacttccttgaaatggaggttcagtcctttcaagttctgagctgtgagtgggggtggctatgggaggaaatcactttgcacagggtttgatgcgacacttctgggaagcttatgaattccgtaggagtgggcatgaagttgtaagcacgaaggacctgtaatacttcagaggagatgaaggaaggagtctggccatgttggagccatagagggaatctggggtttatataatgaatatttctgggtttttgtttttatctgcttttgtttgattttgcttttactttgggagctaagtattttttttatcttgacagatatgttttttcccccttagagtaatatatattcatggattaaaactaaagacaaaaaaaatctctgcagataaacagaaatgcccaccatggctttgaccccagtacctggagataaacatggctgccccatttcctctctctattcatatagctgaagatattaacatacattgcaatcaacattactgtttgctttttgcgttgaacaatataaactcagaattcgttcagagacttcatgtgctccagcatgtaattttcaggggctctagagtagtctacagtgcaaatatcaataatgtgcttaattaggccaccactgctggactttcaggcttactccaacttttctctattataaacagcatgtaaatggacatatttaaagccttgtgaacattaatctccattcacatctttcagtaaaattctgtgataaagaagaactactgagtttttaatatggctacttttattgttttcctgtgtgttgccaaatcactctcctgaatgttagaaaatcaggtttcattccttgtttacataacgtgttctttctaaataaacatttgcagttgattttcagtcaacaaattgcttttattactttaatgtctatgaaataagaccattccagtatccttaccttacagaaatgacagcaacaacagcaaatatgagtaaagaaaaaaaat

SEQ ID NO: 16942 - DNA, 488 bp, Homo sapiens
gaagccctatttaaagctgggaatataggccaaataatccatggtggcagctaacaaggagttaagagctgccagttttaaggtaggcatggtgttggtcttttgtgccatgaaaagaggttggtactctcttagaaaccctaagcaaaaatataggtggacctggagtatccttttctagccaaggcggcccaggatatgtgaaaattacctatttctttgattcttaagtctactcctaacccactagttaactgattttcagttgtaaggaactaagatgtaaggaatgaagttggacaccatttctctctgcacttaagggtatggaattgattttattcgagaatgaactgttgctgggtgtggtggcttatgcctgtaatcccaatactttgggaggctgaggtgggaggactgcttgaggccagcagttaaagaccagcctgggcaatacagcaagaccccatctgtggaaaacaaacaaa

SEQ ID NO: 16943 - DNA, 306 bp, Homo sapiens
ataaatctcaccagactgatggttttataaaaaggcagttccctcgcacatgctctcttgcctgccaccatgtaagatgcacctttgatcctcctttgtctttggccatgattgtgaggcctccccagccatgtggaactgagtcccctaaacctctttttctttataaattacccagtctcgggtatctcttcataacagtatgaaaatggactgacacagcgatgctgacaacaccgtgtgcgctacgtcaatggactgacacagcgatgctgacaacaccgtgtgcgctacgtcaatggactg

SEQ ID NO: 16944 - DNA, 136 bp, Homo sapiens
tgctttttcttttccgtcgaggaagagagaaagaaataaacatccatttgagagaagtcactggctttggtctaggtttgcccatgaatggccctcaataaaactatgtctgctttaggagaaacgactaaggaac

SEQ ID NO: 16945 - DNA, 990 bp, Homo sapiens
  misc_feature (957)..(957): n is a, c, g, or t
tgtctggtgaaaagaatcatcaaccaagtaaacacaactgatattttttttgggaaaaagtgcaatacttctggcagaaaatgtcctgattcataaaaaggtcaaacaatatcatggcagtcaaaatcagatcatttaaatgaggaaaaaattagggatatacattcaacaaaacagtcatagaccatggaaacagaaagtccctaaaaatgttaataatgttgatttttattgttttaccctttgttttccattttatgcaaccaagattttcccttgcaccttagaatgctttctttaaaatgtccttgctctcttaattttctgagttgctactttctcattttccttgctgattataaaacaactgaaggataagaaacacatgtttttctataactgtttttaattaaatgtttggtaaactgaaatgattgtaattactcttttgttatcttcaagaatctactcaagcttcctcagtttctcaaatcattcttgggcaacaaatgaacaagaaagaggacgtcttattatctggtgtctggcttgctgatttaataacctagaagacagtgtttgaagaacacaaactctaaagtccttcacttaaaaaaaaaaaactttcccaaattgcttaccatttggaaaaattgccttaccttcttcagtcatctctgatgttgtcatcctcagagtaagaagtacgcattcataaggaaccataacgtccttcaggaaatccagtacaccctacaattttacctaaaactttgatgttgttttttctgagcattttaccttctagggaaatggatctcatgctgtttatcagtttctgaaagttgttattaatctcccctcatcccaaaattgaagaactttgcttaaatcttagaatcagaactttggctccagtaataaagacttttcaatatctttatctgccattgagtnttacctaacgaaataaagcctccaaagtgggaa

SEQ ID NO: 16946 - DNA, 1054 bp, Homo sapiens
  misc_feature (1021)..(1021): n is a, c, g, or t
aagcagtggttcaaacgcagagtggccattcccctgcctcagcctccggagtagctgggactacaggcgcctgccactgcgcccggctaatttgacattgctcttaaaagtatgttagaacacttccttattcttcatgcatccatagagaaaaggaaaagtcttcttaactctccggaagaattaatcagaggagcatttctaacttctttccacccactcactcactctccttccactgaccattgaaaatgggggaagaaaaaagaattattgatcaaatttggatctctgtgtgctgtcctccaatttaatactttctgtgttgctgttttattttctttcttctggaacctggcaaagtgcgtcaagcgatgaggcttcctctttgaagatcacaggtgagaagattaggtgctttctcagaagcccagcaacctgatgggagtgtggagtgagcaagacccaaatcggagcttcatccctgcatggttcattttgcttatttggcaaacttgccctgcagaatctactcaagcttcctcagtttctcaaatcattcttgggcaacaaatgaacaagaaagaggacgtcttattatctggtgtctggcttgctgatttaataacctagaagacagtgtttgaagaacacaaactctaaagtccttcacttaaaaaaaaaaaactttcccaaattgcttaccatttggaaaaattgccttaccttcttcagtcatctctgatgttgtcatcctcagagtaagaagtacgcattcataaggaaccataacgtccttcaggaaatccagtacaccctacaattttacctaaaactttgatgttgttttttctgagcattttaccttctagggaaatggatctcatgctgtttatcagtttctgaaagttgttattaatctcccctcatcccaaaattgaagaactttgcttaaatcttagaatcagaactttggctccagtaataaagacttttcaatatctttatctgccattgagtnttacctaacgaaataaagcctccaaagtgggaa

SEQ ID NO: 16947 - DNA, 815 bp, Homo sapiens
  misc_feature (782)..(782): n is a, c, g, or t
cagactactcctgcaggacctgcgagataccccgaatacttggttggactgagtcccatgaagccagatcacttctgactgcaaggagcttggaaaagcaagtatctggatcttttaccagctaaatttggagcgatgaggcttcctctttgaagatcacaggtgagaagattaggtgctttctcagaagcccagcaacctgatgggagtgtggagtgagcaagacccaaatcggagcttcatccctgcatggttcattttgcttatttggcaaacttgccctgcagaatctactcaagcttcctcagtttctcaaatcattcttgggcaacaaatgaacaagaaagaggacgtcttattatctggtgtctggcttgctgatttaataacctagaagacagtgtttgaagaacacaaactctaaagtccttcacttaaaaaaaaaaaactttcccaaattgcttaccatttggaaaaattgccttaccttcttcagtcatctctgatgttgtcatcctcagagtaagaagtacgcattcataaggaaccataacgtccttcaggaaatccagtacaccctacaattttacctaaaactttgatgttgttttttctgagcattttaccttctagggaaatggatctcatgctgtttatcagtttctgaaagttgttattaatctcccctcatcccaaaattgaagaactttgcttaaatcttagaatcagaactttggctccagtaataaagacttttcaatatctttatctgccattgagtnttacctaacgaaataaagcctccaaagtgggaa

SEQ ID NO: 16948 - DNA, 680 bp, Homo sapiens
agcggtggaaggatatggtggctgaaataaggcatgaggcacagatacagatttcctgactcaacttctggtgcagataacattgttatactacacatatttataatgcccttttggtggttggactgagtcccatgaagccagatcacttctgactgcaaggagcttggaaaagcaagtatctggatcttttaccagctaaatttggaggcttggccttgggacctgcttaaaccaagagatatgccacatctgagcagttcttttccttgtggcccctgccatgagagcagcgtgtacaaggtggatgctgctccattagcgtggatcctgggatgagaagactcagggagcaggctctgccaacccacagtctacagcagagccacagccagcagtagtcctcattcaacaggagggggaaaaaactgctcgtcatccttagctctgagatttgggggttgttatcacagaagatactgtctcatagaagtttttaatatgactgctactacaacaactattgctataatgtttacagcaatcattgctactttacgttccaacagtattattgcttgcaaggggctatcaaatagatgatcttgttggaaactcacagctacaagggcaggtgaggaagctgaagtaatgagtaggagaagttaatgaattatccc

SEQ ID NO: 16949 - DNA, 694 bp, Homo sapiens
cttgaagctctgtcacggcataatctcttataaataaatgtcagtgtagtcactgaatgcagactggatttttgcctgactacggtgctcagccttctagacaatagttatgctaagggattatcttttaacattgtgcagttatctcctttgtttgttttcttttttcattattcacataagccaagggaaatgaaaagcatcttatttcaggcaaaaaggcctgtgaatgattaactctggttccatgcgttgggactttgcatagcaaccccgtggcttgcaacgacaaaaaagctcaaggcaggaacagcagcccagggacctgagaccagcgttctcaaatgaaggccagatctgctgttagaggagaattcttctgtcctagctgtgtctctgtgatctgtggatgagggtgggaaagcaccactcagtcaattggggtgtacaaaatggagtttgagaaggtctcacatccaggttgttttgaagcaaagtccaagcattgtatcacttcatctgcaaatatttcaataagtacccaaaagtggttggactgagtcccatgaagccagatcacttctgactgcaaggagcttggaaaagcaagtatctggatcttttaccagctaaatttggaggaatgagaagaccatcctggataacacagagagaccctgtatctaccaaaaaa

SEQ ID NO: 16950 - DNA, 394 bp, Homo sapiens
cttaactcgttcagaaaaatgcagcttttgataaaattttgaacctaaaaattggagattgggctaccttcaattatttttcaaaaacacccactaatacatgattgggtggttggagatggtctgagagatggatttttcctgacatagaaaatcagctaatattctcttgaatcatacctatgtaggtgaagccagatttctcgtttaaataatctttggttagtgtgaggtgcagcccatttctgaaaggttaggagtcagcttttgttagctgagcttagttcattgattccatactttcatttagaagttccttttcttctcaatttgtattttaggaatgagaagaccatcctggataacacagagagaccctgtatctaccaaaaaa

SEQ ID NO: 16951 - DNA, 1419 bp, Homo sapiens
  misc_feature (1386)..(1386): n is a, c, g, or t
tcgtagagacggggtttcactgtgttagccaggatggtcttgatctcctgacctcgtgatccgcctgccttggcctcccaaagtgttgggattacaggtgtgagccaccgcgcccggtcgagttttcttctttaatctggtgttgatcctgagagtgctttgttaaaaaacattctccatgctgacctccgttttcgagtccgcttcctggggaaacctgaaacaggacttgatgctagcagctgcccagaagaaccagatgggccactgtccttgccagaagatctgatatcctgtgtatggccaccacctaacactgctcacttctacatgtaaacctcagccagatctgctgttagaggagaattcttctgtcctagctgtgtctctgtgatctgtggatgagggtgggaaagcaccactcagtcaattggggtgtacaaaatggagtttgagaaggtctcacatccaggttgttttgaagcaaagtccaagcattgtatcacttcatctgcaaatatttcaataagtacccaaaagtggttggactgagtcccatgaagccagatcacttctgactgcaaggagcttggaaaagcaagtatctggatcttttaccagctaaatttggagaattattgatcaaatttggatctctgtgtgctgtcctccaatttaatactttctgtgttgctgttttattttctttcttctggaacctggcaaagtgcgtcaagcgatgaggcttcctctttgaagatcacaggtgagaagattaggtgctttctcagaagcccagcaacctgatgggagtgtggagtgagcaagacccaaatcggagcttcatccctgcatggttcattttgcttatttggcaaacttgccctgcagaatctactcaagcttcctcagtttctcaaatcattcttgggcaacaaatgaacaagaaagaggacgtcttattatctggtgtctggcttgctgatttaataacctagaagacagtgtttgaagaacacaaactctaaagtccttcacttaaaaaaaaaaaactttcccaaattgcttaccatttggaaaaattgccttaccttcttcagtcatctctgatgttgtcatcctcagagtaagaagtacgcattcataaggaaccataacgtccttcaggaaatccagtacaccctacaattttacctaaaactttgatgttgttttttctgagcattttaccttctagggaaatggatctcatgctgtttatcagtttctgaaagttgttattaatctcccctcatcccaaaattgaagaactttgcttaaatcttagaatcagaactttggctccagtaataaagacttttcaatatctttatctgccattgagtnttacctaacgaaataaagcctccaaagtgggaa

SEQ ID NO: 16952 - DNA, 1427 bp, Homo sapiens
  misc_feature (1394)..(1394): n is a, c, g, or t
cttgaagctctgtcacggcataatctcttataaataaatgtcagtgtagtcactgaatgcagactggatttttgcctgactacggtgctcagccttctagacaatagttatgctaagggattatcttttaacattgtgcagttatctcctttgtttgttttcttttttcattattcacataagccaagggaaatgaaaagcatcttatttcaggcaaaaaggcctgtgaatgattaactctggttccatgcgttgggactttgcatagcaaccccgtggcttgcaacgacaaaaaagctcaaggcaggaacagcagcccagggacctgagaccagcgttctcaaatgaaggccagatctgctgttagaggagaattcttctgtcctagctgtgtctctgtgatctgtggatgagggtgggaaagcaccactcagtcaattggggtgtacaaaatggagtttgagaaggtctcacatccaggttgttttgaagcaaagtccaagcattgtatcacttcatctgcaaatatttcaataagtacccaaaagtggttggactgagtcccatgaagccagatcacttctgactgcaaggagcttggaaaagcaagtatctggatcttttaccagctaaatttggagaattattgatcaaatttggatctctgtgtgctgtcctccaatttaatactttctgtgttgctgttttattttctttcttctggaacctggcaaagtgcgtcaagcgatgaggcttcctctttgaagatcacaggtgagaagattaggtgctttctcagaagcccagcaacctgatgggagtgtggagtgagcaagacccaaatcggagcttcatccctgcatggttcattttgcttatttggcaaacttgccctgcagaatctactcaagcttcctcagtttctcaaatcattcttgggcaacaaatgaacaagaaagaggacgtcttattatctggtgtctggcttgctgatttaataacctagaagacagtgtttgaagaacacaaactctaaagtccttcacttaaaaaaaaaaaactttcccaaattgcttaccatttggaaaaattgccttaccttcttcagtcatctctgatgttgtcatcctcagagtaagaagtacgcattcataaggaaccataacgtccttcaggaaatccagtacaccctacaattttacctaaaactttgatgttgttttttctgagcattttaccttctagggaaatggatctcatgctgtttatcagtttctgaaagttgttattaatctcccctcatcccaaaattgaagaactttgcttaaatcttagaatcagaactttggctccagtaataaagacttttcaatatctttatctgccattgagtnttacctaacgaaataaagcctccaaagtgggaa

SEQ ID NO: 16953 - DNA, 737 bp, Homo sapiens
tcgtagagacggggtttcactgtgttagccaggatggtcttgatctcctgacctcgtgatccgcctgccttggcctcccaaagtgttgggattacaggtgtgagccaccgcgcccggtcgagttttcttctttaatctggtgttgatcctgagagtgctttgttaaaaaacattctccatgctgacctccgttttcgagtccgcttcctggggaaacctgaaacaggacttgatgctagcagctgcccagaagaaccagatgggccactgtccttgccagaagatctgatatcctgtgtatggccaccacctaacactgctcacttctacatgtaaacctcagccagatctgctgttagaggagaattcttctgtcctagctgtgtctctgtgatctgtggatgagggtgggaaagcaccactcagtcaattggggtgtacaaaatggagtttgagaaggtctcacatccaggttgttttgaagcaaagtccaagcattgtatcacttcatctgcaaatatttcaataagtacccaaaagacttcctaggatagagcttggaaaggttggaaaagtaaggatgattgaacttgaaaggtgtgaatgaaagaagaattatcttttgggatggagaatagtagctgttttcaaagaagattttattttatctttcatttttggcctataagttttgcagagaatctgtgattagagtatttagtaaagtactatgtaat

SEQ ID NO: 16954 - DNA, 274 bp, Homo sapiens
ctctgaggtgcaggcattcactaggacttcacccgtggtatgttactgaaactccggggagccaactgctggagcatttatgagacacactatgccaccatccggggcttcagcagcgtttggtgaaaacctgcctgtggggttgctgttgaatttgctggagagctgactgaggtgctagcagaactcctcaggaaatcaccaggaggagcatccctgggtgccccatgcaccagtcaagagcaggagcaagaggaaaggaaggtagcctctt

SEQ ID NO: 16955 - DNA, 757 bp, Homo sapiens
gaatctaatctaatcacctcattttatagttgaggaaaataccccaggtcacactgctaattaatgggtaatctcgggatcagaattcttgtttcctaacctcgaggcctgtgctttctctggttccactgatgtacaatcatctgtgtaccactgggtagcttaaagaatatttatacactatctcatttgattctcacaacagtcctggaaaatggatgttttaggtatttctacttccctctgttctccctatttctctctctacaccctcttttctttccccttccctttcttatttacctcaatataggacaaagtaggtgtaagcaaagtaggtttaacagcaagtcatctgagaactcacaggttgccagtggtggaagtggggccccacccttgtctgctgacttgccctcattctcttcctagctccccatactttcttactgtggctgctgggattgtcatgatttgttgagcgtaaccatttgacagggttttattctctctcttcagctgagagtgccacatattgtcttgtgaagaatgctgtgaaaatgtttaaggatattggggtaggtgtccaccatttatggtataaaagctatctcaacttctgttctctttagatctagtctgtttgagctacctttgtggtggggtggaccccgagagaagcagtttctgctggcttaatgataaaggcatttttgggaacggggcatgtaggatgggttgggctatgttgaaggtg

SEQ ID NO: 16956 - DNA, 6374 bp, Homo sapiens
cactgcagctggcattggccgggactggaagtgcgggcttctgcagcagccgaagctggagctgctagggcagcagcggctcccctgttgtatggacattctgcacccgaaactgatagctgagtcctgaagttttatgttatgaaacagaagaactttcatcccagcacatgatttgggaattacactttgtgacatggatgaatctgcactgacccttggtacaatagatgtttcttatctgccacattcatcagaatacagtgttggtcgatgtaagcacacaagtgaggaatggggtgagtgtggctttagacccaccatcttcagatctgcaactttaaaatggaaagaaagcctaatgagtcggaaaaggccatttgttggaagatgttgttactcctgcactccccagagctgggacaaatttttcaaccccagtatcccgtctttgggtttgcggaatgttatttatatcaatgaaactcacacaagacaccgcggatggcttgcaagacgcctttcttacgttctttttattcaagagcgagatgtgcataagggcatgtttgccaccaatgtgactgaaaatgtgctgaacagcagtagagtacaagaggcaattgcagaagtggctgctgaattaaaccctgatggttctgcccagcagcaatcaaaagccgttaacaaagtgaaaaagaaagctaaaaggattcttcaagaaatggttgccactgtctcaccggcaatgatcagactgactgggtgggtgctgctaaaactgttcaacagcttcttttggaacattcaaattcacaaaggtcaacttgagatggttaaagctgcaactgagacgaatttgccgcttctgtttctaccagttcatagatcccatattgactatctgctgctcactttcattctcttctgccataacatcaaagcaccatacattgcttcaggcaataatctcaacatcccaatcttcagtaccttgatccataagcttgggggcttcttcatacgacgaaggctcgatgaaacaccagatggacggaaagatgttctctatagagctttgctccatgggcatatagttgaattacttcgacagcagcaattcttggagatcttcctggaaggcacacgttctaggagtggaaaaacctcttgtgctcgggcaggacttttgtcagttgtggtagatactctgtctaccaatgtcatcccagacatcttgataatacctgttggaatctcctatgatcgcattatcgaaggtcactacaatggtgaacaactgggcaaacctaagaagaatgagagcctgtggagtgtagcaagaggtgttattagaatgttacgaaaaaactatggttgtgtccgagtggattttgcacagccattttccttaaaggaatatttagaaagccaaagtcagaaaccggtgtctgctctactttccctggagcaagcgttgttaccagctatacttccttcaagacccagtgatgctgctgatgaaggtagagacacgtccattaatgagtccagaaatgcaacagatgaatccctacgaaggaggttgattgcaaatctggctgagcatattctattcactgctagcaagtcctgtgccattatgtccacacacattgtggcttgcctgctcctctacagacacaggcagggaattgatctctccacattggtcgaagacttctttgtgatgaaagaggaagtcctggctcgtgattttgacctggggttctcaggaaattcagaagatgtagtaatgcatgccatacagctgctgggaaattgtgtcacaatcacccacactagcaggaacgatgagttttttatcacccccagcacaactgtcccatcagtcttcgaactcaacttctacagcaatggggtacttcatgtctttatcatggaggccatcatagcttgcagcctttatgcagttctgaacaagaggggactggggggtcccactagcaccccacctaacctgatcagccaggagcagctggtgcggaaggcggccagcctgtgctaccttctctccaatgaaggcaccatctcactgccttgccagacattttaccaagtctgccatgaaacagtaggaaagtttatccagtatggcattcttacagtggcagagcacgatgaccaggaagatatcagtcctagtcttgctgagcagcagtgggacaagaagcttcctgaacctttgtcttggagaagtgatgaagaagatgaagacagtgactttggggaggaacagcgagattgctacctgaaggtgagccaatccaaggagcaccagcagtttatcaccttcttacagagactccttgggcctttgctggaggcctacagctctgctgccatctttgttcacaacttcagtggtcctgttccagaacctgagtatctgcaaaagttgcacaaatacctaataaccagaacagaaagaaatgttgcagtatatgctgagagtgccacatattgtcttgtgaagaatgctgtgaaaatgtttaaggatattggggttttcaaggagaccaaacaaaagagagtgtctgttttagaactgagcagcacttttctacctcaatgcaaccgacaaaaacttctagaatatattctgagttttgtggtgctgtaggtaacgtgtggcactgctggcaaatgaaggtcatgagatgagttccttgtaggtaccagcttctggctcaagagttgaaggtgccgtcgcagggtcaggcctgccctgtcccgaagtgatctcctggaagacaagtgccttctccctccatggatctgtgatcttcccagctctgcatcaacacagcagcctgcagataacacttggggggacctcagcctctattcgcaactcataatccgtagactacaagatgaaatctcaataaattatttttgagtttattaaagattgacattttaagtacaacttttaaggactaattactgtgatggacacagaaatgtagctgtgttctggaactgaatcttacatggtatacttagtgctgctgggtaatttgttggtatattatctggttagtggttaatgcttcctttaaaaataattgagtcatccattcactctttttcagttttatctgtcaatagtagctacatttttaatgggagcaccttttatcccaaagtgctttataaattgagtggactgatatatatcacacccaggtatcactgtgctgtcctttgctgtcagatttagaaatgtttttaagagctatgtgaaaacagacaatattagtttaggtcgggaactgagatattgtaatcaaatagttaacatcaggaagttaatttggctggcaaaattctagggaaacttggccagaaaactggtgttgaaggcttttgctcatataaacaagtgccattgagtttcaaatgaccagcaaatatatttagaacccttcctgttttatgtctgtacctcgtccacccctcaggtaatacctgcctctcacaggtacagctgtttcttggaaatcctccaaccaaatagcagttttcctaacttgattagcttgagctgacagactgttagaatacagttctctggccacagctgatgagggctttctgtactgcacacagattgtgtactgcaccccagtccaggtgactggtacccactcgagttgtgccgtgcacaacctgtccagtatatgcatgtggtggccctactgactggtaatggttagaggcatttatggatttttagctttgaggaaaaaccatgacttttaacaaatttttatgggttatatgcctaaacccttatgccacatagtggtaaataattatgaaaaatggtctgttcataattggtaggtgccttttgtgagcagggagcataattattggtttattatggtaattatggtgattttttaaatatcatgtaatgttaaaacgttttctaacagtttactgttgcttatctccaagatattatggaattaagaatttttccagatgagtgttacatagattctttgaatttagtataaaagtactgagaattaagtttgtacttccataagcttggattttaaacactgatagtatctcatgagtaatgtgtgttttgggagagggagggatgctgattgatatttcacattgtatgaaataccatgtttgaaactcatagcaataatgctatgctgttgtgatccctctcaagttctgcatttaaaatatattttttctttataggaattgatgtataccatgaagtcattgtcagttgtagtagctctgatgttgaatgagatatcatgttttagcattccattttactgactagggtagaagaacacttttcttggctacatttggaggatacccagggagtcttgggtgttccttatctggggaagcaaacatttcactagtctctttttttcatcctttaaattgtaaattaaggattactcaagctcaccattattcaagattgggactcgcttcccagtcgacactctgccctgcctgtcattgctgcaaagagctgctgctttgccaacctaagcaaagaaaatacggcttctcttgcattattttcccttttggttggtttgttttctagaagtacgttcagatgctttggggaatgcaatgtatgatttgctagctctctcaccacttaactcactgtgaggataaatatgcatgctttttgtaattaactggtgctttgaaaatcttttttaagggagaaaaatctcaaccaaagttatgctcatccagacaagctgacctttgagttaatttcagcacaactcattcttcagtgcctcatgactgaaaacaaaaaacaaaaaaacgaaagcatcttcacaatgaagcttccagatagcaccgttttgctaaaagatacattctcattgttttccaacagtgatggcttccacataaggttaaacaaactaggtgcttgtaaataatttattacagtttactctatcgcatttctgtaacatgaaatgcatgcccttcttcaggggaagactgtggtcaagttaaaaaaaaaaaacaatattaaacaacatgaaactgcagtctgtttttgaaaatgagaatgtcctaagtgattcagaagagaggagggaagttgtgcactctgaaaatgcatgaaaaacaaaggcaaaaactagtgggaaatgtgtagaactgttaactgagatggcttcgagtcttccttctggaatctgttaaatttcacaaagtcatgagggtaaatggagaaaatatttctgggattacaatgaatgtaagcccaaattgtggaattgccagtaacctggatggggaaaagcatttcccatagcactccatgtaatatgagtgctctgtgagatgttcatcagtgttttatagaaatggtgttgctgggaaaccaagtttgcacctggaaacttacaatgcactttagcgcagtaagggcttggcatccggtagtgaaaaactgtctaacccagcattgcccaaactattttgacaccaggacctttttctcctttgggatacttatgaacctctcactaatgtcctgtggagaacattttgggaaacactatgttagatagttctttaaggagacaaaacggtaatgaacagatagcactggggcagaatatgcatgcattttgtaacgtccagtgtggcgttgaatagatgtgtatttcctcccctgcagaaaataagcacagaaaattataatgtaggtgatcggagctctttcctttgatagagagaacagccccaatgatcctggctttttcactgaacgtatcagaatacatggatgaattggggtaaataaggttttaattcagatctagaagaaagtattgtacgtttgaatgcagatttttatccacagatagttgtagtgtttagacatgacaggacctatcgttgaggtttctaagacttactatgggctgtaaacctgttttttaaaactattttagaaacctgagacttgccgtctggcattttagtttaatacaaactaatgattgcatttgaaagagattcttgaccttatttctaaacgtctagagctctgaaatgtcttgatggaaggtattaaactatttgcctgttgtacaaagaaatgttaagactcgtgaaaagaattactataaggtactgtgaaataactgcgattttgtgagcaaaacatacttggaaatgctgattgatttttatgcttgttagtgtattgcaagaaacacagaaaatgtagttttgttttaataaaccaaaaattgaacataaaaatg

SEQ ID NO: 16957 - DNA, 6383 bp, Homo sapiens
cagaggggaagatacgatgcaaaaccaaggaaatcaatacttttgttttagtattgagtggaaaagaatgtttttacggcagcagcggctcccctgttgtatggacattctgcacccgaaactgatagctgagtcctgaagttttatgttatgaaacagaagaactttcatcccagcacatgatttgggaattacactttgtgacatggatgaatctgcactgacccttggtacaatagatgtttcttatctgccacattcatcagaatacagtgttggtcgatgtaagcacacaagtgaggaatggggtgagtgtggctttagacccaccatcttcagatctgcaactttaaaatggaaagaaagcctaatgagtcggaaaaggccatttgttggaagatgttgttactcctgcactccccagagctgggacaaatttttcaaccccagtatcccgtctttgggtttgcggaatgttatttatatcaatgaaactcacacaagacaccgcggatggcttgcaagacgcctttcttacgttctttttattcaagagcgagatgtgcataagggcatgtttgccaccaatgtgactgaaaatgtgctgaacagcagtagagtacaagaggcaattgcagaagtggctgctgaattaaaccctgatggttctgcccagcagcaatcaaaagccgttaacaaagtgaaaaagaaagctaaaaggattcttcaagaaatggttgccactgtctcaccggcaatgatcagactgactgggtgggtgctgctaaaactgttcaacagcttcttttggaacattcaaattcacaaaggtcaacttgagatggttaaagctgcaactgagacgaatttgccgcttctgtttctaccagttcatagatcccatattgactatctgctgctcactttcattctcttctgccataacatcaaagcaccatacattgcttcaggcaataatctcaacatcccaatcttcagtaccttgatccataagcttgggggcttcttcatacgacgaaggctcgatgaaacaccagatggacggaaagatgttctctatagagctttgctccatgggcatatagttgaattacttcgacagcagcaattcttggagatcttcctggaaggcacacgttctaggagtggaaaaacctcttgtgctcgggcaggacttttgtcagttgtggtagatactctgtctaccaatgtcatcccagacatcttgataatacctgttggaatctcctatgatcgcattatcgaaggtcactacaatggtgaacaactgggcaaacctaagaagaatgagagcctgtggagtgtagcaagaggtgttattagaatgttacgaaaaaactatggttgtgtccgagtggattttgcacagccattttccttaaaggaatatttagaaagccaaagtcagaaaccggtgtctgctctactttccctggagcaagcgttgttaccagctatacttccttcaagacccagtgatgctgctgatgaaggtagagacacgtccattaatgagtccagaaatgcaacagatgaatccctacgaaggaggttgattgcaaatctggctgagcatattctattcactgctagcaagtcctgtgccattatgtccacacacattgtggcttgcctgctcctctacagacacaggcagggaattgatctctccacattggtcgaagacttctttgtgatgaaagaggaagtcctggctcgtgattttgacctggggttctcaggaaattcagaagatgtagtaatgcatgccatacagctgctgggaaattgtgtcacaatcacccacactagcaggaacgatgagttttttatcacccccagcacaactgtcccatcagtcttcgaactcaacttctacagcaatggggtacttcatgtctttatcatggaggccatcatagcttgcagcctttatgcagttctgaacaagaggggactggggggtcccactagcaccccacctaacctgatcagccaggagcagctggtgcggaaggcggccagcctgtgctaccttctctccaatgaaggcaccatctcactgccttgccagacattttaccaagtctgccatgaaacagtaggaaagtttatccagtatggcattcttacagtggcagagcacgatgaccaggaagatatcagtcctagtcttgctgagcagcagtgggacaagaagcttcctgaacctttgtcttggagaagtgatgaagaagatgaagacagtgactttggggaggaacagcgagattgctacctgaaggtgagccaatccaaggagcaccagcagtttatcaccttcttacagagactccttgggcctttgctggaggcctacagctctgctgccatctttgttcacaacttcagtggtcctgttccagaacctgagtatctgcaaaagttgcacaaatacctaataaccagaacagaaagaaatgttgcagtatatgctgagagtgccacatattgtcttgtgaagaatgctgtgaaaatgtttaaggatattggggttttcaaggagaccaaacaaaagagagtgtctgttttagaactgagcagcacttttctacctcaatgcaaccgacaaaaacttctagaatatattctgagttttgtggtgctgtaggtaacgtgtggcactgctggcaaatgaaggtcatgagatgagttccttgtaggtaccagcttctggctcaagagttgaaggtgccgtcgcagggtcaggcctgccctgtcccgaagtgatctcctggaagacaagtgccttctccctccatggatctgtgatcttcccagctctgcatcaacacagcagcctgcagataacacttggggggacctcagcctctattcgcaactcataatccgtagactacaagatgaaatctcaataaattatttttgagtttattaaagattgacattttaagtacaacttttaaggactaattactgtgatggacacagaaatgtagctgtgttctggaactgaatcttacatggtatacttagtgctgctgggtaatttgttggtatattatctggttagtggttaatgcttcctttaaaaataattgagtcatccattcactctttttcagttttatctgtcaatagtagctacatttttaatgggagcaccttttatcccaaagtgctttataaattgagtggactgatatatatcacacccaggtatcactgtgctgtcctttgctgtcagatttagaaatgtttttaagagctatgtgaaaacagacaatattagtttaggtcgggaactgagatattgtaatcaaatagttaacatcaggaagttaatttggctggcaaaattctagggaaacttggccagaaaactggtgttgaaggcttttgctcatataaacaagtgccattgagtttcaaatgaccagcaaatatatttagaacccttcctgttttatgtctgtacctcgtccacccctcaggtaatacctgcctctcacaggtacagctgtttcttggaaatcctccaaccaaatagcagttttcctaacttgattagcttgagctgacagactgttagaatacagttctctggccacagctgatgagggctttctgtactgcacacagattgtgtactgcaccccagtccaggtgactggtacccactcgagttgtgccgtgcacaacctgtccagtatatgcatgtggtggccctactgactggtaatggttagaggcatttatggatttttagctttgaggaaaaaccatgacttttaacaaatttttatgggttatatgcctaaacccttatgccacatagtggtaaataattatgaaaaatggtctgttcataattggtaggtgccttttgtgagcagggagcataattattggtttattatggtaattatggtgattttttaaatatcatgtaatgttaaaacgttttctaacagtttactgttgcttatctccaagatattatggaattaagaatttttccagatgagtgttacatagattctttgaatttagtataaaagtactgagaattaagtttgtacttccataagcttggattttaaacactgatagtatctcatgagtaatgtgtgttttgggagagggagggatgctgattgatatttcacattgtatgaaataccatgtttgaaactcatagcaataatgctatgctgttgtgatccctctcaagttctgcatttaaaatatattttttctttataggaattgatgtataccatgaagtcattgtcagttgtagtagctctgatgttgaatgagatatcatgttttagcattccattttactgactagggtagaagaacacttttcttggctacatttggaggatacccagggagtcttgggtgttccttatctggggaagcaaacatttcactagtctctttttttcatcctttaaattgtaaattaaggattactcaagctcaccattattcaagattgggactcgcttcccagtcgacactctgccctgcctgtcattgctgcaaagagctgctgctttgccaacctaagcaaagaaaatacggcttctcttgcattattttcccttttggttggtttgttttctagaagtacgttcagatgctttggggaatgcaatgtatgatttgctagctctctcaccacttaactcactgtgaggataaatatgcatgctttttgtaattaactggtgctttgaaaatcttttttaagggagaaaaatctcaaccaaagttatgctcatccagacaagctgacctttgagttaatttcagcacaactcattcttcagtgcctcatgactgaaaacaaaaaacaaaaaaacgaaagcatcttcacaatgaagcttccagatagcaccgttttgctaaaagatacattctcattgttttccaacagtgatggcttccacataaggttaaacaaactaggtgcttgtaaataatttattacagtttactctatcgcatttctgtaacatgaaatgcatgcccttcttcaggggaagactgtggtcaagttaaaaaaaaaaaacaatattaaacaacatgaaactgcagtctgtttttgaaaatgagaatgtcctaagtgattcagaagagaggagggaagttgtgcactctgaaaatgcatgaaaaacaaaggcaaaaactagtgggaaatgtgtagaactgttaactgagatggcttcgagtcttccttctggaatctgttaaatttcacaaagtcatgagggtaaatggagaaaatatttctgggattacaatgaatgtaagcccaaattgtggaattgccagtaacctggatggggaaaagcatttcccatagcactccatgtaatatgagtgctctgtgagatgttcatcagtgttttatagaaatggtgttgctgggaaaccaagtttgcacctggaaacttacaatgcactttagcgcagtaagggcttggcatccggtagtgaaaaactgtctaacccagcattgcccaaactattttgacaccaggacctttttctcctttgggatacttatgaacctctcactaatgtcctgtggagaacattttgggaaacactatgttagatagttctttaaggagacaaaacggtaatgaacagatagcactggggcagaatatgcatgcattttgtaacgtccagtgtggcgttgaatagatgtgtatttcctcccctgcagaaaataagcacagaaaattataatgtaggtgatcggagctctttcctttgatagagagaacagccccaatgatcctggctttttcactgaacgtatcagaatacatggatgaattggggtaaataaggttttaattcagatctagaagaaagtattgtacgtttgaatgcagatttttatccacagatagttgtagtgtttagacatgacaggacctatcgttgaggtttctaagacttactatgggctgtaaacctgttttttaaaactattttagaaacctgagacttgccgtctggcattttagtttaatacaaactaatgattgcatttgaaagagattcttgaccttatttctaaacgtctagagctctgaaatgtcttgatggaaggtattaaactatttgcctgttgtacaaagaaatgttaagactcgtgaaaagaattactataaggtactgtgaaataactgcgattttgtgagcaaaacatacttggaaatgctgattgatttttatgcttgttagtgtattgcaagaaacacagaaaatgtagttttgttttaataaaccaaaaattgaacataaaaatg

SEQ ID NO: 16958 - DNA, 6320 bp, Homo sapiens
cactgcagctggcattggccgggactggaagtgcgggcttctgcagcagccgaagctggagctgctagggcagcagcggctcccctgttgtatggacattctgcacccgaaactgatagctgagtcctgaagttttatgttatgaaacagaagaactttcatcccagcacatgatttgggaattacactttgtgacatggatgaatctgcactgacccttggtacaatagatgtttcttatctgccacattcatcagaatacagtgttggtcgatgtaagcacacaagtgaggaatggggtgagtgtggctttagacccaccatcttcagatctgcaactttaaaatggaaagaaagcctaatgagtcggaaaaggccatttgttggaagatgttgttactcctgcactccccagagctgggacaaatttttcaaccccagtatcccgtctttgggtttgcggaatgttatttatatcaatgaaactcacacaagacaccgcggatggcttgcaagacgcctttcttacgttctttttattcaagagcgagatgtgcataagggcatgtttgccaccaatgtgactgaaaatgtgctgaacagcagtagagtacaagaggcaattgcagaagtggctgctgaattaaaccctgatggttctgcccagcagcaatcaaaagccgttaacaaagtgaaaaagaaagctaaaaggattcttcaagaaatggttgccactgtctcaccggcaatgatcagactgactgggtgggtgctgctaaaactgttcaacagcttcttttggaacattcaaattcacaaaggtcaacttgagatggttaaagctgcaactgagacgaatttgccgcttctgtttctaccagttcatagatcccatattgactatctgctgctcactttcattctcttctgccataacatcaaagcaccatacattgcttcaggcaataatctcaacatcccaatcttcagtaccttgatccataagcttgggggcttcttcatacgacgaaggctcgatgaaacaccagatggacggaaagatgttctctatagagctttgctccatgggcatatagttgaattacttcgacagcagcaattcttggagatcttcctggaaggcacacgttctaggagtggaaaaacctcttgtgctcgggcaggacttttgtcagttgtggtagatactctgtctaccaatgtcatcccagacatcttgataatacctgttggaatctcctatgatcgcattatcgaaggtcactacaatggtgaacaactgggcaaacctaagaagaatgagagcctgtggagtgtagcaagaggtgttattagaatgttacgaaaaaactatggttgtgtccgagtggattttgcacagccattttccttaaaggaatatttagaaagccaaagtcagaaaccggtgtctgctctactttccctggagcaagcgttgttaccagctatacttccttcaagacccagtgatgctgctgatgaaggtagagacacgtccattaatgagtccagaaatgcaacagatgaatccctacgaaggaggttgattgcaaatctggctgagcatattctattcactgctagcaagtcctgtgccattatgtccacacacattgtggcttgcctgctcctctacagacacaggcagggaattgatctctccacattggtcgaagacttctttgtgatgaaagaggaagtcctggctcgtgattttgacctggggttctcaggaaattcagaagatgtagtaatgcatgccatacagctgctgggaaattgtgtcacaatcacccacactagcaggaacgatgagttttttatcacccccagcacaactgtcccatcagtcttcgaactcaacttctacagcaatggggtacttcatgtctttatcatggaggccatcatagcttgcagcctttatgcagttctgaacaagaggggactggggggtcccactagcaccccacctaacctgatcagccaggagcagctggtgcggaaggcggccagcctgtgctaccttctctccaatgaaggcaccatctcactgccttgccagacattttaccaagtctgccatgaaacagtaggaaagtttatccagtatggcattcttacagtggcagagcacgatgaccaggaagatatcagtcctagtcttgctgagcagcagtgggacaagaagcttcctgaacctttgtcttggagaagtgatgaagaagatgaagacagtgactttggggaggaacagcgagattgctacctgaaggtgagccaatccaaggagcaccagcagtttatcaccttcttacagagactccttgggcctttgctggaggcctacagctctgctgccatctttgttcacaacttcagtggtcctgttccagaacctgagtatctgcaaaagttgcacaaatacctaataaccagaacagaaagaaatgttgcagtatatgctgagagtgccacatattgtcttgtgaagaatgctgtgaaaatgtttaaggatattggggttttcaaggagaccaaacaaaagagagtgtctgttttagaactgagcagcacttttctacctcaatgcaaccgacaaaaacttctagaatatattctgagttttgtggtgctgtaggtaacgtgtggcactgctggcaaatgaaggtcatgagatgagttccttgtaggtaccagcttctggctcaagagttgaaggtgccgtcgcagggtcaggcctgccctgtcccgaagtgatctcctggaagacaagtgccttctccctccatggatctgtgatcttcccagctctgcatcaacacagcagcctgcagataacacttggggggacctcagcctctattcgcaactcataatccgtagactacaagatgaaatctcaataaattatttttgagtttattaaagattgacattttaagtacaacttttaaggactaattactgtgatggacacagaaatgtagctgtgttctggaactgaatcttacatggtatacttagtgctgctgggtaatttgttggtatattatctggttagtggttaatgcttcctttaaaaataattgagtcatccattcactctttttcagttttatctgtcaatagtagctacatttttaatgggagcaccttttatcccaaagtgctttataaattgagtggactgatatatatcacacccaggtatcactgtgctgtcctttgctgtcagatttagaaatgtttttaagagctatgtgaaaacagacaatattagtttaggtcgggaactgagatattgtaatcaaatagttaacatcaggaagttaatttggctggcaaaattctagggaaacttggccagaaaactggtgttgaaggcttttgctcatataaacaagtgccattgagtttcaaatgaccagcaaatatatttagaacccttcctgttttatgtctgtacctcgtccacccctcaggtaatacctgcctctcacaggtacagctgtttcttggaaatcctccaaccaaatagcagttttcctaacttgattagcttgagctgacagactgttagaatacagttctctggccacagctgatgagggctttctgtactgcacacagattgtgtactgcaccccagtccaggtgactggtacccactcgagttgtgccgtgcacaacctgtccagtatatgcatgtggtggccctactgactggtaatggttagaggcatttatggatttttagctttgaggaaaaaccatgacttttaacaaatttttatgggttatatgcctaaacccttatgccacatagtggtaaataattatgaaaaatggtctgttcataattggtaggtgccttttgtgagcagggagcataattattggtttattatggtaattatggtgattttttaaatatcatgtaatgttaaatttttccagatgagtgttacatagattctttgaatttagtataaaagtactgagaattaagtttgtacttccataagcttggattttaaacactgatagtatctcatgagtaatgtgtgttttgggagagggagggatgctgattgatatttcacattgtatgaaataccatgtttgaaactcatagcaataatgctatgctgttgtgatccctctcaagttctgcatttaaaatatattttttctttataggaattgatgtataccatgaagtcattgtcagttgtagtagctctgatgttgaatgagatatcatgttttagcattccattttactgactagggtagaagaacacttttcttggctacatttggaggatacccagggagtcttgggtgttccttatctggggaagcaaacatttcactagtctctttttttcatcctttaaattgtaaattaaggattactcaagctcaccattattcaagattgggactcgcttcccagtcgacactctgccctgcctgtcattgctgcaaagagctgctgctttgccaacctaagcaaagaaaatacggcttctcttgcattattttcccttttggttggtttgttttctagaagtacgttcagatgctttggggaatgcaatgtatgatttgctagctctctcaccacttaactcactgtgaggataaatatgcatgctttttgtaattaactggtgctttgaaaatcttttttaagggagaaaaatctcaaccaaagttatgctcatccagacaagctgacctttgagttaatttcagcacaactcattcttcagtgcctcatgactgaaaacaaaaaacaaaaaaacgaaagcatcttcacaatgaagcttccagatagcaccgttttgctaaaagatacattctcattgttttccaacagtgatggcttccacataaggttaaacaaactaggtgcttgtaaataatttattacagtttactctatcgcatttctgtaacatgaaatgcatgcccttcttcaggggaagactgtggtcaagttaaaaaaaaaaaacaatattaaacaacatgaaactgcagtctgtttttgaaaatgagaatgtcctaagtgattcagaagagaggagggaagttgtgcactctgaaaatgcatgaaaaacaaaggcaaaaactagtgggaaatgtgtagaactgttaactgagatggcttcgagtcttccttctggaatctgttaaatttcacaaagtcatgagggtaaatggagaaaatatttctgggattacaatgaatgtaagcccaaattgtggaattgccagtaacctggatggggaaaagcatttcccatagcactccatgtaatatgagtgctctgtgagatgttcatcagtgttttatagaaatggtgttgctgggaaaccaagtttgcacctggaaacttacaatgcactttagcgcagtaagggcttggcatccggtagtgaaaaactgtctaacccagcattgcccaaactattttgacaccaggacctttttctcctttgggatacttatgaacctctcactaatgtcctgtggagaacattttgggaaacactatgttagatagttctttaaggagacaaaacggtaatgaacagatagcactggggcagaatatgcatgcattttgtaacgtccagtgtggcgttgaatagatgtgtatttcctcccctgcagaaaataagcacagaaaattataatgtaggtgatcggagctctttcctttgatagagagaacagccccaatgatcctggctttttcactgaacgtatcagaatacatggatgaattggggtaaataaggttttaattcagatctagaagaaagtattgtacgtttgaatgcagatttttatccacagatagttgtagtgtttagacatgacaggacctatcgttgaggtttctaagacttactatgggctgtaaacctgttttttaaaactattttagaaacctgagacttgccgtctggcattttagtttaatacaaactaatgattgcatttgaaagagattcttgaccttatttctaaacgtctagagctctgaaatgtcttgatggaaggtattaaactatttgcctgttgtacaaagaaatgttaagactcgtgaaaagaattactataaggtactgtgaaataactgcgattttgtgagcaaaacatacttggaaatgctgattgatttttatgcttgttagtgtattgcaagaaacacagaaaatgtagttttgttttaataaaccaaaaattgaacataaaaatg

SEQ ID NO: 16959 - DNA, 6320 bp, Homo sapiens
cactgcagctggcattggccgggactggaagtgcgggcttctgcagcagccgaagctggagctgctagggcagcagcggctcccctgttgtatggacattctgcacccgaaactgatagctgagtcctgaagttttatgttatgaaacagaagaactttcatcccagcacatgatttgggaattacactttgtgacatggatgaatctgcactgacccttggtacaatagatgtttcttatctgccacattcatcagaatacagtgttggtcgatgtaagcacacaagtgaggaatggggtgagtgtggctttagacccaccatcttcagatctgcaactttaaaatggaaagaaagcctaatgagtcggaaaaggccatttgttggaagatgttgttactcctgcactccccagagctgggacaaatttttcaaccccagtatcccgtctttgggtttgcggaatgttatttatatcaatgaaactcacacaagacaccgcggatggcttgcaagacgcctttcttacgttctttttattcaagagcgagatgtgcataagggcatgtttgccaccaatgtgactgaaaatgtgctgaacagcagtagagtacaagaggcaattgcagaagtggctgctgaattaaaccctgatggttctgcccagcagcaatcaaaagccgttaacaaagtgaaaaagaaagctaaaaggattcttcaagaaatggttgccactgtctcaccggcaatgatcagactgactgggtgggtgctgctaaaactgttcaacagcttcttttggaacattcaaattcacaaaggtcaacttgagatggttaaagctgcaactgagacgaatttgccgcttctgtttctaccagttcatagatcccatattgactatctgctgctcactttcattctcttctgccataacatcaaagcaccatacattgcttcaggcaataatctcaacatcccaatcttcagtaccttgatccataagcttgggggcttcttcatacgacgaaggctcgatgaaacaccagatggacggaaagatgttctctatagagctttgctccatgggcatatagttgaattacttcgacagcagcaattcttggagatcttcctggaaggcacacgttctaggagtggaaaaacctcttgtgctcgggcaggacttttgtcagttgtggtagatactctgtctaccaatgtcatcccagacatcttgataatacctgttggaatctcctatgatcgcattatcgaaggtcactacaatggtgaacaactgggcaaacctaagaagaatgagagcctgtggagtgtagcaagaggtgttattagaatgttacgaaaaaactatggttgtgtccgagtggattttgcacagccattttccttaaaggaatatttagaaagccaaagtcagaaaccggtgtctgctctactttccctggagcaagcgttgttaccagctatacttccttcaagacccagtgatgctgctgatgaaggtagagacacgtccattaatgagtccagaaatgcaacagatgaatccctacgaaggaggttgattgcaaatctggctgagcatattctattcactgctagcaagtcctgtgccattatgtccacacacattgtggcttgcctgctcctctacagacacaggcagggaattgatctctccacattggtcgaagacttctttgtgatgaaagaggaagtcctggctcgtgattttgacctggggttctcaggaaattcagaagatgtagtaatgcatgccatacagctgctgggaaattgtgtcacaatcacccacactagcaggaacgatgagttttttatcacccccagcacaactgtcccatcagtcttcgaactcaacttctacagcaatggggtacttcatgtctttatcatggaggccatcatagcttgcagcctttatgcagttctgaacaagaggggactggggggtcccactagcaccccacctaacctgatcagccaggagcagctggtgcggaaggcggccagcctgtgctaccttctctccaatgaaggcaccatctcactgccttgccagacattttaccaagtctgccatgaaacagtaggaaagtttatccagtatggcattcttacagtggcagagcacgatgaccaggaagatatcagtcctagtcttgctgagcagcagtgggacaagaagcttcctgaacctttgtcttggagaagtgatgaagaagatgaagacagtgactttggggaggaacagcgagattgctacctgaaggtgagccaatccaaggagcaccagcagtttatcaccttcttacagagactccttgggcctttgctggaggcctacagctctgctgccatctttgttcacaacttcagtggtcctgttccagaacctgagtatctgcaaaagttgcacaaatacctaataaccagaacagaaagaaatgttgcagtatatgctgagagtgccacatattgtcttgtgaagaatgctgtgaaaatgtttaaggatattggggttttcaaggagaccaaacaaaagagagtgtctgttttagaactgagcagcacttttctacctcaatgcaaccgacaaaaacttctagaatatattctgagttttgtggtgctgtaggtaacgtgtggcactgctggcaaatgaaggtcatgagatgagttccttgtaggtaccagcttctggctcaagagttgaaggtgccgtcgcagggtcaggcctgccctgtcccgaagtgatctcctggaagacaagtgccttctccctccatggatctgtgatcttcccagctctgcatcaacacagcagcctgcagataacacttggggggacctcagcctctattcgcaactcataatccgtagactacaagatgaaatctcaataaattatttttgagtttattaaagattgacattttaagtacaacttttaaggactaattactgtgatggacacagaaatgtagctgtgttctggaactgaatcttacatggtatacttagtgctgctgggtaatttgttggtatattatctggttagtggttaatgcttcctttaaaaataattgagtcatccattcactctttttcagttttatctgtcaatagtagctacatttttaatgggagcaccttttatcccaaagtgctttataaattgagtggactgatatatatcacacccaggtatcactgtgctgtcctttgctgtcagatttagaaatgtttttaagagctatgtgaaaacagacaatattagtttaggtcgggaactgagatattgtaatcaaatagttaacatcaggaagttaatttggctggcaaaattctagggaaacttggccagtgaccagcaaatatatttagaacccttcctgttttatgtctgtacctcgtccacccctcaggtaatacctgcctctcacaggtacagctgtttcttggaaatcctccaaccaaatagcagttttcctaacttgattagcttgagctgacagactgttagaatacagttctctggccacagctgatgagggctttctgtactgcacacagattgtgtactgcaccccagtccaggtgactggtacccactcgagttgtgccgtgcacaacctgtccagtatatgcatgtggtggccctactgactggtaatggttagaggcatttatggatttttagctttgaggaaaaaccatgacttttaacaaatttttatgggttatatgcctaaacccttatgccacatagtggtaaataattatgaaaaatggtctgttcataattggtaggtgccttttgtgagcagggagcataattattggtttattatggtaattatggtgattttttaaatatcatgtaatgttaaaacgttttctaacagtttactgttgcttatctccaagatattatggaattaagaatttttccagatgagtgttacatagattctttgaatttagtataaaagtactgagaattaagtttgtacttccataagcttggattttaaacactgatagtatctcatgagtaatgtgtgttttgggagagggagggatgctgattgatatttcacattgtatgaaataccatgtttgaaactcatagcaataatgctatgctgttgtgatccctctcaagttctgcatttaaaatatattttttctttataggaattgatgtataccatgaagtcattgtcagttgtagtagctctgatgttgaatgagatatcatgttttagcattccattttactgactagggtagaagaacacttttcttggctacatttggaggatacccagggagtcttgggtgttccttatctggggaagcaaacatttcactagtctctttttttcatcctttaaattgtaaattaaggattactcaagctcaccattattcaagattgggactcgcttcccagtcgacactctgccctgcctgtcattgctgcaaagagctgctgctttgccaacctaagcaaagaaaatacggcttctcttgcattattttcccttttggttggtttgttttctagaagtacgttcagatgctttggggaatgcaatgtatgatttgctagctctctcaccacttaactcactgtgaggataaatatgcatgctttttgtaattaactggtgctttgaaaatcttttttaagggagaaaaatctcaaccaaagttatgctcatccagacaagctgacctttgagttaatttcagcacaactcattcttcagtgcctcatgactgaaaacaaaaaacaaaaaaacgaaagcatcttcacaatgaagcttccagatagcaccgttttgctaaaagatacattctcattgttttccaacagtgatggcttccacataaggttaaacaaactaggtgcttgtaaataatttattacagtttactctatcgcatttctgtaacatgaaatgcatgcccttcttcaggggaagactgtggtcaagttaaaaaaaaaaaacaatattaaacaacatgaaactgcagtctgtttttgaaaatgagaatgtcctaagtgattcagaagagaggagggaagttgtgcactctgaaaatgcatgaaaaacaaaggcaaaaactagtgggaaatgtgtagaactgttaactgagatggcttcgagtcttccttctggaatctgttaaatttcacaaagtcatgagggtaaatggagaaaatatttctgggattacaatgaatgtaagcccaaattgtggaattgccagtaacctggatggggaaaagcatttcccatagcactccatgtaatatgagtgctctgtgagatgttcatcagtgttttatagaaatggtgttgctgggaaaccaagtttgcacctggaaacttacaatgcactttagcgcagtaagggcttggcatccggtagtgaaaaactgtctaacccagcattgcccaaactattttgacaccaggacctttttctcctttgggatacttatgaacctctcactaatgtcctgtggagaacattttgggaaacactatgttagatagttctttaaggagacaaaacggtaatgaacagatagcactggggcagaatatgcatgcattttgtaacgtccagtgtggcgttgaatagatgtgtatttcctcccctgcagaaaataagcacagaaaattataatgtaggtgatcggagctctttcctttgatagagagaacagccccaatgatcctggctttttcactgaacgtatcagaatacatggatgaattggggtaaataaggttttaattcagatctagaagaaagtattgtacgtttgaatgcagatttttatccacagatagttgtagtgtttagacatgacaggacctatcgttgaggtttctaagacttactatgggctgtaaacctgttttttaaaactattttagaaacctgagacttgccgtctggcattttagtttaatacaaactaatgattgcatttgaaagagattcttgaccttatttctaaacgtctagagctctgaaatgtcttgatggaaggtattaaactatttgcctgttgtacaaagaaatgttaagactcgtgaaaagaattactataaggtactgtgaaataactgcgattttgtgagcaaaacatacttggaaatgctgattgatttttatgcttgttagtgtattgcaagaaacacagaaaatgtagttttgttttaataaaccaaaaattgaacataaaaatg

SEQ ID NO: 16960 - DNA, 6267 bp, Homo sapiens
cactgcagctggcattggccgggactggaagtgcgggcttctgcagcagccgaagctggagctgctagggcagcagcggctcccctgttgtatggacattctgcacccgaaactgatagctgagtcctgaagttttatgttatgaaacagaagaactttcatcccagcacatgatttgggaattacactttgtgacatggatgaatctgcactgacccttggtacaatagatgtttcttatctgccacattcatcagaatacagtgttggtcgatgtaagcacacaagtgaggaatggggtgagtgtggctttagacccaccatcttcagatctgcaactttaaaatggaaagaaagcctaatgagtcggaaaaggccatttgttggaagatgttgttactcctgcactccccagagctgggacaaatttttcaaccccagtatcccgtctttgggtttgcggaatgttatttatatcaatgaaactcacacaagacaccgcggatggcttgcaagacgcctttcttacgttctttttattcaagagcgagatgtgcataagggcatgtttgccaccaatgtgactgaaaatgtgctgaacagcagtagagtacaagaggcaattgcagaagtggctgctgaattaaaccctgatggttctgcccagcagcaatcaaaagccgttaacaaagtgaaaaagaaagctaaaaggattcttcaagaaatggttgccactgtctcaccggcaatgatcagactgactgggtgggtgctgctaaaactgttcaacagcttcttttggaacattcaaattcacaaaggtcaacttgagatggttaaagctgcaactgagacgaatttgccgcttctgtttctaccagttcatagatcccatattgactatctgctgctcactttcattctcttctgccataacatcaaagcaccatacattgcttcaggcaataatctcaacatcccaatcttcagtaccttgatccataagcttgggggcttcttcatacgacgaaggctcgatgaaacaccagatggacggaaagatgttctctatagagctttgctccatgggcatatagttgaattacttcgacagcagcaattcttggagatcttcctggaaggcacacgttctaggagtggaaaaacctcttgtgctcgggcaggacttttgtcagttgtggtagatactctgtctaccaatgtcatcccagacatcttgataatacctgttggaatctcctatgatcgcattatcgaaggtcactacaatggtgaacaactgggcaaacctaagaagaatgagagcctgtggagtgtagcaagaggtgttattagaatgttacgaaaaaactatggttgtgtccgagtggattttgcacagccattttccttaaaggaatatttagaaagccaaagtcagaaaccggtgtctgctctactttccctggagcaagcgttgttaccagctatacttccttcaagacccagtgatgctgctgatgaaggtagagacacgtccattaatgagtccagaaatgcaacagatgaatccctacgaaggaggttgattgcaaatctggctgagcatattctattcactgctagcaagtcctgtgccattatgtccacacacattgtggcttgcctgctcctctacagacacaggcagggaattgatctctccacattggtcgaagacttctttgtgatgaaagaggaagtcctggctcgtgattttgacctggggttctcaggaaattcagaagatgtagtaatgcatgccatacagctgctgggaaattgtgtcacaatcacccacactagcaggaacgatgagttttttatcacccccagcacaactgtcccatcagtcttcgaactcaacttctacagcaatggggtacttcatgtctttatcatggaggccatcatagcttgcagcctttatgcagttctgaacaagaggggactggggggtcccactagcaccccacctaacctgatcagccaggagcagctggtgcggaaggcggccagcctgtgctaccttctctccaatgaaggcaccatctcactgccttgccagacattttaccaagtctgccatgaaacagtaggaaagtttatccagtatggcattcttacagtggcagagcacgatgaccaggaagatatcagtcctagtcttgctgagcagcagtgggacaagaagcttcctgaacctttgtcttggagaagtgatgaagaagatgaagacagtgactttggggaggaacagcgagattgctacctgaaggtgagccaatccaaggagcaccagcagtttatcaccttcttacagagactccttgggcctttgctggaggcctacagctctgctgccatctttgttcacaacttcagtggtcctgttccagaacctgagtatctgcaaaagttgcacaaatacctaataaccagaacagaaagaaatgttgcagtatatgctgagagtgccacatattgtcttgtgaagaatgctgtgaaaatgtttaaggatattggggttttcaaggagaccaaacaaaagagagtgtctgttttagaactgagcagcacttttctacctcaatgcaaccgacaaaaacttctagaatatattctgagttttgtggtgctgtaggtaacgtgtggcactgctggcaaatgaaggtcatgagatgagttccttgtaggtaccagcttctggctcaagagttgaaggtgccgtcgcagggtcaggcctgccctgtcccgaagtgatctcctggaagacaagtgccttctccctccatggatctgtgatcttcccagctctgcatcaacacagcagcctgcagataacacttggggggacctcagcctctattcgcaactcataatccgtagactacaagatgaaatctcaataaattatttttgagtttattaaagattgacattttaagtacaacttttaaggactaattactgtgatggacacagaaatgtagctgtgttctggaactgaatcttacatggtatacttagtgctgctgggtaatttgttggtatattatctggttagtggttaatgcttcctttaaaaataattgagtcatccattcactctttttcagttttatctgtcaatagtagctacatttttaatgggagcaccttttatcccaaagtgctttataaattgagtggactgatatatatcacacccaggtatcactgtgctgtcctttgctgtcagatttagaaatgtttttaagagctatgtgaaaacagacaatattagtttaggtcgggaactgagatattgtaatcaaatagttaacatcaggaagttaatttggctggcaaaattctagggaaacttggccagaaaactggtgttgaaggcttttgctcatataaacaagtgccattgagtttcaaatgaccagcaaatatatttagaacccttcctgttttatgtctgtacctcgtccacccctcaggtaatacctgcctctcacaggtacagctgtttcttggaaatcctccaaccaaatagcagttttcctaacttgattagcttgagctgacagactgttagaatacagttctctggccacagctgatgagggctttctgtactgcacacagattgtgtactgcaccccagtccaggtgactggtacccactcgagttgtgccgtgcacaacctgtccagtatatgcatgtggtggccctactgactggtaatggttagaggcatttatggatttttagctttgaggaaaaaccatgacttttaacaaatttttatgggttatatgcctaaacccttatgccacatagtggtaaataattatgaaaaatggtctgttcataattggtaggtgccttttgtgagcagggagcataattattggtttattatggtaattatggtgattttttaaatatcatgtaatgttaaaacgttttctaacagtttactgttgcttatctccaagatattatggaattaagaatttttccagatgagtgttacatagattctttgaatttagtataaaagtactgagaattaagttttgtttgaaactcatagcaataatgctatgctgttgtgatccctctcaagttctgcatttaaaatatattttttctttataggaattgatgtataccatgaagtcattgtcagttgtagtagctctgatgttgaatgagatatcatgttttagcattccattttactgactagggtagaagaacacttttcttggctacatttggaggatacccagggagtcttgggtgttccttatctggggaagcaaacatttcactagtctctttttttcatcctttaaattgtaaattaaggattactcaagctcaccattattcaagattgggactcgcttcccagtcgacactctgccctgcctgtcattgctgcaaagagctgctgctttgccaacctaagcaaagaaaatacggcttctcttgcattattttcccttttggttggtttgttttctagaagtacgttcagatgctttggggaatgcaatgtatgatttgctagctctctcaccacttaactcactgtgaggataaatatgcatgctttttgtaattaactggtgctttgaaaatcttttttaagggagaaaaatctcaaccaaagttatgctcatccagacaagctgacctttgagttaatttcagcacaactcattcttcagtgcctcatgactgaaaacaaaaaacaaaaaaacgaaagcatcttcacaatgaagcttccagatagcaccgttttgctaaaagatacattctcattgttttccaacagtgatggcttccacataaggttaaacaaactaggtgcttgtaaataatttattacagtttactctatcgcatttctgtaacatgaaatgcatgcccttcttcaggggaagactgtggtcaagttaaaaaaaaaaaacaatattaaacaacatgaaactgcagtctgtttttgaaaatgagaatgtcctaagtgattcagaagagaggagggaagttgtgcactctgaaaatgcatgaaaaacaaaggcaaaaactagtgggaaatgtgtagaactgttaactgagatggcttcgagtcttccttctggaatctgttaaatttcacaaagtcatgagggtaaatggagaaaatatttctgggattacaatgaatgtaagcccaaattgtggaattgccagtaacctggatggggaaaagcatttcccatagcactccatgtaatatgagtgctctgtgagatgttcatcagtgttttatagaaatggtgttgctgggaaaccaagtttgcacctggaaacttacaatgcactttagcgcagtaagggcttggcatccggtagtgaaaaactgtctaacccagcattgcccaaactattttgacaccaggacctttttctcctttgggatacttatgaacctctcactaatgtcctgtggagaacattttgggaaacactatgttagatagttctttaaggagacaaaacggtaatgaacagatagcactggggcagaatatgcatgcattttgtaacgtccagtgtggcgttgaatagatgtgtatttcctcccctgcagaaaataagcacagaaaattataatgtaggtgatcggagctctttcctttgatagagagaacagccccaatgatcctggctttttcactgaacgtatcagaatacatggatgaattggggtaaataaggttttaattcagatctagaagaaagtattgtacgtttgaatgcagatttttatccacagatagttgtagtgtttagacatgacaggacctatcgttgaggtttctaagacttactatgggctgtaaacctgttttttaaaactattttagaaacctgagacttgccgtctggcattttagtttaatacaaactaatgattgcatttgaaagagattcttgaccttatttctaaacgtctagagctctgaaatgtcttgatggaaggtattaaactatttgcctgttgtacaaagaaatgttaagactcgtgaaaagaattactataaggtactgtgaaataactgcgattttgtgagcaaaacatacttggaaatgctgattgatttttatgcttgttagtgtattgcaagaaacacagaaaatgtagttttgttttaataaaccaaaaattgaacataaaaatg

SEQ ID NO: 16961 - DNA, 6266 bp, Homo sapiens
cactgcagctggcattggccgggactggaagtgcgggcttctgcagcagccgaagctggagctgctagggcagcagcggctcccctgttgtatggacattctgcacccgaaactgatagctgagtcctgaagttttatgttatgaaacagaagaactttcatcccagcacatgatttgggaattacactttgtgacatggatgaatctgcactgacccttggtacaatagatgtttcttatctgccacattcatcagaatacagtgttggtcgatgtaagcacacaagtgaggaatggggtgagtgtggctttagacccaccatcttcagatctgcaactttaaaatggaaagaaagcctaatgagtcggaaaaggccatttgttggaagatgttgttactcctgcactccccagagctgggacaaatttttcaaccccagtatcccgtctttgggtttgcggaatgttatttatatcaatgaaactcacacaagacaccgcggatggcttgcaagacgcctttcttacgttctttttattcaagagcgagatgtgcataagggcatgtttgccaccaatgtgactgaaaatgtgctgaacagcagtagagtacaagaggcaattgcagaagtggctgctgaattaaaccctgatggttctgcccagcagcaatcaaaagccgttaacaaagtgaaaaagaaagctaaaaggattcttcaagaaatggttgccactgtctcaccggcaatgatcagactgactgggtgggtgctgctaaaactgttcaacagcttcttttggaacattcaaattcacaaaggtcaacttgagatggttaaagctgcaactgagacgaatttgccgcttctgtttctaccagttcatagatcccatattgactatctgctgctcactttcattctcttctgccataacatcaaagcaccatacattgcttcaggcaataatctcaacatcccaatcttcagtaccttgatccataagcttgggggcttcttcatacgacgaaggctcgatgaaacaccagatggacggaaagatgttctctatagagctttgctccatgggcatatagttgaattacttcgacagcagcaattcttggagatcttcctggaaggcacacgttctaggagtggaaaaacctcttgtgctcgggcaggacttttgtcagttgtggtagatactctgtctaccaatgtcatcccagacatcttgataatacctgttggaatctcctatgatcgcattatcgaaggtcactacaatggtgaacaactgggcaaacctaagaagaatgagagcctgtggagtgtagcaagaggtgttattagaatgttacgaaaaaactatggttgtgtccgagtggattttgcacagccattttccttaaaggaatatttagaaagccaaagtcagaaaccggtgtctgctctactttccctggagcaagcgttgttaccagctatacttccttcaagacccagtgatgctgctgatgaaggtagagacacgtccattaatgagtccagaaatgcaacagatgaatccctacgaaggaggttgattgcaaatctggctgagcatattctattcactgctagcaagtcctgtgccattatgtccacacacattgtggcttgcctgctcctctacagacacaggcagggaattgatctctccacattggtcgaagacttctttgtgatgaaagaggaagtcctggctcgtgattttgacctggggttctcaggaaattcagaagatgtagtaatgcatgccatacagctgctgggaaattgtgtcacaatcacccacactagcaggaacgatgagttttttatcacccccagcacaactgtcccatcagtcttcgaactcaacttctacagcaatggggtacttcatgtctttatcatggaggccatcatagcttgcagcctttatgcagttctgaacaagaggggactggggggtcccactagcaccccacctaacctgatcagccaggagcagctggtgcggaaggcggccagcctgtgctaccttctctccaatgaaggcaccatctcactgccttgccagacattttaccaagtctgccatgaaacagtaggaaagtttatccagtatggcattcttacagtggcagagcacgatgaccaggaagatatcagtcctagtcttgctgagcagcagtgggacaagaagcttcctgaacctttgtcttggagaagtgatgaagaagatgaagacagtgactttggggaggaacagcgagattgctacctgaaggtgagccaatccaaggagcaccagcagtttatcaccttcttacagagactccttgggcctttgctggaggcctacagctctgctgccatctttgttcacaacttcagtggtcctgttccagaacctgagtatctgcaaaagttgcacaaatacctaataaccagaacagaaagaaatgttgcagtatatgctgagagtgccacatattgtcttgtgaagaatgctgtgaaaatgtttaaggatattggggttttcaaggagaccaaacaaaagagagtgtctgttttagaactgagcagcacttttctacctcaatgcaaccgacaaaaacttctagaatatattctgagttttgtggtgctgtaggtaacgtgtggcactgctggcaaatgaaggtcatgagatgagttccttgtaggtaccagcttctggctcaagagttgaaggtgccgtcgcagggtcaggcctgccctgtcccgaagtgatctcctggaagacaagtgccttctccctccatggatctgtgatcttcccagctctgcatcaacacagcagcctgcagataacacttggggggacctcagcctctattcgcaactcataatccgtagactacaagatgaaatctcaataaattatttttgagtttattaaagattgacattttaagtacaacttttaaggactaattactgtgatggacacagaaatgtagctgtgttctggaactgaatcttacatggtatacttagtgctgctgggtaatttgttggtatattatctggttagtggttaatgcttcctttaaaaataattgagtcatccattcactctttttcagttttatctgtcaatagtagctacatttttaatgggagcaccttttatcccaaagtgctttataaattgagtggactgatatatatcacacccaggtatcactgtgctgtcctttgctgtcagatttagaaatgtttttaagagctatgtgaaaacagacaatattagtttaggtcgggaactgagatattgtaatcaaatagttaacatcaggaagttaatttggctggcaaaattctagggaaacttggccagaaaactggtgttgaaggcttttgctcatataaacaagtgccattgagtttcaaatgaccagcaaatatatttagaacccttcctgttttatgtctgtacctcgtccacccctcaggtaatacctgcctctcacaggtacagctgtttcttggaaatcctccaaccaaatagcagttttcctaacttgattagcttgagctgacagactgttagaatacagttctctggccacagctgatgagggctttctgtactgcacacagattgtgtactgcaccccagtccaggtgactggtacccactcgagttgtgccgtgcacaacctgtccagtatatgcatgtggtggccctactgactggtaatggttagaggcatttatggatttttagctttgaggaaaaaccatgacttttaacaaatttttatgggttatatgcctaaacccttatgccacatagtggtaaataattatgaaaaatggtctgttcataattggtaggtgccttttgtgagcagggagcataattattggtttattatggtaattatggtgattttttaaatatcatgtaatgttaaatttttccagatgagtgttacatagattctttgaatttagtataaaagtactgagaattaagtttgtacttccataagcttggattttaaacactgatagtatctcatgagtaatgtgtgttttgggagagggagggatgctgattgatatttcacattgtatgaaataccatgtttgaaactcatagcaataatgctatgctgttgtgatccctctcaagttctgcattttgtagtagctctgatgttgaatgagatatcatgttttagcattccattttactgactagggtagaagaacacttttcttggctacatttggaggatacccagggagtcttgggtgttccttatctggggaagcaaacatttcactagtctctttttttcatcctttaaattgtaaattaaggattactcaagctcaccattattcaagattgggactcgcttcccagtcgacactctgccctgcctgtcattgctgcaaagagctgctgctttgccaacctaagcaaagaaaatacggcttctcttgcattattttcccttttggttggtttgttttctagaagtacgttcagatgctttggggaatgcaatgtatgatttgctagctctctcaccacttaactcactgtgaggataaatatgcatgctttttgtaattaactggtgctttgaaaatcttttttaagggagaaaaatctcaaccaaagttatgctcatccagacaagctgacctttgagttaatttcagcacaactcattcttcagtgcctcatgactgaaaacaaaaaacaaaaaaacgaaagcatcttcacaatgaagcttccagatagcaccgttttgctaaaagatacattctcattgttttccaacagtgatggcttccacataaggttaaacaaactaggtgcttgtaaataatttattacagtttactctatcgcatttctgtaacatgaaatgcatgcccttcttcaggggaagactgtggtcaagttaaaaaaaaaaaacaatattaaacaacatgaaactgcagtctgtttttgaaaatgagaatgtcctaagtgattcagaagagaggagggaagttgtgcactctgaaaatgcatgaaaaacaaaggcaaaaactagtgggaaatgtgtagaactgttaactgagatggcttcgagtcttccttctggaatctgttaaatttcacaaagtcatgagggtaaatggagaaaatatttctgggattacaatgaatgtaagcccaaattgtggaattgccagtaacctggatggggaaaagcatttcccatagcactccatgtaatatgagtgctctgtgagatgttcatcagtgttttatagaaatggtgttgctgggaaaccaagtttgcacctggaaacttacaatgcactttagcgcagtaagggcttggcatccggtagtgaaaaactgtctaacccagcattgcccaaactattttgacaccaggacctttttctcctttgggatacttatgaacctctcactaatgtcctgtggagaacattttgggaaacactatgttagatagttctttaaggagacaaaacggtaatgaacagatagcactggggcagaatatgcatgcattttgtaacgtccagtgtggcgttgaatagatgtgtatttcctcccctgcagaaaataagcacagaaaattataatgtaggtgatcggagctctttcctttgatagagagaacagccccaatgatcctggctttttcactgaacgtatcagaatacatggatgaattggggtaaataaggttttaattcagatctagaagaaagtattgtacgtttgaatgcagatttttatccacagatagttgtagtgtttagacatgacaggacctatcgttgaggtttctaagacttactatgggctgtaaacctgttttttaaaactattttagaaacctgagacttgccgtctggcattttagtttaatacaaactaatgattgcatttgaaagagattcttgaccttatttctaaacgtctagagctctgaaatgtcttgatggaaggtattaaactatttgcctgttgtacaaagaaatgttaagactcgtgaaaagaattactataaggtactgtgaaataactgcgattttgtgagcaaaacatacttggaaatgctgattgatttttatgcttgttagtgtattgcaagaaacacagaaaatgtagttttgttttaataaaccaaaaattgaacataaaaatg

SEQ ID NO: 16962 - DNA, 6317 bp, Homo sapiens
cactgcagctggcattggccgggactggaagtgcgggcttctgcagcagccgaagctggagctgctagggcagcagcggctcccctgttgtatggacattctgcacccgaaactgatagctgagtcctgaagttttatgttatgaaacagaagaactttcatcccagcacatgatttgggaattacactttgtgacatggatgaatctgcactgacccttggtacaatagatgtttcttatctgccacattcatcagaatacagtgttggtcgatgtaagcacacaagtgaggaatggggtgagtgtggctttagacccaccatcttcagatctgcaactttaaaatggaaagaaagcctaatgagtcggaaaaggccatttgttggaagatgttgttactcctgcactccccagagctgggacaaatttttcaaccccagtatcccgtctttgggtttgcggaatgttatttatatcaatgaaactcacacaagacaccgcggatggcttgcaagacgcctttcttacgttctttttattcaagagcgagatgtgcataagggcatgtttgccaccaatgtgactgaaaatgtgctgaacagcagtagagtacaagaggcaattgcagaagtggctgctgaattaaaccctgatggttctgcccagcagcaatcaaaagccgttaacaaagtgaaaaagaaagctaaaaggattcttcaagaaatggttgccactgtctcaccggcaatgatcagactgactgggtgggtgctgctaaaactgttcaacagcttcttttggaacattcaaattcacaaaggtcaacttgagatggttaaagctgcaactgagacgaatttgccgcttctgtttctaccagttcatagatcccatattgactatctgctgctcactttcattctcttctgccataacatcaaagcaccatacattgcttcaggcaataatctcaacatcccaatcttcagtaccttgatccataagcttgggggcttcttcatacgacgaaggctcgatgaaacaccagatggacggaaagatgttctctatagagctttgctccatgggcatatagttgaattacttcgacagcagcaattcttggagatcttcctggaaggcacacgttctaggagtggaaaaacctcttgtgctcgggcaggacttttgtcagttgtggtagatactctgtctaccaatgtcatcccagacatcttgataatacctgttggaatctcctatgatcgcattatcgaaggtcactacaatggtgaacaactgggcaaacctaagaagaatgagagcctgtggagtgtagcaagaggtgttattagaatgttacgaaaaaactatggttgtgtccgagtggattttgcacagccattttccttaaaggaatatttagaaagccaaagtcagaaaccggtgtctgctctactttccctggagcaagcgttgttaccagctatacttccttcaagacccagtgatgctgctgatgaaggtagagacacgtccattaatgagtccagaaatgcaacagatgaatccctacgaaggaggttgattgcaaatctggctgagcatattctattcactgctagcaagtcctgtgccattatgtccacacacattgtggcttgcctgctcctctacagacacaggcagggaattgatctctccacattggtcgaagacttctttgtgatgaaagaggaagtcctggctcgtgattttgacctggggttctcaggaaattcagaagatgtagtaatgcatgccatacagctgctgggaaattgtgtcacaatcacccacactagcaggaacgatgagttttttatcacccccagcacaactgtcccatcagtcttcgaactcaacttctacagcaatggggtacttcatgtctttatcatggaggccatcatagcttgcagcctttatgcagttctgaacaagaggggactggggggtcccactagcaccccacctaacctgatcagccaggagcagctggtgcggaaggcggccagcctgtgctaccttctctccaatgaaggcaccatctcactgccttgccagacattttaccaagtctgccatgaaacagtaggaaagtttatccagtatggcattcttacagtggcagagcacgatgaccaggaagatatcagtcctagtcttgctgagcagcagtgggacaagaagcttcctgaacctttgtcttggagaagtgatgaagaagatgaagacagtgactttggggaggaacagcgagattgctacctgaaggtgagccaatccaaggagcaccagcagtttatcaccttcttacagagactccttgggcctttgctggaggcctacagctctgctgccatctttgttcacaacttcagtggtcctgttccagaacctgagtatctgcaaaagttgcacaaatacctaataaccagaacagaaagaaatgttgcagtatatgctgagagtgccacatattgtcttgtgaagaatgctgtgaaaatgtttaaggatattggggttttcaaggagaccaaacaaaagagagtgtctgttttagaactgagcagcacttttctacctcaatgcaaccgacaaaaacttctagaatatattctgagttttgtggtgctgtaggtaacgtgtggcactgctggcaaatgaaggtcatgagatgagttccttgtaggtaccagcttctggctcaagagttgaaggtgccgtcgcagggtcaggcctgccctgtcccgaagtgatctcctggaagacaagtgccttctccctccatggatctgtgatcttcccagctctgcatcaacacagcagcctgcagataacacttggggggacctcagcctctattcgcaactcataatccgtagactacaagatgaaatctcaataaattatttttgagtttattaaagattgacattttaagtacaacttttaaggactaattactgtgatggacacagaaatgtagctgtgttctggaactgaatcttacatggtatacttagtgctgctgggtaatttgttggtatattatctggttagtggttaatgcttcctttaaaaataattgagtcatccattcactctttttcagttttatctgtcaatagtagctacatttttaatgggagcaccttttatcccaaagtgctttataaattgagtggactgatatatatcacacccaggtatcactgtgctgtcctttgctgtcagatttagaaatgtttttaagagctatgtgaaaacagacaatattagtttaggtcgggaactgagatattgtaatcaaatagttaacatcaggaagttaatttggctggcaaaattctagggaaacttggccagaaaactggtgttgaaggcttttgctcatataaacaagtgccattgagtttcaaatgaccagcaaatatatttagaacccttcctgttttatgtctgtacctcgtccacccctcaggtaatacctgcctctcacaggtacagctgtttcttggaaatcctccaaccaaatagcagttttcctaacttgattagcttgagctgacagactgttagaatacagttctctggccacagctgatgagggctttctgtactgcacacagattgtgtactgcaccccagtccaggtgactggtacccactcgagttgtgccgtgcacaacctgtccagtatatgcatgtggtggccctactgactggtaatggttagaggcatttatggatttttagctttgaggaaaaaccatgacttttaacaaatttttatgggttatatgcctaaacccttatgccacatagtggtaaataattatgaaaaatggtctgttcataattggtaggtgccttttgtgagcagggagcataattattggtttattatggtaattatggtgattttttaaatatcatgtaatgttaaaacgttttctaacagtttactgttgcttatctccaagatattatggaattaagaatttttccagatgagtgttacatagattctttgaatttagtataaaagtactgagaattaagtttgtacttccataagcttggattttaaacactgatagtatctcatgagtaatgtgtgttttgggagagggagggatgctgattgatatttcacattgtatgaaataccatgtttgaaactcatagcaataatgctatgctgttgtgatccctctcaagttctgcatttaaaatatattttttctttataggaattgatgtataccatgaagtcattgtcagttgtagtagctctgatgttgaatgagatatcatgttttagcattccattttactgactagggtagaagaacacttttcttggctacatttggaggatacccagggagtcttgggtgttccttatctggggaagcaaacatttcactagtctctttttttcatcctttaaattgtaaattaaggattactcaagctcaccattattcaagattgggactcgcttcccagtcgacactctgccctgcctgtcattgctgcaaagagctgctgctttgccaacctaagcaaagaaaatacggcttctcttgcattattttcccttttggttggtttgttttctagaagtacgttcagatgctttggggaatgcaatgtatgatttgctagctctctcaccacttaactcactgtgaggataaatatgcatgctttttgtaattaactggtgctttgaaaatcttttttaagggagaaaaatctcaaccaaagttatgctcatccagacaagctgacctttgagttaatttcagcacaactcattcttcagtgcctcatgactgaaaacaaaaaacaaaaaaacgaaagcatcttcacaatgaagcttccagatagcaccgttttgctaaaagatacattctcattgttttccaacagtgatggcttccacataaggttaaacaaactaggtgcttgtaaataatttattacagtttactctatcgcatttctgtaacatgaaatgcatgcccttcttcaggggaagactgtggtcaagttaaaaactaagtgattcagaagagaggagggaagttgtgcactctgaaaatgcatgaaaaacaaaggcaaaaactagtgggaaatgtgtagaactgttaactgagatggcttcgagtcttccttctggaatctgttaaatttcacaaagtcatgagggtaaatggagaaaatatttctgggattacaatgaatgtaagcccaaattgtggaattgccagtaacctggatggggaaaagcatttcccatagcactccatgtaatatgagtgctctgtgagatgttcatcagtgttttatagaaatggtgttgctgggaaaccaagtttgcacctggaaacttacaatgcactttagcgcagtaagggcttggcatccggtagtgaaaaactgtctaacccagcattgcccaaactattttgacaccaggacctttttctcctttgggatacttatgaacctctcactaatgtcctgtggagaacattttgggaaacactatgttagatagttctttaaggagacaaaacggtaatgaacagatagcactggggcagaatatgcatgcattttgtaacgtccagtgtggcgttgaatagatgtgtatttcctcccctgcagaaaataagcacagaaaattataatgtaggtgatcggagctctttcctttgatagagagaacagccccaatgatcctggctttttcactgaacgtatcagaatacatggatgaattggggtaaataaggttttaattcagatctagaagaaagtattgtacgtttgaatgcagatttttatccacagatagttgtagtgtttagacatgacaggacctatcgttgaggtttctaagacttactatgggctgtaaacctgttttttaaaactattttagaaacctgagacttgccgtctggcattttagtttaatacaaactaatgattgcatttgaaagagattcttgaccttatttctaaacgtctagagctctgaaatgtcttgatggaaggtattaaactatttgcctgttgtacaaagaaatgttaagactcgtgaaaagaattactataaggtactgtgaaataactgcgattttgtgagcaaaacatacttggaaatgctgattgatttttatgcttgttagtgtattgcaagaaacacagaaaatgtagttttgttttaataaaccaaaaattgaacataaaaatg

SEQ ID NO: 16963 - DNA, 6320 bp, Homo sapiens
cactgcagctggcattggccgggactggaagtgcgggcttctgcagcagccgaagctggagctgctagggcagcagcggctcccctgttgtatggacattctgcacccgaaactgatagctgagtcctgaagttttatgttatgaaacagaagaactttcatcccagcacatgatttgggaattacactttgtgacatggatgaatctgcactgacccttggtacaatagatgtttcttatctgccacattcatcagaatacagtgttggtcgatgtaagcacacaagtgaggaatggggtgagtgtggctttagacccaccatcttcagatctgcaactttaaaatggaaagaaagcctaatgagtcggaaaaggccatttgttggaagatgttgttactcctgcactccccagagctgggacaaatttttcaaccccagtatcccgtctttgggtttgcggaatgttatttatatcaatgaaactcacacaagacaccgcggatggcttgcaagacgcctttcttacgttctttttattcaagagcgagatgtgcataagggcatgtttgccaccaatgtgactgaaaatgtgctgaacagcagtagagtacaagaggcaattgcagaagtggctgctgaattaaaccctgatggttctgcccagcagcaatcaaaagccgttaacaaagtgaaaaagaaagctaaaaggattcttcaagaaatggttgccactgtctcaccggcaatgatcagactgactgggtgggtgctgctaaaactgttcaacagcttcttttggaacattcaaattcacaaaggtcaacttgagatggttaaagctgcaactgagacgaatttgccgcttctgtttctaccagttcatagatcccatattgactatctgctgctcactttcattctcttctgccataacatcaaagcaccatacattgcttcaggcaataatctcaacatcccaatcttcagtaccttgatccataagcttgggggcttcttcatacgacgaaggctcgatgaaacaccagatggacggaaagatgttctctatagagctttgctccatgggcatatagttgaattacttcgacagcagcaattcttggagatcttcctggaaggcacacgttctaggagtggaaaaacctcttgtgctcgggcaggacttttgtcagttgtggtagatactctgtctaccaatgtcatcccagacatcttgataatacctgttggaatctcctatgatcgcattatcgaaggtcactacaatggtgaacaactgggcaaacctaagaagaatgagagcctgtggagtgtagcaagaggtgttattagaatgttacgaaaaaactatggttgtgtccgagtggattttgcacagccattttccttaaaggaatatttagaaagccaaagtcagaaaccggtgtctgctctactttccctggagcaagcgttgttaccagctatacttccttcaagacccagtgatgctgctgatgaaggtagagacacgtccattaatgagtccagaaatgcaacagatgaatccctacgaaggaggttgattgcaaatctggctgagcatattctattcactgctagcaagtcctgtgccattatgtccacacacattgtggcttgcctgctcctctacagacacaggcagggaattgatctctccacattggtcgaagacttctttgtgatgaaagaggaagtcctggctcgtgattttgacctggggttctcaggaaattcagaagatgtagtaatgcatgccatacagctgctgggaaattgtgtcacaatcacccacactagcaggaacgatgagttttttatcacccccagcacaactgtcccatcagtcttcgaactcaacttctacagcaatggggtacttcatgtctttatcatggaggccatcatagcttgcagcctttatgcagttctgaacaagaggggactggggggtcccactagcaccccacctaacctgatcagccaggagcagctggtgcggaaggcggccagcctgtgctaccttctctccaatgaaggcaccatctcactgccttgccagacattttaccaagtctgccatgaaacagtaggaaagtttatccagtatggcattcttacagtggcagagcacgatgaccaggaagatatcagtcctagtcttgctgagcagcagtgggacaagaagcttcctgaacctttgtcttggagaagtgatgaagaagatgaagacagtgactttggggaggaacagcgagattgctacctgaaggtgagccaatccaaggagcaccagcagtttatcaccttcttacagagactccttgggcctttgctggaggcctacagctctgctgccatctttgttcacaacttcagtggtcctgttccagaacctgagtatctgcaaaagttgcacaaatacctaataaccagaacagaaagaaatgttgcagtatatgctgagagtgccacatattgtcttgtgaagaatgctgtgaaaatgtttaaggatattggggttttcaaggagaccaaacaaaagagagtgtctgttttagaactgagcagcacttttctacctcaatgcaaccgacaaaaacttctagaatatattctgagttttgtggtgctgtaggtaacgtgtggcactgctggcaaatgaaggtcatgagatgagttccttgtaggtaccagcttctggctcaagagttgaaggtgccgtcgcagggtcaggcctgccctgtcccgaagtgatctcctggaagacaagtgccttctccctccatggatctgtgatcttcccagctctgcatcaacacagcagcctgcagataacacttggggggacctcagcctctattcgcaactcataatccgtagactacaagatgaaatctcaataaattatttttgagtttattaaagattgacattttaagtacaacttttaaggactaattactgtgatggacacagaaatgtagctgtgttctggaactgaatcttacatggtatacttagtgctgctgggtaatttgttggtatattatctggttagtggttaatgcttcctttaaaaataattgagtcatccattcactctttttcagttttatctgtcaatagtagctacatttttaatgggagcaccttttatcccaaagtgctttataaattgagtggactgatatatatcacacccaggtatcactgtgctgtcctttgctgtcagatttagaaatgtttttaagagctatgtgaaaacagacaatattagtttaggtcgggaactgagatattgtaatcaaatagttaacatcaggaagttaatttggctggcaaaattctagggaaacttggccagaaaactggtgttgaaggcttttgctcatataaacaagtgccattgagtttcaaatgaccagcaaatatatttagaacccttcctgttttatgtctgtacctcgtccacccctcaggtaatacctgcctctcacaggtacagctgtttcttggaaatcctccaaccaaatagcagttttcctaacttgattagcttgagctgacagactgttagaatacagttctctggccacagctgatgagggctttctgtactgcacacagattgtgtactgcaccccagtccaggtgactggtacccactcgagttgtgccgtgcacaacctgtccagtatatgcatgtggtggccctactgactggtaatggttagaggcatttatggatttttagctttgaggaaaaaccatgacttttaacaaatttttatgggttatatgcctaaacccttatgccacatagtggtaaataattatgaaaaatggtctgttcataattggtaggtgccttttgtgagcagggagcataattattggtttattatggtaattatggtgattttttaaatatcatgtaatgttaaaacgttttctaacagtttactgttgcttatctccaagatattatggaattaagaatttttccagatgagtgttacatagattctttgaatttagtataaaagtactgagaattaagtttgtacttccataagcttggattttaaacactgatagtatctcatgagtaatgtgtgttttgggagagggagggatgctgattgatatttcacattgtatgaaataccatgtttgaaactcatagcaataatgctatgctgttgtgatccctctcaagttctgcatttaaaatatattttttctttataggaattgatgtataccatgaagtcattgtcagttgtagtagctctgatgttgaatgagatatcatgttttagcattccattttactgactagggtagaagaacacttttcttggctacatttggaggatacccagggagtcttgggtgttccttatctggggaagcaaacatttcactagtctctttttttcatcctttaaattgtaaattaaggattactcaagctcaccattattcaagattgggactcgcttcccagtcgacactctgccctgcctgtcattgctgcaaagagctgctgctttgccaacctaagcaaagaaaatacggcttctcttgcattattttcccttttggttggtttgttttctagaagtacgttcagatgctttggggaatgcaatgtatgatttgctagctctctcaccacttaactcactgtgaggataaatatgcatgctttttgtaattaactggtgctttgaaaatcttttttaagggagaaaaatctcaaccaaagttatgctcatccagacaagctgacctttgagttaatttcagcacaactcattcttcagtgcctcatgactgaaaacaaaaaacaaaaaaacgaaagcatcttcacaatgaagcttccagatagcaccgttttgctaaaagatacattctcattgttttccaacagtgatggcttccacataaggttaaacaaactaggtgcttgtaaataatttattacagtttactctatcgcatttctgtaacatgaaatgcatgcccttcttcaggggaagactgtggtcaagttaaaaaaaaaaaacaatattaaacaacatgaaactgcagtctgtttttgaaaatgagaatgtcctaagtgattcagaagagaggagggaagttgtgcactctgaaaatgcatgaaaaacaaaggcaaaaactagtgggaaatgtgtagaactgttaactgagatggcttcgagtcttccttctggaatctgttaaatttcacaaagtcatgagggtaaatggagaaaatatttctgggattacaatgaatgtaagcccaaattgtggaattgccagtaacctggatggggaaaagcatttcccatagcactccatgtaatatgagtgctctgtgagatgttcatcagtgttttatagaaatggtgttgctgggaaaccaagtttgcacctggaaacttacaatgcactttagcgcagtaagggcttggcatccggtagtgaaaaactgtctaacccagcattgcccaaactattttgacaccaggacctttttctcctttgggatacttatgaacctctcactaatgtcctgtggagaacattttgggaaacactatgttagatagttctttaaggagacaaaacggtaatgaacagatagcactggggcagaatatgcatgcattttgtaacgtccagtgtggcgttgaatagatgtgtatttcctcccctgcagaaaataagcacagaaaattataatgtaggtgatcggagctctttcctttgatagagagaacagccccaatgatcctggctttttcactgaacgtatcagaatacatggatgaattggggtaaataaggttttaattcagatctagaagaaagtattgtacgtttgaatgcagatttttatccacagatagttgtagtgtttagacatgacaggacctatcgttgaggtttctaagacttactatgggctgtaaacctgttttttataatgattgcatttgaaagagattcttgaccttatttctaaacgtctagagctctgaaatgtcttgatggaaggtattaaactatttgcctgttgtacaaagaaatgttaagactcgtgaaaagaattactataaggtactgtgaaataactgcgattttgtgagcaaaacatacttggaaatgctgattgatttttatgcttgttagtgtattgcaagaaacacagaaaatgtagttttgttttaataaaccaaaaattgaacataaaaatg

SEQ ID NO: 16964 - DNA, 4988 bp, Homo sapiens
  misc_feature (4920)..(4920): n is a, c, g, or t
  misc_feature (4942)..(4942): n is a, c, g, or t
cactgcagctggcattggccgggactggaagtgcgggcttctgcagcagccgaagctggagctgctagggcagcagcggctcccctgttgtatggacattctgcacccgaaactgatagctgagtcctgaagttttatgttatgaaacagaagaactttcatcccagcacatgatttgggaattacactttgtgacatggatgaatctgcactgacccttggtacaatagatgtttcttatctgccacattcatcagaatacagtgttggtcgatgtaagcacacaagtgaggaatggggtgagtgtggctttagacccaccatcttcagatctgcaactttaaaatggaaagaaagcctaatgagtcggaaaaggccatttgttggaagatgttgttactcctgcactccccagagctgggacaaatttttcaaccccagtatcccgtctttgggtttgcggaatgttatttatatcaatgaaactcacacaagacaccgcggatggcttgcaagacgcctttcttacgttctttttattcaagagcgagatgtgcataagggcatgtttgccaccaatgtgactgaaaatgtgctgaacagcagtagagtacaagaggcaattgcagaagtggctgctgaattaaaccctgatggttctgcccagcagcaatcaaaagccgttaacaaagtgaaaaagaaagctaaaaggattcttcaagaaatggttgccactgtctcaccggcaatgatcagactgactgggtgggtgctgctaaaactgttcaacagcttcttttggaacattcaaattcacaaaggtcaacttgagatggttaaagctgcaactgagacgaatttgccgcttctgtttctaccagttcatagatcccatattgactatctgctgctcactttcattctcttctgccataacatcaaagcaccatacattgcttcaggcaataatctcaacatcccaatcttcagtaccttgatccataagcttgggggcttcttcatacgacgaaggctcgatgaaacaccagatggacggaaagatgttctctatagagctttgctccatgggcatatagttgaattacttcgacagcagcaattcttggagatcttcctggaaggcacacgttctaggagtggaaaaacctcttgtgctcgggcaggacttttgtcagttgtggtagatactctgtctaccaatgtcatcccagacatcttgataatacctgttggaatctcctatgatcgcattatcgaaggtcactacaatggtgaacaactgggcaaacctaagaagaatgagagcctgtggagtgtagcaagaggtgttattagaatgttacgaaaaaactatggttgtgtccgagtggattttgcacagccattttccttaaaggaatatttagaaagccaaagtcagaaaccggtgtctgctctactttccctggagcaagcgttgttaccagctatacttccttcaagacccagtgatgctgctgatgaaggtagagacacgtccattaatgagtccagaaatgcaacagatgaatccctacgaaggaggttgattgcaaatctggctgagcatattctattcactgctagcaagtcctgtgccattatgtccacacacattgtggcttgcctgctcctctacagacacaggcagggaattgatctctccacattggtcgaagacttctttgtgatgaaagaggaagtcctggctcgtgattttgacctggggttctcaggaaattcagaagatgtagtaatgcatgccatacagctgctgggaaattgtgtcacaatcacccacactagcaggaacgatgagttttttatcacccccagcacaactgtcccatcagtcttcgaactcaacttctacagcaatggggtacttcatgtctttatcatggaggccatcatagcttgcagcctttatgcagttctgaacaagaggggactggggggtcccactagcaccccacctaacctgatcagccaggagcagctggtgcggaaggcggccagcctgtgctaccttctctccaatgaaggcaccatctcactgccttgccagacattttaccaagtctgccatgaaacagtaggaaagtttatccagtatggcattcttacagtggcagagcacgatgaccaggaagatatcagtcctagtcttgctgagcagcagtgggacaagaagcttcctgaacctttgtcttggagaagtgatgaagaagatgaagacagtgactttggggaggaacagcgagattgctacctgaaggtgagccaatccaaggagcaccagcagtttatcaccttcttacagagactccttgggcctttgctggaggcctacagctctgctgccatctttgttcacaacttcagtggtcctgttccagaacctgagtatctgcaaaagttgcacaaatacctaataaccagaacagaaagaaatgttgcagtatatgctgagagtgccacatattgtcttgtgaagaatgctgtgaaaatgtttaaggatattggggttttcaaggagaccaaacaaaagagagtgtctgttttagaactgagcagcacttttctacctcaatgcaaccgacaaaaacttctagaatatattctgagttttgtggtgctgtaggtaacgtgtggcactgctggcaaatgaaggtcatgagatgagttccttgtaggtaccagcttctggctcaagagttgaaggtgccgtcgcagggtcaggcctgccctgtcccgaagtgatctcctggaagacaagtgccttctccctccatggatctgtgatcttcccagctctgcatcaacacagcagcctgcagataacacttggggggacctcagcctctattcgcaactcataatccgtagactacaagatgaaatctcaataaattatttttgagtttattaaagattgacattttaagtacaacttttaaggactaattactgtgatggacacagaaatgtagctgtgttctggaactgaatcttacatggtatacttagtgctgctgggtaatttgttggtatattatctggttagtggttaatgcttcctttaaaaataattgagtcatccattcactctttttcagttttatctgtcaatagtagctacatttttaatgggagcaccttttatcccaaagtgctttataaattgagtggactgatatatatcacacccaggtatcactgtgctgtcctttgctgtcagatttagaaatgtttttaagagctatgtgaaaacagacaatattagtttaggtcgggaactgagatattgtaatcaaatagttaacatcaggaagttaatttggctggcaaaattctagggaaacttggccagaaaactggtgttgaaggcttttgctcatataaacaagtgccattgagtttcaaatgaccagcaaatatatttagaacccttcctgttttatgtctgtacctcgtccacccctcaggtaatacctgcctctcacaggtacagctgtttcttggaaatcctccaaccaaatagcagttttcctaacttgattagcttgagctgacagactgttagaatacagttctctggccacagctgatgagggctttctgtactgcacacagattgtgtactgcaccccagtccaggtgactggtacccactcgagttgtgccgtgcacaacctgtccagtatatgcatgtggtggccctactgactggtaatggttagaggcatttatggatttttagctttgaggaaaaaccatgacttttaacaaatttttatgggttatatgcctaaacccttatgccacatagtggtaaataattatgaaaaatggtctgttcataattggtaggtgccttttgtgagcagggagcataattattggtttattatggtaattatggtgattttttaaatatcatgtaatgttaaaacgttttctaacagtttactgttgcttatctccaagatattatggaattaagaatttttccagatgagtgttacatagattctttgaatttagtataaaagtactgagaattaagtttgtacttccataagcttggattttaaacactgatagtatctcatgagtaatgtgtgttttgggagagggagggatgctgattgatatttcacattgtatgaaataccatgtttgaaactcatagcaataatgctatgctgttgtgatccctctcaagttctgcatttaaaatatattttttctttataggaattgatgtataccatgaagtcattgtcagttgtagtagctctgatgttgaatgagatatcatgttttagcattccattttactgactagggtagaagaacacttttcttggctacatttggaggatacccagggagtcttgggtgttccttatctggggaagcaaacatttcactagtctctttttttcatcctttaaattgtaaattaaggattactcaagctcaccattattcaagattgggactcgcttcccagtcgacactctgccctgcctgtcattgctgcaaagagctgctgctttgccaacctaagcaaagaaaatacggcttctcttgcattattttcccttttggttggtttgttttctagaagtacgttcagatgctttggggaatgcaatgtatgatttgctagctctctcaccacttaactcactgtgaggataaatatgcatgctttttgtaattaactggtgctttgaaaatcttttttaagggagaaaaatctcaaccaaagttatgctcatccagacaagctgacctttgagttaatttcagcacaactcattcttcagtgcctcatgactgaaaacaaaaaacaaaaaaaaactcgagggntggccttggaacggcatcaatnttggtgtctgtgagatgagtaagaaagagtagataagagggctaca

SEQ ID NO: 16965 - DNA, 4304 bp, Homo sapiens
cactgcagctggcattggccgggactggaagtgcgggcttctgcagcagccgaagctggagctgctagggcagcagcggctcccctgttgtatggacattctgcacccgaaactgatagctgagtcctgaagttttatgttatgaaacagaagaactttcatcccagcacatgatttgggaattacactttgtgacatggatgaatctgcactgacccttggtacaatagatgtttcttatctgccacattcatcagaatacagtgttggtcgatgtaagcacacaagtgaggaatggggtgagtgtggctttagacccaccatcttcagatctgcaactttaaaatggaaagaaagcctaatgagtcggaaaaggccatttgttggaagatgttgttactcctgcactccccagagctgggacaaatttttcaaccccagtatcccgtctttgggtttgcggaatgttatttatatcaatgaaactcacacaagacaccgcggatggcttgcaagacgcctttcttacgttctttttattcaagagcgagatgtgcataagggcatgtttgccaccaatgtgactgaaaatgtgctgaacagcagtagagtacaagaggcaattgcagaagtggctgctgaattaaaccctgatggttctgcccagcagcaatcaaaagccgttaacaaagtgaaaaagaaagctaaaaggattcttcaagaaatggttgccactgtctcaccggcaatgatcagactgactgggtgggtgctgctaaaactgttcaacagcttcttttggaacattcaaattcacaaaggtcaacttgagatggttaaagctgcaactgagacgaatttgccgcttctgtttctaccagttcatagatcccatattgactatctgctgctcactttcattctcttctgccataacatcaaagcaccatacattgcttcaggcaataatctcaacatcccaatcttcagtaccttgatccataagcttgggggcttcttcatacgacgaaggctcgatgaaacaccagatggacggaaagatgttctctatagagctttgctccatgggcatatagttgaattacttcgacagcagcaattcttggagatcttcctggaaggcacacgttctaggagtggaaaaacctcttgtgctcgggcaggacttttgtcagttgtggtagatactctgtctaccaatgtcatcccagacatcttgataatacctgttggaatctcctatgatcgcattatcgaaggtcactacaatggtgaacaactgggcaaacctaagaagaatgagagcctgtggagtgtagcaagaggtgttattagaatgttacgaaaaaactatggttgtgtccgagtggattttgcacagccattttccttaaaggaatatttagaaagccaaagtcagaaaccggtgtctgctctactttccctggagcaagcgttgttaccagctatacttccttcaagacccagtgatgctgctgatgaaggtagagacacgtccattaatgagtccagaaatgcaacagatgaatccctacgaaggaggttgattgcaaatctggctgagcatattctattcactgctagcaagtcctgtgccattatgtccacacacattgtggcttgcctgctcctctacagacacaggcagggaattgatctctccacattggtcgaagacttctttgtgatgaaagaggaagtcctggctcgtgattttgacctggggttctcaggaaattcagaagatgtagtaatgcatgccatacagctgctgggaaattgtgtcacaatcacccacactagcaggaacgatgagttttttatcacccccagcacaactgtcccatcagtcttcgaactcaacttctacagcaatggggtacttcatgtctttatcatggaggccatcatagcttgcagcctttatgcagttctgaacaagaggggactggggggtcccactagcaccccacctaacctgatcagccaggagcagctggtgcggaaggcggccagcctgtgctaccttctctccaatgaaggcaccatctcactgccttgccagacattttaccaagtctgccatgaaacagtaggaaagtttatccagtatggcattcttacagtggcagagcacgatgaccaggaagatatcagtcctagtcttgctgagcagcagtgggacaagaagcttcctgaacctttgtcttggagaagtgatgaagaagatgaagacagtgactttggggaggaacagcgagattgctacctgaaggtgagccaatccaaggagcaccagcagtttatcaccttcttacagagactccttgggcctttgctggaggcctacagctctgctgccatctttgttcacaacttcagtggtcctgttccagaacctgagtatctgcaaaagttgcacaaatacctaataaccagaacagaaagaaatgttgcagtatatgctgagagtgccacatattgtcttgtgaagaatgctgtgaaaatgtttaaggatattggggttttcaaggagaccaaacaaaagagagtgtctgttttagaactgagcagcacttttctacctcaatgcaaccgacaaaaacttctagaatatattctgagttttgtggtgctgtaggtaacgtgtggcactgctggcaaatgaaggtcatgagatgagttccttgtaggtaccagcttctggctcaagagttgaaggtgccgtcgcagggtcaggcctgccctgtcccgaagtgatctcctggaagacaagtgccttctccctccatggatctgtgatcttcccagctctgcatcaacacagcagcctgcagataacacttggggggacctcagcctctattcgcaactcataatccgtagactacaagatgaaatctcaataaattatttttgagtttattaaagattgacattttaagtacaacttttaaggactaattactgtgatggacacagaaatgtagctgtgttctggaactgaatcttacatggtatacttagtgctgctgggtaatttgttggtatattatctggttagtggttaatgcttcctttaaaaataattgagtcatccattcactctttttcagttttatctgtcaatagtagctacatttttaatgggagcaccttttatcccaaagtgctttataaattgagtggactgatatatatcacacccaggtatcactgtgctgtcctttgctgtcagatttagaaatgtttttaagagctatgtgaaaacagacaatattagtttaggtcgggaactgagatattgtaatcaaatagttaacatcaggaagttaatttggctggcaaaattctagggaaacttggccagaaaactggtgttgaaggcttttgctcatataaacaagtgccattgagtttcaaatgaccagcaaatatatttagaacccttcctgttttatgtctgtacctcgtccacccctcaggtaatacctgcctctcacaggtacagctgtttcttggaaatcctccaaccaaatagcagttttcctaacttgattagcttgagctgacagactgttagaatacagttctctggccacagctgatgagggctttctgtactgcacacagattgtgtactgcaccccagtccaggtgactggtacccactcgagttgtgccgtgcacaacctgtccagtatatgcatgtggtggccctactgactggtaatggttagaggcatttatggatttttagctttgaggaaaaaccatgacttttaacaaatttttatgggttatatgcctaaacccttatgccacatagtggtaaataattatgaaaaatggtctgttcataattggtaggtgccttttgtgagcagggagcataattattggtttattatggtaattatggtgattttttaaatatcatgtaatgttaaaacgttttctaacagtttactgttgcttatctccaagatattatggaattaagaatttttccagatgagtgttacatagattctttgaatttagtataaaagtactgagaattaagtttgtacttccataagcttggattttaaacactgatagtatctcatgagtaatgtgtgttttgggagagggagggatgctgattgatatttcacattgtatgaaataccatggttgaaataataaaaaaaatgtcaagccggtgggatcccttctaaagaaccgcattaaaatttatttttggtctaaggaatttt

SEQ ID NO: 16966 - DNA, 437 bp, Homo sapiens
cagctggtctggctcaaagactgggccaaatggattgcttttaaagacatggagtttgattatgtgttatacatgttagcatatgttcaggttggagaagggccatatgtgggagcgatagaggtagcatgactacattactcaaactgtacatttagcctgtgtcctgtttctccttctgatattttcagtatttgccttctctccccaactaaaaaagaaaaccagcaaggtgcggtggctcatgcctgtaatcccagcactttgagaggccaaggcggttggatcaagaagtcaggagttcaagaccactgtggccaacatggtgaaaccctgtctgtactaaaaacacaaaaattagccgggcatgctggcgtgtgcctgtaatctcagctacttgggaggctgaggcaggagaattgcttgagctggtacca

SEQ ID NO: 16967 - DNA, 6765 bp, Homo sapiens
cgccggtggaggggcgcgcggccgcgagcaaaggagggagggaaggaaggaagagagggaggcgggcaagcaggcgggcgcgggggtcggggactgaggcagtagagggaggcgagagcccggcagccgcttcgcgctgtttgctgcgcgggcttttggagggggcggccgtttagtcggctgaggagaagcggacaccagcggcgttggtgatagcgcctgggggagggggactggagaggcgagaaggggggtcgctgcggtggttctctcgctgtcgctctctctttgcctcgctcccggctcggcgggctcctcccggcgtctctctcgcctccggggtcccgctccccgccccccgcggtatgtcttgatcccgagcagcgggtttcatggggctcctcaggattatgatgccgcccaagttgcagctgctggcggtggtggccttcgcggtggcgatgctcttcttggaaaaccagatccagaaactggaggagtcccgctcgaagctagaaagggctattgcaagacacgaagtccgagaaattgagcagcgacatacaatggatggccctcggcaagatgccactttagatgaggaagaggacatggtgatcatttataacagagttcccaaaacggcaagcacttcatttaccaatatcgcctatgacctgtgtgcaaagaataaataccatgtccttcatatcaacactaccaaaaataatccagtgatgtcattgcaagatcaggtgcgctttgtaaagaatataacttcctggaaagagatgaaaccaggattttatcatggacacgtttcttacttggattttgcaaaatttggtgtgaagaagaaaccaatttacattaatgtcataagggatcctattgagaggctagtttcttattattactttctgagatttggagatgattatagaccagggttacggagacgaaaacaaggagacaaaaagacctttgatgaatgtgtagcagaaggtggctcagactgtgctccagagaagctctggcttcaaatcccgttcttctgtggccatagctccgaatgctggaatgtgggaagcaggtgggctatggatcaagccaagtataacctaattaatgaatattttctggtgggagttactgaagaacttgaagattttatcatgttattggaggcagcattgccccggtttttcaggggtgctactgaactctatcgcacaggaaagaaatctcatcttaggaaaaccacagagaagaaactccccactaaacaaaccattgcaaaactacagcaatctgatcatttaggcaaatggagaatgagttctatgaatttgcactagagcagttccaattcatcagagcccatgccgttcgagaaaaagatggagacctctacatcctcgcacaaaactttttctatgaaaagatttaccctaagtcgaactgagtataaggtgtgactattagattcttgaactaaaatttgaccctgtcttcacctttgttctcagctccacagtctggattgctgacagtaggtgtatatgacaatttgtattgagccaaattaggaaacagacagtaacgtcaaggaagtagatactggctggcattgtcagtgttctaagtttcaggcatttttatttttcctggctaaacgttggtgaaagttataacctcctgcctgggagaaaatatacatcacctaaaatgaacttatggcaggtctaatcaaaaggctaaatacaatttcagaaaaggttctgatactcttgtttttgataaagcattttttcaactaaccatgaattaagatgagtccatttgcctcttctgccttcactgagggtttgggttatacacctctactgaattgtgttaataactgtttggcagtgtgtactttgtttttgtgagtcatgtctcatgaaatttattggaatgtttaatcatatttgctaagaaatgtttctgctgtagttggatttgcccatatttatgtaggtggttttaattttttaaatggtgattagtgttaaaaatcaatttaaatcatgactaatatggtaaaaagataaagcatcaaagcagtatttctcattcctgcctcctcaatatctaatactgggaagatacttcaaagaatattgagattgtctgaagttttagttaagattttcacacattaatatcaaaaaagtaagtttagtatttgtttctccatgggttatttgtaaagctgtaaactgagatatcggtgactccgtattatgactccattagtgagctgtggtatgggtaggattttcctacttcttctgtacttttacctgtagactatttttactaaggtgctttataatgtgttttaaagcattgcatttacaaaacaaggaaaatgctgtaaatattgcatattttatgtatttggaccaaaaggttacaagtaattagacaaaagtggttttgcaccaattttatgtcaagtaaaaccatcagacctactgttcttgtatttctcatttaactttactgttaagacatcactgaaatgaacttcagtaagctttcaattttgatacacagttcattattcataacttgaggcagtaattacagtggaatgagtactggacaaggagtcaaaaaacttgatttcaggtcctagctctagcacttacagctgtgtgatcttgggcaagtcacttaacctctctttgcctcaatttcctcatcttgaaatgaggataataatacctgctgtacctacctcacagggctgttgtgaggattaaatgagatggcatgtgaaagcactttgaaaattgtaaagcgctatgtaaatgtaaggtattatagaaacatctttaacatatagtttcataccattcattttttaacaaagaaagggaaaagtctgcttgtaagctggttgaaaaagttaatcttgatataaatttgtgtttgataaatatcctctcagtgttttatcttccatgtttcaacaactattgaaatatgaaatgcctgtgaactcttaaagcttcatgagcagctgcttgagttcaggaagttcactgttagaaataggctttgttagctgactagggtcagggaaacttttctcttcaaatttgaaagctgtttctgttttcattttacattattattcagaaatggtagctattctatacctatggtttaagtaaatatttctgaataaggcttcaccatactgtaagcattttaggtagattgccttaaaggttatgggagggcatgagggaacacttcttatgagaaaacatttataaacaaaagaaacatttataaactaaagaaaaactaaaagaatgacagaacaatcatcttagcaccctttcctcacaataatataaaaatattaaaagaacataggcaggctttttttaaatttggcttttttctttccttttttcaaattgacttttataggtatttcctgaaagtgtatacaaattatttcctcgcccaaaataaagcaccacttcaaggtgtggtttgacattacatgctaatgaacaaacccagtatgcaagttattcttgcaccacatgctcaaatcttcttgaggtgcattaactcttttaggtaactagagcagtacttggtgaactagatcaggaggtcagtaaactttctgtggaagggccagagagtaaatattttaggctttgcagcccatacggtctctgtcacagctagtcaaccctgccattttaccacaaaagcagcaatagacattatgtaaacaaatgagcacagttatgttccaataaaactttatttacaaaaacagatgacatcccagatgcagaccatgggcaaccaaccattgcactggctaaatcattatttatggagaaatcctctttgtgtctctactctagatgcctaaaagagtttatatacttctaaaagctcctaacttatatccaaagaattgctttctgattcgtgtagtctctcccacagattcataaacttttatgacttatattgtttccaggtgggcatggtttatttcccagtttaacagttcagaataggggcatttattttatcatattttagggtgggttaggagtatcctttctggagactgagaaaggggtgtatttaattccatcaggtccagtacagtactaggagtcataatactttataatcaattaaataaatagaaccactgagacaataatgtatttttttaaagtggcaaatgtggttttcttttttcagcctttgcgctttttcagtattttgaccatagggagataatttttttataatacaaaagtaaccacttggaattttaaagataatgttatgtgtgtatgtgaaatatatatacatatatatatatgtttatttcctaaaagaagaaaagatacctttctgttcaacttgtatcaactcctcttttctaattgctgtgaaatggcaactgttgataaattattgtgattgttttaaaatctaatgggaagtaaaatatattttgattttacccagcttaatctgtaaagtagcacttaaatatatctgatagcaacacttaagatattgcatggggattactttcctatcatccatatgcatttgtgcaacttcaaacatattgggtgcttctgaattcctgatgattggatttaagctattgaaaattggataatttaaacttaatgatttttataattttctgatcttaaaatttggttaatgcctataatctgttgctttttctcaatatgtgtcctattggaaattcctcaaatcgttggtgccatcagtgatttacaaacaatattttgatattgcagatgacttgcttactgtatttgcattgttagaaaacagtttgtagacaatgattcttttttaataaaatcaaataattctaaaagtgctagagaatttaactaaaagctggttcccaaatgcatagctggcattttaatttaaattcaaatctacatagagaacatccgtgtaaatcatctaactggattttcccattggtcattcccaaacacacctatggtcctagaatccttaagagaagcaccctgtaaccttttatgtggtttgcctttaagaggcccaggtgcttctcctttatgatttgagttggcctcttcataaattagtgctgtttactttcagaggaagcagagaagttgctgttatgtttttgcatccgtttaccctatgcaaagttgctgtatgatgccaactaaactgctctttaggcagccttctgaggagaaaagcaaccctgtttcaaatccactgccaattcagctcctctggagtggagctttctgatttcttggagcaggaattttagagattgaaatgaatgatcatttagtcagatttatcctgtaatttcatgcagctttgtggcctttgcagtactatttataaaatggaccctgatggtgatgaactctttagaacgcattactgttaagcctgtgttgagacattgatgctgtctatctcattttttagacagtttttgtagctttctattgagagtcaggtatgtgagcatctctgaagcagtgttgaatgtaattttcggaaacatggattgtgtattttgacttttattttataaatacacagctcaacagtgccttttttttccctcatagtcctgttggaagatgctcactactttctctcttctctctccctgccctcccccactccattcagttgattcatttatgcaaattctgtttccaacttgaaaccattttgtcacatctgttggagagataatcactccttttccttaacattctgccagctttctgatgttgaagtgtttcagttgactacctgatgcaaaagctataaaataaacagtgggaaggggaaaaattggtgtcctgttttaatattttcttttgtagccttgacactgatggacattttccaagctgactcagtgttcagtgtcaacttaactctcagatagtgttgccatcaagaaagcatgcaacatcattggtttctaatgattttatggcttgtgacaatattttatctggactgacatgcctctgctgcttttgctttgtacttcattgctggtaataaaatttcagatggaaaacttacaaaatatatacttaattagaagaaaaaaatagagaaagggctattagaattaaaaaaatttgaaagtaacttaatctaacatttatggcacagtttggacatatccataattttttttgggaacacacatttctgattttttttttcccccttaaagaagaaagtctcaattccattgattttcaattcttagccactggctcattgctttgagcaatgcttgattgattctatttatattatatgatattgggttgataaaataccagttcaatgatgagttttcttaacagaatttggtttgtacttgcagtggctgaacaaagagcatggcttgagaatcaaagggatctgcatttagcaatgtgatgtcagtaaatggacataacaggattgttgtaaaggttgggcatgatgtatgcaaagtactggccagggtagactaataactgatggcatttatatgctgtgctggaatattgttaccaagctgatgtgccgttctcaccctgcagaatactggttttgtcatttcataaatgatatttttataaatatttttgaatgactgta

SEQ ID NO: 16968 - DNA, 2022 bp, Homo sapiens
aaaaagtgtagggagggtacctctcacagaagagtcttatgactggcatcaggggaaggtcaccaagtctttcctgtacatgctgtttatcaaattcattcatctcgaagtattcagtatgccagaaagggctattgcaagacacgaagtccgagaaattgagcagcgacatacaatggatggccctcggcaagatgccactttagatgaggaagaggacatggtgatcatttataacagagttcccaaaacggcaagcacttcatttaccaatatcgcctatgacctgtgtgcaaagaataaataccatgtccttcatatcaacactaccaaaaataatccagtgatgtcattgcaagatcaggtgcgctttgtaaagaatataacttcctggaaagagatgaaaccaggattttatcatggacacgtttcttacttggattttgcaaaatttggtgtgaagaagaaaccaatttacattaatgtcataagggatcctattgagaggctagtttcttattattactttctgagatttggagatgattatagaccagggttacggagacgaaaacaaggagacaaaaagacctttgatgaatgtgtagcagaaggtggctcagactgtgctccagagaagctctggcttcaaatcccgttcttctgtggccatagctccgaatgctggaatgtgggaagcaggtgggctatggatcaagccaagtataacctaattaatgaatattttctggtgggagttactgaagaacttgaagattttatcatgttattggaggcagcattgccccggtttttcaggggtgctactgaactctatcgcacagcaccagatactgctacaccatctcatcggcatggacctatatgtggcagcaagtccatctcatcgcttttggtgaaagtcagtccagtttgtaaagattctcattgccttggaaagtgttccaggaatggactttctgcagtatgatgacctgcaaaagcagcccttccatttacatttcaaactccaagtcagccgtgtcaaagtttgaaccagaactgtggaggataatgggtcagatgcaattagcagcccagagaaccacacgttgcagtctgatttatttttttgcccatcagattccaagaatcctagtgcttaaaagcaactaaacaatcgctctattgtactgaaataaagcccggttaattcagaaatcaattgcaccaccaggtggggcacactctggccccaaacagatggggttgaaaactcccctcaaaatgcagtcttgttaaattaaaaacttgatccaggagtggaacaaatagggagccatgaatggaatggagtcaggtccactcaggcggattctttcttctcccactccttttcctttaaaaaagaaaaattccccatttcactttcatcagtgttagcatctatgcagaaacgcagccatccaccctttgcagttgaatgtgttactttaattagtctgaaaattaaagggcaactccgggccaatgtgaatgattatgaaaatacatgtgcatcccatgcaatcttctcatttaattaatagtcttgtaaactatatggctcactttaagtcagtcaagaggtataacaactccattttaaatatccacttaatacttaacaggatgtgaggaacacactatagcatacggtcccttctcaagtttcactgtctgaaatttttcaaagctgacccaagtcaacctgaaaaatgtttaacaccctgggcttgaacacaagaaactctgtgatgaacagacattcaattacattttttaaaagtgagaagcatttttgtaaaatagcgactctggaaactaattggcagccgcaaaacttgtgagcaaaggccaaatcttgtggggaacttttactacagtaacacgactcaaagaaaatgtgaataaaaggcatctttgtttcccagtcaaattagctgattaagaaataaaacatcttaacatgtttttaaaata

SEQ ID NO: 16969 - DNA, 1389 bp, Homo sapiens
ctgctggcgggaagggagaagagtgggaggaggaaataagcaacaggcagcttcctttcttgacagatggaaaataaagggcctgtgcacagctcggcgaactgctccgtggacctcccagcggggctgctttctgaggtgatggtctcctcgctccttagccagcctggtggagccagctactgacgttggaaaggagttggaggatggagcaccagatactgctacaccatctcatcggcatggacctatatgtggcagcaagtccatctcatcgcttttggtgaaagtcagtccagtttgtaaagattctcattgccttggaaagtgttccaggaatggactttctgcagtatgatgacctgcaaaagcagcccttccatttacatttcaaactccaagtcagccgtgtcaaagtttgaaccagaactgtggaggataatgggtcagatgcaattagcagcccagagaaccacacgttgcagtctgatttatttttttgcccatcagattccaagaatcctagtgcttaaaagcaactaaacaatcgctctattgtactgaaataaagcccggttaattcagaaatcaattgcaccaccaggtggggcacactctggccccaaacagatggggttgaaaactcccctcaaaatgcagtcttgttaaattaaaaacttgatccaggagtggaacaaatagggagccatgaatggaatggagtcaggtccactcaggcggattctttcttctcccactccttttcctttaaaaaagaaaaattccccatttcactttcatcagtgttagcatctatgcagaaacgcagccatccaccctttgcagttgaatgtgttactttaattagtctgaaaattaaagggcaactccgggccaatgtgaatgattatgaaaatacatgtgcatcccatgcaatcttctcatttaattaatagtcttgtaaactatatggctcactttaagtcagtcaagaggtataacaactccattttaaatatccacttaatacttaacaggatgtgaggaacacactatagcatacggtcccttctcaagtttcactgtctgaaatttttcaaagctgacccaagtcaacctgaaaaatgtttaacaccctgggcttgaacacaagaaactctgtgatgaacagacattcaattacattttttaaaagtgagaagcatttttgtaaaatagcgactctggaaactaattggcagccgcaaaacttgtgagcaaaggccaaatcttgtggggaacttttactacagtaacacgactcaaagaaaatgtgaataaaaggcatctttgtttcccagtcaaattagctgattaagaaataaaacatcttaacatgtttttaaaata

SEQ ID NO: 16970 - DNA, 952 bp, Homo sapiens
ctgctggcgggaagggagaagagtgggaggaggaaataagcaacaggcagcttcctttcttgacagatggaaaataaagggcctgtgcacagctcggcgaactgctccgtggacctcccagcggggctgctttctgaggtgatggtctcctcgctccttagccagcctggtggagccagctactgacgttggaaaggagttggaggatggagcaccagatactgctacaccatctcatcggcatggacctatatgtggcagcaagtccatctcatcgcttttggtgaaagtcagtccagtttgtaaagattctcattgtcactgtagacgaggaactgggacaccaaaaggagaaactctggccacgcttgcaccctgttcccaatcctggtccagtgtcacccacagatggtaaggagctctagagacctcaccagcccctgggattggtcacctcactcttctatggacagagattcctgctgggatcctttgagggcaagcagacccttcttccagctcggactgtgaactccactgcagccgtaaggactgtctgtgacagtgagcccgagatgactgggctctgtgctccctcccggccctccaatccttggcctgccacagagaactgagctcttttattagcaccatgaatgtgactgatacagctagccattcccttgtgcgaatgactcagtttattaatgctctgctaaagatggcttctttgcttgccagcagccttaaacagtatttcattaaaactggcttaattattttgagaagacggcccaattaaaagctatacactccctctatgtgagtgtttatacatagagctgtatatataatacatatttgtaagtgtgtgtatatatatatgtgtatgtatgtgtctataaatatataggcttagcaatttcattacatgggataaattgttggaaaa

SEQ ID NO: 16971 - DNA, 1252 bp, Homo sapiens
cgcggtcgcagccggggagcactcgccacggtgctgtggaattctctggtttttcacgcaaggtcaggcgtcctgctggcgccctctcgccaccctgccctcccgtcagaagcccggctcctcgccggggaaggccggatgctggcccgccgggacctgggacttgtgccacatggagtgtcgggagtctccattgccgcgagttctacaccacagggccaggctgtttgctccccatcggtcgctgcccccagcaccctgttgttattaaggactcatttgcttggagcggcatcattacaagggtgtggggtcgcggctcctttgtccaggactacgcaggggcttgaccccagggcgctggtttaggccggatctggggtcccttgtcactcccaggcttcttccacttccgaattctggagaaccgggaatcaagccctgcgcgttcctcttcttcctccttcgtgccgaaagcacgcttcatgtctgccagggcatcagttctgaaacaccagatactgctacaccatctcatcggcatggacctatatgtggcagcaagtccatctcatcgcttttggtgaaagtcagtccagtttgtaaagattctcattgtcactgtagacgaggaactgggacaccaaaaggagaaactctggccacgcttgcaccctgttcccaatcctggtccagtgtcacccacagatggtaaggagctctagagacctcaccagcccctgggattggtcacctcactcttctatggacagagattcctgctgggatcctttgagggcaagcagacccttcttccagctcggactgtgaactccactgcagccgtaaggactgtctgtgacagtgagcccgagatgactgggctctgtgctccctcccggccctccaatccttggcctgccacagagaactgagctcttttattagcaccatgaatgtgactgatacagctagccattcccttgtgcgaatgactcagtttattaatgctctgctaaagatggcttctttgcttgccagcagccttaaacagtatttcattaaaactggcttaattattttgagaagacggcccaattaaaagctatacactccctctatgtgagtgtttatacatagagctgtatatataatacatatttgtaagtgtgtgtatatatatatgtgtatgtatgtgtctataaatatataggcttagcaatttcattacatgggataaattgttggaaaa

SEQ ID NO: 16972 - DNA, 1198 bp, Homo sapiens
ctgctggcgggaagggagaagagtgggaggaggaaataagcaacaggcagcttcctttcttgacagatggaaaataaagggcctgtgcacagctcggcgaactgctccgtggacctcccagcggggctgctttctgaggtgatggtctcctcgctccttagccagcctggtggagccagctactgacgttggaaaggagttggaggatggagcaccagatactgctacaccatctcatcggcatggacctatatgtggcagcaagtccatctcatcgcttttggtgaaagtcagtccagtttgtaaagattctcattgtgagtatggctaaaccatccctttgactaaaaaccaaaccagatactcctttacctatcaatacctcctgctgctaaaaagcagcagctaaaaagcagcaggaggtattgataagggaagtcctatctaaattcctggtttagagaatgactatcctcattttatgagttaaacattacccccaattaacacctctgaaaaaccctcccaacatgtttatctcattaatatcacggggttggcaggtcactgtagacgaggaactgggacaccaaaaggagaaactctggccacgcttgcaccctgttcccaatcctggtccagtgtcacccacagatggtaaggagctctagagacctcaccagcccctgggattggtcacctcactcttctatggacagagattcctgctgggatcctttgagggcaagcagacccttcttccagctcggactgtgaactccactgcagccgtaaggactgtctgtgacagtgagcccgagatgactgggctctgtgctccctcccggccctccaatccttggcctgccacagagaactgagctcttttattagcaccatgaatgtgactgatacagctagccattcccttgtgcgaatgactcagtttattaatgctctgctaaagatggcttctttgcttgccagcagccttaaacagtatttcattaaaactggcttaattattttgagaagacggcccaattaaaagctatacactccctctatgtgagtgtttatacatagagctgtatatataatacatatttgtaagtgtgtgtatatatatatgtgtatgtatgtgtctataaatatataggcttagcaatttcattacatgggataaattgttggaaaa

SEQ ID NO: 16973 - DNA, 533 bp, Homo sapiens
cgcggtcgcagccggggagcactcgccacggtgctgtggaattctctggtttttcacgcaaggtcaggcgtcctgctggcgccctctcgccaccctgccctcccgtcagaagcccggctcctcgccggggaaggccggatgctggcccgccgggacctgggacttgtgccacatggagtgtcgggagtctccattgccgcgagttctacaccacagggccaggctgtttgctccccatcggtcgctgcccccagcaccctgttgttattaaggactcatttgcttggagcggcatcattacaagggtgtgggcaccagatactgctacaccatctcatcggcatggacctatatgtggcagcaagtccatctcatcgcttttggtgaaagtcagtccagtttgtaaagattctcattgttttgcaggcttagaggtcttggcttccaaagggagaaagcttccaccaggggacacagaagggtcccattgaactctaagctatggttactggtggggcacttcagattccatg

SEQ ID NO: 16974 - DNA, 6533 bp, Homo sapiens
cgccggtggaggggcgcgcggccgcgagcaaaggagggagggaaggaaggaagagagggaggcgggcaagcaggcgggcgcgggggtcggggactgaggcagtagagggaggcgagagcccggcagccgcttcgcgctgtttgctgcgcgggcttttggagggggcggccgtttagtcggctgaggagaagcggacaccagcggcgttggtgatagcgcctgggggagggggactggagaggcgagaaggggggtcgctgcggtggttctctcgctgtcgctctctctttgcctcgctcccggctcggcgggctcctcccggcgtctctctcgcctccggggtcccgctccccgccccccgcggtatgtcttgatcccgagcagcgggtttcatggggctcctcaggattatgatgccgcccaagttgcagctgctggcggtggtggccttcgcggtggcgatgctcttcttggaaaaccagatccagaaactggaggagtcccgctcgaagctagaaagggctattgcaagacacgaagtccgagaaattgagcagcgacatacaatggatggccctcggcaagatgccactttagatgaggaagaggacatggtgatcatttataacagagttcccaaaacggcaagcacttcatttaccaatatcgcctatgacctgtgtgcaaagaataaataccatgtccttcatatcaacactaccaaaaataatccagtgatgtcattgcaagatcaggtgcgctttgtaaagaatataacttcctggaaagagatgaaaccaggattttatcatggacacgtttcttacttggattttgcaaaatttggtgtgaagaagaaaccaatttacattaatgtcataagggatcctattgagaggctagtttcttattattactttctgagatttggagatgattatagaccagggttacggagacgaaaacaaggagacaaaaagacctttgatgaatgtgtagcagaaggtggctcagactgtgctccagagaagctctggcttcaaatcccgttcttctgtggccatagctccgaatgctggaatgtgggaagcaggtgggctatggatcaagccaagtataacctaattaatgaatattttctggtgggagttactgaagaacttgaagattttatcatgttattggaggcagcattgccccggtttttcaggggtgctactgaactctatcgcacaggaaagaaatctcatcttaggaaaaccacagagaagaaactccccactaaacaaaccattgcaaaactacagcaatctgatcatttaggcaaatggagaatgagttctatgaatttgcactagagcagttccaattcatcagagcccatgccgttcgagaaaaagatggagacctctacatcctcgcacaaaactttttctatgaaaagatttaccctaagtcgaactgagtataaggtgtgactattagattcttgaactaaaatttgaccctgtcttcacctttgttctcagctccacagtctggattgctgacagtaggtgtatatgacaatttgtattgagccaaattaggaaacagacagtaacgtcaaggaagtagatactggctggcattgtcagtgttctaagtttcaggcatttttatttttcctggctaaacgttggtgaaagttataacctcctgcctgggagaaaatatacatcacctaaaatgaacttatggcaggtctaatcaaaaggctaaatacaatttcagaaaaggttctgatactcttgtttttgataaagcattttttcaactaaccatgaattaagatgagtccatttgcctcttctgccttcactgagggtttgggttatacacctctactgaattgtgttaataactgtttggcagtgtgtactttgtttttgtgagtcatgtctcatgaaatttattggaatgtttaatcatatttgctaagaaatgtttctgctgtagttggatttgcccatatttatgtaggtggttttaattttttaaatggtgattagtgttaaaaatcaatttaaatcatgactaatatggtaaaaagataaagcatcaaagcagtatttctcattcctgcctcctcaatatctaatactgggaagatacttcaaagaatattgagattgtctgaagttttagttaagattttcacacattaatatcaaaaaagtaagtttagtatttgtttctccatgggttatttgtaaagctgtaaactgagatatcggtgactccgtattatgactccattagtgagctgtggtatgggtaggattttcctacttcttctgtacttttacctgtagactatttttactaaggtgctttataatgtgttttaaagcattgcatttacaaaacaaggaaaatgctgtaaatattgcatattttatgtatttggaccaaaaggttacaagtaattagacaaaagtggttttgcaccaattttatgtcaagtaaaaccatcagacctactgttcttgtatttctcatttaactttactgttaagacatcactgaaatgaacttcagtaagctttcaattttgatacacagttcattattcataacttgaggcagtaattacagtggaatgagtactggacaaggagtcaaaaaacttgatttcaggtcctagctctagcacttacagctgtgtgatcttgggcaagtcacttaacctctctttgcctcaatttcctcatcttgaaatgaggataataatacctgctgtacctacctcacagggctgttgtgaggattaaatgagatggcatgtgaaagcactttgaaaattgtaaagcgctatgtaaatgtaaggtattatagaaacatctttaacatatagtttcataccattcattttttaacaaagaaagggaaaagtctgcttgtaagctggttgaaaaagttaatcttgatataaatttgtgtttgataaatatcctctcagtgttttatcttccatgtttcaacaactattgaaatatgaaatgcctgtgaactcttaaagcttcatgagcagctgcttgagttcaggaagttcactgttagaaataggctttgttagctgactagggtcagggaaacttttctcttcaaatttgaaagctgtttctgttttcattttacattattattcagaaatggtagctattctatacctatggtttaagtaaatatttctgaataaggcttcaccatactgtaagcattttaggtagattgccttaaaggttatgggagggcatgagggaacacttcttatgagaaaacatttataaacaaaagaaacatttataaactaaagaaaaactaaaagaatgacagaacaatcatcttagcaccctttcctcacaataatataaaaatattaaaagaacataggcaggctttttttaaatttggcttttttctttccttttttcaaattgacttttataggtatttcctgaaagtgtatacaaattatttcctcgcccaaaataaagcaccacttcaaggtgtggtttgacattacatgctaatgaacaaacccagtatgcaagttattcttgcaccacatgctcaaatcttcttgaggtgcattaactcttttaggtaactagagcagtacttggtgaactagatcaggaggtcagtaaactttctgtggaagggccagagagtaaatattttaggctttgcagcccatacggtctctgtcacagctagtcaaccctgccattttaccacaaaagcagcaatagacattatgtaaacttttatgacttatattgtttccaggtgggcatggtttatttcccagtttaacagttcagaataggggcatttattttatcatattttagggtgggttaggagtatcctttctggagactgagaaaggggtgtatttaattccatcaggtccagtacagtactaggagtcataatactttataatcaattaaataaatagaaccactgagacaataatgtatttttttaaagtggcaaatgtggttttcttttttcagcctttgcgctttttcagtattttgaccatagggagataatttttttataatacaaaagtaaccacttggaattttaaagataatgttatgtgtgtatgtgaaatatatatacatatatatatatgtttatttcctaaaagaagaaaagatacctttctgttcaacttgtatcaactcctcttttctaattgctgtgaaatggcaactgttgataaattattgtgattgttttaaaatctaatgggaagtaaaatatattttgattttacccagcttaatctgtaaagtagcacttaaatatatctgatagcaacacttaagatattgcatggggattactttcctatcatccatatgcatttgtgcaacttcaaacatattgggtgcttctgaattcctgatgattggatttaagctattgaaaattggataatttaaacttaatgatttttataattttctgatcttaaaatttggttaatgcctataatctgttgctttttctcaatatgtgtcctattggaaattcctcaaatcgttggtgccatcagtgatttacaaacaatattttgatattgcagatgacttgcttactgtatttgcattgttagaaaacagtttgtagacaatgattcttttttaataaaatcaaataattctaaaagtgctagagaatttaactaaaagctggttcccaaatgcatagctggcattttaatttaaattcaaatctacatagagaacatccgtgtaaatcatctaactggattttcccattggtcattcccaaacacacctatggtcctagaatccttaagagaagcaccctgtaaccttttatgtggtttgcctttaagaggcccaggtgcttctcctttatgatttgagttggcctcttcataaattagtgctgtttactttcagaggaagcagagaagttgctgttatgtttttgcatccgtttaccctatgcaaagttgctgtatgatgccaactaaactgctctttaggcagccttctgaggagaaaagcaaccctgtttcaaatccactgccaattcagctcctctggagtggagctttctgatttcttggagcaggaattttagagattgaaatgaatgatcatttagtcagatttatcctgtaatttcatgcagctttgtggcctttgcagtactatttataaaatggaccctgatggtgatgaactctttagaacgcattactgttaagcctgtgttgagacattgatgctgtctatctcattttttagacagtttttgtagctttctattgagagtcaggtatgtgagcatctctgaagcagtgttgaatgtaattttcggaaacatggattgtgtattttgacttttattttataaatacacagctcaacagtgccttttttttccctcatagtcctgttggaagatgctcactactttctctcttctctctccctgccctcccccactccattcagttgattcatttatgcaaattctgtttccaacttgaaaccattttgtcacatctgttggagagataatcactccttttccttaacattctgccagctttctgatgttgaagtgtttcagttgactacctgatgcaaaagctataaaataaacagtgggaaggggaaaaattggtgtcctgttttaatattttcttttgtagccttgacactgatggacattttccaagctgactcagtgttcagtgtcaacttaactctcagatagtgttgccatcaagaaagcatgcaacatcattggtttctaatgattttatggcttgtgacaatattttatctggactgacatgcctctgctgcttttgctttgtacttcattgctggtaataaaatttcagatggaaaacttacaaaatatatacttaattagaagaaaaaaatagagaaagggctattagaattaaaaaaatttgaaagtaacttaatctaacatttatggcacagtttggacatatccataattttttttgggaacacacatttctgattttttttttcccccttaaagaagaaagtctcaattccattgattttcaattcttagccactggctcattgctttgagcaatgcttgattgattctatttatattatatgatattgggttgataaaataccagttcaatgatgagttttcttaacagaatttggtttgtacttgcagtggctgaacaaagagcatggcttgagaatcaaagggatctgcatttagcaatgtgatgtcagtaaatggacataacaggattgttgtaaaggttgggcatgatgtatgcaaagtactggccagggtagactaataactgatggcatttatatgctgtgctggaatattgttaccaagctgatgtgccgttctcaccctgcagaatactggttttgtcatttcataaatgatatttttataaatatttttgaatgactgta

SEQ ID NO: 16975 - DNA, 6422 bp, Homo sapiens
cgccggtggaggggcgcgcggccgcgagcaaaggagggagggaaggaaggaagagagggaggcgggcaagcaggcgggcgcgggggtcggggactgaggcagtagagggaggcgagagcccggcagccgcttcgcgctgtttgctgcgcgggcttttggagggggcggccgtttagtcggctgaggagaagcggacaccagcggcgttggtgatagcgcctgggggagggggactggagaggcgagaaggggggtcgctgcggtggttctctcgctgtcgctctctctttgcctcgctcccggctcggcgggctcctcccggcgtctctctcgcctccggggtcccgctccccgccccccgcggtatgtcttgatcccgagcagcgggtttcatggggctcctcaggattatgatgccgcccaagttgcagctgctggcggtggtggccttcgcggtggcgatgctcttcttggaaaaccagatccagaaactggaggagtcccgctcgaagctagaaagggctattgcaagacacgaagtccgagaaattgagcagcgacatacaatggatggccctcggcaagatgccactttagatgaggaagaggacatggtgatcatttataacagagttcccaaaacggcaagcacttcatttaccaatatcgcctatgacctgtgtgcaaagaataaataccatgtccttcatatcaacactaccaaaaataatccagtgatgtcattgcaagatcaggtgcgctttgtaaagaatataacttcctggaaagagatgaaaccaggattttatcatggacacgtttcttacttggattttgcaaaatttggtgtgaagaagaaaccaatttacattaatgtcataagggatcctattgagaggctagtttcttattattactttctgagatttggagatgattatagaccagggttacggagacgaaaacaaggagacaaaaagacctttgatgaatgtgtagcagaaggtggctcagactgtgctccagagaagctctggcttcaaatcccgttcttctgtggccatagctccgaatgctggaatgtgggaagcaggtgggctatggatcaagccaagtataacctaattaatgaatattttctggtgggagttactgaagaacttgaagattttatcatgttattggaggcagcattgccccggtttttcaggggtgctactgaactctatcgcacaggaaagaaatctcatcttaggaaaaccacagagaagaaactccccactaaacaaaccattgcaaaactacagcaatctgatcatttaggcaaatggagaatgagttctatgaatttgcactagagcagttccaattcatcagagcccatgccgttcgagaaaaagatggagacctctacatcctcgcacaaaactttttctatgaaaagatttaccctaagtcgaactgagtataaggtgtgactattagattcttgaactaaaatttgaccctgtcttcacctttgttctcagctccacagtctggattgctgacagtaggtgtatatgacaatttgtattgagccaaattaggaaacagacagtaacgtcaaggaagtagatactggctggcattgtcagtgttctaagtttcaggcatttttatttttcctggctaaacgttggtgaaagttataacctcctgcctgggagaaaatatacatcacctaaaatgaacttatggcaggtctaatcaaaaggctaaatacaatttcagaaaaggttctgatactcttgtttttgataaagcattttttcaactaaccatgaattaagatgagtccatttgcctcttctgccttcactgagggtttgggttatacacctctactgaattgtgttaataactgtttggcagtgtgtactttgtttttgtgagtcatgtctcatgaaatttattggaatgtttaatcatatttgctaagaaatgtttctgctgtagttggatttgcccatatttatgtaggtggttttaattttttaaatggtgattagtgttaaaaatcaatttaaatcatgactaatatggtaaaaagataaagcatcaaagcagtatttctcattcctgcctcctcaatatctaatactgggaagatacttcaaagaatattgagattgtctgaagttttagttaagattttcacacattaatatcaaaaaagtaagtttagtatttgtttctccatgggttatttgtaaagctgtaaactgagatatcggtgactccgtattatgactccattagtgagctgtggtatgggtaggattttcctacttcttctgtacttttacctgtagactatttttactaaggtgctttataatgtgttttaaagcattgcatttacaaaacaaggaaaatgctgtaaatattgcatattttatgtatttggaccaaaaggttacaagtaattagacaaaagtggttttgcaccaattttatgtcaagtaaaaccatcagacctactgttcttgtatttctcatttaactttactgttaagacatcactgaaatgaacttcagtaagctttcaattttgatacacagttcattattcataacttgaggcagtaattacagtggaatgagtactggacaaggagtcaaaaaacttgatttcaggtcctagctctagcacttacagctgtgtgatcttgggcaagtcacttaacctctctttgcctcaatttcctcatcttgaaatgaggataataatacctgctgtacctacctcacagggctgttgtgaggattaaatgagatggcatgtgaaagcactttgaaaattgtaaagcgctatgtaaatgtaaggtattatagaaacatctttaacatatagtttcataccattcattttttaacaaagaaagggaaaagtctgcttgtaagctggttgaaaaagttaatcttgatataaatttgtgtttgataaatatcctctcagtgttttatcttccatgtttcaacaactattgaaatatgaaatgcctgtgaactcttaaagcttcatgagcagctgcttgagttcaggaagttcactgttagaaataggctttgttagctgactagggtcagggaaacttttctcttcaaatttgaaagctgtttctgttttcattttacattattattcagaaatggtagctattctatacctatggtttaagtaaatatttctgaataaggcttcaccatactgtaagcattttaggtagattgccttaaaggttatgggagggcatgagggaacacttcttatgagaaaacatttataaacaaaagaaacatttataaactaaagaaaaactaaaagaatgacagaacaatcatcttagcaccctttcctcacaataatataaaaatattaaaagaacataggcaggctttttttaaatttggcttttttctttccttttttcaaattgacttttataggtatttcctgaaagtgtatacaaattatttcctcgcccaaaataaagcaccacttcaaggtgtggtttgacattacatgctaatgaacaaacccagtatgcaagttattcttgcaccacatgctcaaatcttcttgaggtgcattaactcttttaggtaactagagcagtacttggtgaactagatcaggaggtcagtaaactttctgtggaagggccagagagtaaatattttaggctttgcagcccatacggtctctgtcacagctagtcaaccctgccattttaccacaaaagcagcaatagacattatgtaaacaaatgagcacagttatgttccaataaaactttatttacaaaaacagatgacatcccagatgcagaccatgggcaaccaaccattgcactggctaaatcattatttatggagaaatcctctttgtgtctctactctagatgcctaaaagagtttatatacttctaaaagctcctaacttatatccaaagaattgctttctgattcgtgtagtctctcccacagattcataaacttttatgacttatattgtttccaggtgggcatggtttatttcccagtttaacagttcagaataggggcatttattttatcatattttagggtgggttaggagtatcctttctggagactgagaaaggggtgtatttaattccatcaggtccagtacagtactaggagtcataatactttataatcaattaaataaatagaaccactgagacaataatgtatttttttaaagtggcaaatgtggttttcttttttcagcctttgcgctttttcagtattttgaccatagggagataatttttttataatacaaaagtaaccacttggaattttaaagataatgttatgtgtgtatgtgaaatatatatacatatatatatatgtttatttcctaaaagaagaaaagatacctttctgttcaacttgtatcaactcctcttttctaattgctgtgaaatggcaactgttgataaattattgtgattgttttaaaatctaatgggaagtaaaatatattttgattttacccagcttaatctgtaaagtagcacttaaatatatctgatagcaacacttaagatattgcatggggattactttcctatcatccatatgcatttgtgcaacttcaaacatattgggtgcttctgaattcctgatgattggatttaagctattgaaaattggataatttaaacttaatgatttttataattttctgatcttaaaatttggttaatgcctataatctgttgctttttctcaatatgtgtcctattggaaattcctcaaatcgttggtgccatcagtgatttacaaacaatattttgatattgcagatgacttgcttactgtatttgcattgttagaaaacagtttgtagacaatgattcttttttaataaaatcaaataattctaaaagtgctagagaatttaactaaaagctggttcccaaatgcatagctggcattttaatttaaattcaaatctacatagagaacatccgtgtaaatcatctaactggattttcccattggtcattcccaaacacacctatggtcctagaatccttaagagaagcaccctgtaaccttttatgtggtttgcctttaagaggcccaggtgcttctcctttatgatttgagttggcctcttcataaattagtgctgtttactttcagaggaagcagagaagttgctgttatgtttttgcatccgtttaccctatgcaaagttgctgtatgatgccaactaaactgctctttaggcagccttctgaggagaaaagcaaccctgtttcaaatccactgccaattcagctcctctggagtggagctttctgatttcttggagcaggaattttagagattgaaatgaatgatcatttagtcagatttatcctgtaatttcatgcaaattctgtttccaacttgaaaccattttgtcacatctgttggagagataatcactccttttccttaacattctgccagctttctgatgttgaagtgtttcagttgactacctgatgcaaaagctataaaataaacagtgggaaggggaaaaattggtgtcctgttttaatattttcttttgtagccttgacactgatggacattttccaagctgactcagtgttcagtgtcaacttaactctcagatagtgttgccatcaagaaagcatgcaacatcattggtttctaatgattttatggcttgtgacaatattttatctggactgacatgcctctgctgcttttgctttgtacttcattgctggtaataaaatttcagatggaaaacttacaaaatatatacttaattagaagaaaaaaatagagaaagggctattagaattaaaaaaatttgaaagtaacttaatctaacatttatggcacagtttggacatatccataattttttttgggaacacacatttctgattttttttttcccccttaaagaagaaagtctcaattccattgattttcaattcttagccactggctcattgctttgagcaatgcttgattgattctatttatattatatgatattgggttgataaaataccagttcaatgatgagttttcttaacagaatttggtttgtacttgcagtggctgaacaaagagcatggcttgagaatcaaagggatctgcatttagcaatgtgatgtcagtaaatggacataacaggattgttgtaaaggttgggcatgatgtatgcaaagtactggccagggtagactaataactgatggcatttatatgctgtgctggaatattgttaccaagctgatgtgccgttctcaccctgcagaatactggttttgtcatttcataaatgatatttttataaatatttttgaatgactgta

SEQ ID NO: 16976 - DNA, 6374 bp, Homo sapiens
aaaaagtgtagggagggtacctctcacagaagagtcttatgactggcatcaggggaaggtcaccaagtctttcctgtacatgctgtttatcaaattcattcatctcgaagtattcagtatgccagaaagggctattgcaagacacgaagtccgagaaattgagcagcgacatacaatggatggccctcggcaagatgccactttagatgaggaagaggacatggtgatcatttataacagagttcccaaaacggcaagcacttcatttaccaatatcgcctatgacctgtgtgcaaagaataaataccatgtccttcatatcaacactaccaaaaataatccagtgatgtcattgcaagatcaggtgcgctttgtaaagaatataacttcctggaaagagatgaaaccaggattttatcatggacacgtttcttacttggattttgcaaaatttggtgtgaagaagaaaccaatttacattaatgtcataagggatcctattgagaggctagtttcttattattactttctgagatttggagatgattatagaccagggttacggagacgaaaacaaggagacaaaaagacctttgatgaatgtgtagcagaaggtggctcagactgtgctccagagaagctctggcttcaaatcccgttcttctgtggccatagctccgaatgctggaatgtgggaagcaggtgggctatggatcaagccaagtataacctaattaatgaatattttctggtgggagttactgaagaacttgaagattttatcatgttattggaggcagcattgccccggtttttcaggggtgctactgaactctatcgcacaggaaagaaatctcatcttaggaaaaccacagagaagaaactccccactaaacaaaccattgcaaaactacagcaatctgatcatttaggcaaatggagaatgagttctatgaatttgcactagagcagttccaattcatcagagcccatgccgttcgagaaaaagatggagacctctacatcctcgcacaaaactttttctatgaaaagatttaccctaagtcgaactgagtataaggtgtgactattagattcttgaactaaaatttgaccctgtcttcacctttgttctcagctccacagtctggattgctgacagtaggtgtatatgacaatttgtattgagccaaattaggaaacagacagtaacgtcaaggaagtagatactggctggcattgtcagtgttctaagtttcaggcatttttatttttcctggctaaacgttggtgaaagttataacctcctgcctgggagaaaatatacatcacctaaaatgaacttatggcaggtctaatcaaaaggctaaatacaatttcagaaaaggttctgatactcttgtttttgataaagcattttttcaactaaccatgaattaagatgagtccatttgcctcttctgccttcactgagggtttgggttatacacctctactgaattgtgttaataactgtttggcagtgtgtactttgtttttgtgagtcatgtctcatgaaatttattggaatgtttaatcatatttgctaagaaatgtttctgctgtagttggatttgcccatatttatgtaggtggttttaattttttaaatggtgattagtgttaaaaatcaatttaaatcatgactaatatggtaaaaagataaagcatcaaagcagtatttctcattcctgcctcctcaatatctaatactgggaagatacttcaaagaatattgagattgtctgaagttttagttaagattttcacacattaatatcaaaaaagtaagtttagtatttgtttctccatgggttatttgtaaagctgtaaactgagatatcggtgactccgtattatgactccattagtgagctgtggtatgggtaggattttcctacttcttctgtacttttacctgtagactatttttactaaggtgctttataatgtgttttaaagcattgcatttacaaaacaaggaaaatgctgtaaatattgcatattttatgtatttggaccaaaaggttacaagtaattagacaaaagtggttttgcaccaattttatgtcaagtaaaaccatcagacctactgttcttgtatttctcatttaactttactgttaagacatcactgaaatgaacttcagtaagctttcaattttgatacacagttcattattcataacttgaggcagtaattacagtggaatgagtactggacaaggagtcaaaaaacttgatttcaggtcctagctctagcacttacagctgtgtgatcttgggcaagtcacttaacctctctttgcctcaatttcctcatcttgaaatgaggataataatacctgctgtacctacctcacagggctgttgtgaggattaaatgagatggcatgtgaaagcactttgaaaattgtaaagcgctatgtaaatgtaaggtattatagaaacatctttaacatatagtttcataccattcattttttaacaaagaaagggaaaagtctgcttgtaagctggttgaaaaagttaatcttgatataaatttgtgtttgataaatatcctctcagtgttttatcttccatgtttcaacaactattgaaatatgaaatgcctgtgaactcttaaagcttcatgagcagctgcttgagttcaggaagttcactgttagaaataggctttgttagctgactagggtcagggaaacttttctcttcaaatttgaaagctgtttctgttttcattttacattattattcagaaatggtagctattctatacctatggtttaagtaaatatttctgaataaggcttcaccatactgtaagcattttaggtagattgccttaaaggttatgggagggcatgagggaacacttcttatgagaaaacatttataaacaaaagaaacatttataaactaaagaaaaactaaaagaatgacagaacaatcatcttagcaccctttcctcacaataatataaaaatattaaaagaacataggcaggctttttttaaatttggcttttttctttccttttttcaaattgacttttataggtatttcctgaaagtgtatacaaattatttcctcgcccaaaataaagcaccacttcaaggtgtggtttgacattacatgctaatgaacaaacccagtatgcaagttattcttgcaccacatgctcaaatcttcttgaggtgcattaactcttttaggtaactagagcagtacttggtgaactagatcaggaggtcagtaaactttctgtggaagggccagagagtaaatattttaggctttgcagcccatacggtctctgtcacagctagtcaaccctgccattttaccacaaaagcagcaatagacattatgtaaacaaatgagcacagttatgttccaataaaactttatttacaaaaacagatgacatcccagatgcagaccatgggcaaccaaccattgcactggctaaatcattatttatggagaaatcctctttgtgtctctactctagatgcctaaaagagtttatatacttctaaaagctcctaacttatatccaaagaattgctttctgattcgtgtagtctctcccacagattcataaacttttatgacttatattgtttccaggtgggcatggtttatttcccagtttaacagttcagaataggggcatttattttatcatattttagggtgggttaggagtatcctttctggagactgagaaaggggtgtatttaattccatcaggtccagtacagtactaggagtcataatactttataatcaattaaataaatagaaccactgagacaataatgtatttttttaaagtggcaaatgtggttttcttttttcagcctttgcgctttttcagtattttgaccatagggagataatttttttataatacaaaagtaaccacttggaattttaaagataatgttatgtgtgtatgtgaaatatatatacatatatatatatgtttatttcctaaaagaagaaaagatacctttctgttcaacttgtatcaactcctcttttctaattgctgtgaaatggcaactgttgataaattattgtgattgttttaaaatctaatgggaagtaaaatatattttgattttacccagcttaatctgtaaagtagcacttaaatatatctgatagcaacacttaagatattgcatggggattactttcctatcatccatatgcatttgtgcaacttcaaacatattgggtgcttctgaattcctgatgattggatttaagctattgaaaattggataatttaaacttaatgatttttataattttctgatcttaaaatttggttaatgcctataatctgttgctttttctcaatatgtgtcctattggaaattcctcaaatcgttggtgccatcagtgatttacaaacaatattttgatattgcagatgacttgcttactgtatttgcattgttagaaaacagtttgtagacaatgattcttttttaataaaatcaaataattctaaaagtgctagagaatttaactaaaagctggttcccaaatgcatagctggcattttaatttaaattcaaatctacatagagaacatccgtgtaaatcatctaactggattttcccattggtcattcccaaacacacctatggtcctagaatccttaagagaagcaccctgtaaccttttatgtggtttgcctttaagaggcccaggtgcttctcctttatgatttgagttggcctcttcataaattagtgctgtttactttcagaggaagcagagaagttgctgttatgtttttgcatccgtttaccctatgcaaagttgctgtatgatgccaactaaactgctctttaggcagccttctgaggagaaaagcaaccctgtttcaaatccactgccaattcagctcctctggagtggagctttctgatttcttggagcaggaattttagagattgaaatgaatgatcatttagtcagatttatcctgtaatttcatgcagctttgtggcctttgcagtactatttataaaatggaccctgatggtgatgaactctttagaacgcattactgttaagcctgtgttgagacattgatgctgtctatctcattttttagacagtttttgtagctttctattgagagtcaggtatgtgagcatctctgaagcagtgttgaatgtaattttcggaaacatggattgtgtattttgacttttattttataaatacacagctcaacagtgccttttttttccctcatagtcctgttggaagatgctcactactttctctcttctctctccctgccctcccccactccattcagttgattcatttatgcaaattctgtttccaacttgaaaccattttgtcacatctgttggagagataatcactccttttccttaacattctgccagctttctgatgttgaagtgtttcagttgactacctgatgcaaaagctataaaataaacagtgggaaggggaaaaattggtgtcctgttttaatattttcttttgtagccttgacactgatggacattttccaagctgactcagtgttcagtgtcaacttaactctcagatagtgttgccatcaagaaagcatgcaacatcattggtttctaatgattttatggcttgtgacaatattttatctggactgacatgcctctgctgcttttgctttgtacttcattgctggtaataaaatttcagatggaaaacttacaaaatatatacttaattagaagaaaaaaatagagaaagggctattagaattaaaaaaatttgaaagtaacttaatctaacatttatggcacagtttggacatatccataattttttttgggaacacacatttctgattttttttttcccccttaaagaagaaagtctcaattccattgattttcaattcttagccactggctcattgctttgagcaatgcttgattgattctatttatattatatgatattgggttgataaaataccagttcaatgatgagttttcttaacagaatttggtttgtacttgcagtggctgaacaaagagcatggcttgagaatcaaagggatctgcatttagcaatgtgatgtcagtaaatggacataacaggattgttgtaaaggttgggcatgatgtatgcaaagtactggccagggtagactaataactgatggcatttatatgctgtgctggaatattgttaccaagctgatgtgccgttctcaccctgcagaatactggttttgtcatttcataaatgatatttttataaatatttttgaatgactgta

SEQ ID NO: 16977 - DNA, 2027 bp, Homo sapiens
cgccggtggaggggcgcgcggccgcgagcaaaggagggagggaaggaaggaagagagggaggcgggcaagcaggcgggcgcgggggtcggggactgaggcagtagagggaggcgagagcccggcagccgcttcgcgctgtttgctgcgcgggcttttggagggggcggccgtttagtcggctgaggagaagcggacaccagcggcgttggtgatagcgcctgggggagggggactggagaggcgagaaggggggtcgctgcggtggttctctcgctgtcgctctctctttgcctcgctcccggctcggcgggctcctcccggcgtctctctcgcctccggggtcccgctccccgccccccgcggtatgtcttgatcccgagcagcgggtttcatggggctcctcaggattatgatgccgcccaagttgcagctgctggcggtggtggccttcgcggtggcgatgctcttcttggaaaaccagatccagaaactggaggagtcccgctcgaagctagaaagggctattgcaagacacgaagtccgagaaattgagcagcgacatacaatggatggccctcggcaagatgccactttagatgaggaagaggacatggtgatcatttataacagagttcccaaaacggcaagcacttcatttaccaatatcgcctatgacctgtgtgcaaagaataaataccatgtccttcatatcaacactaccaaaaataatccagtgatgtcattgcaagatcaggtgcgctttgtaaagaatataacttcctggaaagagatgaaaccaggattttatcatggacacgtttcttacttggattttgcaaaatttggtgtgaagaagaaaccaatttacattaatgtcataagggatcctattgagaggctagtttcttattattactttctgagatttggagatgattatagaccagggttacggagacgaaaacaaggagacaaaaagacctttgatgaatgtgtagcagaaggtggctcagactgtgctccagagaagctctggcttcaaatcccgttcttctgtggccatagctccgaatgctggaatgtgggaagcaggtgggctatggatcaagccaagtataacctaattaatgaatattttctggtgggagttactgaagaacttgaagattttatcatgttattggaggcagcattgccccggtttttcaggggtgctactgaactctatcgcacaggaaagaaatctcatcttaggaaaaccacagagaagaaactccccactaaacaaaccattgcaaaactacagcaatctgatcatttaggcaaatggagaatgagttctatgaatttgcactagagcagttccaattcatcagagcccatgccgttcgagaaaaagatggagacctctacatcctcgcacaaaactttttctatgaaaagatttaccctaagtcgaactgagtataaggtgtgactattagattcttgaactaaaatttgaccctgtcttcacctttgttctcagctccacagtctggattgctgacagtaggtgtatatgacaatttgtattgagccaaattaggaaacagacagtaacgtcaaggaagtagatactggctggcattgtcagtgttctaagtttcaggcatttttatttttcctggctaaacgttggtgaaagttataacctcctgcctgggagaaaatatacatcacctaaaatgaacttatggcaggtctaatcaaaaggctaaatacaatttcagaaaaggttctgatactcttgtttttgataaagcattttttcaactaaccatgaattaagatgagtccatttgcctcttctgccttcactgagggtttgggttatacacctctactgaattgtgttaataactgtttggcagtgtgtactttgtttttgtgagtcatgtctcatgaaatttattggaatgtttaatcatatttgctaagaaatgtttctgctgtagttgattgcctaaatgaaggaccgagccga

SEQ ID NO: 16978 - DNA, 3595 bp, Homo sapiens
tcgtgccgaattcggcacgaggaaatggtagctattctatacctatggtttaagtaaatatttctgaataaggcttcaccatactgtaagcattttaggtagattgccttaaaggttatgggagggcatgagggaacacttcttatgagaaaacatttataaacaaaagaaacatttataaactaaagaaaaactaaaagaatgacagaacaatcatcttagcaccctttcctcacaataatataaaaatattaaaagaacataggcaggctttttttaaatttggcttttttctttccttttttcaaattgacttttataggtatttcctgaaagtgtatacaaattatttcctcgcccaaaataaagcaccacttcaaggtgtggtttgacattacatgctaatgaacaaacccagtatgcaagttattcttgcaccacatgctcaaatcttcttgaggtgcattaactcttttaggtaactagagcagtacttggtgaactagatcaggaggtcagtaaactttctgtggaagggccagagagtaaatattttaggctttgcagcccatacggtctctgtcacagctagtcaaccctgccattttaccacaaaagcagcaatagacattatgtaaacaaatgagcacagttatgttccaataaaactttatttacaaaaacagatgacatcccagatgcagaccatgggcaaccaaccattgcactggctaaatcattatttatggagaaatcctctttgtgtctctactctagatgcctaaaagagtttatatacttctaaaagctcctaacttatatccaaagaattgctttctgattcgtgtagtctctcccacagattcataaacttttatgacttatattgtttccaggtgggcatggtttatttcccagtttaacagttcagaataggggcatttattttatcatattttagggtgggttaggagtatcctttctggagactgagaaaggggtgtatttaattccatcaggtccagtacagtactaggagtcataatactttataatcaattaaataaatagaaccactgagacaataatgtatttttttaaagtggcaaatgtggttttcttttttcagcctttgcgctttttcagtattttgaccatagggagataatttttttataatacaaaagtaaccacttggaattttaaagataatgttatgtgtgtatgtgaaatatatatacatatatatatatgtttatttcctaaaagaagaaaagatacctttctgttcaacttgtatcaactcctcttttctaattgctgtgaaatggcaactgttgataaattattgtgattgttttaaaatctaatgggaagtaaaatatattttgattttacccagcttaatctgtaaagtagcacttaaatatatctgatagcaacacttaagatattgcatggggattactttcctatcatccatatgcatttgtgcaacttcaaacatattgggtgcttctgaattcctgatgattggatttaagctattgaaaattggataatttaaacttaatgatttttataattttctgatcttaaaatttggttaatgcctataatctgttgctttttctcaatatgtgtcctattggaaattcctcaaatcgttggtgccatcagtgatttacaaacaatattttgatattgcagatgacttgcttactgtatttgcattgttagaaaacagtttgtagacaatgattcttttttaataaaatcaaataattctaaaagtgctagagaatttaactaaaagctggttcccaaatgcatagctggcattttaatttaaattcaaatctacatagagaacatccgtgtaaatcatctaactggattttcccattggtcattcccaaacacacctatggtcctagaatccttaagagaagcaccctgtaaccttttatgtggtttgcctttaagaggcccaggtgcttctcctttatgatttgagttggcctcttcataaattagtgctgtttactttcagaggaagcagagaagttgctgttatgtttttgcatccgtttaccctatgcaaagttgctgtatgatgccaactaaactgctctttaggcagccttctgaggagaaaagcaaccctgtttcaaatccactgccaattcagctcctctggagtggagctttctgatttcttggagcaggaattttagagattgaaatgaatgatcatttagtcagatttatcctgtaatttcatgcagctttgtggcctttgcagtactatttataaaatggaccctgatggtgatgaactctttagaacgcattactgttaagcctgtgttgagacattgatgctgtctatctcattttttagacagtttttgtagctttctattgagagtcaggtatgtgagcatctctgaagcagtgttgaatgtaattttcggaaacatggattgtgtattttgacttttattttataaatacacagctcaacagtgccttttttttccctcatagtcctgttggaagatgctcactactttctctcttctctctccctgccctcccccactccattcagttgattcatttatgcaaattctgtttccaacttgaaaccattttgtcacatctgttggagagataatcactccttttccttaacattctgccagctttctgatgttgaagtgtttcagttgactacctgatgcaaaagctataaaataaacagtgggaaggggaaaaattggtgtcctgttttaatattttcttttgtagccttgacactgatggacattttccaagctgactcagtgttcagtgtcaacttaactctcagatagtgttgccatcaagaaagcatgcaacatcattggtttctaatgattttatggcttgtgacaatattttatctggactgacatgcctctgctgcttttgctttgtacttcattgctggtaataaaatttcagatggaaaacttacaaaatatatacttaattagaagaaaaaaatagagaaagggctattagaattaaaaaaatttgaaagtaacttaatctaacatttatggcacagtttggacatatccataattttttttgggaacacacatttctgattttttttttcccccttaaagaagaaagtctcaattccattgattttcaattcttagccactggctcattgctttgagcaatgcttgattgattctatttatattatatgatattgggttgataaaataccagttcaatgatgagttttcttaacagaatttggtttgtacttgcagtggctgaacaaagagcatggcttgagaatcaaagggatctgcatttagcaatgtgatgtcagtaaatggacataacaggattgttgtaaaggttgggcatgatgtatgcaaagtactggccagggtagactaataactgatggcatttatatgctgtgctggaatattgttaccaagctgatgtgccgttctcaccctgcagaatactggttttgtcatttcataaatgatatttttataaatatttttgaatgactgta

SEQ ID NO: 16979 - DNA, 2540 bp, Homo sapiens
agcggccgctcgcgatctagactgagacaataatgtatttttttaaagtggcaaatgtggttttcttttttcagcctttgcgctttttcagtattttgaccatagggagataatttttttataatacaaaagtaaccacttggaattttaaagataatgttatgtgtgtatgtgaaatatatatacatatatatatatgtttatttcctaaaagaagaaaagatacctttctgttcaacttgtatcaactcctcttttctaattgctgtgaaatggcaactgttgataaattattgtgattgttttaaaatctaatgggaagtaaaatatattttgattttacccagcttaatctgtaaagtagcacttaaatatatctgatagcaacacttaagatattgcatggggattactttcctatcatccatatgcatttgtgcaacttcaaacatattgggtgcttctgaattcctgatgattggatttaagctattgaaaattggataatttaaacttaatgatttttataattttctgatcttaaaatttggttaatgcctataatctgttgctttttctcaatatgtgtcctattggaaattcctcaaatcgttggtgccatcagtgatttacaaacaatattttgatattgcagatgacttgcttactgtatttgcattgttagaaaacagtttgtagacaatgattcttttttaataaaatcaaataattctaaaagtgctagagaatttaactaaaagctggttcccaaatgcatagctggcattttaatttaaattcaaatctacatagagaacatccgtgtaaatcatctaactggattttcccattggtcattcccaaacacacctatggtcctagaatccttaagagaagcaccctgtaaccttttatgtggtttgcctttaagaggcccaggtgcttctcctttatgatttgagttggcctcttcataaattagtgctgtttactttcagaggaagcagagaagttgctgttatgtttttgcatccgtttaccctatgcaaagttgctgtatgatgccaactaaactgctctttaggcagccttctgaggagaaaagcaaccctgtttcaaatccactgccaattcagctcctctggagtggagctttctgatttcttggagcaggaattttagagattgaaatgaatgatcatttagtcagatttatcctgtaatttcatgcagctttgtggcctttgcagtactatttataaaatggaccctgatggtgatgaactctttagaacgcattactgttaagcctgtgttgagacattgatgctgtctatctcattttttagacagtttttgtagctttctattgagagtcaggtatgtgagcatctctgaagcagtgttgaatgtaattttcggaaacatggattgtgtattttgacttttattttataaatacacagctcaacagtgccttttttttccctcatagtcctgttggaagatgctcactactttctctcttctctctccctgccctcccccactccattcagttgattcatttatgcaaattctgtttccaacttgaaaccattttgtcacatctgttggagagataatcactccttttccttaacattctgccagctttctgatgttgaagtgtttcagttgactacctgatgcaaaagctataaaataaacagtgggaaggggaaaaattggtgtcctgttttaatattttcttttgtagccttgacactgatggacattttccaagctgactcagtgttcagtgtcaacttaactctcagatagtgttgccatcaagaaagcatgcaacatcattggtttctaatgattttatggcttgtgacaatattttatctggactgacatgcctctgctgcttttgctttgtacttcattgctggtaataaaatttcagatggaaaacttacaaaatatatacttaattagaagaaaaaaatagagaaagggctattagaattaaaaaaatttgaaagtaacttaatctaacatttatggcacagtttggacatatccataattttttttgggaacacacatttctgattttttttttcccccttaaagaagaaagtctcaattccattgattttcaattcttagccactggctcattgctttgagcaatgcttgattgattctatttatattatatgatattgggttgataaaataccagttcaatgatgagttttcttaacagaatttggtttgtacttgcagtggctgaacaaagagcatggcttgagaatcaaagggatctgcatttagcaatgtgatgtcagtaaatggacataacaggattgttgtaaaggttgggcatgatgtatgcaaagtactggccagggtagactaataactgatggcatttatatgctgtgctggaatattgttaccaagctgatgtgccgttctcaccctgcagaatactggttttgtcatttcataaatgatatttttataaatatttttgaatgactgta

SEQ ID NO: 16980 - DNA, 2465 bp, Homo sapiens
ccaaataggaggaggattacattgtttctctataacactgagcaagagagctcagacgcacatgttggaattttaaagataatgttatgtgtgtatgtgaaatatatatacatatatatatatgtttatttcctaaaagaagaaaagatacctttctgttcaacttgtatcaactcctcttttctaattgctgtgaaatggcaactgttgataaattattgtgattgttttaaaatctaatgggaagtaaaatatattttgattttacccagcttaatctgtaaagtagcacttaaatatatctgatagcaacacttaagatattgcatggggattactttcctatcatccatatgcatttgtgcaacttcaaacatattgggtgcttctgaattcctgatgattggatttaagctattgaaaattggataatttaaacttaatgatttttataattttctgatcttaaaatttggttaatgcctataatctgttgctttttctcaatatgtgtcctattggaaattcctcaaatcgttggtgccatcagtgatttacaaacaatattttgatattgcagatgacttgcttactgtatttgcattgttagaaaacagtttgtagacaatgattcttttttaataaaatcaaataattctaaaagtgctagagaatttaactaaaagctggttcccaaatgcatagctggcattttaatttaaattcaaatctacatagagaacatccgtgtaaatcatctaactggattttcccattggtcattcccaaacacacctatggtcctagaatccttaagagaagcaccctgtaaccttttatgtggtttgcctttaagaggcccaggtgcttctcctttatgatttgagttggcctcttcataaattagtgctgtttactttcagaggaagcagagaagttgctgttatgtttttgcatccgtttaccctatgcaaagttgctgtatgatgccaactaaactgctctttaggcagccttctgaggagaaaagcaaccctgtttcaaatccactgccaattcagctcctctggagtggagctttctgatttcttggagcaggaattttagagattgaaatgaatgatcatttagtcagatttatcctgtaatttcatgcagctttgtggcctttgcagtactatttataaaatggaccctgatggtgatgaactctttagaacgcattactgttaagcctgtgttgagacattgatgctgtctatctcattttttagacagtttttgtagctttctattgagagtcaggtatgtgagcatctctgaagcagtgttgaatgtaattttcggaaacatggattgtgtattttgacttttattttataaatacacagctcaacagtgccttttttttccctcatagtcctgttggaagatgctcactactttctctcttctctctccctgccctcccccactccattcagttgattcatttatgcaaattctgtttccaacttgaaaccattttgtcacatctgttggagagataatcactccttttccttaacattctgccagctttctgatgttgaagtgtttcagttgactacctgatgcaaaagctataaaataaacagtgggaaggggaaaaattggtgtcctgttttaatattttcttttgtagccttgacactgatggacattttccaagctgactcagtgttcagtgtcaacttaactctcagatagtgttgccatcaagaaagcatgcaacatcattggtttctaatgattttatggcttgtgacaatattttatctggactgacatgcctctgctgcttttgctttgtacttcattgctggtaataaaatttcagatggaaaacttacaaaatatatacttaattagaagaaaaaaatagagaaagggctattagaattaaaaaaatttgaaagtaacttaatctaacatttatggcacagtttggacatatccataattttttttgggaacacacatttctgattttttttttcccccttaaagaagaaagtctcaattccattgattttcaattcttagccactggctcattgctttgagcaatgcttgattgattctatttatattatatgatattgggttgataaaataccagttcaatgatgagttttcttaacagaatttggtttgtacttgcagtggctgaacaaagagcatggcttgagaatcaaagggatctgcatttagcaatgtgatgtcagtaaatggacataacaggattgttgtaaaggttgggcatgatgtatgcaaagtactggccagggtagactaataactgatggcatttatatgctgtgctggaatattgttaccaagctgatgtgccgttctcaccctgcagaatactggttttgtcatttcataaatgatatttttataaatatttttgaatgactgta

SEQ ID NO: 16981 - DNA, 1976 bp, Homo sapiens
cgccggtggaggggcgcgcggccgcgagcaaaggagggagggaaggaaggaagagagggaggcgggcaagcaggcgggcgcgggggtcggggactgaggcagtagagggaggcgagagcccggcagccgcttcgcgctgtttgctgcgcgggcttttggagggggcggccgtttagtcggctgaggagaagcggacaccagcggcgttggtgatagcgcctgggggagggggactggagaggcgagaaggggggtcgctgcggtggttctctcgctgtcgctctctctttgcctcgctcccggctcggcgggctcctcccggcgtctctctcgcctccggggtcccgctccccgccccccgcggtatgtcttgatcccgagcagcgggtttcatggggctcctcaggattatgatgccgcccaagttgcagctgctggcggtggtggccttcgcggtggcgatgctcttcttggaaaaccagatccagaaactggaggagtcccgctcgaagctagaaagggctattgcaagacacgaagtccgagaaattgagcagcgacatacaatggatggccctcggcaagatgccactttagatgaggaagaggacatggtgatcatttataacagagttcccaaaacggcaagcacttcatttaccaatatcgcctatgacctgtgtgcaaagaataaataccatgtccttcatatcaacactaccaaaaataatccagtgatgtcattgcaagatcaggtgcgctttgtaaagaatataacttcctggaaagagatgaaaccaggattttatcatggacacgtttcttacttggattttgcaaaatttggtgtgaagaagaaaccaatttacattaatgtcataagggatcctattgagaggctagtttcttattattactttctgagatttggagatgattatagaccagggttacggagacgaaaacaaggagacaaaaagacctttgatgaatgtgtagcagaaggtggctcagactgtgctccagagaagctctggcttcaaatcccgttcttctgtggccatagctccgaatgctggaatgtgggaagcaggtgggctatggatcaagccaagtataacctaattaatgaatattttctggtgggagttactgaagaacttgaagattttatcatgttattggaggcagcattgccccggtttttcaggggtgctactgaactctatcgcacagcaccagatactgctacaccatctcatcggcatggacctatatgtggcagcaagtccatctcatcgcttttggtgaaagtcagtccagtttgtaaagattctcattgtcactgtagacgaggaactgggacaccaaaaggagaaactctggccacgcttgcaccctgttcccaatcctggtccagtgtcacccacagatggtaaggagctctagagacctcaccagcccctgggattggtcacctcactcttctatggacagagattcctgctgggatcctttgagggcaagcagacccttcttccagctcggactgtgaactccactgcagccgtaaggactgtctgtgacagtgagcccgagatgactgggctctgtgctccctcccggccctccaatccttggcctgccacagagaactgagctcttttattagcaccatgaatgtgactgatacagctagccattcccttgtgcgaatgactcagtttattaatgctctgctaaagatggcttctttgcttgccagcagccttaaacagtatttcattaaaactggcttaattattttgagaagacggcccaattaaaagctatacactccctctatgtgagtgtttatacatagagctgtatatataatacatatttgtaagtgtgtgtatatatatatgtgtatgtatgtgtctataaatatataggcttagcaatttcattacatgggataaattgttggaaaa

SEQ ID NO: 16982 - DNA, 1596 bp, Homo sapiens
cgccggtggaggggcgcgcggccgcgagcaaaggagggagggaaggaaggaagagagggaggcgggcaagcaggcgggcgcgggggtcggggactgaggcagtagagggaggcgagagcccggcagccgcttcgcgctgtttgctgcgcgggcttttggagggggcggccgtttagtcggctgaggagaagcggacaccagcggcgttggtgatagcgcctgggggagggggactggagaggcgagaaggggggtcgctgcggtggttctctcgctgtcgctctctctttgcctcgctcccggctcggcgggctcctcccggcgtctctctcgcctccggggtcccgctccccgccccccgcggtatgtcttgatcccgagcagcgggtttcatggggctcctcaggattatgatgccgcccaagttgcagctgctggcggtggtggccttcgcggtggcgatgctcttcttggaaaaccagatccagaaactggaggagtcccgctcgaagctagaaagggctattgcaagacacgaagtccgagaaattgagcagcgacatacaatggatggccctcggcaagatgccactttagatgaggaagaggacatggtgatcatttataacagagttcccaaaacggcaagcacttcatttaccaatatcgcctatgacctgtgtgcaaagaataaataccatgtccttcatatcaacactaccaaaaataatccagtgatgtcattgcaagatcaggtgcgctttgtaaagaatataacttcctggaaagagatgaaaccaggattttatcatggacacgtttcttacttggattttgcaaaatttggtgtgaagaagaaaccaatttacattaatgtcataagggatcctattgagaggctagtttcttattattactttctgagatttggagatgattatagaccagggttacggagacgaaaacaaggagacaaaaagacctttgatgaatgtgtagcagaaggtggctcagactgtgctccagagaagctctggcttcaaatcccgttcttctgtggccatagctccgaatgctggtaggggagataaagttggctcagattgattatcatccttattatctctataatctgtgtttcatttcacaagggctagatatagggaaatcggtgaaagactagactaaaaataacatgtaattcagtaatatctagttttgcagttacttttaaatgcatttaaaagattcctcatgtagagtgatatcctaatatccttgcattgttttctgagatgccggtttttagtatttcttatttttggtgttatgttttgctgtattccagcagagctcttagagactgggggtgggggtgggtgtcataaatcttattttgtccaaagcttactgttttagctattcatgttaaattaagaaaaggcttagtgggttaaaattcacctggttttactgttaaactgattttgactttaagagaagccaaggttatggctgtggtttagtttgctagtaaatatcaagtggaaaataaagatactttaataaaaactgtatttcctcaaaaagtaatga

SEQ ID NO: 16983 - DNA, 6911 bp, Homo sapiens
cgccggtggaggggcgcgcggccgcgagcaaaggagggagggaaggaaggaagagagggaggcgggcaagcaggcgggcgcgggggtcggggactgaggcagtagagggaggcgagagcccggcagccgcttcgcgctgtttgctgcgcgggcttttggagggggcggccgtttagtcggctgaggagaagcggacaccagcggcgttggtgatagcgcctgggggagggggactggagaggcgagaaggggggtcgctgcggtggttctctcgctgtcgctctctctttgcctcgctcccggctcggcgggctcctcccggcgtctctctcgcctccggggtcccgctccccgccccccgcggtatgtcttgatcccgagcagcgggtttcatggggctcctcaggattatgatgccgcccaagttgcagctgctggcggtggtggccttcgcggtggcgatgctcttcttggaaaaccagatccagaaactggaggagtcccgctcgaagctagaaagggctattgcaagacacgaagtccgagaaattgagcagcgacatacaatggatggccctcggcaagatgccactttagatgaggaagaggacatggtgatcatttataacagagttcccaaaacggcaagcacttcatttaccaatatcgcctatgacctgtgtgcaaagaataaataccatgtccttcatatcaacactaccaaaaataatccagtgatgtcattgcaagatcaggtgcgctttgtaaagaatataacttcctggaaagagatgaaaccaggattttatcatggacacgtttcttacttggattttgcaaaatttggtgtgaagaagaaaccaatttacattaatgtcataagggatcctattgagaggctagtttcttattattactttctgagatttggagatgattatagaccagggttacggagacgaaaacaaggagacaaaaagacctttgatgaatgtgtagcagaaggtggctcagactgtgctccagagaagctctggcttcaaatcccgttcttctgtggccatagctccgaatgctggaatgtgggaagcaggtgggctatggatcaagccaagtataacctaattaatgaatattttctggtgggagttactgaagaacttgaagattttatcatgttattggaggcagcattgccccggtttttcaggggtgctactgaactctatcgcacaggaaagaaatctcatcttaggaaaaccacagagaagaaactccccactaaacaaaccattgcaaaactacagcaatctgatcatttaggcaaatggagaatgagttctatgaatttgcactagagcagttccaattcatcagagcccatgccgttcgagaaaaagatggagacctctacatcctcgcacaaaactttttctatgaaaagatttaccctaagtcgaactgagtataaggtgtgactattagattcttgaactaaaatttgaccctgtcttcacctttgttctcagctccacagtctggattgctgacagtaggtgtatatgacaatttgtattgagccaaattaggaaacagacagtaacgtcaaggaagtagatactggctggcattgtcagtgttctaagtttcaggcatttttatttttcctggctaaacgttggtgaaagttataacctcctgcctgggagaaaatatacatcacctaaaatgaacttatggcaggtctaatcaaaaggctaaatacaatttcagaaaaggttctgatactcttgtttttgataaagcattttttcaactaaccatgaattaagatgagtccatttgcctcttctgccttcactgagggtttgggttatacacctctactgaattgtgttaataactgtttggcagtgtgtactttgtttttgtgagtcatgtctcatgaaatttattggaatgtttaatcatatttgctaagaaatgtttctgctgtagttggatttgcccatatttatgtaggtggttttaattttttaaatggtgattagtgttaaaaatcaatttaaatcatgactaatatggtaaaaagataaagcatcaaagcagtatttctcattcctgcctcctcaatatctaatactgggaagatacttcaaagaatattgagattgtctgaagttttagttaagattttcacacattaatatcaaaaaagtaagtttagtatttgtttctccatgggttatttgtaaagctgtaaactgagatatcggtgactccgtattatgactccattagtgagctgtggtatgggtaggattttcctacttcttctgtacttttacctgtagactatttttactaaggtgctttataatgtgttttaaagcattgcatttacaaaacaaggaaaatgctgtaaatattgcatattttatgtatttggaccaaaaggttacaagtaattagacaaaagtggttttgcaccaattttatgtcaagtaaaaccatcagacctactgttcttgtatttctcatttaactttactgttaagacatcactgaaatgaacttcagtaagctttcaattttgatacacagttcattattcataacttgaggcagtaattacagtggaatgagtactggacaaggagtcaaaaaacttgatttcaggtcctagctctagcacttacagctgtgtgatcttgggcaagtcacttaacctctctttgcctcaatttcctcatcttgaaatgaggataataatacctgctgtacctacctcacagggctgttgtgaggattaaatgagatggcatgtgaaagcactttgaaaattgtaaagcgctatgtaaatgtaaggtattatagaaacatctttaacatatagtttcataccattcattttttaacaaagaaagggaaaagtctgcttgtaagctggttgaaaaagttaatcttgatataaatttgtgtttgataaatatcctctcagtgttttatcttccatgtttcaacaactattgaaatatgaaatgcctgtgaactcttaaagcttcatgagcagctgcttgagttcaggaagttcactgttagaaataggctttgttagctgactagggtcagggaaacttttctcttcaaatttgaaagctgtttctgttttcattttacattattattcagaaatggtagctattctatacctatggtttaagtaaatatttctgaataaggcttcaccatactgtaagcattttaggtagattgccttaaaggttatgggagggcatgagggaacacttcttatgagaaaacatttataaacaaaagaaacatttataaactaaagaaaaactaaaagaatgacagaacaatcatcttagcaccctttcctcacaataatataaaaatattaaaagaacataggcaggctttttttaaatttggcttttttctttccttttttcaaattgacttttataggtatttcctgaaagtgtatacaaattatttcctcgcccaaaataaagcaccacttcaaggtgtggtttgacattacatgctaatgaacaaacccagtatgcaagttattcttgcaccacatgctcaaatcttcttgaggtgcattaactcttttaggtaactagagcagtacttggtgaactagatcaggaggtcagtaaactttctgtggaagggccagagagtaaatattttaggctttgcagcccatacggtctctgtcacagctagtcaaccctgccattttaccacaaaagcagcaatagacattatgtaaacaaatgagcacagttatgttccaataaaactttatttacaaaaacagatgacatcccagatgcagaccatgggcaaccaaccattgcactggctaaatcattatttatggagaaatcctctttgtgtctctactctagatgcctaaaagagtttatatacttctaaaagctcctaacttatatccaaagaattgctttctgattcgtgtagtctctcccacagattcataaacttttatgacttatattgtttccaggtgggcatggtttatttcccagtttaacagttcagaataggggcatttattttatcatattttagggtgggttaggagtatcctttctggagactgagaaaggggtgtatttaattccatcaggtccagtacagtactaggagtcataatactttataatcaattaaataaatagaaccactgagacaataatgtatttttttaaagtggcaaatgtggttttcttttttcagcctttgcgctttttcagtattttgaccatagggagataatttttttataatacaaaagtaaccacttggaattttaaagataatgttatgtgtgtatgtgaaatatatatacatatatatatatgtttatttcctaaaagaagaaaagatacctttctgttcaacttgtatcaactcctcttttctaattgctgtgaaatggcaactgttgataaattattgtgattgttttaaaatctaatgggaagtaaaatatattttgattttacccagcttaatctgtaaagtagcacttaaatatatctgatagcaacacttaagatattgcatggggattactttcctatcatccatatgcatttgtgcaacttcaaacatattgggtgcttctgaattcctgatgattggatttaagctattgaaaattggataatttaaacttaatgatttttataattttctgatcttaaaatttggttaatgcctataatctgttgctttttctcaatatgtgtcctattggaaattcctcaaatcgttggtgccatcagtgatttacaaacaatattttgatattgcagatgacttgcttactgtatttgcattgttagaaaacagtttgtagacaatgattcttttttaataaaatcaaataattctaaaagtgctagagaatttaactaaaagctggttcccaaatgcatagctggcattttaatttaaattcaaatctacatagagaacatccgtgtaaatcatctaactggattttcccattggtcattcccaaacacacctatggtcctagaatccttaagagaagcaccctgtaaccttttatgtggtttgcctttaagaggcccaggtgcttctcctttatgatttgagttggcctcttcataaattagtgctgtttactttcagaggaagcagagaagttgctgttatgtttttgcatccgtttaccctatgcaaagttgctgtatgatgccaactaaactgctctttaggcagccttctgaggagaaaagcaaccctgtttcaaatccactgccaattcagctcctctggagtggagctttctgatttcttggagcaggaattttagagattgaaatgaatgatcatttagtcagatttatcctgtaatttcatgcagctttgtggcctttgcagtactatttataaaatggaccctgatggtgatgaactctttagaacgcattactgttaagcctgtgttgagacattgatgctgtctatctcattttttagacagtttttgtagctttctattgagagtcaggtatgtgagcatctctgaagcagtgttgaatgtaattttcggaaacatggattgtgtattttgacttttattttataaatacacagctcaacagtgccttttttttccctcatagtcctgttggaagatgctcactactttctctcttctctctccctgccctcccccactccattcagttgattcatttatgcaaattctgtttccaacttgaaaccattttgtcacatctgttggagagataatcactccttttccttaacattctgccagctttctgatgttgaagtgtttcagttgactacctgatgcaaaagctataaaataaacagtgggaaggggaaaaattggtgtcctgttttaatattttcttttgtagccttgacactgatggacattttccaagctgactcagtgttcagtgtcaacttaactctcagatagtgttgccatcaagaaagcatgcaacatcattggtttctaatgattttatggcttgtgacaatattttatctggactgacatgcctctgctgcttttgctttgtacttcattgctggtaataaaatttcagatggaaaacttacaaaatatatacttaattagaagaaaaaaatagagaaagggctattagaattaaaaaaatttgaaagtaacttaatctaacatttatggcacagtttggacatatccataattttttttgggaacacacatttctgattttttttttcccccttaaagaagaaagtctcaattccattgattttcaattcttagccactggctcattgctttgagcaatgcttgattgattctatttatattatatgatattgggttgataaaataccagttcaatgatgagttttcttaacagaatttggtttgtacttgcagtggctgaacaaagagcatggcttgagaatcaaagggatctgcatttagcaatgtgatgtcagtaaatggacataacaggattgttgtaaaggttgggcatgatgtatgcaaagtactggccagggtagactaataactgatggcatttatatgctgtgctggaatattgttaccaagctgatgtgccgttctcaccctgcagaatactggttttgtcatttcataaatgatatttttataaatatttttgaatgactgtactttttactgattatcttaataccgcctcacttatgtacctgtagcataaatattcctggttctgattcttgctgttctttccacatacaaatcactcatttgtacagattaaaggggggaaacgctgactgttctaaagaagata

SEQ ID NO: 16984 - DNA, 1885 bp, Homo sapiens
ttcgggcccggctggcgggcggcgccgggagcgcgggggcggcgggcccgggtcgagcatgtagcggctgctggcggcggggctcccggggcgggccgggcgggccgcgggagccgcacgcggcgatatggaagaggagggcaagaagggcaagaagcctggaattgtctcgccatttaaacgagtattcctaaaaggtgaaaagagtagagataagaaagcccatgagaaggtgacagagaggcgccctctgcacactgtggtgttgtcattgcctgagcgcgtcgagccagacagactgctgagcgactatattgagaaggaggtaaagtatttaggtcagttaacgtccataccaggatacctgaatccctccagtaggactgaaatcctgcatttcatagacaatgcaaagagagcccaccagcttccgggacacttgactcaggagcacgatgctgtgctcagcctgtctgcgtacaacgtcaagctggcctggagggacggggaggatatcatcctcagggtgcccatccatgacatcgccgccgtctcctatgttcgggatgacgctgcacacctggtggtcctgaagacagcccaggacccagggatctcccccagccagagtctgtgtgcggaaagttccagaggcctcagtgcaggctccctgtcggagagtgcagttgggcccgtggaggcatgctgcctggtcatcctggctgcagagagcaaggtcgctgcggaggagctttgctgtctgctaggccaggtcttccaggttgtttacacggagtccaccatcgactttctggacagagcgatatttgatggggcctctaccccgacccaccacctgtccctgcacagcgatgactcttctacaaaagtggacattaaggagacctacgaggtggaagccagcactttctgcttccctgaatctgtggatgtgggtggtgcatcaccccacagcaagaccatcagtgagagcgagctgagcgccagcgccactgagctgctgcaggactacatgctgacgctgcgcaccaagctgtcatcacaggagatccagcagtttgcagcactgctgcacgagtaccgcaatggggcctctatccacgagttctgcatcaacctgcggcagctctacggggacagccgcaagttcctgctgcttggtctgaggcccttcatccctgagaaggacagccagcacttcgagaacttcctggagaccattggcgtgaaggatggccgcggcatcatcactgacagctttggcaggcaccggcgggccctgagcaccacatccagttccaccaccaatgggaacagggccacgggcagctctgatgaccggtcggcaccctcagagggggatgagtgggaccgcatgatctcggacatcagcagcgacattgaggcgctgggctgcagcatggaccaggactcagcatgatggacagtggatgggggggcacccacaccttccgcgcagtcgtcataggccttcccagaaggagctgcccagacctgcgtgtcagcccttggtggtggccagggagaggcgcccggtgcagatggccccgggcggcccaggtcctctactgtgaaggagcagggagctgccgagggacacgagcctcagtgcggggtggaaggctctttgccttgtccaccagggctcagccaagccctgcagtgtgtccccgctcggggagggcccggccgagcgggcagggagagccagtcctgtcggctgggcccttggacggctgtcagttttgcacatgatgttcctattgtaactctcagagaccttaaaaagaagtttactgcaatgtgaataatttaatctctggttgccaagcaaaaaaaagat

SEQ ID NO: 16985 - DNA, 724 bp, Homo sapiens
ttcgggcccggctggcgggcggcgccgggagcgcgggggcggcgggcccgggtcgagcatgtagcggctgctggcggcggggctcccggggcgggccgggcgggccgcgggagccgcacgcggcgatatggaagaggagggcaagaagggcaagaagcctggaattgtctcgccatttaaacgagtattcctaaaaggtgaaaagagtagagataagaaagcccatgagaaggtgacagagaggcgccctctgcacactgtggtgttgtcattgcctgagcgcgtcgagccagacagactgctgagcgactatattgagaaggaggtaaagggctcccattaatcacatattgatatttattttatttttcatgccctttcatttttctctcatttttcctattctttactcttcccaatgccttctgggaatgtttcaaaccactctccgtcttatgaattcattcctcaactgtattcattcaaccctgaattaaattgtttgtttctactatatctgattggtccttttttataactccttgtccctatttgtttccagtgccctcctacatgcccttgagaatatttattaggattattgtaaattcttgttttctctggcttatcagttcttctccctccagaattagttgtttagtttgtgatcttgcctttccagtgcttgaggtctgtgttccacagatctgtctttattttttcc

SEQ ID NO: 16986 - DNA, 2140 bp, Homo sapiens
tttgaaattaatgtccttctgttgactgcagaatttctgctggaaatgcagggaggctgcttgtggggttcgcgtgctgtgggaagtagggaaaatgagctggtttactttgtgtctttttgtgcatgcagactgtttggattttgccaacagtttctgggtgctgcctgctttttaaacttttaaaaaattgtaaacagcttcagtggctttgcagaaggaagctgtggtttctggtcttcctgttcagtcatgtttttttcagagggagggctaacatctggccatatttttcaacaaattcagaagtgagtagagaatgcatagtagctgtcggcagaggaggaaccagaatctctccaaagaaattcctcaaacagaatttcacacagggtattccatggagaatgagcctggaattgtctcgccatttaaacgagtattcctaaaaggtgaaaagagtagagataagaaagcccatgagaaggtgacagagaggcgccctctgcacactgtggtgttgtcattgcctgagcgcgtcgagccagacagactgctgagcgactatattgagaaggaggtaaagtatttaggtcagttaacgtccataccaggatacctgaatccctccagtaggactgaaatcctgcatttcatagacaatgcaaagagagcccaccagcttccgggacacttgactcaggagcacgatgctgtgctcagcctgtctgcgtacaacgtcaagctggcctggagggacggggaggatatcatcctcagggtgcccatccatgacatcgccgccgtctcctatgttcgggatgacgctgcacacctggtggtcctgaagacagcccaggacccagggatctcccccagccagagtctgtgtgcggaaagttccagaggcctcagtgcaggctccctgtcggagagtgcagttgggcccgtggaggcatgctgcctggtcatcctggctgcagagagcaaggtcgctgcggaggagctttgctgtctgctaggccaggtcttccaggttgtttacacggagtccaccatcgactttctggacagagcgatatttgatggggcctctaccccgacccaccacctgtccctgcacagcgatgactcttctacaaaagtggacattaaggagacctacgaggtggaagccagcactttctgcttccctgaatctgtggatgtgggtggtgcatcaccccacagcaagaccatcagtgagagcgagctgagcgccagcgccactgagctgctgcaggactacatgctgacgctgcgcaccaagctgtcatcacaggagatccagcagtttgcagcactgctgcacgagtaccgcaatggggcctctatccacgagttctgcatcaacctgcggcagctctacggggacagccgcaagttcctgctgcttggtctgaggcccttcatccctgagaaggacagccagcacttcgagaacttcctggagaccattggcgtgaaggatggccgcggcatcatcactgacagctttggcaggcaccggcgggccctgagcaccacatccagttccaccaccaatgggaacagggccacgggcagctctgatgaccggtcggcaccctcagagggggatgagtgggaccgcatgatctcggacatcagcagcgacattgaggcgctgggctgcagcatggaccaggactcagcatgatggacagtggatgggggggcacccacaccttccgcgcagtcgtcataggccttcccagaaggagctgcccagacctgcgtgtcagcccttggtggtggccagggagaggcgcccggtgcagatggccccgggcggcccaggtcctctactgtgaaggagcagggagctgccgagggacacgagcctcagtgcggggtggaaggctctttgccttgtccaccagggctcagccaagccctgcagtgtgtccccgctcggggagggcccggccgagcgggcagggagagccagtcctgtcggctgggcccttggacggctgtcagttttgcacatgatgttcctattgtaactctcagagaccttaaaaagaagtttactgcaatgtgaataatttaatctctggttgccaagcaaaaaaaagat

SEQ ID NO: 16987 - DNA, 1831 bp, Homo sapiens
ggcaggctgggaagtcggccgccgtaaagatggcggcaaattgaaaaagttggagctgctcccgcgcgcgctgagtgggcggagcgaacagggggctggacagcctggaattgtctcgccatttaaacgagtattcctaaaaggtgaaaagagtagagataagaaagcccatgagaaggtgacagagaggcgccctctgcacactgtggtgttgtcattgcctgagcgcgtcgagccagacagactgctgagcgactatattgagaaggaggtaaagtatttaggtcagttaacgtccataccaggatacctgaatccctccagtaggactgaaatcctgcatttcatagacaatgcaaagagagcccaccagcttccgggacacttgactcaggagcacgatgctgtgctcagcctgtctgcgtacaacgtcaagctggcctggagggacggggaggatatcatcctcagggtgcccatccatgacatcgccgccgtctcctatgttcgggatgacgctgcacacctggtggtcctgaagacagcccaggacccagggatctcccccagccagagtctgtgtgcggaaagttccagaggcctcagtgcaggctccctgtcggagagtgcagttgggcccgtggaggcatgctgcctggtcatcctggctgcagagagcaaggtcgctgcggaggagctttgctgtctgctaggccaggtcttccaggttgtttacacggagtccaccatcgactttctggacagagcgatatttgatggggcctctaccccgacccaccacctgtccctgcacagcgatgactcttctacaaaagtggacattaaggagacctacgaggtggaagccagcactttctgcttccctgaatctgtggatgtgggtggtgcatcaccccacagcaagaccatcagtgagagcgagctgagcgccagcgccactgagctgctgcaggactacatgctgacgctgcgcaccaagctgtcatcacaggagatccagcagtttgcagcactgctgcacgagtaccgcaatggggcctctatccacgagttctgcatcaacctgcggcagctctacggggacagccgcaagttcctgctgcttggtctgaggcccttcatccctgagaaggacagccagcacttcgagaacttcctggagaccattggcgtgaaggatggccgcggcatcatcactgacagctttggcaggcaccggcgggccctgagcaccacatccagttccaccaccaatgggaacagggccacgggcagctctgatgaccggtcggcaccctcagagggggatgagtgggaccgcatgatctcggacatcagcagcgacattgaggcgctgggctgcagcatggaccaggactcagcatgatggacagtggatgggggggcacccacaccttccgcgcagtcgtcataggccttcccagaaggagctgcccagacctgcgtgtcagcccttggtggtggccagggagaggcgcccggtgcagatggccccgggcggcccaggtcctctactgtgaaggagcagggagctgccgagggacacgagcctcagtgcggggtggaaggctctttgccttgtccaccagggctcagccaagccctgcagtgtgtccccgctcggggagggcccggccgagcgggcagggagagccagtcctgtcggctgggcccttggacggctgtcagttttgcacatgatgttcctattgtaactctcagagaccttaaaaagaagtttactgcaatgtgaataatttaatctctggttgccaagcaaaaaaaagat

SEQ ID NO: 16988 - DNA, 2861 bp, Homo sapiens
ttcgggcccggctggcgggcggcgccgggagcgcgggggcggcgggcccgggtcgagcatgtagcggctgctggcggcggggctcccggggcgggccgggcgggccgcgggagccgcacgcggcgatatggaagaggagggcaagaagggcaagaagcctggaattgtctcgccatttaaacgagtattcctaaaaggtgaaaagagtagagataagaaagcccatgagaaggtgacagagaggcgccctctgcacactgtggtgttgtcattgcctgagcgcgtcgagccagacagactgctgagcgactatattgagaaggaggtaaagtatttaggtcagttaacgtccataccaggatacctgaatccctccagtaggactgaaatcctgcatttcatagacaatgcaaagagagcccaccagcttccgggacacttgactcaggagcacgatgctgtgctcagcctgtctgcgtacaacgtcaagctggcctggagggacggggaggatatcatcctcagggtgcccatccatgacatcgccgccgtctcctatgttcgggatgacgctgcacacctggtggtcctgaagacagcccaggacccagggatctcccccagccagagtctgtgtgcggaaagttccagaggcctcagtgcaggctccctgtcggagagtgcagttgggcccgtggaggcatgctgcctggtcatcctggctgcagagagcaaggtcgctgcggaggagctttgctgtctgctaggccaggtcttccaggttgtttacacggagtccaccatcgactttctggacagagcgatatttgatggggcctctaccccgacccaccacctgtccctgcacagcgccagccacgtgacctcttccacagtcacatcttcctttgactgtcagcttcctctgcatttcaggactcttgcaatcacattgagcccacccaaattctccagggtcatctccctatttcaaggtcagctgattagcatcctttactcccctttgaaattggtaacatattcaccaattccagggattaggatgtggacgtctttggggggtcattattctgccctccatacttaccttgttcctagtgccagaaatgtcccttttatctctcagcctctccctctgcttcatttaaaatcttaccctctctgcaacactcacctgcctcgctcacaaagctttcactcactgtctgtgctggggtgaaatgtgccttcctcaggtttgaaatagcaaattacagtctgtgtcacacggacctaatgtcatttgttgaatgtagctgctcagtgccagaccctttgctggtctgagggtcttgggaatcctgtggcttcactgggttcagatggggagtcagactgcccggctctgactgtggtttctgctgtgtgacctgggccaagttgtgtaactctctgacttacttcctaatctacaagtgaagacaggggtgatatatgcctgggttaaaggagacaaagccccagtaaccctgcctggcacatgagtgatacctcaaagacagcttttgctggctctggccatgggtgaatgtggacttcagaccagcgtgcagcaggatttgcatttgccaggatccccaggaggggtgtatgtgggctcaagtctgggaagccctgccctgaggcacacagcacattccagagtgcgggcagcttgatgaaggacagcagggtccctgaagaccagggctgccgctgtctcctgtaaatacagcagtgggctggactcaaaatgcctccccactatgtccctgaaagtcatcttagttttctgcatcttccttacagatgactcttctacaaaagtggacattaaggagacctacgaggtggaagccagcactttctgcttccctgaatctgtggatgtgggtggtgcatcaccccacagcaagaccatcagtgagagcgagctgagcgccagcgccactgagctgctgcaggactacatgctgacgctgcgcaccaagctgtcatcacaggagatccagcagtttgcagcactgctgcacgagtaccgcaatggggcctctatccacgagttctgcatcaacctgcggcagctctacggggacagccgcaagttcctgctgcttggtctgaggcccttcatccctgagaaggacagccagcacttcgagaacttcctggagaccattggcgtgaaggatggccgcggcatcatcactgacagctttggcaggcaccggcgggccctgagcaccacatccagttccaccaccaatgggaacagggccacgggcagctctgatgaccggtcggcaccctcagagggggatgagtgggaccgcatgatctcggacatcagcagcgacattgaggcgctgggctgcagcatggaccaggactcagcatgatggacagtggatgggggggcacccacaccttccgcgcagtcgtcataggccttcccagaaggagctgcccagacctgcgtgtcagcccttggtggtggccagggagaggcgcccggtgcagatggccccgggcggcccaggtcctctactgtgaaggagcagggagctgccgagggacacgagcctcagtgcggggtggaaggctctttgccttgtccaccagggctcagccaagccctgcagtgtgtccccgctcggggagggcccggccgagcgggcagggagagccagtcctgtcggctgggcccttggacggctgtcagttttgcacatgatgttcctattgtaactctcagagaccttaaaaagaagtttactgcaatgtgaataatttaatctctggttgccaagcaaaaaaaagat

SEQ ID NO: 16989 - DNA, 2008 bp, Homo sapiens
ttcgggcccggctggcgggcggcgccgggagcgcgggggcggcgggcccgggtcgagcatgtagcggctgctggcggcggggctcccggggcgggccgggcgggccgcgggagccgcacgcggcgatatggaagaggagggcaagaagggcaagaagcctggaattgtctcgccatttaaacgagtattcctaaaaggtgaaaagagtagagataagaaagcccatgagaaggtgacagagaggcgccctctgcacactgtggtgttgtcattgcctgagcgcgtcgagccagacagactgctgagcgactatattgagaaggaggtaaagtatttaggtcagttaacgtccataccaggatacctgaatccctccagtaggactgaaatcctgcatttcatagacaatgcaaagagagcccaccagcttccgggacacttgactcaggagcacgatgctgtgctcagcctgtctgcgtacaacgtcaagctggcctggagggacggggaggatatcatcctcagggtgcccatccatgacatcgccgccgtctcctatgttcgggatgacgctgcacacctggtggtcctgaagacagcccaggacccagggatctcccccagccagagtctgtgtgcggaaagttccagaggcctcagtgcaggctccctgtcggagagtgcagttgggcccgtggaggcatgctgcctggtcatcctggctgcagagagcaaggtcgctgcggaggagctttgctgtctgctaggccaggtcttccaggttgtttacacggagtccaccatcgactttctggacagagcgatatttgatggggcctctaccccgacccaccacctgtccctgcacagcgccagccacgtgacctcttccacagtcacatcttcctttgactgtcagcttcctctgcatttcaggactcttgcaatcacattgagcccacccaaattctccagggtcatctccctatttcaagatgactcttctacaaaagtggacattaaggagacctacgaggtggaagccagcactttctgcttccctgaatctgtggatgtgggtggtgcatcaccccacagcaagaccatcagtgagagcgagctgagcgccagcgccactgagctgctgcaggactacatgctgacgctgcgcaccaagctgtcatcacaggagatccagcagtttgcagcactgctgcacgagtaccgcaatggggcctctatccacgagttctgcatcaacctgcggcagctctacggggacagccgcaagttcctgctgcttggtctgaggcccttcatccctgagaaggacagccagcacttcgagaacttcctggagaccattggcgtgaaggatggccgcggcatcatcactgacagctttggcaggcaccggcgggccctgagcaccacatccagttccaccaccaatgggaacagggccacgggcagctctgatgaccggtcggcaccctcagagggggatgagtgggaccgcatgatctcggacatcagcagcgacattgaggcgctgggctgcagcatggaccaggactcagcatgatggacagtggatgggggggcacccacaccttccgcgcagtcgtcataggccttcccagaaggagctgcccagacctgcgtgtcagcccttggtggtggccagggagaggcgcccggtgcagatggccccgggcggcccaggtcctctactgtgaaggagcagggagctgccgagggacacgagcctcagtgcggggtggaaggctctttgccttgtccaccagggctcagccaagccctgcagtgtgtccccgctcggggagggcccggccgagcgggcagggagagccagtcctgtcggctgggcccttggacggctgtcagttttgcacatgatgttcctattgtaactctcagagaccttaaaaagaagtttactgcaatgtgaataatttaatctctggttgccaagcaaaaaaaagat

SEQ ID NO: 16990 - DNA, 1781 bp, Homo sapiens
  misc_feature (1664)..(1664): n is a, c, g, or t
  misc_feature (1666)..(1666): n is a, c, g, or t
  misc_feature (1671)..(1671): n is a, c, g, or t
  misc_feature (1687)..(1687): n is a, c, g, or t
ttcgggcccggctggcgggcggcgccgggagcgcgggggcggcgggcccgggtcgagcatgtagcggctgctggcggcggggctcccggggcgggccgggcgggccgcgggagccgcacgcggcgatatggaagaggagggcaagaagggcaagaagcctggaattgtctcgccatttaaacgagtattcctaaaaggtgaaaagagtagagataagaaagcccatgagaaggtgacagagaggcgccctctgcacactgtggtgttgtcattgcctgagcgcgtcgagccagacagactgctgagcgactatattgagaaggaggtaaagtatttaggtcagttaacgtccataccaggatacctgaatccctccagtaggactgaaatcctgcatttcatagacaatgcaaagagagcccaccagcttccgggacacttgactcaggagcacgatgctgtgctcagcctgtctgcgtacaacgtcaagctggcctggagggacggggaggatatcatcctcagggtgcccatccatgacatcgccgccgtctcctatgttcgggatgacgctgcacacctggtggtcctgaagacagcccaggacccagggatctcccccagccagagtctgtgtgcggaaagttccagaggcctcagtgcaggctccctgtcggagagtgcagttgggcccgtggaggcatgctgcctggtcatcctggctgcagagagcaaggtcgctgcggaggagctttgctgtctgctaggccaggtcttccaggttgtttacacggagtccaccatcgactttctggacagagcgatatttgatggggcctctaccccgacccaccacctgtccctgcacagcgatgactcttctacaaaagtggacattaaggagacctacgaggtggaagccagcactttctgcttccctgaatctgtggatgtgggtggtgcatcaccccacagcaagaccatcagtgagagcgagctgagcgccagcgccactgagctgctgcaggactacatgctgacgctgcgcaccaagctgtcatcacaggagatccagcagtttgcagcactgctgcacgagtaccgcaatggggcctctatccacgagttctgcatcaacctgcggcagctctacggggacagccgcaagttcctgctgcttggtctgaggcccttcatccctgagaaggacagccagcacttcgagaacttcctggagaccattggcgtgaaggatggccgcggcatcatcactgacagctttggcaggcaccggcgggccctgagcaccacatccagttccaccaccaatgggaacagggccacgggcagctctgatgaccggtcggcaccctcagagggggatgagtgggaccgcatgatctcggacatcagcagcgacattgaggcgctgggctgcagcatggaccaggactcagcatgatggacagtggatgggggggcacccacaccttccgcgcagtcgtcataggccttcccagaaggagctgcccagacctgcgtgtcagcccttggtggtggccagggagaggcgcccggtgcagatggccccgggcggcccaggtcctctactgtgaaggagcagggagctgccgagggacacgagcctcagtgcggggtggggngnaggcntgctgccccaggcacnaccggcaggtccgccggaggccgcgccgcggaacaccgcgggctgggcgccggcgaacagacccaccaaaggcggttaaaaccgctcgggcgag

SEQ ID NO: 16991 - DNA, 2046 bp, Homo sapiens
ttcgggcccggctggcgggcggcgccgggagcgcgggggcggcgggcccgggtcgagcatgtagcggctgctggcggcggggctcccggggcgggccgggcgggccgcgggagccgcacgcggcgatatggaagaggagggcaagaagggcaagaagcctggaattgtctcgccatttaaacgagtattcctaaaaggtgaaaagagtagagataagaaagcccatgagaaggtgacagagaggcgccctctgcacactgtggtgttgtcattgcctgagcgcgtcgagccagacagactgctgagcgactatattgagaaggaggtaaagtatttaggtcagttaacgtccataccaggatacctgaatccctccagtaggactgaaatcctgcatttcatagacaatgcaaagagagcccaccagcttccgggacacttgactcaggagcacgatgctgtgctcagcctgtctgcgtacaacgtcaagctggcctggagggacggggaggatatcatcctcagggtgcccatccatgacatcgccgccgtctcctatgttcgggatgacgctgcacacctggtggtcctgaagacagcccaggacccagggatctcccccagccagagtctgtgtgcggaaagttccagaggcctcagtgcaggctccctgtcggagagtgcagttgggcccgtggaggcatgctgcctggtcatcctggctgcagagagcaaggtcgctgcggaggagctttgctgtctgctaggccaggtcttccaggttgtttacacggagtccaccatcgactttctggacagagcgatatttgatggggcctctaccccgacccaccacctgtccctgcacagcgagcccaactcagagccatgcccccggggagccccaggaccaggccaagctgaccaccctgcatgcccagtcagctctcctctcatcatcatcatcatcacttacattcctctgttcaaggacagggacccacacacacggcatggactaggtttcctgaaacgtgtgtgggatggagggtcggggaagccacccgctcacataccacattctttcgcagctgcttccctgaatctgtggatgtgggtggtgcatcaccccacagcaagaccatcagtgagagcgagctgagcgccagcgccactgagctgctgcaggactacatgctgacgctgcgcaccaagctgtcatcacaggagatccagcagtttgcagcactgctgcacgagtaccgcaatggggcctctatccacgagttctgcatcaacctgcggcagctctacggggacagccgcaagttcctgctgcttggtctgaggcccttcatccctgagaaggacagccagcacttcgagaacttcctggagaccattggcgtgaaggatggccgcggcatcatcactgacagctttggcaggcaccggcgggccctgagcaccacatccagttccaccaccaatgggaacagggccacgggcagctctgatgaccggtcggcaccctcagagggggatgagtgggaccgcatgatctcggacatcagcagcgacattgaggcgctgggctgcagcatggaccaggactcagcatgatggacagtggatgggggggcacccacaccttccgcgcagtcgtcataggccttcccagaaggagctgcccagacctgcgtgtcagcccttggtggtggccagggagaggcgcccggtgcagatggccccgggcggcccaggtcctctactgtgaaggagcagggagctgccgagggacacgagcctcagtgcggggtggaaggctctttgccttgtccaccagggctcagccaagccctgcagtgtgtccccgctcggggagggcccggccgagcgggcagggagagccagtcctgtcggctgggcccttggacggctgtcagttttgcacatgatgttcctattgtaactctcagagaccttaaaaagaagtttactgcaatgtgaataatttaatctctggttgccaagcaaaaaaaagat

SEQ ID NO: 16992 - DNA, 1966 bp, Homo sapiens
tttgaaattaatgtccttctgttgactgcagaatttctgctggaaatgcagggaggctgcttgtggggttcgcgtgctgtgggaagtagggaaaatgagctggtttactttgtgtctttttgtgcatgcagactgtttggattttgccaacagtttctgggtgctgcctgctttttaaacttttaaaaaattgtaaacagcttcagtggctttgcagaaggaagctgtggtttctggtcttcctgttcagtcatgtttttttcagagggagggctaacatctggccatatttttcaacaaattcagaagtgagtagagaatgcatagtagctgtcggcagaggaggaaccagaatctctccaaagaaattcctcaaacagaatttcacacagggtattccatggagaatgagtatttaggtcagttaacgtccataccaggatacctgaatccctccagtaggactgaaatcctgcatttcatagacaatgcaaagagagcccaccagcttccgggacacttgactcaggagcacgatgctgtgctcagcctgtctgcgtacaacgtcaagctggcctggagggacggggaggatatcatcctcagggtgcccatccatgacatcgccgccgtctcctatgttcgggatgacgctgcacacctggtggtcctgaagacagcccaggacccagggatctcccccagccagagtctgtgtgcggaaagttccagaggcctcagtgcaggctccctgtcggagagtgcagttgggcccgtggaggcatgctgcctggtcatcctggctgcagagagcaaggtcgctgcggaggagctttgctgtctgctaggccaggtcttccaggttgtttacacggagtccaccatcgactttctggacagagcgatatttgatggggcctctaccccgacccaccacctgtccctgcacagcgatgactcttctacaaaagtggacattaaggagacctacgaggtggaagccagcactttctgcttccctgaatctgtggatgtgggtggtgcatcaccccacagcaagaccatcagtgagagcgagctgagcgccagcgccactgagctgctgcaggactacatgctgacgctgcgcaccaagctgtcatcacaggagatccagcagtttgcagcactgctgcacgagtaccgcaatggggcctctatccacgagttctgcatcaacctgcggcagctctacggggacagccgcaagttcctgctgcttggtctgaggcccttcatccctgagaaggacagccagcacttcgagaacttcctggagaccattggcgtgaaggatggccgcggcatcatcactgacagctttggcaggcaccggcgggccctgagcaccacatccagttccaccaccaatgggaacagggccacgggcagctctgatgaccggtcggcaccctcagagggggatgagtgggaccgcatgatctcggacatcagcagcgacattgaggcgctgggctgcagcatggaccaggactcagcatgatggacagtggatgggggggcacccacaccttccgcgcagtcgtcataggccttcccagaaggagctgcccagacctgcgtgtcagcccttggtggtggccagggagaggcgcccggtgcagatggccccgggcggcccaggtcctctactgtgaaggagcagggagctgccgagggacacgagcctcagtgcggggtggaaggctctttgccttgtccaccagggctcagccaagccctgcagtgtgtccccgctcggggagggcccggccgagcgggcagggagagccagtcctgtcggctgggcccttggacggctgtcagttttgcacatgatgttcctattgtaactctcagagaccttaaaaagaagtttactgcaatgtgaataatttaatctctggttgccaagcaaaaaaaagat

SEQ ID NO: 16993 - DNA, 1711 bp, Homo sapiens
ttcgggcccggctggcgggcggcgccgggagcgcgggggcggcgggcccgggtcgagcatgtagcggctgctggcggcggggctcccggggcgggccgggcgggccgcgggagccgcacgcggcgatatggaagaggagggcaagaagggcaagaagtatttaggtcagttaacgtccataccaggatacctgaatccctccagtaggactgaaatcctgcatttcatagacaatgcaaagagagcccaccagcttccgggacacttgactcaggagcacgatgctgtgctcagcctgtctgcgtacaacgtcaagctggcctggagggacggggaggatatcatcctcagggtgcccatccatgacatcgccgccgtctcctatgttcgggatgacgctgcacacctggtggtcctgaagacagcccaggacccagggatctcccccagccagagtctgtgtgcggaaagttccagaggcctcagtgcaggctccctgtcggagagtgcagttgggcccgtggaggcatgctgcctggtcatcctggctgcagagagcaaggtcgctgcggaggagctttgctgtctgctaggccaggtcttccaggttgtttacacggagtccaccatcgactttctggacagagcgatatttgatggggcctctaccccgacccaccacctgtccctgcacagcgatgactcttctacaaaagtggacattaaggagacctacgaggtggaagccagcactttctgcttccctgaatctgtggatgtgggtggtgcatcaccccacagcaagaccatcagtgagagcgagctgagcgccagcgccactgagctgctgcaggactacatgctgacgctgcgcaccaagctgtcatcacaggagatccagcagtttgcagcactgctgcacgagtaccgcaatggggcctctatccacgagttctgcatcaacctgcggcagctctacggggacagccgcaagttcctgctgcttggtctgaggcccttcatccctgagaaggacagccagcacttcgagaacttcctggagaccattggcgtgaaggatggccgcggcatcatcactgacagctttggcaggcaccggcgggccctgagcaccacatccagttccaccaccaatgggaacagggccacgggcagctctgatgaccggtcggcaccctcagagggggatgagtgggaccgcatgatctcggacatcagcagcgacattgaggcgctgggctgcagcatggaccaggactcagcatgatggacagtggatgggggggcacccacaccttccgcgcagtcgtcataggccttcccagaaggagctgcccagacctgcgtgtcagcccttggtggtggccagggagaggcgcccggtgcagatggccccgggcggcccaggtcctctactgtgaaggagcagggagctgccgagggacacgagcctcagtgcggggtggaaggctctttgccttgtccaccagggctcagccaagccctgcagtgtgtccccgctcggggagggcccggccgagcgggcagggagagccagtcctgtcggctgggcccttggacggctgtcagttttgcacatgatgttcctattgtaactctcagagaccttaaaaagaagtttactgcaatgtgaataatttaatctctggttgccaagcaaaaaaaagat

SEQ ID NO: 16994 - DNA, 1657 bp, Homo sapiens
ggcaggctgggaagtcggccgccgtaaagatggcggcaaattgaaaaagttggagctgctcccgcgcgcgctgagtgggcggagcgaacagggggctggacagtatttaggtcagttaacgtccataccaggatacctgaatccctccagtaggactgaaatcctgcatttcatagacaatgcaaagagagcccaccagcttccgggacacttgactcaggagcacgatgctgtgctcagcctgtctgcgtacaacgtcaagctggcctggagggacggggaggatatcatcctcagggtgcccatccatgacatcgccgccgtctcctatgttcgggatgacgctgcacacctggtggtcctgaagacagcccaggacccagggatctcccccagccagagtctgtgtgcggaaagttccagaggcctcagtgcaggctccctgtcggagagtgcagttgggcccgtggaggcatgctgcctggtcatcctggctgcagagagcaaggtcgctgcggaggagctttgctgtctgctaggccaggtcttccaggttgtttacacggagtccaccatcgactttctggacagagcgatatttgatggggcctctaccccgacccaccacctgtccctgcacagcgatgactcttctacaaaagtggacattaaggagacctacgaggtggaagccagcactttctgcttccctgaatctgtggatgtgggtggtgcatcaccccacagcaagaccatcagtgagagcgagctgagcgccagcgccactgagctgctgcaggactacatgctgacgctgcgcaccaagctgtcatcacaggagatccagcagtttgcagcactgctgcacgagtaccgcaatggggcctctatccacgagttctgcatcaacctgcggcagctctacggggacagccgcaagttcctgctgcttggtctgaggcccttcatccctgagaaggacagccagcacttcgagaacttcctggagaccattggcgtgaaggatggccgcggcatcatcactgacagctttggcaggcaccggcgggccctgagcaccacatccagttccaccaccaatgggaacagggccacgggcagctctgatgaccggtcggcaccctcagagggggatgagtgggaccgcatgatctcggacatcagcagcgacattgaggcgctgggctgcagcatggaccaggactcagcatgatggacagtggatgggggggcacccacaccttccgcgcagtcgtcataggccttcccagaaggagctgcccagacctgcgtgtcagcccttggtggtggccagggagaggcgcccggtgcagatggccccgggcggcccaggtcctctactgtgaaggagcagggagctgccgagggacacgagcctcagtgcggggtggaaggctctttgccttgtccaccagggctcagccaagccctgcagtgtgtccccgctcggggagggcccggccgagcgggcagggagagccagtcctgtcggctgggcccttggacggctgtcagttttgcacatgatgttcctattgtaactctcagagaccttaaaaagaagtttactgcaatgtgaataatttaatctctggttgccaagcaaaaaaaagat

SEQ ID NO: 16995 - DNA, 2263 bp, Homo sapiens
tttgaaattaatgtccttctgttgactgcagaatttctgctggaaatgcagggaggctgcttgtggggttcgcgtgctgtgggaagtagggaaaatgagctggtttactttgtgtctttttgtgcatgcagactgtttggattttgccaacagtttctgggtgctgcctgctttttaaacttttaaaaaattgtaaacagcttcagtggctttgcagaaggaagctgtggtttctggtcttcctgttcagtcatgtttttttcagagggagggctaacatctggccatatttttcaacaaattcagaagtgagtagagaatgcatagtagctgtcggcagaggaggaaccagaatctctccaaagaaattcctcaaacagaatttcacacagggtattccatggagaatgagcctggaattgtctcgccatttaaacgagtattcctaaaaggtgaaaagagtagagataagaaagcccatgagaaggtgacagagaggcgccctctgcacactgtggtgttgtcattgcctgagcgcgtcgagccagacagactgctgagcgactatattgagaaggaggtaaagatggagttttgctcttgttgcccaggctggagtataatggcgcagtcttggctcaccacaacctccgcctcccgggttcaagcaattatcctgcctcagcctcctgagtagctgagattacagtatttaggtcagttaacgtccataccaggatacctgaatccctccagtaggactgaaatcctgcatttcatagacaatgcaaagagagcccaccagcttccgggacacttgactcaggagcacgatgctgtgctcagcctgtctgcgtacaacgtcaagctggcctggagggacggggaggatatcatcctcagggtgcccatccatgacatcgccgccgtctcctatgttcgggatgacgctgcacacctggtggtcctgaagacagcccaggacccagggatctcccccagccagagtctgtgtgcggaaagttccagaggcctcagtgcaggctccctgtcggagagtgcagttgggcccgtggaggcatgctgcctggtcatcctggctgcagagagcaaggtcgctgcggaggagctttgctgtctgctaggccaggtcttccaggttgtttacacggagtccaccatcgactttctggacagagcgatatttgatggggcctctaccccgacccaccacctgtccctgcacagcgatgactcttctacaaaagtggacattaaggagacctacgaggtggaagccagcactttctgcttccctgaatctgtggatgtgggtggtgcatcaccccacagcaagaccatcagtgagagcgagctgagcgccagcgccactgagctgctgcaggactacatgctgacgctgcgcaccaagctgtcatcacaggagatccagcagtttgcagcactgctgcacgagtaccgcaatggggcctctatccacgagttctgcatcaacctgcggcagctctacggggacagccgcaagttcctgctgcttggtctgaggcccttcatccctgagaaggacagccagcacttcgagaacttcctggagaccattggcgtgaaggatggccgcggcatcatcactgacagctttggcaggcaccggcgggccctgagcaccacatccagttccaccaccaatgggaacagggccacgggcagctctgatgaccggtcggcaccctcagagggggatgagtgggaccgcatgatctcggacatcagcagcgacattgaggcgctgggctgcagcatggaccaggactcagcatgatggacagtggatgggggggcacccacaccttccgcgcagtcgtcataggccttcccagaaggagctgcccagacctgcgtgtcagcccttggtggtggccagggagaggcgcccggtgcagatggccccgggcggcccaggtcctctactgtgaaggagcagggagctgccgagggacacgagcctcagtgcggggtggaaggctctttgccttgtccaccagggctcagccaagccctgcagtgtgtccccgctcggggagggcccggccgagcgggcagggagagccagtcctgtcggctgggcccttggacggctgtcagttttgcacatgatgttcctattgtaactctcagagaccttaaaaagaagtttactgcaatgtgaataatttaatctctggttgccaagcaaaaaaaagat

SEQ ID NO: 16996 - DNA, 1817 bp, Homo sapiens
ttcgggcccggctggcgggcggcgccgggagcgcgggggcggcgggcccgggtcgagcatgtagcggctgctggcggcggggctcccggggcgggccgggcgggccgcgggagccgcacgcggcgatatggaagaggagggcaagaagggcaagaaggataatttcactggatacagaatcaaatagttccctcctctctcttcttgcttggatggttcctgaagagaaatccagtgtcattcttgttcttgccattttatagtatttaggtcagttaacgtccataccaggatacctgaatccctccagtaggactgaaatcctgcatttcatagacaatgcaaagagagcccaccagcttccgggacacttgactcaggagcacgatgctgtgctcagcctgtctgcgtacaacgtcaagctggcctggagggacggggaggatatcatcctcagggtgcccatccatgacatcgccgccgtctcctatgttcgggatgacgctgcacacctggtggtcctgaagacagcccaggacccagggatctcccccagccagagtctgtgtgcggaaagttccagaggcctcagtgcaggctccctgtcggagagtgcagttgggcccgtggaggcatgctgcctggtcatcctggctgcagagagcaaggtcgctgcggaggagctttgctgtctgctaggccaggtcttccaggttgtttacacggagtccaccatcgactttctggacagagcgatatttgatggggcctctaccccgacccaccacctgtccctgcacagcgatgactcttctacaaaagtggacattaaggagacctacgaggtggaagccagcactttctgcttccctgaatctgtggatgtgggtggtgcatcaccccacagcaagaccatcagtgagagcgagctgagcgccagcgccactgagctgctgcaggactacatgctgacgctgcgcaccaagctgtcatcacaggagatccagcagtttgcagcactgctgcacgagtaccgcaatggggcctctatccacgagttctgcatcaacctgcggcagctctacggggacagccgcaagttcctgctgcttggtctgaggcccttcatccctgagaaggacagccagcacttcgagaacttcctggagaccattggcgtgaaggatggccgcggcatcatcactgacagctttggcaggcaccggcgggccctgagcaccacatccagttccaccaccaatgggaacagggccacgggcagctctgatgaccggtcggcaccctcagagggggatgagtgggaccgcatgatctcggacatcagcagcgacattgaggcgctgggctgcagcatggaccaggactcagcatgatggacagtggatgggggggcacccacaccttccgcgcagtcgtcataggccttcccagaaggagctgcccagacctgcgtgtcagcccttggtggtggccagggagaggcgcccggtgcagatggccccgggcggcccaggtcctctactgtgaaggagcagggagctgccgagggacacgagcctcagtgcggggtggaaggctctttgccttgtccaccagggctcagccaagccctgcagtgtgtccccgctcggggagggcccggccgagcgggcagggagagccagtcctgtcggctgggcccttggacggctgtcagttttgcacatgatgttcctattgtaactctcagagaccttaaaaagaagtttactgcaatgtgaataatttaatctctggttgccaagcaaaaaaaagat

SEQ ID NO: 16997 - DNA, 1617 bp, Homo sapiens
ttcgggcccggctggcgggcggcgccgggagcgcgggggcggcgggcccgggtcgagcatgtagcggctgctggcggcggggctcccggggcgggccgggcgggccgcgggagccgcacgcggcgatatggaagaggagggcaagaagggcaagaagcctggaattgtctcgccatttaaacgagtattcctaaaaggtgaaaagagtagagataagaaagcccatgagaaggtgacagagaggcgccctctgcacactgtggtgttgtcattgcctgagcgcgtcgagccagacagactgctgagcgactatattgagaaggaggtaaagcccaggacccagggatctcccccagccagagtctgtgtgcggaaagttccagaggcctcagtgcaggctccctgtcggagagtgcagttgggcccgtggaggcatgctgcctggtcatcctggctgcagagagcaaggtcgctgcggaggagctttgctgtctgctaggccaggtcttccaggttgtttacacggagtccaccatcgactttctggacagagcgatatttgatggggcctctaccccgacccaccacctgtccctgcacagcgatgactcttctacaaaagtggacattaaggagacctacgaggtggaagccagcactttctgcttccctgaatctgtggatgtgggtggtgcatcaccccacagcaagaccatcagtgagagcgagctgagcgccagcgccactgagctgctgcaggactacatgctgacgctgcgcaccaagctgtcatcacaggagatccagcagtttgcagcactgctgcacgagtaccgcaatggggcctctatccacgagttctgcatcaacctgcggcagctctacggggacagccgcaagttcctgctgcttggtctgaggcccttcatccctgagaaggacagccagcacttcgagaacttcctggagaccattggcgtgaaggatggccgcggcatcatcactgacagctttggcaggcaccggcgggccctgagcaccacatccagttccaccaccaatgggaacagggccacgggcagctctgatgaccggtcggcaccctcagagggggatgagtgggaccgcatgatctcggacatcagcagcgacattgaggcgctgggctgcagcatggaccaggactcagcatgatggacagtggatgggggggcacccacaccttccgcgcagtcgtcataggccttcccagaaggagctgcccagacctgcgtgtcagcccttggtggtggccagggagaggcgcccggtgcagatggccccgggcggcccaggtcctctactgtgaaggagcagggagctgccgagggacacgagcctcagtgcggggtggaaggctctttgccttgtccaccagggctcagccaagccctgcagtgtgtccccgctcggggagggcccggccgagcgggcagggagagccagtcctgtcggctgggcccttggacggctgtcagttttgcacatgatgttcctattgtaactctcagagaccttaaaaagaagtttactgcaatgtgaataatttaatctctggttgccaagcaaaaaaaagat

SEQ ID NO: 16998 - DNA, 1574 bp, Homo sapiens
ttcgggcccggctggcgggcggcgccgggagcgcgggggcggcgggcccgggtcgagcatgtagcggctgctggcggcggggctcccggggcgggccgggcgggccgcgggagccgcacgcggcgatatggaagaggagggcaagaagggcaagaagtatttaggtcagttaacgtccataccaggatacctgaatccctccagtaggactgaaatcctgcatttcatagacaatgcaaagagagcccaccagcttccgggacacttgactcaggagcacgatgctgtgctcagcctgtctgcgtacaacgtcaagctggcctggagggacggggaggatatcatcctcagggtgcccatccatgacatcgccgccgtctcctatgttcgggatgacgctgcacacctggtggtcctgaagacaggtcgctgcggaggagctttgctgtctgctaggccaggtcttccaggttgtttacacggagtccaccatcgactttctggacagagcgatatttgatggggcctctaccccgacccaccacctgtccctgcacagcgatgactcttctacaaaagtggacattaaggagacctacgaggtggaagccagcactttctgcttccctgaatctgtggatgtgggtggtgcatcaccccacagcaagaccatcagtgagagcgagctgagcgccagcgccactgagctgctgcaggactacatgctgacgctgcgcaccaagctgtcatcacaggagatccagcagtttgcagcactgctgcacgagtaccgcaatggggcctctatccacgagttctgcatcaacctgcggcagctctacggggacagccgcaagttcctgctgcttggtctgaggcccttcatccctgagaaggacagccagcacttcgagaacttcctggagaccattggcgtgaaggatggccgcggcatcatcactgacagctttggcaggcaccggcgggccctgagcaccacatccagttccaccaccaatgggaacagggccacgggcagctctgatgaccggtcggcaccctcagagggggatgagtgggaccgcatgatctcggacatcagcagcgacattgaggcgctgggctgcagcatggaccaggactcagcatgatggacagtggatgggggggcacccacaccttccgcgcagtcgtcataggccttcccagaaggagctgcccagacctgcgtgtcagcccttggtggtggccagggagaggcgcccggtgcagatggccccgggcggcccaggtcctctactgtgaaggagcagggagctgccgagggacacgagcctcagtgcggggtggaaggctctttgccttgtccaccagggctcagccaagccctgcagtgtgtccccgctcggggagggcccggccgagcgggcagggagagccagtcctgtcggctgggcccttggacggctgtcagttttgcacatgatgttcctattgtaactctcagagaccttaaaaagaagtttactgcaatgtgaataatttaatctctggttgccaagcaaaaaaaagat

SEQ ID NO: 16999 - DNA, 1480 bp, Homo sapiens
ttcgggcccggctggcgggcggcgccgggagcgcgggggcggcgggcccgggtcgagcatgtagcggctgctggcggcggggctcccggggcgggccgggcgggccgcgggagccgcacgcggcgatatggaagaggagggcaagaagggcaagaagcctggaattgtctcgccatttaaacgagtattcctaaaaggtgaaaagagtagagataagaaagcccatgagaaggtgacagagaggcgccctctgcacactgtggtgttgtcattgcctgagcgcgtcgagccagacagactgctgagcgactatattgagaaggaggtaaaggtcgctgcggaggagctttgctgtctgctaggccaggtcttccaggttgtttacacggagtccaccatcgactttctggacagagcgatatttgatggggcctctaccccgacccaccacctgtccctgcacagcgatgactcttctacaaaagtggacattaaggagacctacgaggtggaagccagcactttctgcttccctgaatctgtggatgtgggtggtgcatcaccccacagcaagaccatcagtgagagcgagctgagcgccagcgccactgagctgctgcaggactacatgctgacgctgcgcaccaagctgtcatcacaggagatccagcagtttgcagcactgctgcacgagtaccgcaatggggcctctatccacgagttctgcatcaacctgcggcagctctacggggacagccgcaagttcctgctgcttggtctgaggcccttcatccctgagaaggacagccagcacttcgagaacttcctggagaccattggcgtgaaggatggccgcggcatcatcactgacagctttggcaggcaccggcgggccctgagcaccacatccagttccaccaccaatgggaacagggccacgggcagctctgatgaccggtcggcaccctcagagggggatgagtgggaccgcatgatctcggacatcagcagcgacattgaggcgctgggctgcagcatggaccaggactcagcatgatggacagtggatgggggggcacccacaccttccgcgcagtcgtcataggccttcccagaaggagctgcccagacctgcgtgtcagcccttggtggtggccagggagaggcgcccggtgcagatggccccgggcggcccaggtcctctactgtgaaggagcagggagctgccgagggacacgagcctcagtgcggggtggaaggctctttgccttgtccaccagggctcagccaagccctgcagtgtgtccccgctcggggagggcccggccgagcgggcagggagagccagtcctgtcggctgggcccttggacggctgtcagttttgcacatgatgttcctattgtaactctcagagaccttaaaaagaagtttactgcaatgtgaataatttaatctctggttgccaagcaaaaaaaagat

SEQ ID NO: 17000 - DNA, 1612 bp, Homo sapiens
ttcgggcccggctggcgggcggcgccgggagcgcgggggcggcgggcccgggtcgagcatgtagcggctgctggcggcggggctcccggggcgggccgggcgggccgcgggagccgcacgcggcgatatggaagaggagggcaagaagggcaagaagcctggaattgtctcgccatttaaacgagtattcctaaaaggtgaaaagagtagagataagaaagcccatgagaaggtgacagagaggcgccctctgcacactgtggtgttgtcattgcctgagcgcgtcgagccagacagactgctgagcgactatattgagaaggaggtaaagtatttaggtcagttaacgtccataccaggatacctgaatccctccagtaggactgaaatcctgcatttcatagacaatgcaaagagagcccaccagcttccgggacacttgactcaggagcacgatgctgtgctcagcctgtctgcgtacaacgtcaagctggcctggagggacggggaggatatcatcctcagggtgcccatccatgacatcgccgccgtctcctatgttcgggatgacgctgcacacctggtggtcctgaagacagatgactcttctacaaaagtggacattaaggagacctacgaggtggaagccagcactttctgcttccctgaatctgtggatgtgggtggtgcatcaccccacagcaagaccatcagtgagagcgagctgagcgccagcgccactgagctgctgcaggactacatgctgacgctgcgcaccaagctgtcatcacaggagatccagcagtttgcagcactgctgcacgagtaccgcaatggggcctctatccacgagttctgcatcaacctgcggcagctctacggggacagccgcaagttcctgctgcttggtctgaggcccttcatccctgagaaggacagccagcacttcgagaacttcctggagaccattggcgtgaaggatggccgcggcatcatcactgacagctttggcaggcaccggcgggccctgagcaccacatccagttccaccaccaatgggaacagggccacgggcagctctgatgaccggtcggcaccctcagagggggatgagtgggaccgcatgatctcggacatcagcagcgacattgaggcgctgggctgcagcatggaccaggactcagcatgatggacagtggatgggggggcacccacaccttccgcgcagtcgtcataggccttcccagaaggagctgcccagacctgcgtgtcagcccttggtggtggccagggagaggcgcccggtgcagatggccccgggcggcccaggtcctctactgtgaaggagcagggagctgccgagggacacgagcctcagtgcggggtggaaggctctttgccttgtccaccagggctcagccaagccctgcagtgtgtccccgctcggggagggcccggccgagcgggcagggagagccagtcctgtcggctgggcccttggacggctgtcagttttgcacatgatgttcctattgtaactctcagagaccttaaaaagaagtttactgcaatgtgaataatttaatctctggttgccaagcaaaaaaaagat

SEQ ID NO: 17001 - DNA, 2687 bp, Homo sapiens
ttcgggcccggctggcgggcggcgccgggagcgcgggggcggcgggcccgggtcgagcatgtagcggctgctggcggcggggctcccggggcgggccgggcgggccgcgggagccgcacgcggcgatatggaagaggagggcaagaagggcaagaagtatttaggtcagttaacgtccataccaggatacctgaatccctccagtaggactgaaatcctgcatttcatagacaatgcaaagagagcccaccagcttccgggacacttgactcaggagcacgatgctgtgctcagcctgtctgcgtacaacgtcaagctggcctggagggacggggaggatatcatcctcagggtgcccatccatgacatcgccgccgtctcctatgttcgggatgacgctgcacacctggtggtcctgaagacagcccaggacccagggatctcccccagccagagtctgtgtgcggaaagttccagaggcctcagtgcaggctccctgtcggagagtgcagttgggcccgtggaggcatgctgcctggtcatcctggctgcagagagcaaggtcgctgcggaggagctttgctgtctgctaggccaggtcttccaggttgtttacacggagtccaccatcgactttctggacagagcgatatttgatggggcctctaccccgacccaccacctgtccctgcacagcgccagccacgtgacctcttccacagtcacatcttcctttgactgtcagcttcctctgcatttcaggactcttgcaatcacattgagcccacccaaattctccagggtcatctccctatttcaaggtcagctgattagcatcctttactcccctttgaaattggtaacatattcaccaattccagggattaggatgtggacgtctttggggggtcattattctgccctccatacttaccttgttcctagtgccagaaatgtcccttttatctctcagcctctccctctgcttcatttaaaatcttaccctctctgcaacactcacctgcctcgctcacaaagctttcactcactgtctgtgctggggtgaaatgtgccttcctcaggtttgaaatagcaaattacagtctgtgtcacacggacctaatgtcatttgttgaatgtagctgctcagtgccagaccctttgctggtctgagggtcttgggaatcctgtggcttcactgggttcagatggggagtcagactgcccggctctgactgtggtttctgctgtgtgacctgggccaagttgtgtaactctctgacttacttcctaatctacaagtgaagacaggggtgatatatgcctgggttaaaggagacaaagccccagtaaccctgcctggcacatgagtgatacctcaaagacagcttttgctggctctggccatgggtgaatgtggacttcagaccagcgtgcagcaggatttgcatttgccaggatccccaggaggggtgtatgtgggctcaagtctgggaagccctgccctgaggcacacagcacattccagagtgcgggcagcttgatgaaggacagcagggtccctgaagaccagggctgccgctgtctcctgtaaatacagcagtgggctggactcaaaatgcctccccactatgtccctgaaagtcatcttagttttctgcatcttccttacagatgactcttctacaaaagtggacattaaggagacctacgaggtggaagccagcactttctgcttccctgaatctgtggatgtgggtggtgcatcaccccacagcaagaccatcagtgagagcgagctgagcgccagcgccactgagctgctgcaggactacatgctgacgctgcgcaccaagctgtcatcacaggagatccagcagtttgcagcactgctgcacgagtaccgcaatggggcctctatccacgagttctgcatcaacctgcggcagctctacggggacagccgcaagttcctgctgcttggtctgaggcccttcatccctgagaaggacagccagcacttcgagaacttcctggagaccattggcgtgaaggatggccgcggcatcatcactgacagctttggcaggcaccggcgggccctgagcaccacatccagttccaccaccaatgggaacagggccacgggcagctctgatgaccggtcggcaccctcagagggggatgagtgggaccgcatgatctcggacatcagcagcgacattgaggcgctgggctgcagcatggaccaggactcagcatgatggacagtggatgggggggcacccacaccttccgcgcagtcgtcataggccttcccagaaggagctgcccagacctgcgtgtcagcccttggtggtggccagggagaggcgcccggtgcagatggccccgggcggcccaggtcctctactgtgaaggagcagggagctgccgagggacacgagcctcagtgcggggtggaaggctctttgccttgtccaccagggctcagccaagccctgcagtgtgtccccgctcggggagggcccggccgagcgggcagggagagccagtcctgtcggctgggcccttggacggctgtcagttttgcacatgatgttcctattgtaactctcagagaccttaaaaagaagtttactgcaatgtgaataatttaatctctggttgccaagcaaaaaaaagat

SEQ ID NO: 17002 - DNA, 2447 bp, Homo sapiens
taataattttttttttactgagaagtacacaagtcatacatgtacagttgaatgaattttcataaagtaaacacatcatgtaacaccactactgggggttgctgaagtgggcttcttcccctgccagcctttcccaagacctccccgtgggatccacacacagatgtgcacacgttacgcacatgcatgcattctctgcttatttctgccttggagttttgcttgctgtgttctctctactacagctatgccaaaacatagcagcataaacagcagaaatatattctcttataattctatacgttaagagtccattgtgggtcccactgggctaaagttgaggtgtccacagggctggttccttctggaggctccagagaagaagccatttccttgtctttccagctcctaaaggcggctgcatgccttggctcatggcccttcctctgtcttcacagccagccacgtgacctcttccacagtcacatcttcctttgactgtcagcttcctctgcatttcaggactcttgcaatcacattgagcccacccaaattctccagggtcatctccctatttcaaggtcagctgattagcatcctttactcccctttgaaattggtaacatattcaccaattccagggattaggatgtggacgtctttggggggtcattattctgccctccatacttaccttgttcctagtgccagaaatgtcccttttatctctcagcctctccctctgcttcatttaaaatcttaccctctctgcaacactcacctgcctcgctcacaaagctttcactcactgtctgtgctggggtgaaatgtgccttcctcaggtttgaaatagcaaattacagtctgtgtcacacggacctaatgtcatttgttgaatgtagctgctcagtgccagaccctttgctggtctgagggtcttgggaatcctgtggcttcactgggttcagatggggagtcagactgcccggctctgactgtggtttctgctgtgtgacctgggccaagttgtgtaactctctgacttacttcctaatctacaagtgaagacaggggtgatatatgcctgggttaaaggagacaaagccccagtaaccctgcctggcacatgagtgatacctcaaagacagcttttgctggctctggccatgggtgaatgtggacttcagaccagcgtgcagcaggatttgcatttgccaggatccccaggaggggtgtatgtgggctcaagtctgggaagccctgccctgaggcacacagcacattccagagtgcgggcagcttgatgaaggacagcagggtccctgaagaccagggctgccgctgtctcctgtaaatacagcagtgggctggactcaaaatgcctccccactatgtccctgaaagtcatcttagttttctgcatcttccttacagatgactcttctacaaaagtggacattaaggagacctacgaggtggaagccagcactttctgcttccctgaatctgtggatgtgggtggtgcatcaccccacagcaagaccatcagtgagagcgagctgagcgccagcgccactgagctgctgcaggactacatgctgacgctgcgcaccaagctgtcatcacaggagatccagcagtttgcagcactgctgcacgagtaccgcaatggggcctctatccacgagttctgcatcaacctgcggcagctctacggggacagccgcaagttcctgctgcttggtctgaggcccttcatccctgagaaggacagccagcacttcgagaacttcctggagaccattggcgtgaaggatggccgcggcatcatcactgacagctttggcaggcaccggcgggccctgagcaccacatccagttccaccaccaatgggaacagggccacgggcagctctgatgaccggtcggcaccctcagagggggatgagtgggaccgcatgatctcggacatcagcagcgacattgaggcgctgggctgcagcatggaccaggactcagcatgatggacagtggatgggggggcacccacaccttccgcgcagtcgtcataggccttcccagaaggagctgcccagacctgcgtgtcagcccttggtggtggccagggagaggcgcccggtgcagatggccccgggcggcccaggtcctctactgtgaaggagcagggagctgccgagggacacgagcctcagtgcggggtggaaggctctttgccttgtccaccagggctcagccaagccctgcagtgtgtccccgctcggggagggcccggccgagcgggcagggagagccagtcctgtcggctgggcccttggacggctgtcagttttgcacatgatgttcctattgtaactctcagagaccttaaaaagaagtttactgcaatgtgaataatttaatctctggttgccaagcaaaaaaaagat

SEQ ID NO: 17003 - DNA, 1480 bp, Homo sapiens
ttcgggcccggctggcgggcggcgccgggagcgcgggggcggcgggcccgggtcgagcatgtagcggctgctggcggcggggctcccggggcgggccgggcgggccgcgggagccgcacgcggcgatatggaagaggagggcaagaagggcaagaagcctggaattgtctcgccatttaaacgagtattcctaaaaggtgaaaagagtagagataagaaagcccatgagaaggtgacagagaggcgccctctgcacactgtggtgttgtcattgcctgagcgcgtcgagccagacagactgctgagcgactatattgagaaggaggtaaagtatttaggtcagttaacgtccataccaggatacctgaatccctccagtaggactgaaatcctgcatttcatagacaatgcaaagagagcccaccagcttccgggacacttgactcaggagcacgatgctgtgctcagcctgtctgcgtacaacgtcaagctggcctggagggacggggaggatatcatcctcagggtgcccatccatgacatcgccgccgtctcctatgttcgggatgacgctgcacacctggtggtcctgaagacagcccaggacccagggatctcccccagccagagtctgtgtgcggaaagttccagaggcctcagtgcaggctccctgtcggagagtgcagttgggcccgtggaggcatgctgcctggtcatcctggctgcagagagcaaggtcgctgcggaggagctttgctgtctgctaggccaggtcttccaggttgtttacacggagtccaccatcgactttctggacagagcgatatttgatggggcctctaccccgacccaccacctgtccctgcacagcgatgactcttctacaaaagtggacattaaggagacctacgaggtggaagccagcactttctgcttccctgaatctgtggatgtgggtggtgcatcaccccacagcaagaccatcagtgagagcgagctgagcgccagcgccactgagctgctgcaggactacatgctgacgctgcgcaccaagctgtcatcacaggagatccagcagtttgcagcactgctgcacgagtaccgcaatggggcctctatccacgagttctgcatcaacctgcggcagctctacggggacagccgcaagttcctgctgcttggtctgaggcccttcatccctgagaaggacagccagcacttcgagaacttcctggagaccattggcgtgaaggatggccgcggcatcatcactgacagctttggcagccaagccctgcagtgtgtccccgctcggggagggcccggccgagcgggcagggagagccagtcctgtcggctgggcccttggacggctgtcagttttgcacatgatgttcctattgtaactctcagagaccttaaaaagaagtttactgcaatgtgaataatttaatctctggttgccaagcaaaaaaaagat

SEQ ID NO: 17004 - DNA, 1390 bp, Homo sapiens
ttcgggcccggctggcgggcggcgccgggagcgcgggggcggcgggcccgggtcgagcatgtagcggctgctggcggcggggctcccggggcgggccgggcgggccgcgggagccgcacgcggcgatatggaagaggagggcaagaagggcaagaagcctggaattgtctcgccatttaaacgagtattcctaaaaggtgaaaagagtagagataagaaagcccatgagaaggtgacagagaggcgccctctgcacactgtggtgttgtcattgcctgagcgcgtcgagccagacagactgctgagcgactatattgagaaggaggtaaagtatttaggtcagttaacgtccataccaggatacctgaatccctccagtaggactgaaatcctgcatttcatagacaatgcaaagagagcccaccagcttccgggacacttgactcaggagcacgatgctgtgctcagcctgtctgcgtacaacgtcaagctggcctggagggacggggaggatatcatcctcagggtgcccatccatgacatcgccgccgtctcctatgttcgggatgacgctgcacacctggtggtcctgaagacagcccaggacccagggatctcccccagccagagtctgtgtgcggaaagttccagaggcctcagtgcaggctccctgtcggagagtgcagttgggcccgtggaggcatgctgcctggtcatcctggctgcagagagcaaggtcgctgcggaggagctttgctgtctgctaggccaggtcttccaggttgtttacacggagtccaccatcgactttctggacagagcgatatttgatggggcctctaccccgacccaccacctgtccctgcacagcgatgactcttctacaaaagtggacattaaggagacctacgaggtggaagccagcactttctgcttccctgaatctgtggatgtgggtggtgcatcaccccacatggatgggggggcacccacaccttccgcgcagtcgtcataggccttcccagaaggagctgcccagacctgcgtgtcagcccttggtggtggccagggagaggcgcccggtgcagatggccccgggcggcccaggtcctctactgtgaaggagcagggagctgccgagggacacgagcctcagtgcggggtggaaggctctttgccttgtccaccagggctcagccaagccctgcagtgtgtccccgctcggggagggcccggccgagcgggcagggagagccagtcctgtcggctgggcccttggacggctgtcagttttgcacatgatgttcctattgtaactctcagagaccttaaaaagaagtttactgcaatgtgaataatttaatctctggttgccaagcaaaaaaaagat

SEQ ID NO: 17005 - DNA, 1772 bp, Homo sapiens
tttgaaattaatgtccttctgttgactgcagaatttctgctggaaatgcagggaggctgcttgtggggttcgcgtgctgtgggaagtagggaaaatgagctggtttactttgtgtctttttgtgcatgcagactgtttggattttgccaacagtttctgggtgctgcctgctttttaaacttttaaaaaattgtaaacagcttcagtggctttgcagaaggaagctgtggtttctggtcttcctgttcagtcatgtttttttcagagggagggctaacatctggccatatttttcaacaaattcagaagtgagtagagaatgcatagtagctgtcggcagaggaggaaccagaatctctccaaagaaattcctcaaacagaatttcacacagggtattccatggagaatgagtatttaggtcagttaacgtccataccaggatacctgaatccctccagtaggactgaaatcctgcatttcatagacaatgcaaagagagcccaccagcttccgggacacttgactcaggagcacgatgctgtgctcagcctgtctgcgtacaacgtcaagctggcctggagggacggggaggatatcatcctcagggtgcccatccatgacatcgccgccgtctcctatgttcgggatgacgctgcacacctggtggtcctgaagacagcccaggacccagggatctcccccagccagagtctgtgtgcggaaagttccagaggcctcagtgcaggctccctgtcggagagtgcagttgggcccgtggaggcatgctgcctggtcatcctggctgcagagagcaagctgcttccctgaatctgtggatgtgggtggtgcatcaccccacagcaagaccatcagtgagagcgagctgagcgccagcgccactgagctgctgcaggactacatgctgacgctgcgcaccaagctgtcatcacaggagatccagcagtttgcagcactgctgcacgagtaccgcaatggggcctctatccacgagttctgcatcaacctgcggcagctctacggggacagccgcaagttcctgctgcttggtctgaggcccttcatccctgagaaggacagccagcacttcgagaacttcctggagaccattggcgtgaaggatggccgcggcatcatcactgacagctttggcaggcaccggcgggccctgagcaccacatccagttccaccaccaatgggaacagggccacgggcagctctgatgaccggtcggcaccctcagagggggatgagtgggaccgcatgatctcggacatcagcagcgacattgaggcgctgggctgcagcatggaccaggactcagcatgatggacagtggatgggggggcacccacaccttccgcgcagtcgtcataggccttcccagaaggagctgcccagacctgcgtgtcagcccttggtggtggccagggagaggcgcccggtgcagatggccccgggcggcccaggtcctctactgtgaaggagcagggagctgccgagggacacgagcctcagtgcggggtggaaggctctttgccttgtccaccagggctcagccaagccctgcagtgtgtccccgctcggggagggcccggccgagcgggcagggagagccagtcctgtcggctgggcccttggacggctgtcagttttgcacatgatgttcctattgtaactctcagagaccttaaaaagaagtttactgcaatgtgaataatttaatctctggttgccaagcaaaaaaaagat

SEQ ID NO: 17006 - DNA, 1638 bp, Homo sapiens
aaactcatgagtcctggaggcaggtagaggcacttgtaggctgaggacccgtagagcccggtgtgccctgcccaagccccacctgggaatggagttatctctgtaaagatcttgctgcctttgagcaagcactgcaaatgggtatttaggtcagttaacgtccataccaggatacctgaatccctccagtaggactgaaatcctgcatttcatagacaatgcaaagagagcccaccagcttccgggacacttgactcaggagcacgatgctgtgctcagcctgtctgcgtacaacgtcaagctggcctggagggacggggaggatatcatcctcagggtgcccatccatgacatcgccgccgtctcctatgttcgggatgacgctgcacacctggtggtcctgaagacagcccaggacccagggatctcccccagccagagtctgtgtgcggaaagttccagaggcctcagtgcaggctccctgtcggagagtgcagttgggcccgtggaggcatgctgcctggtcatcctggctgcagagagcaaggtcgctgcggaggagctttgctgtctgctaggccaggtcttccaggttgtttacacggagtccaccatcgactttctggacagagcgatatttgatggggcctctaccccgacccaccacctgtccctgcacagcgctgcttccctgaatctgtggatgtgggtggtgcatcaccccacagcaagaccatcagtgagagcgagctgagcgccagcgccactgagctgctgcaggactacatgctgacgctgcgcaccaagctgtcatcacaggagatccagcagtttgcagcactgctgcacgagtaccgcaatggggcctctatccacgagttctgcatcaacctgcggcagctctacggggacagccgcaagttcctgctgcttggtctgaggcccttcatccctgagaaggacagccagcacttcgagaacttcctggagaccattggcgtgaaggatggccgcggcatcatcactgacagctttggcaggcaccggcgggccctgagcaccacatccagttccaccaccaatgggaacagggccacgggcagctctgatgaccggtcggcaccctcagagggggatgagtgggaccgcatgatctcggacatcagcagcgacattgaggcgctgggctgcagcatggaccaggactcagcatgatggacagtggatgggggggcacccacaccttccgcgcagtcgtcataggccttcccagaaggagctgcccagacctgcgtgtcagcccttggtggtggccagggagaggcgcccggtgcagatggccccgggcggcccaggtcctctactgtgaaggagcagggagctgccgagggacacgagcctcagtgcggggtggaaggctctttgccttgtccaccagggctcagccaagccctgcagtgtgtccccgctcggggagggcccggccgagcgggcagggagagccagtcctgtcggctgggcccttggacggctgtcagttttgcacatgatgttcctattgtaactctcagagaccttaaaaagaagtttactgcaatgtgaataatttaatctctggttgccaagcaaaaaaaagat

SEQ ID NO: 17007 - DNA, 1342 bp, Homo sapiens
ttcgggcccggctggcgggcggcgccgggagcgcgggggcggcgggcccgggtcgagcatgtagcggctgctggcggcggggctcccggggcgggccgggcgggccgcgggagccgcacgcggcgatatggaagaggagggcaagaagggcaagaagcctggaattgtctcgccatttaaacgagtattcctaaaaggtgaaaagagtagagataagaaagcccatgagaaggtgacagagaggcgccctctgcacactgtggtgttgtcattgcctgagcgcgtcgagccagacagactgctgagcgactatattgagaaggaggtaaagtatttaggtcagttaacgtccataccaggatacctgaatccctccagtaggactgaaatcctgcatttcatagacaatgcaaagagagcccaccagcttccgggacacttgactcaggagcacgatgctgtgctcagcctgtctgcgtacaacgtcaagctggcctggagggacggggaggatatcatcctcagggtgcccatccatgacatcgccgccgtctcctatgttcgggatgacgctgcacacctggtggtcctgaagacagcccaggacccagggatctcccccagccagagtctgtgtgcggaaagttccagaggcctcagtgcaggctccctgtcggagagtgcagttgggcccgtggaggcatgctgcctggtcatcctggctgcagagagcaaggtcgctgcggaggagctttgctgtctgctaggccaggtcttccaggttgtttacacggagtccaccatcgactttctggacagagcgatatttgatggggcctctaccccgacccaccacctgtccctgcacagcgatgactcttctacaaaagtggacattaaggagacctacgaggtggaagccagcactttgtgagtgcacatgccaccaagccctgcggtgggacacgcaccaaatgcgttgtctggtgttgtccaggctgcagccagtcagctcccccatctcagctcaccctcgctaagccatccccagacccactgtacccagcttagtgaatggctgaggcctggctcgccgccctctcctcgtagacttctagagcccttgctgtccctcttgtctctccctgcctaccttcccatggcctcccaagagtgagcttgtaataggcatgttggatggagctgttcccctgcccgagcctgccgaggcgctggccttccagcccatctctgccaccacctggggctctgtagtagttcacccactcgcgctctccattcctgccacctccccaaccctggctccttcccctgcccaaca

SEQ ID NO: 17008 - DNA, 2318 bp, Homo sapiens
ttcgggcccggctggcgggcggcgccgggagcgcgggggcggcgggcccgggtcgagcatgtagcggctgctggcggcggggctcccggggcgggccgggcgggccgcgggagccgcacgcggcgatatggaagaggagggcaagaagggcaagaagcctggaattgtctcgccatttaaacgagtattcctaaaaggtgaaaagagtagagataagaaagcccatgagaaggtgacagagaggcgccctctgcacactgtggtgttgtcattgcctgagcgcgtcgagccagacagactgctgagcgactatattgagaaggaggtaaagtatttaggtcagttaacgtccataccaggatacctgaatccctccagtaggactgaaatcctgcatttcatagacaatgcaaagagagcccaccagcttccgggacacttgactcaggagcacgatgctgtgctcagcctgtctgcgtacaacgtcaagctggcctggagggacggggaggatatcatcctcagggtgcccatccatgacatcgccgccgtctcctatgttcgggatgacgctgcacacctggtggtcctgaagacagcccaggacccagggatctcccccagccagagtctgtgtgcggaaagttccagaggcctcagtgcaggctccctgtcggagagtgcagttgggcccgtggaggcatgctgcctggtcatcctggctgcagagagcaaggtcgctgcggaggagctttgctgtctgctaggccaggtcttccaggttgtttacacggagtccaccatcgactttctggacagagcgatatttgatggggcctctaccccgacccaccacctgtccctgcacagcgccagccacgtgacctcttccacagtcacatcttcctttgactgtcagcttcctctgcatttcaggactcttgcaatcacattgagcccacccaaattctccagggtcatctccctatttcaaggtcagctgattagcatcctttactcccctttgaaattggtaacatattcaccaattccagggattaggatgtggacgtctttggggggtcattattctgccctccatacttaccttgttcctagtgccagaaatgtcccttttatctctcagcctctccctctgcttcatttaaaatcttaccctctctgcaacactcacctgcctcgctcacaaagctttcactcactgtctgtgctggggtgaaatgtgccttcctcaggtttgaaatagcaaattacagtctgtgtcacacggacctaatgtcatttgttgaatgtagctgctcagtgccagaccctttgctggtctgagggtcttgggaatcctgtggcttcactgggttcagatggggagtcagactgcccggctctgactgtggtttctgctgtgtgacctgggccaagttgtgtaactctctgacttacttcctaatctacaagtgaagacaggggtgatatatgcctgggttaaaggagacaaagccccagtaaccctgcctggcacatgagtgatacctcaaagacagcttttgctggctctggccatgggtgaatgtggacttcagaccagcgtgcagcaggatttgcatttgccaggatccccaggaggggtgtatgtgggctcaagtctgggaagccctgccctgaggcacacagcacattccagagtgcgggcagcttgatgaaggacagcagggtccctgaagaccagggctgccgctgtctcctgtaaatacagcagtgggctggactcaaaatgcctccccactatgtccctgaaagtcatcttagttttctgcatcttccttacagatgactcttctacaaaagtggacattaaggagacctacgaggtggaagccagcactttgtgagtgcacatgccaccaagccctgcggtgggacacgcaccaaatgcgttgtctggtgttgtccaggctgcagccagtcagctcccccatctcagctcaccctcgctaagccatccccagacccactgtacccagcttagtgaatggctgaggcctggctcgccgccctctcctcgtagacttctagagcccttgctgtccctcttgtctctccctgcctaccttcccatggcctcccaagagtgagcttgtaataggcatgttggatggagctgttcccctgcccgagcctgccgaggcgctggccttccagcccatctctgccaccacctggggctctgtagtagttcacccactcgcgctctccattcctgccacctccccaaccctggctccttcccctgcccaaca

SEQ ID NO: 17009 - DNA, 429 bp, Homo sapiens
tatacgtatgcatttctgttgggtgtatacctaggagtgaagttgctggaatacatgtattctgccttattggtgaacaccaaataattttccaaagtagttgtgctagtttacacataacgtgtggttttaatgtgcatttcctacatttattgcattttggctactagaaattaattctctcagtgattgcagcttaatttttaaattaataagagagctgccataaggattttcctatactgcattttttgctagggaagaggacataggtcaagtgggttgccctgacaactgtaattcttggggacttatttacaaaggggtacctgaccacaaggcctcttggccatggtcaggcaaaccaaaggctaggtcatctaaaagtgaatttactttacataaatatatttaacccaatggtgtttt

SEQ ID NO: 17010 - DNA, 387 bp, Homo sapiens
gtaagctggatatttaaagggattgcagtctttgctgatgagactaagcatatgacgacaggaatgagtgtgagagagaacctcaagaaactgaaaggccagactctcagagggtgaatattgaagtcaccaagaattatgacagaagtgtgagtgcctgggtttgaatcctgatactatgtacttaccaggtatatgtccttgggcaagttatataaccttagtttcctcatcagttaaaatgaggataatgatagtatagttctctgaattatcaggagtaaacaatttaatacttatgaaactcttagtatgtggtatatggcaaatgacatataaatgtttataatattatcagaatcataataaccattattatttgtatga

SEQ ID NO: 17011 - DNA, 435 bp, Homo sapiens
gtttaaaaaccaggatgggcatggtggctcacacctgtaatctcagcactttggcaggctgaggtgggcggatcacctgaggtcaggagttccagaccagtctgggcagcatggtaaaatcccatctctactaaaaatacaaaaattagctgggcgtggtggcggacctctgtaatctgagctactcgggagactgaggcaggagaatcttttgaactcgggaggcggaggttgcagtgagctgagatcgcgccactgcactccagcctgggcaacagagtgagacttcatctcaaacaaacaaacaaacaaacatgacttcaagtaataatagcactttctgtgttccttcctagcactttgattaaatgtgtcgtttaatctgtacaacatccctgcaagtagcaatttttttttttttttgtagttggcaca

SEQ ID NO: 17012 - DNA, 401 bp, Homo sapiens
accgggtttggagtctataaagtgcaacctcctgcttcctcatagattcagtcttctcactgtaaccctacgcggtggaagggcctcttttataaaggcactgaatctcattcatgagggctccgccctggtggtctaatcacctctactttaaatactatcacctcaggggtgaggatttcaacattggaattttgggggtcgtaacattcagaccgttatcagggctgtgacagagctgatgacacggcttggtgagctacgtatggatttattaagaagacagtgaagctgaaggttcagggcccctcacttgctggagcccctccccaggccctaggagggaccctagcaatatggtcacatggtcataggttttgataaaatttgcaaatgttaca

SEQ ID NO: 17013 - DNA, 473 bp, Homo sapiens
ggatatctgggccaaaattgggttcaggagcattaatgtaaagcaaaacttaaatgtttggtatcatttcacttgggtggagctcttaagggccattgggacaaggtttcagttcctctaatgagaagtacagcagcaagtctgatttgtttataagagtcttgaattcaatgtaagagaaacaaaaatctctaggcaaacttaacagagaggcaaattatgtaagtaagtaaatccaatgttcagaatagtattcaactgatactttcccttcacacaacaaactcccaaatgatggatattgggagaaggcgaagaagctagtaggaattactcaccattaagagtaaggtaggctgggtgcagtggttcacgcctgtaatccccgcactttgggaggccgaggcgggtggatcacctgaggtccggagttcgagaccagcctggccaacatggtaaaaccctgtctctac

SEQ ID NO: 17014 - DNA, 515 bp, Homo sapiens
ggtcctgctagccccgcggctccgaactcggtggtcctggaagctccgcaggatgggggagaagatggcggaagaggagaggttccccaatacaactcatgagggtttcaatgtcaccctccacaccaccctggttgtcacgacgaaactggtgctcccgacccctggcaagcccatcctccccgtgcagacaggggagcaggcccagcaagaggagcagtccagcggcatgaccattttcttcagcctccttgtcctaggtgaatatggacactgtcatccccatcatctgccatcccgtgtctgtgtgctcggtctgtgtgtttaaccctgtcactcctcttgactgtcaagtcttcctcccatttggttttcatatcaaacactgagggaacatgatcagtttataacatcattaacaggaaactctcttctttataaaatcatggtgcttagcaagttctgaagagctgttgatgtaatatcttggcctttgaaagaaggattaaaaaaat

SEQ ID NO: 17015 - DNA, 390 bp, Homo sapiens
ggtcctgctagccccgcggctccgaactcggtggtcctggaagctccgcaggatgggggagaagatggcggaagaggagaggttccccaatacaactcatgagggtttcaatgtcaccctccacaccaccctggttgtcacgacgaaactggtgctcccgacccctggcaagcccatcctccccgtgcagacaggggagcaggcccagcaagaggagcagtccagcggcatgaccattttcttcagcctccttgtcctagctatctgcatcatattggtgcatttactgatccgatacagattacatttcttgccagagagtgttgctgttgtttctttaggtaagtgtgtattggtgattccataataaaagcagtaacaataactacc

SEQ ID NO: 17016 - DNA, 975 bp, Homo sapiens
aataatgtgccctcactcctgatacagtggagagcaaagtaaaaacagctaaactattcaaaagaaacaataagaaaacattataaggcatgaaaacccaatcaaacagttgtatttcaacatgagagaaacagtttgcagcagattttcagtttaaatacatgtttaatttcatgtttaaatgcaagccaaatctcagatttaggacaggggatcttcattatccagatgaatattcctgcataaggaagtagggaaaaaggcctgtagaaacctctgtcatggtaggttatatgcagaatccaatgccagcagctggctatatgtgtctgggctggcatggttgactctttcccaaggatggtcatctagtgggttcctcttcctgacatcgcaggtacaattggccatgatgccctctgcatggtcaaactatatgtttcctaagagaccttgggcccacttctgtcaccttacatggatctgttaacattacactggataggttaagcaatgacctgtattatgatagccagttcatgatgtctatatagtaatctcttaggacatggtaaatgattatgatcatcattagttttgccccatgtgtcaggttcttcatttaaattggaagcttattcttatacttactacgtgctaggcacagtgcgaagagagataatatttattttcatctggaattaatgtcattctaactccaaaagaaatgactagagaagattagggaagcccagacaacttgtcacgtagcagtctcaatcaaaattcattaaaaagaaaagacgattataaatgaggaagaaagcaatatataaatatttcctgttttatcattatgtattattttatttgctactgtctctgaaccatggtattttgataggagttttataagttcctagaatgatattgtactcaattgtgcatatattaaaactttttaaaagaaacctc

SEQ ID NO: 17017 - DNA, 352 bp, Homo sapiens
ataaaactttatattattagattaagttttatgtaatatataagtagaagtatgagaaaatgatttcctagaatgaggatggcaaatttaagttcccattctgtctttagctgttcagcatgtccataacagatatactaatgaattacaacttttgttttgaaatttgcacatggccttaaaagctttcttagcctagggcttcaggcagtattttggagtgtgtaggtaacaggaaactatttgcatttcttagagcaggggtgtccaatcttttggcttcccccacattgaaagaagaattgtcttgggccacacataaactatgctaacacgatagccgatgagagaa

SEQ ID NO: 17018 - DNA, 351 bp, Homo sapiens
aagggagggacccactgcttcagaaaggtccgctgtgcacaggccatgggggcagcatgggccgcttccgaccttcagcttcataatgttgatttctcctgggaaataaagataataatcaggaagctgcccggcactggagtgctgagtcggcaggagccgctgccgggacttgggagagtgtggtgctcactggagtctccgggccagaagcagcgacgccgccgtctccaggcttcggcttttctgattgatgttttccttttagaacagcgtccttgagcttcctgcacaaaacttgcttttctcttcctccaactctaaataaaaacgctcttctgcttctgagga

SEQ ID NO: 17019 - DNA, 603 bp, Homo sapiens
agtatttcactcaatagatgcagaaaaagtatttcacaaaatcaatcatccattcaccataaaaactcacagcaaactaggaatagaggggaatatcctcaactggataaagaatatttgcaaaaaacctataaccaacatcataattaatggtgagaaactatatgctttccccctcggatcagaaacaagaatgtctcctctcactacttctagtcaacattgcaggaggttctagctaatacaatatgacaagaaaagaaaaggcatccagattgggaaggacgaaataaaactgtctttgttcacagatgacataattatttatataaagaaatcccaaagaaccaacaaaaagtgatcataagaaggttgcagagacagcatctcacagtgttgcccagactggagagcagtgcactgcaacctctaactcctgggctcaagtgatccttctgcctcagcctccggagtagctgggactacaggtgcatgccaccatgcttggcaataatctatatatctgataattatataattatatagccacctcatctctatttttgttactatttgcataaagtatcttttccattaaattac

SEQ ID NO: 17020 - DNA, 699 bp, Homo sapiens
agtatttcactcaatagatgcagaaaaagtatttcacaaaatcaatcatccattcaccataaaaactcacagcaaactaggaatagaggggaatatcctcaactggataaagaatatttgcaaaaaacctataaccaacatcataattaatggtgagaaactatatgctttccccctcggatcagaaacaagaatgtctcctctcactacttctagtcaacattgcaggaggttctagctaatacaatatgacaagaaaagaaaaggcatccagattgggaaggacgaaataaaactgtctttgttcacagatgacataattatttatataaagaaatcccaaagaaccaacaaaaagtgatcataagaaggttgcagagatggtcataaagaaattccctgacctatctggcttgacagtaggtcataagacccccattccaggatcctgttccatacctgagaggaagaaatgctacaacagagacaccaagaagaacctcaacagacaggtcttgctgggcttcctcctctcggtctactacattagatcacaccctttgccacagttgtacatgactgtccactcttcattgcatcgaagcatacaaatggacagtttttcctatatctctgggtcttcattttgaaggctcccatgtcatgtaaaaccatgattaaataaacttgttacacttt

SEQ ID NO: 17021 - DNA, 986 bp, Homo sapiens
agtccattacactgaacagtaggaaattaccacttttgtaaggctcaaaaatgatcaactattaacagtttcttatggttcagtctaattacaaatttttaaaaagtttatcagtgtatcatttcagattcatctgtatcttctgtaatattatttccagtactgaggtaaggtacacaaaaattcccctggaaaaactatattctagttttgtaagatgatttcccacagtccatttgcttatttcttcctttgataattcaaaaagatgctttaggtaatggtacagaattagaagctgctattttagctctattaactttttctctatggtttcaattttatccaaccagagagggctggcctagttggtatctttaaggcccttccagtagtaatttgagtctagtcacatgtcagaccctgagcaacacctaaccaaatgcccaagtattctcataaggagtatgctgaatttaagtggtgtttgttttacatatgtatccatcccagacattttcaactatgctgaatgcaatctataagatattccaaacaaggacaaagtaatttttcacaagtcttacagccccactattaagtatgctacttattagcttcttgaatttctttgtatttcagtgattgggatgttctttttttttgggaaagtttttttacccctttgtaccctcttaattggattaactgtaaaatgtacatattaattttctagttttagagaccattttcattaaaaatattttccaatagtttttctaggataaacaatttatacttaattgttgcttggttgcttacatttcaacctctaggcttcctttttcagctaacttggctgtcttcaggttgtaaagaaaaatgtaaacatatatttgaaatttcattaactgaaactgctgtaaggtgttagcaaatgttaaccataacagattatcccatatcattggactgttctattattg

SEQ ID NO: 17022 - DNA, 928 bp, Homo sapiens
agtccattacactgaacagtaggaaattaccacttttgtaaggctcaaaaatgatcaactattaacagtttcttatggttcagtctaattacaaatttttaaaaagtttatcagtgtatcatttcagattcatctgtatcttctgtaatattatttccagtactgaggtaaggtacacaaaaattcccctggaaaaactatattctagttttgtaagatgatttcccacagtccatttgcttatttcttcctttgataattcaaaaagatgctttaggtaatggtacagaattagaagctgctattttagctctattaactttttctctatggtttcaattttatccaaccagagagggctggcctagttggtatctttaaggcccttccagtagtaatttgagtctagtcacatgtcagaccctgagcaacacctaaccaaatgcccaagtattctcataaggagtatgctgaatttaagtggtgtttgttttacatatgtatccatcccagacattttcaactatgctgaatgcaatctataagatattccaaacaaggacaaagtaatttttcacaagtcttacagccccactattaagtatgtgggaaagtttttttacccctttgtaccctcttaattggattaactgtaaaatgtacatattaattttctagttttagagaccattttcattaaaaatattttccaatagtttttctaggataaacaatttatacttaattgttgcttggttgcttacatttcaacctctaggcttcctttttcagctaacttggctgtcttcaggttgtaaagaaaaatgtaaacatatatttgaaatttcattaactgaaactgctgtaaggtgttagcaaatgttaaccataacagattatcccatatcattggactgttctattattg

SEQ ID NO: 17023 - DNA, 291 bp, Homo sapiens
acaatagctctacagagcgttaggctcaaaagataccttacaaataattcagtccagtgtttttttccatcaggagccaatagaaatcaagaaagtgatggtcaggccagatggctttagagcctcccatcccattcaagcatcatcagatatttgttaatagcccattttgtagccaggtgtggtggctcacacctgtaatcccagctactcagcagggtgaggtgagaggatcacttgaggccaagagtttcagaccagcctgggcaacatagccagacctcgtctcta

SEQ ID NO: 17024 - DNA, 360 bp, Homo sapiens
gctcaggtcctcaaggtggcctgctctaacaccctcctcaataacattgtcttgtatgtggccacggcactgctgggtgtgtttcctgtagctgggatcctcttctcctactctcagattgtctcctccttaatgggaatgtcctccaccaagggcaagtacaaagccttttccacctgtggatctcacctctgtgtggtctccttgttctatggaacaggacttggggtctatctgagttctgctgtgacccattcttcccagagcagctccaccgcctcagtgatgtacgccatggtcacccccatgctgaaccccttcatctacagcctgaggaacaaggatgtgaagggggccctg

SEQ ID NO: 17025 - DNA, 610 bp, Homo sapiens
gctccccctgaagccggagaccgtgtatagggatctgggggaccggagggcaacgccagagaacaagtggaggaggtggctatcaatcctcagagtttgtcatccactatgaagaaagctggccaggttttgttctgataacatcacatagatattttatactttttaaaagatgatcagagtgacatctgtgtggttaaaaagccaaataacacagaaggcttttaataaaaaataacagccctgcctgggtcctgtccttccttggtcccactttccagaggaaacacctttgaaccctcccagctttgttgaaagttctttgggtggctaccttcatatctttaaataatatatggtagtaccatttgtactagttttctagggctgctgtgacaaaataccgtaaactgggtggcttaaaacaatagaaatttattatctcatagttctgagggctggaagtctgtaatcaaggtgccagcatggccacacttgttctgaaggctcagggggatccaccccccacctcttccagctcctggaagtgccatcggtccttagcttgccctctgtgtccctgtgtgtccctcctcacatggcattttcc

SEQ ID NO: 17026 - DNA, 367 bp, Homo sapiens
ccccaagagacagcactgaagagcagaaaagacagtgactaacttctatgttagcagttgacaacagctcagtagagaaaacctgtccacaagcaatgagaatatcacggccgggtgcagtggctcacacctgtaatcctagcattctgggaggccaaggcgggctgattgcttgagtccaggagtatgagacaaacctaggcagcatggcaaaaactcatctctacaaaaattagccgcacctgtagtcccagatacttgaggagctgaggtggaagaatcgctagagcctggcagtttgaggctgtagtgagctgagactgtgccactgcactccagcctggacaacagagcaagactctgtctc

SEQ ID NO: 17027 - DNA, 948 bp, Homo sapiens
acgttgacacttcagcctgggtgacagcgaaactgtctcaaatagataaataataaataataaatatagtgctttcattgagttctgtgagttattctagcaaatttttaaacctgaggaggctataggaaacctgaaatttatagctggtctgtcagaaatggaagttgtccctgagaattggggctggcatcggaagtggaggcagtcttgggaagaactttgcctgtggggttctgcgctaaggtgggtagtgtcagaactgaattgaaatgtaggacacctatttggtgtcagagaattgctgtcggggaataacaacctgacaagttttgacatacatacacagcattgaaaccatcacttcaattaaagtgaacttatcaccctcataagtttcctccttttgctttttagtcctctctgctccccatttgcgccttgcttctgtcaggttccttttatcgcgaattagaagtcttttgtatgggtataccacaatggatttatccatttaccttttgaaggacagttggttattttcagttttgtgatatgctgaataaagctgttaggaacacgtacttgtatttgtgtgaaatgttttcagtaaattcttaagaatggaatttttggcttaaatgttaaatgcatctttaaattttatgaagaactgccatacagttatctgaagtggttgtaccattttatatatctacctccagtgtatgtttctcttgttaagtctgttcagatcttttcctcatttttatgttgagttggatgattcacatactacctgatttcaaaactttttaataaagctacagtaatcaaagctatgtggtattggtaaaagggcacagaaaataggaacacaacagagtccagaaataggcctacatggtatagcagtttttttcaacaaagatgccaaaacaatcctgt

SEQ ID NO: 17028 - DNA, 483 bp, Homo sapiens
  misc_feature (26)..(26): n is a, c, g, or t
tcactccttctagatctgctttcttntctcttcctgtctcttaggatagcttatcctgtggtgcagatggcctcccaaagggctgggattacaggtgtgagccaccgtgtctggccccacataaagtttaggttggatttttctgtttcttcaaaaaatattgtgatcttgatatagattgcactgaatctgtagactgcattgggtagtattggcatctttacaatattgtcttcccatccatgaatatgaagtatctttccatttactggcatctgtaagttctttcagcagtgttttgtagtcttcattgtacaagtcttttgctcctgtggttaagattattctgctaggctgctcacggtggctgatgtctgtaatcctagcactttgggaggtggaggttgctgtgagcccgattgcgccattatagtccagcctgggcaacaagagcgaaactcaaaacaagaacgtctcaattaa

SEQ ID NO: 17029 - DNA, 161 bp, Homo sapiens
ggtccctggggattacagcacgattatttttattgcaagagtttcccaatgcgggaactcacagccccaaagagtttgcatctgagcttcctgtagcatcctggggcacggacaggcggaaccgggccatcagccgtccctgcgcacagaggcgcacagat

SEQ ID NO: 17030 - DNA, 658 bp, Homo sapiens
gtttatggagagttgtgaactcataacatacttgggtgccaagatgaccagaaaatacaaggaacctcagttcagagccattgactttgatcataagttaaagacctttctctctctcagaaatatagacccaattaatgggtagtttacttaggtgatagcagcctgaatctcaagagttatctgaaagtgatagagggaaactgagagaagtagattgaaaatctgggcctcttggaagtacttttgcctcctgagcaaggtaccatggctgccagacttcaggtgaactcaaaggtctgccagccaggaaggagcactcttatggaaacaagttttaatacaattttaaaatgtattgctctttgcctgaactttgatgctttaacaaaataaacattctatttataattccatatagaaaagttaagtgacttatttaataaatgtattattttcctttttaacattttcagtagaaaagtcagtctctgttaaaattactcattaaatgttagaaagctttaagacatttaacattgttataaatgaaaccaaaatatgggttatacattttacatacaaaactgtttgtgaactttgtgaacataagatactatcattttcccaataaaataaatggattttgcaacaactt

SEQ ID NO: 17031 - DNA, 171 bp, Homo sapiens
ccatgctcccaggctcagtactagactcctggtcaccccaacatctttatttttgcctccctgctctgggggttgtagcttcttccttcaccaactctgttacttcagtatcccttttgcactttcagccctcaaaccccaagtaaatacgctttcacttccctttcttga

SEQ ID NO: 17032 - DNA, 400 bp, Homo sapiens
aaatgcttccgtccattccagagaaccatattttactcaaatatcaaagtccgtaggttacagaaaagggagcaaatgacaaaagcattttatgagcagtagacttctctagcccttgaattatggtagataactagccttgagttcctgccaccagaaattccctcctctaaaccctgtggtggttgaggagccctttcctgagctgtggtattctctgggaagacacaggttggaactagagtcagtttccatcagtagatagtattttgcagaacaatttacttggagaagaaagaggacagaatttctgtcacgtcgatcagtggtttattctctcactgccattgtctagccatatgtccctaaaaataagccacattgaatggatgtaatgatc

SEQ ID NO: 17033 - DNA, 626 bp, Homo sapiens
ccagcaaagcagcatcaaaaggaagtgatcctgggttatagttcacagctctaggggttggagcaggaggggtagggaagtaactgcctttagttagtgtccacctgttttcctgagtgatttgcaaagacaggacttttatgccaaaacctctgttttagaaaaaagtagaggacaatattttttaactttgaggtatagaagcaagacaaaatacaaaagtttcaaagaaaaagatttgataaattcaactaaaaatttctaaaaattaaatttctatatgacagtgggcagcataaacaaagttaaaataatgacagactaggaagatagatttacaacatttacaccaaataaggaatatccagaatacataacaatttccataagtaaaaagaaaaagaaaatgggaaaaggttctaagttaagtatttcacggaagagaaaaaatatgaatggctagtaaacagctcaccagtgatgtgggaagtgtgagttaaaatagtgaaatcccatattttgttcattaaactggcagatattttaaagattgaaaatatctggtattggtgaatgtatagggaaatggacatgtaatggtacaggctgaacatctgaaattggaa

SEQ ID NO: 17034 - DNA, 373 bp, Homo sapiens
tcatctccctcagggcccatcatccccaggatactctactctttctgctgccctgtaggggagatggcagtggtcagaaggccaggggtaagaggtaccccaggtatattgtggaacactgctattcaaaatgtggttcacagaccagcagtgctggtatcacactttgggagcatgttagaaatgcaggttctcaagtccggccccagacctgctgaatcaaaaactctgggagggctgggcacactctcgtggctgtaatcccagcattttgggaggccgaggagggaggatcaatggagcccaggagttcaataccagcctgagaaacacattgggaccccgtatgcacaaaaaatttgaaagttaacga

SEQ ID NO: 17035 - DNA, 451 bp, Homo sapiens
acaatcatttcaactaactcctttaaatattgcaatgaaattcctcacaaatcttcagtgactctttcagaaatgattcttcaaggaagaatatttttctcttaggtctttgaaattaatatttttaaatgatctaagatattaatactaggctactttttaggctctcaataatacatagggttggcatagttaagatgagctaatttgtgtatgttcaaggatgctagccaagctatacatttagtaatattaaaatagtttagtaggaaaaagtattaatatttttaaatgatcttagataatgcattttacattctttttccctctccccaaagagatttggaaatgtttcatatttgtcaaatatatctcaatataaaaaagcatggctgctctaattagatacatttgttttaaggcaatttttctttattagtatagttaatac

SEQ ID NO: 17036 - DNA, 496 bp, Homo sapiens
gacatccaagtatttatgttacatatgcaagtccgaagctctgaggaaaagttggggctgtgcatataaaaatgtgggaatcatcacaaaagaaatgggtattgaataccagtgaacagatgtgattacctagggagaaaactgaagtaagccaagaaggggctcaaaagttgagtcctcaaaagcaacatttcagagtttaaaaaaatttcctcagccagatgcagtggctcacgcctgtattcccagcactttaggaggccgaggcaggcagatcacgaagtcaggagatgtagaccatcctggctaacacggtgaaaccctgtctctagtaaaaatacaaaaagactagccaggtgtggtggcgggcacctgtagtcccaggtacttgggaggctgaggcaggagaatggcgtgaacctgggaggtggagctttcagtgagcctagatcttgccactgcactccagcctgggcgacagagcaagactccgtct

SEQ ID NO: 17037 - DNA, 471 bp, Homo sapiens
ttcattcaaacttatttactaattatataaatttggccagattacttaatctcattttacctcagctttactatatgttaggtagacaaaataatagtttctacgtcacaaggttattttgagaattaaatgagttaatatgcataaaacactcagatcactgccaggcacataagatgtgggtcgagcgcagcagctcatacctgttatcccagtgctttgggaggctgaagtgggaggattgctagaggctgggaatacacaactagcctgggcaacataaagagaccttgtctctacaaaaatttttaaaaaaattagctgagcatggtggcgcgtgcctgtagtcccagctactcaggaagctgcagagggagcaccatttgagcccaggagtttgatgctgcagtgagctatgattgtgtcactacactccagtctgggtgacagagctagatcttgtctctatta

SEQ ID NO: 17038 - DNA, 563 bp, Homo sapiens
ttttagacaattgcattaaaatgttatttatattgactatggggacttttggggcccccttaaattttgcacttgaaatgggatccccacttgtgtcaccccatagtccagccctggttttaggatggggatggaggcaaaggcatcaggcaagtaatgaagcaaaggtttattttttggtgtccagattatccatagctcagtcatgaaaatctatgtctttctatttttctcctttctgcaatgtccctgcctcggctcatcagccaattagctcctagaaagctggggtcatctcgtattcccagcaagtacccagcacagtgccggttcagagcaggtgctccacacacattcctggaatgagacagcacagaaatggctctcgggagcctcggatgctgctgggagtaagtgatccaggaccttaccgctaagaggagaaactttttttcaaagcatttataaatactccctccacccctcactccacaaatggggtgatcaacacttactgcttgctcttgttctgctaatgattaaaacaagtttatttaatttca

SEQ ID NO: 17039 - DNA, 298 bp, Homo sapiens
aaaaagtactgtgtgatatgaaaaatgacattttgttttaggcttggataattgttgctgccccctctccttcatgaatagacactgtaagtcatggagaccttggatcagtttattttgtagcatgtgctgtgcatttgtgcattgcaggatatccaccattcctgtagctcacccattaagtgctagtggcatcctcccattttttttttttaaattacagtctaaacacattttcagaatgcccccattgagcatttctaggttagaggaaagaaggcacagagcaatatgtcga

SEQ ID NO: 17040 - DNA, 396 bp, Homo sapiens
aagaaactgcccctgcaggaggaaggagagatagatatcacaccacagccaaaaagtcattctccactttatttggtgtttggtcaggagctgactgtacttctgggtctagttagaggcagcatgatttagaggaatgtggagatattggacccagtccagagaatagaataaaaatgcaataacacaatcagaaggttggagggagataatctaccagaaaaagtccaaatattcatagaaaaaacactttttgtattttcctggggatgtttccaaatagaagaaaactgtaacatgggaaaattaataaaataaccttggcattccttttcataattagtaagaccatagtaatgaagtagcctgcaaaacactaattggctcatggttttt

SEQ ID NO: 17041 - DNA, 425 bp, Homo sapiens
acctgcttgaatgatacttagacctgggacaactgaaaggagttgcacttatacaattcggtgcagtggagtcccctgggaggagccccagtcacacgggaagagacagtcacagctgtaataaatgatggctagcatgtatcaagcactggccgagtcctcagcatacattacattacagaattcagtgtgcacctcaacactctgggggtgtattttataggagaactgtggcacaaagagggtaagtgtcttactaacagtgtggctcatctgccaagcaggggtaatctgaccccatgaggttgccacaagtattcaattagttttattttacagttagaacagtggctggctgaagaagtaaaatatacaagtatttgttatgcaaaaacaaataagtcataaatctccatcttataggt

SEQ ID NO: 17042 - DNA, 265 bp, Homo sapiens
ctgtgccgctggctccaccctcaggtctccccactcctctcattagccaccggccttctcagccttctcttattcttgtgactcttgcctgaccctgcctcagctctgtgtcctcccagactgctgactgtgaggctttgcccagcggattttccatcgccaaattagagcttttctttcctcgcctgactgctccctgtcactgtcttctgtatcttcctgttcctgattttggctggctatcaagagaagaagatctacaatc

SEQ ID NO: 17043 - DNA, 451 bp, Homo sapiens
ggaatttaaaggttgttaactgctgttttagttttaggacaaattacctgccttctaactgccatgcaaacaaataccgctcaggtgtgaccaaaatttaagcatcttaagtctccgctctcttcagttaggaattttcattaaaacagcttgcctttcactttcaaccctcaaacctaaggacttcaaatactagatttggtaactctggatatccaaagtcactttgggggaaaaaggagcgtaggaaagattgcaaatatttagcagggctatttttgaatctcttgatttaggctagaagtccaatgcgctatccattgcaccacagagcctgcttgcaagcagggctatttttaagtgaaaaagctaataacaaaatagtttgcagaatgataccttatcttgataaataaataaaaatcacccttatcgtcccattccatgtgtt

SEQ ID NO: 17044 - DNA, 385 bp, Homo sapiens
ccccattagggcattgcgtaaagttggaataaacctttcaacataaaatcccaaattgcatcatttatttctttgttcaagtctaatagtttagctattgatgatgatgatgatgatcacagcagcagatcctgctccagctcccatcacaggaaaggatgctcgatgacagttggtttcactttattgctcagaagagacatattctgatgagctcccacccttcattcattatgctgcaatcatattgctaggagacaaagatgaatgctgtgtacttatctgattaaactgcctgttgttttaaatctattttcacagagaatttttcctctgatagacatccagtgacataacacattaaaaattatatctgtatcagtgg

SEQ ID NO: 17045 - DNA, 474 bp, Homo sapiens
tgatgctaatcccacagtcagaaggttttctttaggctatcaatctagcaactcccttcaccatccttccagtgtagggctataaactacacagtgccatgcacaatatccttagaagactaatacacaacaagatgtctaacaacatacaacacattttggtaaatccaaccccaagttggattcatagtacccaaggatccatttaccttactgtgggaaaattccccacacgtactgcagtgactgtccctggacccttgaacaatacactcaccttaggcattaaggtaaacacaggaccacaaaatgtcagtgaccccttagtgagaattcaactcttgacctgctgcttcagtccacctacaacgcaaatcctacataacaagatctacatcttttctaccatgcctggcccactgcagttgccacaggccctcagcagcccaagagctctcaggtggggtggggata

SEQ ID NO: 17046 - DNA, 592 bp, Homo sapiens
cttttcctactttgggggatatatctgaggggagtgtcctgtggtatggggacacaattacccatctgtgaagagaggacagagtaaggatttttttttccctcaaaggaatcccagtgattcaggaggcatttgagagaaatacagactgaagatgattggttactcaactagaaagaggggaacaagtcatccctagttccttttttctcccagggaataaccgggttatgtgagggagagagagaagagctgtcctcacatccctgagtccctgtaaccttgggatggtgcagaccatgggtgccaatgtggcttttcacccttgttaacagggggcctaggaggtgggaattatccgcatttacccacatgctgcctttcctctgctgtcagtaacctttgagttccctagaccttgtctgtgccatggatgctagcatgacctctatccatgaaatgggaggggtcctaactggcaggaattagtcatgctaaggtaaatctgtggtgctgagtcctcctcaaacaagggagagtaaagggtgtcttgtgagttggggtcctggcttaataagatgttttccaaaag

SEQ ID NO: 17047 - DNA, 414 bp, Homo sapiens
aaaaacgtcttcaataaaaccatgttgattgattggttgatgattgattatttgacctgccatcctagttggttgtcagaaatcctctccttatttttcttggtggacacaagtttagtgatacttgtagaggccaactttgcctttcaactttgaacttccattgatttttccactgtgtgtgccaaagccttaaattggttccagttgcttaaaagagatgtatatttttcttctacacattttatggaaaaaaaaaaacctggagcgtattttccctagactccaccaaaaccagatagtttttccagaaatgtatgaatgaacaacaaagtggttactttggaagccgacataccgttatattggatttcagaaaagtcaagtaatcccatatttcatgtgattccaggt

SEQ ID NO: 17048 - DNA, 295 bp, Homo sapiens
cagaggatgaaaaagtaccaggatagtccatctataagctggagaatgatagaagcatggcttttagagaagttggtagcatggctcctagggcaggcagtggcatgacttggtccaattctgaaagcctcaaaactagagaagctgacaatgtaggccagaggcctgagagcccctgagaggccactggtgcaagtcccagagtccgaaggccaaagaccctggagtctgatgtgcaaaggcaggaagaggaaagggtacactgctacaaaagagagaaagagagtgtgagcaa

SEQ ID NO: 17049 - DNA, 399 bp, Homo sapiens
cagttacgtattctgttaccttgctcaattctttcactgtttgagctagcttcatcactgattttatagggatgcactgtccaatagaaatgtaatttgagctatgtacataattaaaatttttgtagtacattttaaaaagaaaggctgggcgtggtggctcatgcttgtaatcccaacactttgggaggccaaggcgggcagatcacaaggtcaggagatcgagaccatcctggccaatgtggtgaaaccctatctctactaaaaatacagaaattagctgggcgtggcggtgggtacctgtaatcccaactactcaggaggctgaggcaggagaatcgcttgaacccaggaggcagaggttgcagtgagccgagttcacgccactgcactccagcc

SEQ ID NO: 17050 - DNA, 431 bp, Homo sapiens
ggccaggagttcgagaccagcctggccaacagagtgaagccctgtctctactgaaaatacaaaaattagccaggtgtggtggtgcatgcctgtaataccagctactagggtggctgaggcagatgaattgcttgaatcctggaggtagtggttgcagtgagctgagatcgtgccactacactccaacagtgtgagactctgtgtcaaaaaaaaaaaaaaatcaatttatgaaagttatttttaaatttgaagatattgaagatactaaatttgtgtttaaaaagcatttattttgatcaactccgctgtatagaatattttgtcttaagtcactgtaaagtttccatgccctcaaatgaaatacagtgccaggtttaacattcgttttcatggattgttttcaaaagttattgagttgtctgatttgctgt

SEQ ID NO: 17051 - DNA, 2822 bp, Homo sapiens
tttctgtgattattgagcataactgatgagagaatgacagtattggtgactagcttttttgtttttaaataacacactttaaaatgccacagtgttatttgaaagcttaaaggcattttctcatcttcagtatttgctttttatcagttgtagaaaagaaccttagtgttttcttctctacctatgtatgcttatgaaaccgctctacctacatatgaaacttctctacctatgtatgtttacgaaaagagatgtatttgccaagaaaatcttgattatataaaagacaaaaagattataaaagacagtttctgtttaagtaaaactgtctttgaaacttaagaaagcttaagttttaaaaaaatctcagttaaacatcattggtttatttgacttactgttaactcttgcttctctttgactccatggtgtttttagataaccatgtatgaactttatgttaatggtttgtgggatactaaaatagcttgaagatgacttgatgactgtgcattttatatagttttattctcctaaaatctcaggagggcagcaagtgctgtcaacgattatatagtgatgagatttttatgggaatgatttcttcttggtgcgttttacacatttgtactgatagcaaaactaaagtttaaagcagcaaagtttaagttctccttaaatcctacagaaaccaaccttttaaggacataatttcatctaaaacatgacgatatttagcacaccttttaatgtgggtatatatcaagtgtttaaggactggctagtatgtgatagagcaagacctgagactttataagtatttgctcgtgtctgttgacagacctctttctttcaaacttgttagaagagtggtaagacatatccaattggaaaataagatgcagtgttgtatagcacatacatttaaagtgcttgcgttaaaattagtttctcaataagataaaattattttaaaaatttggttcactttattacaatagtggcaatttagcttttcagtattacaggaatttaaaaattggtttcttgtaggggacatctcaactttgggaatatcttcacttaatttttaaaaaatattttcatgctttattgtccagctatacaatatatcgcaaaatcctgacaagttcattgtattaaggtattaactattacatggaaagcaattctgttcatcttttgatgtttgtgttgaaaatgcttatctttgtgttttgatcttccaacagctgagagcttgaactgatttaaacatttgtcaatatacttaagaatgctttaagtaaagaaggggaaaattttaagtaagttttttcccttctaggaagaaaaactatgatgatgttaagaaaatgtcattatagagcttgctcaataatatgttctttaaatccacctccatttgtacattataggtatcattctgtttttgcttaaaataatctgcaaccatttcagatagttttacagcaaattgatctaaaagccactaataaattctagggtttgagtctagaagccaagcaaactgtcaccaatgtcagttgtaaattagaatgcaacatgaggcttcagactcatgacaatgatatacatgaaaacaaaaatataattgtgtctaccttcctactttcccttttgacatatgtagttggaattttacatagtcttaaaatccatatttagaatcttacctgtttctataataattagtaaaatgccaaagtagtgatagaatattgtggcattgaagtagccgaaaaattgttagttttagcatcaaaaaagtaaatagatgttgaaatgaatttttgtatgtgccaggttgaagagagtgtgccagtgacaggaagtagtctaaaaaattaacagttatggttttaataggatctgaaagacaatctttaaagaaatgggagaaattgggggtatcagtgaacctataccaacctctctttgtacataaatatggtgatgtagctagatataaaaatcagtgtcttactggcaccatttacagtttagaaaacaatctttttcttaaaaatgcccatctgatttctatttttaggagctacttggatttgtatgtattttttctacgtgaaaatatatgtactcttcacttttgttccagtactataattgctcatgcactctttctcccctttgagaacattcagtgaaatacaacttcatcaaagatttgctcaaaggagaagaatcgcatgagtgtgaaaagtagatgctcgtagccagaacagaaaaggttacacatgatcatggcacagaagataggaggtttgacttggtgggccataatgtttattatcctttttgaaataacagggaccagcagcagttttctcaggataaatgctctaccccacttctctatgaacaggtgtggggaggcttactttccattttcatatttatacacctctctacaaaagcaatttttaatgaaggttagtggaattgttaaaaatctgagaggaatgatgactggaggtgtttggggtttttttctgtattcattttttaatgagaaaagttttaaatgtagtacaggttagacccaactactaccttactattataggacgattctatgtttctgttaaagtattcaagtagctttctctgggggaaaaagtaccacttggacacttaaaggaattgggatttttgtctactttggataaggcagttgacttcttaagtaaaagcaatagtgtaaaatgtcattttgtttggaatgttaagtgagcaaataaaaaacatgttgaaattgt

SEQ ID NO: 17052 - DNA, 2920 bp, Homo sapiens
  misc_feature (2823)..(2823): n is a, c, g, or t
tttctgtgattattgagcataactgatgagagaatgacagtattggtgactagcttttttgtttttaaataacacactttaaaatgccacagtgttatttgaaagcttaaaggcattttctcatcttcagtatttgctttttatcagttgtagaaaagaaccttagtgttttcttctctacctatgtatgcttatgaaaccgctctacctacatatgaaacttctctacctatgtatgtttacgaaaagagatgtatttgccaagaaaatcttgattatataaaagacaaaaagattataaaagacagtttctgtttaagtaaaactgtctttgaaacttaagaaagcttaagttttaaaaaaatctcagttaaacatcattggtttatttgacttactgttaactcttgcttctctttgactccatggtgtttttagataaccatgtatgaactttatgttaatggtttgtgggatactaaaatagcttgaagatgacttgatgactgtgcattttatatagttttattctcctaaaatctcaggagggcagcaagtgctgtcaacgattatatagtgatgagatttttatgggaatgatttcttcttggtgcgttttacacatttgtactgatagcaaaactaaagtttaaagcagcaaagtttaagttctccttaaatcctacagaaaccaaccttttaaggacataatttcatctaaaacatgacgatatttagcacaccttttaatgtgggtatatatcaagtgtttaaggactggctagtatgtgatagagcaagacctgagactttataagtatttgctcgtgtctgttgacagacctctttctttcaaacttgttagaagagtggtaagacatatccaattggaaaataagatgcagtgttgtatagcacatacatttaaagtgcttgcgttaaaattagtttctcaataagataaaattattttaaaaatttggttcactttattacaatagtggcaatttagcttttcagtattacaggaatttaaaaattggtttcttgtaggggacatctcaactttgggaatatcttcacttaatttttaaaaaatattttcatgctttattgtccagctatacaatatatcgcaaaatcctgacaagttcattgtattaaggtattaactattacatggaaagcaattctgttcatcttttgatgtttgtgttgaaaatgcttatctttgtgttttgatcttccaacagctgagagcttgaactgatttaaacatttgtcaatatacttaagaatgctttaagtaaagaaggggaaaattttaagtaagttttttcccttctaggaagaaaaactatgatgatgttaagaaaatgtcattatagagcttgctcaataatatgttctttaaatccacctccatttgtacattataggtatcattctgtttttgcttaaaataatctgcaaccatttcagatagttttacagcaaattgatctaaaagccactaataaattctagggtttgagtctagaagccaagcaaactgtcaccaatgtcagttgtaaattagaatgcaacatgaggcttcagactcatgacaatgatatacatgaaaacaaaaatataattgtgtctaccttcctactttcccttttgacatatgtagttggaattttacatagtcttaaaatccatatttagaatcttacctgtttctataataattagtaaaatgccaaagtagtgatagaatattgtggcattgaagtagccgaaaaattgttagttttagcatcaaaaaagtaaatagatgttgaaatgaatttttgtatgtgccaggttgaagagagtgtgccagtgacaggaagtagtctaaaaaattaacagttatggttttaataggatctgaaagacaatctttaaagaaatgggagaaattgggggtatcagtgaacctataccaacctctctttgtacataaatatggtgatgtagctagatataaaaatcagtgtcttactggcaccatttacagtttagaaaacaatctttttcttaaaaatgcccatctgatttctatttttaggagctacttggatttgtatgtattttttctacgtgaaaatatatgtactcttcacttttgttccagtactataattgctcatgcactctttctcccctttgagaacattcagtgaaatacaacttcatcaaagatttgctcaaaggagaagaatcgcatgagtgtgaaaagtagatgctcgtagccagaacagaaaaggttacacatgatcatggcacagaagataggaggtttgacttggtgggccataatgtttattatcctttttgaaataacagggaccagcagcagttttctcaggataaatgctctaccccacttctctatgaacaggtgtggggaggcttactttccattttcatatttatacacctctctacaaaagcaatttttaatgaaggttagtggaattgttaaaaatctgagaggaatgatgactggaggtgtttggggtttttttctgtattcattttttaatgagaaaagttttaaatgtagtacaggttagacccaactactaccttactattataggacgattctatgtttctgttaaagtattcaagtagctttctctgggggaaaaagtaccacttggacacttaaaggaattgggatttttgtctactttggataaggcagttgacttcttaagtaaaagcaatagtgtaaaatgtcattttgtttggaatgttaagtgagcaaataaaaaacatgttgaaattgtncaccaaaccaacaacaaaaaaaccggggctttttttcggggcggaaaggttaaagccactggcaatttcccgcccttttttcaggggaaacgggcca

SEQ ID NO: 17053 - DNA, 1013 bp, Homo sapiens
acctaaataatctgaaagaacctgactctggcagaattaggaattcctaattttacagtgttttggttttgcgctgtttcctggatgccttttcacctttcttccttgaaaagtggatagaggctggaccatgcccctaactccccattcctatcagagagactgccatcttctcttgccccttttgtaaaccttatgtcaacttctaatattttaagttttccagcttaaacgttagtgctttcttaaactgaccttaagtatacatgttaactagtggggtatgtacatttattgtaatcgttgtttagttgggttttttgtttttgcttcttgtttgtttgggttgggtggggagaaagactttcctagcatctgaaattgttttacttaaatatctacctacatcttttcttgtaaaacctatctttattctcttatactgggctctgctctttattgtacagctcatagtcacttcctgcttcagcctccaaactgagccttctaaatttgaggacatacctgcccaggggatgccaacccattttggtcagtttctacagcagcataaattagggttctcggagccattcagaaattgagccctcatctggcaaatacaatcctcccagggaaactcagaaacaaaaataatatgcacagaagaaaaatatgtaaaatattttttaaacatacatttggacaaggattggaagatatatgtaaaattaaaatatcaagatggtggagttatggatgtacttctttttgaaaatgtggatattatatttttaaggttaaaaaaatgaaacatgttaagaaatgttaataacttttaacaagaatatcctgaaaggataaattttgattatgaagtagagatgcctcaactttgctcactacttccaacttgctagaattccctaccagatctctaatggcaagaaataaatgatatgacagtagagtttttcatattaataacaaatttaaatttccaactatgatat

SEQ ID NO: 17054 - DNA, 87 bp, Homo sapiens
ggatgctgtcactttttgaaatccagtaaaaaggtttctgtcttttttacctcattggtgagtgattggggagtgggacccatgggc

SEQ ID NO: 17055 - DNA, 343 bp, Homo sapiens
atgtaactgaataaatatttattgaatgaggatatatagttattaagttagaaatgaacagaattatggatctaacatctcaagaataatcaaaatattcagctacattacacagtgaaatatctgaactttccctaaaccaaacattttccaggacatgtgtaactttatgtctccagtttaaagttcagctataagctgggcatggtggcacatgcctgtaatcccagctacttgggaggctgaggcacaagaattgcttgaacctgggaggtggaggttgcaggagctgagatcgagccactgccccccagcctgggcaacaaaacaagaccctgtctct

SEQ ID NO: 17056 - DNA, 196 bp, Homo sapiens
acacctgtcacgtaactcagaacaaaaaggcggaggacagagattcaaacagctcatttaaccaacatgacacacgtcatgtcggcatatatcatgagacttacatatatacacaaatatataaaatcagtatatccacttcaccaaccgctagcagagtgtctgttattttcaggtacacgtggaacatttacca

SEQ ID NO: 17057 - DNA, 377 bp, Homo sapiens
ttttctctttgtgtccattttggtaggctatgtttttctagggatttctcagtttcaccacaattttaaatgacataattattgattatattccttattaatctattcgatatctatataacttgatggatgtttcatttttcttcctaatagtgaaaatttgtgtctttgcttctatttatgatgtcatgctaaagggcctatcaattttattgttcttttcaaataatacactttgggttttgtttattttttctagtgaacatctgttttatatttttctgctcctatattcattctacattttaatccccataagacattaaattattgacatatatggtgaatatttacttacatttaccctcatatcatct

SEQ ID NO: 17058 - DNA, 452 bp, Homo sapiens
ttttttctcatctactgcttccaagcagattataccaccctcctggctccaactgccaaccctgccaacacaggttaggataaatagtagcacctttccccaagtgtgttcaccaaatgtgttctcacccaggtactttcaaacacctcatgaggctggccagagatgacaccactgccccggatgcaagggggcagccttgctttggaccccgttctgaatctcaggcttcatctattaggcacactgagcagaaacactcctccctgccacttccgagttgcagcaaaaagggtctaactatgatttaaaacaaataattttaaacttcaaattttcattactgtcatacttatgaggaccaaataatgtaatgactaagacatcaaattacatgtaatatgaataaaaccagtaagaaaatgatagttacttataattggatcaacata

SEQ ID NO: 17059 - DNA, 402 bp, Homo sapiens
aatactctgagaagctatttatatagagagattttatcattcaatcatgcttttggtgaaataattattaaagattattaaggattaataaggattaatatgtaaaaacataaggctttaatttgttgattttttaattctgtaatttaattatgatgttcaaagaaaggaatagaaccatctagtctcaaaagtgggaggagcctatcatgacttccctatctccttttcttctcaccctctctaactcagtgacttatccagttttacttcatgtctgttgtcagtatcttgagcaaataaaaaatagagggaataaaaatcaagaatgtgtgccttaggagaggacaaggtaccatacaatctcatattgaaaattaaataaaaatatatcaagttata

SEQ ID NO: 17060 - DNA, 691 bp, Homo sapiens
ccacgcccggctaatttttgtatttttagtagagacagggtttcactatgttgatcaaaatggtctccatctcctgacctctaggaggcaggcccgatccgcccgcctcaacctcccaaagtgctgggattacaggcatgagccactgcgcccggcccagttgtacttttttgacatatgtatgtcttctcttattttccccattgctctattgccattctttgtttttctgctgctcacttgctggatataaacatcctgagagcaagaactgctttggcacatttcagtttctagcacagtgcatagcacatagtagaccctcaatacatgtgtggaagtgagccctccaatattccagacggcgtctcactctgtcaccaggttgaagtgcagtggcgtggtcttggctcactgcaacctctgcctccggctacacaacccgcttctgaccttcagagcttgctggactgcttgccttccttctcacttccactgccaccaccagcagctagctttcttttgggggccatttttacacagaaaagcaaggatggcactaaagggaaagtgctgaatcacacactggctcttaacacatccacctgtgagtgacacctatcacttctgccagcatctcatggccaagacttgtctcacggccacaccttactttgaagggaacagggaa

SEQ ID NO: 17061 - DNA, 350 bp, Homo sapiens
acatggagttctcaggtgagggctttgacctcagagagctgttggtctcattctcgcctgtgaaattccaagggtttggaaacgtacatgaaagagctctgcttccctcccagccatcacctcccctgactctaccctccactgggatccgtgtccttgcctcagacccagcatgcagcatgaggcccactaagggacggggactttttctctccagcagcagctccagctgcagaagatgcaaaccgaagtgccagcaaagtctatctctgtcctgtgtgagctggccggctggcggcagaatgacacaatctcttcccacctctctcgtcacctggccatcagctggg

SEQ ID NO: 17062 - DNA, 279 bp, Homo sapiens
aaaaggttatatgctatatgattccatttatataacattcctgaaatgacagaattatagagatggagaatagactcgtgattccccaagggttggactggggaggggagaagcgcagggacaagagggagatgagtatggctatgaaagcgtggcatgagaggttcttgaagcaatgggaccattctctatttcaactgtgctgctagttacacgaatgtacacatgtaaaattgcatagcattaaatacacacaaatgaacgcacataaaactggta

SEQ ID NO: 17063 - DNA, 189 bp, Homo sapiens
agaacctgaaagatttcaagacccataagtgaggatagctggaggaaaagtattccagccagaaaaacagcaagtgcaaagactttgattgaggaccaaagtcaaggaacagaactgaagctgctgtcactgaggcctaatgaactagacagaaagtaggaggacataaagtcagagaagaaacaggaa

SEQ ID NO: 17064 - DNA, 1963 bp, Homo sapiens
  misc_feature (185)..(185): n is a, c, g, or t
  misc_feature (1958)..(1958): n is a, c, g, or t
aataaaaaccttcaataaattaggtatagaaggaacatatctcaaaataataaaggccgtatgtgacaaactcacatctaaatcatcctgaatgggggaaagctgaaagctttttctctaagaactggaagaagacaaggatgcctgctttgaccactcctgctcagatagtgctggaagtagtnctagccagagcagtcaggcaagagaatgcaataaagggcatccaaactggaaaagaggaagttaaattgttcctcttttcagatgacatgatcttctatatagaaaaacctaaagacgtcaccaaaaaacacatttagaactgatgaataaattcattaaagtgacaggatacaaaatcaacatacaaaaatcagtagtgtttctatacaccagtaacaaactagctttaaaaaatcaagaaaaagccgggtgtgatgcttcatgcctgtaatcccagcactttaggaggatgaggtgggtgcattgcttgagcttaggagttttgagaccagcctgggcaacatggtgaaaccctatctctgcaaaaaaaaaaaaaaaaaaaaaaaaaaaattaaccaggtgtggtagcacatgcctgtagtccccagctagtagggaggctgaggtgaaaagatcgcttgagcataggaggctgcagtgagctgtgattacgctactgcactccagcctgggtgacagagaaagaccctgtctcagaaaaaaaaagaaaaattgagaaagcaatcccttttacgatagctaccccccaaaaaactaaaaaacccaggaataaatctaaccaaggaggtgaaagagctctgcaatgaaaacttataaaacagtgataaaagaaattgaaggggacaattaaaaatggaaagacatcacatgctcatgattggaagaattaatgcagttaaaatgatcatactaccaagagcaatctacagattcgatgcaatctctttcaaaatactaatgacattcctcatagaaacagaaaaaagcaatcctaaaattcatatggaaacacaaaagacttcaaatagccaaagtaatactaagccaaaagaaaaaagctggagtcattacactacttgacttcaaaatatactacaaagctatagtaaccagaacagctttgtattggtgtaaaaacaaatgcatagaccagtggaacagaacatagaacccagaaataaatccacatatttatagccaactgatttttgataagggtgcaaagaacatacattggggaaaggatccttctttaatttgctgagaaagctgggtatctctcaactcaagatgaattaaagacttaaacataatacccgaaactataaaactactagaagagagcataagggaaacacttcaggacattagtctgggcaaaaattgtatgtgtagcacatcaaaagcacaggcaacaaaaaaatagacaaagcagacgatatcaaactaaaaagcttctgcacagcaaaagaaacaatcagagcaaagagacaacctgttgaatgcagaaactatctgcaagctattcatcttacaagggacttgtatatccggaatatacaaggaactcaattcagcagcaaaataataatgataatgtgattttaaaatgggcaaaggatctgaacagacatttctcaaaagaagaagtagaggccgggtgtggtggttcatgcctgtaatcccagcacgttgggaggccgaggtgggtagattgcctgaggtcagggcttcgagaccagcctggccaacatggtgaaaccccatctctactaaaaatacaaaattagctgggtgtggtagcatacacctgtaatcccagctactcgggaggctgaggcaggagaatcacccgaacctgggaggcggaggttgcagtgagccgagaacacaccattgcactccagcctgggcaacaagagtgaaactcngtctc

SEQ ID NO: 17065 - DNA, 681 bp, Homo sapiens
  misc_feature (676)..(676): n is a, c, g, or t
tgaagtgtttccgttatgctctcttctagtagttttatagtttcgggtattacgtttaagtctttaattcatcttgagttgagagatacccagctttctcagcaaattaaagaaggatcctttccccaatgtatgtgtagcacatcaaaagcacaggcaacaaaaaaatagacaaagcagacgatatcaaactaaaaagcttctgcacagcaaaagaaacaatcagagcaaagagacaacctgttgaatgcagaaactatctgcaagctattcatcttacaagggacttgtatatccggaatatacaaggaactcaattcagcagcaaaataataatgataatgtgattttaaaatgggcaaaggatctgaacagacatttctcaaaagaagaagtagaggccgggtgtggtggttcatgcctgtaatcccagcacgttgggaggccgaggtgggtagattgcctgaggtcagggcttcgagaccagcctggccaacatggtgaaaccccatctctactaaaaatacaaaattagctgggtgtggtagcatacacctgtaatcccagctactcgggaggctgaggcaggagaatcacccgaacctgggaggcggaggttgcagtgagccgagaacacaccattgcactccagcctgggcaacaagagtgaaactcngtctc

SEQ ID NO: 17066 - DNA, 320 bp, Homo sapiens
ttcttttttttcatagtgcttagcatactttataagtatatacttacgtgtttaagttttgtctcctatactagactgtaggctccacaagagtacagggattgtgtctcttctgttcatcattacatatccagtgcttagcataggatatgccctgggtaattactgagtggttgaaagaattctgaagctgcccaggtgtggtagctcatgcctgtaatcccagcactttgggaggctgcggtgggaggcttgcttgagctcaggagtttaagaccagcctgggcaacatggtagtgagaccctgtctctctttaaaa

SEQ ID NO: 17067 - DNA, 310 bp, Homo sapiens
gggcttggcgacccttctgtgtccttgcagcgccctactttgccctgggcttcctggctttgggggctcaagttcgtgttcctgggaatccctgcttcttgaccacaaagaatccaggagcctcccagtgagtgtgtaccaaggtggggacagagaatggtggttggctccttccagggcaagggtctgtctggaaggtcaacacccaggagacattttcaatcagctgctgggtgccaagttggaagccaaagattacttgaaataggatttggtgtgtgttttgaataaaagtcgacccgcgagttta

SEQ ID NO: 17068 - DNA, 771 bp, Homo sapiens
tccagttacatgtatgttaagtatcaaaccatttcatgtcgtctcttaggtttcacatgactctacccactccttctcctcccagccctttatagtatagtttggataatttctgttaacctaacttcaacttcactgattatttactatgctaatctgctgataagtcctttgaaagagttcttggcctggggtgatagctcacacctataaacccagcactttgggaggctgaggtgagtggatcacttgaggtcaggagttcaagaccagcctggccaacatggtgaaaccctgtctctactaaaaatacaaaaaattagctgggtgtggtggtgggcacctataatcccagctacttggaaggctgaggcaggagaatcccttgaactcaagaggcagaggttgcagtgagctgagatcatgccattctagcctgggcagcaagagcgaaactccgtctcagaaaaaaaaaaaaaaaaaaaaaaaagaatttcttcctttttttataagagagaaagagttttttttatctcttatactcattttttgattttttaaaaaatttctagcacttacatatacatgcacacccctacacatatactctgtctgtacccaaattccctatctctttgtatacatgatctaccttttgcactacgtgctttaacgtacttttcatggttattttaaaatccctacctaatgattcttacattctgtttgtgcgactgttttcttgaaggcttccttataacaataagttcc

SEQ ID NO: 17069 - DNA, 661 bp, Homo sapiens
aggttaggtcgaaaattatcaatgatgtgtatctttttataatttgctttatggcaaagcaaaaaaactaaacttttaattcccctcattatgacatagttgtaaacaagtgagggatctgtacctctgagcaagcagagattcttaacttttttatgccttggaaccattgttcagtctgaagcccatggtctgcttttcagaataattttttttttattttatttatttatttatttatttatttatttttttgagacagtctcactctcttgaccaggctggagtgcagaggttgcagtgagctgagatcatgccattctagcctgggcagcaagagcgaaactccgtctcagaaaaaaaaaaaaaaaaaaaaaaaagaatttcttcctttttttataagagagaaagagttttttttatctcttatactcattttttgattttttaaaaaatttctagcacttacatatacatgcacacccctacacatatactctgtctgtacccaaattccctatctctttgtatacatgatctaccttttgcactacgtgctttaacgtacttttcatggttattttaaaatccctacctaatgattcttacattctgtttgtgcgactgttttcttgaaggcttccttataacaataagttcc

SEQ ID NO: 17070 - DNA, 395 bp, Homo sapiens
tctcctaaattcctaaattcttggctcaagacccagatcaaaaactgaggacttctgggccaggtgcagtacctcatgcctgtaatcccggtactttgcgaggccgaggcaggaggatcacttttgctcaggagttcgagaccaacctgggcaacatagtgagacccccatctctactaagtaaagaccctgtttttacttttttctactaaaaagtttaaaaatatatatatcagccaggcatggtgtgtgcacctgtagtcctagctacttgggaggctgaggcgggagaatggcttgagtcggggaaatcgagactgcagtgagctttgatcacaccactgcactccagcctgagtgacagagcaagaacctgtcttaaaaacaaaaaaact

SEQ ID NO: 17071 - DNA, 580 bp, Homo sapiens
agctcccggtgacactggagggtcccgcttctcatcactgctgtccccggggttcgatggagctctgcacaagattcctgccctggtggtgggaccacgatgttggggcagtgatgtgggaagatgagaacagggactagagatcagagaggcaggacatctttaaagagcccctcctgcctcactcaggtcttcaggggtctttggcagtatgtgtaatggtagagaccagtgacttgagggccatatgtcccagattcaaatcctggctcctccactaactcagcgtctatacctcacttttcccatctgcaacatgggcatactagcacataccttacagtattgtcatgagttggcccacatagagcacttaggatggcacctgggtcggaggaatcccttgctaactggtggctgtcctgtgctagtaaagaactgtggggatttcattactgaagccggggagaaagcatgaggaagaagcaagcctcccttgcccgtggtaggggtcgcggttccctgccctcatttcttagtagcccttggccgccaccctgagctcatgttttgttagcct

SEQ ID NO: 17072 - DNA, 360 bp, Homo sapiens
tctagtaccactgctttgtgagctatatcgtggctgacatagagctcaagtagggtagaagtgtcggctcggcagattcttgtttatcattgctgttcacttgtgcttgttcaattagtgttatcttctatccacagttcctttggtgggatcttttaaagccaattgtccattttgtgaggattagtttagttaaaaattagattatataatctctaaatccacttaatagggcatgtatgaactgcaattcaggaaaggcgagtgagccccaaagggtgccactgttgaccccttcgtgttagccatgaagctcctatgcctccctcaaaatacttgaggcctatgtgatgtatgagc

SEQ ID NO: 17073 - DNA, 961 bp, Homo sapiens
ggttgccccttaattttcactgagtctcttaaagattattcctgaaatatctctcaaatttgtcttttctgattacaaccttactgacgctgcagtaagttagaaactcaacatctgtagtctaaaccgttaaaatagctgcttgacttttccggtctctgtgtagctctattctctccattttcattaagtttctttgcaaaacacagacatgatactgccaaagtttcgaacaaatacctttagtggcactgagttatctactgttaaatctccagacacctcaagagagcattcaaggttcatgatcttgaaccaatttacttttgggcattctccaaaagaattcccttggtagtaaatagtatccattgctgaggctcttggcaacatttggtgggacaaaggatgggcaatgggcaacaggaagggcattctaaaccttctctccccaccccccctccacttttttagggatggtagatttagagttgggatagagaaagaaaagagagaaaactagccattgaaatttgatctctctctgtgccttgtaaaggaagcctggtccccaggcaaaaaggggtttatttcaagaaggagcagttaccatcttagtttcaaattaaactataaactaaatttctcctaaagtgagttcagcctgtgcccaggaataaacaaggatagtctggaggttagaggcaagatggggtgggttagatcagatctctttcactcccataattttgtcactgttatagtttttgcaaaggtgttttcacaaagcctgcgaggtggttgagaaacagaaagaaggccaatgggcatctgaactgcatagaatagtcagttttattgcttaaaatgtatttgcaagagtaagtctgactatagtaatataaatgactttgcttttttagtttttcaatacttaataataaaatatatcttaatttta

SEQ ID NO: 17074 - DNA, 255 bp, Homo sapiens
tactgggggagtccagcttccttctctgtctcttgagcttactcttttgcctttcaccaagggacaatcctttgcatgtggtgccttctgccctgttatgacacagtaaaaaaatccctcaccagatgtggcccttgatcttggacttcacagccttcagaattattagccaaataaatctcttttctttatagattacctagtctgtggtattctattacagcagcagaaaacagactaagacatttgtattct

SEQ ID NO: 17075 - DNA, 367 bp, Homo sapiens
tgatacctttggggatagaagtatgactccttcttcttcttcctcttcttttttgtttaacttgttatatgttgtatctagttgtgctgaaatagaggatttaatttgcagattaatatgtaaggatgtacattataatgaatttgcattattgtagaagacaatggaggcaatatagagtgtttgtggttcatagtgtggcttctgaggccataccgtcagggtttggctacctgctctaccaactaatagccatagtgtcttggctaagtcacagaacttctaaaatccttagttttcttatctaaaatatcagaataataagggtacctaacttatttttttaatatgcattaaatgagaaaaa

SEQ ID NO: 17076 - DNA, 699 bp, Homo sapiens
gaaaaggccgagacctggacgctgcccggtggcctcggcgggggccctgtccttggccgctgcctctctgaatcccaggtgagaagaataaaacgtcctgacgctgtccggcttccggttcttggagaggacgggccgtctctgccgagagaactgtgcggaatcaggaagcgctggtgctccttcgctttcacgggactaagcgaaatccggctttaaacgaagtaaagccggctgcctcctggagtatttttgtcatagtatttttattttgggtcagggtattctgctgcggaccctgagtcttaggaaggaggcttataacagcggaaagccatttttttttaagaattgctgagttttccggattgtactttcaaagactttccctgaaactttgcgtggcatgggggttgcagaaactggtgtctacacattacaaaagtgtactgtttacacctatttgtgatgcacccatcgtgtttttctccatggaccacctattaagcttcctgctggagcgctcttggcccccttcctgctttctgggccacatcctgttgtaaatcggtgctacttgtggggttttgtttgtgaattggggatatttaaggaacaatttattgaaacaactgaagagtttgtttcctcctttgggttttacttttaaaataaattcggttaggaaaaagtaaaaaa

SEQ ID NO: 17077 - DNA, 4037 bp, Homo sapiens
ggtgtgacgtaggaggaaggagacgccattagagggaggcagagagggatcgttcttcgcttttcctccggtgcctgacgtggtgggctggggcccttcattctcggactttccctcagcccttccaggcctcgcccgaggagggcgtggggacagcgcccgggtcggcggggccggggcggtgggggctgagccggccgtggctgtgaaggcgctgccgcggctgtcgggagggcggcgcgacactcgggctcgggcggccgggaagcgacgggatggctgcggccggcggcggcggcggcggggcggcggcggcgggccgagcctactcgttcaaggtggtgctgctgggggaaggctgcgtggggaagacgtcgctggtgctgcgctactgcgagaacaagtttaacgacaagcacatcaccactctgcaggcatcattcttaacaaagaagttaaatattggtgggaaaagagtaaaccttgccatatgggatacggcaggtcaagagagattccatgcattgggtccaatttactacagagattcaaatggagcgattttagtttatgacataacagatgaagattcttttcagaaggtaaaaaactgggtcaaagaattacggaaaatgttgggaaatgaaatctgtttatgtatagttggtaataaaatagacttggaaaaggagagacatgtttccattcaagaagcagagtcgtatgcagaatctgtgggagcaaaacattatcatacttcagccaaacagaacaaaggaattgaggaactctttcttgacctttgtaaaaggatgatagaaacagcacaagtggatgagagagcaaaaggcaatggctctagtcagccgggaactgcaaggcgaggtgtacagattattgatgatgaacctcaagcccagaccagtggtggagggtgctgttcttctggataactgttcacgcctaagaaattaaaagacagaacaaaactgtggatcattgccctcaacatgaagactgccatattccaagtcacattattttaccaatggaattatagaattaacagtattttaaattacgtttataacactgcagagaccttaagtgctaaacttagtggagtttgtgaccagagaattggcattttctacaaatgtttttttttgttttttttttgtttttttttgttttttttttgagacggagtctcgctctgtcacccaggctggagtgcactggcttgatctcggctcactgcaagctccacctcccaggttcacgccattctcctgcctcagcctcccgagtagctgggactataggcgcccaccacgacgcccggctaattttttgtatttttagtagagacggggtttcaccaggttagccaggatggtctcgatctcctgaccttgtgatccgcccgcctcggcctcccaaagtgctgggattacaggcgtgagccaccgtgcccggcctacaaatgttaacaaagcaattaccaatggcctttttacatattttttctttaatgaggaataatatgcatgtagaaaagacctacttaaagtcttcatttatattctttcaaatcaaatctttatttaataacttatatatgttgttggaatggttacatttttgcagccctttgtattttgtggtagttgaaattgtatcacttctaaacagcaaactgtttttgtttttaattagcagatatctgaagtactatttttgcagggtttgcacaggcccgtaactgtctactactttgatataatctgtatacatcctgtatgctgagctggtaaaatacattgtaaattacatattaaatattttatctgcttttacaagcgcaaggtgcaaaaatatatacaatagtctcattgatgactgtaaagtgaattaacatttggtgattatgcctagcttttttgactaatataaagatcatagctccccttcacttctgtcttaacttgaacatggcgtgtttaaattttcatacatactttacttgaattattgctgttgtcacatatttttgcctctgtgagttcatctgatgattgagcagtagcatttgccttttgggttttttgtttgttattatagaagagatgacttctgctgattttgctttagaatggttaccttagaagaatttgggtggctcatgttgaatttcacttctgcaatagctttcattttctcataggctttataagagatgggttcagtggtatgagcagaggaagagatcccagatagtagccagttaaccaagactcattcatatagcacgtagtttatgttcctgaggcagcacttttagatcctttgtgagcaagttctatttgttcattgcttgccagagatgaacacagaatgttctgtttcattttacaagaactatcctgagtttctgtggatggaaacattacatgtaatgcagatatagtgaacactggaaagatttattaaagaattatatttgtgtatactttataaattagtccctcattagatttttttttcttaagcataagactgaacttaaatgtgttaattttagtagaatcaggcactgctcgcagaaggaacacagattgtagagattaacataaattgttcttgttctaatatatatattttttcatttctgtcgtgcttggaaaactagtaaatattatgtctaagataaaatggaatggcccctggatttacttcttataagaagcagtagtatgtaataaagctattagcatgagcaattaagaggctataaagagattatagttacaaaagaaatactgccatatttttaagttaataacttaaaccttctcaaatgggttaaaagttgaatgaattgacaccctgatgttatgatgttggaattttaacttaaactgggaggcattctgtgagccttcactttaccttctttaattattgtccttgctaaactcaacacagacttttctgttatgtgtttttgaggaagttggggtgggaagagtcagggagataagctaaaattgtcttcttttatggggtaattgtactctgtagtctcttggtttcctgtgaagttagtatttatgtgggggtgggggaaggtagcaagaatcatgggtatcacggtactttgtttttgacctcctggctctttcagacagagtgaagaaagcttttccattcttactgttgtagaagtagataggaaataagcttttctcattacagtgaaatatgttttaaaaactagagtagctgggcacagaggcatgcatttgtagggccagctacttgggagagtgaggcaggaggatcacttgaggccaggatttcaaatccagcctaggtaacactgagacctccatctcgtaaaagacacaaaaactagttagagatgaaattgagctttattttaaaaaaacgttctaaagcctgataattggagagctatacttcagcttttcatcctactttaatgaaacagctagataggaacctctgctccagaattgccagataattattggtgggtcataactattcttcatattttttttttcttttttctcctttggtttctgtgttatctttcttaacctcacgtatttctttatcctttttagtgggggcctgtaattgaggctaattcaatagcaacaatagacaacatgatatggctgctgtcactttgaaacccaaaaggtctttgggtaggaatagagtaatgaaagaggaccagtcaacttcagtatatatacaaaggaaagacaaagagatgataaaccaaggctgaggaaatttttctgatgctttcttcatttctctaatataccttttgcattctttttctgataattgtgctattaggcagaagacacaagttaccacgttgtgtattaaaagcagtaggtaggttgtgccagtattttttcagccagtaagcatatacagttaacttatataattaaaaattggtttaagatagtgattaaaaatacctgaatatt

SEQ ID NO: 17078 - DNA, 967 bp, Homo sapiens
ccacgcgtccgcggacgcgtggggcaaaattttcctagttgtaatattttaatagtgttatgtattggaaaaaatttagaaatactcctaagagttttcaatttcaagcagaaatgcttctcttctaaataaataccacttaattgatagacctttagcagttcttgtgctatctaggatttatacatttttgcttttctggaaaactgctttggcgcattaacctttctactgcaacattttctcttcagtagatatatgagtaaacatgatgagttaatgttacacagcatacccagttaggtctcttattcttaaagcatctttctttagaagtctgcacatattttcaaatgcatcatattaaaggcacaagttaagaggaggtggagttgcctacttcagtggcctttattcccactataccagttctcagtcttgattttgatactttctggcaactgtatcatctcttcactatcaagtattttaagaaaaagctaaggtgatttctttacatttgaacatgtgtagatcaatgagagaatggtgagggatagcaaggataaagtataatgttgaaaagtagaaagaagtggtatctgctaaactctagctttagtagcaagctattttaaggaaatcattgtatgtggtacttcctagaaatatgaaagttcctcattttgtatttaattatgtaagaaaatgttctaggaaaagaataaaaaacatatattgtcaaagtgccctttggtagtgctcccaaatggtagtaactattggtctctagtatatactcctcaaatatctttttgctatgtattaatatatctatatgtttacatatagaaatacatagtgttgtgggttttaaattttcccataaattgtgtcttacccatgtgttttgccatttgccttttctcttgccaacgtgtctaggagctctttggtaaatacagac

SEQ ID NO: 17079 - DNA, 6104 bp, Homo sapiens
ggtgtgacgtaggaggaaggagacgccattagagggaggcagagagggatcgttcttcgcttttcctccggtgcctgacgtggtgggctggggcccttcattctcggactttccctcagcccttccaggcctcgcccgaggagggcgtggggacagcgcccgggtcggcggggccggggcggtgggggctgagccggccgtggctgtgaaggcgctgccgcggctgtcgggagggcggcgcgacactcgggctcgggcggccgggaagcgacgggatggctgcggccggcggcggcggcggcggggcggcggcggcgggccgagcctactcgttcaaggtggtgctgctgggggaaggctgcgtggggaagacgtcgctggtgctgcgctactgcgagaacaagtttaacgacaagcacatcaccactctgcaggcatcattcttaacaaagaagttaaatattggtgggaaaagagtaaaccttgccatatgggatacggcaggtcaagagagattccatgcattgggtccaatttactacagagattcaaatggagcgattttagtttatgacataacagatgaagattcttttcagaaggtaaaaaactgggtcaaagaattacggaaaatgttgggaaatgaaatctgtttatgtatagttggtaataaaatagacttggaaaaggagagacatgtttccattcaagaagcagagtcgtatgcagaatctgtgggagcaaaacattatcatacttcagccaaacagaacaaaggaattgaggaactctttcttgacctttgtaaaaggatgatagaaacagcacaagtggatgagagagcaaaaggcaatggctctagtcagccgggaactgcaaggcgaggtgtacagattattgatgatgaacctcaagcccagaccagtggtggagggtgctgttcttctggataactgttcacgcctaagaaattaaaagacagaacaaaactgtggatcattgccctcaacatgaagactgccatattccaagtcacattattttaccaatggaattatagaattaacagtattttaaattacgtttataacactgcagagaccttaagtgctaaacttagtggagtttgtgaccagagaattggcattttctacaaatgtttttttttgttttttttttgtttttttttgttttttttttgagacggagtctcgctctgtcacccaggctggagtgcactggcttgatctcggctcactgcaagctccacctcccaggttcacgccattctcctgcctcagcctcccgagtagctgggactataggcgcccaccacgacgcccggctaattttttgtatttttagtagagacggggtttcaccaggttagccaggatggtctcgatctcctgaccttgtgatccgcccgcctcggcctcccaaagtgctgggattacaggcgtgagccaccgtgcccggcctacaaatgttaacaaagcaattaccaatggcctttttacatattttttctttaatgaggaataatatgcatgtagaaaagacctacttaaagtcttcatttatattctttcaaatcaaatctttatttaataacttatatatgttgttggaatggttacatttttgcagccctttgtattttgtggtagttgaaattgtatcacttctaaacagcaaactgtttttgtttttaattagcagatatctgaagtactatttttgcagggtttgcacaggcccgtaactgtctactactttgatataatctgtatacatcctgtatgctgagctggtaaaatacattgtaaattacatattaaatattttatctgcttttacaagcgcaaggtgcaaaaatatatacaatagtctcattgatgactgtaaagtgaattaacatttggtgattatgcctagcttttttgactaatataaagatcatagctccccttcacttctgtcttaacttgaacatggcgtgtttaaattttcatacatactttacttgaattattgctgttgtcacatatttttgcctctgtgagttcatctgatgattgagcagtagcatttgccttttgggttttttgtttgttattatagaagagatgacttctgctgattttgctttagaatggttaccttagaagaatttgggtggctcatgttgaatttcacttctgcaatagctttcattttctcataggctttataagagatgggttcagtggtatgagcagaggaagagatcccagatagtagccagttaaccaagactcattcatatagcacgtagtttatgttcctgaggcagcacttttagatcctttgtgagcaagttctatttgttcattgcttgccagagatgaacacagaatgttctgtttcattttacaagaactatcctgagtttctgtggatggaaacattacatgtaatgcagatatagtgaacactggaaagatttattaaagaattatatttgtgtatactttataaattagtccctcattagatttttttttcttaagcataagactgaacttaaatgtgttaattttagtagaatcaggcactgctcgcagaaggaacacagattgtagagattaacataaattgttcttgttctaatatatatattttttcatttctgtcgtgcttggaaaactagtaaatattatgtctaagataaaatggaatggcccctggatttacttcttataagaagcagtagtatgtaataaagctattagcatgagcaattaagaggctataaagagattatagttacaaaagaaatactgccatatttttaagttaataacttaaaccttctcaaatgggttaaaagttgaatgaattgacaccctgatgttatgatgttggaattttaacttaaactgggaggcattctgtgagccttcactttaccttctttaattattgtccttgctaaactcaacacagacttttctgttatgtgtttttgaggaagttggggtgggaagagtcagggagataagctaaaattgtcttcttttatggggtaattgtactctgtagtctcttggtttcctgtgaagttagtatttatgtgggggtgggggaaggtagcaagaatcatgggtatcacggtactttgtttttgacctcctggctctttcagacagagtgaagaaagcttttccattcttactgttgtagaagtagataggaaataagcttttctcattacagtgaaatatgttttaaaaactagagtagctgggcacagaggcatgcatttgtagggccagctacttgggagagtgaggcaggaggatcacttgaggccaggatttcaaatccagcctaggtaacactgagacctccatctcgtaaaagacacaaaaactagttagagatgaaattgagctttattttaaaaaaacgttctaaagcctgataattggagagctatacttcagcttttcatcctactttaatgaaacagctagataggaacctctgctccagaattgccagataattattggtgggtcataactattcttcatattttttttttcttttttctcctttggtttctgtgttatctttcttaacctcacgtatttctttatcctttttagtgggggcctgtaattgaggctaattcaatagcaacaatagacaacatgatatggctgctgtcactttgaaacccaaaaggtctttgggtaggaatagagtaatgaaagaggaccagtcaacttcagtatatatacaaaggaaagacaaagagatgataaaccaaggctgaggaaatttttctgatgctttcttcatttctctaatataccttttgcattctttttctgataattgtgctattaggcagaagacacaagttaccacgttgtgtattaaaagcagtaggtaggttgtgccagtattttttcagccagtaagcatatacagttaacttatataattaaaaattggtttaagatagtgattaaaaatacctgaatattatgttaaaagtatacaatcattgtttctgtaatgatgatgggtattctgcttcttgtttttcattgtaattacaggggaagattgtttttgaaaatgtatattgccatgcttttggggtaagcagtaatgtgaaaagaaaaaagcattatgttattgtatgaaatataagtgttcagatttgttttgtctggggtgttgcctaagaataccctaaagctatggctgttactgcattgaaatcttttttttttttaatagtagccatatgttattagtggagtactttatatttgacattaaagtgaagaagaagagtagtacttcacttttaggtttttagtagtgaaagataaaattggaaaaatagggaaagagcatagggaggaatagaatggaagtcaagtaaataaaaaactacaacctgacagttttttaaatcactttgaaaagtacattacttttatcaaagagtttctaattaaggcaaactatgcattatgccaaatattaagaacattttaaaaatggattgtgatactgtttatttctttaattatataatttgcaattttctgtattataagtgctaccaggattctagatagttgatcttacatattcagatagtatagtttactcttataattacccgttacgttatctctaaaagtagtttgatctgtgcctttaacttttagaattcatcttttgacttgtttgccactgtagagttttcagttttctctgtagattcagtgtgacaaagagggaatacataatttgtgaccatttaagatgctgatattttctggaaaaggatatagatagtagtagtgacccgcaggagcctcacaataatgtctaaagatataaactgagtagatccctaagtactcttctctaaattataaaatgcattacctaggctttaatagttaaaagctggaatttattgaaccgcatctacttgatttcataatatgcattgattttagtatgttgctgttctgttatctgtaatcaactataacagagtaatatatttggtgttctggaccaaaattcgtgctacacatatgtctgatggcctttaccttttcaagaaaacagttgcaattttgagcaaaattttcctagttgtaatattttaatagtgttatgtattggaaaaaatttagaaatactcctaagagttttcaatttcaagcagaaatgcttctcttctaaataaataccacttaattgatagacctttagcagttcttgtgctatctaggatttatacatttttgcttttctggaaaactgctttggcgcattaacctttctactgcaacattttctcttcagtagatatatgagtaaacatgatgagttaatgttacacagcatacccagttaggtctcttattcttaaagcatctttctttagaagtctgcacatattttcaaatgcatcatattaaaggcacaagttaagaggaggtggagttgcctacttcagtggcctttattcccactataccagttctcagtcttgattttgatactttctggcaactgtatcatctcttcactatcaagtattttaagaaaaagctaaggtgatttctttacatttgaacatgtgtagatcaatgagagaatggtgagggatagcaaggataaagtataatgttgaaaagtagaaagaagtggtatctgctaaactctagctttagtagcaagctattttaaggaaatcattgtatgtggtacttcctagaaatatgaaagttcctcattttgtatttaattatgtaagaaaatgttctaggaaaagaataaaaaacatatattgtcaaagtgccctttggtagtgctcccaaatggtagtaactattggtctctagtatatactcctcaaatatctttttgctatgtattaatatatctatatgtttacatatagaaatacatagtgttgtgggttttaaattttcccataaattgtgtcttacccatgtgttttgccatttgccttttctcttgccaacgtgtctaggagctctttggtaaatacagac

SEQ ID NO: 17080 - DNA, 5093 bp, Homo sapiens
ggtgtgacgtaggaggaaggagacgccattagagggaggcagagagggatcgttcttcgcttttcctccggtgcctgacgtggtgggctggggcccttcattctcggactttccctcagcccttccaggcctcgcccgaggagggcgtggggacagcgcccgggtcggcggggccggggcggtgggggctgagccggccgtggctgtgaaggcgctgccgcggctgtcgggagggcggcgcgacactcgggctcgggcggccgggaagcgacgggatggctgcggccggcggcggcggcggcggggcggcggcggcgggccgagcctactcgttcaaggtggtgctgctgggggaaggctgcgtggggaagacgtcgctggtgctgcgctactgcgagaacaagtttaacgacaagcacatcaccactctgcaggcatcattcttaacaaagaagttaaatattggtgggaaaagagtaaaccttgccatatgggatacggcaggtcaagagagattccatgcattgggtccaatttactacagagattcaaatggagcgattttagtttatgacataacagatgaagattcttttcagaaggtaaaaaactgggtcaaagaattacggaaaatgttgggaaatgaaatctgtttatgtatagttggtaataaaatagacttggaaaaggagagacatgtttccattcaagaagcagagtcgtatgcagaatctgtgggagcaaaacattatcatacttcagccaaacagaacaaaggaattgaggaactctttcttgacctttgtaaaaggatgatagaaacagcacaagtggatgagagagcaaaaggcaatggctctagtcagccgggaactgcaaggcgaggtgtacagattattgatgatgaacctcaagcccagaccagtggtggagggtgctgttcttctggataactgttcacgcctaagaaattaaaagacagaacaaaactgtggatcattgccctcaacatgaagactgccatattccaagtcacattattttaccaatggaattatagaattaacagtattttaaattacgtttataacactgcagagaccttaagtgctaaacttagtggagtttgtgaccagagaattggcattttctacaaatgtttttttttgttttttttttgtttttttttgttttttttttgagacggagtctcgctctgtcacccaggctggagtgcactggcttgatctcggctcactgcaagctccacctcccaggttcacgccattctcctgcctcagcctcccgagtagctgggactataggcgcccaccacgacgcccggctaattttttgtatttttagtagagacggggtttcaccaggttagccaggatggtctcgatctcctgaccttgtgatccgcccgcctcggcctcccaaagtgctgggattacaggcgtgagccaccgtgcccggcctacaaatgttaacaaagcaattaccaatggcctttttacatattttttctttaatgaggaataatatgcatgtagaaaagacctacttaaagtcttcatttatattctttcaaatcaaatctttatttaataacttatatatgttgttggaatggttacatttttgcagccctttgtattttgtggtagttgaaattgtatcacttctaaacagcaaactgtttttgtttttaattagcagatatctgaagtactatttttgcagggtttgcacaggcccgtaactgtctactactttgatataatctgtatacatcctgtatgctgagctggtaaaatacattgtaaattacatattaaatattttatctgcttttacaagcgcaaggtgcaaaaatatatacaatagtctcattgatgactgtaaagtgaattaacatttggtgattatgcctagcttttttgactaatataaagatcatagctccccttcacttctgtcttaacttgaacatggcgtgtttaaattttcatacatactttacttgaattattgctgttgtcacatatttttgcctctgtgagttcatctgatgattgagcagtagcatttgccttttgggttttttgtttgttattatagaagagatgacttctgctgattttgctttagaatggttaccttagaagaatttgggtggctcatgttgaatttcacttctgcaatagctttcattttctcataggctttataagagatgggttcagtggtatgagcagaggaagagatcccagatagtagccagttaaccaagactcattcatatagcacgtagtttatgttcctgaggcagcacttttagatcctttgtgagcaagttctatttgttcattgcttgccagagatgaacacagaatgttctgtttcattttacaagaactatcctgagtttctgtggatggaaacattacatgtaatgcagatatagtgaacactggaaagatttattaaagaattatatttgtgtatactttataaattagtccctcattagatttttttttcttaagcataagactgaacttaaatgtgttaattttagtagaatcaggcactgctcgcagaaggaacacagattgtagagattaacataaattgttcttgttctaatatatatattttttcatttctgtcgtgcttggaaaactagtaaatattatgtctaagataaaatggaatggcccctggatttacttcttataagaagcagtagtatgtaataaagctattagcatgagcaattaagaggctataaagagattatagttacaaaagaaatactgccatatttttaagttaataacttaaaccttctcaaatgggttaaaagttgaatgaattgacaccctgatgttatgatgttggaattttaacttaaactgggaggcattctgtgagccttcactttaccttctttaattattgtccttgctaaactcaacacagacttttctgttatgtgtttttgaggaagttggggtgggaagagtcagggagataagctaaaattgtcttcttttatggggtaattgtactctgtagtctcttggtttcctgtgaagttagtatttatgtgggggtgggggaaggtagcaagaatcatgggtatcacggtactttgtttttgacctcctggctctttcagacagagtgaagaaagcttttccattcttactgttgtagaagtagataggaaataagcttttctcattacagtgaaatatgttttaaaaactagagtagctgggcacagaggcatgcatttgtagggccagctacttgggagagtgaggcaggaggatcacttgaggccaggatttcaaatccagcctaggtaacactgagacctccatctcgtaaaagacacaaaaactagttagagatgaaattgagctttattttaaaaaaacgttctaaagcctgataattggagagctatacttcagcttttcatcctactttaatgaaacagctagataggaacctctgctccagaattgccagataattattggtgggtcataactattcttcatattttttttttcttttttctcctttggtttctgtgttatctttcttaacctcacgtatttctttatcctttttagtgggggcctgtaattgaggctaattcaatagcaacaatagacaacatgatatggctgctgtcactttgaaacccaaaaggtctttgggtaggaatagagtaatgaaagaggaccagtcaacttcagtatatatacaaaggaaagacaaagagatgataaaccaaggctgaggaaatttttctgatgctttcttcatttctctaatataccttttgcattctttttctgataattgtgctattaggcagaagacacaagttaccacgttgtgtattaaaagcagtaggtaggttgtgccagtattttttcagccagtaagcatatacagttaacttatataattaaaaattggtttaagatagtgattaaaaatacctgaatattatgttaaaagtatacaatcattgtttctgtaatgatgatgggtattctgcttcttgtttttcattgtaattacaggggaagattgtttttgaaaatgtatattgccatgcttttggggtaagcagtaatgtgaaaagaaaaaagcattatgttattgtatgaaatataagtgttcagatttgttttgtctggggtgttgcctaagaataccctaaagctatggctgttactgcattgaaatcttttttttttttaatagtagccatatgttattagtggagtactttatatttgacattaaagtgaagaagaagagtagtacttcacttttaggtttttagtagtgaaagataaaattggaaaaatagggaaagagcatagggaggaatagaatggaagtcaagtaaataaaaaactacaacctgacagttttttaaatcactttgaaaagtacattacttttatcaaagagtttctaattaaggcaaactatgcattatgccaaatattaagaacattttaaaaatggattgtgatactgtttatttctttaattatataatttgcaattttctgtattataagtgctaccaggattctagatagttgatcttacatattcagatagtatagtttactcttataattacccgttacgttatctctaaaagtagtttgatctgtgcctttaacttttagaattcatcttttgacttgtttgccactgtagagttttcagttttctctgtagattcagtgtgacaaagagggaatacataatttgtgaccatttaagatgctgatattttctggaaaaggatatagatagtagtagtgacccgcaggagcctcacaataatgtctaaagatataaactgagtagatccctaagtactcttctctaaattataaaatgcattacctaggctttaatagttaaaagctggaatttattgaaccgcatctacttgatttcataatatgcattgattttagtatgttgctgttctgttatctgtaatcaactataacagagtaatatatttggtgttctgg

SEQ ID NO: 17081 - DNA, 2712 bp, Homo sapiens
ggtgtgacgtaggaggaaggagacgccattagagggaggcagagagggatcgttcttcgcttttcctccggtgcctgacgtggtgggctggggcccttcattctcggactttccctcagcccttccaggcctcgcccgaggagggcgtggggacagcgcccgggtcggcggggccggggcggtgggggctgagccggccgtggctgtgaaggcgctgccgcggctgtcgggagggcggcgcgacactcgggctcgggcggccgggaagcgacgggatggctgcggccggcggcggcggcggcggggcggcggcggcgggccgagcctactcgttcaaggtggtgctgctgggggaaggctgcgtggggaagacgtcgctggtgctgcgctactgcgagaacaagtttaacgacaagcacatcaccactctgcaggcatcattcttaacaaagaagttaaatattggtgggaaaagagtaaaccttgccatatgggatacggcaggtcaagagagattccatgcattgggtccaatttactacagagattcaaatggagcgattttagtttatgacataacagatgaagattcttttcagaaggtaaaaaactgggtcaaagaattacggaaaatgttgggaaatgaaatctgtttatgtatagttggtaataaaatagacttggaaaaggagagacatgtttccattcaagaagcagagtcgtatgcagaatctgtgggagcaaaacattatcatacttcagccaaacagaacaaaggaattgaggaactctttcttgacctttgtaaaaggatgatagaaacagcacaagtggatgagagagcaaaaggcaatggctctagtcagccgggaactgcaaggcgaggtgtacagattattgatgatgaacctcaagcccagaccagtggtggagggtgctgttcttctggataactgttcacgcctaagaaattaaaagacagaacaaaactgtggatcattgccctcaacatgaagactgccatattccaagtcacattattttaccaatggaattatagaattaacagtattttaaattacgtttataacactgcagagaccttaagtgctaaacttagtggagtttgtgaccagagaattggcattttctacaaatgtttttttttgttttttttttgtttttttttgttttttttttgagacggagtctcgctctgtcacccaggctggagtgcactggcttgatctcggctcactgcaagctccacctcccaggttcacgccattctcctgcctcagcctcccgagtagctgggactataggcgcccaccacgacgcccggctaattttttgtatttttagtagagacggggtttcaccaggttagccaggatggtctcgatctcctgaccttgtgatccgcccgcctcggcctcccaaagtgctgggattacaggcgtgagccaccgtgcccggcctacaaatgttaacaaagcaattaccaatggcctttttacatattttttctttaatgaggaataatatgcatgtagaaaagacctacttaaagtcttcatttatattctttcaaatcaaatctttatttaataacttatatatgttgttggaatggttacatttttgcagccctttgtattttgtggtagttgaaattgtatcacttctaaacagcaaactgtttttgtttttaattagcagatatctgaagtactatttttgcagggtttgcacaggcccgtaactgtctactactttgatataatctgtatacatcctgtatgctgagctggtaaaatacattgtaaattacatattaaatattttatctgcttttacaagcgcaaggtgcaaaaatatatacaatagtctcattgatgactgtaaagtgaattaacatttggtgattatgcctagcttttttgactaatataaagatcatagctccccttcacttctgtcttaacttgaacatggcgtgtttaaattttcatacatactttacttgaattattgctgttgtcacatatttttgcctctgtgagttcatctgatgattgagcagtagcatttgccttttgggttttttgtttgttattatagaagagatgacttctgctgattttgctttagaatggttaccttagaagaatttgggtggctcatgttgaatttcacttctgcaatagctttcattttctcataggctttataagagatgggttcagtggtatgagcagaggaagagatcccagatagtagccagttaaccaagactcattcatatagcacgtagtttatgttcctgaggcagcacttttagatcctttgtgagcaagttctatttgttcattgcttgccagagatgaacacagaatgttctgtttcattttacaagaactatcctgagtttctgtggatggaaacattacatgtaatgcagatatagtgaacactggaaagatttattaaagaattatatttgtgtatactttataaattagtccctcattagatttttttttcttaagcataagactgaacttaaatgtgttaattttagtagaatcaggcactgctcgcagaaggaacacagattgtagagattaacataaattgttcttgttctaatatatatattttttcatttctgtcgtgcttggaaaactagtaaatattatgtctaagata

SEQ ID NO: 17082 - DNA, 6111 bp, Homo sapiens
ggtgtgacgtaggaggaaggagacgccattagagggaggcagagagggatcgttcttcgcttttcctccggtgcctgacgtggtgggctggggcccttcattctcggactttccctcagcccttccaggcctcgcccgaggagggcgtggggacagcgcccgggtcggcggggccggggcggtgggggctgagccggccgtggctgtgaaggcgctgccgcggctgtcgggagggcggcgcgacactcgggctcgggcggccgggaagcgacgggatggctgcggccggcggcggcggcggcggggcggcggcggcgggccgagcctactcgttcaaggtggtgctgctgggggaaggctgcgtggggaagacgtcgctggtgctgcgctactgcgagaacaagtttaacgacaagcacatcaccactctgcaggcatcattcttaacaaagaagttaaatattggtgggaaaagagtaaaccttgccatatgggatacggcaggtcaagagagattccatgcattgggtccaatttactacagagattcaaatggagcgattttagtttatgacataacagatgaagattcttttcagaaggtaaaaaactgggtcaaagaattacggaaaatgttgggaaatgaaatctgtttatgtatagttggtaataaaatagacttggaaaaggagagacatgtttccattcaagaagcagagtcgtatgcagaatctgtgggagcaaaacattatcatacttcagccaaacagaacaaaggaattgaggaactctttcttgacctttgtaaaaggatgatagaaacagcacaagtggatgagagagcaaaaggcaatggctctagtcagccgggaactgcaaggcgaggtgtacagattattgatgatgaacctcaagcccagaccagtggtggagggtgctgttcttctggataactgttcacgcctaagaaattaaaagacagaacaaaactgtggatcattgccctcaacatgaagactgccatattccaagtcacattattttaccaatggaattatagaattaacagtattttaaattacgtttataacactgcagagaccttaagtgctaaacttagtggagtttgtgaccagagaattggcattttctacaaatgttcacaatggtaaaactaacagcgtgaatcacatgcggtacacttttggaaacggagtctcgctctgtcacccaggctggagtgcactggcttgatctcggctcactgcaagctccacctcccaggttcacgccattctcctgcctcagcctcccgagtagctgggactataggcgcccaccacgacgcccggctaattttttgtatttttagtagagacggggtttcaccaggttagccaggatggtctcgatctcctgaccttgtgatccgcccgcctcggcctcccaaagtgctgggattacaggcgtgagccaccgtgcccggcctacaaatgttaacaaagcaattaccaatggcctttttacatattttttctttaatgaggaataatatgcatgtagaaaagacctacttaaagtcttcatttatattctttcaaatcaaatctttatttaataacttatatatgttgttggaatggttacatttttgcagccctttgtattttgtggtagttgaaattgtatcacttctaaacagcaaactgtttttgtttttaattagcagatatctgaagtactatttttgcagggtttgcacaggcccgtaactgtctactactttgatataatctgtatacatcctgtatgctgagctggtaaaatacattgtaaattacatattaaatattttatctgcttttacaagcgcaaggtgcaaaaatatatacaatagtctcattgatgactgtaaagtgaattaacatttggtgattatgcctagcttttttgactaatataaagatcatagctccccttcacttctgtcttaacttgaacatggcgtgtttaaattttcatacatactttacttgaattattgctgttgtcacatatttttgcctctgtgagttcatctgatgattgagcagtagcatttgccttttgggttttttgtttgttattatagaagagatgacttctgctgattttgctttagaatggttaccttagaagaatttgggtggctcatgttgaatttcacttctgcaatagctttcattttctcataggctttataagagatgggttcagtggtatgagcagaggaagagatcccagatagtagccagttaaccaagactcattcatatagcacgtagtttatgttcctgaggcagcacttttagatcctttgtgagcaagttctatttgttcattgcttgccagagatgaacacagaatgttctgtttcattttacaagaactatcctgagtttctgtggatggaaacattacatgtaatgcagatatagtgaacactggaaagatttattaaagaattatatttgtgtatactttataaattagtccctcattagatttttttttcttaagcataagactgaacttaaatgtgttaattttagtagaatcaggcactgctcgcagaaggaacacagattgtagagattaacataaattgttcttgttctaatatatatattttttcatttctgtcgtgcttggaaaactagtaaatattatgtctaagataaaatggaatggcccctggatttacttcttataagaagcagtagtatgtaataaagctattagcatgagcaattaagaggctataaagagattatagttacaaaagaaatactgccatatttttaagttaataacttaaaccttctcaaatgggttaaaagttgaatgaattgacaccctgatgttatgatgttggaattttaacttaaactgggaggcattctgtgagccttcactttaccttctttaattattgtccttgctaaactcaacacagacttttctgttatgtgtttttgaggaagttggggtgggaagagtcagggagataagctaaaattgtcttcttttatggggtaattgtactctgtagtctcttggtttcctgtgaagttagtatttatgtgggggtgggggaaggtagcaagaatcatgggtatcacggtactttgtttttgacctcctggctctttcagacagagtgaagaaagcttttccattcttactgttgtagaagtagataggaaataagcttttctcattacagtgaaatatgttttaaaaactagagtagctgggcacagaggcatgcatttgtagggccagctacttgggagagtgaggcaggaggatcacttgaggccaggatttcaaatccagcctaggtaacactgagacctccatctcgtaaaagacacaaaaactagttagagatgaaattgagctttattttaaaaaaacgttctaaagcctgataattggagagctatacttcagcttttcatcctactttaatgaaacagctagataggaacctctgctccagaattgccagataattattggtgggtcataactattcttcatattttttttttcttttttctcctttggtttctgtgttatctttcttaacctcacgtatttctttatcctttttagtgggggcctgtaattgaggctaattcaatagcaacaatagacaacatgatatggctgctgtcactttgaaacccaaaaggtctttgggtaggaatagagtaatgaaagaggaccagtcaacttcagtatatatacaaaggaaagacaaagagatgataaaccaaggctgaggaaatttttctgatgctttcttcatttctctaatataccttttgcattctttttctgataattgtgctattaggcagaagacacaagttaccacgttgtgtattaaaagcagtaggtaggttgtgccagtattttttcagccagtaagcatatacagttaacttatataattaaaaattggtttaagatagtgattaaaaatacctgaatattatgttaaaagtatacaatcattgtttctgtaatgatgatgggtattctgcttcttgtttttcattgtaattacaggggaagattgtttttgaaaatgtatattgccatgcttttggggtaagcagtaatgtgaaaagaaaaaagcattatgttattgtatgaaatataagtgttcagatttgttttgtctggggtgttgcctaagaataccctaaagctatggctgttactgcattgaaatcttttttttttttaatagtagccatatgttattagtggagtactttatatttgacattaaagtgaagaagaagagtagtacttcacttttaggtttttagtagtgaaagataaaattggaaaaatagggaaagagcatagggaggaatagaatggaagtcaagtaaataaaaaactacaacctgacagttttttaaatcactttgaaaagtacattacttttatcaaagagtttctaattaaggcaaactatgcattatgccaaatattaagaacattttaaaaatggattgtgatactgtttatttctttaattatataatttgcaattttctgtattataagtgctaccaggattctagatagttgatcttacatattcagatagtatagtttactcttataattacccgttacgttatctctaaaagtagtttgatctgtgcctttaacttttagaattcatcttttgacttgtttgccactgtagagttttcagttttctctgtagattcagtgtgacaaagagggaatacataatttgtgaccatttaagatgctgatattttctggaaaaggatatagatagtagtagtgacccgcaggagcctcacaataatgtctaaagatataaactgagtagatccctaagtactcttctctaaattataaaatgcattacctaggctttaatagttaaaagctggaatttattgaaccgcatctacttgatttcataatatgcattgattttagtatgttgctgttctgttatctgtaatcaactataacagagtaatatatttggtgttctggaccaaaattcgtgctacacatatgtctgatggcctttaccttttcaagaaaacagttgcaattttgagcaaaattttcctagttgtaatattttaatagtgttatgtattggaaaaaatttagaaatactcctaagagttttcaatttcaagcagaaatgcttctcttctaaataaataccacttaattgatagacctttagcagttcttgtgctatctaggatttatacatttttgcttttctggaaaactgctttggcgcattaacctttctactgcaacattttctcttcagtagatatatgagtaaacatgatgagttaatgttacacagcatacccagttaggtctcttattcttaaagcatctttctttagaagtctgcacatattttcaaatgcatcatattaaaggcacaagttaagaggaggtggagttgcctacttcagtggcctttattcccactataccagttctcagtcttgattttgatactttctggcaactgtatcatctcttcactatcaagtattttaagaaaaagctaaggtgatttctttacatttgaacatgtgtagatcaatgagagaatggtgagggatagcaaggataaagtataatgttgaaaagtagaaagaagtggtatctgctaaactctagctttagtagcaagctattttaaggaaatcattgtatgtggtacttcctagaaatatgaaagttcctcattttgtatttaattatgtaagaaaatgttctaggaaaagaataaaaaacatatattgtcaaagtgccctttggtagtgctcccaaatggtagtaactattggtctctagtatatactcctcaaatatctttttgctatgtattaatatatctatatgtttacatatagaaatacatagtgttgtgggttttaaattttcccataaattgtgtcttacccatgtgttttgccatttgccttttctcttgccaacgtgtctaggagctctttggtaaatacagac

SEQ ID NO: 17083 - DNA, 6040 bp, Homo sapiens
ggtgtgacgtaggaggaaggagacgccattagagggaggcagagagggatcgttcttcgcttttcctccggtgcctgacgtggtgggctggggcccttcattctcggactttccctcagcccttccaggcctcgcccgaggagggcgtggggacagcgcccgggtcggcggggccggggcggtgggggctgagccggccgtggctgtgaaggcgctgccgcggctgtcgggagggcggcgcgacactcgggctcgggcggccgggaagcgacgggatggctgcggccggcggcggcggcggcggggcggcggcggcgggccgagcctactcgttcaaggtggtgctgctgggggaaggctgcgtggggaagacgtcgctggtgctgcgctactgcgagaacaagtttaacgacaagcacatcaccactctgcaggcatcattcttaacaaagaagttaaatattggtgggaaaagagtaaaccttgccatatgggatacggcaggtcaagagagattccatgcattgggtccaatttactacagagattcaaatggagcgattttagtttatgacataacagatgaagattcttttcagaaggtaataaaatagacttggaaaaggagagacatgtttccattcaagaagcagagtcgtatgcagaatctgtgggagcaaaacattatcatacttcagccaaacagaacaaaggaattgaggaactctttcttgacctttgtaaaaggatgatagaaacagcacaagtggatgagagagcaaaaggcaatggctctagtcagccgggaactgcaaggcgaggtgtacagattattgatgatgaacctcaagcccagaccagtggtggagggtgctgttcttctggataactgttcacgcctaagaaattaaaagacagaacaaaactgtggatcattgccctcaacatgaagactgccatattccaagtcacattattttaccaatggaattatagaattaacagtattttaaattacgtttataacactgcagagaccttaagtgctaaacttagtggagtttgtgaccagagaattggcattttctacaaatgtttttttttgttttttttttgtttttttttgttttttttttgagacggagtctcgctctgtcacccaggctggagtgcactggcttgatctcggctcactgcaagctccacctcccaggttcacgccattctcctgcctcagcctcccgagtagctgggactataggcgcccaccacgacgcccggctaattttttgtatttttagtagagacggggtttcaccaggttagccaggatggtctcgatctcctgaccttgtgatccgcccgcctcggcctcccaaagtgctgggattacaggcgtgagccaccgtgcccggcctacaaatgttaacaaagcaattaccaatggcctttttacatattttttctttaatgaggaataatatgcatgtagaaaagacctacttaaagtcttcatttatattctttcaaatcaaatctttatttaataacttatatatgttgttggaatggttacatttttgcagccctttgtattttgtggtagttgaaattgtatcacttctaaacagcaaactgtttttgtttttaattagcagatatctgaagtactatttttgcagggtttgcacaggcccgtaactgtctactactttgatataatctgtatacatcctgtatgctgagctggtaaaatacattgtaaattacatattaaatattttatctgcttttacaagcgcaaggtgcaaaaatatatacaatagtctcattgatgactgtaaagtgaattaacatttggtgattatgcctagcttttttgactaatataaagatcatagctccccttcacttctgtcttaacttgaacatggcgtgtttaaattttcatacatactttacttgaattattgctgttgtcacatatttttgcctctgtgagttcatctgatgattgagcagtagcatttgccttttgggttttttgtttgttattatagaagagatgacttctgctgattttgctttagaatggttaccttagaagaatttgggtggctcatgttgaatttcacttctgcaatagctttcattttctcataggctttataagagatgggttcagtggtatgagcagaggaagagatcccagatagtagccagttaaccaagactcattcatatagcacgtagtttatgttcctgaggcagcacttttagatcctttgtgagcaagttctatttgttcattgcttgccagagatgaacacagaatgttctgtttcattttacaagaactatcctgagtttctgtggatggaaacattacatgtaatgcagatatagtgaacactggaaagatttattaaagaattatatttgtgtatactttataaattagtccctcattagatttttttttcttaagcataagactgaacttaaatgtgttaattttagtagaatcaggcactgctcgcagaaggaacacagattgtagagattaacataaattgttcttgttctaatatatatattttttcatttctgtcgtgcttggaaaactagtaaatattatgtctaagataaaatggaatggcccctggatttacttcttataagaagcagtagtatgtaataaagctattagcatgagcaattaagaggctataaagagattatagttacaaaagaaatactgccatatttttaagttaataacttaaaccttctcaaatgggttaaaagttgaatgaattgacaccctgatgttatgatgttggaattttaacttaaactgggaggcattctgtgagccttcactttaccttctttaattattgtccttgctaaactcaacacagacttttctgttatgtgtttttgaggaagttggggtgggaagagtcagggagataagctaaaattgtcttcttttatggggtaattgtactctgtagtctcttggtttcctgtgaagttagtatttatgtgggggtgggggaaggtagcaagaatcatgggtatcacggtactttgtttttgacctcctggctctttcagacagagtgaagaaagcttttccattcttactgttgtagaagtagataggaaataagcttttctcattacagtgaaatatgttttaaaaactagagtagctgggcacagaggcatgcatttgtagggccagctacttgggagagtgaggcaggaggatcacttgaggccaggatttcaaatccagcctaggtaacactgagacctccatctcgtaaaagacacaaaaactagttagagatgaaattgagctttattttaaaaaaacgttctaaagcctgataattggagagctatacttcagcttttcatcctactttaatgaaacagctagataggaacctctgctccagaattgccagataattattggtgggtcataactattcttcatattttttttttcttttttctcctttggtttctgtgttatctttcttaacctcacgtatttctttatcctttttagtgggggcctgtaattgaggctaattcaatagcaacaatagacaacatgatatggctgctgtcactttgaaacccaaaaggtctttgggtaggaatagagtaatgaaagaggaccagtcaacttcagtatatatacaaaggaaagacaaagagatgataaaccaaggctgaggaaatttttctgatgctttcttcatttctctaatataccttttgcattctttttctgataattgtgctattaggcagaagacacaagttaccacgttgtgtattaaaagcagtaggtaggttgtgccagtattttttcagccagtaagcatatacagttaacttatataattaaaaattggtttaagatagtgattaaaaatacctgaatattatgttaaaagtatacaatcattgtttctgtaatgatgatgggtattctgcttcttgtttttcattgtaattacaggggaagattgtttttgaaaatgtatattgccatgcttttggggtaagcagtaatgtgaaaagaaaaaagcattatgttattgtatgaaatataagtgttcagatttgttttgtctggggtgttgcctaagaataccctaaagctatggctgttactgcattgaaatcttttttttttttaatagtagccatatgttattagtggagtactttatatttgacattaaagtgaagaagaagagtagtacttcacttttaggtttttagtagtgaaagataaaattggaaaaatagggaaagagcatagggaggaatagaatggaagtcaagtaaataaaaaactacaacctgacagttttttaaatcactttgaaaagtacattacttttatcaaagagtttctaattaaggcaaactatgcattatgccaaatattaagaacattttaaaaatggattgtgatactgtttatttctttaattatataatttgcaattttctgtattataagtgctaccaggattctagatagttgatcttacatattcagatagtatagtttactcttataattacccgttacgttatctctaaaagtagtttgatctgtgcctttaacttttagaattcatcttttgacttgtttgccactgtagagttttcagttttctctgtagattcagtgtgacaaagagggaatacataatttgtgaccatttaagatgctgatattttctggaaaaggatatagatagtagtagtgacccgcaggagcctcacaataatgtctaaagatataaactgagtagatccctaagtactcttctctaaattataaaatgcattacctaggctttaatagttaaaagctggaatttattgaaccgcatctacttgatttcataatatgcattgattttagtatgttgctgttctgttatctgtaatcaactataacagagtaatatatttggtgttctggaccaaaattcgtgctacacatatgtctgatggcctttaccttttcaagaaaacagttgcaattttgagcaaaattttcctagttgtaatattttaatagtgttatgtattggaaaaaatttagaaatactcctaagagttttcaatttcaagcagaaatgcttctcttctaaataaataccacttaattgatagacctttagcagttcttgtgctatctaggatttatacatttttgcttttctggaaaactgctttggcgcattaacctttctactgcaacattttctcttcagtagatatatgagtaaacatgatgagttaatgttacacagcatacccagttaggtctcttattcttaaagcatctttctttagaagtctgcacatattttcaaatgcatcatattaaaggcacaagttaagaggaggtggagttgcctacttcagtggcctttattcccactataccagttctcagtcttgattttgatactttctggcaactgtatcatctcttcactatcaagtattttaagaaaaagctaaggtgatttctttacatttgaacatgtgtagatcaatgagagaatggtgagggatagcaaggataaagtataatgttgaaaagtagaaagaagtggtatctgctaaactctagctttagtagcaagctattttaaggaaatcattgtatgtggtacttcctagaaatatgaaagttcctcattttgtatttaattatgtaagaaaatgttctaggaaaagaataaaaaacatatattgtcaaagtgccctttggtagtgctcccaaatggtagtaactattggtctctagtatatactcctcaaatatctttttgctatgtattaatatatctatatgtttacatatagaaatacatagtgttgtgggttttaaattttcccataaattgtgtcttacccatgtgttttgccatttgccttttctcttgccaacgtgtctaggagctctttggtaaatacagac

SEQ ID NO: 17084 - DNA, 6050 bp, Homo sapiens
ggtgtgacgtaggaggaaggagacgccattagagggaggcagagagggatcgttcttcgcttttcctccggtgcctgacgtggtgggctggggcccttcattctcggactttccctcagcccttccaggcctcgcccgaggagggcgtggggacagcgcccgggtcggcggggccggggcggtgggggctgagccggccgtggctgtgaaggcgctgccgcggctgtcgggagggcggcgcgacactcgggctcgggcggccgggaagcgacgggatggctgcggccggcggcggcggcggcggggcggcggcggcgggccgagcctactcgttcaaggtggtgctgctgggggaaggctgcgtggggaagacgtcgctggtgctgcgctactgcgagaacaagtttaacgacaagcacatcaccactctgcaggcatcattcttaacaaagaagttaaatattggtgggaaaagagtaaaccttgccatatgggatacggcaggtcaagagagattccatgcattgggtccaatttactacagagattcaaatggagcgattttagtttatgacataacagatgaagattcttttcagaaggtaaaaaactgggtcaaagaattacggaaaatgttgggaaatgaaatctgtttatgtatagttggtaataaaatagacttggaaaaggagagacatgtttccattcaagaagcagagtcgtatgcagaatctgtgggagcaaaacattatcatacttcagccaaacagaacaaaggaattgaggaactctttcttgacctttgtaaaaggatgatagaaacagcacaagtggatgagagagcaaaaggcaatggctctagtcagccgggaactgcaaggcgaggtgtacagattattgatgatgaacctcaagcccagaccagtggtggagggtgctgttcttctggataactgttcacgcctaagaaattaaaagacagaacaaaactgtggatcattgccctcaacatgaagactgccatattccaagtcacattattttaccaatggaattatagaattaacagtattttaaattacgtttataacactgcagagaccttaagtgctaaacttagtggagtttgtgaccagagaattggcattttctacaaatgtttttttttgttttttttttgtttttttttgttttttttttgagacggagtctcgctctgtcacccaggctggagtgcactggcttgatctcggctcactgcaagctccacctcccaggttcacgccattctcctgcctcagcctcccgagtagctgggactataggcgcccaccacgacgcccggctaattttttgtatttttagtagagacggggtttcaccaggttagccaggatggtctcgatctcctgaccttgtgatccgcccgcctcggcctcccaaagtgctgggattacaggcgtgagccaccgtgcccggcctacaaatgttaacaaagcaattaccaatggcctttttacatattttttctttaatgaggaataatatgcatgtagataacttatatatgttgttggaatggttacatttttgcagccctttgtattttgtggtagttgaaattgtatcacttctaaacagcaaactgtttttgtttttaattagcagatatctgaagtactatttttgcagggtttgcacaggcccgtaactgtctactactttgatataatctgtatacatcctgtatgctgagctggtaaaatacattgtaaattacatattaaatattttatctgcttttacaagcgcaaggtgcaaaaatatatacaatagtctcattgatgactgtaaagtgaattaacatttggtgattatgcctagcttttttgactaatataaagatcatagctccccttcacttctgtcttaacttgaacatggcgtgtttaaattttcatacatactttacttgaattattgctgttgtcacatatttttgcctctgtgagttcatctgatgattgagcagtagcatttgccttttgggttttttgtttgttattatagaagagatgacttctgctgattttgctttagaatggttaccttagaagaatttgggtggctcatgttgaatttcacttctgcaatagctttcattttctcataggctttataagagatgggttcagtggtatgagcagaggaagagatcccagatagtagccagttaaccaagactcattcatatagcacgtagtttatgttcctgaggcagcacttttagatcctttgtgagcaagttctatttgttcattgcttgccagagatgaacacagaatgttctgtttcattttacaagaactatcctgagtttctgtggatggaaacattacatgtaatgcagatatagtgaacactggaaagatttattaaagaattatatttgtgtatactttataaattagtccctcattagatttttttttcttaagcataagactgaacttaaatgtgttaattttagtagaatcaggcactgctcgcagaaggaacacagattgtagagattaacataaattgttcttgttctaatatatatattttttcatttctgtcgtgcttggaaaactagtaaatattatgtctaagataaaatggaatggcccctggatttacttcttataagaagcagtagtatgtaataaagctattagcatgagcaattaagaggctataaagagattatagttacaaaagaaatactgccatatttttaagttaataacttaaaccttctcaaatgggttaaaagttgaatgaattgacaccctgatgttatgatgttggaattttaacttaaactgggaggcattctgtgagccttcactttaccttctttaattattgtccttgctaaactcaacacagacttttctgttatgtgtttttgaggaagttggggtgggaagagtcagggagataagctaaaattgtcttcttttatggggtaattgtactctgtagtctcttggtttcctgtgaagttagtatttatgtgggggtgggggaaggtagcaagaatcatgggtatcacggtactttgtttttgacctcctggctctttcagacagagtgaagaaagcttttccattcttactgttgtagaagtagataggaaataagcttttctcattacagtgaaatatgttttaaaaactagagtagctgggcacagaggcatgcatttgtagggccagctacttgggagagtgaggcaggaggatcacttgaggccaggatttcaaatccagcctaggtaacactgagacctccatctcgtaaaagacacaaaaactagttagagatgaaattgagctttattttaaaaaaacgttctaaagcctgataattggagagctatacttcagcttttcatcctactttaatgaaacagctagataggaacctctgctccagaattgccagataattattggtgggtcataactattcttcatattttttttttcttttttctcctttggtttctgtgttatctttcttaacctcacgtatttctttatcctttttagtgggggcctgtaattgaggctaattcaatagcaacaatagacaacatgatatggctgctgtcactttgaaacccaaaaggtctttgggtaggaatagagtaatgaaagaggaccagtcaacttcagtatatatacaaaggaaagacaaagagatgataaaccaaggctgaggaaatttttctgatgctttcttcatttctctaatataccttttgcattctttttctgataattgtgctattaggcagaagacacaagttaccacgttgtgtattaaaagcagtaggtaggttgtgccagtattttttcagccagtaagcatatacagttaacttatataattaaaaattggtttaagatagtgattaaaaatacctgaatattatgttaaaagtatacaatcattgtttctgtaatgatgatgggtattctgcttcttgtttttcattgtaattacaggggaagattgtttttgaaaatgtatattgccatgcttttggggtaagcagtaatgtgaaaagaaaaaagcattatgttattgtatgaaatataagtgttcagatttgttttgtctggggtgttgcctaagaataccctaaagctatggctgttactgcattgaaatcttttttttttttaatagtagccatatgttattagtggagtactttatatttgacattaaagtgaagaagaagagtagtacttcacttttaggtttttagtagtgaaagataaaattggaaaaatagggaaagagcatagggaggaatagaatggaagtcaagtaaataaaaaactacaacctgacagttttttaaatcactttgaaaagtacattacttttatcaaagagtttctaattaaggcaaactatgcattatgccaaatattaagaacattttaaaaatggattgtgatactgtttatttctttaattatataatttgcaattttctgtattataagtgctaccaggattctagatagttgatcttacatattcagatagtatagtttactcttataattacccgttacgttatctctaaaagtagtttgatctgtgcctttaacttttagaattcatcttttgacttgtttgccactgtagagttttcagttttctctgtagattcagtgtgacaaagagggaatacataatttgtgaccatttaagatgctgatattttctggaaaaggatatagatagtagtagtgacccgcaggagcctcacaataatgtctaaagatataaactgagtagatccctaagtactcttctctaaattataaaatgcattacctaggctttaatagttaaaagctggaatttattgaaccgcatctacttgatttcataatatgcattgattttagtatgttgctgttctgttatctgtaatcaactataacagagtaatatatttggtgttctggaccaaaattcgtgctacacatatgtctgatggcctttaccttttcaagaaaacagttgcaattttgagcaaaattttcctagttgtaatattttaatagtgttatgtattggaaaaaatttagaaatactcctaagagttttcaatttcaagcagaaatgcttctcttctaaataaataccacttaattgatagacctttagcagttcttgtgctatctaggatttatacatttttgcttttctggaaaactgctttggcgcattaacctttctactgcaacattttctcttcagtagatatatgagtaaacatgatgagttaatgttacacagcatacccagttaggtctcttattcttaaagcatctttctttagaagtctgcacatattttcaaatgcatcatattaaaggcacaagttaagaggaggtggagttgcctacttcagtggcctttattcccactataccagttctcagtcttgattttgatactttctggcaactgtatcatctcttcactatcaagtattttaagaaaaagctaaggtgatttctttacatttgaacatgtgtagatcaatgagagaatggtgagggatagcaaggataaagtataatgttgaaaagtagaaagaagtggtatctgctaaactctagctttagtagcaagctattttaaggaaatcattgtatgtggtacttcctagaaatatgaaagttcctcattttgtatttaattatgtaagaaaatgttctaggaaaagaataaaaaacatatattgtcaaagtgccctttggtagtgctcccaaatggtagtaactattggtctctagtatatactcctcaaatatctttttgctatgtattaatatatctatatgtttacatatagaaatacatagtgttgtgggttttaaattttcccataaattgtgtcttacccatgtgttttgccatttgccttttctcttgccaacgtgtctaggagctctttggtaaatacagac

SEQ ID NO: 17085 - DNA, 4263 bp, Homo sapiens
acgcgtccgcccacgcgtccggcgcaaggtgcaaaaatatatacaatagtctcattgatgactgtaaagtgaattaacatttggtgattatgcctagcttttttgactaatataaagatcatagctccccttcacttctgtcttaacttgaacatggcgtgtttaaattttcatacatactttacttgaattattgctgttgtcacatatttttgcctctgtgagttcatctgatgattgagcagtagcatttgccttttgggttttttgtttgttattatagaagagatgacttctgctgattttgctttagaatggttaccttagaagaatttgggtggctcatgttgaatttcacttctgcaatagctttcattttctcataggctttataagagatgggttcagtggtatgagcagaggaagagatcccagatagtagccagttaaccaagactcattcatatagcacgtagtttatgttcctgaggcagcacttttagatcctttgtgagcaagttctatttgttcattgcttgccagagatgaacacagaatgttctgtttcattttacaagaactatcctgagtttctgtggatggaaacattacatgtaatgcagatatagtgaacactggaaagatttattaaagaattatatttgtgtatactttataaattagtccctcattagatttttttttcttaagcataagactgaacttaaatgtgttaattttagtagaatcaggcactgctcgcagaaggaacacagattgtagagattaacataaattgttcttgttctaatatatatattttttcatttctgtcgtgcttggaaaactagtaaatattatgtctaagataaaatggaatggcccctggatttacttcttataagaagcagtagtatgtaataaagctattagcatgagcaattaagaggctataaagagattatagttacaaaagaaatactgccatatttttaagttaataacttaaaccttctcaaatgggttaaaagttgaatgaattgacaccctgatgttatgatgttggaattttaacttaaactgggaggcattctgtgagccttcactttaccttctttaattattgtccttgctaaactcaacacagacttttctgttatgtgtttttgaggaagttggggtgggaagagtcagggagataagctaaaattgtcttcttttatggggtaattgtactctgtagtctcttggtttcctgtgaagttagtatttatgtgggggtgggggaaggtagcaagaatcatgggtatcacggtactttgtttttgacctcctggctctttcagacagagtgaagaaagcttttccattcttactgttgtagaagtagataggaaataagcttttctcattacagtgaaatatgttttaaaaactagagtagctgggcacagaggcatgcatttgtagggccagctacttgggagagtgaggcaggaggatcacttgaggccaggatttcaaatccagcctaggtaacactgagacctccatctcgtaaaagacacaaaaactagttagagatgaaattgagctttattttaaaaaaacgttctaaagcctgataattggagagctatacttcagcttttcatcctactttaatgaaacagctagataggaacctctgctccagaattgccagataattattggtgggtcataactattcttcatattttttttttcttttttctcctttggtttctgtgttatctttcttaacctcacgtatttctttatcctttttagtgggggcctgtaattgaggctaattcaatagcaacaatagacaacatgatatggctgctgtcactttgaaacccaaaaggtctttgggtaggaatagagtaatgaaagaggaccagtcaacttcagtatatatacaaaggaaagacaaagagatgataaaccaaggctgaggaaatttttctgatgctttcttcatttctctaatataccttttgcattctttttctgataattgtgctattaggcagaagacacaagttaccacgttgtgtattaaaagcagtaggtaggttgtgccagtattttttcagccagtaagcatatacagttaacttatataattaaaaattggtttaagatagtgattaaaaatacctgaatattatgttaaaagtatacaatcattgtttctgtaatgatgatgggtattctgcttcttgtttttcattgtaattacaggggaagattgtttttgaaaatgtatattgccatgcttttggggtaagcagtaatgtgaaaagaaaaaagcattatgttattgtatgaaatataagtgttcagatttgttttgtctggggtgttgcctaagaataccctaaagctatggctgttactgcattgaaatcttttttttttttaatagtagccatatgttattagtggagtactttatatttgacattaaagtgaagaagaagagtagtacttcacttttaggtttttagtagtgaaagataaaattggaaaaatagggaaagagcatagggaggaatagaatggaagtcaagtaaataaaaaactacaacctgacagttttttaaatcactttgaaaagtacattacttttatcaaagagtttctaattaaggcaaactatgcattatgccaaatattaagaacattttaaaaatggattgtgatactgtttatttctttaattatataatttgcaattttctgtattataagtgctaccaggattctagatagttgatcttacatattcagatagtatagtttactcttataattacccgttacgttatctctaaaagtagtttgatctgtgcctttaacttttagaattcatcttttgacttgtttgccactgtagagttttcagttttctctgtagattcagtgtgacaaagagggaatacataatttgtgaccatttaagatgctgatattttctggaaaaggatatagatagtagtagtgacccgcaggagcctcacaataatgtctaaagatataaactgagtagatccctaagtactcttctctaaattataaaatgcattacctaggctttaatagttaaaagctggaatttattgaaccgcatctacttgatttcataatatgcattgattttagtatgttgctgttctgttatctgtaatcaactataacagagtaatatatttggtgttctggaccaaaattcgtgctacacatatgtctgatggcctttaccttttcaagaaaacagttgcaattttgagcaaaattttcctagttgtaatattttaatagtgttatgtattggaaaaaatttagaaatactcctaagagttttcaatttcaagcagaaatgcttctcttctaaataaataccacttaattgatagacctttagcagttcttgtgctatctaggatttatacatttttgcttttctggaaaactgctttggcgcattaacctttctactgcaacattttctcttcagtagatatatgagtaaacatgatgagttaatgttacacagcatacccagttaggtctcttattcttaaagcatctttctttagaagtctgcacatattttcaaatgcatcatattaaaggcacaagttaagaggaggtggagttgcctacttcagtggcctttattcccactataccagttctcagtcttgattttgatactttctggcaactgtatcatctcttcactatcaagtattttaagaaaaagctaaggtgatttctttacatttgaacatgtgtagatcaatgagagaatggtgagggatagcaaggataaagtataatgttgaaaagtagaaagaagtggtatctgctaaactctagctttagtagcaagctattttaaggaaatcattgtatgtggtacttcctagaaatatgaaagttcctcattttgtatttaattatgtaagaaaatgttctaggaaaagaataaaaaacatatattgtcaaagtgccctttggtagtgctcccaaatggtagtaactattggtctctagtatatactcctcaaatatctttttgctatgtattaatatatctatatgtttacatatagaaatacatagtgttgtgggttttaaattttcccataaattgtgtcttacccatgtgttttgccatttgccttttctcttgccaacgtgtctaggagctctttggtaaatacagac

SEQ ID NO: 17086 - DNA, 862 bp, Homo sapiens
ggtgtgacgtaggaggaaggagacgccattagagggaggcagagagggatcgttcttcgcttttcctccggtgcctgacgtggtgggctggggcccttcattctcggactttccctcagcccttccaggcctcgcccgaggagggcgtggggacagcgcccgggtcggcggggccggggcggtgggggctgagccggccgtggctgtgaaggcgctgccgcggctgtcgggagggcggcgcgacactcgggctcgggcggccgggaagcgacgggatggctgcggccggcggcggcggcggcggggcggcggcggcgggccgagcctactcgttcaaggtggtgctgctgggggaaggctgcgtggggaagacgtcgctggtgctgcgctactgcgagaacaagtttaacgacaagcacatcaccactctgcaggcatcattcttaacaaagaagttaaatattggtgggaaaagagtaaaccttgccatatgggatacggcaggtcaagagagattccatgcattgggtccaatttactacagagattcaaatggagcgattttagtttatgacataacagatgaagattcttttcagaaggtaaaaaactgggtcaaagaattacggaaaatgttgggaaatgaaatctgtttatgtatagttggtaataaaatagacttggaaaaggagagacatgtttccattcaagaagcagagtcgtatgcagaatctgtgggagcaaaacattatcatacttcagccaaacagaacaaaggaattgaggaactctttcttgacctttgtaaaaggatgatagaaacagcctgagcaacagagccggaccctgtctcaccaaagga

SEQ ID NO: 17087 - DNA, 1239 bp, Homo sapiens
ctggcaataaatgattcttcagtgaatcatttctagtaataactaaataatatagactcttaaaattctgaggtattttgacagtgttgagttttttgggtgttgtgatagtagtaattccaacaggatttgttttaatatgtgctcttttgtatatacaggtaaaaaactgggtcaaagaattacggaaaatgttgggaaatgaaatctgtttatgtatagttggtaagcatcattacttttttctaaaaaaaaagtcctctgtttccttaatgttttattgaagacaagtaatttttgttttaaagttatatgagaaaggaagaatggcatattaatataaatattttagaataatttaggatttagcctggtgcagtggctcatgcctgtaattccagcgccttgggaggccaaagtgggtggatcacttgaggtcaggagttcaagaccagcctggtcaacatggcgaaaccctgtctctctaaaaatacaaaaaaaaaaaaaaaaaaaaaaaaaaaaaagagccgcccgaagagaggggggggtattgtgccctttgtgtcccccgcggcgcgtgtggggggagggcggagaagagggggagagaaaccgcgggggaaccgcgggagggcgcgggggggtgcagggagagccgggggtgcgcgcccccatgtgtggccccccacgccgggggcggtacaccggggagagaatctctcatcttcttcacaaaaaaacaattgcgggcgtgggcacaggggggctccagcgccctggtgtattcccccacgacactgtggggagaagtgcgagaacgggcaggggtagaaaccacatctcgtgggggacacgggaagttccaaaaacacccagggcgggtgcccaccaatctattggagtgaaaccccccggccttaattataacaagctacacaaaaatatgtacgaggcggggggtgtggggggggggaccccccttatatatatcccccagctatcattggggggaaagcgaaagaaggcgcagagggaaaaaaattccctggtaaaccacccgcggggggggtgagtcggtcttgctcggggacccccaagaaaatacccgccatttgccccctccagttgtggccacgacagagcgcgaaacggtgttctctccacaacacataacaaaaaccggggcggcacaaatattgggggggggggacacaaaggtgattgaaaggcgcaaggtgc

SEQ ID NO: 17088 - DNA, 1680 bp, Homo sapiens
ggtgtgacgtaggaggaaggagacgccattagagggaggcagagagggatcgttcttcgcttttcctccggtgcctgacgtggtgggctggggcccttcattctcggactttccctcagcccttccaggcctcgcccgaggagggcgtggggacagcgcccgggtcggcggggccggggcggtgggggctgagccggccgtggctgtgaaggcgctgccgcggctgtcgggagggcggcgcgacactcgggctcgggcggccgggaagcgacgggatggctgcggccggcggcggcggcggcggggcggcggcggcgggccgagcctactcgttcaaggtggtgctgctgggggaaggctgcgtggggaagacgtcgctggtgctgcgctactgcgagaacaagtttaacgacaagcacatcaccactctgcaggcatcattcttaacaaagaagttaaatattggtgggaaaagagtaaaccttgccatatgggatacggcaggtcaagagagattccatgcattgggtccaatttactacagagattcaaatggagcgattttagtttatgacataacagatgaagattcttttcagaaggtaaaaaactgggtcaaagaattacggaaaatgttgggaaatgaaatctgtttatgtatagttggtaagcatcattacttttttctaaaaaaaaagtcctctgtttccttaatgttttattgaagacaagtaatttttgttttaaagttatatgagaaaggaagaatggcatattaatataaatattttagaataatttaggatttagcctggtgcagtggctcatgcctgtaattccagcgccttgggaggccaaagtgggtggatcacttgaggtcaggagttcaagaccagcctggtcaacatggcgaaaccctgtctctctaaaaatacaaaaaaaaaaaaaaaaaaaaaaaaaaaaaagagccgcccgaagagaggggggggtattgtgccctttgtgtcccccgcggcgcgtgtggggggagggcggagaagagggggagagaaaccgcgggggaaccgcgggagggcgcgggggggtgcagggagagccgggggtgcgcgcccccatgtgtggccccccacgccgggggcggtacaccggggagagaatctctcatcttcttcacaaaaaaacaattgcgggcgtgggcacaggggggctccagcgccctggtgtattcccccacgacactgtggggagaagtgcgagaacgggcaggggtagaaaccacatctcgtgggggacacgggaagttccaaaaacacccagggcgggtgcccaccaatctattggagtgaaaccccccggccttaattataacaagctacacaaaaatatgtacgaggcggggggtgtggggggggggaccccccttatatatatcccccagctatcattggggggaaagcgaaagaaggcgcagagggaaaaaaattccctggtaaaccacccgcggggggggtgagtcggtcttgctcggggacccccaagaaaatacccgccatttgccccctccagttgtggccacgacagagcgcgaaacggtgttctctccacaacacataacaaaaaccggggcggcacaaatattgggggggggggacacaaaggtgattgaaaggcgcaaggtgc

SEQ ID NO: 17089 - DNA, 3436 bp, Homo sapiens
  misc_feature (2781)..(2781): n is a, c, g, or t
cgcgcggccaggccctcttagccctctgccgtttggggggcacgggtgaacctgccgccccactcccaccccgccccgccccgcccgtacagccaaatcggaagggacgagcctgccctttgaaagggttttttttcttgctcctgcggagggcgccccagccatggccctcaggagctccctagaccccgcagggactgccctccatcccggccgccggggcccgccctctgcatcccgcgggcagcctgtgtgaagcggcctcccgcagcccccggcccctcccccatggaggaggaggagggggcggtggccaaggagtggggcacgacccccgcggggcccgtctggaccgcggtgttcgactacgaggcggcgggcgacgaggagctgaccctgcggaggggcgatcgcgtccaggtgctttcccaagactgtgcggtgtccggcgacgagggctggtggaccgggcagctccccagcggccgcgtgggcgtcttccccagcaactacgtggcccccggcgcccccgctgcacccgcgggcctccagctgccccaggagatccccttccacgagctgcagctagaggagatcatcggtgtggggggctttggcaaggtctatcgggccctgtggcgtggcgaggaggtggcagtcaaggccgcccggctggaccctgagaaggacccggcagtgacagcggagcaggtgtgccaggaagcccggctctttggagccctgcagcaccccaacataattgcccttaggggcgcctgcctcaaccccccacacctctgcctagtgatggagtatgcccggggtggtgcactgagcagggtgctggcaggtcgccgggtgccacctcacgtgctggtcaactgggctgtgcaggtggcccggggcatgaactacctacacaatgatgcccctgtgcccatcatccaccgggacctcaagtccatcaacatcctgatcctggaggccatcgagaaccacaacctcgcagacacggtgctcaagatcacggacttcggcctcgcccgcgagtggcacaagaccaccaagatgagcgctgcggggacctacgcctggatggcgccggaggttatccgtctctccctcttctccaaaagcagtgatgtctggagcttcggggtgctgctgtgggagctgctgacgggggaggtcccctaccgtgagatcgacgccttggccgtggcgtatggcgtggctatgaataagctgacgctgcccattccctccacgtgccccgagccctttgcccgcctcctggaggaatgctgggacccagacccccacgggcggccagatttcggtagcatcttgaagcggcttgaagtcatcgaacagtcagccctgttccagatgccactggagtccttccactcgctgcaggaagactggaagctggagattcagcacatgtttgatgaccttcggaccaaggagaaggagcttcggagccgtgaggaggagctgctgcgggcggcacaggagcagcgcttccaggaggagcagctgcggcggcgggagcaggagctggcagaacgtgagatggacatcgtggaacgggagctgcacctgctcatgtgccagctgagccaggagaagccccgggtccgcaagcgcaagggcaacttcaagcgcagccgcctgctcaagctgcgggaaggcggcagccacatcagcctgccctctggctttgagcataagatcacagtccaggcctctccaactctggataagcggaaaggatccgatggggccagcccccctgcaagccccagcatcatcccccggctgagggccattcgcctgactcccgtggactgtggtggcagcagcagtggcagcagcagtggaggaagtgggacatggagccgcggtgggcccccaaagaaggaagaactggtcgggggcaagaagaagggacgaacgtgggggcccagctccaccctgcagaaggagcgggtgggaggagaggagaggctgaaggggctgggggaaggaagcaaacagtggtcatcaagtgcccccaacctgggcaagtcccccaaacacacacccatcgcccctggcttcgccagcctcaatgagatggaggagttcgcggaggcagaggatggaggcagcagcgtgcccccttccccctactcgaccccgtcctacctctcagtgccactgcctgccgagccctccccgggggcgcgggcgccgtgggagccgacgccgtccgcgccccccgctcggtggggacacggcgcccggcggcgctgcgacctggcgctgctaggctgcgccacgctgctgggggctgtgggcctgggcgccgacgtggccgaggcgcgcgcggccgacggtgaggagcagcggcgctggctcgacggcctcttctttccccgcgccggccgcttcccgcggggcctcagcccacccgcgcgtccccacggccgccgcgaagacgtgggccccggcctgggcctggcgccctcggccaccctcgtgtcgctgtcgtccgtgtccgactgcaactccacgcgttcactgctgcgctctgacagtgacgaggccgcaccggccgcgccctccccaccaccctccccgcccgcgcccacacccacgccctcgcccagcaccaaccccctggtggacctggagctggagagcttcaagaaggacccccgccagtcgctcacgcccacccacgtcacggctgcatgcgctgtgagccgcgggcaccggcggacgccatcgganggggcgctggggcagcgggggccgcccgagcccgcgggccatggccctggccctcgtgaccttctggacttcccccgcctgcccgacccccaggccctgttcccagcccgccgccggccccctgagttcccaggccgccccaccaccctgacctttgccccgagacctcggccggctgccagtcgcccccgcttggacccctggaaactggtctccttcggccggacactcaccatctcgcctcccagcaggccagacactccggagagccctgggccccccagcgtgcagcccacactgctggacatggacatggaggggcagaaccaagacagcacagtgcccctgtgcggggcccacggctcccactaaggcctgcccaccaccgcccgcctgggcagccatgaatgtagcgccccaggccctgccccagcccgccatgccacaaggtgggggaggccctgggcaggatgttcactctatttattggggaaggagggaggggggggacacttaacttattcctttgtaccccagggggtggagccctgtgcccaccctgcactggggggagggtgggcagggatactcagggacagggcatcatgggggatttggcacaaaatggagcattaaaggtaacccctgcccccta

SEQ ID NO: 17090 - DNA, 956 bp, Homo sapiens
cgcgcggccaggccctcttagccctctgccgtttggggggcacgggtgaacctgccgccccactcccaccccgccccgccccgcccgtacagccaaatcggaagggacgagcctgccctttgaaagggttttttttcttgctcctgcggagggcgccccagccatggccctcaggagctccctagaccccgcagggactgccctccatcccggccgccggggcccgccctctgcatcccgcgggcagcctgtgtgaagcggcctcccgcagcccccggcccctcccccatggaggaggaggagggggcggtggccaaggagtggggcacgacccccgcggggcccgtctggaccgcggtgttcgactacgaggcggcgggcgacgaggagctgaccctgcggaggggcgatcgcgtccaggtgctttcccaagactgtgcggtgtccggcgacgagggctggtggaccgggcagctccccagcggccgcgtgggcgtcttccccagcaactacgtggcccccggcgcccccgctgcacccgcgggcctccagctgccccaggagatccccttccacgagctgcagctagaggagatcatcggtgtggggggctttggcaaggtctatcgggccctgtggcgtggcgaggaggtggcagtcaaggccgcccggctggaccctgagaaggacccggcagtgacagcggagcaggtgtgccaggaagcccggctctttggagccctgcagcaccccaacataattgcccttaggggcgcctgcctcaaccccccacacctctgcctagtgatggagtatgcccggggtggtgcactgagcagggtgctggcaggtcgccgggtgccacctcacgtgctggtcaactgggctgtgcaggtggcccggggcatgaactacctacacaatgatgggtacaggggggtgcactgttctctgct

SEQ ID NO: 17091 - DNA, 3849 bp, Homo sapiens
  misc_feature (2781)..(2781): n is a, c, g, or t
cgcgcggccaggccctcttagccctctgccgtttggggggcacgggtgaacctgccgccccactcccaccccgccccgccccgcccgtacagccaaatcggaagggacgagcctgccctttgaaagggttttttttcttgctcctgcggagggcgccccagccatggccctcaggagctccctagaccccgcagggactgccctccatcccggccgccggggcccgccctctgcatcccgcgggcagcctgtgtgaagcggcctcccgcagcccccggcccctcccccatggaggaggaggagggggcggtggccaaggagtggggcacgacccccgcggggcccgtctggaccgcggtgttcgactacgaggcggcgggcgacgaggagctgaccctgcggaggggcgatcgcgtccaggtgctttcccaagactgtgcggtgtccggcgacgagggctggtggaccgggcagctccccagcggccgcgtgggcgtcttccccagcaactacgtggcccccggcgcccccgctgcacccgcgggcctccagctgccccaggagatccccttccacgagctgcagctagaggagatcatcggtgtggggggctttggcaaggtctatcgggccctgtggcgtggcgaggaggtggcagtcaaggccgcccggctggaccctgagaaggacccggcagtgacagcggagcaggtgtgccaggaagcccggctctttggagccctgcagcaccccaacataattgcccttaggggcgcctgcctcaaccccccacacctctgcctagtgatggagtatgcccggggtggtgcactgagcagggtgctggcaggtcgccgggtgccacctcacgtgctggtcaactgggctgtgcaggtggcccggggcatgaactacctacacaatgatgcccctgtgcccatcatccaccgggacctcaagtccatcaacatcctgatcctggaggccatcgagaaccacaacctcgcagacacggtgctcaagatcacggacttcggcctcgcccgcgagtggcacaagaccaccaagatgagcgctgcggggacctacgcctggatggcgccggaggttatccgtctctccctcttctccaaaagcagtgatgtctggagcttcggggtgctgctgtgggagctgctgacgggggaggtcccctaccgtgagatcgacgccttggccgtggcgtatggcgtggctatgaataagctgacgctgcccattccctccacgtgccccgagccctttgcccgcctcctggaggaatgctgggacccagacccccacgggcggccagatttcggtagcatcttgaagcggcttgaagtcatcgaacagtcagccctgttccagatgccactggagtccttccactcgctgcaggaagactggaagctggagattcagcacatgtttgatgaccttcggaccaaggagaaggagcttcggagccgtgaggaggagctgctgcgggcggcacaggagcagcgcttccaggaggagcagctgcggcggcgggagcaggagctggcagaacgtgagatggacatcgtggaacgggagctgcacctgctcatgtgccagctgagccaggagaagccccgggtccgcaagcgcaagggcaacttcaagcgcagccgcctgctcaagctgcgggaaggcggcagccacatcagcctgccctctggctttgagcataagatcacagtccaggcctctccaactctggataagcggaaaggatccgatggggccagcccccctgcaagccccagcatcatcccccggctgagggccattcgcctgactcccgtggactgtggtggcagcagcagtggcagcagcagtggaggaagtgggacatggagccgcggtgggcccccaaagaaggaagaactggtcgggggcaagaagaagggacgaacgtgggggcccagctccaccctgcagaaggagcgggtgggaggagaggagaggctgaaggggctgggggaaggaagcaaacagtggtcatcaagtgcccccaacctgggcaagtcccccaaacacacacccatcgcccctggcttcgccagcctcaatgagatggaggagttcgcggaggcagaggatggaggcagcagcgtgcccccttccccctactcgaccccgtcctacctctcagtgccactgcctgccgagccctccccgggggcgcgggcgccgtgggagccgacgccgtccgcgccccccgctcggtggggacacggcgcccggcggcgctgcgacctggcgctgctaggctgcgccacgctgctgggggctgtgggcctgggcgccgacgtggccgaggcgcgcgcggccgacggtgaggagcagcggcgctggctcgacggcctcttctttccccgcgccggccgcttcccgcggggcctcagcccacccgcgcgtccccacggccgccgcgaagacgtgggccccggcctgggcctggcgccctcggccaccctcgtgtcgctgtcgtccgtgtccgactgcaactccacgcgttcactgctgcgctctgacagtgacgaggccgcaccggccgcgccctccccaccaccctccccgcccgcgcccacacccacgccctcgcccagcaccaaccccctggtggacctggagctggagagcttcaagaaggacccccgccagtcgctcacgcccacccacgtcacggctgcatgcgctgtgagccgcgggcaccggcggacgccatcgganggggcgctggggcagcgggggccgcccgagcccgcgggccatggccctggccctcgtgaccttctggacttcccccgcctgcccgacccccaggccctgttcccagcccgccgccggccccctgagttcccaggccgccccaccaccctgacctttgccccgagacctcggccggctgccagtcgcccccgcttggacccctggaaactggtctccttcggccggacactcaccatctcgcctcccagcaggccagacactccggagagccctgggccccccagcgtgcagcccacactgctggacatggacatggaggggcagaaccaagacagcacagtgcccctgtgcggggcccacggctcccactaaggcctgcccaccaccgcccgcctgggcagccatgaatgtagcgccccaggccctgccccagcccgccatgccacaaggtgggggaggccctgggcaggatgttcactctatttattggggaaggagggaggggggggacacttaacttattcctttgtaccccagggggtggagccctgtgcccaccctgcactggggggagggtgggcagggatactcagggacagggcatcatgggggatttggcacaaaatggagcattaaaggtaacccctgccccctaaaaaaaaaaaaaaaacaaaaaaaaaaaaaaaaaaaaaaaaaaaaaaaaaaaaaaaaaagggggggggcacacaaaaaaatccccggagggggcccaccgatatgagagcgcggcaaccgggacttgtgggacaaggggtgaccacataagaggaggacacaaataaaagagcgcacgcgcgggcgcggcataaaacacgccagcactggaaaaaagcgcaacagaggaacatttggggacaggcacctcctctcgtggcggtacaccaactgtgtggaaaactactcccaagggaaataataggcgcacactgggggaaacacatacacgagaggggatatagggggttccaactggtgtaaataactgggtgtacagaatggcacacgggctgtctccaacaactttccggg

SEQ ID NO: 17092 - DNA, 3602 bp, Homo sapiens
  misc_feature (2534)..(2534): n is a, c, g, or t
cgcgcggccaggccctcttagccctctgccgtttggggggcacgggtgaacctgccgccccactcccaccccgccccgccccgcccgtacagccaaatcggaagggacgagcctgccctttgaaagggttttttttcttgctcctgcggagggcgccccagccatggccctcaggagctccctagaccccgcagggactgccctccatcccggccgccggggcccgccctctgcatcccgcgggcagcctgtgtgaagcggcctcccgcagcccccggcccctcccccatggaggaggaggagggggcggtggccaaggagtggggcacgacccccgcggggcccgtctggaccgcggtgttcgactacgaggcggcgggcgacgaggagctgaccctgcggaggggcgatcgcgtccaggtgctttcccaagactgtgcggtgtccggcgacgagggctggtggaccgggcagctccccagcggccgcgtgggcgtcttccccagcaactacgtggcccccggcgcccccgctgcacccgcgggcctccagctgccccaggagatccccttccacgagctgcagctagaggagatcatcggtgtggggggctttggcaaggtctatcgggccctgtggcgtggcgaggaggtggcagtcaaggccgcccggctggaccctgagaaggacccggcagtgacagcggagcaggtgtgccaggaagcccggctctttggagccctgcagcaccccaacataattgcccttaggggcgcctgcctcaaccccccacacctctgcctagtgatggagtatgcccggggtggtgcactgagcagggtgctggcaggtcgccgggtgccacctcacgtgctggtcaactgggctgtgcaggtggcccggggcatgaactacctacacaatgatgcccctgtgcccatcatccaccgggacctcaagtccatcaacatcctgatcctggaggccatcgagaaccacaacctcgcagacacggtgctcaagatcacggacttcggcctcgcccgcgagtggcacaagaccaccaagatgagcgctgcggggacctacgcctggatggcgccggaggttatccgtctctccctcttctccaaaagcagtgatgtctggagcttcggggtgctgctgtgggagctgctgacgggggaggtcccctaccgtgagatcgacgccttggccgtggcgtatggcgtggctatgaataagctgacgctgcccattccctccacgtgccccgagccctttgcccgcctcctggaggaatgctgggacccagacccccacgggcggccagatttcggtagcatcttgaagcggcttgaagtcatcgaacagtcagccctgttccagatgccactggagtccttccactcgctgcaggaagactggaagctggagattcagcacatgtttgatgaccttcggaccaaggagaaggctttgagcataagatcacagtccaggcctctccaactctggataagcggaaaggatccgatggggccagcccccctgcaagccccagcatcatcccccggctgagggccattcgcctgactcccgtggactgtggtggcagcagcagtggcagcagcagtggaggaagtgggacatggagccgcggtgggcccccaaagaaggaagaactggtcgggggcaagaagaagggacgaacgtgggggcccagctccaccctgcagaaggagcgggtgggaggagaggagaggctgaaggggctgggggaaggaagcaaacagtggtcatcaagtgcccccaacctgggcaagtcccccaaacacacacccatcgcccctggcttcgccagcctcaatgagatggaggagttcgcggaggcagaggatggaggcagcagcgtgcccccttccccctactcgaccccgtcctacctctcagtgccactgcctgccgagccctccccgggggcgcgggcgccgtgggagccgacgccgtccgcgccccccgctcggtggggacacggcgcccggcggcgctgcgacctggcgctgctaggctgcgccacgctgctgggggctgtgggcctgggcgccgacgtggccgaggcgcgcgcggccgacggtgaggagcagcggcgctggctcgacggcctcttctttccccgcgccggccgcttcccgcggggcctcagcccacccgcgcgtccccacggccgccgcgaagacgtgggccccggcctgggcctggcgccctcggccaccctcgtgtcgctgtcgtccgtgtccgactgcaactccacgcgttcactgctgcgctctgacagtgacgaggccgcaccggccgcgccctccccaccaccctccccgcccgcgcccacacccacgccctcgcccagcaccaaccccctggtggacctggagctggagagcttcaagaaggacccccgccagtcgctcacgcccacccacgtcacggctgcatgcgctgtgagccgcgggcaccggcggacgccatcgganggggcgctggggcagcgggggccgcccgagcccgcgggccatggccctggccctcgtgaccttctggacttcccccgcctgcccgacccccaggccctgttcccagcccgccgccggccccctgagttcccaggccgccccaccaccctgacctttgccccgagacctcggccggctgccagtcgcccccgcttggacccctggaaactggtctccttcggccggacactcaccatctcgcctcccagcaggccagacactccggagagccctgggccccccagcgtgcagcccacactgctggacatggacatggaggggcagaaccaagacagcacagtgcccctgtgcggggcccacggctcccactaaggcctgcccaccaccgcccgcctgggcagccatgaatgtagcgccccaggccctgccccagcccgccatgccacaaggtgggggaggccctgggcaggatgttcactctatttattggggaaggagggaggggggggacacttaacttattcctttgtaccccagggggtggagccctgtgcccaccctgcactggggggagggtgggcagggatactcagggacagggcatcatgggggatttggcacaaaatggagcattaaaggtaacccctgccccctaaaaaaaaaaaaaaaacaaaaaaaaaaaaaaaaaaaaaaaaaaaaaaaaaaaaaaaaaagggggggggcacacaaaaaaatccccggagggggcccaccgatatgagagcgcggcaaccgggacttgtgggacaaggggtgaccacataagaggaggacacaaataaaagagcgcacgcgcgggcgcggcataaaacacgccagcactggaaaaaagcgcaacagaggaacatttggggacaggcacctcctctcgtggcggtacaccaactgtgtggaaaactactcccaagggaaataataggcgcacactgggggaaacacatacacgagaggggatatagggggttccaactggtgtaaataactgggtgtacagaatggcacacgggctgtctccaacaactttccggg

SEQ ID NO: 17093 - DNA, 1986 bp, Homo sapiens
cgcgcggccaggccctcttagccctctgccgtttggggggcacgggtgaacctgccgccccactcccaccccgccccgccccgcccgtacagccaaatcggaagggacgagcctgccctttgaaagggttttttttcttgctcctgcggagggcgccccagccatggccctcaggagctccctagaccccgcagggactgccctccatcccggccgccggggcccgccctctgcatcccgcgggcagcctgtgtgaagcggcctcccgcagcccccggcccctcccccatggaggaggaggagggggcggtggccaaggagtggggcacgacccccgcggggcccgtctggaccgcggtgttcgactacgaggcggcgggcgacgaggagctgaccctgcggaggggcgatcgcgtccaggtgctttcccaagactgtgcggtgtccggcgacgagggctggtggaccgggcagctccccagcggccgcgtgggcgtcttccccagcaactacgtggcccccggcgcccccgctgcacccgcgggcctccagctgccccaggagatccccttccacgagctgcagctagaggagatcatcggtgtggggggctttggcaaggtctatcgggccctgtggcgtggcgaggaggtggcagtcaaggccgcccggctggaccctgagaaggacccggcagtgacagcggagcaggtgtgccaggaagcccggctctttggagccctgcagcaccccaacataattgcccttaggggcgcctgcctcaaccccccacacctctgcctagtgatggagtatgcccggggtggtgcactgagcagggtgctggcaggtcgccgggtgccacctcacgtgctggtcaactgggctgtgcaggtggcccggggcatgaactacctacacaatgatgcccctgtgcccatcatccaccgggacctcaagtccatcaacatcctgatcctggaggccatcgagaaccacaacctcgcagacacggtgctcaagatcacggacttcggcctcgcccgcgagtggcacaagaccaccaagatgagcgctgcggggacctacgcctggatggcgccggaggttatccgtctctccctcttctccaaaagcagtgatgtctggagcttcggggtgctgctgtgggagctgctgacgggggaggtcccctaccgtgagatcgacgccttggccgtggcgtatggcgtggctatgaataagctgacgctgcccattccctccacgtgccccgagccctttgcccgcctcctggaggaatgctgggacccagacccccacgggcggccagatttcggtagcatcttgaagcggcttgaagtcatcgaacagtcagccctgttccagatgccactggagtccttccactcgctgcaggaagactggaagctggagattcagcacatgtttgatgaccttcggaccaaggagaaggagcttcggagccgtgaggaggagctgctgcgggcggcacaggagcagcgcttccaggaggagcagctgcggcggcgggagcaggagctggcagaacgtgagatggacatcgtggaacgggagctgcacctgctcatgtgccagctgagccaggagaagccccgggtccgcaagcgcaagggcaacttcaagcgcagccgcctgctcaagctgcgggaaggcggcagccacatcagcctgccctctggtacccacccgtgtccccagagcgccccccaagaggctgctgggagcagccccgacctaggatttatctcttccttttctttttcaacttgtttttattgctaaatatatcgcacatagtcagtgatcagcccagtgcagtggcgagcacttgtagtcccagcctactcaggaggccaaggtgggaggatcacttgaggccagaagtttgagaccagcctgggcaacatagaccccatatttaccaataaaaacaagttgaaa

SEQ ID NO: 17094 - DNA, 3622 bp, Homo sapiens
  misc_feature (2554)..(2554): n is a, c, g, or t
cgcgcggccaggccctcttagccctctgccgtttggggggcacgggtgaacctgccgccccactcccaccccgccccgccccgcccgtacagccaaatcggaagggacgagcctgccctttgaaagggttttttttcttgctcctgcggagggcgccccagccatggccctcaggagctccctagaccccgcagggactgccctccatcccggccgccggggcccgccctctgcatcccgcgggcagcctgtgtgaagcggcctcccgcagcccccggcccctcccccatggaggaggaggagggggcggtggccaaggagtggggcacgacccccgcggggcccgtctggaccgcggtgttcgactacgaggcggcgggcgacgaggagctgaccctgcggaggggcgatcgcgtccaggtgctttcccaagactgtgcggtgtccggcgacgagggctggtggaccgggcagctccccagcggccgcgtgggcgtcttccccagcaactacgtggcccccggcgcccccgctgcacccgcgggcctccagctgccccaggagatccccttccacgagctgcagctagaggagatcatcggtgtggggggctttggcaaggtctatcgggccctgtggcgtggcgaggaggtggcagtcaaggccgcccggctggaccctgagaaggacccggcagtgacagcggagcaggtggcccggggcatgaactacctacacaatgatgcccctgtgcccatcatccaccgggacctcaagtccatcaacatcctgatcctggaggccatcgagaaccacaacctcgcagacacggtgctcaagatcacggacttcggcctcgcccgcgagtggcacaagaccaccaagatgagcgctgcggggacctacgcctggatggcgccggagcttcggggtgctgctgtgggagctgctgacgggggaggtcccctaccgtgagatcgacgccttggccgtggcgtatggcgtggctatgaataagctgacgctgcccattccctccacgtgccccgagccctttgcccgcctcctggaggaatgctgggacccagacccccacgggcggccagatttcggtagcatcttgaagcggcttgaagtcatcgaacagtcagccctgttccagatgccactggagtccttccactcgctgcaggaagactggaagctggagattcagcacatgtttgatgaccttcggaccaaggagaaggagcttcggagccgtgaggaggagctgctgcgggcggcacaggagcagcgcttccaggaggagcagctgcggcggcgggagcaggagctggcagaacgtgagatggacatcgtggaacgggagctgcacctgctcatgtgccagctgagccaggagaagccccgggtccgcaagcgcaagggcaacttcaagcgcagccgcctgctcaagctgcgggaaggcggcagccacatcagcctgccctctggctttgagcataagatcacagtccaggcctctccaactctggataagcggaaaggatccgatggggccagcccccctgcaagccccagcatcatcccccggctgagggccattcgcctgactcccgtggactgtggtggcagcagcagtggcagcagcagtggaggaagtgggacatggagccgcggtgggcccccaaagaaggaagaactggtcgggggcaagaagaagggacgaacgtgggggcccagctccaccctgcagaaggagcgggtgggaggagaggagaggctgaaggggctgggggaaggaagcaaacagtggtcatcaagtgcccccaacctgggcaagtcccccaaacacacacccatcgcccctggcttcgccagcctcaatgagatggaggagttcgcggaggcagaggatggaggcagcagcgtgcccccttccccctactcgaccccgtcctacctctcagtgccactgcctgccgagccctccccgggggcgcgggcgccgtgggagccgacgccgtccgcgccccccgctcggtggggacacggcgcccggcggcgctgcgacctggcgctgctaggctgcgccacgctgctgggggctgtgggcctgggcgccgacgtggccgaggcgcgcgcggccgacggtgaggagcagcggcgctggctcgacggcctcttctttccccgcgccggccgcttcccgcggggcctcagcccacccgcgcgtccccacggccgccgcgaagacgtgggccccggcctgggcctggcgccctcggccaccctcgtgtcgctgtcgtccgtgtccgactgcaactccacgcgttcactgctgcgctctgacagtgacgaggccgcaccggccgcgccctccccaccaccctccccgcccgcgcccacacccacgccctcgcccagcaccaaccccctggtggacctggagctggagagcttcaagaaggacccccgccagtcgctcacgcccacccacgtcacggctgcatgcgctgtgagccgcgggcaccggcggacgccatcgganggggcgctggggcagcgggggccgcccgagcccgcgggccatggccctggccctcgtgaccttctggacttcccccgcctgcccgacccccaggccctgttcccagcccgccgccggccccctgagttcccaggccgccccaccaccctgacctttgccccgagacctcggccggctgccagtcgcccccgcttggacccctggaaactggtctccttcggccggacactcaccatctcgcctcccagcaggccagacactccggagagccctgggccccccagcgtgcagcccacactgctggacatggacatggaggggcagaaccaagacagcacagtgcccctgtgcggggcccacggctcccactaaggcctgcccaccaccgcccgcctgggcagccatgaatgtagcgccccaggccctgccccagcccgccatgccacaaggtgggggaggccctgggcaggatgttcactctatttattggggaaggagggaggggggggacacttaacttattcctttgtaccccagggggtggagccctgtgcccaccctgcactggggggagggtgggcagggatactcagggacagggcatcatgggggatttggcacaaaatggagcattaaaggtaacccctgccccctaaaaaaaaaaaaaaaacaaaaaaaaaaaaaaaaaaaaaaaaaaaaaaaaaaaaaaaaaagggggggggcacacaaaaaaatccccggagggggcccaccgatatgagagcgcggcaaccgggacttgtgggacaaggggtgaccacataagaggaggacacaaataaaagagcgcacgcgcgggcgcggcataaaacacgccagcactggaaaaaagcgcaacagaggaacatttggggacaggcacctcctctcgtggcggtacaccaactgtgtggaaaactactcccaagggaaataataggcgcacactgggggaaacacatacacgagaggggatatagggggttccaactggtgtaaataactgggtgtacagaatggcacacgggctgtctccaacaactttccggg

SEQ ID NO: 17095 - DNA, 1677 bp, Homo sapiens
  misc_feature (1363)..(1363): n is a, c, g, or t
  misc_feature (1502)..(1502): n is a, c, g, or t
cgcgcggccaggccctcttagccctctgccgtttggggggcacgggtgaacctgccgccccactcccaccccgccccgccccgcccgtacagccaaatcggaagggacgagcctgccctttgaaagggttttttttcttgctcctgcggagggcgccccagccatggccctcaggagctccctagaccccgcagggactgccctccatcccggccgccggggcccgccctctgcatcccgcgggcagcctgtgtgaagcggcctcccgcagcccccggcccctcccccatggaggaggaggagggggcggtggccaaggagtggggcacgacccccgcggggcccgtctggaccgcggtgttcgactacgaggcggcgggcgacgaggagctgaccctgcggaggggcgatcgcgtccaggtgctttcccaagactgtgcggtgtccggcgacgagggctggtggaccgggcagctccccagcggccgcgtgggcgtcttccccagcaactacgtggcccccggcgcccccgctgcacccgcgggcctccagctgccccaggagatccccttccacgagctgcagctagaggagatcatcggtgtggggggctttggcaaggtctatcgggccctgtggcgtggcgaggaggtggcagtcaaggccgcccggctggaccctgagaaggacccggcagtgacagcggagcaggtgtgccaggaagcccggctctttggagccctgcagcaccccaacataattgcccttaggggcgcctgcctcaaccccccacacctctgcctagtgatggagtatgcccggggtggtgcactgagcagggtgctggcaggtcgccgggtgccacctcacgtgctggtcaactgggctgtgcaggtggcccggggcatgaactacctacacaatgatgcccctgtgcccatcatccaccgggacctcaagtccatcaacatcctgatcctggaggccatcgagaaccacaacctcgcagacacggtgctcaagatcacggacttcggcctcgcccgcgagtggcacaagaccaccaagatgagcgctgcggggacctacgcctggatggcgccggaggttatccgtctctccctcttctccaaaagcagtgatgtctggagcttcggggtgctgctgtgggagctgctgacgggggaggtcccctaccgtgagatcgacgccttggccgtggcgtatggcgtggctatgaataagctgacgctgcccattccctccacgtgccccgagccctttgcccgcctcctggagggtgagccggggccccgtgacgagggtaggctcagcttggagtggcagggacctgtgggccagnacctttccccttcacacctatccataccagtgggcccaggagtgaggaagaaggggctggaacccactggactctaaacagcctccccatggttggctccatcccccacatcccagcccttgtttgggccagggccagnagctctcaggacaacctgttaggattccttgggccctggggatttccacctttgatccttgatttcaactacccctcctcggggtgcaggtcccagggtttctctcccagcgtttcactgagtggaattggccaggagcttggctttgaatcccttcccctcagctccatagcag

SEQ ID NO: 17096 - DNA, 501 bp, Homo sapiens
cgtgggtcttggtcttgctgttggaggggtcatcgggggctgtcccttggcacaagtccccgtggggccctggccagccctgcagcggagtgatggccctctccggttgcagaggagttcgcggaggcagaggatggaggcagcagcgtgcccccttccccctactcgaccccgtcctacctctcagtgccactgcctgccgagccctccccgggggcgcgggcgccgtgggagccgacgccgtccgcgccccccgctcggtggggacacggcgcccggcggcgctgcgacctggcgctgctaggctgcgccacgctgctgggggctgtgggcctgggcgccgacgtggccgaggcgcgcgcggccgacggtgaggagcagcggcgctggctcgacggcctcttctttccccgcgccggccgcttcccgcggggcctcagcccacccgcgcgtccccacggccgccgcgaagacgtgggccccggcctgggcctggcgccc

SEQ ID NO: 17097 - DNA, 413 bp, Homo sapiens
cccacacctctgcctagtgatggagtatgcccggggtggtgcactgagcagggtgctggcaggtcgccgggtgccacctcacgtgctggtcaactgggctgtgcaggtggcccggggcatgaactacctacacaatgatgcccctgtgcccatcatccaccgggacctcaagtccatcaacagtaagtggtgtcctctccccaaaattccttccacagaacctctcaaggccaggcctaggtggtgggaaacagggtgagggacaccagatgacactgtgcctggagtgagaaggggcagcagtatgataccttcagggtgaaggtgaggtaggccttgcctgccttaagggagaaaaaggaggctcagaaaggttgaaggacttacctgcctcccaggctgcagagtcacaa

SEQ ID NO: 17098 - DNA, 566 bp, Homo sapiens
gttattttaacactacttttatcttatcaaagcaatgtatgcacgtggttgaaaagtgaaataatgctgacaaaacttctaacaagaagcactactcctgcccctgattctccccagaccagtttccagagacagtgaatcatttggactatttgagctgtttctttgattttgcctccaatttttaaatattaatttttaatgctttttcttgatttcgcctgtttcagaaattatcttttgacttcctgttttggaagttggacgtgtagctcttgccccctccacccacctaactcactacttttcctctccccttcattccaaaagacctgtttcacaatagtcagtgattatcatgtaaatgatgtttaccactgagccaagaaatgtataatattatgatgagttttttttgtttgttttgttttattttttgagacagggtcttgctctgtcacccagactggagtacagtggtgcagtcatggctcacttcatccttgacctccttggatcaaacaaccctcctgcttcaggctcctgagtagctggggctacaggcc

SEQ ID NO: 17099 - DNA, 1574 bp, Homo sapiens
atttagtttttttttttttgagacagagtcccactctgtctccaagccagcggcacgatctcggctcactgcaatctctgcctcctgggttcaagcgattcttctgccttagcctcccgagtagctgggattacaggcacacaccaccacacccagctaatttttatatttttagtagagacggggtttcaccatgttggccaggatggtcttgatctcctgacctcgtgatccacctgcctcggcctcccaaagtgctgggattataggcgtgagccactgcgccccaccttatttagtattaaagtgttctcattacttgtacacacaaatttaaatgtcttagctttacagtattgcttgctcagcgaatatatgtcatgagaaaggtctgtcagattcatacagtaaacttgagcaccaattatgtgttttgacactactgggcacaaagacaatggaaaagaaaaggtgtaacaaatcccctgtctgagattaataagccccaaggcaacaatttgggcttttgtttgttttgtcaatctgagaaatgcagtttcagaactttgataggtggtactgttagccctgatgacattcaaagtcctcatttcaaatattcaaggtagaaaattcaaaactcagttgtaaaacaaaagaattggattagcagacccttttcatgaaatgaaatcttacttagaagcctgttatgtaaagcagaaaagccaagctactctggtggttagtatctggaagccttcctactgttgtgttgtcacccacctgcactgccagtgatgcctaaggctcatcttcaagcttccaggttttaccaagcacactctgaaagtgagtctatgtattagggataacagaaggaaatcaagcaaaaacttgctctttatttacaataaactccataaggaatttgaattctaaagttaacaaatcaatgaactccatgtaaaatagtctttacatggaataatggaaaacaatcgatggtccttttcttaaaaaccaatttttccccattgtaatacctttttttttttttaagatgagatctcgctctgtttccaaggctggagtgcagtcatttccatgtagtatgtacttttcccgagtactgccatgactcacttgccattttcaaggaatagcagcccactgactcaacaccctcacagacacacccaggatcaatactttgtatccttcaatccaatcaggttgacactcattattaaccatcacaaacttctttataaattgttatggaatgagctccaatacatattgttaaagttaaaaagcaagattaaagactaccatttgtgtaaaaagggggggggattaaaatatatgtatgcatatttgcttgaataagcattaattaactcttgaaggatattgttaatattgattgcctctggggaaaagaactgggtggttggggagtaggggtgggagactttttgccatttatcttttctttatgccttttgagttttgaatcatgtgaatgaattacctattcagaaaaatacatattattttaaaaaataaca

SEQ ID NO: 17100 - DNA, 239 bp, Homo sapiens
  misc_feature (7)..(7): n is a, c, g, or t
  misc_feature (9)..(9): n is a, c, g, or t
  misc_feature (11)..(11): n is a, c, g, or t
gagaganananaaaaaaaaaaaaaaaaaaaaaaaaaaagagagagagagcgggaactgtccgaggtgctgagctggggcgggaccggaatcctcccggtagggtaccagggactgagttgggcctggggccgtgtccaaggtgccaatgatgcgggccgacagagcgggccgcactgtctgtctgtccgtctgtcccggaaagaactataaagcgctggaagcgcctgcagatggtttt

SEQ ID NO: 17101 - DNA, 2515 bp, Homo sapiens
ggcgcagctcaggattagagcagcggagccgcctagcagccaccttcccccgccagtccgcgcgcccgggccgggctaggccccccaccgccgggtcccccggggctgcagtagcagcggcgccgcccgcggctcccgctggggcctgggcgccggccccgctctgcaggatgggcacagtgctgtctctttcgcctgcctcctcggccaagggccggaggcccggcgggctgcccgaggagaagaagaaggcgccgcccgcgggggacgaggcgctggggggctacggggcgccgccagtgggcaagggcggcaaaggcgagagccgactcaagcggccgtccgtgctcatctcggcgctcacctggaagcgcctggtggccgcgtccgccaagaagaagaaaggcagcaagaaggtgacacccaagccggcatccacgggccccgaccccctggtccagcaacgcaaccgcgagaaccttctccgcaagggccgggatccccccgacggcggcggcaccgccaagcccctggcggtgccagtgcccaccgtgcccgcggctgccgccacctgcgagccaccgtcggggggcagcgcggccgctcagccgccgggctcgggcgggggaaagcctccgccgccgcctcccccagccccgcaggtggcgccgccggtgcctggcggctcgccgcggcgggtcatcgtgcaggcgtccaccggcgagctgctgcgctgtctgggcgacttcgtgtgccgacgctgctatcgcctcaaggagctgagcccgggcgagctggtgggctggttccgcggtgtggaccgctcgctgctgctgcagggctggcaagaccaggccttcattacgcctgcaaacctggtgttcgtgtacctgctgtgccgcgagtcgctgcgtggggacgagctggcgtcggccgccgagctgcaggccgccttcctcacctgcctctacctcgcctactcctacatgggcaacgagatctcctacccactcaagcccttcctcgtggagcccgacaaggagcgcttctggcagcgctgcctgcgcctcatccagcggctcagcccgcagatgctgcggctcaacgccgacccccacttcttcacgcaggtctttcaagacctcaagaacgagggcgaggccgccgccagcggcgggggcccaccgagcgggggcgcgcccgccgcctcctcggccgccagggacagctgcgcggccggaaccaagcactggactatgaacctggaccgctagggatacccaggggccgcgcccatccccccgccccagcccctgacacacactcggaccccccgggaccacaaagccaccgccgctgttaccgccgctcagcgccccggctgggcggaggaggagacgcccatgcccctcaggggaaagtggagaccgggacaccagaggccgcggtgtttggatttgctgggcgtggagtggggacggaagatgagcgcgggaaaggcactccaacctcactcttcccgtctgtctgcgcccccatttctccatttctgccggggtctcccccttcccttcagcccattccccctcggttttatccatttccttgcctcctttttgtgtcttcatttttcctcctgtctgcattcctctctctctctctccctctctctcctgttcctctctttcttcctccctctccctgcctttccattttccgttccttgggtttgtgtgtctgcatctccatcttaccccttgcctgactgtaccccgtagacccctgtttctcctcctgcacctgtgtccccatctgcccttcttgttgctcctgtcatgtgtcaccatcttccctcctgtctgccttcttcctccacttgtgtcagcttgcatttttttattcctgactgagtcaccacacccctctcccctgatcaaagggaatattagtttttaatttggatcgactgaggtgccaggagaaactgcagtcccaggtatccagacagccaccaggatggtccctcgccccacccccaccgcctctccccaccttttccaacgtgttgcatgctgggagctggggggtgtgggggaaggggctgccggcttctttcaggaggctgaggtttggaggcaaaatcaacctgggagaccaccccggccgcggcgcctcagtggacaggtgggaggaaaagaaaacttcttaccttggaggagggacatcccgcttccttatccttagcttttttgttgctcctccccactgccccttttaatttatttggttgtttgcggagggaggggggaggggggtaggctgggccgggaactgtccgaggtgctgagctggggcgggaccggaatcctcccggtagggtaccagggactgagttgggcctggggccgtgtccaaggtgccaatgatgcgggccgacagagcgggccgcactgtctgtctgtccgtctgtcccggaaagaactataaagcgctggaagcgcctgcagatggtttt

SEQ ID NO: 17102 - DNA, 1892 bp, Homo sapiens
  misc_feature (1872)..(1872): n is a, c, g, or t
ggcgcagctcaggattagagcagcggagccgcctagcagccaccttcccccgccagtccgcgcgcccgggccgggctaggccccccaccgccgggtcccccggggctgcagtagcagcggcgccgcccgcggctcccgctggggcctgggcgccggccccgctctgcaggatgggcacagtgctgtctctttcgcctgcctcctcggccaagggccggaggcccggcgggctgcccgaggagaagaagaaggcgccgcccgcgggggacgaggcgctggggggctacggggcgccgccagtgggcaagggcggcaaaggcgagagccgactcaagcggccgtccgtgctcatctcggcgctcacctggaagcgcctggtggccgcgtccgccaagaagaagaaaggcagcaagaaggtgacacccaagccggcatccacgggccccgaccccctggtccagcaacgcaaccgcgagaaccttctccgcaagggccgggatccccccgacggcggcggcaccgccaagcccctggcggtgccagtgcccaccgtgcccgcggctgccgccacctgcgagccaccgtcggggggcagcgcggccgctcagccgccgggctcgggcgggggaaagcctccgccgccgcctcccccagccccgcaggtggcgccgccggtgcctggcggctcgccgcggcgggtcatcgtgcaggcgtccaccggcgagctgctgcgctgtctgggcgacttcgtgtgccgacgctgctatcgcctcaaggagctgagcccgggcgagctggtgggctggttccgcggtgtggaccgctcgctgctgctgcagggctggcaagaccaggccttcattacgcctgcaaacctggtgttcgtgtacctgctgtgccgcgagtcgctgcgtggggacgagctggcgtcggccgccgagctgcaggccgccttcctcacctgcctctacctcgcctactcctacatgggcaacgagatctcctacccactcaagcccttcctcgtggagcccgacaaggagcgcttctggcagcgctgcctgcgcctcatccagcggctcagcccgcagatgctgcggctcaacgccgacccccacttcttcacgcaggtctttcaagacctcaagaacgagggcgaggccgccgccagcggcgggggcccaccgagcgggggcgcgcccgccgcctcctcggccgccagggacagctgcgcggccggaaccaagcactggactatgaacctggaccgctagggatacccaggggccgcgcccatccccccgccccagcccctgacacacactcggaccccccgggaccacaaagccaccgccgctgttaccgccgctcagcgccccggctgggcggaggaggagacgcccatgcccctcaggggaaagtggagaccgggacaccagaggccgcggtgtttggatttgctgggcgtggagtggggacggaagatgagcgcgggaaaggcactccaacctcactcttcccgtctgtctgcgcccccatttctccatttctgccggggtctcccccttcccttcagcccattccccctcggttttatccatttccttgcctcctttttgtgtcttcatttttcctcctgtctgcattcctctctctctctctccctctctctcctgttcctctctttcttcctccctctccctgcctttccattttccgttccttgggtttgtgtgtctgcatctccatcttaccccttgcctgactgtaccccgtagacccctgtttctcctcctgcacctgtgtccccatctgcccttcttgttgctcctgtcatgtgtcaccatcttccctcctgtcgggctagtcggntagactcctgagagtaccga

SEQ ID NO: 17103 - DNA, 1542 bp, Homo sapiens
ggcgcagctcaggattagagcagcggagccgcctagcagccaccttcccccgccagtccgcgcgcccgggccgggctaggccccccaccgccgggtcccccggggctgcagtagcagcggcgccgcccgcggctcccgctggggcctgggcgccggccccgctctgcaggatgggcacagtgctgtctctttcgcctgcctcctcggccaagggccggaggcccggcgggctgcccgaggagaagaagaaggcgccgcccgcgggggacgaggcgctggggggctacggggcgccgccagtgggcaagggcggcaaaggcgagagccgactcaagcggccgtccgtgctcatctcggcgctcacctggaagcgcctggtggccgcgtccgccaagaagaagaaaggcagcaagaaggtgacacccaagccggcatccacgggccccgaccccctggtccagcaacgcaaccgcggtgtttggatttgctgggcgtggagtggggacggaagatgagcgcgggaaaggcactccaacctcactcttcccgtctgtctgcgcccccatttctccatttctgccggggtctcccccttcccttcagcccattccccctcggttttatccatttccttgcctcctttttgtgtcttcatttttcctcctgtctgcattcctctctctctctctccctctctctcctgttcctctctttcttcctccctctccctgcctttccattttccgttccttgggtttgtgtgtctgcatctccatcttaccccttgcctgactgtaccccgtagacccctgtttctcctcctgcacctgtgtccccatctgcccttcttgttgctcctgtcatgtgtcaccatcttccctcctgtctgccttcttcctccacttgtgtcagcttgcatttttttattcctgactgagtcaccacacccctctcccctgatcaaagggaatattagtttttaatttggatcgactgaggtgccaggagaaactgcagtcccaggtatccagacagccaccaggatggtccctcgccccacccccaccgcctctccccaccttttccaacgtgttgcatgctgggagctggggggtgtgggggaaggggctgccggcttctttcaggaggctgaggtttggaggcaaaatcaacctgggagaccaccccggccgcggcgcctcagtggacaggtgggaggaaaagaaaacttcttaccttggaggagggacatcccgcttccttatccttagcttttttgttgctcctccccactgccccttttaatttatttggttgtttgcggagggaggggggaggggggtaggctgggccgggaactgtccgaggtgctgagctggggcgggaccggaatcctcccggtagggtaccagggactgagttgggcctggggccgtgtccaaggtgccaatgatgcgggccgacagagcgggccgcactgtctgtctgtccgtctgtcccggaaagaactataaagcgctggaagcgcctgcagatggtttt

SEQ ID NO: 17104 - DNA, 1007 bp, Homo sapiens
ccccgctagcccgacagcccccgactagcccgacagcccccgactagcccgacagcccccgactagcccgacagcccccgcgctctcccactccctcatgcctgtcctccccggtcccctcctcccgctcattcactcgcccctctctctctctccctctctctcctgttcctctctttcttcctccctctccctgcctttccattttccgttccttgggtttgtgtgtctgcatctccatcttaccccttgcctgactgtaccccgtagacccctgtttctcctcctgcacctgtgtccccatctgcccttcttgttgctcctgtcatgtgtcaccatcttccctcctgtctgccttcttcctccacttgtgtcagcttgcatttttttattcctgactgagtcaccacacccctctcccctgatcaaagggaatattagtttttaatttggatcgactgaggtgccaggagaaactgcagtcccaggtatccagacagccaccaggatggtccctcgccccacccccaccgcctctccccaccttttccaacgtgttgcatgctgggagctggggggtgtgggggaaggggctgccggcttctttcaggaggctgaggtttggaggcaaaatcaacctgggagaccaccccggccgcggcgcctcagtggacaggtgggaggaaaagaaaacttcttaccttggaggagggacatcccgcttccttatccttagcttttttgttgctcctccccactgccccttttaatttatttggttgtttgcggagggaggggggaggggggtaggctgggccgggaactgtccgaggtgctgagctggggcgggaccggaatcctcccggtagggtaccagggactgagttgggcctggggccgtgtccaaggtgccaatgatgcgggccgacagagcgggccgcactgtctgtctgtccgtctgtcccggaaagaactataaagcgctggaagcgcctgcagatggtttt

SEQ ID NO: 17105 - DNA, 917 bp, Homo sapiens
aagatgatttcaaataatgcattaagttagcctgctgtgttaatttcataaagctattctttttcattttattttttcaagttttcattcacttttcaaaataatggtagcatataatcacatgcaatgccaatgaatccccatattaagcttcgtacttctgtccaaatgtattgtagttgcctaatttcaaggttctaatttggaaatctgatttattttgtatgtttttatatacataccaattttaagcattatcttgcaaagtagacataggtggtgtttgatttgccataattaacttgaatttgattttgtaaccaaaatgtggctgtccacataattggagatcagtgtctttgggcttttaatggagaacaaatcacattgtgggtgttgctggtttttctgtttcacatttacttttgctctaggaagtatttccgtgagtctgatgactccataagttatgatcctcagtgttaagtaacttaggacggttgggcattacttttaatattcacttaaggcttctggtatcctttttttctgtatttttcccttaggaatttaattcgggtcttcctcaaattttacagctttaaaaaaattccatgaatgggttttcctcaacctcagaatatcataataaattacaagatatgaccccctggttcctattaccttgattaaagtggcggcaattaatttactgatgttttgtcagtgaaataaataatagcatcttatgaagtttgtgtatctctgatgaaaatgagtcatgtcagattccctctctgaagggaagttaaataaacaacatttttaaaattctttgaattctaaataaatatgctttgaaaagtgagttagggttttgtctaattgcactgaggcgagctagcttcggtgccatt

SEQ ID NO: 17106 - DNA, 633 bp, Homo sapiens
aaaaagactgggccccagcccgggccgcccttgcccacgagttgggttccaagtatttacagagaccttggggaaacgagggttttttcctcagtccgcctggcaagttcggaggtgacttcctggtctatcctggtgaccccctccgcttccacgcccattatatcgctcagtgctgggcccctgaggacaccatcccactccaagacctggttgctgctgggcgccttggaaccagcgtcagaaagaccctgctcctctgttctccgcagcctgatggtaaggtggtctacacctccctgcaatgggccagcctgcagtgaactccagagacctaggggatgtggctgtgtcggcagcaagagcctttctggatgttccccagctcttctctgggagtctagaacatcctcctacctttctccgcggttagtttttgattccaggttttcgaacactacatcttttttatgttcttccttgtttcaaagcacttattggctgtgtttttgtagttacctattttcacactgtgagcttcccgagaatggggcctgggtttgattcatctgttttctacagggtttaagtctcaggaggtctcaataaacttggtatataaatgttcatgat

SEQ ID NO: 17107 - DNA, 480 bp, Homo sapiens
gtaaattgccccttttaaaatcccttaccattagtttgccttcccacccattctaatattcctagtattagtctccaagtgtgttgctatctgtcctatgtatcttaagtaatgaagaagctcagagctaacaggtcaatttccccagcaatccttccagtgggaaaataaagagaaattacctttgtgagttgtgttttagggcatctggctcattcagcatggatttttccatttgcctgtggctgttaaccagcctgcagtgaagaggaattgcccatctgtagtcagaaaattggagtggtgacatatatttcctcccttgagtgacacagagagttccctctcatcatcaattcacttagaaggaccattttcaatagaaaaatgtacctgattcttgcccatgttcagaaagccagctaagaattctcaaacatttcatttcagttcagctttgtgactaatttccctatatgc

SEQ ID NO: 17108 - DNA, 447 bp, Homo sapiens
tcattggtagtattcatgaaattccaaattaaaatggaccaaaaaaaaatacctacctccttaccttacctaattccccaacctattagcacctttttattgtgatattccagtgctaatgaaggcatggtgaaactgatgatctcatgcatgcttttgtggcattgtaaattagtaacaatctttctggaaaggttttggcaagaggttttagttgtcataaaaatgtttatacctccaagcccactaatcccatttttgggaatctctcctgaagaggtaagttagaataagcaaagcttcattgcaactttatttgtagtaatgaataataggaagaaatcaacatattcaacaatatgaaaatgaagtaaatgaaatttcaactgaatttctttttagttgtgatttaaaacgagcaaaaaatatgagcatggaaaacaaaaa

SEQ ID NO: 17109 - DNA, 402 bp, Homo sapiens
tgaaagccctgagccccttcctcctccctttcttctacatgactggagtttggggagcacacagagccccgtgccacacccaactggctggcatttcggctcacaaaaacacctttcttggagaagcagatctaatttcctccctgtgaaaaaaacagttgtctagcactcgggcagcctctgtcgtggggcagtcagctgcttccacggtgagcacgagggtgggtaaaatctggatcaggacaagctgtgggcacatggacagtgactggcatgaaataatcattcttttcccaggtgagggctgtggtaagggcaagtggcggtgctgtgtgatgctccaggatggtttgtaaggctgagagtaactccccctccctaggcctcagtttccccatctgt

SEQ ID NO: 17110 - DNA, 299 bp, Homo sapiens
tttgattatttagttcagtaaaagcattttgagaattttaaagttgtaattgtaatcatttggttctttgttagtaattttgcttcatatattttgcattaaaatgtatttctgttatcagtgttcatctaaaatttttagctttgggagattaaaaaattaaatgtattatagaatgaatgatgaattacttattttggaagttctatagaaaatgggatactactgaatcatccctttgtcattttttcattatatatagatttatcttcttgacaatttattgtatgcattcattc

SEQ ID NO: 17111 - DNA, 343 bp, Homo sapiens
acaaataagatggtatagactcagttttcctgctcttccctgctaagtacaactctaaatcttggaattggtacaaaagacacccaaaggagaattcttgaagtttataagaagaaagtgaactgacttgggatcacagcattggaagaacaacatagtcgtagagcatcttgcatcctcccatccacctagacccggtgtttcctgaccctcccacctagcaacagagtgcaggctaggtaggttggctcattcctcccctgaatcaaatggaagtccccccgaaaacatctgccaaggccgacagcattgacaaaggggatcagttgggaactctagccct

SEQ ID NO: 17112 - DNA, 1439 bp, Homo sapiens
gcagcccgaagcagccagaccagcccctgagcctcccgggtgctggcagctgtcatggggctaccctgggggcagcctcacctagggctgcagatgctcctcctggcgttgaactgtctccggcccagcctgagcctgggtgagtgggggtcctggatggacgcgtccagccagacccaaggggctgggggccctgctggagtgattggaccctgggcgcccgcccccctccgattgggagaggcagccccagggacccccacgcccgtctccgtggctcaccttttgtcccccgtggccacagagctggtgccctacacaccacagataacagcttgggacctggaagggaaggtcacagccaccaccttctccctggagcagccgcgctgtgtcttcgatgggcttgccagcgccagcgataccgtctggctcgtggtggccttcagcaatgcctccaggggcttccagaacccggagacactggctgacattccggcctccccacagctgctgaccgatggccactacatgacgctgcccctgtctccggaccagctgccctgtggcgaccccatggcgggcagcggaggcgcccccgtgctgcgggtgggccatgaccacggctgccaccagcagcccttctgcaacgcgcccctccctggccctggaccctatcgggaagacccccggatccatcgacacctggccagggcggcgaagtggcagcatgatcgtcattacctccatcctctcttctctggccggcctcctactcttggccttcttggcagcctctaccatgcgcttctccagcctgtggtggccggaggaggccccggagcagctgcggatcggctccttcatgggcaagcgctacatgacccaccacatcccacccagcgaggccgccacactgccggtgggctgcaagcctggcctggaccccctccccagcctcagcccctagcctggcctctttgcatggggctgggggagatggggcgccgggagtgagtgcatggtgctttgtcccagctcctgcacccacaggccccctcagggctccttgcctttcccccccaccagcacaccccgtaccctgcctggaatcccagcaccagcccccctgcctctcctctgcctttctggtttctctccctctccaagcatctgtaagttgcactcaggagggtttaggggagggccatgggcaggctggtctcgtgatagtgagtgagtgctcatgggatctggttgtttagaagcatgcagcacctcctgcttcactctctctgtctctcctgctccaccatggccagaaacgtgcctgcttccccttcgccttctgccgtgattgtcagtttcttgagggctccccagccatgcttcctgtacagcctgcaaaactgtgagtcaattaaacctcttttcttcat

SEQ ID NO: 17113 - DNA, 1942 bp, Homo sapiens
gcagcccgaagcagccagaccagcccctgagcctcccgggtgctggcagctgtcatggggctaccctgggggcagcctcacctagggctgcagatgctcctcctggcgttgaactgtctccggcccagcctgagcctgggtgagtgggggtcctggatggacgcgtccagccagacccaaggggctgggggccctgctggagtgattggaccctgggcgcccgcccccctccgattgggagaggcagccccagggacccccacgcccgtctccgtggctcaccttttgtcccccgtggccacagagctggtgccctacacaccacagataacagcttgggacctggaagggaaggtcacagccaccaccttctccctggagcagccgcgctgtgtcttcgatgggcttgccagcgccagcgataccgtctggctcgtggtggccttcagcaatgcctccaggggcttccagaacccggagacactggctgacattccggcctccccacagctgctgaccgatggccactacatgacgctgcccctgtctccggaccagctgccctgtggcgaccccatggcgggcagcggaggcgcccccgtgctgcgggtgggccatgaccacggctgccaccagcagcccttctgcaacgcgcccctccctggccctggaccctatcgggaagacccccgtgaagttcctcctgatggacaccaggggctcacccagggctgagaccaagtggtcagaccccatcactctccaccaagggaagacccccggatccatcgacacctggccagggcggcgaagtggcagcatgatcgtcattacctccatcctctcttctctggccggcctcctactcttggccttcttggcagcctctaccatgcgcttctccagcctgtggtggccggaggaggccccggagcagctgcggatcggctccttcatgggcaagcgctacatgacccaccacatcccacccagcgaggccgccacactgccggtgggctgcaagcctggcctggaccccctccccagcctcagcccctagcctggcctctttgcatggggctgggggagatggggcgccgggagtgagtgcatggtgctttgtcccagctcctgcacccacaggccccctcagggctccttgcctttcccccccaccagcacaccccgtaccctgcctggaatcccagcaccagcccccctgcctctcctctgcctttctggtttctctccctctccaagcatctgtaagttgcactcaggagggtttaggggagggccatgggcaggctggatacccagtccccacctccatccccacctctgtctcacctgacctcctgcgagggaggctggagactgtgtggacaggccgccctgaccgcaagcttccagaccctgggaggaggcctgcagaggactgtgctttgcctgatgcagggagctgggcccatcctggggcctatgagacctgagccaccctccgtcccccatcccacacatcagtggctgggcggggtgaggattcagaggcatctctactgcccctgggcacagcacctttctgagagtgggactctccatggtcatctgactaccaattctggccaccacctccaaccctcttgtgcatatggatggctctagcccttatccaccccctcaagcatttattaagcatctgctgtatgctacatacagtgttagacttggggcttcaggcatagccggtcctgaccttggggagatgccttctctagacctgagacgaccacgtgtccagatgtgacctgttgctgtcgggggtctatcaggcccttagaccgtcaccccagtaggctctccaggacccaggagcctccatcacctggaaggaccctctgtgcaaaacctcaagcgtccatctgtgcacaaggccggtggt

SEQ ID NO: 17114 - DNA, 1529 bp, Homo sapiens
gcagcccgaagcagccagaccagcccctgagcctcccgggtgctggcagctgtcatggggctaccctgggggcagcctcacctagggctgcagatgctcctcctggcgttgaactgtctccggcccagcctgagcctgggtgagtgggggtcctggatggacgcgtccagccagacccaaggggctgggggccctgctggagtgattggaccctgggcgcccgcccccctccgattgggagaggcagccccagggacccccacgcccgtctccgtggctcaccttttgtcccccgtggccacagagctggtgccctacacaccacagataacagcttgggacctggaagggaaggtcacagccaccaccttctccctggagcagccgcgctgtgtcttcgatgggcttgccagcgccagcgataccgtctggctcgtggtggccttcagcaatgcctccaggggcttccagaacccggagacactggctgacattccggcctccccacagctgctgaccgatggccactacatgacgctgcccctgtctccggaccagctgccctgtggcgaccccatggcgggcagcggaggcgcccccgtgctgcgggtgggccatgaccacggctgccaccagcagcccttctgcaacgcgcccctccctggccctggaccctatcgggaagacccccgtgaagttcctcctgatggacaccaggggctcacccagggctgagaccaagtggtcagaccccatcactctccaccaagggaagacccccggatccatcgacacctggccagggcggcgaagtggcagcatgatcgtcattacctccatcctctcttctctggccggcctcctactcttggccttcttggcagcctctaccatgcgcttctccagcctgtggtggccggaggaggccccggagcagctgcggatcggctccttcatgggcaagcgctacatgacccaccacatcccacccagcgaggccgccacactgccggtgggctgcaagcctggcctggaccccctccccagcctcagcccctagcctggcctctttgcatggggctgggggagatggggcgccgggagtgagtgcatggtgctttgtcccagctcctgcacccacaggccccctcagggctccttgcctttcccccccaccagcacaccccgtaccctgcctggaatcccagcaccagcccccctgcctctcctctgcctttctggtttctctccctctccaagcatctgtaagttgcactcaggagggtttaggggagggccatgggcaggctggtctcgtgatagtgagtgagtgctcatgggatctggttgtttagaagcatgcagcacctcctgcttcactctctctgtctctcctgctccaccatggccagaaacgtgcctgcttccccttcgccttctgccgtgattgtcagtttcttgagggctccccagccatgcttcctgtacagcctgcaaaactgtgagtcaattaaacctcttttcttcat

SEQ ID NO: 17115 - DNA, 467 bp, Homo sapiens
ccccaccaagctgtttgtgatggcatcagtctcctcatttaagactgaacatttaagctgataatttagatcctgtctgcttggaggcattattattattttactgggaggctcggctaagaaggtaaaaggacacaaagccctgtagccttctcctgggagcatggattattttttcagattccctaagtgctgggagatggatgagtacattttaagggcacttggaagtaggatagaaggagtgaggtgggatctattctcctaagtaccaaggctgtagaaccataagttagggacagaggagaccactccagaacagagcattaaaaaggaacaagaggaggaatagcaaagaaaaaaatgtctcctttctgaattttgctaaatgctggccccagccccaagtggaaaaagcatgatattcttttaataaatcagctttgaaatgacttcccaaatggaaa

SEQ ID NO: 17116 - DNA, 891 bp, Homo sapiens
  misc_feature (3)..(3): n is a, c, g, or t
  misc_feature (8)..(8): n is a, c, g, or t
  misc_feature (18)..(18): n is a, c, g, or t
  misc_feature (21)..(22): n is a, c, g, or t
  misc_feature (26)..(26): n is a, c, g, or t
  misc_feature (33)..(33): n is a, c, g, or t
  misc_feature (36)..(36): n is a, c, g, or t
  misc_feature (44)..(44): n is a, c, g, or t
  misc_feature (47)..(47): n is a, c, g, or t
  misc_feature (51)..(51): n is a, c, g, or t
  misc_feature (54)..(54): n is a, c, g, or t
  misc_feature (57)..(58): n is a, c, g, or t
  misc_feature (61)..(61): n is a, c, g, or t
  misc_feature (65)..(65): n is a, c, g, or t
  misc_feature (69)..(69): n is a, c, g, or t
acncgccntccacgtgcnccnnctgnctctccnttntcgcttgnganctcnagnctnnccncggnttgnaatggaccccaactgctcctgcgccactggtaagggacgcccgggttctgtgccttgggatgccaaattcccagacaccatagagagtgtccctgggtttgaggaggtcgtattttgctatcagaggtaaaggggactcctttattggtccagtgctttcctgttggccaagctcctgagggcattttcctcctccctgttcctctatgtcagagttgagggtcctgaggctcaaggctgtcctgctccacgtcacctggttggtcacagggctgctggctgagccccaattctctaacctgactctgagctaccggattggataggagacattggataggaggggacattgcctcttccaggttcaggacagaaagtcgaagtcttcctgggccatgtctgcagcctgggactttcctttggagtagaaataggagggtgcttggttttcccagcatgaatggagaggacatggggcttctcttcctctgctctgagtgggaaaggagctctgagggctggctctgcacagagaagggggaagtggacactcattgacccactgctgtaccttctgcatctcactcaccgttcactggctttttctcttctagcaggtggctcctgcacgtgcgccggctcctgcaagtgcaaagagtgcaaatgcacctcctgcaagaagagctgctgctcctgctcccaagtacaaatagagtgacccgtaaaatccaggattttttgttttttgctacaatcttgacccctttgctacattcctttttttctgtgaaatatgtgaataataattaaacacttagactc

SEQ ID NO: 17117 - DNA, 303 bp, Homo sapiens
  misc_feature (3)..(3): n is a, c, g, or t
  misc_feature (8)..(8): n is a, c, g, or t
  misc_feature (18)..(18): n is a, c, g, or t
  misc_feature (21)..(22): n is a, c, g, or t
  misc_feature (26)..(26): n is a, c, g, or t
  misc_feature (33)..(33): n is a, c, g, or t
  misc_feature (36)..(36): n is a, c, g, or t
  misc_feature (44)..(44): n is a, c, g, or t
  misc_feature (47)..(47): n is a, c, g, or t
  misc_feature (51)..(51): n is a, c, g, or t
  misc_feature (54)..(54): n is a, c, g, or t
  misc_feature (57)..(58): n is a, c, g, or t
  misc_feature (61)..(61): n is a, c, g, or t
  misc_feature (65)..(65): n is a, c, g, or t
  misc_feature (69)..(69): n is a, c, g, or t
acncgccntccacgtgcnccnnctgnctctccnttntcgcttgnganctcnagnctnnccncggnttgnaatggaccccaactgctcctgcgccactggtggctcctgcacgtgcgccggctcctgcaagtgcaaagagtgcaaatgcacctcctgcaagaagagctgctgctcctgctcccaagtacaaatagagtgacccgtaaaatccaggattttttgttttttgctacaatcttgacccctttgctacattcctttttttctgtgaaatatgtgaataataattaaacacttagactc

SEQ ID NO: 17118 - DNA, 540 bp, Homo sapiens
gcctcacctactgtgctcctcctctttcatgaacgagccttcctgcctgtcatcacaaggcagacctcaaagcccctcttccaagcacagtaagcccaagatgtctgcctgtaggtcactcctggaactaggccaatacagagtggacacatggaataagaaattcatcacttctccggtggcctaaaggagccagcttcttaatattttctccatcatttcctgcttggtgtctgtcccaagtgtgggtaaaaagatgtaggagttctccctaatctgccatggaaacagctcagtcctctctcttaatttccagcatcatctgctgctcattgaaccctgagaggctgtccagcctcctggaggctgtctcaagcttctttgcatgatggtgggacagtgggttggctaaaaggaggttcctaaccatgtgctgtgagaaactgctgccctcagccctcagagtggctagggtcgccagagcctctgggctggttagctctagctgtgagcagcgtcatctgggatacagctctcctc

SEQ ID NO: 17119 - DNA, 378 bp, Homo sapiens
gagggagctccactcaggcctgtgccagactccgagggggagttcaaagacctaaggtcttgtctttgccccgccatgtccacaataacataacacatgtaccatctactttccctgaagttgtggttttctgttcaggttcctgattccctaattggcctgtagctcccagagcagcagatctgggctcctccccctcttctctggtgtgtaggcagtgcattgaagaacacaggtgcattggtgttagttctcagctcgtttctaatgtttaacatatacagtgtttcttgagctattactatgtgtccttacgatgcataccctgctctgatgatttccatgcattttatttccactgctatttcacagatgagg

SEQ ID NO: 17120 - DNA, 399 bp, Homo sapiens
agtgtgtccacatttacatagtctttctagctacttcaatctctcttgccacttctgccttcaaataagcttcaattttttaaaaaagacttttgactttactttcaactactgccctttgcctcatattgtgttttcaatacaattccaggaaatattaggaatgattgttttttacttcttaatcacctatatctactttcactccttcattaagtctgtttttttcctaaggtcttcattaattatttcaaacaaatctaaaggttgttgggttttttccccttagtctttattattcttgatctatcttttgcaaagaacaaagctaatgtccattttatttagtatctctttctctctctccatgtatttaatacccaagaattctttctgtcc

SEQ ID NO: 17121 - DNA, 642 bp, Homo sapiens
caccatctttaaagtgcttagggaaggagagctttggggaaagctgggaatcaagaattctacatccggcagaaatatcccacaggaatgaatgccacatgaagattattttagattttaaaagtgagaaaggaccagatgcggtagctcacacctgtaatcccagcattttgggaggccacacggcaggtggatcacttgaagccaggagttttgagaccaacctgcctgaaaccctgtctctattaaaaaaattaaatttaaaagagaaagaatttgttgccagctaccctccactagtagaaatgctgaagtaaattctttgggatgaagggaaatgatataccaagtcaaactcctgttttcaaaaaggaatgaagggaaaacttgtcttattttatcctctttatttgtttcaaatgtatatgatgttgaaagcaaaaaaaaaaaagtaacattgggtgatttatatgtagatataatacatatggcaactatatcagaaaggactgggatgggcaggtaaatagaatcatttggtgacaagttttttacatttttcataaattgtatgatattaactctgaaatgttaatatctgaaaatgtaaaggtatatttcagttcttagaacagacactta

SEQ ID NO: 17122 - DNA, 251 bp, Homo sapiens
tgaggaaggagggacagatttgtgggagacaaggtctgtgtagggcacaagaggtaggaagtgcctgtagggcatcaagtatgtggagatgtctggtattcagtttgtggttagagcttaggaaaagaggtcagacccagagataaagtctttgtctctttcccaaatcattcgtgtgatattctctctctctctctctctctctctctctctcttttttgagacggggtctctctttgtcccctgggctg

SEQ ID NO: 17123 - DNA, 778 bp, Homo sapiens
agattctaatactatatttttaccgtcctttttctatgtttagacatgcagatagcatggtgacagttgcctgcagtattcagtaccgtgctgtacagatgtgtagctaggagcagtaggttatggcacacagcctaggtgtgtagtgggtgccaccatctaggtctgtttaagtgtgctctgtgatgctcccacgacaaaatcgtccaacagcgcatttctcagaatgtacccctgtcgtcaactgatgcatggctgtaattttaagccagctgttcaaaaaagttctcaccaattagagaatttatattctcaccactttaacaaacggagttaagtaagaaacctctaaaatggttgctagaaattaaatattgtcaccgacctggtcaaaaccttttaagtaaaatgattagccaatcacagccttggcttacactggcatcagagtctggtgtgtgtcgcacacacgtgctgtaggtggaatgtttcatgacgaggactttctggaactcagaagccctttttgagtggggcccgggtagctgtaggatgggcagatctgaattcccagtacagtgtggcattttgaaaaagaaagaatgtataagaataaaagggtcagtcaagaagtaggagcaattattacccaactattcgaaggatgaccctttaaaaatcaataaaaacctatctggagtgaaagaccaacttaaatgagcaatagcatgaattacgtaatataaagacaagcgttcctgcttcaaagcacacgaaa

SEQ ID NO: 17124 - DNA, 576 bp, Homo sapiens
ggcagttaggcaggcaccagtagtatcatctgcacagttgaatactttattagccataacaatgtgcaaacaatccacacacttcatttgggatatttattccttcaggtgtaacttaagcatcttttttgactctaaacaattgagcgtattatggaaaatccttatttttctaaaccatcgtacttaacattaatgcttgtattctcaacaagcacaatattgtgaaaattggtttgggtcaggaggaggaaaaaaaaatcttagaaattgcaatggctgtgcatggtggctcattctggtaatcccagcactttaggaggccaaggtaaacagatcacctgagcccaggagttcgagaccagcttgggcaacgtggtgaagccctgttactacaaaacaaacaaacaaacacccaaaaaattagccaggcatggtagcttgcacctgtagtcccagctattcggaagactgaggtgggaggatcagttgatcccaggaaattgaggctgcagtgagctgtgatcatgcccctgcattgcagcctgggcaacagagcaagaccccatctcaaaa

SEQ ID NO: 17125 - DNA, 178 bp, Homo sapiens
gtgcctggccgctgcttggttttaaatgaatcttggatacaggtggccagactaaatggtctctcaacttgtcttcaagtttaggattttaatttttgatatttttcacttctctctggaaatttgttcaattctcaattgttgggggagtgcgcagctgcttcattatgagtttact

SEQ ID NO: 17126 - DNA, 779 bp, Homo sapiens
tcagtctcaggagttgctaagactacaggcgcacaccaccacgcccaactaattttttgtatttttagtagagatggggtttcaccacgttggccaggctggtctggaactcctagcctcaagtgatcctcccatctctgcctcccaaagtgctggaattacaggtgtaagccaccgtgcccagccctaaagagatcttttaatttcaaaagaaaaacatgtttgttggaagaaataaactaaacaaaactgtaaaaagtaaaagcccctctcctagttgttgagtttatcagtttacttaaaaaatggctgtcgcttatgcctgtaatcccagcactttgtggggctaaggcgggaggactgcttgagaccagcagtttgggaccatcctgggcaacatagcaagacccgtctctccaaaaaaaaaaaaaaaaaaaaaaaaattgccaggtgtgatggtgcacatctgtagtcccggctacaagggaggctaaggcaggaagactgcttgagcccaccagttcgaggctgctgtgagatatgatcccaccactgcacttgagcctcggtggcagtgcaaaatcctgtctctaaaaacaaaaaccaacaaaaaaaggcatcttactttctatgtggtcctgaaatttttttcaattaatgtcaatgacttttaattgttctcttggttatctaacaagaatcaatagaagacttttacaaattaaatgttatagaaaattctttaaccaactcagtttaattctaaacagcttcatgat

SEQ ID NO: 17127 - DNA, 517 bp, Homo sapiens
tagccaacagtgtcatactgtaggaaacaccgcccacaagtcttctaggcttgaattcctagcgagcttccccacatttgccaggtgcttctaagccaatgattatggagggagcatctggccctgcctgaccctagcagtggagaggtaatccaactaagttctggcgctcacatgaaatcttccccagattgggagagaagcaactgcatgtcagtgattactcatggacacaatatctggtcctgcccaagcctagcagtgaagagatgatccaactcagccctgatgctctcattatgtcttccccaaaccaggaggcagttgcaggtcagtgattacccatggaaagagcatctggccaccaccaaaccttggcgttctactctaccctagaccagtaggtaagcccaagtccacacatgtctatagggcatatcctctggccttgtccaccttgtgtggctgagtaacaaccacaaaaatctcacccagcatgggagcctgtcatacagct

SEQ ID NO: 17128 - DNA, 717 bp, Homo sapiens
atttatccatggtgtatcgtagcatactaataatagaaactggaacattatgtctcttgtgaactataggaatatttaccgtgtgttcttaatctttcatctcttgaatatttgacttttaaagattcttctgaaggcatattcaaataaaattttggaaatgtgaaaccagagaaaactatacgtacacatacatacatgtttacatatgcatacacacacatctttttttaacctattagactgtgtcaggctccatggattggtatcgttttgtaaaatgatgattactaaagagactatttaaaggaactaatgatagtctaactctaatacaggatgcctctcaagattttatacacaactttttcttgctaataatcttatattctagcactagacaaaaatgctaaattgagaccattttaagaaaatgggccaggcgcggtggctcacccctgtaatcccagcactttgggaggctgaggcgggtggatcacgaggtcagggggtcgagaccacggtgaaaccccatctctactaaaaatacaaaaaaaattcgccgggcacggtggtgggcgcttgtggtcccagctactcgggaggctgaggcaggagaatggcgtgaacccaggaggcggagcttgcagtgagctgagattgcgccattgcactccagcctgggcgacagagcaagactctgtcttaaaaaaaaaa

SEQ ID NO: 17129 - DNA, 368 bp, Homo sapiens
cagtttggttttccatccgcagagttgatttagtcagagtgtaatttgtgcaaaatgagaacatctgtaagagtcagacacctttgggttctgtctgctaaagaaaaggtttatgaatttaagagtttatttgcggccgggcgtggtggctcatgcgtgtaatcccagcactttgggaggccgaggcaggtggatcacctgaggtcaggagtttgagactaacctggccaacatgatgaaaccccatctctactaaaaatacaaaaaattagcaggacatggtggcaggcacctgtagtcccagctactggggaggctgaggcaggagaatcgcttgaacctgggaggcggatggaggttgctgtgag

SEQ ID NO: 17130 - DNA, 419 bp, Homo sapiens
cactttgggaggccgaggtgggtggatcatgaggtcaggagatcgagaccatcctgactaacacggtgaaaccccgtctctactaaaaatacaaaaattagccaggcgtggtcgcgggcgcctgtagtcccagctactcaggaggctgaggcaggagaatggcttgaacccaggaggcggagcttgcagtgagccgagatcgtgccactgcagtccagcctggacgacagagcaagactccgtctaaaaaaaaaaaaaaaaacaaaaaacaaaaagtagccaagcatggtatcacactcctgtagtcccagctactcaggtgagaggaccacttcagcccagaaaggtggtgatgctgtggtgagctgtgatggtgccactgcactctggcctaggcaacagagtgagaccctgtctcg

SEQ ID NO: 17131 - DNA, 305 bp, Homo sapiens
ttttttttttgagacaaggtctcgctcttttgtccaggctccagtacaatggtgcaatcttggctcgctgcaacttccacctcccaggctcaagcaattcttctgcctcagcctcccgagtatctgggactacaggcgtgtcaccatgccttgctataagagttggtgttttgaatagataaatcaaatcaataaaactttagctagactaagaaaaaaaagaaatctcaaaaccagaaatgaaaaaagaaacattacaactgatattacaaaaatataaagaattataagaaactactatgaac

SEQ ID NO: 17132 - DNA, 234 bp, Homo sapiens
atgggcaatgtctgtttttctacattcttagtgtaaaatatctttgtcacgctttttttcttaagaatttttttatgtgttattttcctcaatcagacagaatgtgcatccaaaatgacaaagtctcaattttttatttcaatgaaacctatgtaaatagtaacttacttaattcaccagaatcctcagtgaactggatcctgcctgcatcagactttagggaaaaaaaggaaa

SEQ ID NO: 17133 - DNA, 832 bp, Homo sapiens
  misc_feature (758)..(758): n is a, c, g, or t
  misc_feature (770)..(770): n is a, c, g, or t
tgggggtcagtgtcacctccaggatacagacagccccccttcagcccagcccagccaggtctcctacaccgccaccatgccattcggtaacacccacaacaagttcaagctgaattacaagcctgaggaggagtaccccgacctcagcaaacataacaaccacatggccaaggtactgacccttgaactctacaagaagctgcgggacaaggagactccatctggcttcactgtagacgatgtcatccagacaggagtggacaacccaggtcaccccttcatcatgaccgtgggctgcgtggctggtgatgaggagtcctacgaagttttcaaggaactctttgaccccatcatctcggatcgccacgggggctacaaacccactgacaagcacaagactgacctcaaccatgaaaacctcaagggtggagacgacctggaccccaactacgtgctcagcagccgcgtccgcactggccgcagcatcaagggctacacgttgcccccacactgctcccgtggcgagcgccgggcggtggagaagctctctgtggaagctctcaacagcctgacgggcgagttcaaagggaagtactaccctctgaagagcatgacggagaaggagcagcagcagtcatcgatgaccacttcctgttcgacaagcccgtgtcccgtgctgctggctcaggcatggccggaatggccgaagccgtgggtctggacaatgacaacaagagctcctggggggggaccagggngcaccccgggancccgggaacggggacacagggtccgcggtggaggcaaaagagcaaaaaagcgccgggaaacg

SEQ ID NO: 17134 - DNA, 832 bp, Homo sapiens
tgggggtcagtgtcacctccaggatacagacagccccccttcagcccagcccagccaggtctcctacaccgccaccatgccattcggtaacacccacaacaagttcaagctgaattacaagcctgaggaggagtaccccgacctcagcaaacataacaaccacatggccaaggtactgacccttgaactctacaagaagctgcgggacaaggagactccatctggcttcactgtagacgatgtcatccagacaggagtggacaacccaggtcaccccttcatcatgaccgtgggctgcgtggctggtgatgaggagtcctacgaagttttcaaggaactctttgaccccatcatctcggatcgccacgggggctacaaacccactgacaagcacaagactgacctcaaccatgaaaacctcaagggtggagacgacctggaccccaactacgtgctcacctgcccatccaacctgggcactgggctgcgtggaggcgtgcatgtgaagctggcgcacctgagcaagcaccccaagttcgaggagatcctcacccgcctgcgtctgcagaagaggggtacaggtggcgtggacacagctgccgtgggctcagtatttgacgtgtccaacgctgatcggctggctcgtccgaagtagaacaggtgcagctggtggtggatggtgtgaagctcatggtggaatggggagaagttggagaaggccagtccatcgagcatgatccccgagaatagggctgcaactgcacgtgcgggacccaaggggggggcaccaaattgtcaacgcgccgcacaccggggatctcccttacacgca

SEQ ID NO: 17135 - DNA, 819 bp, Homo sapiens
tgggggtcagtgtcacctccaggatacagacagccccccttcagcccagcccagccaggtctcctacaccgccaccatgccattcggtaacacccacaacaagttcaagctgaattacaagcctgaggaggagtaccccgacctcagcaaacataacaaccacatggccaaggtactgacccttgaactctacaagaagctgcgggacaaggagactccatctggcttcactgtagacgatgtcatccagacaggagtggacaacccaggtcaccccttcatcatgaccgtgggctgcgtggctggtgatgaggagtcctacgaagttttcaaggaactctttgaccccatcatctcggatcgccacgggggctacaaacccactgacaagcacaagactgacctcaaccaggagctctagttaatggagagctcccagcacactcggagctttgtgctttgtcctccacgcaaagcgaccaaaataaaagcctcgtggcccttaacaaaccaacacacaccacaacaccccaccgcgccccacacacacccccaccccccccacacacactgcgtgcggcgccgccgccccccacagacaactcctccacaacacacgttggggcgccacccccccagcgatagcaacaacggcccacgctccccaagaaacccgcccaacagccgtgctcccccacaaaaaagcgcggccccgcagcgtcgcacacccagacgcgcgcccacagccccacgacgccacgaccatacacgcaccgcgcagcaaccccacgcacacagcacacaggcccacacgccacg

SEQ ID NO: 17136 - DNA, 854 bp, Homo sapiens
tgggggtcagtgtcacctccaggatacagacagccccccttcagcccagcccagccaggtctcctacaccgccaccatgccattcggtaacacccacaacaagttcaagctgaattacaagcctgaggaggagtaccccgacctcagcaaacataacaaccacatggccaaggtactgacccttgaactctacaagaagctgcgggacaaggagactccatctggcttcactgtagacgatgtcatccagacaggagtggacaacccaggtcaccccttcatcatgaccgtgggctgcgtggctggtgatgaggagtcctacgaagttttcaaggaactctttgaccccatcatctcagaaggggggcaacatgaaggaggttttccgccgcttctgcgtagggctgcagaagattgaggagatctttaagaaagctggccaccccttcatgtggaaccagcacctgggctacgtgctcacctgcccatccaacctgggcactgggctgcgtggaggcgtgcatgtgaagctggcgcacctgagcaagcaccccaagttcgaggagatcctcacccgcctgcgtctgcagaagaggggtacaggtggcgtggacacagctgccgtgggctcagtatttgacgtgtccaacgctgatcggctggctcgtccgaagtagaacaggtgcagctggtggtggatggtgtgaagctcatggtggaatggggagaagttggagaaggccagtccatcgagcatgatccccgagaatagggctgcaactgcacgtgcgggacccaaggggggggcaccaaattgtcaacgcgccgcacaccggggatctcccttacacgca

SEQ ID NO: 17137 - DNA, 927 bp, Homo sapiens
tgggggtcagtgtcacctccaggatacagacagccccccttcagcccagcccagccaggtctcctacaccgccaccatgccattcggtaacacccacaacaagttcaagctgaattacaagcctgaggaggagtaccccgacctcagcaaacataacaaccacatggcgagcgccgggcggtggagaagctctctgtggaagctctcaacagcctgacgggcgagttcaaagggaagtactaccctctgaagagcatgacggagaaggagcagcagcagtcatcgatgaccacttcctgttcgacaagcccgtgtcccgtgctgctggctcaggcatggccggaatggccgaagccgtgggtctggacaatgacaacaagagctcctgggggggtgaacgaggaggatcacctccgggtcatctccatggagaaggggggcaacatgaaggaggttttccgccgcttctgcgtagggctgcagaagattgaggagatctttaagaaagctggccaccccttcatgtggaaccagcacctgggctacgtgctcacctgcccatccaacctgggcactgggctgcgtggaggcgtgcatgtgaagctggcgcacctgagcaagcaccccaagttcgaggagatcctcacccgcctgcgtctgcagaagaggggtacaggtggcgtggacacagctgccgtgggctcagtatttgacgtgtccaacgctgatcggctggctcgtccgaagtagaacaggtgcagctggtggtggatggtgtgaagctcatggtggaatggggagaagttggagaaggccagtccatcgagcatgatccccgagaatagggctgcaactgcacgtgcgggacccaaggggggggcaccaaattgtcaacgcgccgcacaccggggatctcccttacacgca

SEQ ID NO: 17138 - DNA, 805 bp, Homo sapiens
tgggggtcagtgtcacctccaggatacagacagccccccttcagcccagcccagccaggtctcctacaccgccaccatgccattcggtaacacccacaacaagttcaaagggaagtactaccctctgaagagcatgacggagaaggagcagcagcagtcatcgatgaccacttcctgttcgacaagcccgtgtcccgtgctgctggctcaggcatggccggaatggccgaagccgtgggtctggacaatgacaacaagagctcctgggggggtgaacgaggaggatcacctccgggtcatctccatggagaaggggggcaacatgaaggaggttttccgccgcttctgcgtagggctgcagaagattgaggagatctttaagaaagctggccaccccttcatgtggaaccagcacctgggctacgtgctcacctgcccatccaacctgggcactgggctgcgtggaggcgtgcatgtgaagctggcgcacctgagcaagcaccccaagttcgaggagatcctcacccgcctgcgtctgcagaagaggggtacaggtggcgtggacacagctgccgtgggctcagtatttgacgtgtccaacgctgatcggctggctcgtccgaagtagaacaggtgcagctggtggtggatggtgtgaagctcatggtggaatggggagaagttggagaaggccagtccatcgagcatgatccccgagaatagggctgcaactgcacgtgcgggacccaaggggggggcaccaaattgtcaacgcgccgcacaccggggatctcccttacacgca

SEQ ID NO: 17139 - DNA, 649 bp, Homo sapiens
tgggggtcagtgtcacctccaggatacagacagccccccttcagcccagcccagccaggtctcctacaccgccaccatgccattcggtaacacccacaacaagttcaagctgaattacaagcctgaggaggagtaccccgacctcagcaaacataacaaccacatggccaaggtactgacccttgaactctgcgtagggctgcagaagattgaggagatctttaagaaagctggccaccccttcatgtggaaccagcacctgggctacgtgctcacctgcccatccaacctgggcactgggctgcgtggaggcgtgcatgtgaagctggcgcacctgagcaagcaccccaagttcgaggagatcctcacccgcctgcgtctgcagaagaggggtacaggtggcgtggacacagctgccgtgggctcagtatttgacgtgtccaacgctgatcggctggctcgtccgaagtagaacaggtgcagctggtggtggatggtgtgaagctcatggtggaatggggagaagttggagaaggccagtccatcgagcatgatccccgagaatagggctgcaactgcacgtgcgggacccaaggggggggcaccaaattgtcaacgcgccgcacaccggggatctcccttacacgca

SEQ ID NO: 17140 - DNA, 1177 bp, Homo sapiens
tgggggtcagtgtcacctccaggatacagacagccccccttcagcccagcccagccaggtctcctacaccgccaccatgccattcggtaacacccacaacaagttcaagctgaattacaagcctgaggaggagtaccccgacctcagcaaacataacaaccacatggccaaggtactgacccttgaactctacaagaagctgcgggacaaggagactccatctggcttcactgtagacgatgtcatccagacaggagtggacaacccaggtcaccccttcatcatgaccgtgggctgcgtggctggtgatgaggagtcctacgaagttttcaaggaactctttgaccccatcatctcggatcgccacgggggctacaaacccactgacaagcacaagactgacctcaaccatgaaaacctcaagggtggagacgacctggaccccaactacgtgctcaacagcctgacgggcgagttcaaagggaagtactaccctctgaagagcatgacggagaaggagcagcagcagtcatcgatgaccacttcctgttcgacaagcccgtgtcccgtgctgctggctcaggcatggccggaatggccgaagccgtgggtctggacaatgacaacaagagctcctgggggggtgaacgaggaggatcacctccgggtcatctccatggagaaggggggcaacatgaaggaggttttccgccgcttctgcgtagggctgcagaagattgaggagatctttaagaaagctggccaccccttcatgtggaaccagcacctgggctacgtgctcacctgcccatccaacctgggcactgggctgcgtggaggcgtgcatgtgaagctggcgcacctgagcaagcaccccaagttcgaggagatcctcacccgcctgcgtctgcagaagaggggtacaggtggcgtggacacagctgccgtgggctcagtatttgacgtgtccaacgctgatcggctggctcgtccgaagtagaacaggtgcagctggtggtggatggtgtgaagctcatggtggaatggggagaagttggagaaggccagtccatcgagcatgatccccgagaatagggctgcaactgcacgtgcgggacccaaggggggggcaccaaattgtcaacgcgccgcacaccggggatctcccttacacgca

SEQ ID NO: 17141 - DNA, 719 bp, Homo sapiens
  misc_feature (645)..(645): n is a, c, g, or t
  misc_feature (657)..(657): n is a, c, g, or t
tgggggtcagtgtcacctccaggatacagacagccccccttcagcccagcccagccaggtctcctacaccgccaccatgccattcggtaacacccacaacaagttcaagctgaattacaagcctgaggaggagtaccccgacctcagcaaacataacaaccacatggccaaggtactgacccttgaactctacaagaagctgcgggacaaggagactccatctggcttcactgtagacgatgtcatccagacaggagtggacaacccaggtcaccccttcatcatgaccgtgggctgcgtggctggtgatgaggagtcctacgaagttttcaaggaactctttgagcagccgcgtccgcactggccgcagcatcaagggctacacgttgcccccacactgctcccgtggcgagcgccgggcggtggagaagctctctgtggaagctctcaacagcctgacgggcgagttcaaagggaagtactaccctctgaagagcatgacggagaaggagcagcagcagtcatcgatgaccacttcctgttcgacaagcccgtgtcccgtgctgctggctcaggcatggccggaatggccgaagccgtgggtctggacaatgacaacaagagctcctggggggggaccagggngcaccccgggancccgggaacggggacacagggtccgcggtggaggcaaaagagcaaaaaagcgccgggaaacg

SEQ ID NO: 17142 - DNA, 412 bp, Homo sapiens
ccagaaatccccattagccgacatctctttcataggccagattccagataatgatgtaggaatttccggttcactacacatttctacttcctaagatggggtggcttgccatttctccacccgtgaacttccaggacatgccctcctacgtctcctcctttaaatccctctgtcttcagtcccatacagaggtgagaacttctacctgttccctttgagaaccaggccgggaggaggattggaaccaattcacagtttagtaactagaattgaggtattataaacttttccaggttgcttttcctattgtttcattattattatcaaagttgatcctcactgttcaggtagttcttggcccttttgttccactcagtatttcttctgataattcagtgtgcagactttgtct

SEQ ID NO: 17143 - DNA, 279 bp, Homo sapiens
aggattttgtggctgaggcaggatcaaaggtgaactttaaaagtaaagctttattgattacctattgtaactgaagtcatctatgctaattatatatgtggattgatggggaatgtggttaaaagagaattctatacttcacactcattaggataagaaacaaaataatataaataataataaaatgcagtatattccaatattaaaaccctttctagagcattcaattatgggagccttggttaaggctcgatcttgtcttaacactgtctcaaggtt

SEQ ID NO: 17144 - DNA, 2098 bp, Homo sapiens
ggcacgagggtgagccgagattgcaccactgcactccagcctgggtgacagagcgagactccatctaaaaaaaataaataaacatgggagaaacctggaagaatatttgctcaactgtgaggcatggttggtggctaagggatcacagaatggcaggcctgcctattcctcctgagatcgttaaggaggctgaggtgccgcaggctgcgctgggcgtcccagcccaggggacaggggacaatggccacacgcctgtggaggaggaggtcgggggcatcccagtaccagcaccggggctcctgcaggtcacggagaggaggcagcctctgagcagcgtctcctctctggaggtccacttcgacctcctggacctcactgagctcaccgacatgtcggaccaggagctggccgaggtctttgctgactcggacgacgagaacctcaacaccgagtccccagcaggtctgcacccgctgccccgggccggctacctgcgctccccttcctggacgaggacaagggctgagcagagccacgagaagcagcccctaggcgaccccgagcggcaggccacagtcctggacacgtttctcactgtggagaggccccaggaggactagaccatctccacctgccccagctcctgcagggatggggtccgaacacgatggcagatctgggcagtgctgacccagcagacacacttcacccgcccacgaggctccagccgtcacctcctgacacacaccctgggggcagctctctgccagccccgagaccggccttgtctgctgggcacgggtcttcgcctcacttggagaccagccggctttcctgggggacacacggggcccccggatgcctctgggagccccagcacaagcacagcccagtggccttacgtccagctcgttcctgggccccgagtcaggaagacagcgtcacggagtcactgccaggaacgtgctgaggaatggagtggcccacggcggccttggggtgaaggggacccaggcctgtgacagccactccaggaactcctgggggtgctccaacctccgcgttttcctgtgctgccaagctcagaagccagaggcgggtttggtagtggctaatgggacaatgtgctgtccagcaaagcacacatggagaagcggccccaaaattcccaccttgatttccatcctgccccttcttctactccacggaggcgctgtctcactagggtcccctccccaaggctcagctctaagacctgcacctgcttctcttggcccctgcgtgacagacaagtccattccctccttagctcagaacaccaaatatcaccagactgcctaagagacttgatgacacctcccggaatgctctcggggtggggttcacctctccttgtcctgcacccactgctaggccacattctcgtttctgctcacatcccattgcccggctacaaggcctgcccacggcccttaaacttgctgggcaggtttggagcccatgggaccccgtgggtctctgtccaggagcagcagaggaggctgacaggccctgctccctctgctctgggggtgtctgggagccccagctcacaccctcccaatgcttatatgctgaagctcacagaatgggcttcttgcctgacagcaagtcaaagaatgagtttaatatcaaagtgtaagcttactttccatccccaagccagcctgccccctgccccatttcccatgagcacacttctggggaaggaaaacaggctcctggccttcactctcagcagagctttggagatgccccaggcatgccctgagctccttctgtgtacctgctcccacttctgagccacccgctgcccctccgcactgctggcaaacccagttcctgcctcagccaggtctccttccctggtttccagtcacacagagcccagcagctttctctttcagtcccataagggcagccttgtgtccctggccacacttccacccgccagggtcttcctccccatctttccatccttcctgctgagcttccacagagctcgtttgcaaacagggggattaaagcatcactgcgcattcgaaaaaaaaaaccacag

SEQ ID NO: 17145 - DNA, 2161 bp, Homo sapiens
  misc_feature (29)..(29): n is a, c, g, or t
  misc_feature (51)..(52): n is a, c, g, or t
  misc_feature (56)..(56): n is a, c, g, or t
  misc_feature (76)..(77): n is a, c, g, or t
ctgggggggcgccgggagggggccggggnccgggagcagctgcgcgccccnnccgncccgcggctcctccctgccnncgcggcccccggttgctgccccgatgcgctgcgcccggagccggggccgagtcgctgccgcagctgttggggcgcccgggccaggcgacgccgccgtcgcccgtgcccctcccagaccgcaccggccgcatggagcccccggagggcgccggcaccggagagatcgttaaggaggctgaggtgccgcaggctgcgctgggcgtcccagcccaggggacaggggacaatggccacacgcctgtggaggaggaggtcgggggcatcccagtaccagcaccggggctcctgcaggtcacggagaggaggcagcctctgagcagcgtctcctctctggaggtccacttcgacctcctggacctcactgagctcaccgacatgtcggaccaggagctggccgaggtctttgctgactcggacgacgagaacctcaacaccgagtccccagcaggtctgcacccgctgccccgggccggctacctgcgctccccttcctggacgaggacaagggctgagcagagccacgagaagcagcccctaggcgaccccgagcggcaggccacagtcctggacacgtttctcactgtggagaggccccaggaggactagaccatctccacctgccccagctcctgcagggatggggtccgaacacgatggcagatctgggcagtgctgacccagcagacacacttcacccgcccacgaggctccagccgtcacctcctgacacacaccctgggggcagctctctgccagccccgagaccggccttgtctgctgggcacgggtcttcgcctcacttggagaccagccggctttcctgggggacacacggggcccccggatgcctctgggagccccagcacaagcacagcccagtggccttacgtccagctcgttcctgggccccgagtcaggaagacagcgtcacggagtcactgccaggaacgtgctgaggaatggagtggcccacggcggccttggggtgaaggggacccaggcctgtgacagccactccaggaactcctgggggtgctccaacctccgcgttttcctgtgctgccaagctcagaagccagaggcgggtttggtagtggctaatgggacaatgtgctgtccagcaaagcacacatggagaagcggccccaaaattcccaccttgatttccatcctgccccttcttctactccacggaggcgctgtctcactagggtcccctccccaaggctcagctctaagacctgcacctgcttctcttggcccctgcgtgacagacaagtccattccctccttagctcagaacaccaaatatcaccagactgcctaagagacttgatgacacctcccggaatgctctcggggtggggttcacctctccttgtcctgcacccactgctaggccacattctcgtttctgctcacatcccattgcccggctacaaggcctgcccacggcccttaaacttgctgggcaggtttggagcccatgggaccccgtgggtctctgtccaggagcagcagaggaggctgacaggccctgctccctctgctctgggggtgtctgggagccccagctcacaccctcccaatgcttatatgctgaagctcacagaatgggcttcttgcctgacagcaagtcaaagaatgagtttaatatcaaagtgtaagcttactttccatccccaagccagcctgccccctgccccatttcccatgagcacacttctggggaaggaaaacaggctcctggccttcactctcagcagagctttggagatgccccaggcatgccctgagctccttctgtgtacctgctcccacttctgagccacccgctgcccctccgcactgctggcaaacccagttcctgcctcagccaggtctccttccctggtttccagtcacacagagcccagcagctttctctttcagtcccataagggcagccttgtgtccctggccacacttccacccgccagggtcttcctccccatctttccatccttcctgctgagcttccacagagctcgtttgcaaacagggggattaaagcatcactgcgcattcgaaaaaaaaaaccacag

SEQ ID NO: 17146 - DNA, 1144 bp, Homo sapiens
  misc_feature (29)..(29): n is a, c, g, or t
  misc_feature (51)..(52): n is a, c, g, or t
  misc_feature (56)..(56): n is a, c, g, or t
  misc_feature (76)..(77): n is a, c, g, or t
  misc_feature (1078)..(1078): n is a, c, g, or t
  misc_feature (1121)..(1121): n is a, c, g, or t
ctgggggggcgccgggagggggccggggnccgggagcagctgcgcgccccnnccgncccgcggctcctccctgccnncgcggcccccggttgctgccccgatgcgctgcgcccggagccggggccgagtcgctgccgcagctgttggggcgcccgggccaggcgacgccgccgtcgcccgtgcccctcccagaccgcaccggccgcatggagcccccggagggcgccggcaccggagagatcgttaaggaggctgaggtgccgcaggctgcgctgggcgtcccagcccaggggacaggggacaatggccacacgcctgtggaggaggaggtcgggggcatcccagtaccagcaccggggctcctgcaggtcacggagaggaggcagcctctgagcagcgtctcctctctggaggtccacttcgacctcctggacctcactgagctcaccgacatgtcggaccaggagctggccgaggtctttgctgactcggacgacgagaacctcaacaccgagtccccagcaggtctgcacccgctgccccgggccggctacctgcgctccccttcctggacgaggacaagggctgagcagagccacgagaagcagcccctaggcgaccccgagcggcaggccacagtcctggacacgtttctcactgtggagaggccccaggaggactagaccatctccacctgccccagctcctgcagggatggggtccgaacacgatggcagatctgggcagtgctgacccagcagacacacttcacccgcccacgaggctccagccgtcacctcctgacacacaccctgggggcagctctctgccagccccgagaccggccttgtctgctgggcacgggtcttcgcctcacttggagaccagccggctttcctgggggacacacggggcccccggatgcctctgggagccccagcacaagcacagcccagtggccttacgtccagctcgttcctgggccccgagtcaggaagacagcgtcacggagtcactgccaggaacgtgctgaggaatggagtggcccacggcggccttgggtgagggacaagctgtnaacaatcagaatctggggtgtcactcggtttctttctgcaatnaaacaaaggggttgtatgtatgg

SEQ ID NO: 17147 - DNA, 2066 bp, Homo sapiens
  misc_feature (37)..(37): n is a, c, g, or t
agcgggggtctgtcattacccagcgcgagtcaggccnctcctgtgcccctcgccagccccgaggggcgcccgcacacagtcggcgccccacacgcaagtacctggaagagaacaagaggacgccagcgggcgcggccgccaaagatcgttaaggaggctgaggtgccgcaggctgcgctgggcgtcccagcccaggggacaggggacaatggccacacgcctgtggaggaggaggtcgggggcatcccagtaccagcaccggggctcctgcaggtcacggagaggaggcagcctctgagcagcgtctcctctctggaggtccacttcgacctcctggacctcactgagctcaccgacatgtcggaccaggagctggccgaggtctttgctgactcggacgacgagaacctcaacaccgagtccccagcaggtctgcacccgctgccccgggccggctacctgcgctccccttcctggacgaggacaagggctgagcagagccacgagaagcagcccctaggcgaccccgagcggcaggccacagtcctggacacgtttctcactgtggagaggccccaggaggactagaccatctccacctgccccagctcctgcagggatggggtccgaacacgatggcagatctgggcagtgctgacccagcagacacacttcacccgcccacgaggctccagccgtcacctcctgacacacaccctgggggcagctctctgccagccccgagaccggccttgtctgctgggcacgggtcttcgcctcacttggagaccagccggctttcctgggggacacacggggcccccggatgcctctgggagccccagcacaagcacagcccagtggccttacgtccagctcgttcctgggccccgagtcaggaagacagcgtcacggagtcactgccaggaacgtgctgaggaatggagtggcccacggcggccttggggtgaaggggacccaggcctgtgacagccactccaggaactcctgggggtgctccaacctccgcgttttcctgtgctgccaagctcagaagccagaggcgggtttggtagtggctaatgggacaatgtgctgtccagcaaagcacacatggagaagcggccccaaaattcccaccttgatttccatcctgccccttcttctactccacggaggcgctgtctcactagggtcccctccccaaggctcagctctaagacctgcacctgcttctcttggcccctgcgtgacagacaagtccattccctccttagctcagaacaccaaatatcaccagactgcctaagagacttgatgacacctcccggaatgctctcggggtggggttcacctctccttgtcctgcacccactgctaggccacattctcgtttctgctcacatcccattgcccggctacaaggcctgcccacggcccttaaacttgctgggcaggtttggagcccatgggaccccgtgggtctctgtccaggagcagcagaggaggctgacaggccctgctccctctgctctgggggtgtctgggagccccagctcacaccctcccaatgcttatatgctgaagctcacagaatgggcttcttgcctgacagcaagtcaaagaatgagtttaatatcaaagtgtaagcttactttccatccccaagccagcctgccccctgccccatttcccatgagcacacttctggggaaggaaaacaggctcctggccttcactctcagcagagctttggagatgccccaggcatgccctgagctccttctgtgtacctgctcccacttctgagccacccgctgcccctccgcactgctggcaaacccagttcctgcctcagccaggtctccttccctggtttccagtcacacagagcccagcagctttctctttcagtcccataagggcagccttgtgtccctggccacacttccacccgccagggtcttcctccccatctttccatccttcctgctgagcttccacagagctcgtttgcaaacagggggattaaagcatcactgcgcattcgaaaaaaaaaaccacag

SEQ ID NO: 17148 - DNA, 1082 bp, Homo sapiens
  misc_feature (3)..(4): n is a, c, g, or t
  misc_feature (20)..(20): n is a, c, g, or t
  misc_feature (23)..(23): n is a, c, g, or t
ttnncgtttcaccccaaggncgncgtgggccactccattcctccgcgttttcctgtgctgccaagctcagaagccagaggcgggtttggtagtggctaatgggacaatgtgctgtccagcaaagcacacatggagaagcggccccaaaattcccaccttgatttccatcctgccccttcttctactccacggaggcgctgtctcactagggtcccctccccaaggctcagctctaagacctgcacctgcttctcttggcccctgcgtgacagacaagtccattccctccttagctcagaacaccaaatatcaccagactgcctaagagacttgatgacacctcccggaatgctctcggggtggggttcacctctccttgtcctgcacccactgctaggccacattctcgtttctgctcacatcccattgcccggctacaaggcctgcccacggcccttaaacttgctgggcaggtttggagcccatgggaccccgtgggtctctgtccaggagcagcagaggaggctgacaggccctgctccctctgctctgggggtgtctgggagccccagctcacaccctcccaatgcttatatgctgaagctcacagaatgggcttcttgcctgacagcaagtcaaagaatgagtttaatatcaaagtgtaagcttactttccatccccaagccagcctgccccctgccccatttcccatgagcacacttctggggaaggaaaacaggctcctggccttcactctcagcagagctttggagatgccccaggcatgccctgagctccttctgtgtacctgctcccacttctgagccacccgctgcccctccgcactgctggcaaacccagttcctgcctcagccaggtctccttccctggtttccagtcacacagagcccagcagctttctctttcagtcccataagggcagccttgtgtccctggccacacttccacccgccagggtcttcctccccatctttccatccttcctgctgagcttccacagagctcgtttgcaaacagggggattaaagcatcactgcgcattcgaaaaaaaaaaccacag

SEQ ID NO: 17149 - DNA, 628 bp, Homo sapiens
  misc_feature (128)..(128): n is a, c, g, or t
agcgccaagcaggcagggaccgagaggggtgatggcgcgcccacccctgcagagccgcctgcgcggttgtcccgcgcgtccctgccggcgaaggctgtgagaagcaccgcggggctacggcgcctccnatcctctctaacagccgcgcttaccagacagccagcctccagcgctgctaggctactccgagcaggggagaaaagacgccggtccgccggggaccaggagggagacgtgaaaccagaggcccgggggccccctctccgcctgtgcgacttgtagtctcgtaccagacgcgtccgcttcactgctgaatctgaaaacgtgggctcttgagagctgcccttggaaggagctgtgctttctgcctcatctttaacttttcgtttattcagcaaatatgtatcaagttccgacttcgtggaagagattgtgttagacactgggagtaatagaaacataattaagaagcaggggtcccggacctgaagggcctgagcgtcgggtaaggaggcaacgcttacaccgaacctgtgctgagataaataacgaacagttctggctcttagagttggcctgggggaacaaaaattcaaaaagaataaaaccccaaacaaacaggagaaaa

SEQ ID NO: 17150 - DNA, 800 bp, Homo sapiens
  misc_feature (128)..(128): n is a, c, g, or t
agcgccaagcaggcagggaccgagaggggtgatggcgcgcccacccctgcagagccgcctgcgcggttgtcccgcgcgtccctgccggcgaaggctgtgagaagcaccgcggggctacggcgcctccnatcctctctaacagccgcgcttaccagacagccagcctccagcgctgctaggctactccgagcaggggagaaaagacgccggtccgccggggaccaggagggagacgtgaaaccagaggcccgggggccccctctccgcctgtgcgacttgtagtctcgtaccagacgcgtccgcttcactgctgaatctgaaaacgtgggctcttgagagctgcccttggaaggagctgtgctttctgcctcatctttaacttttcgtttattcagcaaatatgtatcaagttccgacttcgtggaagagattgtgttagacactgggagtaatagaaacataattaagaagcaggggtcccggacctgaagggcctgagcgtcggttctgaaggctgagaagttcaagagcaagtgctggcatctgatgagggccttcttgctgtatcatcctacggtggaagggtttcactgtatctcccaggctggaatatagtggagatcatggctcactgcaaccttgacctcctgggctcaagcggtcttcacacctcagcctccccagtagctgatcctacaggttctttcaaaactggggaaatgctcatttaaactgaacaatgatgaacatcctattgggctggatcctgtacccttaggaacgctcttgttggaatacta

SEQ ID NO: 17151 - DNA, 934 bp, Homo sapiens
  misc_feature (128)..(128): n is a, c, g, or t
agcgccaagcaggcagggaccgagaggggtgatggcgcgcccacccctgcagagccgcctgcgcggttgtcccgcgcgtccctgccggcgaaggctgtgagaagcaccgcggggctacggcgcctccnatcctctctaacagccgcgcttaccagacagccagcctccagcgctgctaggctactccgagcaggggagaaaagacgccggtccgccggggaccaggagggagacgtgaaaccagaggcccgggggccccctctccgcctgtgcgacttgtagtctcgtaccagacgcgtccgcttcactgctgaatctgaaaacgtgggctcttgagagctgcccttggaaggagctgtgctttctgcctcatctttaacttttcgtttattcagcaaatatgtatcaagttccgacttcgtggaagagattgtgttagacactgggagtaatagaaacataattaagaagcaggggtcccggacctgaagggcctgagcgtcgggtaaggaggcaacgcttacaccgaacctgtgctgagataaataacgaacagttctggctcttagagttggccaaaaaaaaaaaaaaaaaaaaaaaaaaaaaaattggggggggggttggagctgagaaaaagggttttaaaacacaattgcgggggggcgcgcgggggcccaaggtgtggaacacgggacacacggggcgcaaaagggggtcccaagggaaacccggggccaaggcaacaagggaggggaggttcttacacacaattaaaaaagggcgggggggggaacaacggaggggtttttggagaaaaattccagaagggggaggttataaggagaggagaataaaagggggagtttattcacagggggggtaaaaggaagagatctcaaaatattcaaatttaagccaggagtggggggtgatg

SEQ ID NO: 17152 - DNA, 631 bp, Homo sapiens
caattaatgttagctattattatcatcataatcgttgtgttaaatatattgcccaagataatatgtgggggaatgtttgttttatatgcatattgtatcctgactgtgtgcagaacacattatgtgtattgcatatatgtaaaagaagtgtacaaggaagtggccatccttgttcaagttacgtatctagttagaacaacttcccagtccattggagttctttgagaagcctcagggaagtagctctgggtccttctaatcaacctcccattactgcgccagtaagtttctgtttcttataaataaactctttgctattcagaaaacctcaaggggcccccacattcactaagcatggggctcctaactggggtccaggtccatagagtgtaggaagaacatattagaacaatacttgtgcttatttttatctagcttttttatgtttgtgtatgttttataatggcataatagtacaatggtacatgtacataattttaaataaataaatgaatgaatgaataaataagcatatgcctggtgcatgcatgtgacaatattgtcgcaggtagggttgcattcactgaaatctggagagcactgaactggagaataaaccttccttatactc

SEQ ID NO: 17153 - DNA, 3466 bp, Homo sapiens
ggcggttgcgtgtggtgcgcgggggcgcgggctgcgtgtggcgcggggcggggcgcggctggtgcgcttgagaagcgatggcggcggcctgaactcacctaacaccgcagcagcaaccgggcccggccaggttcggcgttccgtgagtgaacgatttagaaatctggactggccagtgacctctgggcttgccattccagcctggtataacctctggctccatgggcagctactggctcctacagaccggatgaagcagactggagacacaagtggagaaaacctccagctggcaaatcctcagagtgtaggcctctggctgccagtcctgcccagcctgcctcatggagaggatgaattggctgagcagactggcctcccggggccctgggcaccgtatacctcaaggggccaatctccaaaccccagtcatggctgatcccgagacctgcctcatggtcttcaagaatcactggtcccaggtggtgcgaatcctggagcggcaaggccctcgggcagctcctgggggtgcagacgatctcagtgctgtgcgcaaccacacttaccagatgttgacactgctggcagaggaccgtgcagttccctcggcccccacaggccctgggcccctgctggagtttgctctgcacgaggatctgctgacccgtgtgttgacatggcagctgcaatgggatgagcttggggatggggtcgaggaacggcgggctgagcaactgaaactatttgaaatgctagtgagcgaagctcgccagccactgttgcggcatggtccagttcgtgaggctctgctcaccctgctggatgcctgtggccgccctgtgcccagtagcccagcactggatgaaggcttggtgctacttctcagccagctgtgtgtttgtgtggcccaggagccttcattgctcgagttcttcctgcagccacctcctgagcctggagccgctccccgtcttcttctcttttctcgccttgtcccttttgtgcatcgagagggcaccctgggccagcaggcccgtgatgccctacttcttctcatggctttgtcagctgggagccccactgtgggccgctacatcgcggatcactcttacttctgcccggtgctggccacagggctcagtgccctgtactcatcactgcctcgaaagattgaggttccaggggatgattggcactgtctgcgacgggaagactggctgggagtgccagcccttgcactcttcatgagttccctggagttctgcaatgcagtaattcaggtggctcaccccctggtgcagaagcagttggttgattatatccataatgggttcctggtgcctgtcatgggtcctgccttgcacaagacctctgtggaggagatgatcgccagtaccgcctacctggaacttttcctacggagtatctcagagcctgctttgctccgtaccttcctgcgattcctgttgttgcaccggcatgacacccacaccatcctcgacaccctcgttgctcgtattggcagtaactcccggctctgcatggtctctctgagtctcttcaggaccctcctgaacctcagctgtgaggatgtcctgctgcagctggttctcaggtatcttgttccatgtaaccacgttatgctgagccagaagccggctgttcgtgatgtggacctatatggacgagcagctgacaagtttctctccctaatcccacgctgttgtcggcaccacgcccccagcccacctcgtccagagcatgcctcatgggcacgaggtgggcctagcagagagacagggagaagggaggacatcacgggtcctggaagcccaagtgtggactcctcttctgtgacgacagtaccccggccctccacaccatctcgtctggctctcttcctgcggcagcagagcctgggtggctctgagtctccaggcccagccccttgctcaccagggctttctgcatcccccgcctccagccctggccgacggcctacccctgcagaggagcctggagagctggaagacaattacctggagtatctgcgtgaggcacgtcgtggtgtggaccgctgtgtccgagcctgccgtacctggtctgccccctatgatggcgagcggccctctcctgagcccagtccttttggctcccggactaagaaacgcagcctactgcctgaggaggacaggaacaacgtgggggaaggggaggaggaagagctggggaggagggggcgggctgggggtgcaggggagggccctggtcacctgccccctccccagctcaatggagtgccaggatcatggcctgagggggccaagaaggttcgtctggtgccaaaggagggagctggggaactgctagagggcatctccgagggcatggcaggactagagggctttgggcaggagctccgggagctagaggtggcattgagcaatgggggaactggctcagagtcccccttagaacctccactgccccttgaggaggaggaggcctacgagagcttcacctgtccccctgagccccctggccccttcctcagcagccctttgcggactctcaaccagctgccaagccagcccttcactggccccttcatggctgtgctctttgccaaactcgagaacatgctgcagaactccgtctatgtcaacttcctgctgacggggctggtggcccagctggcctgtcacccccagcccctgctccgctctttcctgctcaacaccaacatggtcttccagcccagtgtcaagtccctgctgcaggtgctgggctctgtgaagaataagattgagaactttgcggcttcccaggaggacttcccagcactgctgtccaaagccaagaagtacctcattgcccgtggcaagttggactgggctgagggccctgcagcaggacctgccccacgccgttctgatcccctagtgaagagccggaggccatccttgggggagttactcctgcggcatgcacacagtccaaccagggcccggcaggcggcacaattggtccttcagcctgggcgagacggagcaggacttggcctaagtgggggctcccctggggcttcaactccagttctactcacccggggcggggcccctgaacgccaaggtgaggctcttcgagtcaagaatgctgtctactgtgcagtcattttccctgaatttctcaaggagttggctgccatctcccaggctcatgccgtcacctcgcctttcttgttggagacttcagaggaaggatctggccctctcatctcaggctgtgggcccctcaatccttaactttcttccatggacaatcagggccatgggtggcccgggctggggctagggcacaggctcctttttatgtttggaggcagtggcaaaaggactttttaatttatttcagatgaatgttttatggagaacttgttgcaatatgtataaaagggaaatctcta

SEQ ID NO: 17154 - DNA, 3424 bp, Homo sapiens
ggcggttgcgtgtggtgcgcgggggcgcgggctgcgtgtggcgcggggcggggcgcggctggtgcgcttgagaagcgatggcggcggcctgaactcacctaacaccgcagcagcaaccgggcccggccaggttcggcgttccgtgagtgaacgatttagaaatctggactggccagtgacctctgggcttgccattccagcctggtataacctctggctccatgggcagctactggctcctacagaccggatgaagcagactggagacacaagtggagaaaacctccagctggcaaatcctcagagtgtaggcctctggctgccagtcctgcccagcctgcctcatggagaggatgaattggctgagcagactggcctcccggggccctgggcaccgtatacctcaaggggccaatctccaaaccccagtcatggctgatcccgagacctgcctcatggtcttcaagaatcactggtcccaggtggtgcgaatcctggagcggcaaggccctcgggcagctcctgggggtgcagacgatctcagtgctgtgcgcaaccacacttaccagatgttgacactgctggcagaggaccgtgcagttccctcggcccccacaggccctgggcccctgctggagtttgctctgcacgaggatctgctgacccgtgtgttgacatggcagctgcaatgggatgagcttggggatggggtcgaggaacggcgggctgagcaactgaaactatttgaaatgctagtgagcgaagctcgccagccactgttgcggcatggtccagttcgtgaggctctgctcaccctgctggatgcctgtggccgccctgtgcccagtagcccagcactggatgaaggcttggtgctacttctcagccagctgtgtgtttgtgtggcccaggagccttcattgctcgagttcttcctgcagccacctcctgagcctggagccgctccccgtcttcttctcttttctcgccttgtcccttttgtgcatcgagagggcaccctgggccagcaggcccgtgatgccctacttcttctcatggctttgtcagctgggagccccactgtgggccgctacatcgcggatcactcttacttctgcccggtgctggccacagggctcagtgccctgtactcatcactgcctcgaaagattgaggttccaggggatgattggcactgtctgcgacgggaagactggctgggagtgccagcccttgcactcttcatgagttccctggagttctgcaatgcagtaattcaggtggctcaccccctggtgcagaagcagttggttgattatatccataatgggttcctggtgcctgtcatgggtcctgccttgcacaagacctctgtggaggagatgatcgccagtaccgcctacctggaacttttcctacggagtatctcagagcctgctttgctccgtaccttcctgcgattcctgttgttgcaccggcatgacacccacaccatcctcgacaccctcgttgctcgtattggcagtaactcccggctctgcatggtctctctgagtctcttcaggaccctcctgaacctcagctgtgaggatgtcctgctgcagctggttctcaggtatcttgttccatgtaaccacgttatgctgagccagaagccggctgttcgtgatgtggacctatatggacgagcagctgacaagtttctctccctaatcccacgctgttgtcggcaccacgcccccagcccacctcgtccagagcatgcctcatgggcacgaggtcctggaagcccaagtgtggactcctcttctgtgacgacagtaccccggccctccacaccatctcgtctggctctcttcctgcggcagcagagcctgggtggctctgagtctccaggcccagccccttgctcaccagggctttctgcatcccccgcctccagccctggccgacggcctacccctgcagaggagcctggagagctggaagacaattacctggagtatctgcgtgaggcacgtcgtggtgtggaccgctgtgtccgagcctgccgtacctggtctgccccctatgatggcgagcggccctctcctgagcccagtccttttggctcccggactaagaaacgcagcctactgcctgaggaggacaggaacaacgtgggggaaggggaggaggaagagctggggaggagggggcgggctgggggtgcaggggagggccctggtcacctgccccctccccagctcaatggagtgccaggatcatggcctgagggggccaagaaggttcgtctggtgccaaaggagggagctggggaactgctagagggcatctccgagggcatggcaggactagagggctttgggcaggagctccgggagctagaggtggcattgagcaatgggggaactggctcagagtcccccttagaacctccactgccccttgaggaggaggaggcctacgagagcttcacctgtccccctgagccccctggccccttcctcagcagccctttgcggactctcaaccagctgccaagccagcccttcactggccccttcatggctgtgctctttgccaaactcgagaacatgctgcagaactccgtctatgtcaacttcctgctgacggggctggtggcccagctggcctgtcacccccagcccctgctccgctctttcctgctcaacaccaacatggtcttccagcccagtgtcaagtccctgctgcaggtgctgggctctgtgaagaataagattgagaactttgcggcttcccaggaggacttcccagcactgctgtccaaagccaagaagtacctcattgcccgtggcaagttggactgggctgagggccctgcagcaggacctgccccacgccgttctgatcccctagtgaagagccggaggccatccttgggggagttactcctgcggcatgcacacagtccaaccagggcccggcaggcggcacaattggtccttcagcctgggcgagacggagcaggacttggcctaagtgggggctcccctggggcttcaactccagttctactcacccggggcggggcccctgaacgccaaggtgaggctcttcgagtcaagaatgctgtctactgtgcagtcattttccctgaatttctcaaggagttggctgccatctcccaggctcatgccgtcacctcgcctttcttgttggagacttcagaggaaggatctggccctctcatctcaggctgtgggcccctcaatccttaactttcttccatggacaatcagggccatgggtggcccgggctggggctagggcacaggctcctttttatgtttggaggcagtggcaaaaggactttttaatttatttcagatgaatgttttatggagaacttgttgcaatatgtataaaagggaaatctcta

SEQ ID NO: 17155 - DNA, 3356 bp, Homo sapiens
ggcggttgcgtgtggtgcgcgggggcgcgggctgcgtgtggcgcggggcggggcgcggctggtgcgcttgagaagcgatggcggcggcctgaactcacctaacaccgcagcagcaaccgggcccggccaggttcggcgttccgtgagtgaacgatttagaaatctggactggccagtgacctctgggcttgccattccagcctggtataacctctggctccatgggcagctactggctcctacagaccggatgaagcagactggagacacaagtggagaaaacctccagctggcaaatcctcagagtgtaggcctctggctgccagtcctgcccagcctgcctcatggagaggatgaattggctgagcagactggcctcccggggccctgggcaccgtatacctcaaggggccaatctccaaaccccagtcatggctgatcccgagacctgcctcatggtcttcaagaatcactggtcccaggtggtgcgaatcctggagcggcaaggccctcgggcagctcctgggggtgcagacgatctcagtgctgtgcgcaaccacacttaccagatgttgacactgctggcagaggaccgtgcagttccctcggcccccacaggccctgggcccctgctggagtttgctctgcacgaggatctgctgacccgtgtgttgacatggcagctgcaatgggatgagcttggggatggggtcgaggaacggcgggctgagcaactgaaactatttgaaatgctagtgagcgaagctcgccagccactgttgcggcatggtccagttcgtgaggctctgctcaccctgctggatgcctgtggccgccctgtgcccagtagcccagcactggatgaaggcttggtgctacttctcagccagctgtgtgtttgtgtggcccaggagccttcattgctcgagttcttcctgcagccacctcctgagcctggagccgctccccgtcttcttctcttttctcgccttgtcccttttgtgcatcgagagggcaccctgggccagcaggcccgtgatgccctacttcttctcatggctttgtcagctgggagccccactgtgggccgctacatcgcggatcactcttacttctgcccggtgctggccacagggctcagtgccctgtactcatcactgcctcgaaagattgaggttccaggggatgattggcactgtctgcgacgggaagactggctgggagtgccagcccttgcactcttcatgagttccctggagttctgcaatgcagtaattcaggtggctcaccccctggtgcagaagcagttggttgattatatccataatgggttcctggtgcctgtcatgggtcctgccttgcacaagacctctgtggaggagatgatcgccagtaccgcctacctggaacttttcctacggagtatctcagagcctgctttgctccgtaccttcctgcgattcctgttgttgcaccggcatgacacccacaccatcctcgacaccctcgttgctcgtattggcagtaactcccggctctgcatggtctctctgagtctcttcaggaccctcctgaacctcagctgtgaggatgtcctgctgcagctggttctcaggtatcttgttccatgtaaccacgttatgctgagccagaagccggctgttcgtgatgtggacctatatggacgagcagctgacaagtttctctccctaatcccacgctgttgtcggcaccacgcccccagcccacctcgtccagagcatgcctcatgggcacgaggtcctggaagcccaagtgtggactcctcttctgtgacgacagtaccccggccctccacaccatctcgtctggctctcttcctgcggcagcagagcctgggtggctctgagtctccaggcccagccccttgctcaccagggctttctgcatcccccgcctccagccctggccgacggcctacccctgcagaggagcctggagagctggaagacaattacctggagtatctgcgtgaggcacgtcgtggtgtggaccgctgtgtccgagcctgccgtacctggtctgccccctatgatggcgagcggccctctcctgagcccagtccttttggctcccggactaagaaacgcagcctactgcctgaggaggacaggaacaacgtgggggaaggggaggaggaagagctggggaggagggggcgggctgggggtgcaggggagggccctggtcacctgccccctccccagctcaatggagtgccaggatcatggcctgagggggccaagaaggttcgtctggtgccaaaggagggagctggggaactgctagagggcatctccgagggcatggcaggactagagggctttgggcaggagctccgggagctagaggtggcattgagcaatgggggaactggctcagagtcccccttagaacctccactgccccttgaggaggaggaggcctacgagagcttcacctgtccccctgagccccctggccccttcctcagcagccctttgcggactctcaaccagctgccaagccagcccttcactggccccttcatggctgtgctctttgccaaactcgagaacatgctgcagaatccgctctttcctgctcaacaccaacatggtcttccagcccagtgtcaagtccctgctgcaggtgctgggctctgtgaagaataagattgagaactttgcggcttcccaggaggacttcccagcactgctgtccaaagccaagaagtacctcattgcccgtggcaagttggactgggctgagggccctgcagcaggacctgccccacgccgttctgatcccctagtgaagagccggaggccatccttgggggagttactcctgcggcatgcacacagtccaaccagggcccggcaggcggcacaattggtccttcagcctgggcgagacggagcaggacttggcctaagtgggggctcccctggggcttcaactccagttctactcacccggggcggggcccctgaacgccaaggtgaggctcttcgagtcaagaatgctgtctactgtgcagtcattttccctgaatttctcaaggagttggctgccatctcccaggctcatgccgtcacctcgcctttcttgttggagacttcagaggaaggatctggccctctcatctcaggctgtgggcccctcaatccttaactttcttccatggacaatcagggccatgggtggcccgggctggggctagggcacaggctcctttttatgtttggaggcagtggcaaaaggactttttaatttatttcagatgaatgttttatggagaacttgttgcaatatgtataaaagggaaatctcta

SEQ ID NO: 17156 - DNA, 3309 bp, Homo sapiens
ggcggttgcgtgtggtgcgcgggggcgcgggctgcgtgtggcgcggggcggggcgcggctggtgcgcttgagaagcgatggcggcggcctgaactcacctaacaccgcagcagcaaccgggcccggccaggttcggcgttccgtgagtgaacgcctggtataacctctggctccatgggcagctactggctcctacagaccggatgaagcagactggagacacaagtggagaaaacctccagctggcaaatcctcagagtgtaggcctctggctgccagtcctgcccagcctgcctcatggagaggatgaattggctgagcagactggcctcccggggccctgggcaccgtatacctcaaggggccaatctccaaaccccagtcatggctgatcccgagacctgcctcatggtcttcaagaatcactggtcccaggtggtgcgaatcctggagcggcaaggccctcgggcagctcctgggggtgcagacgatctcagtgctgtgcgcaaccacacttaccagatgttgacactgctggcagaggaccgtgcagttccctcggcccccacaggccctgggcccctgctggagtttgctctgcacgaggatctgctgacccgtgtgttgacatggcagctgcaatgggatgagcttggggatggggtcgaggaacggcgggctgagcaactgaaactatttgaaatgctagtgagcgaagctcgccagccactgttgcggcatggtccagttcgtgaggctctgctcaccctgctggatgcctgtggccgccctgtgcccagtagcccagcactggatgaaggcttggtgctacttctcagccagctgtgtgtttgtgtggcccaggagccttcattgctcgagttcttcctgcagccacctcctgagcctggagccgctccccgtcttcttctcttttctcgccttgtcccttttgtgcatcgagagggcaccctgggccagcaggcccgtgatgccctacttcttctcatggctttgtcagctgggagccccactgtgggccgctacatcgcggatcactcttacttctgcccggtgctggccacagggctcagtgccctgtactcatcactgcctcgaaagattgaggttccaggggatgattggcactgtctgcgacgggaagactggctgggagtgccagcccttgcactcttcatgagttccctggagttctgcaatgcagtaattcaggtggctcaccccctggtgcagaagcagttggttgattatatccataatgggttcctggtgcctgtcatgggtcctgccttgcacaagacctctgtggaggagatgatcgccagtaccgcctacctggaacttttcctacggagtatctcagagcctgctttgctccgtaccttcctgcgattcctgttgttgcaccggcatgacacccacaccatcctcgacaccctcgttgctcgtattggcagtaactcccggctctgcatggtctctctgagtctcttcaggaccctcctgaacctcagctgtgaggatgtcctgctgcagctggttctcaggtatcttgttccatgtaaccacgttatgctgagccagaagccggctgttcgtgatgtggacctatatggacgagcagctgacaagtttctctccctaatcccacgctgttgtcggcaccacgcccccagcccacctcgtccagagcatgcctcatgggcacgaggtcctggaagcccaagtgtggactcctcttctgtgacgacagtaccccggccctccacaccatctcgtctggctctcttcctgcggcagcagagcctgggtggctctgagtctccaggcccagccccttgctcaccagggctttctgcatcccccgcctccagccctggccgacggcctacccctgcagaggagcctggagagctggaagacaattacctggagtatctgcgtgaggcacgtcgtggtgtggaccgctgtgtccgagcctgccgtacctggtctgccccctatgatggcgagcggccctctcctgagcccagtccttttggctcccggactaagaaacgcagcctactgcctgaggaggacaggaacaacgtgggggaaggggaggaggaagagctggggaggagggggcgggctgggggtgcaggggagggccctggtcacctgccccctccccagctcaatggagtgccaggatcatggcctgagggggccaagaaggttcgtctggtgccaaaggagggagctggggaactgctagagggcatctccgagggcatggcaggactagagggctttgggcaggagctccgggagctagaggtggcattgagcaatgggggaactggctcagagtcccccttagaacctccactgccccttgaggaggaggaggcctacgagagcttcacctgtccccctgagccccctggccccttcctcagcagccctttgcggactctcaaccagctgccaagccagcccttcactggccccttcatggctgtgctctttgccaaactcgagaacatgctgcagaatccgctctttcctgctcaacaccaacatggtcttccagcccagtgtcaagtccctgctgcaggtgctgggctctgtgaagaataagattgagaactttgcggcttcccaggaggacttcccagcactgctgtccaaagccaagaagtacctcattgcccgtggcaagttggactgggctgagggccctgcagcaggacctgccccacgccgttctgatcccctagtgaagagccggaggccatccttgggggagttactcctgcggcatgcacacagtccaaccagggcccggcaggcggcacaattggtccttcagcctgggcgagacggagcaggacttggcctaagtgggggctcccctggggcttcaactccagttctactcacccggggcggggcccctgaacgccaaggtgaggctcttcgagtcaagaatgctgtctactgtgcagtcattttccctgaatttctcaaggagttggctgccatctcccaggctcatgccgtcacctcgcctttcttgttggagacttcagaggaaggatctggccctctcatctcaggctgtgggcccctcaatccttaactttcttccatggacaatcagggccatgggtggcccgggctggggctagggcacaggctcctttttatgtttggaggcagtggcaaaaggactttttaatttatttcagatgaatgttttatggagaacttgttgcaatatgtataaaagggaaatctcta

SEQ ID NO: 17157 - DNA, 3162 bp, Homo sapiens
ggcggttgcgtgtggtgcgcgggggcgcgggctgcgtgtggcgcggggcggggcgcggctggtgcgcttgagaagcgatggcggcggcctgaactcacctaacaccgcagcagcaaccgggcccggccaggttcggcgttccgtgagtgaacgatttagaaatctggactggccagtgacctctgggcttgccattccagcctggtataacctctggctccatgggcagctactggctcctacagaccggatgaagcagactggagacacaagtggagaaaacctccagctggcaaatcctcagagtgtaggcctctggctgccagtcctgcccagcctgcctcatggagaggatgaattggctgagcagactggcctcccggggccctgggcaccgtatacctcaaggggccaatctccaaaccccagtcatggctgatcccgagacctgcctcatggtcttcaagaatcactggtcccaggtggtgcgaatcctggagcggcaaggccctcgggcagctcctgggggtgcagacgatctcagtgctgtgcgcaaccacacttaccagatgttgacactgctggcagaggaccgtgcagttccctcggcccccacaggccctgggcccctgctggagtttgctctgcacgaggatctgctgacccgtgtgttgacatggcagctgcaatgggatgagcttggggatggggtcgaggaacggcgggctgagcaactgaaactatttgaaatgctagtgagcgaagctcgccagccactgttgcggcatggtccagttcgtgaggctctgctcaccctgctggatgcctgtggccgccctgtgcccagtagcccagcactggatgaaggcttggtgctacttctcagccagctgtgtgtttgtgtggcccaggagccttcattgctcgagttcttcctgcagccacctcctgagcctggagccgctccccgtcttcttctcttttctcgccttgtcccttttgtgcatcgagagggcaccctgggccagcaggcccgtgatgccctacttcttctcatggctttgtcagctgggagccccactgtgggccgctacatcgcggatcactcttacttctgcccggtgctggccacagggctcagtgccctgtactcatcactgcctcgaaagattgaggttccaggggatgattggcactgtctgcgacgggaagactggctgggagtgccagcccttgcactcttcatgagttccctggagttctgcaatgcagtaattcaggtggctcaccccctggtgcagaagcagttggttgattatatccataatgggttcctggtgcctgtcatgggtcctgccttgcacaagacctctgtggaggagatgatcgccagtaccgcctacctggaacttttcctacggagtatctcagagcctgctttgctccgtaccttcctgcgattcctgttgttgcaccggcatgacacccacaccatcctcgacaccctcgttgctcgtattggcagtaactcccggctctgcatggtctctctgagtctcttcaggaccctcctgaacctcagctgtgaggatgtcctgctgcagctggttctcaggtatcttgttccatgtaaccacgttatgctgagccagaagccggctgttcgtgatgtggacctatatggacgagcagctgacaagtttctctccctaatcccacgctgttgtcggcaccacgcccccagcccacctcgtccagagcatgcctcatgggcacgaggtcctggaagcccaagtgtggactcctcttctgtgacgacagtaccccggccctccacaccatctcgtctggctctcttcctgcggcagcagagcctgggtggctctgagtctccaggcccagccccttgctcaccagggctttctgcatcccccgcctccagccctggccgacggcctacccctgcagaggagcctggagagctggaagacaattaccaggatcatggcctgagggggccaagaaggttcgtctggtgccaaaggagggagctggggaactgctagagggcatctccgagggcatggcaggactagagggctttgggcaggagctccgggagctagaggtggcattgagcaatgggggaactggctcagagtcccccttagaacctccactgccccttgaggaggaggaggcctacgagagcttcacctgtccccctgagccccctggccccttcctcagcagccctttgcggactctcaaccagctgccaagccagcccttcactggccccttcatggctgtgctctttgccaaactcgagaacatgctgcagaactccgtctatgtcaacttcctgctgacggggctggtggcccagctggcctgtcacccccagcccctgctccgctctttcctgctcaacaccaacatggtcttccagcccagtgtcaagtccctgctgcaggtgctgggctctgtgaagaataagattgagaactttgcggcttcccaggaggacttcccagcactgctgtccaaagccaagaagtacctcattgcccgtggcaagttggactgggctgagggccctgcagcaggacctgccccacgccgttctgatcccctagtgaagagccggaggccatccttgggggagttactcctgcggcatgcacacagtccaaccagggcccggcaggcggcacaattggtccttcagcctgggcgagacggagcaggacttggcctaagtgggggctcccctggggcttcaactccagttctactcacccggggcggggcccctgaacgccaaggtgaggctcttcgagtcaagaatgctgtctactgtgcagtcattttccctgaatttctcaaggagttggctgccatctcccaggctcatgccgtcacctcgcctttcttgttggagacttcagaggaaggatctggccctctcatctcaggctgtgggcccctcaatccttaactttcttccatggacaatcagggccatgggtggcccgggctggggctagggcacaggctcctttttatgtttggaggcagtggcaaaaggactttttaatttatttcagatgaatgttttatggagaacttgttgcaatatgtataaaagggaaatctcta

SEQ ID NO: 17158 - DNA, 3447 bp, Homo sapiens
ggcggttgcgtgtggtgcgcgggggcgcgggctgcgtgtggcgcggggcggggcgcggctggtgcgcttgagaagcgatggcggcggcctgaactcacctaacaccgcagcagcaaccgggcccggccaggttcggcgttccgtgagtgaacgatttagaaatctggactggccagtgacctctgggcttgccattccagcctggtataacctctggctccatgggcagctactggctcctacagaccggatgaagcagactggagacacaagtggagaaaacctccagctggcaaatcctcagagtgtaggcctctggctgccagtcctgcccagcctgcctcatggagaggatgaattggctgagcagactggcctcccggggccctgggcaccgtatacctcaaggggccaatctccaaaccccagtcatggctgatcccgagacctgcctcatggtcttcaagaatcactggtcccaggtggtgcgaatcctggagcggcaaggccctcgggcagctcctgggggtgcagacgatctcagtgctgtgcgcaaccacacttaccagatgttgacactgctggcagaggaccgtgcagttccctcggcccccacaggccctgggcccctgctggagtttgctctgcacgaggatctgctgacccgtgtgttgacatggcagctgcaatgggatgagcttggggatggggtcgaggaacggcgggctgagcaactgaaactatttgaaatgctagtgagcgaagctcgccagccactgttgcggcatggtccagttcgtgaggctctgctcaccctgctggatgcctgtggccgccctgtgcccagtagcccagcactggatgaaggcttggtgctacttctcagccagctgtgtgtttgtgtggcccaggagccttcattgctcgagttcttcctgcagccacctcctgagcctggagccgctccccgtcttcttctcttttctcgccttgtcccttttgtgcatcgagagggcaccctgggccagcaggcccgtgatgccctacttcttctcatggctttgtcagctgggagccccactgtgggccgctacatcgcggatcactcttacttctgcccggtgctggccacagggctcagtgccctgtactcatcactgcctcgaaagattgaggttccaggggatgattggcactgtctgcgacgggaagactggctgggagtgccagcccttgcactcttcatgagttccctggagttctgcaatgcagtaattcaggtggctcaccccctggtgcagaagcagttggttgattatatccataatgggttcctggtgcctgtcatgggtcctgccttgcacaagacctctgtggaggagatgatcgccagtaccgcctacctggaacttttcctacggagtatctcagagcctgctttgctccgtaccttcctgcgattcctgttgttgcaccggcatgacacccacaccatcctcgacaccctcgttgctcgtattggcagtaactcccggctctgcatggtctctctgagtctcttcaggaccctcctgaacctcagctgtgaggatgtcctgctgcagctggttctcaggtatcttgttccatgtaaccacgttatgctgagccagaagccggctgttcgtgatgtggacctatatggacgagcagctgacaagtttctctccctaatcccacgctgttgtcggcaccacgcccccagcccacctcgtccagagcatgcctcatgggcacgaggtcctggaagcccaagtgtggactcctcttctgtgacgacagtaccccggccctccacaccatctcgtctggctctcttcctgcggcagcagagcctgggtggctctgagtctccaggcccagccccttgctcaccagggctttctgcatcccccgcctccagccctggccgacggcctacccctgcagaggagcctggagagctggaagacaattacctggagtatctgcgtgaggcacgtcgtggtgtggaccgctgtgtccgagcctgccgtacctggtctgccccctatgatggcgagcggccctctcctgagcccagtccttttggctcccggactaagaaacgcagcctactgcctgaggaggacaggaacaacgtgggggaaggggaggaggaagagctggggaggagggggcgggctgggggtgcaggggagggccctggtcacctgccccctccccagctcaatggagtgccaggatcatggcctgagggggccaagaaggttcgtctggtgccaaaggagggagctggggaactgctagagggcatctccgagggcatggcaggactagagggctttgggcaggagctccgggagctagaggtggcattgagcaatgggggaactggctcagagtcccccttagaacctccactgccccttgaggaggaggaggcctacgagagcttcacctgtccccctgagccccctggccccttcctcagcagccctttgcggactctcaaccagctgccaagccagcccttcactggccccttcatggctgtgctctttgccaaactcgagaacatgctgcagaactccgtctatgtcaacttcctgctgacggggctggtggcccagctggcctgtcacccccagcccctgctccgctctttcctgctcaacaccaacatggtcttccagcccagtgtcaagtccctgctgcaggtgtgcgatgcatgcatgcatgggtgctgggctctgtgaagaataagattgagaactttgcggcttcccaggaggacttcccagcactgctgtccaaagccaagaagtacctcattgcccgtggcaagttggactgggctgagggccctgcagcaggacctgccccacgccgttctgatcccctagtgaagagccggaggccatccttgggggagttactcctgcggcatgcacacagtccaaccagggcccggcaggcggcacaattggtccttcagcctgggcgagacggagcaggacttggcctaagtgggggctcccctggggcttcaactccagttctactcacccggggcggggcccctgaacgccaaggtgaggctcttcgagtcaagaatgctgtctactgtgcagtcattttccctgaatttctcaaggagttggctgccatctcccaggctcatgccgtcacctcgcctttcttgttggagacttcagaggaaggatctggccctctcatctcaggctgtgggcccctcaatccttaactttcttccatggacaatcagggccatgggtggcccgggctggggctagggcacaggctcctttttatgtttggaggcagtggcaaaaggactttttaatttatttcagatgaatgttttatggagaacttgttgcaatatgtataaaagggaaatctcta

SEQ ID NO: 17159 - DNA, 2081 bp, Homo sapiens
tgatagcgtgcaggttttaccacagtcttgaagtattaattgaagcttttgtctttttttcctttggtaaacttatctgagcttttcaattttttttttccaagaaacttccaggaaatgaaaggaacaggacaaaattatggggcgtcttaggactctgttaagctagagttgttttgaagctaatgctagacatgtgcacctggagtgaaaaatgttttagcatctttttcaggattcactccctcctgccctccatcattctcctgtctcaatgcatagtacagttcttagatatatactccctttccccaaaaaaatccctaatcagaaggactgtgatggttatagaggcctactgctggtgatctggcttagctgaggtcagttttcccagtggataatgctgatcctttcccttccttctctcccaccaaagagtctgtcctcagtcagtttctctgcccctgcactaagctatccttttactacatattctgttccaccgtcttggttcccagcttctgaaagacaaaactgatgtcttctctggtcctccaaatatttttttccctaactttaaattggctcacatagttactttgtctttgcaacaccatcttctagctttctttctgagcaggtttagtgttatcctccgttttttgtggaacctaattcttttggacctaattactttctcaacctatttgttcttctgttgtgcctcttgggtgaatcttttataaaaacaatatgtaattgtagcttatggttataactgaacacttaaaatttgccagatctgaggctaaatgctttatattgataactctttgatcctcttcatcaccttatgaggtaggtatattttcctattttacgaactaggaaactaaggcttggacaattttgacctgtccaaactagtaaagggcaaagccagtgaaaccagatctttcagagtccagagcctaagatctggcttgtcagcttgaatgtgtgtaaagctggcatctggaatcttgtgggtccatatggtgtctgccatcttatttcctccagaataggtggccacgggatatttaaacatacccagaggctgacatacaaatacttttcatctggtgggggtctcttgttttggggaggaatgcgtgcgatgtgcattgtgttcaggctttgtatccttgtgcccacctcccccccaacccaggccccttcatggctgtgctctttgccaaactcgagaacatgctgcagaactccgtctatgtcaacttcctgctgacggggctggtggcccagctggcctgtcacccccagcccctgctccgctctttcctgctcaacaccaacatggtcttccagcccagtgtcaagtccctgctgcaggtgctgggctctgtgaagaataagattgagaactttgcggcttcccaggaggacttcccagcactgctgtccaaagccaagaagtacctcattgcccgtggcaagttggactgggctgagggccctgcagcaggacctgccccacgccgttctgatcccctagtgaagagccggaggccatccttgggggagttactcctgcggcatgcacacagtccaaccagggcccggcaggcggcacaattggtccttcagcctgggcgagacggagcaggacttggcctaagtgggggctcccctggggcttcaactccagttctactcacccggggcggggcccctgaacgccaaggtgaggctcttcgagtcaagaatgctgtctactgtgcagtcattttccctgaatttctcaaggagttggctgccatctcccaggctcatgccgtcacctcgcctttcttgttggagacttcagaggaaggatctggccctctcatctcaggctgtgggcccctcaatccttaactttcttccatggacaatcagggccatgggtggcccgggctggggctagggcacaggctcctttttatgtttggaggcagtggcaaaaggactttttaatttatttcagatgaatgttttatggagaacttgttgcaatatgtataaaagggaaatctcta

SEQ ID NO: 17160 - DNA, 1883 bp, Homo sapiens
tataagaaagcgtcaagacacaacacccactacctaaaaaatcccaaacatatactgaactcctcacacccaattggaccaatctatcaccctatagaagaactaatgttagtataagtaacatgaaaacattctcctccgcatacgcccttagggcctactgctggtgatctggcttagctgaggtcagttttcccagtggataatgctgatcctttcccttccttctctcccaccaaagagtctgtcctcagtcagtttctctgcccctgcactaagctatccttttactacatattctgttccaccgtcttggttcccagcttctgaaagacaaaactgatgtcttctctggtcctccaaatatttttttccctaactttaaattggctcacatagttactttgtctttgcaacaccatcttctagctttctttctgagcaggtttagtgttatcctccgttttttgtggaacctaattcttttggacctaattactttctcaacctatttgttcttctgttgtgcctcttgggtgaatcttttataaaaacaatatgtaattgtagcttatggttataactgaacacttaaaatttgccagatctgaggctaaatgctttatattgataactctttgatcctcttcatcaccttatgaggtaggtatattttcctattttacgaactaggaaactaaggcttggacaattttgacctgtccaaactagtaaagggcaaagccagtgaaaccagatctttcagagtccagagcctaagatctggcttgtcagcttgaatgtgtgtaaagctggcatctggaatcttgtgggtccatatggtgtctgccatcttatttcctccagaataggtggccacgggatatttaaacatacccagaggctgacatacaaatacttttcatctggtgggggtctcttgttttggggaggaatgcgtgcgatgtgcattgtgttcaggctttgtatccttgtgcccacctcccccccaacccaggccccttcatggctgtgctctttgccaaactcgagaacatgctgcagaactccgtctatgtcaacttcctgctgacggggctggtggcccagctggcctgtcacccccagcccctgctccgctctttcctgctcaacaccaacatggtcttccagcccagtgtcaagtccctgctgcaggtgctgggctctgtgaagaataagattgagaactttgcggcttcccaggaggacttcccagcactgctgtccaaagccaagaagtacctcattgcccgtggcaagttggactgggctgagggccctgcagcaggacctgccccacgccgttctgatcccctagtgaagagccggaggccatccttgggggagttactcctgcggcatgcacacagtccaaccagggcccggcaggcggcacaattggtccttcagcctgggcgagacggagcaggacttggcctaagtgggggctcccctggggcttcaactccagttctactcacccggggcggggcccctgaacgccaaggtgaggctcttcgagtcaagaatgctgtctactgtgcagtcattttccctgaatttctcaaggagttggctgccatctcccaggctcatgccgtcacctcgcctttcttgttggagacttcagaggaaggatctggccctctcatctcaggctgtgggcccctcaatccttaactttcttccatggacaatcagggccatgggtggcccgggctggggctagggcacaggctcctttttatgtttggaggcagtggcaaaaggactttttaatttatttcagatgaatgttttatggagaacttgttgcaatatgtataaaagggaaatctcta

SEQ ID NO: 17161 - DNA, 990 bp, Homo sapiens
aacttaggcgacagcgattctaggatagtcagtagaattagaatcgtgaagatgataagtgtagagggaaggttaatggttgatattgctagggtggcgcttccaattaggtgcatgagtaggtggcctgcagtaatgttagcggttaggcgtacggccagggctattggttgaatgagtaggctgatggtttcgatacctaagttcagagccaggcctggctctgaacttaggcccagtgggactagaaaggactgtatcagtctagagctgctcagaaatgtcacgaaggtgtgcttcataggtgctgggctctgtgaagaataagattgagaactttgcggcttcccaggaggacttcccagcactgctgtccaaagccaagaagtacctcattgcccgtggcaagttggactgggctgagggccctgcagcaggacctgccccacgccgttctgatcccctagtgaagagccggaggccatccttgggggagttactcctgcggcatgcacacagtccaaccagggcccggcaggcggcacaattggtccttcagcctgggcgagacggagcaggacttggcctaagtgggggctcccctggggcttcaactccagttctactcacccggggcggggcccctgaacgccaaggtgaggctcttcgagtcaagaatgctgtctactgtgcagtcattttccctgaatttctcaaggagttggctgccatctcccaggctcatgccgtcacctcgcctttcttgttggagacttcagaggaaggatctggccctctcatctcaggctgtgggcccctcaatccttaactttcttccatggacaatcagggccatgggtggcccgggctggggctagggcacaggctcctttttatgtttggaggcagtggcaaaaggactttttaatttatttcagatgaatgttttatggagaacttgttgcaatatgtataaaagggaaatctcta

SEQ ID NO: 17162 - DNA, 3362 bp, Homo sapiens
ggcggttgcgtgtggtgcgcgggggcgcgggctgcgtgtggcgcggggcggggcgcggctggtgcgcttgagaagcgatggcggcggcctgaactcacctaacaccgcagcagcaaccgggcccggccaggttcggcgttccgtgagtgaacgatttagaaatctggactggccagtgacctctgggcttgccattccagcctggtataacctctggctccatgggcagctactggctcctacagaccggatgaagcagactggagacacaagtggagaaaacctccagctggcaaatcctcagagtgtaggcctctggctgccagtcctgcccagcctgcctcatggagaggatgaattggctgagcagactggcctcccggggccctgggcaccgtatacctcaaggggccaatctccaaaccccagtcatggctgatcccgagacctgcctcatggtcttcaagaatcactggtcccaggtggtgcgaatcctggagcggcaaggccctcgggcagctcctgggggtgcagacgatctcagtgctgtgcgcaaccacacttaccagatgttgacactgctggcagaggaccgtgcagttccctcggcccccacaggccctgggcccctgctggagtttgctctgcacgaggatctgctgacccgtgtgttgacatggcagctgcaatgggatgagcttggggatggggtcgaggaacggcgggctgagcaactgaaactatttgaaatgctagtgagcgaagctcgccagccactgttgcggcatggtccagttcgtgaggctctgctcaccctgctggatgcctgtggccgccctgtgcccagtagcccagcactggatgaaggcttggtgctacttctcagccagctgtgtgtttgtgtggcccaggagccttcattgctcgagttcttcctgcagccacctcctgagcctggagccgctccccgtcttcttctcttttctcgccttgtcccttttgtgcatcgagagggcaccctgggccagcaggcccgtgatgccctacttcttctcatggctttgtcagctgggagccccactgtgggccgctacatcgcggatcactcttacttctgcccggtgctggccacagggctcagtgccctgtactcatcactgcctcgaaagattgaggttccaggggatgattggcactgtctgcgacgggaagactggctgggagtgccagcccttgcactcttcatgagttccctggagttctgcaatgcagtaattcaggtggctcaccccctggtgcagaagcagttggttgattatatccataatgggttcctggtgcctgtcatgggtcctgccttgcacaagacctctgtggaggagatgatcgccagtaccgcctacctggaacttttcctacggagtatctcagagcctgctttgctccgtaccttcctgcgattcctgttgttgcaccggcatgacacccacaccatcctcgacaccctcgttgctcgtattggcagtaactcccggctctgcatggtctctctgagtctcttcaggaccctcctgaacctcagctgtgaggatgtcctgctgcagctggttctcaggtatcttgttccatgtaaccacgttatgctgagccagaagccggctgttcgtgatgtggacctatatggacgagcagctgacaagtttctctccctaatcccacgctgttgtcggcaccacgcccccagcccacctcgtccagagcatgcctcatgggcacgaggtcctggaagcccaagtgtggactcctcttctgtgacgacagtaccccggccctccacaccatctcgtctggctctcttcctgcggcagcagagcctgggtggctctgagtctccaggcccagccccttgctcaccagggctttctgcatcccccgcctccagccctggccgacggcctacccctgcagaggagcctggagagctggaagacaattacctggagtatctgcgtgaggcacgtcgtggtgtggaccgctgtgtccgagcctgccgtacctggtctgccccctatgatggcgagcggccctctcctgagcccagtccttttggctcccggactaagaaacgcagcctactgcctgaggaggacaggaacaacgtgggggaaggggaggaggaagagctggggaggagggggcgggctgggggtgcaggggagggccctggtcacctgccccctccccagctcaatggagtgccaggatcatggcctgagggggccaagaaggttcgtctggtgccaaaggagggagctggggaactgctagagggcatctccgagggcatggcaggactagagggctttgggcaggagctccgggagctagaggtggcattgagcaatgggggaactggctcagagtcccccttagaacctccactgccccttgaggaggaggaggcctacgagagcttcacctgtccccctgagccccctggccccttcctcagcagccctttgcggactctcaaccagctgccaagccagcccttcactggccccttcatggctgtgctctttgccaaactcgagaacatgctgcagaactccgtctatgtcaacttcctgctgacggggctggtggcccagctggcctgtcacccccagcccctgctccgctctttcctgctcaacaccaacatggtcttccagcccagtgtcaagtccctgctgcaggtgctgggctctgtgaagaataagattgagaactttgcggcttcccaggaggacttcccagcactgctgtccaaagccaagaagtacctcattgcccgtggcaagttggactgggctgagggccctgcagcaggacctgccccacgccgttctgatcccctagtgaagagccggaggccatccttgggggagttactcctgcggcatgcacacagtccaaccagggcccggcaggcggcacaattggtccttcagcctgggcgagacggagcaggacttggcctaagtgggggctcccctggggcttcaactccagttctactcacccggggcggggcccctgaacgccaaggtgaggctcttcgagtcaagaatgctgtctactgtgcagtcattttccctgaatttctcaaggagttggctgccatctcccaggctcatgccgtcacctcgcctttcttgttggagacttcagaggaaggatctggccctctcatctcaggctgtgggcccctcaatccttaactttcttccatggacaatcagggccatgggtggcccgggctggggctatattaaggcgcccggagggtaaggctcaaggatcgtctagagtacccagca

SEQ ID NO: 17163 - DNA, 706 bp, Homo sapiens
aggatccctcctgctgcagtgcctcagcccagtcaacttgccacgggcagtgaggtacttcttgtgctttggacagcagtgctgggaagtcctcctgggaagccgcaaagttctcaatcttattcttcacagagcccagcacctgcagcagggacttgacactacgccgttctgtatccctagtgaagagccggaggccatccttgggggagttactcctgcggcatgcacacagtccaaccagggcccggcaggcggcacaattggtccttcagcctgggcgagacggagcaggacttggcctaagtgggggctcccctggggcttcaactccagttctactcacccggggcggggcccctgaacgccaaggtgaggctcttcgagtcaagaatgctgtctactgtgcagtcattttccctgaatttctcaaggagttggctgccatctcccaggctcatgccgtcacctcgcctttcttgttggagacttcagaggaaggatctggccctctcatctcaggctgtgggcccctcaatccttaactttcttccatggacaatcagggccatgggtggcccgggctggggctagggcacaggctcctttttatgtttggaggcagtggcaaaaggactttttaatttatttcagatgaatgttttatggagaacttgttgcaatatgtataaaagggaaatctcta

SEQ ID NO: 17164 - DNA, 3245 bp, Homo sapiens
ggcggttgcgtgtggtgcgcgggggcgcgggctgcgtgtggcgcggggcggggcgcggctggtgcgcttgagaagcgatggcggcggcctgaactcacctaacaccgcagcagcaaccgggcccggccaggttcggcgttccgtgagtgaacgatttagaaatctggactggccagtgacctctgggcttgccattccagcctggtataacctctggctccatgggcagctactggctcctacagaccggatgaagcagactggagacacaagtggagaaaacctccagctggcaaatcctcagagtgtaggcctctggctgccagtcctgcccagcctgcctcatggagaggatgaattggctgagcagactggcctcccggggccctgggcaccgtatacctcaaggggccaatctccaaaccccagtcatggctgatcccgagacctgcctcatggtcttcaagaatcactggtcccaggtggtgcgaatcctggagcggcaaggccctcgggcagctcctgggggtgcagacgatctcagtgctgtgcgcaaccacacttaccagatgttgacactgctggcagaggaccgtgcagttccctcggcccccacaggccctgggcccctgctggagtttgctctgcacgaggatctgctgacccgtgtgttgacatggcagctgcaatgggatgagcttggggatggggtcgaggaacggcgggctgagcaactgaaactatttgaaatgctagtgagcgaagctcgccagccactgttgcggcatggtccagttcgtgaggctctgctcaccctgctggatgcctgtggccgccctgtgcccagtagcccagcactggatgaaggcttggtgctacttctcagccagctgtgtgtttgtgtggcccaggagccttcattgctcgagttcttcctgcagccacctcctgagcctggagccgctccccgtcttcttctcttttctcgccttgtcccttttgtgcatcgagagggcaccctgggccagcaggcccgtgatgccctacttcttctcatggctttgtcagctgggagccccactgtgggccgctacatcgcggatcactcttacttctgcccggtgctggccacagggctcagtgccctgtactcatcactgcctcgaaagattgaggttccaggggatgattggcactgtctgcgacgggaagactggctgggagtgccagcccttgcactcttcatgagttccctggagttctgcaatgcagtaattcaggtggctcaccccctggtgcagaagcagttggttgattatatccataatgggttcctggtgcctgtcatgggtcctgccttgcacaagacctctgtggaggagatgatcgccagtaccgcctacctggaacttttcctacggagtatctcagagcctgctttgctccgtaccttcctgcgattcctgttgttgcaccggcatgacacccacaccatcctcgacaccctcgttgctcgtattggcagtaactcccggctctgcatggtctctctgagtctcttcaggaccctcctgaacctcagctgtgaggatgtcctgctgcagctggttctcaggtatcttgttccatgtaaccacgttatgctgagccagaagccggctgttcgtgatgtggacctatatggacgagcagctgacaagtttctctccctaatcccacgctgttgtcggcaccacgcccccagcccacctcgtccagagcatgcctcatgggcacgaggtcctggaagcccaagtgtggactcctcttctgtgacgacagtaccccggccctccacaccatctcgtctggctctcttcctgcggcagcagagcctgggtggctctgagtctccaggcccagccccttgctcaccagggctttctgcatcccccgcctccagccctggccgacggcctacccctgcagaggagcctggagagctggaagacaattacctggagtatctgcgtgaggcacgtcgtggtgtggaccgctgtgtccgagcctgccgtacctggtctgccccctatgatggcgagcggccctctcctgagcccagtccttttggctcccggactaagaaacgcagcctactgcctgaggaggacaggaacaacgtgggggaaggggaggaggaagagctggggaggagggggcgggctgggggtgcaggggagggccctggtcacctgccccctccccagctcaatggagtgccaggatcatggcctgagggggccaagaaggttcgtctggtgccaaaggagggagctggggaactgctagagggcatctccgagggcatggcaggactagagggctttgggcaggagctccgggagctagaggtggcattgagcaatgggggaactggctcagagtcccccttagaacctccactgccccttgaggaggaggaggcctacgagagcttcacctgtccccctgagccccctggccccttcctcagcagccctttgcggactctcaaccagctgccaagccagcccttcactggtaagctacttagcctaggccttcccttctgtgtactctttgcatgttctcgacatgtttgtgctggtttcttggacctcttggccatgtcatttctgtgtacttgcctagcccctcatccatcctgcttgcatcacttccagatacgtgtcatgtcatacttgtgtccctgtgtctgtctgtacgtcttccatgcttgtgctggtttgagtattgacttacatctgagccttgtatgtatgtcctatgtgcatgttcctcctctttccctagtctggccatttcctgcgatttgtaattaggatattctgtgtttgatgtttcctggtgaatcacagcaatatttctgaaccatattgaagacgtatgtgctgtcctgtatggagaggcacctaaacactctctatgccattccgtccagtttatctgtctgggtcttgggttttctgtcagctctcctggggcctaaggttaaccttctggtatttttctccctactcagctccttcctccccacctcttcaaagaaggacttgatttcaagtttttcctgttcgctttccttgtaccttcttggttgctgtgactgtctgctagcactaagactgtcttaagcagatagagtgcaatttctttgaaggcaaatgacaaagcgtggccctgagctccctgactgagttcatttg

SEQ ID NO: 17165 - DNA, 2658 bp, Homo sapiens
ggcggttgcgtgtggtgcgcgggggcgcgggctgcgtgtggcgcggggcggggcgcggctggtgcgcttgagaagcgatggcggcggcctgaactcacctaacaccgcagcagcaaccgggcccggccaggttcggcgttccgtgagtgaacgatttagaaatctggactggccagtgacctctgggcttgccattccagcctggtataacctctggctccatgggcagctactggctcctacagaccggatgaagcagactggagacacaagtggagaaaacctccagctggcaaatcctcagagtgtaggcctctggctgccagtcctgcccagcctgcctcatggagaggatgaattggctgagcagactggcctcccggggccctgggcaccgtatacctcaaggggccaatctccaaaccccagtcatggctgatcccgagacctgcctcatggtcttcaagaatcactggtcccaggtggtgcgaatcctggagcggcaaggccctcgggcagctcctgggggtgcagacgatctcagtgctgtgcgcaaccacacttaccagatgttgacactgctggcagaggaccgtgcagttccctcggcccccacaggccctgggcccctgctggagtttgctctgcacgaggatctgctgacccgtgtgttgacatggcagctgcaatgggatgagcttggggatggggtcgaggaacggcgggctgagcaactgaaactatttgaaatgctagtgagcgaagctcgccagccactgttgcggcatggtccagttcgtgaggctctgctcaccctgctggatgcctgtggccgccctgtgcccagtagcccagcactggatgaaggcttggtgctacttctcagccagctgtgtgtttgtgtggcccaggagccttcattgctcgagttcttcctgcagccacctcctgagcctggagccgctccccgtcttcttctcttttctcgccttgtcccttttgtgcatcgagagggcaccctgggccagcaggcccgtgatgccctacttcttctcatggctttgtcagctgggagccccactgtgggccgctacatcgcggatcactcttacttctgcccggtgctggccacagggctcagtgccctgtactcatcactgcctcgaaagattgaggttccaggggatgattggcactgtctgcgacgggaagactggctgggagtgccagcccttgcactcttcatgagttccctggagttctgcaatgcagtaattcaggtggctcaccccctggtgcagaagcagttggttgattatatccataatgggttcctggtgcctgtcatgggtcctgccttgcacaagacctctgtggaggagatgatcgccagtaccgcctacctggaacttttcctacggagtatctcagagcctgctttgctccgtaccttcctgcgattcctgttgttgcaccggcatgacacccacaccatcctcgacaccctcgttgctcgtattggcagtaactcccggctctgcatggtctctctgagtctcttcaggaccctcctgaacctcagctgtgaggatgtcctgctgcagctggttctcaggtatcttgttccatgtaaccacgttatgctgagccagaagccggctgttcgtgatgtggacctatatggacgagcagctgacaagtttctctccctaatcccacgctgttgtcggcaccacgcccccagcccacctcgtccagagcatgcctcatgggcacgaggtcctggaagcccaagtgtggactcctcttctgtgacgacagtaccccggccctccacaccatctcgtctggctctcttcctgcggcagcagagcctgggtggctctgagtctccaggcccagccccttgctcaccagggctttctgcatcccccgcctccagccctggccgacggcctacccctgcagaggagcctggagagctggaagacaattacctggagtatctgcgtgaggcacgtcgtggtgtggaccgctgtgtccgagcctgccgtacctggtctgccccctatgatggcgagcggccctctcctgagcccagtccttttggctcccggactaagaaacgcagcctactgcctgaggaggacaggaacaacgtgggggaaggggaggaggaagagctggggaggagggggcgggctgggggtgcaggggagggccctggtcacctgccccctccccagctcaatggagtgccaggatcatggcctgagggggccaagaaggttcgtctggtgccaaaggagggagctggggaactgctagagggcatctccgagggcatggcaggactagagggctttgggcaggagctccgggagctagaggtggcattgagcaatgggggaactggctcagagtcccccttagaacctccactgccccttgaggaggaggaggcctacgagagcttcacctgtccccctgagccccctggccccttcctcagcagccctttgcggactctcaaccagctgccaagccagcccttcactggacccttcatggctgcgctgtttgccaacttgagaaaagtctctcagaaccgctatgtgcatttggtgttcaaggcttcttgtccttctaagtagattg

SEQ ID NO: 17166 - DNA, 210 bp, Homo sapiens
cagggagaagggaggacatcacgggtatggcctaggttctgggggagcgtagcaaggaggggctggggtgaaggggaggaaggtgtccatgaatgatagtctgtctttggggaggttgatgagggtgtcttgcagggaggacccttaacactcaccaaagaaaattagagtgggacttctgggcaaagctattcttgttcttctctctag

SEQ ID NO: 17167 - DNA, 296 bp, Homo sapiens
ggaatgcgtgcgatgtgcattgtgttcaggctttgtatccttgtgcccacctcccccccaacccaggccccttcatggctgtgctctttgccaaactcgagaacatgctgcagaactccgtctatgtcaacttcctgctgacggggctggtggcccagctggcctgtcacccccagcccctgctccgctctttcctgctcaacaccaacatggtcttccagcccagtgtcaagtccctgctgcaggtgtgcgatgcatgcatgcatgggtgcgtccaggctccgtggtgggccagg

SEQ ID NO: 17168 - DNA, 2647 bp, Homo sapiens
tcatgcagtacagacatagcaagccttgtcctgactatgtttcacatttgtgaattaggtatggccacctggtgaattcagttgttaagcaatatataatggggaattgtataccccactatttctaagattcccattagttttccctttttcctttttaatatgagtaatgctttataaaaatgggaaaaaaagtatacttaaggatctgtagtaataactgctttacaaaatccttaaaactactaatttgctgcttgtacagaaagtgaaaattagttggcaatcataagaaacatctgaataacaacgatgaatgggaaactagtgttgaaataggattcattttacttagcaccagcttaatttccttaggaagggctcatctccattagaaaatggagtcatcttatgtgcttaattattttcagttaattgtcaagtttaagtgcctaatcaaggcaagtgttgtttcagcctatgcttaatgcaagctaggatagtgattttaaataatcactaaaatcactagatttaaataatcactaaaatgatttgtgagaaactggcacttcagatattatatcctttagctataggttcttctctccctaagaacattagatattttagttttccagaacaaaagctttaaacttctgcagtaagttgagagaagggttgagaagaggaaaagaacttctcattttctatcagataagaatcacattagaaactaagtacaagattagacaacaaattatgtggtcaaataatatagtcattagccacctaaacattttaattccagatattatttaattccatataataactgaattcttgtgagtggattacaggtttttgatcccaaaattccagagctttcaactctctgaatttgtagtcctgaatatcccagtggtgggggttcccagcattgtgggtgctacttgcaaggccatagaatctagatggccctgtcttgaccctgaaatgaaccttaagccttagaacaaagtcatgcagatgccccatttgataataatcttattcacctgtgctctggtcctcggtttctgcatgtgttagcattgcattgataactcagaatcttgataaacacttaatatttgggcctgaagcattaaactttctttttattgtatatacttaaaaaatagaactcactgccctatcatacattgtagccctcttattctttggtctttcatatgcattagttaaatcccttaaagtagacattcataaaaacttacattgtttattggagtataaaatattacccaagtttcttcatgagttgacatgagctgttttaaatactggtgtattttcagaacagtaaaattactgaatatcagaaaaaatgttaattgatgatgaagcttattcccaaaatgccttttgtgcatatgatacttggaaagtcactaatgtgcctcagttaatacatcagtaaaatgttgtgtttcttttccagtgtagtgtttttggaatataaattccccatgctagtatagtatctcagcaaagagaatttccccccaggaggctcagtaaaggaataccgtgtcttacccatcgttatgatggaaggctgctttgaaaatggctgttttaccttataaggttaaaattttgatccatatgttaagtgatagaagattttggtgcaacagtagtaggatatatttctcctagaacatcccttattggcttacatgattttattgccttttaatagatattttgtcattttggccaaacaaaagacactgagtagttacacttaagttaaaaatgaggggaaaatcattattttaggtgtggagccatttttattataaaactttctcaaaataaaaaaacattgaatcatttcaatttttgcagtccctgtattagtatatgaatacatacttgccatttgaattaataacatgaaaagagtatactgtgtttttaaatccgtgtttctttgaatttaaagggtgtacaggtctttctgtagggaaaattattccatgtaaacatttcaactctgtatgaaaatgttaaatattgtaagaaagttatcctctcattttttcactgctatgatatatttattataaaatagggaatgaatgaatgaatatggattgctgttaactagaaacacttctgtatgtcagtcagcatttaatgaccacctactgtgtgcacagcactactggtaaaattttgaagacattgttaacattaaaaaatattttaaagttgtctacaaatctgagccttgtaatgatgtatatttaagttatttttgtttttatagattaaagtaagattatactatccagttttattactaaaaaagactggttttaattttaccaatgtgtgaactataaaagctttttgcctacagattttacattttaaaattatctatggctgttttaaattgtctagcaatttatatggttgtggttaactcatttaagaaacaattatctttctatattaagccattttcaaatagcaagacagtgcttgtctttttttgttattacactaactgcaattcagtaagctgcatgacaaaatatgtattatgtaaataaactgggtttactaaata

SEQ ID NO: 17169 - DNA, 2714 bp, Homo sapiens
tcatgcagtacagacatagcaagccttgtcctgactatgtttcacatttgtgaattaggtatggccacctggtgaattcagttgttaagcaatatataatggggaattgtataccccactatttctaagattcccattagttttccctttttcctttttaatatgagtaatgctttataaaaatgggaaaaaaagtatacttaaggatctgtagtaataactgctttacaaaatccttaaaactactaatttgctgcttgtacagaaagtgaaaattagttggcaatcataagaaacatctgaataacaacgatgaatgggaaactagtgttgaaataggattcattttacttagcaccagcttaatttccttaggaagggctcatctccattagaaaatggagtcatcttatgtgcttaattattttcagttaattgtcaagtttaagtgcctaatcaaggcaagtgttgtttcagcctatgcttaatgcaagctaggatagtgattttaaataatcactaaaatcactagatttaaataatcactaaaatgatttgtgagaaactggcacttcagatattatatcctttagctataggttcttctctccctaagaacattagatattttagttttccagaacaaaagctttaaacttctgcagtaagttgagagaagggttgagaagaggaaaagaacttctcattttctatcagataagaatcacattagaaactaagtacaagattagacaacaaattatgtggtcaaataatatagtcattagccacctaaacattttaattccagatattatttaattccatataataactgaattcttgtgagtggattacaggtttttgatcccaaaattccagagctttcaactctctgaatttgtagtcctgaatatcccagtggtgggggttcccagcattgtgggtgctacttgcaaggccatagaatctagatggccctgtcttgaccctgaaatgaaccttaagccttagaacaaagtcatgcagatgccccatttgataataatcttattcacctgtgctctggtcctcggtttctgcatgtgttagcattgcattgataactcagaatcttgataaacacttaatatttgggcctgaagcattaaactttctttttattgtatatacttaaaaaatagaactcactgccctatcatacattgtagccctcttattctttggtctttcatatgcattagttaaatcccttaaagtagacattcataaaaacttacattgtttattggagtataaaatattacccaagtttcttcatgagttgacatgagctgttttaaatactggtgtattttcagaacagtaaaattactgaatatcagaaaaaatgttaattgatgatgaagcttattcccaaaatgccttttgtgcatatgatacttggaaagtcactaatgtgcctcagttaatacatcagtaaaatgttgtgtttcttttccagtgtagtgtttttggaatataaattccccatgctagtatagtatctcagcaaagagaatttccccccaggaggctcagtaaaggaataccgtgtcttacccatcgttatgatggaaggctgctttgaaaatggctgttttaccttataaggttaaaattttgatccatatgttaagtgatagaagattttggtgcaacagtagtaggatatatttctcctagaacatcccttattggcttacatgattttattgccttttaatagatattttgtcattttggccaaacaaaagacactgagtagttacacttaagttaaaaatgaggggaaaatcattattttaggtgtggagccatttttattataaaactttctcaaaataaaaaaacattgaatcatttcaatttttgcagtccctgtattagtatatgaatacatacttgccatttgaattaataacatgaaaagagtatactgtgtttttaaatccgtgtttctttgaatttaaagggtgtacaggtctttctgtagggaaaattattccatgtaaacatttcaactctgtatgaaaatgttaaatattgtaagaaagttatcctctcattttttcactgctatgatatatttattataaaatagggaatgaatgaatgaatatggattgctgttaactagaaacacttctgtatgtcagtcagcatttaatgaccacctactgtgtgcacagcactactggtaaaattttgaagacattgttaacattaaaaaatattttaaagttgtctacaaatctgagccttgtaatgatgtatatttaagttatttttgtttttatagattaaagtaagattatactatccagttttattactaaaaaagactggttttaattttaccaatgtgtgaactataaaagctttttgcctacagattttacattttaaaattatctatggctgttttaaattgtctagcaatttatatggttgtggttaactcatttaagaaacaattatctttctatattaagccattttcaaatagcaagacagtgcttgtctttttttgttattacactaactgcaattcagtaagctgcatgacaaaatatgtattatgtaaataaactgggtttactaaataaaaaaaacaccccaaaaaaaaaagggggggggggaaaaatacccgggggggcccattgccccccttt

SEQ ID NO: 17170 - DNA, 2676 bp, Homo sapiens
tcatgcagtacagacatagcaagccttgtcctgactatgtttcacatttgtgaattaggtatggccacctggtgaattcagttgttaagcaatatataatggggaattgtataccccactatttctaagattcccattagttttccctttttcctttttaatatgagtaatgctttataaaaatgggaaaaaaagtatacttaaggatctgtagtaataactgctttacaaaatccttaaaactactaatttgctgcttgtacagaaagtgaaaattagttggcaatcataagaaacatctgaataacaacgatgaatgggaaactagtgttgaaataggattcattttacttagcaccagcttaatttccttaggaagggctcatctccattagaaaatggagtcatcttatgtgcttaattattttcagttaattgtcaagtttaagtgcctaatcaaggcaagtgttgtttcagcctatgcttaatgcaagctaggatagtgattttaaataatcactaaaatcactagatttaaataatcactaaaatgatttgtgagaaactggcacttcagatattatatcctttagctataggttcttctctccctaagaacattagatattttagttttccagaacaaaagctttaaacttctgcagtaagttgagagaagggttgagaagaggaaaagaacttctcattttctatcagataagaatcacattagaaactaagtacaagattagacaacaaattatgtggtcaaataatatagtcattagccacctaaacattttaattccagatattatttaattccatataataactgaattcttgtgagtggattacaggtttttgatcccaaaattccagagctttcaactctctgaatttgtagtcctgaatatcccagtggtgggggttcccagcattgtgggtgctacttgcaaggccatagaatctagatggccctgtcttgaccctgaaatgaaccttaagccttagaacaaagtcatgcagatgccccatttgataataatcttattcacctgtgctctggtcctcggtttctgcatgtgttagcattgcattgataactcagaatcttgataaacacttaatatttgggcctgaagcattaaactttctttttattgtatatacttaaaaaatagaactcactgccctatcatacattgtagccctcttattctttggtctttcatatgcattagttaaatcccttaaagtagacattcataaaaacttacattgtttattggagtataaaatattacccaagtttcttcatgagttgacatgagctgttttaaatactggtgtattttcagaacagtaaaattactgaatatcagaaaaaatgttaattgatgatgaagcttattcccaaaatgccttttgtgcatatgatacttggaaagtcactaatgtgcctcagttaatacatcagtaaaatgttgtgtttcttttccagtgtagtgtttttggaatataaattccccatgctagtatagtatctcagcaaagagaatttccccccaggaggctcagtaaaggaataccgtgtcttacccatcgttatgatggaaggctgctttgaaaatggctgttttaccttataaggttaaaattttgatccatatgttaagtgatagaagattttggtgcaacagtagtaggatatatttctcctagaacatcccttattggcttacatgattttattgccttttaatagatattttgtcattttggccaaacaaaagacactgagtagttacacttaagttaaaaatgaggggaaaatcattattttaggtgtggagccatttttattataaaactttctcaaaataaaaaaacattgaatcatttcaatttttgcagtccctgtattagtatatgaatacatacttgccatttgaattaataacatgaaaagagtatactgtgtttttaaatccgtgtttctttgaatttaaagggtgtacaggtctttctgtagggaaaattattccatgtaaacatttcaactctgtatgaaaatgttaaatattgtaagaaagttatcctctcattttttcactgctatgatatatttattataaaatagggaatgaatgaatgaatatggattgctgttaactagaaacacttctgtatgtcagtcagcatttaatgaccacctactgtgtgcacagcactactggtaaaattttgaagacattgttaacattaaaaaatattttaaagttgtctacaaatctgagccttgtaatgatgtatatttaagttatttttgtttttatagattaaagtaagattatactatccagttttattactaaaaaagactggttttaattttaccaatgtgtgaactataaaagctttttgcctacagattttacattttaaaattatctatggctgttttaaattgtctagcaatttatatggttgtggttaactcatttaagaaacaattatctttctatattaagccattttcaaatagcaagacagtgcttgtctttttttgttattacactaactgcaattcagtaagctgcatgacaaaatatgtattatgtaaataaactgggtttactaaataagaaataaacaataaatgaaacaagaaga

SEQ ID NO: 17171 - DNA, 2452 bp, Homo sapiens
tcatgcagtacagacatagcaagccttgtcctgactatgtttcacatttgtgaattaggtatggccacctggtgaattcagttgttaagcaatatataatggggaattgtataccccactatttctaagattcccattagttttccctttttcctttttaatatgagtaatgctttataaaaatgggaaaaaaagtatacttaaggatctgtagtaataactgctttacaaaatccttaaaactactaatttgctgcttgtacagaaagtgaaaattagttggcaatcataagaaacatctgaataacaacgatgaatgggaaactagtgttgaaataggattcattttacttagcaccagcttaatttccttaggaagggctcatctccattagaaaatggagtcatcttatgtgcttaattattttcagttaattgtcaagtttaagtgcctaatcaaggcaagtgttgtttcagcctatgcttaatgcaagctaggatagtgattttaaataatcactaaaatcactagatttaaataatcactaaaatgatttgtgagaaactggcacttcagatattatatcctttagctataggttcttctctccctaagaacattagatattttagttttccagaacaaaagctttaaacttctgcagtaagttgagagaagggttgagaagaggaaaagaacttctcattttctatcagataagaatcacattagaaactaagtacaagattagacaacaaattatgtggtcaaataatatagtcattagccacctaaacattttaattccagatattatttaattccatataataactgaattcttgtgagtggattacaggtttttgatcccaaaattccagagctttcaactctctgaatttgtagtcctgaatatcccagtggtgggggttcccagcattgtgggtgctacttgcaaggccatagaatctagatggccctgtcttgaccctgaaatgaaccttaagccttagaacaaagtcatgcagatgccccatttgataataatcttattcacctgtgctctggtcctcggtttctgcatgtgttagcattgcattgataactcagaatcttgataaacacttaatatttgggcctgaagcattaaactttctttttattgtatatacttaaaaaatagaactcactgccctatcatacattgtagccctcttattctttggtctttcatatgcattagttaaatcccttaaagtagacattcataaaaacttacattgtttattggagtataaaatattacccaagtttcttcatgagttgacatgagctgttttaaatactggtgtattttcagaacagtaaaattactgaatatcagaaaaaatgttaattgatgatgaagcttattcccaaaatgccttttgtgcatatgatacttggaaagtcactaatgtgcctcagttaatacatcagtaaaatgttgtgtttcttttccagtgtagtgtttttggaatataaattccccatgctagtatagtatctcagcaaagagaatttccccccaggaggctcagtaaaggaataccgtgtcttacccatcgttatgatggaaggctgctttgaaaatggctgttttaccttataaggttaaaattttgatccatatgttaagtgatagaagattttggtgcaacagtagtaggatatatttctcctagaacatcccttattggcttacatgattttattgccttttaatagatattttgtcattttggccaaacaaaagacactgagtagttacacttaagttaaaaatgaggggaaaatcattattttaggtgtggagccatttttattataaaactttctcaaaataaaaaaacattgaatcatttcaatttttgcagtccctgtattagtatatgaatacatacttgccatttgaattaataacatgaaaagagtatactgtgtttttaaatccgtgtttctttgaatttaaagggtgtacaggtctttctgtagggaaaattattccatgtaaacatttcaactctgtatgaaaatgttaaatattgtaagaaagttatcctctcattttttcactgctatgatatatttattataaaatagggaatgaatgaatgaatatggattgctgttaactagaaacacttctgtatgtcagtcagcatttaatgaccacctactgtgtgcacagcactactggtaaaattttgaagacattgttaacattaaaaaatattttaaagttgtctacaaatctgagccttgtaatgatgtatatttaagttatttttgtttttatagattaaagtaagattcccatcccactttatcacctaaaaagacatcgttttcattctcaccactcggaccactataataagcctttttgtctacccacgttttcatttaaaa

SEQ ID NO: 17172 - DNA, 1287 bp, Homo sapiens
tattcgtgttgcacttatacgtgttgcacaatgttaattgatgatgaagcttattcccaaaatgccttttgtgcatatgatacttggaaagtcactaatgtgcctcagttaatacatcagtaaaatgttgtgtttcttttccagtgtagtgtttttggaatataaattccccatgctagtatagtatctcagcaaagagaatttccccccaggaggctcagtaaaggaataccgtgtcttacccatcgttatgatggaaggctgctttgaaaatggctgttttaccttataaggttaaaattttgatccatatgttaagtgatagaagattttggtgcaacagtagtaggatatatttctcctagaacatcccttattggcttacatgattttattgccttttaatagatattttgtcattttggccaaacaaaagacactgagtagttacacttaagttaaaaatgaggggaaaatcattattttaggtgtggagccatttttattataaaactttctcaaaataaaaaaacattgaatcatttcaatttttgcagtccctgtattagtatatgaatacatacttgccatttgaattaataacatgaaaagagtatactgtgtttttaaatccgtgtttctttgaatttaaagggtgtacaggtctttctgtagggaaaattattccatgtaaacatttcaactctgtatgaaaatgttaaatattgtaagaaagttatcctctcattttttcactgctatgatatatttattataaaatagggaatgaatgaatgaatatggattgctgttaactagaaacacttctgtatgtcagtcagcatttaatgaccacctactgtgtgcacagcactactggtaaaattttgaagacattgttaacattaaaaaatattttaaagttgtctacaaatctgagccttgtaatgatgtatatttaagttatttttgtttttatagattaaagtaagattatactatccagttttattactaaaaaagactggttttaattttaccaatgtgtgaactataaaagctttttgcctacagattttacattttaaaattatctatggctgttttaaattgtctagcaatttatatggttgtggttaactcatttaagaaacaattatctttctatattaagccattttcaaatagcaagacagtgcttgtctttttttgttattacactaactgcaattcagtaagctgcatgacaaaatatgtattatgtaaataaactgggtttactaaata

SEQ ID NO: 17173 - DNA, 547 bp, Homo sapiens
  misc_feature (14)..(15): n is a, c, g, or t
  misc_feature (21)..(21): n is a, c, g, or t
  misc_feature (36)..(36): n is a, c, g, or t
  misc_feature (40)..(40): n is a, c, g, or t
  misc_feature (43)..(45): n is a, c, g, or t
  misc_feature (60)..(60): n is a, c, g, or t
  misc_feature (66)..(66): n is a, c, g, or t
  misc_feature (81)..(81): n is a, c, g, or t
  misc_feature (110)..(110): n is a, c, g, or t
cgttaccccccccnntttccnccgccctgatatctntatnccnnnatcgggcctgactgnatgcanctggattgccgttcncccgacccccccccgtatgcccgcccgcntttaatgccccccccccgtggccccgccccccaaattttgaagacattgttaacattaaaaaatattttaaagttgtctacaaatctgagccttgtaatgatgtatatttaagttatttttgtttttatagattaaagtaagattatactatccagttttattactaaaaaagactggttttaattttaccaatgtgtgaactataaaagctttttgcctacagattttacattttaaaattatctatggctgttttaaattgtctagcaatttatatggttgtggttaactcatttaagaaacaattatctttctatattaagccattttcaaatagcaagacagtgcttgtctttttttgttattacactaactgcaattcagtaagctgcatgacaaaatatgtattatgtaaataaactgggtttactaaata

SEQ ID NO: 17174 - DNA, 2157 bp, Homo sapiens
tttaaataaagcttcttcaagctgttttcagctttggaaccagaaacctccaaactttgtaagttacataaatgcttagtacatcataaccttcaaaaggttgccaattagaagaaatcttaagcattgtcaggaaattccttctctctatatatagccttatgcatagtagacttgttgctttctttcccttttaaagttggaacatagaacataaaaccccagtacgtcggcattgtgaggtccttgtgacctcacctttcaaataggatatggttacctgggaaactaagttaattacatatggaacatcagaggctaagctcaggtggcaacaggatgggtcagatcaaggaagactgagactccggaccaagcctcacggctggtgagggccagggactcaatcacaggaacaagacttcttttgtagaattatcctatggaatgatattttcataatgagtcaacaaggttacgtggctacacctccgtattctcagcctcagcctggaataggcctttctccacctcattatgggcactatggggatccgtcgcacacagcatctccaacaggaagaaaactgaggtccttaaagataagcttcttgcccaggttcatacaactaataagtaaccagtggggccttgaactactctaacccaagcccagtgatttctctcctttactgcaatttctcaagaagaaaagagagaaatgtctgaagacagttccaaagagaagtctttaaaggtatgatgaagccagcagggcctttgggggccaccgccactaggggaatgttgcctccgggtcccccacctcctggaccccatcagtttggtcagaatggagctcatgccactggtcaccctccccaaagatttccaggccctccacctgtcaacaatgtggcatcctcacatgcaccataccaaccctctgcacaatcttcttatccaggtcctatatccacttcatctgtcacccagctgggcagccagctcagtgctatgcaaatcaacagctatggtaatagttttattattagtgtttattgactgccttgtgtcctggtcatttttaatgagagaggttttcttcatttttaaaatagatgtaactagggcatactgtgttgaagtagtatttggacatttttaataataaagcatctatcttatgtatggctatagttaattgttttcttgatcatgctgccacttatttcaaggtaattgaaggaccctcagaataccttccattcaatgattgaacaataagaaaagacaaaaaatgctgatttcacaaataaacattagaatagtgaaattattttaagaaataaataaggataatttaaaccttgtattgtttatgatggggcccccaaatcagaaatatagtactcattgtttcacagtgcattttaattatgtgtttagatcatggaaagagtggaagctcagatgttgtgaggcagaaaagagaagataggagaggaaagagtcacagtactgagatttacatcaacagaaatgctgtatatcctgtgagtcatggaaagctccactgtaatgacagcacagtcggccatttatctagatgaagaatgtttccatgttacttaaaattagttttctgaagtatcattaaaacccctctattttctgtcttttactcatttcaaaatggataagtctccaaagaagcaacccagtttcccataatcagagaaaggaaaacataatctggttttacagctatttccaatatgattggagagcatgttggtggcccttctcttgtctctggttatttccacctaattctgaaatttgtttggtcaagtcacgcacaggatgcaaataatttattgaatgtgcaatttacctgagtaatgcttgttatgtaatagaatttttatatgattttctagatttgtaccagatacagatgctttaattaatgcatatatcatgtaattacacaactgagttaaaatttattctatgaattcccttacttaaattataaatgttgcttttaccttttaaaaattttccaggccaggcatggtggctcacacctataatcccagcactttgggatgccaaggaggaagtattgcttgagcccaggagtttgagacc

SEQ ID NO: 17175 - DNA, 1461 bp, Homo sapiens
tttaaataaagcttcttcaagctgttttcagctttggaaccagaaacctccaaactttgtaagttacataaatgcttagtacatcataaccttcaaaaggttgccaattagaagaaatcttaagcattgtcaggaaattccttctctctatatatagccttatgcatagtagacttgttgctttctttcccttttaaagttggaacatagaacataaaaccccagtacgtcggcattgtgaggtccttgtgacctcacctttcaaataggatatggttacctgggaaactaagttaattacatatggaacatcagaggctaagctcaggtggcaacaggatgggtcagatcaaggaagactgagactccggaccaagcctcacggctggtgagggccagggactcaatcacaggaacaagacttcttttgtagaattatcctatggaatgatattttcataatgagtcaacaaggttacgtggctacacctccgtattctcagcctcagcctggaataggcctttctccacctcattatgggcactatggggatccgtcgcacacagcatctccaacaggaagaaaactgaggtccttaaagataagcttcttgcccaggttcatacaactaataagtaaccagtggggccttgaactactctaacccaagcccagtgatttctctcctttactgcaatttctcaagaagaaaagagagaaatgtctgaagacagttccaaagagaagtctttaaaggtatgatgaagccagcagggcctttgggggccaccgccactaggggaatgttgcctccgggtcccccacctcctggaccccatcagtttggtcagaatggagctcatgccactggtcaccctccccaaagatttccaggccctccacctgtcaacaatgtggcatcctcacatgcaccataccaaccctctgcacaatcttcttatccaggtcctatatccacttcatctgtcacccagctgggcagccagctcagtgctatgcaaatcaacagctatggttcaggcatggctcctccaagccagggaccccctggccctctgtcagccacatcattgcagactcctccacgacctccacagccgtccattttgcagcctggatctcaagttcttccaccaccacccaccacactcaatggtcctggtgcctcacctttgcctctaccaatgtacagaccagatgggctctctgggcctcctcctccaaatgcccagtaccagcccccacctcttccaggccagaccttgggtgctggatatcctccgcagcaggccaactctggtccccagatggcaggcgcacaactgtcttacccaggaggcttccctggaggtcctgcacagatggctggtccgccacagccccagaagaagctggatcctgactctatccctaacccaatccaggtgattgagaatgaa

SEQ ID NO: 17176 - DNA, 1744 bp, Homo sapiens
tttaaataaagcttcttcaagctgttttcagctttggaaccagaaacctccaaactttgtaagttacataaatgcttagtacatcataaccttcaaaaggttgccaattagaagaaatcttaagcattgtcaggaaattccttctctctatatatagccttatgcatagtagacttgttgctttctttcccttttaaagttggaacatagaacataaaaccccagtacgtcggcattgtgaggtccttgtgacctcacctttcaaataggatatggttacctgggaaactaagttaattacatatggaacatcagaggctaagctcaggtggcaacaggatgggtcagatcaaggaagactgagactccggaccaagcctcacggctggtgagggccagggactcaatcacaggaacaagacttcttttgtagaattatcctatggaatgatattttcataatgagtcaacaaggttacgtggctacacctccgtattctcagcctcagcctggaataggcctttctccacctcattatgggcactatggggatccgtcgcacacagcatctccaacaggaagaaaactgaggtccttaaagataagcttcttgcccaggttcatacaactaataagtaaccagtggggccttgaactactctaacccaagcccagtgatttctctcctttactgcaatttctcaagaagaaaagagagaaatgtctgaagacagttccaaagagaagtctttaaaggtatgatgaagccagcagggcctttgggggccaccgccactaggggaatgttgcctccgggtcccccacctcctggaccccatcagtttggtcagaatggagctcatgccactggtcaccctccccaaagatttccaggccctccacctgtcaacaatgtggcatcctcacatgcaccataccaaccctctgcacaatcttcttatccaggtcctatatccacttcatctgtcacccagctgggcagccagctcagtgctatgcaaatcaacagctatgatcatggaaagagtggaagctcagatgttgtgaggcagaaaagagaagataggagaggaaagagtcacagtactgagatttacatcaacagaaatgctgtatatcctgtgagtcatggaaagctccactgtaatgacagcacagtcggccatttatctagatgaagaatgtttccatgttacttaaaattagttttctgaagtatcattaaaacccctctattttctgtcttttactcatttcaaaatggataagtctccaaagaagcaacccagtttcccataatcagagaaaggaaaacataatctggttttacagctatttccaatatgattggagagcatgttggtggcccttctcttgtctctggttatttccacctaattctgaaatttgtttggtcaagtcacgcacaggatgcaaataatttattgaatgtgcaatttacctgagtaatgcttgttatgtaatagaatttttatatgattttctagatttgtaccagatacagatgctttaattaatgcatatatcatgtaattacacaactgagttaaaatttattctatgaattcccttacttaaattataaatgttgcttttaccttttaaaaattttccaggccaggcatggtggctcacacctataatcccagcactttgggatgccaaggaggaagtattgcttgagcccaggagtttgagacc

SEQ ID NO: 17177 - DNA, 1283 bp, Homo sapiens
tttaaataaagcttcttcaagctgttttcagctttggaaccagaaacctccaaactttgtaagttacataaatgcttagtacatcataaccttcaaaaggttgccaattagaagaaatcttaagcattgtcaggaaattccttctctctatatatagccttatgcatagtagacttgttgctttctttcccttttaaagttggaacatagaacataaaaccccagtacgtcggcattgtgaggtccttgtgacctcacctttcaaataggatatggttacctgggaaactaagttaattacatatggaacatcagaggctaagctcaggtggcaacaggatgggtcagatcaaggaagactgagactccggaccaagcctcacggctggtgagggccagggactcaatcacaggaacaagacttcttttgtagaattatcctatggaatgatattttcataatgagtcaacaaggttacgtggctacacctccgtattctcagcctcagcctggaataggcctttctccacctcattatgggcactatggggatccgtcgcacacagcatctccaacaggtatgatgaagccagcagggcctttgggggccaccgccactaggggaatgttgcctccgggtcccccacctcctggaccccatcagtttggtcagaatggagctcatgccactggtcaccctccccaaagatttccaggccctccacctgtcaacaatgtggcatcctcacatgcaccataccaaccctctgcacaatcttcttatccaggtcctatatccacttcatctgtcacccagctgggcagccagctcagtgctatgcaaatcaacagctatggttcaggcatggctcctccaagccagggaccccctggccctctgtcagccacatcattgcagactcctccacgacctccacagccgtccattttgcagcctggatctcaagttcttccaccaccacccaccacactcaatggtcctggtgcctcacctttgcctctaccaatgtacagaccagatgggctctctgggcctcctcctccaaatgcccagtaccagcccccacctcttccaggccagaccttgggtgctggatatcctccgcagcaggccaactctggtccccagatggcaggcgcacaactgtcttacccaggaggcttccctggaggtcctgcacagatggctggtccgccacagccccagaagaagctggatcctgactctatccctaacccaatccaggtgattgagaatgaa

SEQ ID NO: 17178 - DNA, 803 bp, Homo sapiens
tttaaataaagcttcttcaagctgttttcagctttggaaccagaaacctccaaactttgtaagttacataaatgcttagtacatcataaccttcaaaaggttgccaattagaagaaatcttaagcattgtcaggaaattccttctctctatatatagccttatgcatagtagacttgttgctttctttcccttttaaagttggaacatagaacataaaaccccagtacgtcggcattgtgaggtccttgtgacctcacctttcaaataggatatggttacctgggaaactaagttaattacatatggaacatcagaggctaagctcaggtggcaacaggatgggtcagatcaaggaagactgagactccggaccaagcctcacggctggtgagggccagggactcaatcacaggaacaagacttcttttgtagaattatcctatggaatgatattttcataatgagtcaacaaggttacgtggctacacctccgtattctcagcctcagcctggaataggcctttctccacctcattatgggcactatggggatccgtcgcacacagcatctccaacaggaagaaaactgaggtccttaaagataagcttcttgcccaggttcatacaactaataagtaaccagtggggccttgaactactctaacccaagcccagtgatttctctcctttactgcaatttctcaagaagaaaagagagaaatgtctgaagacagttccaaagagaagtctttaaaggtctctatttgagaagagctgctaataaatgaaaacacagacattc

SEQ ID NO: 17179 - DNA, 338 bp, Homo sapiens
gatccaggacccactccaccaccacaagagtgtgagaacagaaataaggaaaaagcttttaagtcaagtatgaagaccccacatgtatcccactattctccctactgcaggtctgtatgtagaatttacaaaggaagcaacaaaaagacgctacaattctcacaaaaaagacttgacttcatctactacagagaacctcaactcttgtcatcttaccctcaaagcagaacttaaataccccaggtaatcaaaggggcaataattcacttctgcaccactgaagataacccttgacttccacaccaccaattaggataaatctatttggatgaacaaag

SEQ ID NO: 17180 - DNA, 389 bp, Homo sapiens
gtcccataagaagagtgaacccttgcattttacctagactcaaataatccacctgtttgcttagtctaatctgttaacacaccctcgctgaagcccataacttctacagagggttaatgacttttatacagtactcaatacagttgatgaatgaatgaatgagtgaatatgaattcagtttcagtgatatgggtcatgtcactgtggagatgatcttttatttcaaatacagtatgagaaccttacaatagtatactttcatttctttccttctggccttttcattattgtcttttaataaattttaaaccctagaatatatttaaaaaaatactttctctttaaatacttttcttttaaataataataaagatctgtttactcagata

SEQ ID NO: 17181 - DNA, 1047 bp, Homo sapiens
ccccaaacacccccaccaaattccctgaactgcgtcccagcacttctcaaacctccaagacttgacccagctcttttcagctcaaattcagcctttgggatgctccaaatccttcccacaactgacatttcttggacacccccaaagcctcaggcctgttccgcacccatatccccaaagccctaacagacttgtccagcccaggttcccttgatgctagaacttccaagataggcgcaacctgtctgcaattccagggaaccagaccctccccaagcaccctctttgtcttacgcctaaccctgagtcccttccctgagatggtgccccaaaggtaccctcttcacagacaccagtgtttcccagagggttgtatttgtacctttggtggtgtgctaaggtttgaggcagtatgaggacaaacacttgttttaaaagttttgtctctaatacgcattttgtacagaagccgataagtgcaggcatcgctgcttggctaggacacggtttatttaggttaagagtgtttccatttaaagtagtccacagatgatcacagaggctgttcccgaagggcaggaacactggagtatcagaagattgggaaccgacaacacccagctcggctgggatcccagccccccttccccagcggtcctcaccgcgtcacgctcgcgggtggaaaatcatttcccacctcctatcctggctcaaggatgcgctacctcccccaagcccagagaccacaccggtcccagactctttagcggaccccccttttggagccggggtcccacggaattagccacctccctccctctgctcccacggcctcaggaaccccccacccgagggtggatggggggcgtcactgagcacgattctcgatgcaacgattcctatgcaaggggcattttgagtcccccccatccttccctcggaccctaaaccctggtgaagcaggggtgaggggtggggcgggttttggtgggggcggggcaaagggctaggggctccagacaccagggtacggggtggggactgatt

SEQ ID NO: 17182 - DNA, 761 bp, Homo sapiens
gatctcagctcactgcagcctccacctcccgggttgaagcatgtctcctgccccagcctcccaagtagctgggactacaggcgcatgtcaccatgcctagctaatttttgtatttttaatagagatggggtttcaccatgttgctcaggcgaatctcgaactcctgacctcaagtgatccgcctgcctcggcttcctaatgtgcaaagatgcttttttgttgtcacattttaagacagccaaaaagaatgagaaagtcattgtttagaagaaaaggaatcctagtgacgagttgtcttgaaagagaagaaaaaaagttaaaaaacagaagaaaaaggagatctttaaccgtgctgggtataaaattctaagtcaggatacttttcttcctttgagcatctttgactgcctggggaatatcagacattcttttagtggccttgtgatcattttgctgagcttgttcatattcctgttctaggttctcttagaattgataaatagacttaacgaaaaccttttaattaccatgaatttttaataaaacgtgaaattaatgttctggccttgtattgcacttctgtgccaattgggaagatgtctcaaccttttctcaacagttattaagaaatatgttggataaaacaccgattactactgctaaagaagaaccttccaacaaattggtaatgttttctttcagataagcaacacacactgccacttaagtacaagccgcatctagactcctcactatcacca

SEQ ID NO: 17183 - DNA, 312 bp, Homo sapiens
tctgctactaatatggtatgtcctgatagagactgaatcttaccctgaatcccagcatcgcattgtggaactaagtgctgaataataatagttctgaggaagaaataaacgtttgttcttgcaagcctctgagaattcaaagatatttgctaccacattacaacttccagaaagctgaaagtacactttcaatgacctgttttttctttactcaccttaaccttccaaatccacagttacagatagtagctcattatctccactacttgtacgaactttgaaatctgcatttgagaattttcttcatatgat

SEQ ID NO: 17184 - DNA, 155 bp, Homo sapiens
gacagtttaggggacataaaacagcaaaaatggatttaaaggaaagcccagtcattcacacttagaagaattcctggactaacaattctaagccaaggcagctgcggcaacgttgaggcagaatcaaaacctggggaaagaccttaggtattcag

SEQ ID NO: 17185 - DNA, 1027 bp, Homo sapiens
gaaccaacattctgcctcttgggatatatttcaaagaatctttaatacagctccatcagatgacatgtgcatgagtgtttttgcagtatgatttttggtggtgggggcctagaggcaacataaatgttcagcattaggagaatgcataggtgaaacatgtattcatatcatggggcattaaacaacagaagcaacaaaattcatgtgcatacaacataagagtaccttttaaaaggtatgtagtgggagaagaaaaagcattttatagatacagaaaacatcattctgtaacttagaaacatacataggaaacagaaacagtttttaaaaacctacacaaaaagccacagtattactacattagaaaagttgcttttcagaggaatgggagtgagatggcgataagaggaaataaaaaacaaaaatatttttaaatagcaaaataacccctttttttttgagacagtttccctctgtcactcaggctggagtgtagtggcgcgatcctggctcactgcaacctttgcctcccgggttcaagcattcttctgcctcaacctcttgagtagctgcagttacaggtgcgcactaccatacctggctaatttttgtgtttttagtagagacggggttttgtcatgttggccaggctggtcttgaactcctgacctcaagtaatctgcccgcctcagcctcccaaagtgctgggattacaggtgtgagccaccgtgcccagccaaaacatgtttttgaagagtagttgataaagagtagatgataaaaaggaagatgcttaactgtgtaactaaatgaaaacataatatgggtatgtatatagtatgatctcagttatgtaaaaaactatgcacaaaaaaacctaaaaagaaaaatatcaggatgtatttctagaaggtgggattatctgttgttaaaaatttttgatattctattttctaaattgagtttttatcgcttttgtataagagaacctaaagggtaaagagttttaaaaatgaggacattgaaa

SEQ ID NO: 17186 - DNA, 734 bp, Homo sapiens
caggcaagaggttaggtttggcccatgggcataggtttgctgacttcagcatagagtcgtgggttatttacaagtgacatacttttcctgggttatctgggtatgttgactccatgccacttgcataaagcagcaatggatattagtattatggatgtccagtaagttattccacaaagaccatgcctaaggtggcatcagccctgggctccacagctgcgtggcatcaaagctttctcttaactctcttacctctaggcaaactgagacctcaccatcctctcccctgcttcccacgacagtcctttgcccttgccatgctcagggttggaatcaagttgttctattctcaacagaccaaaatgtttagttaaggcaaagtatcttggaaacaattgtgattaattacagtcttgtactcttgacaaagctgtgcagatggcaataagttcataccagcaatcctggagtcccataataaatacgtacatgtggaacatcgtgcacataatttcaacagttcgcagatctgtagttatgaagccagggtttggtggtatttgctctctcttggtgcatttgataaggatccactgaggcctgaatgtggaagatgatgggcagcgagaggagcgtcagaagaccccagtcaagacgtgttcgccatcagaggttacaggccgcacagcctgatgagcttcaagcctggcagggtaaatagtttttgggttttt

SEQ ID NO: 17187 - DNA, 311 bp, Homo sapiens
caatggcacaggccaatgtaggctggggcttagagaactggagaaaaacgtgtttgtgtgtagtacctcaggtactccttgccttgcagtccaaagcaaatgtaccgcttctcctggttttctttctagaaactgcattatatataccctatttttatatataatgcttctgtattactcctctggagactagccttttttatagactttctggtagaatgttaattagaaaggaaaataactatcttcaaccaatttattcattaaaagttcagttttttccaaagagtcataatacataaacttttttt

SEQ ID NO: 17188 - DNA, 402 bp, Homo sapiens
acgccactgcactccagcctgggtgacagagggaggctccctctcagaaaaacaaacaaacaaacagaccttagagagtcagcgtgaagttcccagagagtgaactctggctaactaattatctggctaatttgcatcttaaaaggacacacgggaatcagtgaggagaatcctaagggtcagagacttgcttggcatcttaatcgttaaaaataatttactcagactaggcaatatatccacaaaaaaaattttaaaaattagctggaggtggtggctcacgcctttagtcccagctactcgggaggctgaggtaggaggattgcttgagccactgcgttccaggctgcggtgagctgtgatcttaccactgtgctccagcctgagcggcatagcgagacc

SEQ ID NO: 17189 - DNA, 263 bp, Homo sapiens
tgaagtgaaaattagatttaaatggaatcaaggtaacttctgcaaataagtgtattctccaacttctgtgacttggtccaccccagagcgcaggtgtcatgtcctcagaagtgttcctggctcaggtgggaaggacattttccatatctgaagggactgaaatacatcctggaatagtcggttgatctccaattcctaccctttatttctttaaaaagaaaagagtcaaccaaaccaaaaaggagtgattcacatgtcatttt

SEQ ID NO: 17190 - DNA, 380 bp, Homo sapiens
tccaaatgtttctggagctacacttcttaatctccttcctcctttcctgtctcagaggaacagaagtccttcctcctcatcagttctaacttccatctgcagttttgatcccatggcttcccacctcctctggactgatttccatcatttatttatttatttatttagctgtgtttttcttctccattgagtctccttttatgtacaaatatcctcctgtgttctccatttaaaacaaatttaaaaattaaaagtaggccaggtgcagtggctcacacctgtaacacctcccagcactttgggagccaaaggcaggaaaattgcttgagcttaggcatttgtgaccagctggggaaacatagtaagatcctgtctctaca

SEQ ID NO: 17191 - DNA, 176 bp, Homo sapiens
acagaagtttgctaacccctgtctaagcctcattgtcctaaaataaattcagaaacctcaactgctactccttcagcccagacagcacctttattttctctctccttcattttaatatgcacgacaccactcagcaaaatgtcctgcatgcatggcctggcctaggtactccactc

SEQ ID NO: 17192 - DNA, 389 bp, Homo sapiens
gattcaatccatatattacggtaccagccccagaacaggagcagcctagagcaagcctgtaatatagggtttctgaaacctcctccatataaccaggagacaacataaaaagttacacgactatttatgtgacatggagtcgtattagtagtgacgtgcccacataaatagcactgtgaatttttggaatatggaaattaaagaaaaatatttcaaacctaagctgtgtattatgaaaaataacaaatcttcccaaatgccataaaaaaatagaggtggaaggaaagacaaagggctagaagtctatgagtattctttcttgataaaaatttaattttctaaaaaatctcataattgtacaaatagtaaataaacatttatgaaaggaa

SEQ ID NO: 17193 - DNA, 395 bp, Homo sapiens
cgcccacctcggcctcccaaagtgctaggattacacatgtgagccaccacgcctggcctgtggtacattcttaaagcagccctaagaaatcaatacaagaaatgtctaggcagggcaaggtggctcacgcctataaccccagcaatttgggaggccgaggtgggaggaccacctgaggtcaggagttcaagacccgcccagccaacatggcgaaaccccatctctactaaaaatacaaaaattagctgtgcatggtgggggcatgcctgtaatcccagctgcctgggaggctgaggcagtagaatcgcttgaacccaggaggcagaggttgcagtgagtcgaaatcgtgccactgcactccagcttggctgactgagcaagattccatctcaaaa

SEQ ID NO: 17194 - DNA, 466 bp, Homo sapiens
gggtcttaagtcctcttgggcaccaaaaaccccttctacactgtggagctgtgctgtccagggtagcagccactagtcacatatggtcttttacatctaaattaatgaaaattaaactaaaaaatttagctcctcagtcacactagttatattccaagtactcagtaatcacatgtggctagttgctactgtattggacaacagagataggaaaacatttctatcatcacagaaagttcaattggactctattgctttggagggaattcctggctccatattctttctgggatgacttatattctttgaattccagggcccactttgggttttaggaggcctaattttatgcctctgagaaaaacgaacacacatttgacttatcctccctcctaactccaaagttccttccctaaaggtgtattttcagtatggtagtataggtttacacctcagatgttatgga

SEQ ID NO: 17195 - DNA, 435 bp, Homo sapiens
ttactagggatggacactaagcagaaagatttctgagtatctattcatcttccccaatcagacagtcctttaaatttaaagaagaatgcctgacccttaagacagggaggttcatcatatttcccattctgacagtttggaatgaaaggacacataaattattattattattattgaattagaggtatgggtatgatgactgaggtttctcagcagaagatttctgattccatgctttgcatcattagacagccaacagaagctgcacttagtggccgcgtgatgtgattgattggttagattgggaataaaacttttttgttgttttttaaatccaatattactttatttttatttaattaacttacattcaaatgcaattgatcatatgattttctaattttaggattaaaatatatatgaagataagtttgg

SEQ ID NO: 17196 - DNA, 407 bp, Homo sapiens
tttctgttttcaggaatgacgagtcctttttgtaatgccaataatacatgaccattcagtctcagttttagtacttttagtgatagcaagttcattaccgcacaaaccagcctatgtcatatttgaagagctttgttggaatattttcttactttgcccctaaatcatccttctatccatatgtctctgaaatcacacaagtgcaattctcttccagttttcagttcttcgaatattatgaaaacataattatttcacaacagttttctttctgaatagaggggattgtcttcacagccctgtcttctgtagcatctgcttggaggcctcttggcaccctgaatactgtcctagggaaattgtctagtttacctcacttttagggcttcgatgccaccaaaaaaaaa

SEQ ID NO: 17197 - DNA, 286 bp, Homo sapiens
atcttccttttagtttggaccaccctttctcctgatggaagggctaaaacttcctttgagtcccgaggcctccaggagcaggacagctggccccaattattcccataaacaacttctgttctaaaccctgtctgcctggcattcttatttgttcactctactgaccggtttgctttcatatttgcctgataagacagaagattcctggcctagcgtggctttctatgggatgatggaaagtgtgtggggcccattttttctctttctgacacatagcttatacatt

SEQ ID NO: 17198 - DNA, 702 bp, Homo sapiens
cccggacccagcagccgtttcacgccaatagatagggcgcatgcgagcaaatcctcctcggctctctagcgtgactttcccaaggggccacgccagcttgccttctgattggtccagctggtgggttgtcttccgccatctttgatcagggcactaaggatgctcccgacggccttcacagtgacggcggagaccctgccccgccagctgctcagtacgtgccgcgtacccgtgcgagccaagtgtgagtccgggcgagcgcctgcggagctagcactgggcccagaatgagagggaggcggaggagcagcgatcacgtggttttagggactgtctaataattccacgccagcattgccggtgtttcagggggtgggaaccgctgcgttccccatcaacttttctcccacccaccaccctccccaacctacaagcccagctcagcttgaggtaactgctgaccggactgtcctatacagccctacaagacagaggcgcctagggctgaaagcgggggcctccgtagggagccagcgggggcctcaatagttactcattttctctacctttgatgaaaataagagctaattcttaataaggcctaccgggtatcacgcaaaaaccctgtgcttactattatactttgggttgttgcaaagattaaaggaaataagccgtgcaaagcgcttaagagcttggtat

SEQ ID NO: 17199 - DNA, 608 bp, Homo sapiens
tagcacaaagttattaacaggccaggaagaccttgtttctttcaggcttccataatgggtttgaaagaaaacacggattcttctacagcaacagagttaaagaaatagtcatagtcattcttccacgatctttgtagtctagcttgaatttcaaactgtgtccttccttactccagagagggagcaagtgtttcagctgcatgtggaactaggtaagcttcagtggcctcagaactccaggcccctcacggagatcaccctgaacaatgcccagtttttcatgcaggttttgtcctatgaccagttaactacatgttcaataaataaatgtcaaagaaataaatgcgtgaaaaggcaaccagttcatcatcttatgattaggttttcttgattagggatgtgtttagtacagctgaatgaacaagttcacccagctgctggtgacagaaacccaactcaaactagctgatgaaaaacagaactatacagatcaatgaatctctccccctttttcagcctcactgcacctctcccacccctacttccggtaccctcttcttgtcggactctctatgctttgccccctctctccctcgcttgcgccttcc

SEQ ID NO: 17200 - DNA, 666 bp, Homo sapiens
tagcacaaagttattaacaggccaggaagaccttgtttctttcaggcttccataatgggtttgaaagaaaacacggattcttctacagcaacagagttaaagaaatagtcatagtcattcttccacgatctttgtagtctagcttgaatttcaaactgtgtccttccttactccagagagggagcaagaaaaaaaacctggatgctttgaagggatctgccactatttaaaaggggattaggattctgtttcagctgcatgtggaactaggtaagcttcagtggcctcagaactccaggcccctcacggagatcaccctgaacaatgcccagtttttcatgcaggttttgtcctatgaccagttaactacatgttcaataaataaatgtcaaagaaataaatgcgtgaaaaggcaaccagttcatcatcttatgattaggttttcttgattagggatgtgtttagtacagctgaatgaacaagttcacccagctgctggtgacagaaacccaactcaaactagctgatgaaaaacagaactatacagatcaatgaatctctccccctttttcagcctcactgcacctctcccacccctacttccggtaccctcttcttgtcggactctctatgctttgccccctctctccctcgcttgcgccttcc

SEQ ID NO: 17201 - DNA, 1464 bp, Homo sapiens
acattaatttgcatttataccattttctttacaaagtgctttaatgtaaactcatctaccaatttagactaactcttagtactaagtttaatgttaatttaatgactaactcatctaccaattaaccctatagataacttttctgggtattttccccattttacattagagagtattgaaacttaaaaaggactcgtgatttatccagtgatccaaagtgtgtatttcataaacacatacacacagtgcgtgcattgtttaggcatacgttactttccacagtatctcaaatgccttttacatgaatcccatactatcaaaaattggtgataacctaaaatgtagtgcaataatacaataaggcatttattttcttagagttgagttgatggatttttagatttttattcaagatcttttgtttgtttggctttgcttggaagatactgatttattctttcatattaaagcaaatcctgccaaagcactaaatagaccgttttgggttggttttttagtgtaatattaatacgggtccacaggtgaattgagtctgttcagatgtaaggattgaaccttatgttatcaatccttgacaccatccttgataacttacggatatcaaggatcaaaccatatggtatcaatattgttagttattcagcataaacagaattatttcccaatacttgatctgaaatatttttaatggtcttacttgaaacttatattctttctgggagtgatgtttttatcatttttccatggagacaggttctaactctgttgcccaggctgcagtgcagtgatgtgatcatagctcactgcagcctgaaactcctgggttcaagtgatctctggcctcagcctcccaagtagttggaacttcagatacgtgccaccacaaccagctaatttattttttagagatgaggtctcgctatgttgcccagtctggtctcctagcctcaagtgatcttcccatctcagccttcagttggagatttctgatttatgttaatataagaaagctgttgatagtttatcataaaggcatttccttatattgctagtataattttctgaaaattagtggtaagatgtgacaatacatcagctgcatccacaggaaaggggaattaattagcagttctgattctgggtacacttgttatgatcataatttacataatattttcatgaaaatggtcagctcacagctatgaaatgtaaatgatagaaatctttaatcatgtatatggatagacttgttactatttccttatcaaagtgtcactttagggacagcagttgcccctttaaattaaggatcaccacaataatactctgccatgtcatggaatcagcatgaagccctggatgctatccaagattctgtttcagttctcattttgtatattcttgtttgtgctcttgattaaaatatctccttatatatagctg

SEQ ID NO: 17202 - DNA, 449 bp, Homo sapiens
tgtttatttccctccagccatactgagatttttctcttcagaaagcatccacacatcctcttgtgtcagcacttttagacatactgctccttttgctaggaaagctcccctcactatctttcactctgtgtaggaagaatgctttgcatgctttgttccctctctgcattcaagtctctgctctggtcacctcttcaaagaggccttcgctcacccaactgcacctaaaatatcaccatctgccctgttgttttcatcctccaaccttagtgtgtactccatttctcccttctagaatatgagctccatgaaggtagaagctcttgtaaccgcattgctgagagcaggatctagggtccagtgccaggaaggcattcactgcctccatatgccctctgagaagcagcattttctctgcagagcctgcagacaaggttatctccacttgg

SEQ ID NO: 17203 - DNA, 4324 bp, Homo sapiens
tgggcaggccccgggccgcatgcggaccctagaggcaaccagcgggctggatccgcacagcggccctggggaatggatcgtgtacaggggacaaagctacacatgtctttcattttggaggggggaaaaaagaaaaaacggaaatgaaagattgaaaatgtgtgggctctccgtcctttcctttgctcctgcgcgctctctggggtggggggctcagcgagcttcaagaggtggccgagattcccccaccccgcccccagatccccgggagaggtcagcacggcccctcccgtgggtgtcacagagaccgataccggtcccgctccccgggaaggagtgggtctgggtccagtccgcaggaccccctcgcggatgctgacgcagaatggagttgaggtgggggcagcgctggaccctagggcccctgcctgcctcctggggagcccggtgacccaggcagccctggtgaggccgcaggagtctgggccctagcgacgcccccgggctcccacaggacgaatgtagacggtgaggccaaggacgccctgctgccctcgggactgtccctccagcccccagctttccgtggttattgggccccctctgcagaggggcaggggagcccaccctggatcctgaggcgccgagcttgagggaccccagagctccagccaggccgctttctttgcggatggtgaagctgaggtcccgaggagggcaggggcaggtcccgggcgctcctcaggcaaagggagccgatttaggggctggggtcacaggaggcgcttctgcgacctctagggccctagagcccgggaggatgagagactgggggcctttcgtccacccctggggctgggcagacgctcagcctgtgcaacccgaagctgcttctgcccagtcccagccgcggcccctttaagagggggtggtgcttcagcctggcgccagggacgctgccagcatgcaggccccgacggaagccgagactgcgcttcgtgcgaggcccgggcagcatcggcggcgtggtcagagcgagtctcggagaagatgtggtggcttccgtttgttggtggaggaggtggcaggcctcggcgggtaacccagagaacacagccgaagtggaatgtggggacgtctgcgacaccggggacagagcaactgtggatgaagagggctacatctggttcctggggaggagtcatgacactatcaatgcctctgggtggtgaaggcattgattgtcctgaccccacagtttctgtcccatgacaaggaccagctgactaaggagctgcagcagcatgtaaagtcagtgacagccccatgaaacctcctcgacactccgaagtccagatcgcaggccccacctggaatgctctccttgcagcctgttcgaagactcatgagaccgtgctgcacactggacttcaaccatgagcttcaccgtctgtctcttccttcactaccttcgctctgcactaggccataagctctgtaggagaaggaactcatcacagtgcctgccccagacaggttgttcataagcacgtattgaaatatagaattcccaggcacctccaacagagagactggaccttgtgagacccaacaagaagccagtatttcagaactgatgaaaaatagcaaggatctagattagggggtatagtgggaatgaaatgggggactgggtgatgccccatatttgtcaacgactcatagtctttctccagagatgtcttcctcccctgtgttctttgtctcatcagctgccaccagcactcactccagccactaaagccagaaagttgaaagacctctgccctcatccggcccagcccccatccagccaaagacctgtcatttcaacctcacgcccaccccgctttccactcccactgctcctgccttagttcagaccaccaccgtcgctctcctacccagttcaagccaagctgacctggccagtggccttcaggccttcccttctccatcctgccatgtccatcctccacaggcagaacaggaagctgtcatgtaaaagtgcaggtctgctttggtccttctcctaaacccttcagtggcttcccggttccctttgggtcctggtacagattccttagcatggccagggaggacagccctccatgatcctcccctccctgagatgttcctcctgccccagcaccctgtgtttgagcccaagcccgccctgtggtgtcacgggaggcccagctcctctgcctggggtgccttgcctggcctaggaactgggaaaacttacctgcttccaagactcagctctagcacctcttcctgctgggtgttttccgatgccccccctctcgccacctcatggggaccccacagtcccctgaagagccttctgccccagtgcctcaccccactctttagacctgtttctgtttccatggctgccttgccttcttagaccacgggctcctgcagagcgggaccccatatctcagtcggctttgcattcccagtgcctggccgaaactgaggctggaatggtctcctattccataagctctcaataacccttgaaaaatgactggaatcctggacagcgccaaggcagcaactgggatgggagagtgatctgctgccctctcctggcaatgtgaggaattgtcctaagcacagacaactccctccctgccttgcacaagtgcaggatgggggaaactggaaaaggagctgatggaggattggggaggtggatgctgtctaaggagacaaactgaattgaggggttgctgggactctgccggctcacacgctattcccatgtcatgggcccaggggccaagtcagtgcttccaaaggagggtgcatcctgagagaggctctggctcccccaacaaaaccctaaactcttgaaggacatcttccttctcagtataccctattgctgtgttgttgtaactatcactgtaacttttattcacttcagtgggcgatcactgagtttttcctccattgttgtaaaacatgtgttttgctcttgtgtgtaaaatgactgtgaatttagccactgccttctcctgattttaactcagctttctactgctaggaggttatctctgttctgggtttctcagctttctatcaaaacccaaatactgtcattcctcggtatccgtaggggattggttccaggaacctcccttgaagataccaacattgcaggtgcccaagcccctgatagagaacagcgcagcatttgcagacaacctatgtacacactgcatgcactttcaatcagctctagattacttctgatacctaattcaatgtaaatgctgtgtcagtagttgtctagggaataatgacaagaagaaaattttgtacatgttcagtacgtaggaaaaagaaagagagatcagactgtcactgtgtctatgtagaaagggaagacataagagattccattttgaaaaagacctgtactttaaacagttgctttgctgagatgttgttaatttgtagctttgccccagccactttgccttagccactttgacccaacctggagctcacaaaaatatgtgttgtataaaatcaaggtttaagggatctagggctgtgcaggatatgccttgttaacaaaatgtttacaagcagtatacttggtaaaggtcatcgccattctctagtctcaataaaacaggagcacagtgcactgcggaaagccgcagggacctctgcccttgaaagtggggtattgtccaaggtttctccccatgtgatagtctgaaatatggctcgtgggatgagaaagacctgactgtgccccagcccgacacccataaagggtctgtgctgaggtggattagtaaaagaggaaagcctcttgcagttgagatagaggaaggccactgtctcctgcctgcccctgggaactgaatgtctcggtataaaacccgattgtacatttgttcaattctgagataggagaaaaaccgccctatggtgggaggcgagacatgtttgcagcaatgctgccttgttattctttactccgctgagatgtttgggtggagagaaacataaatctggcctacatgcacatccgggcatagtaccttcccttgaacttaatcatgacacagattcttttgctcacatgttttttgctgaccttctccttattatcaccctgctgtcctactacattcctttttgctgaaataatgaaaataatagtcaataaaaactgagggaactcaaaggccggtgccagtgcaggtccttggtgtgccgaatactggtcccctggacccactgttgtttctct

SEQ ID NO: 17204 - DNA, 1373 bp, Homo sapiens
attgacaatcctgcccatgttctcactcttgagagtgtggcactggggcagaagcagcaaagacgaccactgcatactttgcagctcccagacagaggcgcacttggcttccaatgcacaaggcccccttcgataacaccttttcagggtgcaggataatagagtaaagtgtgggtggactggagtgaagtgcagcccaggatgatagcaccagctcagaacgtcctcagcgaggccagcaacaatttggagaatattgagatggagctgtccaatgagccagagggtccctgagagatgagatggccttggcctggattccccacccctcactcacaaaagcagcttggtccatggagctggggagcactgttcaataataatgaacagcccaccaggcatgcctcccatcagagcccagtgagggggcaggtgagcgctgtctccccagcacctgctcctgcctgggccagtggccctgacccttctgacaaatccctaagtgcgccaactgctacgtggtttctcaccatctgcagcccaaactctgcctccaaagcctagtggatccacccaatgggccttacctcccactctccccacacattctgctgtaactgagactcgcctgctccctgggctgcaacgctcatgtttacctggacttcctcacaccgtccccaccacctgaattatcctgctcctttccaccccgaacaatggtaggaacagaagcagcacagaagagatagcttcaagtcctccactaaacagagagtgcctgcataatcccacaaacgaacataaagttaaccatcttacagttacagaggcccgacgtccacagttagcctcagccaggctgaagtcacagtgtcagcacggctggctcgttctggagctcctgggagacgtggctcccttgcctttcccagctcctagaggcatcatgagttccttggcttatggtcccatagcacatggacttctgcttctgtggccacatctccatctttgactctggccctccagagtccctcttttgaggactcctgtgattacattaccagacgttgtaagggaagcatggcaccagcatctgcttctgatgagggcctcaggaagcttcccatcatggcatatggcaaagagggagcaagcaaatcatggtgagaaaggaagcaagagtgagcgggaggaaatgccaggctcttttgaacaaccggatctcgcatgaagtcatagagtgagaactcattcattactgcaggacaacaccaagtcatttgtgaagattccatccccgtgacccaaacacctccagtgttggaggtgtggcctaccccggagttcgacgcggccgcaaatttagg

SEQ ID NO: 17205 - DNA, 426 bp, Homo sapiens
cttttgttttttgttttaccactcttgtttacaccccatgtaccccaaaaggtgggagggaagggaggctggcagaccgatggattttaatgcctataaatggggagactgcgcttcgtgcgaggcccgggcagcatcggcggcgtggtcagagcgagtctcggagaagatgtggtggcttccgtttgttggtggaggaggtggcaggcctcggcgctatgtttcccagtgtcctctgggtgtttcccagagccaccagaaacggataaatctctgccataggagttttagcccattcagaggccttgctcccccccatttgggacattcccttggatttgacccagtcaggaagagatgggagaaaagtgaaaccaccaccattaacccccagcattaaccaaccaaaagagtttagccaaacca

SEQ ID NO: 17206 - DNA, 3400 bp, Homo sapiens
tgggcaggccccgggccgcatgcggaccctagaggcaaccagcgggctggatccgcacagcggccctggggaatggatcgtgtacaggggacaaagctacacatgtctttcattttggaggggggaaaaaagaaaaaacggaaatgaaagattgaaaatgtgtgggctctccgtcctttcctttgctcctgcgcgctctctggggtggggggctcagcgagcttcaagaggtggccgagattcccccaccccgcccccagatccccgggagaggtcagcacggcccctcccgtgggtgtcacagagaccgataccggtcccgctccccgggaaggagtgggtctgggtccagtccgcaggaccccctcgcggatgctgacgcagaatggagttgaggtgggggcagcgctggaccctagggcccctgcctgcctcctggggagcccggtgacccaggcagccctggtgaggccgcaggagtctgggccctagcgacgcccccgggctcccacaggacgaatgtagacggtgaggccaaggacgccctgctgccctcgggactgtccctccagcccccagctttccgtggttattgggccccctctgcagaggggcaggggagcccaccctggatcctgaggcgccgagcttgagggaccccagagctccagccaggccgctttctttgcggatggtgaagctgaggtcccgaggagggcaggggcaggtcccgggcgctcctcaggcaaagggagccgatttaggggctggggtcacaggaggcgcttctgcgacctctagggccctagagcccgggaggatgagagactgggggcctttcgtccacccctggggctgggcagacgctcagcctgtgcaacccgaagctgcttctgcccagtcccagccgcggcccctttaagagggggtggtgcttcagcctggcgccagggacgctgccagcatgcaggccccgacggaagccgagactgcgcttcgtgcgaggcccgggcagcatcggcggcgtggtcagagcgagtctcggagaagatgtggtggcttccgtttgttggtggaggaggtggcaggcctcggcgggtaacccagagaacacagccgaagtggaatgtggggacgtctgcgacaccggggacagagcaactgtggatgaagagggctacatctggttcctggggaggagtcatgacactatcaatgcctctgggtggtgaaggcattgattgtcctgaccccacagtttctgtcccatgacaaggaccagctgactaaggagctgcagcagcatgtaaagtcagtgacagccccatgtgccttgcctggcctaggaactgggaaaacttacctgcttccaagactcagctctagcacctcttcctgctgggtgttttccgatgccccccctctcgccacctcatggggaccccacagtcccctgaagagccttctgccccagtgcctcaccccactctttagacctgtttctgtttccatggctgccttgccttcttagaccacgggctcctgcagagcgggaccccatatctcagtcggctttgcattcccagtgcctggccgaaactgaggctggaatggtctcctattccataagctctcaataacccttgaaaaatgactggaatcctggacagcgccaaggcagcaactgggatgggagagtgatctgctgccctctcctggcaatgtgaggaattgtcctaagcacagacaactccctccctgccttgcacaagtgcaggatgggggaaactggaaaaggagctgatggaggattggggaggtggatgctgtctaaggagacaaactgaattgaggggttgctgggactctgccggctcacacgctattcccatgtcatgggcccaggggccaagtcagtgcttccaaaggagggtgcatcctgagagaggctctggctcccccaacaaaaccctaaactcttgaaggacatcttccttctcagtataccctattgctgtgttgttgtaactatcactgtaacttttattcacttcagtgggcgatcactgagtttttcctccattgttgtaaaacatgtgttttgctcttgtgtgtaaaatgactgtgaatttagccactgccttctcctgattttaactcagctttctactgctaggaggttatctctgttctgggtttctcagctttctatcaaaacccaaatactgtcattcctcggtatccgtaggggattggttccaggaacctcccttgaagataccaacattgcaggtgcccaagcccctgatagagaacagcgcagcatttgcagacaacctatgtacacactgcatgcactttcaatcagctctagattacttctgatacctaattcaatgtaaatgctgtgtcagtagttgtctagggaataatgacaagaagaaaattttgtacatgttcagtacgtaggaaaaagaaagagagatcagactgtcactgtgtctatgtagaaagggaagacataagagattccattttgaaaaagacctgtactttaaacagttgctttgctgagatgttgttaatttgtagctttgccccagccactttgccttagccactttgacccaacctggagctcacaaaaatatgtgttgtataaaatcaaggtttaagggatctagggctgtgcaggatatgccttgttaacaaaatgtttacaagcagtatacttggtaaaggtcatcgccattctctagtctcaataaaacaggagcacagtgcactgcggaaagccgcagggacctctgcccttgaaagtggggtattgtccaaggtttctccccatgtgatagtctgaaatatggctcgtgggatgagaaagacctgactgtgccccagcccgacacccataaagggtctgtgctgaggtggattagtaaaagaggaaagcctcttgcagttgagatagaggaaggccactgtctcctgcctgcccctgggaactgaatgtctcggtataaaacccgattgtacatttgttcaattctgagataggagaaaaaccgccctatggtgggaggcgagacatgtttgcagcaatgctgccttgttattctttactccgctgagatgtttgggtggagagaaacataaatctggcctacatgcacatccgggcatagtaccttcccttgaacttaatcatgacacagattcttttgctcacatgttttttgctgaccttctccttattatcaccctgctgtcctactacattcctttttgctgaaataatgaaaataatagtcaataaaaactgagggaactcaaaggccggtgccagtgcaggtccttggtgtgccgaatactggtcccctggacccactgttgtttctct

SEQ ID NO: 17207 - DNA, 1671 bp, Homo sapiens
tgggcaggccccgggccgcatgcggaccctagaggcaaccagcgggctggatccgcacagcggccctggggaatggatcgtgtacaggggacaaagctacacatgtctttcattttggaggggggaaaaaagaaaaaacggaaatgaaagattgaaaatgtgtgggctctccgtcctttcctttgctcctgcgcgctctctggggtggggggctcagcgagcttcaagaggtggccgagattcccccaccccgcccccagatccccgggagaggtcagcacggcccctcccgtgggtgtcacagagaccgataccggtcccgctccccgggaaggagtgggtctgggtccagtccgcaggaccccctcgcggatgctgacgcagaatggagttgaggtgggggcagcgctggaccctagggcccctgcctgcctcctggggagcccggtgacccaggcagccctggtgaggccgcaggagtctgggccctagcgacgcccccgggctcccacaggacgaatgtagacggtgaggccaaggacgccctgctgccctcgggactgtccctccagcccccagctttccgtggttattgggccccctctgcagaggggcaggggagcccaccctggatcctgaggcgccgagcttgagggaccccagagctccagccaggccgctttctttgcggatggtgaagctgaggtcccgaggagggcaggggcaggtcccgggcgctcctcaggcaaagggagccgatttaggggctggggtcacaggaggcgcttctgcgacctctagggccctagagcccgggaggatgagagactgggggcctttcgtccacccctggggctgggcagacgctcagcctgtgcaacccgaagctgcttctgcccagtcccagccgcggcccctttaagagggggtggtgcttcagcctggcgccagggacgctgccagcatgcaggccccgacggaagccgagactgcgcttcgtgcgaggcccgggcagcatcggcggcgtggtcagagcgagtctcggagaagatgtggtggcttccgtttgttggtggaggaggtggcaggcctcggcgggtaacccagagaacacagccgaagtggaatgtggggacgtctgcgacaccggggacagagcaactgtggatgaagagggctacatctggttcctggggaggagtcatgacactatcaatgcctctgggtggtgaaggcattgattgtcctgaccccacagtttctgtcccatgacaaggaccagctgactaaggagctgcagcagcatgtaaagtcagtgacagccccatcatgtaagtacccgaggaagctaagtgagggcagatggaaggggtcagttcccagtactcctgccccatgtctcctagggtggctgtgcagggggaagcttggagactcacagtagtggcttttttttctgcataagaagcaatttggcttagggatggggtgttctcttaaaaatgtatttaaactgacaaattagaacaatgatctattaaaagccaggagacatagattacaatcctaattcaggtgattacacacaacatatgttcttaagcactttctatactgctggccactttataagagtgtctaagataaatctagtcatacaatgctgaactc

SEQ ID NO: 17208 - DNA, 2006 bp, Homo sapiens
tgggcaggccccgggccgcatgcggaccctagaggcaaccagcgggctggatccgcacagcggccctggggaatggatcgtgtacaggggacaaagctacacatgtctttcattttggaggggggaaaaaagaaaaaacggaaatgaaagattgaaaatgtgtgggctctccgtcctttcctttgctcctgcgcgctctctggggtggggggctcagcgagcttcaagaggtggccgagattcccccaccccgcccccagatccccgggagaggtcagcacggcccctcccgtgggtgtcacagagaccgataccggtcccgctccccgggaaggagtgggtctgggtccagtccgcaggaccccctcgcggatgctgacgcagaatggagttgaggtgggggcagcgctggaccctagggcccctgcctgcctcctggggagcccggtgacccaggcagccctggtgaggccgcaggagtctgggccctagcgacgcccccgggctcccacaggacgaatgtagacggtgaggccaaggacgccctgctgccctcgggactgtccctccagcccccagctttccgtggttattgggccccctctgcagaggggcaggggagcccaccctggatcctgaggcgccgagcttgagggaccccagagctccagccaggccgctttctttgcggatggtgaagctgaggtcccgaggagggcaggggcaggtcccgggcgctcctcaggcaaagggagccgatttaggggctggggtcacaggaggcgcttctgcgacctctagggccctagagcccgggaggatgagagactgggggcctttcgtccacccctggggctgggcagacgctcagcctgtgcaacccgaagctgcttctgcccagtcccagccgcggcccctttaagagggggtggtgcttcagcctggcgccagggacgctgccagcatgcaggccccgacggaagccgagactgcgcttcgtgcgaggcccgggcagcatcggcggcgtggtcagagcgagtctcggagaagatgtggtggcttccgtttgttggtggaggaggtggcaggcctcggcgggtaacccagagaacacagccgaagtggaatgtggggacgtctgcgacaccggggacagagcaactgtggatgaagagggctacatctggttcctggggaggagtcatgacactatcaatgcctctgggtggtgaaggcattgattgtcctgaccccacagtttctgtcccatgacaaggaccagctgactaaggagctgcagcagcatgtaaagtcagtgacagccccatgttgtaagggaagcatggcaccagcatctgcttctgatgagggcctcaggaagcttcccatcatggcatatggcaaagagggagcaagcaaatcatggtgagaaaggaagcaagagtgagcgggaggaaatgccaggctcttttgaacaaccggatctcgcatgaagtcatagagtgagaactcattcattactgcaggacaacaccaagtcatttgtgaagattccatccccgtgacccaaacacctccgggtaggcccacctccaacactggaggtcacatttcaacatgagatttggaggggacaaacatctaaaccatatcaagatttttcatttatttgtctaaattgattcctatgtatttcatatttttgtagctattgtaaatgagattgctttcttgatttcttttttcagattattcaccattgacatatataaatgctactaatttctgtatgttgagtttgtatccagcaacttactgaattagtttaccagttctagcagttttttggtggagtctttaggtttttctaagtgtaagttcatgtcatctgtgaacaaggctatgatttctttctttccaattttagtactctttatttttttcccttgcctaattgctcttccaggacttccaatattatgttaaataaaagtggtgaaaagtga

SEQ ID NO: 17209 - DNA, 1750 bp, Homo sapiens
attgacaatcctgcccatgttctcactcttgagagtgtggcactggggcagaagcagcaaagacgaccactgcatactttgcagctcccagacagaggcgcacttggcttccaatgcacaaggcccccttcgataacaccttttcagggtgcaggataatagagtaaagtgtgggtggactggagtgaagtgcagcccaggatgatagcaccagctcagaacgtcctcagcgaggccagcaacaatttggagaatattgagatggagctgtccaatgagccagagggtccctgagagatgagatggccttggcctggattccccacccctcactcacaaaagcagcttggtccatggagctggggagcactgttcaataataatgaacagcccaccaggcatgcctcccatcagagcccagtgagggggcaggtgagcgctgtctccccagcacctgctcctgcctgggccagtggccctgacccttctgacaaatccctaagtgcgccaactgctacgtggtttctcaccatctgcagcccaaactctgcctccaaagcctagtggatccacccaatgggccttacctcccactctccccacacattctgctgtaactgagactcgcctgctccctgggctgcaacgctcatgtttacctggacttcctcacaccgtccccaccacctgaattatcctgctcctttccaccccgaacaatggtaggaacagaagcagcacagaagagatagcttcaagtcctccactaaacagagagtgcctgcataatcccacaaacgaacataaagttaaccatcttacagttacagaggcccgacgtccacagttagcctcagccaggctgaagtcacagtgtcagcacggctggctcgttctggagctcctgggagacgtggctcccttgcctttcccagctcctagaggcatcatgagttccttggcttatggtcccatagcacatggacttctgcttctgtggccacatctccatctttgactctggccctccagagtccctcttttgaggactcctgtgattacattaccagacgttgtaagggaagcatggcaccagcatctgcttctgatgagggcctcaggaagcttcccatcatggcatatggcaaagagggagcaagcaaatcatggtgagaaaggaagcaagagtgagcgggaggaaatgccaggctcttttgaacaaccggatctcgcatgaagtcatagagtgagaactcattcattactgcaggacaacaccaagtcatttgtgaagattccatccccgtgacccaaacacctccgggtaggcccacctccaacactggaggtcacatttcaacatgagatttggaggggacaaacatctaaaccatatcaagatttttcatttatttgtctaaattgattcctatgtatttcatatttttgtagctattgtaaatgagattgctttcttgatttcttttttcagattattcaccattgacatatataaatgctactaatttctgtatgttgagtttgtatccagcaacttactgaattagtttaccagttctagcagttttttggtggagtctttaggtttttctaagtgtaagttcatgtcatctgtgaacaaggctatgatttctttctttccaattttagtactctttatttttttcccttgcctaattgctcttccaggacttccaatattatgttaaataaaagtggtgaaaagtga

SEQ ID NO: 17210 - DNA, 1879 bp, Homo sapiens
tgggcaggccccgggccgcatgcggaccctagaggcaaccagcgggctggatccgcacagcggccctggggaatggatcgtgtacaggggacaaagctacacatgtctttcattttggaggggggaaaaaagaaaaaacggaaatgaaagattgaaaatgtgtgggctctccgtcctttcctttgctcctgcgcgctctctggggtggggggctcagcgagcttcaagaggtggccgagattcccccaccccgcccccagatccccgggagaggtcagcacggcccctcccgtgggtgtcacagagaccgataccggtcccgctccccgggaaggagtgggtctgggtccagtccgcaggaccccctcgcggatgctgacgcagaatggagttgaggtgggggcagcgctggaccctagggcccctgcctgcctcctggggagcccggtgacccaggcagccctggtgaggccgcaggagtctgggccctagcgacgcccccgggctcccacaggacgaatgtagacggtgaggccaaggacgccctgctgccctcgggactgtccctccagcccccagctttccgtggttattgggccccctctgcagaggggcaggggagcccaccctggatcctgaggcgccgagcttgagggaccccagagctccagccaggccgctttctttgcggatggtgaagctgaggtcccgaggagggcaggggcaggtcccgggcgctcctcaggcaaagggagccgatttaggggctggggtcacaggaggcgcttctgcgacctctagggccctagagcccgggaggatgagagactgggggcctttcgtccacccctggggctgggcagacgctcagcctgtgcaacccgaagctgcttctgcccagtcccagccgcggcccctttaagagggggtggtgcttcagcctggcgccagggacgctgccagcatgcaggccccgacggaagccgagactgcgcttcgtgcgaggcccgggcagcatcggcggcgtggtcagagcgagtctcggagaagatgtggtggcttccgtttgttggtggaggaggtggcaggcctcggcgggtaacccagagaacacagccgaagtggaatgtggggacgtctgcgacaccggggacagagcaactgtggatgaagagggctacatctggttcctggggaggagtcatgacactatcaatgcctctgggtggtgaaggcattgattgtcctgaccccacagtttctgtcccatgacaaggaccagctgactaaggagctgcagcagcatgtaaagtcagtgacagccccatggcattgtataaacatcaggtgtctatggaacaaatgcaaagagagtacacaaaagaagcaaaagggactgtctttgcacgatgcagaaaattagacctgcatggcacgtttagccctaaatttaggaatctaccccactagacaggaaatatcttttcaattaacaaatggcctctccactccttctttccttggaaagtttactgaacaatgattgggcaccgtaaactttgttttcatgtcaaacagtacctgccctccagtggtttatcatctattttgtgggacatggcacaaaggaagaaaaactgtttggtcctcaggaagtctgtaacctcaccagacgaggcatccatctcacacttgcttctccgggaccactagagagccacatgagaccatgtgcaatgaaatgctgaattcacaaccacttaccactgaaaatgagcagcacagaaaatcagtgtttttagttaggtggcgctatcagggcaggcttcctgaaagaagctggctttgaactgccctaggctgggaagaagtagaaaac

SEQ ID NO: 17211 - DNA, 1747 bp, Homo sapiens
tgggcaggccccgggccgcatgcggaccctagaggcaaccagcgggctggatccgcacagcggccctggggaatggatcgtgtacaggggacaaagctacacatgtctttcattttggaggggggaaaaaagaaaaaacggaaatgaaagattgaaaatgtgtgggctctccgtcctttcctttgctcctgcgcgctctctggggtggggggctcagcgagcttcaagaggtggccgagattcccccaccccgcccccagatccccgggagaggtcagcacggcccctcccgtgggtgtcacagagaccgataccggtcccgctccccgggaaggagtgggtctgggtccagtccgcaggaccccctcgcggatgctgacgcagaatggagttgaggtgggggcagcgctggaccctagggcccctgcctgcctcctggggagcccggtgacccaggcagccctggtgaggccgcaggagtctgggccctagcgacgcccccgggctcccacaggacgaatgtagacggtgaggccaaggacgccctgctgccctcgggactgtccctccagcccccagctttccgtggttattgggccccctctgcagaggggcaggggagcccaccctggatcctgaggcgccgagcttgagggaccccagagctccagccaggccgctttctttgcggatggtgaagctgaggtcccgaggagggcaggggcaggtcccgggcgctcctcaggcaaagggagccgatttaggggctggggtcacaggaggcgcttctgcgacctctagggccctagagcccgggaggatgagagactgggggcctttcgtccacccctggggctgggcagacgctcagcctgtgcaacccgaagctgcttctgcccagtcccagccgcggcccctttaagagggggtggtgcttcagcctggcgccagggacgctgccagcatgcaggccccgacggaagccgagactgcgcttcgtgcgaggcccgggcagcatcggcggcgtggtcagagcgagtctcggagaagatgtggtggcttccgtttgttggtggaggaggtggcaggcctcggcgggtaacccagagaacacagccgaagtggaatgtggggacgtctgcgacaccggggacagagcaactgtggatgaagagggctacatctggttcctggggaggagtcatgacactatcaatgcctctgggtaggtgtgactgatgccaggctggctgttgtcatcctcatatgcctcctgggatcttgcttgcccagacagtctttcatgcattggtgacaggaccctcagcccaatttgaatagagccatgtctacaatgccctgatcccaggttttggtgcacctccctaacccctgcatacagaagaatcaatcaaaatgaaattcaagagtgtcttgaagacataataagacactgtgcaatttagagaagggccttggaatgagactgagaaggaagactctgttttggtccccataggttcagggagcttatttcatgtgtgtgctcctctaatgcagcacaggatgtcacagaacaaacatagtaataataacaactaacctttagctattgtttattttttatttattattattattaatctattataaatctatgaatacaacaaatctattaagatagattattataaatctattatttgttataattatttagctaacctggagtacttactatgtgaaa

SEQ ID NO: 17212 - DNA, 1493 bp, Homo sapiens
tgggcaggccccgggccgcatgcggaccctagaggcaaccagcgggctggatccgcacagcggccctggggaatggatcgtgtacaggggacaaagctacacatgtctttcattttggaggggggaaaaaagaaaaaacggaaatgaaagattgaaaatgtgtgggctctccgtcctttcctttgctcctgcgcgctctctggggtggggggctcagcgagcttcaagaggtggccgagattcccccaccccgcccccagatccccgggagaggtcagcacggcccctcccgtgggtgtcacagagaccgataccggtcccgctccccgggaaggagtgggtctgggtccagtccgcaggaccccctcgcggatgctgacgcagaatggagttgaggtgggggcagcgctggaccctagggcccctgcctgcctcctggggagcccggtgacccaggcagccctggtgaggccgcaggagtctgggccctagcgacgcccccgggctcccacaggacgaatgtagacggtgaggccaaggacgccctgctgccctcgggactgtccctccagcccccagctttccgtggttattgggccccctctgcagaggggcaggggagcccaccctggatcctgaggcgccgagcttgagggaccccagagctccagccaggccgctttctttgcggatggtgaagctgaggtcccgaggagggcaggggcaggtcccgggcgctcctcaggcaaagggagccgatttaggggctggggtcacaggaggcgcttctgcgacctctagggccctagagcccgggaggatgagagactgggggcctttcgtccacccctggggctgggcagacgctcagcctgtgcaacccgaagctgcttctgcccagtcccagccgcggcccctttaagagggggtggtgcttcagcctggcgccagggacgctgccagcatgcaggccccgacggaagccgagactgcgcttcgtgcgaggcccgggcagcatcggcggcgtggtcagagcgagtctcggagaagatgtggtggcttccgtttgttggtggaggaggtggcaggcctcggcgggtaacccagagaacacagccgaagtggaatgtggggacgtctgcgacaccggggacagagcaactgtggatgaagagggctacatctggttcctggggaggagtcatgacactatcaatgcctctgggtggtgaaggcattgattgtcctgaccccacagtttctgtcccatgacaaggaccagctgactaaggagctgcagcagcatgtaaagtcagtgacagccccataatgaatacaaccaatcaagacagataacgccaagtgctggagaggaggtggagaaatcgaaaccctcatacactgccagtgggaatataaaatggtgcagccacttttttggaagatagtatgtcagtttcttaaaatgttaaaaataaaactgctttaaaccc

SEQ ID NO: 17213 - DNA, 261 bp, Homo sapiens
gaagccctggaggctgcctgaatttgtgccaataagtacatgatgaaaagttgcggcgaggatggctttcatatccaagtgcggctccaccccttccacgttatgcacatcaacaagacgtcctgtgctgggctgacaggctccaaacaggtatatgaggtgcctttgaaaagccccagggcactttggccagggttcacattggtacacgacatcgtgtccatcgacaccaagtctgcagcacagggcgcatgttattga

SEQ ID NO: 17214 - DNA, 345 bp, Homo sapiens
gtgtgtcaagattgcgccattgcactccagcctgggcaacgagcgaaactccatttcaaaaaagaaagtagagtggtagagaaagttggaagaatgaattttttaaatgagggtaataataaatgtatgagtctgcggggaggcagtagagattgaaaactgaaatagaatttggtcgttattaacattttgaggctgggtatggtggcccatgcttgtaatgccagcactttgggaggctgaggcaagtggattgctcgagtccaggagttcaagaccagcctgggcaacatggtgaaaccctgtctctaccaaaaatacacaaattagctgggagtggtggca

SEQ ID NO: 17215 - DNA, 2441 bp, Homo sapiens
accgggaggcggggccaggggtcgcaaggcggaagagcccctctcgcctccgacccggcgcctcgcactccgttcactctcggttcctcttcgcattcttgccagtcccgtagcgctgggctggtttcctccgaggtctctaagagcctcctactgcgccccgctcgccgcccggaagcccccagcccctcaaggacgcatcacctaatgccgcggtcacggccaccgtcacaagcgcccccagccccaccccaccccggcctgcccgccgtccttctcccgcccccgcccctgcctgccagctccaccgggccgtaggtgcggacgacctcaaaattcctcggcccgcgaaggccgccagctgcggggaggggaggggaggcgcggtcccgcagcgcccccaggctcatgtcccaggttgtgcctttttagccaagaagcatggaagtcattcacggcaggccctactgttgcagggagcttgaaggagctgacatactgtccaacaccttttactctaatgaattgcacaaccccctccagacggttactcgcccaactgcctcagaggacaggtatcaggaattaagggagtcacttcaacaatgtaggcttccttggggcgctgaaagagagtatggtgggataataccgatttcactccccgaggaccacaggccaaagtatgagcctcctcgtgtcatgggcaaaggacatcagcattatggatttggtggagaaacctggccaagaaagcttcctgttgaacaattttattatttgacccagaacaaaaaaagtgatgtctatggaaatgattctttgatacccaagccgcctaattcaacagtaggagagatctgcttgccatatccaattgaacacccctaccacacacacatctgtcgcggcaccatgttccccaccttcacgtcacctgaggacctctacacgggcattaaagcccgcacccagcagccctttcctcccacggtgccaagcaaggcttatgattcaacagttttgaagacaagaggtaatccttatagatatgaactgattgatattcccatggattcaaagaagaaagcactgacttggccaggtcaaggtgtatattatgattttcccagaggtgttgagaaaaataagccagtattctacccaaaacctcctaaaaccttcgctcctaacacttctttaaattcatgggaccctatttgctctgccaaagaagccaacatacaaagaaatcttgagaggtcccactggctcacttcgtacactcatgattttacaggtctggggcccatggacccccttgaactggatgattaccatgaaaagatggtagcagagttaacacgaaagataggatttgacccagagccgcaagaaaaattccaccctgtcttcaaacctcccagaccgttggaaggacgaattgcccgattaattcagaaccgacgttctctggaggctatagtccagcaaagaccacgttcctgtccagattgtactcctagagttttgtgtaattttcatacctttgtacccagttctaaagaaatggtggcacttagtgataacataccagccggtgtgacccataaaaaccaggatattgaagagaagatcatagaagaacagagcttgctgtctacctatgaactcccatcttgttacccaacaaaagacctaactagcatttatgacataaagccatttccaaaaatcacagatactaaaaagacagaagatttatactggagacagcagtcactaaaaacccaacccacaccttactgtaaaccagaccactggattcactatgaaaatcttaaatctcccctacgtgatcagtataatatgtgtccagaccctgttagccttagtaaacctagtgttttacaaaataaacaagacacggaagctttcactttagaacattttttaagtaagccagaagaagagttgttcttgaatatggaaaacaatgaagaaacaagacctgttcttggttggattcctagagctggagtgaccaaacctcagaccaacctgctggagcttaagaactctttttcaaaaactggtgcacaaaagcgtttccataaatcaattctagaagaccataaagacctcagggataatgagcattcggggatgaagcaccaattctatggccataattcctattatttctataattgagatactcattcttcccttcaaaacccagcctcttgcaagaagctaaaaaatataacagaatttccttcgtattgctggattctgttttctagattaaaccacaaggaccttgttagtgaggtttacattttcaggaatttaagttagtatctggttggaggaacccagaaaaggtgatgttatgacttcttgaaaagtttaacaatttggcaataaaatattagaac

SEQ ID NO: 17216 - DNA, 2654 bp, Homo sapiens
accgggaggcggggccaggggtcgcaaggcggaagagcccctctcgcctccgacccggcgcctcgcactccgttcactctcggttcctcttcgcattcttgccagtcccgtagcgctgggctggtttcctccgaggtctctaagagcctcctactgcgccccgctcgccgcccggaagcccccagcccctcaaggacgcatcacctaatgccgcggtcacggccaccgtcacaagcgcccccagccccaccccaccccggcctgcccgccgtccttctcccgcccccgcccctgcctgccagctccaccgggccgtaggtgcggacgacctcaaaattcctcggcccgcgaaggccgccagctgcggggaggggaggggaggcgcggtcccgcagcgcccccaggctcatgtcccaggttgtgcctttttagccaagaagcatggaagtcattcacggcaggccctactgttgcagggagcttgaaggagctgacatactgtccaacaccttttactctaatgaattgcacaaccccctccagacggttactcgcccaactgcctcagaggacaggtatcaggaattaagggagtcacttcaacaatgtaggcttccttggggcgctgaaagagagtatggtgggataataccgatttcactccccgaggaccacaggccaaagtatgagcctcctcgtgtcatgggcaaaggacatcagcattatggatttggtggagaaacctggccaagaaagcttcctgttgaacaattttattatttgacccagaacaaaaaaagtgatgtctatggaaatgattctttgatacccaagccgcctaattcaacagtaggagagatctgcttgccatatccaattgaacacccctaccacacacacatctgtcgcggcaccatgttccccaccttcacgtcacctgaggacctctacacgggcattaaagcccgcacccagcagccctttcctcccacggtgccaagcaaggcttatgattcaacagttttgaagacaagaggtaatccttatagatatgaactgattgatattcccatggattcaaagaagaaagcactgacttggccaggtcaaggtgtatattatgattttcccagaggtgttgagaaaaataagccagtattctacccaaaacctcctaaaaccttcgctcctaacacttctttaaattcatgggaccctatttgctctgccaaagaagccaacatacaaagaaatcttgagaggtcccactggctcacttcgtacactcatgattttacaggtctggggcccatggacccccttgaactggatgattaccatgaaaagatggtagcagagttaacacgaaagataggatttgacccagagccgcaagaaaaattccaccctgtcttcaaacctcccagaccgttggaaggacgaattgcccgattaattcagaaccgacgttctctggaggctatagtccagcaaagaccacgttcctgtccagattgtactcctagagttttgtgtaattttcatacctttgtacccagttctaaagaaatggtggcacttagtgataacataccagccggtgtgacccataaaaaccaggatattgaagagaagatcatagaagaacagagcttgctgtctacctatgaactcccatcttgttacccaacaaaagacctaactagcatttatgacataaagccatttccaaaaatcacagatactaaaaagacagaagatttatactggagacagcagtcactaaaaacccaacccacaccttactgtaaaccagaccactggattcactatgaaaatcttaaatctcccctacgtgatcagtataatatgtgtccagaccctgttagccttagtaaacctagtgttttacaaaataaacaagacacggaagctttcactttagaacattttttaagtaagccagaagaagagttgttcttgaatatggaaaacaatgaagaaacaagacctgttcttggttggattcctagagctggagtgaccaaacctcagaccaacctgctggagcttaagaactctttttcaaaaactggtgcacaaaagcgtttccataaatcaattctagaagaccataaagacctcagggataatgagcattcggggatgaagcaccaattctatggccataattcctattatttctataattgagatactcattcttcccttcaaaacccagcctcttgcaagaagctaaaaaatataacagaatttccttcgtattgctggattctgttttctagattaaaccacaaggaccttgttagtgaggtttacattttcaggaatttaagttagtatctggttggaggaacccagaaaaggtgatgttatgacttcttgaaaagtttaacaatttggcaataaaatattagaactagaaaaatttatagtctttaatctctcatcttcagattatacaaggaaattttccaaaatcacaaaaagcaatgtgtacaacaaagtttacatcattgtttcaccaaaaaaaattgaaaagctggaaagaactcaaatgatcaataattaatgaatgactatacaaattatagtatcttaataaaaatgagaacactgtccctttatgtaaa

SEQ ID NO: 17217 - DNA, 2750 bp, Homo sapiens
accgggaggcggggccaggggtcgcaaggcggaagagcccctctcgcctccgacccggcgcctcgcactccgttcactctcggttcctcttcgcattcttgccagtcccgtagcgctgggctggtttcctccgaggtctctaagagcctcctactgcgccccgctcgccgcccggaagcccccagcccctcaaggacgcatcacctaatgccgcggtcacggccaccgtcacaagcgcccccagccccaccccaccccggcctgcccgccgtccttctcccgcccccgcccctgcctgccagctccaccgggccgtaggtgcggacgacctcaaaattcctcggcccgcgaaggccgccagctgcggggaggggaggggaggcgcggtcccgcagcgcccccaggctcatgtcccaggtatgtccagacccccgaggcaccgcttgcagggcagtgacagcccgtgaggctcggcctcgacccctggcacccttggtcccagctacgccggctcctggccttcccccaagtccgagagagaggtgggattctccccgacgcagttggaaaccgggaatcccctttagggtcccgttcgtgctgcactactgactccaccatctgcaaagggattcttgtccagaatccccgaaggctttaggacagcgcttattttgttgaatgaagagtctctaattttcggaaagaccacaggctaaaagtcaagttgtgcctttttagccaagaagcatggaagtcattcacggcaggccctactgttgcagggagcttgaaggagctgacatactgtccaacaccttttactctaatgaattgcacaaccccctccagacggttactcgcccaactgcctcagaggacaggtatcaggaattaagggagtcacttcaacaatgtaggcttccttggggcgctgaaagagagtatggtgggataataccgatttcactccccgaggaccacaggccaaagtatgagcctcctcgtgtcatgggcaaaggacatcagcattatggatttggtggagaaacctggccaagaaagcttcctgttgaacaattttattatttgacccagaacaaaaaaagtgatgtctatggaaatgattctttgatacccaagccgcctaattcaacagtaggagagatctgcttgccatatccaattgaacacccctaccacacacacatctgtcgcggcaccatgttccccaccttcacgtcacctgaggacctctacacgggcattaaagcccgcacccagcagccctttcctcccacggtgccaagcaaggcttatgattcaacagttttgaagacaagaggtaatccttatagatatgaactgattgatattcccatggattcaaagaagaaagcactgacttggccaggtcaaggtgtatattatgattttcccagaggtgttgagaaaaataagccagtattctacccaaaacctcctaaaaccttcgctcctaacacttctttaaattcatgggaccctatttgctctgccaaagaagccaacatacaaagaaatcttgagaggtcccactggctcacttcgtacactcatgattttacaggtctggggcccatggacccccttgaactggatgattaccatgaaaagatggtagcagagttaacacgaaagataggatttgacccagagccgcaagaaaaattccaccctgtcttcaaacctcccagaccgttggaaggacgaattgcccgattaattcagaaccgacgttctctggaggctatagtccagcaaagaccacgttcctgtccagattgtactcctagagttttgtgtaattttcatacctttgtacccagttctaaagaaatggtggcacttagtgataacataccagccggtgtgacccataaaaaccaggatattgaagagaagatcatagaagaacagagcttgctgtctacctatgaactcccatcttgttacccaacaaaagacctaactagcatttatgacataaagccatttccaaaaatcacagatactaaaaagacagaagatttatactggagacagcagtcactaaaaacccaacccacaccttactgtaaaccagaccactggattcactatgaaaatcttaaatctcccctacgtgatcagtataatatgtgtccagaccctgttagccttagtaaacctagtgttttacaaaataaacaagacacggaagctttcactttagaacattttttaagtaagccagaagaagagttgttcttgaatatggaaaacaatgaagaaacaagacctgttcttggttggattcctagagctggagtgaccaaacctcagaccaacctgctggagcttaagaactctttttcaaaaactggtgcacaaaagcgtttccataaatcaattctagaagaccataaagacctcagggataatgagcattcggggatgaagcaccaattctatggccataattcctattatttctataattgagatactcattcttcccttcaaaacccagcctcttgcaagaagctaaaaaatataacagaatttccttcgtattgctggattctgttttctagattaaaccacaaggaccttgttagtgaggtttacattttcaggaatttaagttagtatctggttggaggaacccagaaaaggtgatgttatgacttcttgaaaagtttaacaatttggcaataaaatattagaac

SEQ ID NO: 17218 - DNA, 2720 bp, Homo sapiens
accgggaggcggggccaggggtcgcaaggcggaagagcccctctcgcctccgacccggcgcctcgcactccgttcactctcggttcctcttcgcattcttgccagtcccgtagcgctgggctggtttcctccgaggtctctaagagcctcctactgcgccccgctcgccgcccggaagcccccagcccctcaaggacgcatcacctaatgccgcggtcacggccaccgtcacaagcgcccccagccccaccccaccccggcctgcccgccgtccttctcccgcccccgcccctgcctgccagctccaccgggccgtaggtgcggacgacctcaaaattcctcggcccgcgaaggccgccagctgcggggaggggaggggaggcgcggtcccgcagcgcccccaggctcatgtcccaggtatgtccagacccccgaggcaccgcttgcagggcagtgacagcccgtgaggctcggcctcgacccctggcacccttggtcccagctacgccggctcctggccttcccccaagtccgagagagaggtgggattctccccgacgcagttggaaaccgggaatcccctttagggtcccgttcgtgctgcactactgactccaccatctgcaaagggattcttgtccagaatccccgaaggctttaggacagcgcttattttgttgaatgaagagtctctaattttcggaaagaccacaggctaaaagtcaagttgtgcctttttagccaagaagcatggaagtcattcacggcaggccctactgttgcagggagcttgaaggagctgacatactgtccaacaccttttactctaatgaattgcacaaccccctccagacggttactcgcccaactgcctcagaggacaggtatcaggaattaagggagtcacttcaacaatgtaggcttccttggggcgctgaaagagagtatggtgggataataccgatttcactccccgaggaccacaggccaaagtatgagcctcctcgtgtcatgggcaaaggacatcagcattatggatttggtggagaaacctggccaagaaagcttcctgttgaacaattttattatttgacccagaacaaaaaaagtgatgtctatggaaatgattctttagagatctgcttgccatatccaattgaacacccctaccacacacacatctgtcgcggcaccatgttccccaccttcacgtcacctgaggacctctacacgggcattaaagcccgcacccagcagccctttcctcccacggtgccaagcaaggcttatgattcaacagttttgaagacaagaggtaatccttatagatatgaactgattgatattcccatggattcaaagaagaaagcactgacttggccaggtcaaggtgtatattatgattttcccagaggtgttgagaaaaataagccagtattctacccaaaacctcctaaaaccttcgctcctaacacttctttaaattcatgggaccctatttgctctgccaaagaagccaacatacaaagaaatcttgagaggtcccactggctcacttcgtacactcatgattttacaggtctggggcccatggacccccttgaactggatgattaccatgaaaagatggtagcagagttaacacgaaagataggatttgacccagagccgcaagaaaaattccaccctgtcttcaaacctcccagaccgttggaaggacgaattgcccgattaattcagaaccgacgttctctggaggctatagtccagcaaagaccacgttcctgtccagattgtactcctagagttttgtgtaattttcatacctttgtacccagttctaaagaaatggtggcacttagtgataacataccagccggtgtgacccataaaaaccaggatattgaagagaagatcatagaagaacagagcttgctgtctacctatgaactcccatcttgttacccaacaaaagacctaactagcatttatgacataaagccatttccaaaaatcacagatactaaaaagacagaagatttatactggagacagcagtcactaaaaacccaacccacaccttactgtaaaccagaccactggattcactatgaaaatcttaaatctcccctacgtgatcagtataatatgtgtccagaccctgttagccttagtaaacctagtgttttacaaaataaacaagacacggaagctttcactttagaacattttttaagtaagccagaagaagagttgttcttgaatatggaaaacaatgaagaaacaagacctgttcttggttggattcctagagctggagtgaccaaacctcagaccaacctgctggagcttaagaactctttttcaaaaactggtgcacaaaagcgtttccataaatcaattctagaagaccataaagacctcagggataatgagcattcggggatgaagcaccaattctatggccataattcctattatttctataattgagatactcattcttcccttcaaaacccagcctcttgcaagaagctaaaaaatataacagaatttccttcgtattgctggattctgttttctagattaaaccacaaggaccttgttagtgaggtttacattttcaggaatttaagttagtatctggttggaggaacccagaaaaggtgatgttatgacttcttgaaaagtttaacaatttggcaataaaatattagaac

SEQ ID NO: 17219 - DNA, 918 bp, Homo sapiens
accgggaggcggggccaggggtcgcaaggcggaagagcccctctcgcctccgacccggcgcctcgcactccgttcactctcggttcctcttcgcattcttgccagtcccgtagcgctgggctggtttcctccgaggtctctaagagcctcctactgcgccccgctcgccgcccggaagcccccagcccctcaaggacgcatcacctaatgccgcggtcacggccaccgtcacaagcgcccccagccccaccccaccccggcctgcccgccgtccttctcccgcccccgcccctgcctgccagctccaccgggccgtaggtgcggacgacctcaaaattcctcggcccgcgaaggccgccagctgcggggaggggaggggaggcgcggtcccgcagcgcccccaggctcatgtcccaggttgtgcctttttagccaagaagcatggaagtcattcacggcaggccctactgttgcagggagcttgaaggagctgacatactgtccaacaccttttactctaatgaattgcacaaccccctccagacggttactcgcccaactgcctcagaggacaggtatcaggaattaagggagtcacttcaacaatgtaggcttccttggggcgctgaaagagagtatggtgggataataccgatttcactccccgaggaccacaggccaaagtatgagcctcctcgtgtcatgggcaaaggacatcagcattatggatttggtggagaaacctggccaagaaagcttcctgttgaacaattttattatttgacccagaacaaaaaaagtgatgtctatggaaatgattctttgatacccaagccgcctaattcaacagtaggtttgcagtgagccaagatcatgccactgcactccagcctgagcaacagagtgaactctgtttaa

SEQ ID NO: 17220 - DNA, 2085 bp, Homo sapiens
taccacttctgctgttcatggtagtagtggaaggtaaatttggaaatggcattgacataaaatgaaaatgtttacggacacttttcttttttgcttttttattgtatttggataaagatccacttaaaagttatctgttttttcctgtttttttttttttttccccaaagtgtagttatgttttcactattgctgcttctatagagggcattgtgatagagagttacagatgaaacattaaatgccacagtgagtagaaataattactacaaaaagtaataaatatgattacttggtaatatcattctccatctaaaatactagtttcacctgtgagcagatttcagctcagtttatagttaaaaacaatgagggtaaaatgggattcatgctcagggaatgaatcagccatagttagagtgggaaattattattttcttcatttaaaggtagattttatgtttatttccctaaattgcataagataaaattgtctgtttaataaaaagacatttattaccattattaacagtcattttagagccaaatttaagaaaaggatattgaaagggtctttattggccttgtttgggtaactctatgctgttagatagaagagacttaggtaaataactttttatgtctgaggtgagtacacaatattggttcttggaaaaatagctgtttcttcataagatacccaagtgataattttttttcccctagactgtcaggcctatgagtaaatactaaatctattagctgtccccactcataaaccaaaccaaaccaatacaaacagatgaggagaggaaatgtagtaaaaatactggctgggtcttatgattgggatgagtgattttataagataatatggtgataattttattctaggattttatttttggcctaatataggaatgtttaaaaaaggcttttctatgaaaattagaaatttatacttgaaattaaaagtctagaagggggaggaccttaaagctaagctaccagtaagacaatgaataattcagaagagaacactattcttttactgactgagtgcccaagatgccaatttccatgaagtcttgatttatatatatgtacacatgttatgcacatacatgtttgttttctaacagttattttttaagcttttgagataattttagacttacagaagagttgtaaaagtagtagagttcttgtatactctgcacccaccttgcccttatgttaacatcttacgtaacaatagaacatttgtcaaaattaagaaattaaccttgatataatactaactaaagtagaaagtttaaaaagtagagattttagtcttttcactaatgtccttttactgttccaagacccagccttgcatttagctatcatgcctacgtcctgtcttccagtctgtgacagtgtatcataacaggggatacctgatgttgtaatgtatttctggtgttgttaaccttgatcactatgctaaggtggtgtctgctaggattcgctactgtaaacttactgtgttttccttgtaattattgaatatttgctggagatacccggagactatgcaaatgtcccgtttctgcttaaacttttgctcattttactatccattggcagatcttgcttgtggcagttactactgtggtgttctaatggtgattttctatttctctcaatccttctacatttattattggaattcttctgtaaggaagagttgtcagttctggatttatatttttaactataataagatattcaggataagtatagatttagaacttaaagatgttaaatcatgttaaaattattccaaataccaatatcaaagaaaactaagttggtaatctatctcagaaaatatatgaacttaagaaggaaaatagtatttatgatttgtagaattggttcaacttttgacttaatactgactttggactgaattcaaagttttcttgaaatttcacatctggactttttaaagtgtctacatttatattactttggggatcattttgtcaaagtcttgaataaagttacccagtcctggcatgataaacacaaaaaaat

SEQ ID NO: 17221 - DNA, 190 bp, Homo sapiens
ctaaaaagagcagctattctaaccaaacttcagggtgcagaggaagaaattaatgacacaatggaaaatgatgagctatttcgtactcttgcatcttataaacttattgcaccaagatacagatggcaaagaagtaaatggggacgtacatgtcctgtgaatttaaaagatggtaacatttattcaggat

SEQ ID NO: 17222 - DNA, 410 bp, Homo sapiens
gagatcgcaccactgcactctagcctgggcgacagagcaaggctccatctcaaaaaaaaaaaaaagaattgaactttttcttgaggacaattggaagttattacagggtttttaaaagtcaacatggcagggcacagtggctcacacctctaacctcactgctttggaaggaagccaaggcaagaggatcacttgaggccgggagttcaagaccctcttgggaaaactagcaagaccctgtctatacaaaacaatttaaaaattagccaggtgtagaggcacttgcctatagtcctagctactggggaggctgaggcagaggatcatttgggctcaggagttccaggatgcagtgagctttgaaggcgccattttatgccaacctgcacagcagtgagaccctctcggtc

SEQ ID NO: 17223 - DNA, 426 bp, Homo sapiens
gacatggagaatagcttgaagaagagataaggttaaagggagcttttcttttagaagtactttttcaaagaagggtctagtgagctaagtttcatcttctggtactcattgatcaaactgacctttctattctcataagcgtttctacccaaagttgtgtgtggaaggagtgtatagcagagaggaaatccctttcaacagagtcagctgctaactgatttcctataagcacactggattaagggcagccacagtggtttctactgtatgtatgaaccgaatggaggaatgttttcaaagattgatttggtgtggattgcaattgtaatggaaggcataacttgggatcccgggctgtaacttgctcttttgtttcccacccccctgacatgtatgtgtgctttaataaagctttctcacttgtca

SEQ ID NO: 17224 - DNA, 843 bp, Homo sapiens
gtgaatcgcatcgtttatcggacaggtggtgacataatctggatgtccctgggcctaaatgctgcctagagtatcctagatgatggatgtgagatgagttgcgcatctcttcatcagaaacagatgggctgacgagtctggcgcagggatgatagagatacattcaggatggggtgataggagtccagatgtgctatttgaagtgccaaagctgaaaagtggaaagagtgcattggaagctgagagtgagagtctggatagcttcacagctgactcggatagcacctccaggagagactctctggataaatctggcctctttccagaatggaagaagatgtctgctcccaaatctcaagtagaaaaggaaactcagcctggaggtcaaaatgtggtatttgtggatgagggtgagatgatatttaagaagaacaccagaaaaatcctcaggccttcagagtacactaaatctgtgatagatcttcgcccagaagatgtggtacatgaaagtggctccttgggagacagaagcaaatccgtcccaggcctcaatgtggatatggaagaggaagaagaagaagaagacattgaccacctagtgaagttacatcgccagaagctagccagaagcagcatgcaaagtggctcctccatggtaagttctattagatctgtggttacaggcatgttggggtactaggaagaaaagaagcacctccctagagcagattcgggacctggggaaaccatcctagtcactcttttcaggtaagtaagatcatttgtttgttcctatcctcaatttagactataggtgcttagtgtacatctaggtgacttcct

SEQ ID NO: 17225 - DNA, 625 bp, Homo sapiens
gtacctctacctcatcttttccctgtgtgccagtacgtactacgaaagacagcctcatgcatgtctaagaaagggtgtgtgcaagaggcttaacatcttatagttcaataaagaccaggaaatatacaagttgaggaaatattgaggtttcaggaacctgtatagctttgccgtgttgtttatgttctccactgttttgtagggaactagtaaaaaaagaaaaagaaaaaataaagtgaaagaggcgtgttgtctagtttcaaaggagaggagagaaggtaagtgtgattctcatttcctttttcactctctgtctaccttgggctctttgactcccatgactaccaagtgtatattatcagatacattttttcttcctgaggtccagccctgtgtctccaactatttcctgggcccagttacctggatatcaagtatgcaacactaacttaatagggttaaaacaaaactttttgccttacttccaaacctgtttctttccttacatcttctattgctatgagggctgtcactagccagtcagttgtttaatcttgactgtgaactaggcatctttgacttcaccttcttcatcctctctgctcagtcagtctccctattctgt

SEQ ID NO: 17226 - DNA, 4030 bp, Homo sapiens
  misc_feature (1)..(2): n is a, c, g, or t
  misc_feature (2628)..(2628): n is a, c, g, or t
nncggccccgcgaacggcgagaagacgacagaaggggagggtgagaagggccggctgccggagctggggcgatcttcccggagccggagaccctcccttgaaaccggcactgggacttctcgatctctggaggcacctgttgcaagtgacagcgctcggccgtcgagcggggtcgctaacccgcactctcttcggacctacgacatcgcggcttctctggcgttggccagtcagccacagggaactagtaaaaaaagaaaaagaaaaaataaagtgaaagaggcgtgttgtctagtttcaaaggagaggagagaagagactgagtcgccctgtgttgcccaggctggtcttgaactcctaggctcaagagatcctcctgcctcagcctcccaaagtgctgggattacaggcaactctggtagctctccttgtctggttgttttgaagaaagaagagtagaagaaaaagttgagtaaatcatgtcggagttactggacctttcttttctgtctgaggaggaaaaggatttgattctcagtgttctacagcgagatgaagaggtccggaaagcagatgagaaaaggattaggcgactaaagaatgagttactggagataaaaaggaaaggggccaagaggggcagccaacactacagtgatcggacctgtgcccggtgccaggagagcctgggccgtttgagtcccaaaaccaatacttgtcggggttgtaatcacctggtgtgtcgggactgccgcatacaggaaagcaatggtacctggaggtgcaaggtgtgcgccaaggaaatagagttgaagaaagcaactggggactggttttatgaccagaaagtgaatcgctttgcttaccgcacaggtagtgagataatcaggatgtccctgcgccacaaacctgcagtgagtaaaagagagacagtgggacagtccctccttcatcagacacagatgggtgacatctggccaggaagaaagatcattcaggagcggcagaaggagcccagtgtgctatttgaagtgccaaagctgaaaagtggaaagagtgcattggaagctgagagtgagagtctggatagcttcacagctgactcggatagcacctccaggagagactctctggataaatctggcctctttccagaatggaagaagatgtctgctcccaaatctcaagtagaaaaggaaactcagcctggaggtcaaaatgtggtatttgtggatgagggtgagatgatatttaagaagaacaccagaaaaatcctcaggccttcagagtacactaaatctgtgatagatcttcgcccagaagatgtggtacatgaaagtggctccttgggagacagaagcaaatccgtcccaggcctcaatgtggatatggaagaggaagaagaagaagaagacattgaccacctagtgaagttacatcgccagaagctagccagaagcagcatgcaaagtggctcctccatgagtacgatcggcagcatgatgagcatctacagtgaagctggtgatttcgggaacatctttgtgactggcaggattgccttttccctgaagtatgagcagcaaacccagagtctggttgtccatgtgaaggagtgccatcagctggcctatgctgatgaagccaagaagcgctctaacccatatgtgaagacttaccttctgcctgacaagtcccgccaaggaaaaagaaaaaccagcatcaagcgggacactgttaatccactatatgatgagacgctgaggtatgagatcccagaatctctcctggcccagaggaccctgcagttctcagtttggcatcatggtcgttttggcagaaacactttccttggagaggcagagatccagatggattcctggaagcttgataagaaactggatcattgcctccctttacatggaaagatcagtgctgagtccccgactggcttgccatcacacaaaggcgagttggtggtttcattgaaatacatcccagcctccaaaacccctgttggaggtgaccggaaaaagagtaaaggtggggaagggggagagctccaggtgtggatcaaagaagccaagaacttgacggctgccaaagcaggagggacttcagacagctttgtcaagggatacctccttcccatgaggaacaaggccagtaaacgtaaaactcctgtgatgaagaagaccctgaatcctcactacaaccatacatttgtctacaatggtgtgaggctggaagatctacagcatatgtgcctggaactgactgtgtgggaccgggagcccctggccagcaatgacttcctgggaggggtcaggctgggtgttggcactgggatcagtaatggggaagtggtggactggatggactcgactggggaagaagtgagcctgtggcagaagatgcgacagtacccagggtcttgggcagaagggactctgcagctccgttcctcaatggccaagcagaagctgggtttatgagtccctgtcctcttctgcaggtccagccctggcgagggcaggtcagaggaagtgaagaaatcaagagcaaagatttataatttaatgtgtatgtgtgtatgtgtgtatgtgtgtgtgtgtgtgtgtgtgtgtntgtgtacaaacatgtattttctgcaaatctcattatgctggctagagtgatgcagacttgttcttctttttaaagcagtctcaagaataagcatttctttaaaatgtttctgtgtataatctagtttattttcagagtccattttttcttatgtctttataaggttcacttaacttaaaaacagcttttaaaacaactttttatcttctgtcttgctatcattgttcctacttccctaggaagccctggctacctttcgcattaggaccagtctgggttttaaggctctgggaagcagggttggttagtaaagacaggaatgttggggagaggtgagtagttccttcctctttctcctctccaatttatgcttttaacttattttctacctggataaacttctggaacttggcttttaaatttaacttttctagtttttaagcagtttccaccttgctttggtctaatgcttttctttgaaatgctaacagaattcccaagctttttccagttctagatatctttactagacctttgggggactcttataatggagctgcttttgaaaagcactttaattagataatgtattttgactaaatcacgaggatgcccagtgagagcttctagctgatctcagaggaccagagtgactgagggtaaagtgtctcacagcccatgctgaattttctgcattttaaactgatactgcagtcattggagagagagctcctcatttctcgaatgaaagatgagatatattcatcctcatgtaccacatctgtcttagtgtttgcgtctggggtgtgttatcaaacagagcatggtctacatcccactgtgtcaaccagaagagccaagtgttatctcaattggcccagtgtttctccaggctggggactgttaagggctctaagggaatgtagacagagtctccctgttattctgacttcctgcttgatgagctttcagttcctgtttttgctattgtttcctaaatttgacctacatattacatgggtgtagtgtgttgaggcttttcaaagaagggtctagtgagctaagtttcatcttctggtactcattgatcaaactgacctttctattctcataagcgtttctacccaaagttgtgtgtggaaggagtgtatagcagagaggaaatccctttcaacagagtcagctgctaactgatttcctataagcacactggattaagggcagccacagtggtttctactgtatgtatgaaccgaatggaggaatgttttcaaagattgatttggtgtggattgcaattgtaatggaaggcataacttgggatcccgggctgtaacttgctcttttgtttcccacccccctgacatgtatgtgtgctttaataaagctttctcacttgtca

SEQ ID NO: 17227 - DNA, 3849 bp, Homo sapiens
  misc_feature (1)..(2): n is a, c, g, or t
  misc_feature (2447)..(2447): n is a, c, g, or t
nncggccccgcgaacggcgagaagacgacagaaggggagggtgagaagggccggctgccggagctggggcgatcttcccggagccggagaccctcccttgaaaccggcactgggacttctcgatctctggaggcacctgttgcaagtgacagggaactagtaaaaaaagaaaaagaaaaaataaagtgaaagaggcgtgttgtctagtttcaaaggagaggagagaaggcaactctggtagctctccttgtctggttgttttgaagaaagaagagtagaagaaaaagttgagtaaatcatgtcggagttactggacctttcttttctgtctgaggaggaaaaggatttgattctcagtgttctacagcgagatgaagaggtccggaaagcagatgagaaaaggattaggcgactaaagaatgagttactggagataaaaaggaaaggggccaagaggggcagccaacactacagtgatcggacctgtgcccggtgccaggagagcctgggccgtttgagtcccaaaaccaatacttgtcggggttgtaatcacctggtgtgtcgggactgccgcatacaggaaagcaatggtacctggaggtgcaaggtgtgcgccaaggaaatagagttgaagaaagcaactggggactggttttatgaccagaaagtgaatcgctttgcttaccgcacaggtagtgagataatcaggatgtccctgcgccacaaacctgcagtgagtaaaagagagacagtgggacagtccctccttcatcagacacagatgggtgacatctggccaggaagaaagatcattcaggagcggcagaaggagcccagtgtgctatttgaagtgccaaagctgaaaagtggaaagagtgcattggaagctgagagtgagagtctggatagcttcacagctgactcggatagcacctccaggagagactctctggataaatctggcctctttccagaatggaagaagatgtctgctcccaaatctcaagtagaaaaggaaactcagcctggaggtcaaaatgtggtatttgtggatgagggtgagatgatatttaagaagaacaccagaaaaatcctcaggccttcagagtacactaaatctgtgatagatcttcgcccagaagatgtggtacatgaaagtggctccttgggagacagaagcaaatccgtcccaggcctcaatgtggatatggaagaggaagaagaagaagaagacattgaccacctagtgaagttacatcgccagaagctagccagaagcagcatgcaaagtggctcctccatgagtacgatcggcagcatgatgagcatctacagtgaagctggtgatttcgggaacatctttgtgactggcaggattgccttttccctgaagtatgagcagcaaacccagagtctggttgtccatgtgaaggagtgccatcagctggcctatgctgatgaagccaagaagcgctctaacccatatgtgaagacttaccttctgcctgacaagtcccgccaaggaaaaagaaaaaccagcatcaagcgggacactgttaatccactatatgatgagacgctgaggtatgagatcccagaatctctcctggcccagaggaccctgcagttctcagtttggcatcatggtcgttttggcagaaacactttccttggagaggcagagatccagatggattcctggaagcttgataagaaactggatcattgcctccctttacatggaaagatcagtgctgagtccccgactggcttgccatcacacaaaggcgagttggtggtttcattgaaatacatcccagcctccaaaacccctgttggaggtgaccggaaaaagagtaaaggtggggaagggggagagctccaggtgtggatcaaagaagccaagaacttgacggctgccaaagcaggagggacttcagacagctttgtcaagggatacctccttcccatgaggaacaaggccagtaaacgtaaaactcctgtgatgaagaagaccctgaatcctcactacaaccatacatttgtctacaatggtgtgaggctggaagatctacagcatatgtgcctggaactgactgtgtgggaccgggagcccctggccagcaatgacttcctgggaggggtcaggctgggtgttggcactgggatcagtaatggggaagtggtggactggatggactcgactggggaagaagtgagcctgtggcagaagatgcgacagtacccagggtcttgggcagaagggactctgcagctccgttcctcaatggccaagcagaagctgggtttatgagtccctgtcctcttctgcaggtccagccctggcgagggcaggtcagaggaagtgaagaaatcaagagcaaagatttataatttaatgtgtatgtgtgtatgtgtgtatgtgtgtgtgtgtgtgtgtgtgtgtntgtgtacaaacatgtattttctgcaaatctcattatgctggctagagtgatgcagacttgttcttctttttaaagcagtctcaagaataagcatttctttaaaatgtttctgtgtataatctagtttattttcagagtccattttttcttatgtctttataaggttcacttaacttaaaaacagcttttaaaacaactttttatcttctgtcttgctatcattgttcctacttccctaggaagccctggctacctttcgcattaggaccagtctgggttttaaggctctgggaagcagggttggttagtaaagacaggaatgttggggagaggtgagtagttccttcctctttctcctctccaatttatgcttttaacttattttctacctggataaacttctggaacttggcttttaaatttaacttttctagtttttaagcagtttccaccttgctttggtctaatgcttttctttgaaatgctaacagaattcccaagctttttccagttctagatatctttactagacctttgggggactcttataatggagctgcttttgaaaagcactttaattagataatgtattttgactaaatcacgaggatgcccagtgagagcttctagctgatctcagaggaccagagtgactgagggtaaagtgtctcacagcccatgctgaattttctgcattttaaactgatactgcagtcattggagagagagctcctcatttctcgaatgaaagatgagatatattcatcctcatgtaccacatctgtcttagtgtttgcgtctggggtgtgttatcaaacagagcatggtctacatcccactgtgtcaaccagaagagccaagtgttatctcaattggcccagtgtttctccaggctggggactgttaagggctctaagggaatgtagacagagtctccctgttattctgacttcctgcttgatgagctttcagttcctgtttttgctattgtttcctaaatttgacctacatattacatgggtgtagtgtgttgaggcttttcaaagaagggtctagtgagctaagtttcatcttctggtactcattgatcaaactgacctttctattctcataagcgtttctacccaaagttgtgtgtggaaggagtgtatagcagagaggaaatccctttcaacagagtcagctgctaactgatttcctataagcacactggattaagggcagccacagtggtttctactgtatgtatgaaccgaatggaggaatgttttcaaagattgatttggtgtggattgcaattgtaatggaaggcataacttgggatcccgggctgtaacttgctcttttgtttcccacccccctgacatgtatgtgtgctttaataaagctttctcacttgtca

SEQ ID NO: 17228 - DNA, 1402 bp, Homo sapiens
  misc_feature (11)..(11): n is a, c, g, or t
cgacccgcttnctttctaactgctccaagcggtccctttctctctgttaatgcccccttgccatctcccttctcgggtgtctttcccattcccggcgagctttcccctgttcttctcgatgccgtttccgacgttcgtccattttttcttatgtctttataaggttcacttaacttaaaaacagcttttaaaacaactttttatcttctgtcttgctatcattgttcctacttccctaggaagccctggctacctttcgcattaggaccagtctgggttttaaggctctgggaagcagggttggttagtaaagacaggaatgttggggagaggtgagtagttccttcctctttctcctctccaatttatgcttttaacttattttctacctggataaacttctggaacttggcttttaaatttaacttttctagtttttaagcagtttccaccttgctttggtctaatgcttttctttgaaatgctaacagaattcccaagctttttccagttctagatatctttactagacctttgggggactcttataatggagctgcttttgaaaagcactttaattagataatgtattttgactaaatcacgaggatgcccagtgagagcttctagctgatctcagaggaccagagtgactgagggtaaagtgtctcacagcccatgctgaattttctgcattttaaactgatactgcagtcattggagagagagctcctcatttctcgaatgaaagatgagatatattcatcctcatgtaccacatctgtcttagtgtttgcgtctggggtgtgttatcaaacagagcatggtctacatcccactgtgtcaaccagaagagccaagtgttatctcaattggcccagtgtttctccaggctggggactgttaagggctctaagggaatgtagacagagtctccctgttattctgacttcctgcttgatgagctttcagttcctgtttttgctattgtttcctaaatttgacctacatattacatgggtgtagtgtgttgaggcttttcaaagaagggtctagtgagctaagtttcatcttctggtactcattgatcaaactgacctttctattctcataagcgtttctacccaaagttgtgtgtggaaggagtgtatagcagagaggaaatccctttcaacagagtcagctgctaactgatttcctataagcacactggattaagggcagccacagtggtttctactgtatgtatgaaccgaatggaggaatgttttcaaagattgatttggtgtggattgcaattgtaatggaaggcataacttgggatcccgggctgtaacttgctcttttgtttcccacccccctgacatgtatgtgtgctttaataaagctttctcacttgtca

SEQ ID NO: 17229 - DNA, 2416 bp, Homo sapiens
  misc_feature (1)..(2): n is a, c, g, or t
  misc_feature (2410)..(2410): n is a, c, g, or t
nncggccccgcgaacggcgagaagacgacagaaggggagggtgagaagggccggctgccggagctggggcgatcttcccggagccggagaccctcccttgaaaccggcactgggacttctcgatctctggaggcacctgttgcaagtgacagcgctcggccgtcgagcggggtcgctaacccgcactctcttcggacctacgacatcgcggcttctctggcgttggccagtcagccacagggaactagtaaaaaaagaaaaagaaaaaataaagtgaaagaggcgtgttgtctagtttcaaaggagaggagagaagagactgagtcgccctgtgttgcccaggctggtcttgaactcctaggctcaagagatcctcctgcctcagcctcccaaagtgctgggattacaggcaactctggtagctctccttgtctggttgttttgaagaaagaagagtagaagaaaaagttgagtaaatcatgtcggagttactggacctttcttttctgtctgaggaggaaaaggatttgattctcagtgttctacagcgagatgaagaggtccggaaagcagatgagaaaaggattaggcgactaaagaatgagttactggagataaaaaggaaaggggccaagaggggcagccaacactacagtgatcggacctgtgcccggtgccaggagagcctgggccgtttgagtcccaaaaccaatacttgtcggggttgtaatcacctggtgtgtcgggactgccgcatacaggaaagcaatggtacctggaggtgcaaggtgtgcgccaaggaaatagagttgaagaaagcaactggggactggttttatgaccagaaagtgaatcgctttgcttaccgcacaggtagtgagataatcaggatgtccctgcgccacaaacctgcagtgagtaaaagagagacagtgggacagtccctccttcatcagacacagatgggtgacatctggccaggaagaaagatcattcaggagcggcagaaggagcccagtgtgctatttgaagtgccaaagctgaaaagtggaaagagtgcattggaagctgagagtgagagtctggatagcttcacagctgactcggatagcacctccaggagagactctctggataaatctggcctctttccagaatggaagaagatgtctgctcccaaatctcaagtagaaaaggaaactcagcctggaggtcaaaatgtggtatttgtggatgagggtgagatgatatttaagaagaacaccagaaaaatcctcaggccttcagagtacactaaatctgtgatagatcttcgcccagaagatgtggtacatgaaagtggctccttgggagacagaagcaaatccgtcccaggcctcaatgtggatatggaagaggaagaagaagaagaagacattgaccacctagtgaagttacatcgccagaagctagccagaagcagcatgcaaagtggctcctccatgagtacgatcggcagcatgatgagcatctacagtgaagctggtgatttcgggaacatctttgtgactggcaggattgccttttccctgaagtatgagcagcaaacccagagtctggttgtccatgtgaaggagtgccatcagctggcctatgctgatgaagccaagaagcgctctaacccatatgtgaagacttaccttctgcctgacaagtcccgccaaggaaaaagaaaaaccagcatcaagcgggacactgttaatccactatatgatgagacgctgaggtatgagatcccagaatctctcctggcccagaggaccctgcagttctcagtttggcatcatggtcgttttggcagaaacactttccttggagaggcagagatccagatggattcctggaagcttgataagaaactggatcattgcctccctttacatggaaagatcagtgctgagtccccgactggcttgccatcacacaaaggcgagttggtggtttcattgaaatacatcccagcctccaaaacccctgttggaggtgaccggaaaaagagtaaaggtggggaagggggagagctccaggtgtggatcaaagaagccaagaacttgacggctgccaaagcaggagggacttcagacagctttgtcaagggatacctccttcccatgaggaacaaggccagtaaacgtaaaactcctgtgatgaagaagaccctgaatcctcactacaaccatacatttgtctacaatggtgtgaggctggaagatctacagcatatgtgcctggaactgactgtgtgggaccgggagcccctggccagcaatgacttcctgggaggggtcaggctgggtgttggcactggtgagatcccctcccccacaatactgcaggacactgtttggactgtggggtcttctagagtggnctgcta

SEQ ID NO: 17230 - DNA, 1396 bp, Homo sapiens
  misc_feature (1)..(2): n is a, c, g, or t
nncggccccgcgaacggcgagaagacgacagaaggggagggtgagaagggccggctgccggagctggggcgatcttcccggagccggagaccctcccttgaaaccggcactgggacttctcgatctctggaggcacctgttgcaagtgacagcgctcggccgtcgagcggggtcgctaacccgcactctcttcggacctacgacatcgcggcttctctggcgttggccagtcagccacagggaactagtaaaaaaagaaaaagaaaaaataaagtgaaagaggcgtgttgtctagtttcaaaggagaggagagaagagactgagtcgccctgtgttgcccaggctggtcttgaactcctaggctcaagagatcctcctgcctcagcctcccaaagtgctgggattacaggcaactctggtagctctccttgtctggttgttttgaagaaagaagagtagaagaaaaagttgagtaaatcatgtcggagttactggacctttcttttctgtctgaggaggaaaaggatttgattctcagtgttctacagcgagatgaagaggtccggaaagcagatgagaaaaggattaggcgactaaagaatgagttactggagataaaaaggaaaggggccaagaggggcagccaacactacagtgatcggacctgtgcccggtgccaggagagcctgggccgtttgagtcccaaaaccaatacttgtcggggttgtaatcacctggtgtgtcgggactgccgcatacaggaaagcaatggtacctggaggtgcaaggtgtgcgccaaggaaatagagttgaagaaagcaactggggactggttttatgaccagaaagtgaatcgctttgcttaccgcacaggtagtgagataatcaggatgtccctgcgccacaaacctgcagtgagtaaaagagagacagtgggacagtccctccttcatcagacacagatgggtgacatctggccaggaagaaagatcattcaggagcggcagaaggagcccagtgtgctatttgaagtgccaaagctgaaaagtggaaagagtgcattggaagctgagagtgagagtctggatagcttcacagctgactcggatagcacctccaggagagactctctggataaatctggcctctttccagaatggaagaagatgtctgctcccaaatctcaagtagaaaaggaaactcagcctggaggtcaaaatgtggtatttgtggatgagggtgagatgatatttaagaagaacaccagaaaaatcctcaggccttcaggtaactggtttcccttactggtctttcaggactgaagttctgagtacccttgatgggctcttggtatggagaagaataggtctctttgatttggctttttttggtcttc

SEQ ID NO: 17231 - DNA, 649 bp, Homo sapiens
tggaacatttttctgcatcttgctttgttgacttaaccctatgtcttggatatctttccatgtcagcatgtacagattcactgaattcttttttgatgactgcatgccatatgccataccaggacactacaattattcatttaactctttctatagtgattgacatttaggtcgtttccactttttggctattactaacaatgctggtagcaagattctctgtcatgctgtcagtccttcgtgagtttgtatggcaaccttgcttgaagatctttgagagtatttggaatctagtaactatgcccccaaagtggcataatagtgggtattgcagaagactctttgttggttctgccctatttccttctaaagaaactgccatagaaacctgtggctgccatggcctagggacggtggattatattcatatgaagaaggatcctcttttgccctgatgctgttcttggggggtaattttagaatttttttcagagagaagtcccaacaattcttgagaagcccagcttgacctgttgggtttccctgtgtttcagatcagtgctgagtccccgactggcttgccatcacacaaaggcgagttggtggtttcattgaaatacatcccagcctccaaaacccctgttggagg

SEQ ID NO: 17232 - DNA, 538 bp, Homo sapiens
tgcttactggcaggcactgtgctaggcactgaggagacaggacaggcacggttctgttatggagctcgctgcctttaggagcaagcaaagaaagtgctgcataaacaaagctcaagataaatctagaggtggaaggggctcacttgctatggctgacatcccttacaggtaaaggtggggaagggggagagctccaggtgtggatcaaagaagccaagaacttgacggctgccaaagcaggagggacttcagacagctttgtcaaggggtgagtccctagaccagccccaaattaaccagtttcagaacaagagagctaagagaagaatttaactttctctgtggatattatccagtgtgtcttaccactcccggcaaccaaatttgttcctgaaattaggtaatgacaaaaccttcaccacctttgcactggtctgggctgtagacttgataatccaaagaggagggctgcagacaggttctgacttttgtctgactcatgttcttaattaattctgggtgaaaatctgtgtcttct

SEQ ID NO: 17233 - DNA, 4485 bp, Homo sapiens
  misc_feature (1)..(2): n is a, c, g, or t
  misc_feature (2628)..(2628): n is a, c, g, or t
nncggccccgcgaacggcgagaagacgacagaaggggagggtgagaagggccggctgccggagctggggcgatcttcccggagccggagaccctcccttgaaaccggcactgggacttctcgatctctggaggcacctgttgcaagtgacagcgctcggccgtcgagcggggtcgctaacccgcactctcttcggacctacgacatcgcggcttctctggcgttggccagtcagccacagggaactagtaaaaaaagaaaaagaaaaaataaagtgaaagaggcgtgttgtctagtttcaaaggagaggagagaagagactgagtcgccctgtgttgcccaggctggtcttgaactcctaggctcaagagatcctcctgcctcagcctcccaaagtgctgggattacaggcaactctggtagctctccttgtctggttgttttgaagaaagaagagtagaagaaaaagttgagtaaatcatgtcggagttactggacctttcttttctgtctgaggaggaaaaggatttgattctcagtgttctacagcgagatgaagaggtccggaaagcagatgagaaaaggattaggcgactaaagaatgagttactggagataaaaaggaaaggggccaagaggggcagccaacactacagtgatcggacctgtgcccggtgccaggagagcctgggccgtttgagtcccaaaaccaatacttgtcggggttgtaatcacctggtgtgtcgggactgccgcatacaggaaagcaatggtacctggaggtgcaaggtgtgcgccaaggaaatagagttgaagaaagcaactggggactggttttatgaccagaaagtgaatcgctttgcttaccgcacaggtagtgagataatcaggatgtccctgcgccacaaacctgcagtgagtaaaagagagacagtgggacagtccctccttcatcagacacagatgggtgacatctggccaggaagaaagatcattcaggagcggcagaaggagcccagtgtgctatttgaagtgccaaagctgaaaagtggaaagagtgcattggaagctgagagtgagagtctggatagcttcacagctgactcggatagcacctccaggagagactctctggataaatctggcctctttccagaatggaagaagatgtctgctcccaaatctcaagtagaaaaggaaactcagcctggaggtcaaaatgtggtatttgtggatgagggtgagatgatatttaagaagaacaccagaaaaatcctcaggccttcagagtacactaaatctgtgatagatcttcgcccagaagatgtggtacatgaaagtggctccttgggagacagaagcaaatccgtcccaggcctcaatgtggatatggaagaggaagaagaagaagaagacattgaccacctagtgaagttacatcgccagaagctagccagaagcagcatgcaaagtggctcctccatgagtacgatcggcagcatgatgagcatctacagtgaagctggtgatttcgggaacatctttgtgactggcaggattgccttttccctgaagtatgagcagcaaacccagagtctggttgtccatgtgaaggagtgccatcagctggcctatgctgatgaagccaagaagcgctctaacccatatgtgaagacttaccttctgcctgacaagtcccgccaaggaaaaagaaaaaccagcatcaagcgggacactgttaatccactatatgatgagacgctgaggtatgagatcccagaatctctcctggcccagaggaccctgcagttctcagtttggcatcatggtcgttttggcagaaacactttccttggagaggcagagatccagatggattcctggaagcttgataagaaactggatcattgcctccctttacatggaaagatcagtgctgagtccccgactggcttgccatcacacaaaggcgagttggtggtttcattgaaatacatcccagcctccaaaacccctgttggaggtgaccggaaaaagagtaaaggtggggaagggggagagctccaggtgtggatcaaagaagccaagaacttgacggctgccaaagcaggagggacttcagacagctttgtcaagggatacctccttcccatgaggaacaaggccagtaaacgtaaaactcctgtgatgaagaagaccctgaatcctcactacaaccatacatttgtctacaatggtgtgaggctggaagatctacagcatatgtgcctggaactgactgtgtgggaccgggagcccctggccagcaatgacttcctgggaggggtcaggctgggtgttggcactgggatcagtaatggggaagtggtggactggatggactcgactggggaagaagtgagcctgtggcagaagatgcgacagtacccagggtcttgggcagaagggactctgcagctccgttcctcaatggccaagcagaagctgggtttatgagtccctgtcctcttctgcaggtccagccctggcgagggcaggtcagaggaagtgaagaaatcaagagcaaagatttataatttaatgtgtatgtgtgtatgtgtgtatgtgtgtgtgtgtgtgtgtgtgtgtntgtgtacaaacatgtattttctgcaaatctcattatgctggctagagtgatgcagacttgttcttctttttaaagcagtctcaagaataagcatttctttaaaatgtttctgtgtataatctagtttattttcagagtccattttttcttatgtctttataaggttcacttaacttaaaaacagcttttaaaacaactttttatcttctgtcttgctatcattgttcctacttccctaggaagccctggctacctttcgcattaggaccagtctgggttttaaggctctgggaagcagggttggttagtaaagacaggaatgttggggagaggtgagtagttccttcctctttctcctctccaatttatgcttttaacttattttctacctggataaacttctggaacttggcttttaaatttaacttttctagtttttaagcagtttccaccttgctttggtctaatgcttttctttgaaatgctaacagaattcccaagctttttccagttctagatatctttactagacctttgggggactcttataatggagctgcttttgaaaagcactttaattagataatgtattttgactaaatcacgaggatgcccagtgagagcttctagctgatctcagaggaccagagtgactgagggtaaagtgtctcacagcccatgctgaattttctgcattttaaactgatactgcagtcattggagagagagctcctcatttctcgaatgaaagatgagatatattcatcctcatgtaccacatctgtcttagtgtttgcgtctggggtgtgttatcaaacagagcatggtctacatcccactgtgtcaaccagaagagccaagtgttatctcaattggcccagtgtttctccaggctggggactgttaagggctctaagggaatgtagacagagtctccctgttattctgacttcctgcttgatgagctttcagttcctgtttttgctattgtttcctaaatttgacctacatattacatgggtgtagtgtgttgaggcttttcaaagaagggtctagtgagctaagtttcatcttctggtactcattgatcaaactgacctttctattctcataagcgtttctacccaaagttgtgtgtggaaggagtgtatagcagagaggaaatccctttcaacagagtcagctgctaactgatttcctataagcacactggattaagggcagccacagtggtttctactgtatgtatgaaccgaatggaggaatgttttcaaagattgatttggtgtggattgcaattgtaatggaaggcataacttgggatcccgggctgtaacttgctcttttgtttcccacccccctgacatgtatgtgtgctttaataaagctttctcacttgtcaaacgtttgtgtttgttagttctataaatgcttttgtctctgatgtcctcactgttgcttttcccctggcttgaaggataagaaccaaagtgataaatgctcttccctaaccatcctatgctgattgaagaaaattcacctttccccgcattgctgcctgataccttaaatgcctgatactttcgctgagcttgatccctcgtcctttgtatttggtatctaaggagaacactgagaaatcatctttaaagtggcaccacttttctatcttgtaacaaaggaactcttcctttagctttgcagaccctcctatactggaggaaggagagagatgttcatacaggaggtgaggggagacattccctgctataagcacttctttctggatccttcaatttctctgggaggcggggactttttcttttactcctcctaccattatgtagttttgagaga

SEQ ID NO: 17234 - DNA, 1672 bp, Homo sapiens
  misc_feature (1)..(2): n is a, c, g, or t
nncggccccgcgaacggcgagaagacgacagaaggggagggtgagaagggccggctgccggagctggggcgatcttcccggagccggagaccctcccttgaaaccggcactgggacttctcgatctctggaggcacctgttgcaagtgacagcgctcggccgtcgagcggggtcgctaacccgcactctcttcggacctacgacatcgcggcttctctggcgttggccagtcagccacagggaactagtaaaaaaagaaaaagaaaaaataaagtgaaagaggcgtgttgtctagtttcaaaggagaggagagaagagactgagtcgccctgtgttgcccaggctggtcttgaactcctaggctcaagagatcctcctgcctcagcctcccaaagtgctgggattacaggcaactctggtagctctccttgtctggttgttttgaagaaagaagagtagaagaaaaagttgagtaaatcatgtcggagttactggacctttcttttctgtctgaggaggaaaaggatttgattctcagtgttctacagcgagatgaagaggtccggaaagcagatgagaaaaggattaggcgactaaagaatgagttactggagataaaaaggaaaggggccaagaggggcagccaacactacagtgatcggacctgtgcccggtgccaggagagcctgggccgtttgagtcccaaaaccaatacttgtcggggttgtaatcacctggtgtgtcgggactgccgcatacaggaaagcaatggtacctggaggtgcaaggtgtgcgccaaggaaatagagttgaagaaagcaactggggactggttttatgaccagaaagtgaatcgctttgcttaccgcacaggtagtgagataatcaggatgtccctgcgccacaaacctgcagtgagtaaaagagagacagtgggacagtccctccttcatcagacacagatgggtgacatctggccaggaagaaagatcattcaggagcggcagaaggagcccagtgtgctatttgaagtgccaaagctgaaaagtggaaagagtgcattggaagctgagagtgagagtctggatagcttcacagctgactcggatagcacctccaggagagactctctggataaatctggcctctttccagaatggaagaagatgtctgctcccaaatctcaagtagaaaaggaaactcagcctggaggtcaaaatgtggtatttgtggatgagggtgagatgatatttaagaagaacaccagaaaaatcctcaggccttcagagtacactaaatctgtgatagatcttcgcccagaagatgtggtacatgaaagtggctccttgggagacagaagcaaatccgtcccaggcctcaatgtggatatggaagaggaagaagaagaagaagacattgaccacctagtgaagttacatcgccagaagctagccagaagcagcatgcaaagtggctcctccatggtaagttctattagatctgtggttacaggcatgttggggtactaggaagaaaagaagcacctccctagagcagattcgggacctggggaaaccatcctagtcactcttttcaggtaagtaagatcatttgtttgttcctatcctcaatttagactataggtgcttagtgtacatctaggtgacttcct

SEQ ID NO: 17235 - DNA, 3233 bp, Homo sapiens
  misc_feature (4)..(4): n is a, c, g, or t
  misc_feature (2434)..(2434): n is a, c, g, or t
ggcncgagccggaagtgttgtggccgccgccgccgcgcgtcgcggaggcacgtgtggagccccggcagcaggagcgtcgcaggtccttggcccttgccagacattagcaccatgagcttcgtggcatacgaggagctgatcaaggagggtgacacggccatcctgtcactgggccatggtgcaatggtggcagtgcgtgtgcagcgtggggcacagacccagacccggcatggtgtcctgcggcactcagttgaccttatcggccgccccttcggctccaaggtgacgtgcggccgaggtggctgggtgtatgtgctgcaccccacgcccgagctctggacgctgaacctgccgcaccgcacgcagatcctctactccacagacatcgccctcatcaccatgatgttggagcttcggcccggctctgtggtctgtgagtctggcaccggcagtggctctgtgtcccacgccatcatccgcaccattgcacccacgggtcacctgcacacggtggagttccaccagcagcgggcagagaaggcccgggaggagttccaggagcaccgtgtgggccgctgggtgactgtgcgcacccaggacgtgtgccgcagtggctttggcgtgagccacgtggccgacgccgtcttcctggacatcccatcaccctgggaggccgtgggccacgcctgggacgccctcaaggtcgaaggcgggcgcttctgctccttctcaccgtgcatcgagcaggtgcaacgcacatgccaggcgctggcagcgcgcggcttctcagagctgagcaccctggaggtgctgccacaggtctacaacgtgcgcactgtcagcctgccaccgcccgacctgggcacaggcacagatggccctgccggctccgacaccagccccttccgcagcggcacgcccatgaaggaggccgtgggccacaccggctacctgaccttcgccaccaagaccccaggctagggggccgcctcccagggcaccagggagctgggagcactgaagggctgggcagggaggccagaggcaccttatatggtcagcgatgcctgccagacacagacggtggggtggggcttgggggcctcctgggtggccagagtgggacagcaggaagggcggctgtgatggaggagcagtgctggggctgggcctcagccattcctgtccagccctgtggcccatcccagctgctgtttgttgccaatatgaagtatccactgccacaggctcccctgggtgttgaagccaaagggtgcaggtgggggagtctgaccccctcccaggtgggcctaagcaggaagggggtggaggagggaggggggcattgaccctgagaccacgctgcgtctgacccctgggcccccacggccctggctgccccacggggcctgagaccatctcgtgcttctccagtccccgggccgaggctccagccttggccagaagctggggtgagctgacccagaatccctgccctgctctccccagcgctaggagaccaggccagcccaggaaccagggaggtgaccctgctctctggcctcctggctgatgtcacagcactgagctcagcccaggccttcgtccactcatgtccaagaggcggggcatcccccacccagccagagcccctgacatgggctgcactcgctgaggccaggcagcgctgcggagaggagcggcagagtgggttgtctgccgcaggcaaccaggcaagtgtgtcggggctggggtgtgaatgccagcctgtgagtcccggaactatgtgggtacccctacccctcacagaagccaagggcatggaggaggtccctccacagtgacaacggtgtggggtaggggaggtgcattcaggacaccacccagggacagtgcctatgtgatcacctcttaaaggctaagcttaggggcatttcccaaagtggggacagagggcaggacgcccaggctgggggctctcctcgcccgccctggtgtctgacagcctcaaggaaggagcagtgcctgtgtcagccatggggcccttggagctgccgctggtgcctagggggcctgggtttctgcccaggcagccagtggctgttgggagcctctgtttcccctgtgctgggggccttgagtgctatgctagcaggggcctggccccaagtgtgagtgatgagcaataaacgtaccgtccccctctgttctgagtgatccctagcagccaaggccacccccagctgctgtctaggccagccctacctgcgctctgcccctggtccctgctcctccctgtcctggtttggcatgataggcgctccagtctccaggacaaaggggcaaatgtgtggccacccccatctggctgcagaaaaggccactccttcctggggttggggtggtccaggagtgctgggccttcttccacagncctgggctggaattcagtgtggctgcctgggttacttgtatgcgcccctgaaggaagggtccactccaggccgcctggtccctgcgaagtgtcacactgtgggtcaccgggggctgtggctaatgtggtccgggaggcctgtgtccctgagagttgctcagccctgctccgagggcttgtcctctccttccaggacccagcttcccttctaaccttgttactcacctggggcacagaggaggggcccccagtcaggttcaacatggaagtgggtgaccctaatgccaggagctttggggtcaggctgtccctggggtgtcatgaactgggtgacgcacacccctgagatctcagttcccccaagcctgccctgcccctcctggccacagcaaaggcctgcatggtgtctgatgggtggacaccgggaggtgtttctttgaggcgcagctccatggtttgtaggacacataggcctcaggcactgtagggtccaggttgtgcccattttccagccggggctggttgccctggtggcagccctgggtgagtcaccagggtccgcacatggagagcgggaggtcccagcccacccttagttgtcacatgggacagagttgctgtgtcaatcccctcggccctgctgctctgccctgcacacaggcccccatgatgaccttgagcctccaggcatccacccccaccgtatggccctctagacccagctgggcctcaccccactccctcagcttggatcctcacgtggcctggagccagcattaaactcctgtatgtccttcaa

SEQ ID NO: 17236 - DNA, 2205 bp, Homo sapiens
  misc_feature (4)..(4): n is a, c, g, or t
ggcncgagccggaagtgttgtggccgccgccgccgcgcgtcgcggaggcacgtgtggagccccggcagcaggagcgtcgcaggtccttggcccttgccagacattagcaccatgagcttcgtggcatacgaggagctgatcaaggagggtgacacggccatcctgtcactgggccatggtgcaatggtggcagtgcgtgtgcagcgtggggcacagacccagacccggcatggtgtcctgcggcactcagttgaccttatcggccgccccttcggctccaaggtgacgtgcggccgaggtggctgggtgtatgtgctgcaccccacgcccgagctctggacgctgaacctgccgcaccgcacgcagatcctctactccacagacatcgccctcatcaccatgatgttggagcttcggcccggctctgtggtctgtgagtctggcaccggcagtggctctgtgtcccacgccatcatccgcaccattgcacccacgggtcacctgcacacggtggagttccaccagcagcgggcagagaaggcccgggaggagttccaggagcaccgtgtgggccgctgggtgactgtgcgcacccaggacgtgtgccgcagtggctttggcgtgagccacgtggccgacgccgtcttcctggacatcccatcaccctgggaggccgtgggccacgcctgggacgccctcaaggtcgaaggcgggcgcttctgctccttctcaccgtgcatcgagcaggtgcaacgcacatgccaggcgctggcagcgcgcggcttctcagagctgagcaccctggaggtgctgccacaggtctacaacgtgcgcactgtcagcctgccaccgcccgacctgggcacaggcacagatggccctgccggctccgacaccagccccttccgcagcggcacgcccatgaaggaggccgtgggccacaccggctacctgaccttcgccaccaagaccccaggctagggggccgcctcccagggcaccagggagctgggagcactgaagggctgggcagggaggccagaggcaccttatatggtcagcgatgcctgccagacacagacggtggggtggggcttgggggcctcctgggtggccagagtgggacagcaggaagggcggctgtgatggaggagcagtgctggggctgggcctcagccattcctgtccagccctgtggcccatcccagctgctgtttgttgccaatatgaagtatccactgccacaggctcccctgggtgttgaagccaaagggtgcaggtgggggagtctgaccccctcccaggtgggcctaagcaggaagggggtggaggagggaggggggcattgaccctgagaccacgctgcgtctgacccctgggcccccacggccctggctgccccacggggcctgagaccatctcgtgcttctccagtccccgggccgaggctccagccttggccagaagctggggtgagctgacccagaatccctgccctgctctccccagcgctaggagaccaggccagcccaggaaccagggaggtgaccctgctctctggcctcctggctgatgtcacagcactgagctcagcccaggccttcgtccactcatgtccaagaggcggggcatcccccacccagccagagcccctgacatgggctgcactcgctgaggccaggcagcgctgcggagaggagcggcagagtgggttgtctgccgcaggcaaccaggcaagtgtgtcggggctggggtgtgaatgccagcctgtgagtcccggaactatgtgggtacccctacccctcacagaagccaagggcatggaggaggtccctccacagtgacaacggtgtggggtaggggaggtgcattcaggacaccacccagggacagtgcctatgtgatcacctcttaaaggctaagcttaggggcatttcccaaagtggggacagagggcaggacgcccaggctgggggctctcctcgcccgccctggtgtctgacagcctcaaggaaggagcagtgcctgtgtcagccatggggcccttggagctgccgctggtgcctagggggcctgggtttctgcccaggcagccagtggctgttgggagcctctgtttcccctgtgctgggggccttgagtgctatgctagcaggggcctggccccaagtgtgagtgatgagcaataaacgtaccgtccccctc

SEQ ID NO: 17237 - DNA, 2575 bp, Homo sapiens
  misc_feature (4)..(4): n is a, c, g, or t
ggcncgagccggaagtgttgtggccgccgccgccgcgcgtcgcggaggcacgtgtggagccccggcagcaggagcgtcgcaggtccttggcccttgccagacattagcaccatgagcttcgtggcatacgaggagctgatcaaggagggtgacacggccatcctgtcactgggccatggtgcaatggtggcagtgcgtgtgcagcgtggggcacagacccagacccggcatggtgtcctgcggcactcagttgaccttatcggccgccccttcggctccaaggtgacgtgcggccgaggtggctgggtgtatgtgctgcaccccacgcccgagctctggacgctgaacctgccgcaccgcacgcagatcctctactccacagacatcgccctcatcaccatgatgttggagcttcggcccggctctgtggtctgtgagtctggcaccggcagtggctctgtgtcccacgccatcatccgcaccattgcacccacgggtcacctgcacacggtggagttccaccagcagcgggcagagaaggcccgggaggagttccaggagcaccgtgtgggccgctgggtgactgtgcgcacccaggacgtgtgccgcagtggctttggcgtgagccacgtggccgacgccgtcttcctggacatcccatcaccctgggaggccgtgggccacgcctgggacgccctcaaggtcgaaggcgggcgcttctgctccttctcaccgtgcatcgagcaggtgcaacgcacatgccaggcgctggcagcgcgcggcttctcagagctgagcaccctggaggtgctgccacaggtctacaacgtgcgcactgtcagcctgccaccgcccgacctgggcacaggcacagatggccctgccggctccgacaccagccccttccgcagcggcacgcccatgaaggaggccgtgggccacaccggctacctgaccttcgccaccaagaccccaggctagggggccgcctcccagggcaccagggagctgggagcactgaagggctgggcagggaggccagaggcaccttatatggtcagcgatgcctgccagacacagacggtggggtggggcttgggggcctcctgggtggccagagtgggacagcaggaagggcggctgtgatggaggagcagtgctggggctgggcctcagccattcctgtccagccctgtggcccatcccagctgctgtttgttgccaatatgaagtatccactgccacaggctcccctgggtgttgaagccaaagggtgcaggtgggggagtctgaccccctcccaggtgggcctaagcaggaagggggtggaggagggaggggggcattgaccctgagaccacgctgcgtctgacccctgggcccccacggccctggctgccccacggggcctgagaccatctcgtgcttctccagtccccgggccgaggctccagccttggccagaagctggggtgagctgacccagaatccctgccctgctctccccagcgctaggagaccaggccagcccaggaaccagggaggtgaccctgctctctggcctcctggctgatgtcacagcactgagctcagcccaggccttcgtccactcatgtccaagaggcggggcatcccccacccagccagagcccctgacatgggctgcactcgctgaggccaggcagcgctgcggagaggagcggcagagtgggttgtctgccgcaggcaaccaggcaagtgtgtcggggctggggtgtgaatgccagcctgtgagtcccggaactatgtgggtacccctacccctcacagaagccaagggcatggaggaggtccctccacagtgacaacggtgtggggtaggggaggtgcattcaggacaccacccagggacagtgcctatgtgatcacctcttaaaggctaagcttaggggcatttcccaaagtggggacagagggcaggacgcccaggctgggggctctcctcgcccgccctggtgtctgacagcctcaaggaaggagcagtgcctgtgtcagccatggggcccttggagctgccgctggtgcctagggggcctgggtttctgcccaggcagccagtggctgttgggagcctctgtttcccctgtgctgggggccttgagtgctatgctagcaggggcctggccccaagtgtgagtgatgagcaataaacgtaccgtccccctcaaaaaaaaaaaaaaaaacaaaaaaaaaaaaaaaaaaaaaaaaacaaaaaggaaaaaaaaaaaaaaaaaaaaaaaaaaaaagagaggggggggcaaaaaaaaaattaccccgcagggaggaggacaaaaataacagtcctaaacgaatctttttataaaagaaggcggccacgataaaggatggcattataataaagcaagagagagcgctgtagaatcacaggcagggagaagaaaggtaagatagatattgtggagaagcctctatggggagggaactatatgtgacacacacaaggaaataggccacgagaataaatattatgatgatgataaccacgttatgggaagaagcgcaaggtgaggaatcc

SEQ ID NO: 17238 - DNA, 1869 bp, Homo sapiens
  misc_feature (4)..(4): n is a, c, g, or t
ggcncgagccggaagtgttgtggccgccgccgccgcgcgtcgcggaggcacgtgtggagccccggcagcaggagcgtcgcaggtccttggcccttgccagacattagcaccatgagcttcgtggcatacgaggagctgatcaaggagggtgacacggccatcctgtcactgggccatggtgcaatggtggcagtgcgtgtgcagcgtggggcacagacccagacccggcatggtgtcctgcggcactcagttgaccttatcggccgccccttcggctccaaggtgacgtgcggccgaggtggctgggtgtatgtgctgcaccccacgcccgagctctggacgctgaacctgccgcaccgcacgcagatcctctactccacagacatcgccctcatcaccatgatgttggagcttcggcccggctctgtggtctgtgagtctggcaccggcagtggctctgtgtcccacgccatcatccgcaccattgcacccacgggtcacctgcacacggtggagttccaccagcagcgggcagagaaggcccgggaggagttccaggagcaccgtgtgggccgctgggtgactgtgcgcacccaggacgtgtgccgcagtggctttggcgtgagccacgtggccgacgccgtcttcctggacatcccatcaccctgggaggccgtgggccacgcctgggacgccctcaaggtcgaaggcgggcgcttctgctccttctcaccgtgcatcgagcaggtgcaacgcacatgccaggcgctggcagcgcgcggcttctcagagctgagcaccctggaggtgctgccacaggtctacaacgtgcgcactgtcagcctgccaccgcccgacctgggcacaggcacagatggccctgccggctccgacaccagccccttccgcagcggcacgcccatgaaggaggccgtgggccacaccggctacctgaccttcgccaccaagaccccaggctagggggccgcctcccagggcaccagggagctgggagcactgaagggctgggcagggaggccagaggcaccttatatggtcagcgatgcctgccagacacagacggtggggtggggcttgggggcctcctgggtggccagagtgggacagcaggaagggcggctgtgatggaggagcagtgctggggctgggcctcagccattcctgtccagccctgtggcccatcccagctgctgtttgttgccaatatgaagtatccactgccacaggctcccctgggtgttgaagccaaagggtgcaggtgggggagtctgaccccctcccaggtgggcctaagcaggaagggggtggaggagggaggggggcattgaccctgagaccacgctgcgtctgacccctgggcccccacggccctggctgccccacggggcctgagaccatctcgtgcttctccagtccccgggccgaggctccagccttggccagaagctggggtgagctgacccagaatccctgccctgctctccccagcgctaggagaccaggccagcccaggaaccagggaggtgaccctgctctctggcctcctggctgatgtcacagcactgagctcagcccaggccttcgtccactcatgtccaagaggcggggcatcccccacccagccagagcccctgacatgggctgcactcgctgaggccaggcagcgctgcggagaggagcggcagagtgggttgttgccgctggtgcctagggggcctgggtttctgcccaggcagccagtggctgttgggagcctctgtttcccctgtgctgggggccttgagtgctatgctagcaggggcctggccccaagtgtgagtgatgagcaataaacgtaccgtccccctc

SEQ ID NO: 17239 - DNA, 1500 bp, Homo sapiens
  misc_feature (4)..(4): n is a, c, g, or t
ggcncgagccggaagtgttgtggccgccgccgccgcgcgtcgcggaggcacgtgtggagccccggcagcaggagcgtcgcaggtccttggcccttgccagacattagcaccatgagcttcgtggcatacgaggagctgatcaaggagggtgacacggccatcctgtcactgggccatggtgcaatggtggcagtgcgtgtgcagcgtggggcacagacccagacccggcatggtgtcctgcggcactcagttgaccttatcggccgccccttcggctccaaggtgacgtgcggccgaggtggctgggtgtatgtgctgcaccccacgcccgagctctggacgctgaacctgccgcaccgcacgcagatcctctactccacagacatcgccctcatcaccatgatgttggagcttcggcccggctctgtggtctgtgagtctggcaccggcagtggctctgtgtcccacgccatcatccgcaccattgcacccacgggtcacctgcacacggtggagttccaccagcagcgggcagagaaggcccgggaggagttccaggagcaccgtgtgggccgctgggtgactgtgcgcacccaggacgtgtgccgcagtggctttggcgtgagccacgtggccgacgccgtcttcctggacatcccatcaccctgggaggccgtgggccacgcctgggacgccctcaaggtcgaaggcgggcgcttctgctccttctcaccgtgcatcgagcaggtgcaacgcacatgccaggcgctggcagcgcgcggcttctcagagctgagcaccctggaggtgctgccacaggtctacaacgtgcgcactgtcagcctgccaccgcccgacctgggcacaggcacagatggccctgccggctccgacaccagccccttccgcagcggcacgcccatgaaggaggccgtgggccacaccggctacctgaccttcgccaccaagaccccaggctagggggccgcctcccagggcaccagggagctgggagcactgaagggctgggcagggaggccagaggcaccttatatggtcagcgatgcctgccagacacagacggtggggtggggcttgggggcctcctgggtggccagagtgggacagcaggaagggcggctgtgatggaggagcagtgctggggctgggcctcagccattcctgtccagccctgtggcccatcccagctgctgtttgttgccaatatgaagtatccactgccacaggctcccctgggtgttgaagccaaagggtgcaggtgggggagtctgaccccctcccaggtgggcctaacagtgcctgtgtcagccatggggcccttggagctgccgctggtgcctagggggcctgggtttctgcccaggcagccagtggctgttgggagcctctgtttcccctgtgctgggggccttgagtgctatgctagcaggggcctggccccaagtgtgagtgatgagcaataaacgtaccgtccccctc

SEQ ID NO: 17240 - DNA, 2873 bp, Homo sapiens
  misc_feature (4)..(4): n is a, c, g, or t
  misc_feature (2074)..(2074): n is a, c, g, or t
ggcncgagccggaagtgttgtggccgccgccgccgcgcgtcgcggaggcacgtgtggagccccggcagcaggagcgtcgcaggcaccggcagtggctctgtgtcccacgccatcatccgcaccattgcacccacgggtcacctgcacacggtggagttccaccagcagcgggcagagaaggcccgggaggagttccaggagcaccgtgtgggccgctgggtgactgtgcgcacccaggacgtgtgccgcagtggctttggcgtgagccacgtggccgacgccgtcttcctggacatcccatcaccctgggaggccgtgggccacgcctgggacgccctcaaggtcgaaggcgggcgcttctgctccttctcaccgtgcatcgagcaggtgcaacgcacatgccaggcgctggcagcgcgcggcttctcagagctgagcaccctggaggtgctgccacaggtctacaacgtgcgcactgtcagcctgccaccgcccgacctgggcacaggcacagatggccctgccggctccgacaccagccccttccgcagcggcacgcccatgaaggaggccgtgggccacaccggctacctgaccttcgccaccaagaccccaggctagggggccgcctcccagggcaccagggagctgggagcactgaagggctgggcagggaggccagaggcaccttatatggtcagcgatgcctgccagacacagacggtggggtggggcttgggggcctcctgggtggccagagtgggacagcaggaagggcggctgtgatggaggagcagtgctggggctgggcctcagccattcctgtccagccctgtggcccatcccagctgctgtttgttgccaatatgaagtatccactgccacaggctcccctgggtgttgaagccaaagggtgcaggtgggggagtctgaccccctcccaggtgggcctaagcaggaagggggtggaggagggaggggggcattgaccctgagaccacgctgcgtctgacccctgggcccccacggccctggctgccccacggggcctgagaccatctcgtgcttctccagtccccgggccgaggctccagccttggccagaagctggggtgagctgacccagaatccctgccctgctctccccagcgctaggagaccaggccagcccaggaaccagggaggtgaccctgctctctggcctcctggctgatgtcacagcactgagctcagcccaggccttcgtccactcatgtccaagaggcggggcatcccccacccagccagagcccctgacatgggctgcactcgctgaggccaggcagcgctgcggagaggagcggcagagtgggttgtctgccgcaggcaaccaggcaagtgtgtcggggctggggtgtgaatgccagcctgtgagtcccggaactatgtgggtacccctacccctcacagaagccaagggcatggaggaggtccctccacagtgacaacggtgtggggtaggggaggtgcattcaggacaccacccagggacagtgcctatgtgatcacctcttaaaggctaagcttaggggcatttcccaaagtggggacagagggcaggacgcccaggctgggggctctcctcgcccgccctggtgtctgacagcctcaaggaaggagcagtgcctgtgtcagccatggggcccttggagctgccgctggtgcctagggggcctgggtttctgcccaggcagccagtggctgttgggagcctctgtttcccctgtgctgggggccttgagtgctatgctagcaggggcctggccccaagtgtgagtgatgagcaataaacgtaccgtccccctctgttctgagtgatccctagcagccaaggccacccccagctgctgtctaggccagccctacctgcgctctgcccctggtccctgctcctccctgtcctggtttggcatgataggcgctccagtctccaggacaaaggggcaaatgtgtggccacccccatctggctgcagaaaaggccactccttcctggggttggggtggtccaggagtgctgggccttcttccacagncctgggctggaattcagtgtggctgcctgggttacttgtatgcgcccctgaaggaagggtccactccaggccgcctggtccctgcgaagtgtcacactgtgggtcaccgggggctgtggctaatgtggtccgggaggcctgtgtccctgagagttgctcagccctgctccgagggcttgtcctctccttccaggacccagcttcccttctaaccttgttactcacctggggcacagaggaggggcccccagtcaggttcaacatggaagtgggtgaccctaatgccaggagctttggggtcaggctgtccctggggtgtcatgaactgggtgacgcacacccctgagatctcagttcccccaagcctgccctgcccctcctggccacagcaaaggcctgcatggtgtctgatgggtggacaccgggaggtgtttctttgaggcgcagctccatggtttgtaggacacataggcctcaggcactgtagggtccaggttgtgcccattttccagccggggctggttgccctggtggcagccctgggtgagtcaccagggtccgcacatggagagcgggaggtcccagcccacccttagttgtcacatgggacagagttgctgtgtcaatcccctcggccctgctgctctgccctgcacacaggcccccatgatgaccttgagcctccaggcatccacccccaccgtatggccctctagacccagctgggcctcaccccactccctcagcttggatcctcacgtggcctggagccagcattaaactcctgtatgtccttcaa

SEQ ID NO: 17241 - DNA, 1990 bp, Homo sapiens
  misc_feature (1191)..(1191): n is a, c, g, or t
taaactaacggctgaggtatgaggctgggttgttgaatcaggccgaggaaacccctcccaggtgggcctaagcaggaagggggtggaggagggaggggggcattgaccctgagaccacgctgcgtctgacccctgggcccccacggccctggctgccccacggggcctgagaccatctcgtgcttctccagtccccgggccgaggctccagccttggccagaagctggggtgagctgacccagaatccctgccctgctctccccagcgctaggagaccaggccagcccaggaaccagggaggtgaccctgctctctggcctcctggctgatgtcacagcactgagctcagcccaggccttcgtccactcatgtccaagaggcggggcatcccccacccagccagagcccctgacatgggctgcactcgctgaggccaggcagcgctgcggagaggagcggcagagtgggttgtctgccgcaggcaaccaggcaagtgtgtcggggctggggtgtgaatgccagcctgtgagtcccggaactatgtgggtacccctacccctcacagaagccaagggcatggaggaggtccctccacagtgacaacggtgtggggtaggggaggtgcattcaggacaccacccagggacagtgcctatgtgatcacctcttaaaggctaagcttaggggcatttcccaaagtggggacagagggcaggacgcccaggctgggggctctcctcgcccgccctggtgtctgacagcctcaaggaaggagcagtgcctgtgtcagccatggggcccttggagctgccgctggtgcctagggggcctgggtttctgcccaggcagccagtggctgttgggagcctctgtttcccctgtgctgggggccttgagtgctatgctagcaggggcctggccccaagtgtgagtgatgagcaataaacgtaccgtccccctctgttctgagtgatccctagcagccaaggccacccccagctgctgtctaggccagccctacctgcgctctgcccctggtccctgctcctccctgtcctggtttggcatgataggcgctccagtctccaggacaaaggggcaaatgtgtggccacccccatctggctgcagaaaaggccactccttcctggggttggggtggtccaggagtgctgggccttcttccacagncctgggctggaattcagtgtggctgcctgggttacttgtatgcgcccctgaaggaagggtccactccaggccgcctggtccctgcgaagtgtcacactgtgggtcaccgggggctgtggctaatgtggtccgggaggcctgtgtccctgagagttgctcagccctgctccgagggcttgtcctctccttccaggacccagcttcccttctaaccttgttactcacctggggcacagaggaggggcccccagtcaggttcaacatggaagtgggtgaccctaatgccaggagctttggggtcaggctgtccctggggtgtcatgaactgggtgacgcacacccctgagatctcagttcccccaagcctgccctgcccctcctggccacagcaaaggcctgcatggtgtctgatgggtggacaccgggaggtgtttctttgaggcgcagctccatggtttgtaggacacataggcctcaggcactgtagggtccaggttgtgcccattttccagccggggctggttgccctggtggcagccctgggtgagtcaccagggtccgcacatggagagcgggaggtcccagcccacccttagttgtcacatgggacagagttgctgtgtcaatcccctcggccctgctgctctgccctgcacacaggcccccatgatgaccttgagcctccaggcatccacccccaccgtatggccctctagacccagctgggcctcaccccactccctcagcttggatcctcacgtggcctggagccagcattaaactcctgtatgtccttcaa

SEQ ID NO: 17242 - DNA, 875 bp, Homo sapiens
ccagcttctggccaaggctgggtcagctcaccccagcttctggccaaggctggagcctcggcccggggactggagaagcacgagatggtctcaggccccgtggggcagccaggccgtgggggcccaggggtcagaagctggggtgagctgacccagaatccctgccctgctctccccagcgctaggagaccaggccagcccaggaaccagggaggtgaccctgctctctggcctcctggctgatgtcacagcactgagctcagcccaggccttcgtccactcatgtccaagaggcggggcatcccccacccagccagagcccctgacatgggctgcactcgctgaggccaggcagcgctgcggagaggagcggcagagtgggttgtctgccgcaggcaaccaggcaagtgtgtcggggctggggtgtgaatgccagcctgtgagtcccggaactatgtgggtacccctacccctcacagaagccaagggcatggaggaggtccctccacagtgacaacggtgtggggtaggggaggtgcattcaggacaccacccagggacagtgcctatgtgatcacctcttaaaggctaagcttaggggcatttcccaaagtggggacagagggcaggacgcccaggctgggggctctcctcgcccgccctggtgtctgacagcctcaaggaaggagcagtgcctgtgtcagccatggggcccttggagctgccgctggtgcctagggggcctgggtttctgcccaggcagccagtggctgttgggagcctctgtttcccctgtgctgggggccttgagtgctatgctagcaggggcctggccccaagtgtgagtgatgagcaataaacgtaccgtccccctc

SEQ ID NO: 17243 - DNA, 652 bp, Homo sapiens
gaagggtgatgggagggtcgggtcctcactccgggaatccttgggaccgaactccgccattgccaagcctcagtcttttcatctctgatttaggctcatagtccctgtctcttgtcctagaccaagaaaggcttcagaggccaggccagagtgcagcgctattgggctccctgtcaggcagtggcagagactgaggctgagctagccacaccccgcccatgcccactgctgggatgtaggcctcgaagccttctacctagaccctaggccctcatcctgcctcctgacttgctcatgcctacacacacccctccccaggtccttggcccttgccagacattagcaccatgagcttcgtggcatacgaggagctgatcaaggagggtgacacggccatcctgtcactgggccatggtgcaatggtggcagtgcgtgtgcagcgtggggcacagacccagacccggcatggtgtcctgcggcactcagttgaccttatcggccgccccttcggctccaaggtgacgtgcggccgaggtggctgggtgtatgtgctgcaccccacgcccgagctctggacgctgaacctgccgcaccgcacgcagatcctctactccacagacatcgccctcatcaccatgatgttggagcttcg

SEQ ID NO: 17244 - DNA, 6939 bp, Homo sapiens
tttccagccaacgccaaacagtgactgttgacaatttcatattgtcatcaggggaaccaaggcttattcagatgcctatttcagaacctaggacagttccattgaaaaggcgcaggcgttcgggctggctgactagatggatcaggcctggctgcctgatggctatattcctccttcctccctctccacttccatctcaacccttgaggctgcatattgaatagttggagaattcagtgaactaagagatgcaaatgcacagtacaaaattcaaatgtccaattcggggcagggctgcatctaactttaatggcaaccactgcatgtgatgtctggggactctatagatacatggcctcagaccctgaagacatctggattctgtcactggattgttcacaaagtgaggctgaactttccacaggacgaagtcttcaggctggccgcctccctcgggaacctggggcttgagccaggtgccgccctatggatgggagatgacggcaaaccgagatgggcgagactacttcatcaatcacatgacacaggcaatcccttttgacgaccctcggttagagagctgccaaatcatccctccggctcctcggaaggtggagatgagaagggaccccgtgctgggatttggttttgtggcaggcagtgaaaagccagtggtcgttcgctcagtaacaccaggtggcccctctgaaggcaagctgatcccgggagatcagattgtaatgattaatgatgaaccggtcagcgctgcacccagagagcgggtcatcgatctggtcagaagctgcaaagaatcgatactcctcactgtcattcagccttacccttctcccaaatcagcatttattagtgctgcaaaaaaggcaagattaaagtccaatcctgtcaaagtacgcttctctgaggaggtcatcatcaacggccaagtgtcggaaactgttaaggacaactcacttctttttatgccaaatgttttgaaagtctatctggaaaatgggcagaccaaatcatttcgttttgactgcagcacttccattaaggatgtcatcttaacccttcaagagaagctctccatcaaaggcattgaacacttctctctcatgctggagcagaggacagaaggggctggaacgaagctgctcttgcttcatgaacaggagactctaactcaggtgacacagaggcccagctcccataagatgagatgtcttttccgaattagcttcgtcccaaaagatccaattgaccttttaaggagagatccagttgctttcgagtatctctatgttcagagttgtaacgatgtggttcaggagcgatttgggccggagctgaaatatgacatagccctgcggctggccgcattacaaatgtacattgcaaccgttaccaccaagcaaacgcagaaaatctccctcaaatacatcgaaaaagaatggggattagagacttttcttccctctgctgtgctgcaaagcatgaaagagaagaacataaagaaagcactttcacaccttgtcaaagcaaatcaaaacttggtaccaccgggtaaaaagctctctgcactacaagccaaggtccattatctcaagttcctcagtgacctacgattgtatgggggccgtgtgttcaaggcaacattagtgcaggcagaaaagcgctcggaagtgactctcctggttgggccccggtatggcataagccatgtcatcaacaccaaaaccaatctggtggctcttttagccgactttagccacgtcaacaggatcgaaatgttttccgaggaggagagcttggtgcgggtagaactccacgtgctagatgtgaagcctatcacgcttctgatggaatcctcagatgccatgaacctggcctgcttgacggctggatactaccggctgcttgttgattccaggaggtcgatatttaacatggccaacaagaaaaacacagcgacccaggaaacaggacctgaaaacaaggggaagcataacctccttggcccagattggaactgtataccccaaatgaccacctttattggcgaaggggaacaagaagcccagataacatacatagattcaaagcagaagacggtggagatcacagacagcaccatgtgtccaaaagagcaccggcacttgtacatagacaatgcctatagttcagatggacttaaccagcagctgagccagcccggggaggccccctgtgaggcagactacagaagtctagctcagcggtccctattgaccctctcaggaccagaaactctgaagaaagcacaggaatctccgagaggagctaaagtgtcctttatttttggagacttcgccttggatgatggtattagtcccccaacccttggctatgaaacgctactagatgagggtcctgaaatgctggagaagcagagaaatctctacattggcagtgccaatgacatgaagggcctggatctcactccagaggcagagggcatccagtttgtggaaaattctgtttatgcaaacataggcgatgtgaagagcttccaggccgcggaggggatcgaggaacccctcttgcatgacatctgttatgcagaaaacactgatgacgcggaggacgaggacgaggtgagctgcgaggaggacctcgtggtgggggagatgaaccagccggccatcctcaacctgtctgggtcaagcgatgacatcattgacctcacatccctgccccctccagaaggtgatgacaatgaggatgacttcctgttgcgttccttgaacatggccattgccgcacccccacctggctttagagacagttcagatgaagaggactctcagagccaggcagcttccttccccgaggacaaggagaaaggcagcagcctgcaaaatgatgagatccccgtgtccctcattgacgctgtgcccaccagcgccgaaggcaagtgtgagaagggactggataatgccgtcgtctccacgctgggagctctagaggctctatccgtgtcagaagaacagcagaccagtgacaattcaggtgtagccatcttgcgggcttatagtcctgagtcttcgtcagactcgggcaatgaaactaactcttctgaaatgactgagagttctgaactggccacagcacaaaaacagtcagaaaacctctcccgcatgttcttggccactcacgaaggctaccacccccttgcagaagagcagaccgagttcccggcctccaagacccccgctgggggcttgcctccaaagtcctcgcacgccctggctgctaggccagcaaccgacctcccgcccaaagttgtgccttccaagcagttacttcactcagaccacatggagatggagcctgaaactatggagactaagtcggtcactgactattttagcaaactgcacatggggtcggtggcatactcctgcactagcaaaaggaaaagcaagctggccgatggtgaggggaaggcaccccctaatgggaacacaacaggaaaaaaacagcaggggaccaaaacggcagagatggaggaggaggccagtggtaaatttggtactgtgtcttcacgagacagtcaacacctgagcacttttaatctggagagaactgcctttcgcaaggacagtcaaagatggtatgtggccactgaaggtgggatggctgaaaaaagtggattagaagcagcaacagggaaaacctttccaagagcttctggtcttggggcaagggaggccgaagggaaggaagaaggagctcctgatggagaaaccagtgatggctcaggacttggtcaaggggaccgcttcttaactgacgtgacctgtgcatcttcagccaaagacttagataacccagaggacgctgactcgtccacctgcgaccatccttccaagcttcctgaggctgatgagagtgtggcccgcctttgtgactaccacttggccaagcggatgtcatcactgcaaagcgagggccatttttctctgcagagctcccaaggctcttcagtggatgcaggctgtggcacaggcagcagtggcagtgcctgtgccacacccgtggagtcgccgctctgcccctccctggggaagcacttgattcctgacgcttctgggaaaggcgtgaattacattccttcagaggagagagcccctgggcttcccaaccacggagccacctttaaggaactgcacccacagacagaagggatgtgtccacggatgacagtgcctgctctgcacacagccattaacaccgaacccctgtttggcacattgagagatggatgccatcggctccccaagattaaggaaaccacagtgtagctttgacagagcctgggaaggagagacgaggaggcatgccttcagcttggtctcaacatcctgaagctgatcccatcctgctaccatcaaacattcactcggaatcaaaggtgccaattccaaatcaagaccctaatgatttctcccaagcaaatcaggcatacggagaggctgtgagctggcggccaccggatctgagaggggggagcctcaggacacctcccagccagaaggctctgagacatagcagcagtatcctctccggatctgtcgatttggagaccttccgagagagaaccaagggtgcagtcagcttaaagtgtccaggcatcacagaagcacaggaggccagttctgaaaggcgagcagaactccccctggggaggaagctcaccaaaagtttttcccaaagctcaatgcacttgagctctgaggggaggtttcacaaaaggtccccagtggctcataaagactcaaagctgtataggacattacccttgcggaagctggagggcagcaattggagatgccggggacccttcagctattgcttcctgaaccgagggcaggatgaagatggtgaggaagaagaggagaggggagaggccaccgtccaggtctcttgcctctatagaccacaggtgactcaagccatgccagaaccaagcagcccatgcctggctgtggcgattcagaagcaacgaggggagctatccagagggtcagtgctgaaggtctgggcagaagacctgcgagacccagatgacttggacttcagcaacctggcttttgatgcccggattgcaagaataaatgccctaaaggagagcacatatgcaatgcctgatgggttccttgcagcccaaaatgatgccaatgagctgctctgtctcgtcagggcaaccaaggagaagagggaggagtcacgccctgaagcgtacgaccttacactttctcagtacaagcaactgttatccattgagtccagacagttgggaagtgcctgtaggaaaatggcgatggctgagaaaagcccggaggagatgctcctagctatgacttccagctttcaagtgctctgttgcctaacagaagcttgcatgcgattagttaaagtcgtgaactcagaaacacagcggcaggaaattgtagggaagatcgatgaagtggtcataaattacatttgtctactgaaagctgccgaagcagccactggaaagaaccctggggaccctaatgttggactctcggcgcgacactcaaccaccatggccgctctcgtaagcacactgacacgttctctcaagaggcttttaaacaaataaatatggaagtcacgtcataatctacctttgcaaagccatacatgaacttttatttactttgtgtgtatgatgaacagatgtctcctttcttctctctgtatattttgttattttatataaaataggagataaaagtcacactgatgaaatgttgaaatgtactaatcagatgtattctgtttatattatacatatatatacacgtaaaagaaatatccaagaaagtgatgacatttggctatttttcatatagttaaaactccaggtatatgatgtgaaattttaaattctaccatgttagagcaaaacaatgaatcctatcccctttctttccaagtagctacttggaaaccatatcattcatatttagaagtaaaacacaaaacaaaaaagagagagaaaagaaaagaaatcacaatgtatataaaacagtacttatgttttaaaattatgatttttaagcattggaaatagcaaaaagacatttaaaattcaagaagctattatgaattactagagaatatatctgtaataaattaattttttgctcatagtatttggttactggatgctttcttccaagaatcccacatatttaatttgggtttttgctactggggctacaaattggtggggatggattctactgtgtcagcacaaatgctcttcacagtggttctagcatttaaaaaacttcccggggagaagaacagaggggatgatgggcagtttcctaggtaacacctagagttatagaatatctcattacataaaatgtatggaattaataataccaaaattaattatttgatggaaagatctgctttgactaaatgtcaaaaatctgcaaaccaaagacattatcttcccctcatcccaactcaactacgaaacttaaaattccctttagagtgataggacatttagtaaagtatttgcaaacttaaaaaaaggaacatttaatgatcatcaaaattaagtacagattcagtaatgtagaccagaccacacaccagcacctgtgagtctcatctcagatcacagctctcagcatagggcttcatgcatcaccgcctctacagaggctaaggctgccagtcaaatttggaattatagcgtagtactgggacaaaatctcaaatcttggatgttccagaaaatcagggagtgatggctactgtaatcatgggagccatgagtaaatagttaagtatttattaaataaatacttaatctggattggctgataaaaatatgaaatctgaaaa

SEQ ID NO: 17245 - DNA, 993 bp, Homo sapiens
gattaatagttcatttttttttcccacttggattttgggaattattgcagtctttcttattggtactaattaggtatcactatacttagaattgttaaatctgaatcttatgtaagtaggctttgatataatgtataaattaataaatatattcaagctgggcgcggtagctcacatctataatcccagcactttgggaggctgaggagggcagatcacctcaggtcgggagttctagaccagcctgaccaacatggtgaaaccccgtctctactaaaaatacaaaaattagccgtgcgtagtggccggcacctgtagtcccagctacatgggaggctgaggcaggagaattacttgaaccggggaggtggaggttacagtgagccggaatcgccccattgcactccagcctgggtgacagagcaagactccgtctcaaaaatatatatatatatattcgtagtatagttagacacgaattcttattttttttttttaaacctctgtgtgctaggcgctgctctctgtatggcataaaagctgggtttttacactactgtacagagtattctcagcctcaaaccagcgtctggctagttttgacagtgtggagcaatggtgacccatggtccttaggatgactgctcagggacaatttctagtgattcctgcagttttgataaattataatgaaaggtagattgatttctttctaaagagaacgttactttcagagaaagccgggaactctttcagggttagttcaagcaaggaaatctagttttggatttttcagtcccccttaactctcaatatctggttctgaattgcagcttattctcccctctttcattaatagtgtgataatatgcttatagtttgcattcctctgatggtcaatatcttgtgtaagtatggaggaaaccagtaagccaaaaccaccagagtctcaggtcagttttaagtccaaattcagatcttacatatactcca

SEQ ID NO: 17246 - DNA, 423 bp, Homo sapiens
gagtgtctgatatatagtggggactccatgaactcgttccttcctggatgagctggtttagaacatctagaaatggtcatagtggaaataggggtattttaatttttatcacctggttaatattgggaagttcactgagcctttagatagatgtgccctttgatatcttccttgattttcttggggggagaaaagcttagaatataaactcagaaggttcaaatcccatctcctcttttcccagcaacatctccatgagcatctccaacttttctggcttctccttctccatctacgtaatgagagcaatcataagtccttggaggattgtagcgaggatcaaatcataacgtatgatgctgcctggtagtagtaactggttcctacacaagttttacctagtgacaacttgaaagctaacac

SEQ ID NO: 17247 - DNA, 432 bp, Homo sapiens
agtattgtaacatcacggtgtagtaggaaagaatgttggcgaattgaatccagttttaggctctgctcctattaggcaagtggcttcttttttcctgggcctcagtttcctcatctgtaaaatgagtgaattatattagctgctctccagaaacctttagccatgtgcacagtttgaataatttcattttaatttggaaaagaataaacttgttaagcatttgaaaatcaaatagaaaacatgagggaagaaagctatatttagtgtagacatttacattttttaaattaaactctacattatgatattggtaataagaattagaatgagacagtctttactattctctccctagctctaatatggcacagatgtgataataaagtccatatgcagccttgaagaaagtgtttgattagacataaaatgtta

SEQ ID NO: 17248 - DNA, 297 bp, Homo sapiens
tattagttgtaagccaaaacatgttttaaaagttgctggaatagcattgaacaatttaactttcattgaaataggcatatatatgccttctcttgataaaggagacgtgcatatggatattgaataagtttcatttcaagataatgaaataggcacttagccttcatcctctgtctatagttcagaaggatcacatcttctcctgtcttggagttcctggttaacttttagttaaaaatggtgactcctctcctccagcagaccccttccctactttctgtctacacattgacctgt

SEQ ID NO: 17249 - DNA, 1029 bp, Homo sapiens
atccctgctccggacaggtgtggggtgcacactgaaaatgccacgctccttcctggtgaagagcaagaaggctcacacctaccaccagccccgtgtgcaggaagatgaaccgctctggcctcctgcccttaccccggtgcccagagaccaggctccaagcaacagccctgtccttagcactctattcccaaaccagtgcctggactggaccaacctcaaacgagagccggagctggagcaggaccagaacttggccaggatggccccggcaccagagggccccattgtgctgtcccgaccccaggatggggactctccactgtccgactcacccccattctacaagcctagcttctcctgggacaccttggccacaacctatggccacagctaccggcaggccccctccaccatgcagtcagccttcctggagcactccgtcagcctgtacggcagtcctcttgtgcccagcactgagcccgccttggacttcagcctccgctactccccaggcatggatgcgtaccactgtgtgaagtgcaacaaggtcttctccacccctcacgggctcgaagtgcatgtgcgacgctcccatagtgggacccggcccttcgcctgtgacatctgcggcaaaaccttcggccacgctgtgagcctggagcagcacacgcacgtccactcccaggagcgcacttcgagtgccgcatgtgcggcaaggccttcaagcgctcgtccacgctgtccacccacctgctcatccactcagacacgcggccctacccctgccagttctgcggcaagcgtttccaccagaagtccgacatgaagaagcacacctacatccacacaggtgagaagccgcacaagtgccaggtgtgcggaaaggccttcagccagagctccaacctcatcacccacagccgcaagcacacaggcttcaagcccttcagctgtgagctgtgcaccaaaggcttccagcgcaaggtggacctgcggcggcaccgcgagagccagcacaatctcaagtga

SEQ ID NO: 17250 - DNA, 456 bp, Homo sapiens
ctacgcaagtctagattctgccttgaatccagcttcctgtgtccagtgccagacagcgagacaggatactggcagttcggactgccctggacattgccccatccttgggcaatgctggcatggcatggtgaaatgaaagccctaggtcttcccgaaagctgcccttgcctctgccaagacaggagatcagaaataacccggtcttgtttttatgcctccagcgagtgggcccactccatgcctttccaagcaaccacattcctccttgctgtagttgtgggacactgggttgaagcaccccttgacctttatctggtagatgagaataacaatccctgtctggctgggtggatgtgctgctttacgggagattatttaatacatgttacataggtagcatggtacctgggaggaaagagatgtctcagaaatgttacatgccagttttcatcatcc

SEQ ID NO: 17251 - DNA, 387 bp, Homo sapiens
aaattcagatgttaaaaaacttctaatatattataaaacagtcaaaatttcccccaaggagttagcaaggtcaaacatatgaacatatatacaaatattttagttaatggaactggaggccattatcctaactgaaatatctcagaaacagaaagtcaaatacttcatgtttccacttataagtgggagctaaacaatgggtacatgtggtcctacagagtgaaataatagacactggcgattacagaaggtgggagggtaagaggagggtcaggctcaaaaaaattacctgttgggtacaacgttcgctattcagaagatgggtatgctaaaagcccagacttcaccacgacacaatgaatgtgaaacctgcacttgtactctcta

SEQ ID NO: 17252 - DNA, 639 bp, Homo sapiens
gagaacgccgggaccgaactcttgctgcagggttttgagcgccgcttcctggcggtgcgcacactgcgctccttcccctggcagagcttagaggcaaagttaagagactcatcagattctgagctgctgcgggatattttgcagaagactgtgaggcatcctgtgtgtgtgaagcacccgccgtcagtcaagtatgcctggtgctttctctcagaactcatcaaaaagtcctcaggaggctcggtcacactctccaagagcacagccatcatctcccacggtaccacaggcctggtcacatgggatgccgccctctaccttgcagaatgggccatcgagaacccggcagccttcattaacaggactgtcctagagcttggcagtggtgccggcctcacaggccttgccatctgcaagatgtgccgcccccgggcatacatcttcagcgaccctcacagccggatcctcgagcagctccgagggaatgtccttctcaatggcctctcattagaggcagacatcactggcaacttagacagccccagggtgacagtggcccagctggactgggacgtagcaatggtccatcagctctctgccttccagccagatgttgtcattgcagcaggtaatgcccag

SEQ ID NO: 17253 - DNA, 381 bp, Homo sapiens
taactccctcacttggacttgagacccttccctaactccctcacttggacttgagacccttcacaacccagcagcgctccacctccaacttgacatcatgctttctggaaacttccccgtatgtcccactttcccacacttggtgccctggagcaccttccggcctctacatgctgtacgttcccctgtgagcaccctcctctcggcctctggccaacacagtcccacccatctgtgggtaacaagggggtgtgggtgttcttttcagccttgctaaactgtctgaatcaaggatcacaaactacagcctgcaggccaaatccagcccacagcctgtgtttgtaaataaagctttgttggaacaaagccacaccccttaat

SEQ ID NO: 17254 - DNA, 1611 bp, Homo sapiens
gagaacgccgggaccgaactcttgctgcagggttttgagcgccgcttcctggcggtgcgcacactgcgctccttcccctggcagagcttagaggcaaagttaagagactcatcagattctgagctgctgcgggatattttgcagaagactgtgaggcatcctgtgtgtgtgaagcacccgccgtcagtcaagtatgcctggtgctttctctcagaactcatcaaaaagcacgaggctgtccacacggagcctttggacaaactgtacgaggtgctcgcggagactctgatggccaaggagtccacccagggccaccggagctatttgctgtcctcaggaggctcggtcacactctccaagagcacagccatcatctcccacggtaccacaggcctggtcacatgggatgccgccctctaccttgcagaatgggccatcgagaacccggcagccttcattaacagacgtgctgtattgcccagaagccatcgtgtcgctggtcggggtcctgcagaggctggctgcctgccgggagcacaagcgggctcctgaggtctacgtggcctttaccgtccgcaacccagagacatgccagctgttcaccaccgagctaggccgggatgggatcagatgggaagcggaagctcatcatgaccagaaactgtttccctatggagagcacttggagatggcaatgctgaacctcacactgtaggactcacacatgactccaaagggattgtgagaatcaagtcactctcgtgggaagaatttttatatgggaaagtggataaaactttcattggactggaatgtttggagattattaaactccaaatcaggaatcaaaactgccctctaataagacattagctgtctaggcgtgtgggtgccccctttctgccagcagttctggttctcaagaaaatcatcataaatcagacatgaaaattctggctccaaaaatagcattttctttctgcaaataaaaacgtgtgtatcaaggatgacgttcccccaacgtggacacactcagttcctcagaaagccaagcccgctgcagctgccacatccctggacacactcggttcctcacaaagccaagcccgctgcagctgccacatcccagggcttatggtgcagcaggcgcttttttcaagacaggaatgaaagtgttaggaacacggcagaaaggtgacacctggagaccaaatgcaggatgaggagtactgcagaggtcacagggaagtcacagaacagtaatacgctagcaggggcatggggcatgaagaacagaagacaggaagcatttcagagactccaaagaagaaatcagggccaaccacagcttcccgggtcattcaccaggtgacaccactgccgtcatttcagcttctggccactgggaggcgctgctcgaaaggctttgccctgagaccccaagaagctgcgggaaggacagcaggggccctggggttttagcctctggcccaggagttatgtgtccataaccaaagggagcacagtctgcacccagctctcatcccatcagagctgctgagactcttgcaggttcttccagaactggtttagcttgcctgcaggatcaga

SEQ ID NO: 17255 - DNA, 1709 bp, Homo sapiens
gagaacgccgggaccgaactcttgctgcagggttttgagcgccgcttcctggcggtgcgcacactgcgctccttcccctggcagagcttagaggcaaagttaagagactcatcagattctgagctgctgcgggatattttgcagaagactgtgaggcatcctgtgtgtgtgaagcacccgccgtcagtcaagtatgcctggtgctttctctcagaactcatcaaaaagcacgaggctgtccacacggagcctttggacaaactgtacgaggtgctcgcggagactctgatggccaaggagtccacccagggccaccggagctatttgctgtcctcaggaggctcggtcacactctccaagagcacagccatcatctcccacggtaccacaggcctggtcacatgggatgccgccctctaccttgcagaatgggccatcgagaacccggcagccttcattaacagacgtgctgtattgcccagaagccatcgtgtcgctggtcggggtcctgcagaggctggctgcctgccgggagcacaagcgggctcctgaggtctacgtggcctttaccgtccgcaacccagagacatgccagctgttcaccaccgagctaggccgggatgggatcagatgggaagcggaagctcatcatgaccagaaactgtttccctatggagagcacttggagatggcaatgctgaacctcacactgtaggactcacacatgactccaaagggattgtgagaatcaagtcactctcgtgggaagaatttttatatgggaaagtggataaaactttcattggactggaatgtttggagattattaaactccaaatcaggaatcaaaactgccctctaataagacattagctgtctaggcgtgtgggtgccccctttctgccagcagttctggttctcaagaaaatcatcataaatcagacatgaaaattctggctccaaaaatagcattttctttctgcaaataaaaacgtgtgtatcaaggatgacgttcccccaacgtggacacactcagttcctcagaaagccaagcccgctgcagctgccacatccctggacacactcggttcctcacaaagccaagcccgctgcagctgccacatcccagggcttatggtgcagcaggcgcttttttcaagacaggaatgaaagtgttaggaacacggcagaaaggtgacacctggagaccaaatgcaggatgaggagtactgcagaggtcacagggaagtcacagaacagtaatacgctagcaggggcatggggcatgaagaacagaagacaggaagcatttcagagactccaaagaagaaatcagggccaaccacagcttcccggtccctaactccctcacttggacttgagacccttcacaacccagcagcgctccacctccaacttgacatcatgctttctggaaacttccccgtatgtcccactttcccacacttggtgccctggagcaccttccggcctctacatgctgtacgttcccctgtgagcaccctcctctcggcctctggccaacacagtcccacccatctgtgggtaacaagggggtgtgggtgttcttttcagccttgctaaactgtctgaatcaaggatcacaaactacagcctgcaggccaaatccagcccacagcctgtgtttgtaaataaagctttgttggaacaaagccacaccccttaat

SEQ ID NO: 17256 - DNA, 1509 bp, Homo sapiens
gagaacgccgggaccgaactcttgctgcagggttttgagcgccgcttcctggcggtgcgcacactgcgctccttcccctggcagagcttagaggcaaagttaagagactcatcagattctgagctgctgcgggatattttgcagaagactgtgaggcatcctgtgtgtgtgaagcacccgccgtcagtcaagtatgcctggtgctttctctcagaactcatcaaaaagtcctcaggaggctcggtcacactctccaagagcacagccatcatctcccacggtaccacaggcctggtcacatgggatgccgccctctaccttgcagaatgggccatcgagaacccggcagccttcattaacagacgtgctgtattgcccagaagccatcgtgtcgctggtcggggtcctgcagaggctggctgcctgccgggagcacaagcgggctcctgaggtctacgtggcctttaccgtccgcaacccagagacatgccagctgttcaccaccgagctaggccgggatgggatcagatgggaagcggaagctcatcatgaccagaaactgtttccctatggagagcacttggagatggcaatgctgaacctcacactgtaggactcacacatgactccaaagggattgtgagaatcaagtcactctcgtgggaagaatttttatatgggaaagtggataaaactttcattggactggaatgtttggagattattaaactccaaatcaggaatcaaaactgccctctaataagacattagctgtctaggcgtgtgggtgccccctttctgccagcagttctggttctcaagaaaatcatcataaatcagacatgaaaattctggctccaaaaatagcattttctttctgcaaataaaaacgtgtgtatcaaggatgacgttcccccaacgtggacacactcagttcctcagaaagccaagcccgctgcagctgccacatccctggacacactcggttcctcacaaagccaagcccgctgcagctgccacatcccagggcttatggtgcagcaggcgcttttttcaagacaggaatgaaagtgttaggaacacggcagaaaggtgacacctggagaccaaatgcaggatgaggagtactgcagaggtcacagggaagtcacagaacagtaatacgctagcaggggcatggggcatgaagaacagaagacaggaagcatttcagagactccaaagaagaaatcagggccaaccacagcttcccgggtcattcaccaggtgacaccactgccgtcatttcagcttctggccactgggaggcgctgctcgaaaggctttgccctgagaccccaagaagctgcgggaaggacagcaggggccctggggttttagcctctggcccaggagttatgtgtccataaccaaagggagcacagtctgcacccagctctcatcccatcagagctgctgagactcttgcaggttcttccagaactggtttagcttgcctgcaggatcaga

SEQ ID NO: 17257 - DNA, 1753 bp, Homo sapiens
gagaacgccgggaccgaactcttgctgcagggttttgagcgccgcttcctggcggtgcgcacactgcgctccttcccctggcagagcttagaggcaaagttaagagactcatcagattctgagctgctgcgggatattttgcagaagactgtgaggcatcctgtgtgtgtgaagcacccgccgtcagtcaagtatgcctggtgctttctctcagaactcatcaaaaagcacgaggctgtccacacggagcctttggacaaactgtacgaggtgctcgcggagactctgatggccaaggagtccacccagggccaccggagctatttgctgtcctcaggaggctcggtcacactctccaagagcacagccatcatctcccacggtaccacaggcctggtcacatgggatgccgccctctaccttgcagaatgggccatcgagaacccggcagccttcattaacagacgtgctgtattgcccagaagccatcgtgtcgctggtcggggtcctgcagaggctggctgcctgccgggagcacaagcgggctcctgaggtctacgtggcctttaccgtccgcaacccagagacatgccagctgttcaccaccgagctaggtgaacccccacgcccacccgggcctacatggtgcccgagctgtccctgcaggactccagtggaagtgaaagaactgggcgctggggaaaagctaggatgctccacactcccacactatgcggggaactcgggcagaggccggccgggatgggatcagatgggaagcggaagctcatcatgaccagaaactgtttccctatggagagcacttggagatggcaatgctgaacctcacactgtaggactcacacatgactccaaagggattgtgagaatcaagtcactctcgtgggaagaatttttatatgggaaagtggataaaactttcattggactggaatgtttggagattattaaactccaaatcaggaatcaaaactgccctctaataagacattagctgtctaggcgtgtgggtgccccctttctgccagcagttctggttctcaagaaaatcatcataaatcagacatgaaaattctggctccaaaaatagcattttctttctgcaaataaaaacgtgtgtatcaaggatgacgttcccccaacgtggacacactcagttcctcagaaagccaagcccgctgcagctgccacatccctggacacactcggttcctcacaaagccaagcccgctgcagctgccacatcccagggcttatggtgcagcaggcgcttttttcaagacaggaatgaaagtgttaggaacacggcagaaaggtgacacctggagaccaaatgcaggatgaggagtactgcagaggtcacagggaagtcacagaacagtaatacgctagcaggggcatggggcatgaagaacagaagacaggaagcatttcagagactccaaagaagaaatcagggccaaccacagcttcccgggtcattcaccaggtgacaccactgccgtcatttcagcttctggccactgggaggcgctgctcgaaaggctttgccctgagaccccaagaagctgcgggaaggacagcaggggccctggggttttagcctctggcccaggagttatgtgtccataaccaaagggagcacagtctgcacccagctctcatcccatcagagctgctgagactcttgcaggttcttccagaactggtttagcttgcctgcaggatcaga

SEQ ID NO: 17258 - DNA, 437 bp, Homo sapiens
tacctttatcttgccaaatccaattagacaggtctgtctgcagtctacctgactgcacagatgcatttaacataatagtcttctgcctccctcttgaaatacattttcacttggtttttgggcccctctcctttctttttttctcttttccagtgccttctcaacttccttagcttgtccttttgccatccctgacccgttaatgggtaggggggcctgtgccttagtcctagagcccccaattcttctcttccttagtcatcccattcaggtttctgactttaaacatcatctacaagctgatgatccccaaatctatacctctagctgtgacttttgactgaactctagactcttacatccaattacctactcaatgtctctatttggttgtctaacagatacgtcaaccttaatatgacctaactctcagtttc

SEQ ID NO: 17259 - DNA, 346 bp, Homo sapiens
gtaggattaaacaatgaaagacaggttatatttttctaacctgtgttttgctgagctgaagcatgaaatatcaaatatttataataaagtattcatagttaagtacactgaatcattaaaatgttggaaatattgaaatggatgatcgatcttattggagtccttgtgtgatacaggaacttctgtatttactgttaacaagaaaaactcaaaaggttacattcctttttagattcagagctcaaatagaattgatttaaaatttaaagcacttctaataagacatttcagcattgcataagttaaacatggagaaaaaaataaatacatttatgtttttctatta

SEQ ID NO: 17260 - DNA, 344 bp, Homo sapiens
agtctcaatttacatttgttgcctgccagatttctggaagaaaacaagtatttattagcttcttaaaatgtatggaagcactgtgctaggcattgttaagaaattatttcaggtgtgagccactgcgcctggcctatatgaattttatatttacctgctcccttcaccaggagatcatgctgctgtgatatcgggttttcttaacagcataaggaagacttgcccccttgccctatcaaagagaatagttttggaggggagaagtggggccaaaaaagatgcagttttcatttgtatagggaaatgtgaaaataaaattgccaactcctttagttaataacaaa

SEQ ID NO: 17261 - DNA, 572 bp, Homo sapiens
ggaagggcatgtgactgactccctcagcgccctgcagtcttgtcccctctggtcccaaaagtgtatcctgccttcgctttgcgataggtttcttcctgccctttgcctggaaattttatctctggttcttgcaaacattatttacagctgtctaattttttctgtctacctcacagctgccaaactaaagtaggtgggaagccattttccctctctaggtcaatgaataccccccgttctccacccgcgcttttgaagattccagcactgctgccaagtcaacccatctgcaggagaacgctttggaaaaaacagactttaaaaagaaaagcaaactgctcttagcccctgatagcttctccacaggagagggaatatggacagagctgaggttcaagacacatgtgctgtttgagctgaatctgtgctgttttcttctttccgtggttacccaacaacgaaggcgtgttgtaccttcttgccttcaaacctgttcctcctcccgtcagatgtccttactcctcaatttgaagttttccttcataggatttctgagaaggactttggaaaaa

SEQ ID NO: 17262 - DNA, 295 bp, Homo sapiens
tgacttacctgatctgattgatgcatttgcagttccaggagatgcctacaccgattatgtagctacgagatggtaccgagctcctgaacttcttgtgggagatactcagtatggttcttcagtcgatatatgggctattggttgtgtttttgcagagctcctgacaggccagccactgtggcctggaaaatcagatgtggaccaactttatctgataatcagaacactaggtatgaattgcattttatggcaacagagttgctgaattgttatagcattcatatgttactataat

SEQ ID NO: 17263 - DNA, 275 bp, Homo sapiens
aaaagcttatatacttaaattaggaatccttaactctcgaacaaaatggtatgtttcccaaatatttctgtctgtatttaaggctggaggtaactgaggcttcattgaaactggttaataatctttgtctaatgaaccttgatttaaaagttggaagtcaaatatgagcacaaaatatttctgtaatggtattagaaaataaaacttccctcttttctcactctctttctcttttaacctctcttcctttccttcaacctcttttctctctcttc

SEQ ID NO: 17264 - DNA, 178 bp, Homo sapiens
gtatttaatataaaaatatatgtaaacagaaggatatagaacagagtggatatttctaatgaattctgtattatatatacatatatctgcactgtttaaatgttttatagtgggaaaaatgttttaattagaaaaaatagactttttcaataaaaccttttttgacttatctcaaaat

SEQ ID NO: 17265 - DNA, 479 bp, Homo sapiens
aattctactaacatgtaggcttaaatgataaccagccactgttctctggcttgcttttctataattccttgcctcttaggagatgtggccagaggtcacaggattggtgacttttccaattgttcctatagataacactacttttatattgcctaagattgttattctgagatgtttttcagaattctgcattctggcaaatgaatgactgcacctgacccgtgactcatgactcaactagtcctgtggaccccgccttgaggtggactcagtgcaccaggaccattttccacacccctacaatttcatccccaaccaatcagcagcactcattccctagcctgctgttcaccaaattagccatgaaacccctacctagactagcctctgagttctgagagaggctgatttgagtaataaagtaataaactcctgttctgcttggctagccctgtttattaaacttgttctctactgca

SEQ ID NO: 17266 - DNA, 193 bp, Homo sapiens
caaatttatgtgacttgaataaatcttttggtaaataaaactatgttgttattgttggtttaataaaaataactgtcttctgagctaacaaaaaaatatacatgtgcttaatggcaaggttcttgcttttacgatacttgcctaatgtacagtaatataaaaaacagttaataaaaaatttaacttgtgatga

SEQ ID NO: 17267 - DNA, 494 bp, Homo sapiens
ttggactttgttgcaaggatagaagactttctgtatctccaggttcttgccttggtgtaccagaagaatcaatcacacatggtcttggagaatgagtgcaaagttttattgagtgcaggtagctctctgctgctcttccaccagtatgctctccacaaccagccgcttgtgtgttcttccactgatgtgtcctctcaatgtccagacgcttctgtctctgccttgctaggatcttgggcttttatagaccttggatggggaggtggtgagccagggtggtcttgggaaatgcaacatttgggcgtgaagtcaggagtgcctgttctcacctaggtccgtgggggtaaagccctagctagggaccatgccttcctctacccagcacttcccttcctcattctgtatcatttaaagagaccacactcctcccttcccagcactcctgtatcagtaggaagatagaagaaaactctagatcaccatcaagttcaagt

SEQ ID NO: 17268 - DNA, 465 bp, Homo sapiens
tccttggccagagatcttatttccctcttattgagaaacagaggacagcctccatgagccccctgggtgtgcctacccatctccacctgagaagatctcctacctccatttggcccagtttgccaactggcttaacaagaaaaactgctctccagagataccaccttgatcttcactgccccaggatcttctctgacagttaactctttgtctcttgtacttttgattcctccctgtccctgtgtggtttacagactcacacattgtcttccatctgtgactctattccattgctttgggtacttcccaggttcagaacctcatcttctctcacctgggctcctcattgatccctccagctgcagctgctttcttcccagaattttatgccagaattatttcattaaaatacacgtgtgattatgttagtcccctacccaaaaactcagagatctccaaaaagaa

SEQ ID NO: 17269 - DNA, 456 bp, Homo sapiens
acagtctcaatctcatcagaagagaggtcctataaactcgttaaacctgttatcaacccagtacccatgacagtcattctcctgagctggctgtagtccctgtccatttcctttttaccatttttctcacattcccagtctccaaaaagaggaaaggatagagacttttgatgacttcattcccataaggtgtgactcagctactgtcacgtcataccagacaaacaaggatgctttggagtggaggaccaaggaaaaggaagtaaccaaacccaatggatgaggaagacaagctgatttggaagggaagtgaggaagaggatgaataaagaagttggaaaaaaggggacccaagcacactcaaatgcaaaagcagagatttattgaaaagcattgagagactgattggaaaccgagaaagaaaatggttatattttttaagtctcagtcccattt

SEQ ID NO: 17270 - DNA, 508 bp, Homo sapiens
ctcattcagttgcaagaactccattagtatgttggcagagtctgtcacagaaatgcttttcaagggcattatttgaagtatgatatgacattgcctcccttaaatatttctcaggctttgcaaacttagaggataactttgccaaatcttgtaagtttttgtttcccattactgatttttttttcacaaatagtcattaaacactcatttgttaaaggcttaacacactccatttttctgccaaatttatatttgcacccaaactatgtttcagcaattcagaattaaattaatgcagtacatcctatttatcaatatggcagaccagctgctggaggacaagggatgatttacacccgactgtgagtctgtgtgtttgtctgtacacgtgtgtgtgtgtatatacatcttgcataaacctgtgagctcttccctggtatttatttcacactggagaattcctgataaaataatcctttaaatatcttgacatgtggtttaaatcatc

SEQ ID NO: 17271 - DNA, 675 bp, Homo sapiens
agagatcccggcttaggagtatcacagtgagaccggtctcaacaaaaataaaataggctgggcgcagttgctcatgcctgcaaccccagcacgttgggagaccaaggtgggtggatcacttgaggtcaggatttcaggaccagcctggccaacacggtgaaaccccatctctactaaaaatacaaaaattagttgggcatggtggcatgcctatggtcccagctactcaagaggctgaggtaggaggatcgcttgagactgagaggtgaagtctacagtgggctatgatcacgccactacactccagcttgagcaacagagtgagacccatctcagaaaaaagaaaaaagagaggatgatcccaggcaagctaattagcctctttgggcttcatgctcatgatctgtaaaatgggcacactaataatatctacatcataggactgtggtgaggtttaatggtcagtatctataaagcacttaagaccatgctaggcacctaagaagagctctatgtgagttggctatttttcttggccttgcctgtttcttctagtaactacctaggctgtgacttccctaatttttctaaaaaatgaataaaaagcctagattttcttgcaatgcaaggtatagaagaggaaatagaagcagaggtttcacagtgtggtacccc

SEQ ID NO: 17272 - DNA, 813 bp, Homo sapiens
tgacatggaaatgtagactcagtaaatgtgtacaaacgtggtgtatctagagctcctgctgtgtgtttacagagttggtgctgcatttaaggaggacagagatgcctttgttgtcatgctgaccacattcccttcctggtaagcagtactcactcctgagtcaggcccctaggttcaaatctcagccctaccatttattaagaggatgggccaggcatggtggctcactcctgtaatctcccagcacttcgggaggctgaggtgggggcattgcttgagcctaggagttcgggaccagcctgggcaacatagggagacccccatctctacttgggcatggtggcatgcctatggtcccagctactcaagaggctgaggtaggaggatcgcttgagactgagaggtgaagtctacagtgggctatgatcacgccactacactccagcttgagcaacagagtgagacccatctcagaaaaaagaaaaaagagaggatgatcccaggcaagctaattagcctctttgggcttcatgctcatgatctgtaaaatgggcacactaataatatctacatcataggactgtggtgaggtttaatggtcagtatctataaagcacttaagaccatgctaggcacctaagaagagctctatgtgagttggctatttttcttggccttgcctgtttcttctagtaactacctaggctgtgacttccctaatttttctaaaaaatgaataaaaagcctagattttcttgcaatgcaaggtatagaagaggaaatagaagcagaggtttcacagtgtggtacccc

SEQ ID NO: 17273 - DNA, 371 bp, Homo sapiens
aaattttagagtgcttgccactgggctttaaaaaagaaaaaaaagaaaaactttatgaggtcttcacttaaccatgttctctttagttagtaataggagtaaacaaacagctctttatagcgaggaaggaattatgccaatattaaatccagagcaaactttttttctgcaagtgtcaaaatttatcaacaattaatgaggagtatttctgtgcaaaggcaaatgaatgaattaactcaacacatatctccctctttggagagttcctctgaagaaatgttaacataacataatgggtgcttgtaacaatcaccgtacttttttttttttttttttttttttgagactgagtcttgctctgtcacccaggc

SEQ ID NO: 17274 - DNA, 347 bp, Homo sapiens
aaattccacaaaggtccaaattctagggcccagacagaagagaagagtcacatcatctagatgatgaatgaaaagatatgtcattattctcctttgggcagtgcttctgcagaaaagttgcaccttctaggtgttggactcagcaatatatcacaatgtctgcagtattttggaaggagaggagagtcaccattacttagtctatcttcaatttacagaccttggcttttctaccccaattcaagaagtcacttcttcagtcaaccaaaccaattacaaaattgtgttccaatgtcacatgttcaaaaataaacagttcctgaaaagatgtaagctttaaaaaaaat

SEQ ID NO: 17275 - DNA, 4230 bp, Homo sapiens
  misc_feature (1034)..(1034): n is a, c, g, or t
  misc_feature (1943)..(1943): n is a, c, g, or t
caacgcttttgacaagtcaaacttttctaaacatcaagaaaatcatgctgctgagaaatcctagaaatgtgaagaatgtgacaaagcctctaaatgattgtcacacttgatcgtagggcccagacagaagagaagagtcacatcatctagatgatgaatgaaaagatatgtcattattctcctttgggcagtgcttctgcagaaaagttgcaccttctaggtgttggactcagcaatatatcacaatgtctgcagtattttggaaggagaggagagtcaccattacttaggtgctaggcccagcaatacatctcaagcacttcttgggcaaagcccaagcagtaaaaaagagtcacattacctaggttctgggtatagcaatatgtcacaaatgcccctaagaagagggcccaggaaaagagagtcaccttggtgagaatgtcagagatattccatttttgggtattcacaaaaaagaataaagtcccataacctagaaggtgggctctgctccatgacacaaatcaccctagtgggcaggtccattaaagagaaggctgtcaaagcacatagatgctgggcaaagtgatatgtcataatccccatgatgataggcccagagacatgtcacaatgacctctttaggcagagaccaggcagaagaatcacatcacttgtgtgctggccctagtgataagtcactctcatttctgtggacatggcccaggcagaagagcagagtcacattacctaagcgctgggtcaagagatatgtcacaatcttttacatgggcaaaacccaggtaaaaaagaggagtaatatcagatagtaggtgttgccagagatatgtcaaaatgccccctgtatgaaagactcaggcagtcaaaacacattagttggtttcttaacctagtgatatgttataatctttcctgtgggtatgatgcaggcagaagacgagagtcatgtgatggatgcagagacatgtcacaaggtcttctgtgggcagggtccagactgaagccttccaccngctaggggttgagcccaatgatatgtcacaatacccaaattatgcagggcccaggcaaaaaaaacgagaggcacatcacctgggttctggatccaatgatatatcacaattttctattttggcaagacccaggcagaaagaaaagttacatcacctaggtgatgaatgaaaatacatattataatagttttgtgggcaggacccatgcgggagagtcacatcacctaggtgttggacccagaaatatgtcacaatatacagtgtatacagagctgaggcatgagacaatagtaacttcactcatttgttgagcccagctatacaatccttttttgggcacagccgaagtagtagaggagagttacatcaccttggtgctgggtccagcaatgtgtcaccatacctgctgaggggagggtacaggcaagagagccacatcacttaggtgaggggcccagagatatctcacagtaccccctgtgggtagaactcaggaaaaaggagagagtcacataatctagaagctgagctcagctgtatgttacaatcacccagtggacaggtcccaggcatgagagtagagtcacatcacataggtgctggaccaagcaatttgtcacaaccttcactgtggacaggtccccagaaaaagagaatcacatcatttaggtaacaaaacctgagttagtcactgttacttgtttgggcagaggtcaggaagaagtgtcacacaacatgtatgctggactaagcaatacgtcactctctctgttttaggtatggcccaggcaggagagaagggtcatatcacctaagctctggattcgcagataggccccaatctcttttttgggcaatgctcgggtaagagagcagagtcacatcaagtggttgatgggcccagagatntatcacattgccccttgtggacagggaccaggcaggggactcacatcacaatagaggtaggacaaggaatacatcacaatacgttttgagagcagaaccaaaaaagagtaacataatctttgtgttgagtgcagcaatatgttacacttttctttgtgggcagaacgtgtaaagaaggaaaaagttggccggacacggtggcctgtaatcccaacactttgggaggtcaaggtgggcagatcacctgaggtcaggagttcaagaccagcctggccaacatggcaaaacgctgtctctactaaaaatacaaaaattggctgggtgtggtggcgggcacctgtaattctagctactcaggaggctgaggcaggagagtcacctgaacctttgaggcagaggctgcagtaagcaaagatcacgccactgcactccagtgtgggtgacacagcaagactccatctcaaaagaaaaaaaaataaagaaaggaaaagtcacataagctaggcacttggcccagtgatatgtcatagtcacccatttgagaagggaacagcgaagagaagagagtcacatcacctctctggtggacacagagatatctcacaatgctctctgtaggcagggccagggcacaagagttatataactcgggtgttagaccaagcaacatgtcacaatggctgatatgggccagacacagacaagggagtcacatatttgggtgtagggctcagttatatgttgaaatgccccctgtgggcagcgacaaagcagaagattcacatcacctggatataaggcccggtgatacgttacaattcccctgtgagcagcgctaaagcagaagaatagggtaatatcacctaggggctgagtccagtgatatgtcacaattccatctgggctgggcccaggcagatgtgtcaaatcatgaaggttctgtgaaggtgcatatatcacaatcacacctgcaggaaggtccaataatgagattaacaatctcacacaggtccgggttctaggtatgagagtcaacacctgtgtgttggatccaaatagatgagtcgtagtctcaacaattgacttgatccatgtgtgagatcctagtttctatttgcattactattggtaccagtacctattaattcttccaccttctacatctttgttctgtatgaatgtatatacaaagattgatacatatacaagattatatgagtatttctatgtaaatatgtacacaaaaattgttcctccaaagacatttttcagtatcttagcatattctaagggtgcagatgtagaattatttctcttctctggctcagtagcatgtcagaatggaacataggtatagaatgttttttgtatagacaaagcttcactttcaggggcaaggtttgggaaataagctgatagtaaagtcatgtaacactttctgtgcaggttaacatttctggaccttgctttccttctcagtgtatgcatgagctattctcatgcaccactgggggccagtcttgattaatctacagttgaaatttagagaactggctgattgaatccacctgggctgagctaactgacattgaaatcagctgggctgagcttattggccagttaaaatcatctgggctcaaatatcggctgactggagtcacctgggctaaactaattggctgattttaatctcctgggattggttaattgactgtaatgacctgatttgagttaattgactgattgaaatcaaaagtgctgacctaattggctgattgaaatcacctagaatgaggtaactgactgattggatttacctgatctgagctaattggctgatcagaattacctagaccaaattaattggctaattggaatacactgggctgagctaattggctgattgaaataatcagggctgagtaagtgggttgcttgtattcacctcccctgagaagaataagtagggaaatgatctctgacttacctttttttttataagacatactcataaatggacattacatagatatatttatatattgtatgtgtttgtatgtgtttatctacatatattatatctgttaaccttcaagttaaagtgtgcaaaggaatctgaaatttgctttcaatattgcagtctatcttcaatttacagaccttggcttttctaccccaattcaagaagtcacttcttcagtcaaccaaaccaattacaaaattgtgttccaatgtcacatgttcaaaaataaacagttcctgaaaagatgtaagctttaaaaaaaat

SEQ ID NO: 17276 - DNA, 524 bp, Homo sapiens
caacgcttttgacaagtcaaacttttctaaacatcaagaaaatcatgctgctgagaaatcctagaaatgtgaagaatgtgacaaagcctctaaatgattgtcacacttgatcgtagggcccagacagaagagaagagtcacatcatctagatgatgaatgaaaagatatgtcattattctcctttgggcagtgcttctgcagaaaagttgcaccttctaggtgttggactcagcaatatatcacaatgtctgcagtattttggaaggagaggagagtcaccattacttaggtatggcccaggcaggagagaagggtcatatcacctaagctctggattcgcagataggccccaatctcttttttgggcaatgctcggtctatcttcaatttacagaccttggcttttctaccccaattcaagaagtcacttcttcagtcaaccaaaccaattacaaaattgtgttccaatgtcacatgttcaaaaataaacagttcctgaaaagatgtaagctttaaaaaaaat

SEQ ID NO: 17277 - DNA, 996 bp, Homo sapiens
cgcttcaaccactcgtgaacgcgagcgcaggcgcgccggaggaaacggaggctgcgcttgcgtatgtgtgatgccgccgccccaccgtctactttcccaccgaccccgcttacgtctaccgcctaccagtgcgtcccccgcggactgtcattccccgaggcttgcctgactgttcagcttctctctcccgcttgtcccagagatccaactccattcttccggtcttgtcatttcagaaacctcgcaagaagctcgcccttgtcgtctcccagcgggcttcttagctcccagcttgtttgatgggggtgcctctttttctttccaggtatagctgtccagcgacaccatcatgcattcatttctccaacaaacattttcatgggctcttgctctatactggggatgtagtggtaaatgaaatggacgaggccctgccctcgtggaacttacagtctggcaaaggaaacagacaataaaattctcagttgtctaaggaggcagagatgcatggggagaggatcagagtagggatgcggaagcagcgagtggtcaggagtgtgcgtgccaaaaggcaggagacctgtgggacgtgggggcagctggggccggaacttgcgctggaggaacaccccttgcctgctggggcgagaagaggaccctttccttgggtgaaattccccatattgttaaaaggacaattaaagaaatgaaagagaggtcacctgggtgaataggcaacttagatgggcctccctgtgttcctgtcatgcctccaattctgcgtccaggtgtccggaacacatttttttctgcctttgaaaccttccagtacctctggcagagatataccataccctccttgttacctgcgtgcggaatcttaactcatcgttgtgctacatctgcaccttctgcctttgtgccttgttttgtgttttccctctccggggagaatataataaacttagctgagtccgttctacatacaaggaaata

SEQ ID NO: 17278 - DNA, 258 bp, Homo sapiens
tccagactagtattgtgaacaaagatatgcgagaagaaccttataaaagactgcccagcctggcatcctcgctgtggcagcagctcacatgtggtttaggagtagccccaccaggtggtagacaccctgtaaggtctggatgtaggtggactcctgggtcacttgtaagccaaggggattccctcttcttccctccctctacctttcccaccccctaaccctgcatatgggacttccccagctttcccgcttttatga

SEQ ID NO: 17279 - DNA, 325 bp, Homo sapiens
gaggagcccacctgtcctcccggaagagatggcccctttcacttgagattccaggagattgcccagggagaaggtgtggagggaggggttttgagaaggaatatgaagcctccagtggtgagcagtaccagcaagacgaccaagaagaggcagttgggttggtcagttaggaggtcttgtcatccatcttggggttggcagagcaatagagacagacatcacatcaccatgggaagagaagagaataagaggaagatgaagattatattccatcagaagactggaaaaaggagattatggtgggaaggtctttgctggtgggaag

SEQ ID NO: 17280 - DNA, 2827 bp, Homo sapiens
gaggagcccacctgtcctcccggaagagatggcccctttcacttgagattccaggagattgcccagggagaaggtgtggagggaggggttttgagaaggaatatgaagcctccagtggtgagcagtaccagcaagacgaccaagaagaggcagttgggttggtcagttaggaggtcttgtcatccatcttggggttggcagagcaatagagacagacatcacatcaccatgggaagagaagagaataagaggaagaagtggagatgagaggaacaggtcacctcttccaactatgaagggaaagaggtggatgagtggaagtgacccgtttggactggtctttttttatgtagctaatatttggcctgtgcttttctggatcaggccctgatgagcattttgtcaacaatatctccctgaaaccttaagagaacatcctagggttgacgtggttttgcccactatacagaagagcttcaaaagatgaaggcactttcccaagatggggggcagagctgggatttgtgtcccattctgttgcccttcagagcctcactttcaccactgtccttgtcttccctgtagtcatgaggggaagaaggaggtggagggctgcctgcagttagggagctggggcaaaggcaccagggaggctcccggtgctcagataggactggaagtctgggacacatcatttttcagagggggaagaggccagggaagagagaggctatttttaatagccaaatagatatgagcccattaaaaaccaggaggaaaggaataaaatgtttaataaaatctttaagtatctgagtggaggacctctctaagctgaaaagcaaggaaatgacaccaagaagagaaaggccaacagcgaacagggataagtgatggcctgtgtcccaagtggcctggagtggacggcactagatggacagataggggcttagccttggatagcaagcatgcaacgacccacccacccaaacctgggaggcttagcactcggcaggtgacctcatctgttctcaagccatcactgggaggtactcaataaatatttgctggggtgaaataactgaaatgggaaattagatcaaagaggaaaaataccagcattaagctattgatgatacaagaagttcccaaggtgctgggattataggcatgagccaccgtgcgcagccccttattcttttttaaaattgtcttggtcatattgcacatttactttttcaggtacattttataatcagcttgtcaaagttctgtgaacaaaatgtctgttggaagtttgagaagaattgcattgaaggggaaattaacatctttagaatataagttcttcccatctgtggacatggtgtctgtctctttttaatcagaattgtatttgttttgttttgttttgtttttaatgccttttaataaaggttggttgcttttgtcataaagatttttcacagttcttaataggtttattcctgaaaaccttattagttttgttgcttttgtgagtggaaaaactttcccttttttcattttgctttccaaattttaatcagtttactaatcactatgcttcattcacagacacacacacagcaaatgtgctttgtccctgggcacacaaatgaaaacacagcacacatgtaaatcagagctaattggctgaaaatgaattagaatttttgaattaaattttaattatacaagtaatacatgaatacattttcctttaaataaaattagagcattttaggtaaagaagtctctactggcctccccagcctgacctcaggccccttccccactttagaggcagctgctgttaggcatttgctgttgatccaaaatgttctcctatgcgcattgaaacatgtcctgtgttctattgttgcttttgtttgcttgcatagatgtggtggtgtacacactggaggtgctgctcctgagctcagggcaccttacgggactctcctcatgtcgcgtgtcacctgccgcagctggctccactgcccctttcagctggccgctggcaaccagaactgattgtgctatgatttatttagttgttgcttattgatcgactattaaaaggcttccagtcttgtttcaataagacaaacctgtaacagcatccttgtacatgccacttttgctcatgtacaagtgtttttctggagcagatacttagaaacagaattgatgggtcatagagtctacacatcttaaattctaatagtaactgctaaaatgttcttcaaagtacctttctgatttaatttcatgccagcagtatgtgtgtccatttctccagaccatctccaagttttacattttaaccaatctggtgggtgaaaaataatatcttgttttagtttgcatttttctgaattaccaggatggctgaagtctgtgtctcctatccatttatatttccttctctgcattacttgtccaaatcttttgcccatttcttttttttagggtacgttgtcttttccttattgattttttagaagttctttatgtattttgtatactttatgtgtattgcaaatattttctgtattgtgattcttgtcatttaattgtattgtgtctttggagaaatcttaaattttgatacagtcaaatcgatctattttaattttatgtctttttttcaattttatttaagaaagcctttcctgtactgaggtcataagcatttttcctgtatttcttctctaacatttatcatttacatatatgtgtgtgtgtgtgtgtgtgtatgccttttttaccacatgcaaaaaataaattccatatgcatacatga

SEQ ID NO: 17281 - DNA, 2538 bp, Homo sapiens
tccagactagtattgtgaacaaagatatgcgagaagaaccttataaaagactgcccagcctggcatcctcgctgtggcagcagctcacatgtggtttaggagtagccccaccaggtggtagacaccctgtaaggtctggatgtaggtggactcctgggtcacttgtaagccaaggggattccctcttcttccctccctctacctttcccaccccctaaccctgcatatgggatttgtgtcccattctgttgcccttcagagcctcactttcaccactgtccttgtcttccctgtagtcatgaggggaagaaggaggtggagggctgcctgcagttagggagctggggcaaaggcaccagggaggctcccggtgctcagataggactggaagtctgggacacatcatttttcagagggggaagaggccagggaagagagaggctatttttaatagccaaatagatatgagcccattaaaaaccaggaggaaaggaataaaatgtttaataaaatctttaagtatctgagtggaggacctctctaagctgaaaagcaaggaaatgacaccaagaagagaaaggccaacagcgaacagggataagtgatggcctgtgtcccaagtggcctggagtggacggcactagatggacagataggggcttagccttggatagcaagcatgcaacgacccacccacccaaacctgggaggcttagcactcggcaggtgacctcatctgttctcaagccatcactgggaggtactcaataaatatttgctggggtgaaataactgaaatgggaaattagatcaaagaggaaaaataccagcattaagctattgatgatacaagaagttcccaaggtgctgggattataggcatgagccaccgtgcgcagccccttattcttttttaaaattgtcttggtcatattgcacatttactttttcaggtacattttataatcagcttgtcaaagttctgtgaacaaaatgtctgttggaagtttgagaagaattgcattgaaggggaaattaacatctttagaatataagttcttcccatctgtggacatggtgtctgtctctttttaatcagaattgtatttgttttgttttgttttgtttttaatgccttttaataaaggttggttgcttttgtcataaagatttttcacagttcttaataggtttattcctgaaaaccttattagttttgttgcttttgtgagtggaaaaactttcccttttttcattttgctttccaaattttaatcagtttactaatcactatgcttcattcacagacacacacacagcaaatgtgctttgtccctgggcacacaaatgaaaacacagcacacatgtaaatcagagctaattggctgaaaatgaattagaatttttgaattaaattttaattatacaagtaatacatgaatacattttcctttaaataaaattagagcattttaggtaaagaagtctctactggcctccccagcctgacctcaggccccttccccactttagaggcagctgctgttaggcatttgctgttgatccaaaatgttctcctatgcgcattgaaacatgtcctgtgttctattgttgcttttgtttgcttgcatagatgtggtggtgtacacactggaggtgctgctcctgagctcagggcaccttacgggactctcctcatgtcgcgtgtcacctgccgcagctggctccactgcccctttcagctggccgctggcaaccagaactgattgtgctatgatttatttagttgttgcttattgatcgactattaaaaggcttccagtcttgtttcaataagacaaacctgtaacagcatccttgtacatgccacttttgctcatgtacaagtgtttttctggagcagatacttagaaacagaattgatgggtcatagagtctacacatcttaaattctaatagtaactgctaaaatgttcttcaaagtacctttctgatttaatttcatgccagcagtatgtgtgtccatttctccagaccatctccaagttttacattttaaccaatctggtgggtgaaaaataatatcttgttttagtttgcatttttctgaattaccaggatggctgaagtctgtgtctcctatccatttatatttccttctctgcattacttgtccaaatcttttgcccatttcttttttttagggtacgttgtcttttccttattgattttttagaagttctttatgtattttgtatactttatgtgtattgcaaatattttctgtattgtgattcttgtcatttaattgtattgtgtctttggagaaatcttaaattttgatacagtcaaatcgatctattttaattttatgtctttttttcaattttatttaagaaagcctttcctgtactgaggtcataagcatttttcctgtatttcttctctaacatttatcatttacatatatgtgtgtgtgtgtgtgtgtgtatgccttttttaccacatgcaaaaaataaattccatatgcatacatga

SEQ ID NO: 17282 - DNA, 2753 bp, Homo sapiens
gaggagcccacctgtcctcccggaagagatggcccctttcacttgagattccaggagattgcccagggagaaggtgtggagggaggggttttgagaaggaatatgaagcctccagtggtgagcagtaccagcaagacgaccaagaagaggcagttgggttggtcagttaggaggtcttgtcatccatcttggggttggcagagcaatagagacagacatcacatcaccatgggaagagaagagaataagaggaagaagtggagatgagaggaacaggtcacctcttccaactatgaagggaaagaggtggatgagtggaagtgacccgtttggactggtctttttttatgtagctaatatttggcctgtgcttttctggatcaggccctgatgagcattttgtcaacaatatctccctgaaaccttaagagaacatcctagggttgacgtggttttgcccactatacagaagagcttcaaaagatgaaggcactttcccaagatggggggcagagctgggatttgtgtcccattctgttgcccttcagagcctcactttcaccactgtccttgtcttccctgtagtcatgaggggaagaaggaggtggagggctgcctgcagttagggagctggggcaaaggcaccagggaggctcccggtgctcagataggactggaagtctgggacacatcatttttcagagggggaagaggccagggaagagagaggctatttttaatagccaaatagatatgagcccattaaaaaccaggaggaaaggaataaaatgtttaataaaatctttaagtatctgagtggaggacctctctaagctgaaaagcaaggaaatgacaccaagaagagaaaggccaacagcgaacagggataagtgatggcctgtgtcccaagtggcctggagtggacggcactagatggacagataggggcttagccttggatagcaagcatgcaacgacccacccacccaaacctgggaggcttagcactcggcaggtgacctcatctgttctcaagccatcactgggaggtactcaataaatatttgctgggtcccaaggtgctgggattataggcatgagccaccgtgcgcagccccttattcttttttaaaattgtcttggtcatattgcacatttactttttcaggtacattttataatcagcttgtcaaagttctgtgaacaaaatgtctgttggaagtttgagaagaattgcattgaaggggaaattaacatctttagaatataagttcttcccatctgtggacatggtgtctgtctctttttaatcagaattgtatttgttttgttttgttttgtttttaatgccttttaataaaggttggttgcttttgtcataaagatttttcacagttcttaataggtttattcctgaaaaccttattagttttgttgcttttgtgagtggaaaaactttcccttttttcattttgctttccaaattttaatcagtttactaatcactatgcttcattcacagacacacacacagcaaatgtgctttgtccctgggcacacaaatgaaaacacagcacacatgtaaatcagagctaattggctgaaaatgaattagaatttttgaattaaattttaattatacaagtaatacatgaatacattttcctttaaataaaattagagcattttaggtaaagaagtctctactggcctccccagcctgacctcaggccccttccccactttagaggcagctgctgttaggcatttgctgttgatccaaaatgttctcctatgcgcattgaaacatgtcctgtgttctattgttgcttttgtttgcttgcatagatgtggtggtgtacacactggaggtgctgctcctgagctcagggcaccttacgggactctcctcatgtcgcgtgtcacctgccgcagctggctccactgcccctttcagctggccgctggcaaccagaactgattgtgctatgatttatttagttgttgcttattgatcgactattaaaaggcttccagtcttgtttcaataagacaaacctgtaacagcatccttgtacatgccacttttgctcatgtacaagtgtttttctggagcagatacttagaaacagaattgatgggtcatagagtctacacatcttaaattctaatagtaactgctaaaatgttcttcaaagtacctttctgatttaatttcatgccagcagtatgtgtgtccatttctccagaccatctccaagttttacattttaaccaatctggtgggtgaaaaataatatcttgttttagtttgcatttttctgaattaccaggatggctgaagtctgtgtctcctatccatttatatttccttctctgcattacttgtccaaatcttttgcccatttcttttttttagggtacgttgtcttttccttattgattttttagaagttctttatgtattttgtatactttatgtgtattgcaaatattttctgtattgtgattcttgtcatttaattgtattgtgtctttggagaaatcttaaattttgatacagtcaaatcgatctattttaattttatgtctttttttcaattttatttaagaaagcctttcctgtactgaggtcataagcatttttcctgtatttcttctctaacatttatcatttacatatatgtgtgtgtgtgtgtgtgtgtatgccttttttaccacatgcaaaaaataaattccatatgcatacatga

SEQ ID NO: 17283 - DNA, 339 bp, Homo sapiens
gtgaaataactgaaatgggaaattagatcaaagaggaaaaataccagcattaagctattgatgatacaagaagtgtccaggtgccgtggctcacgcctataatcccagcactttgggaggccaaggcgggtggatcacctgaggccaggagttcgagactagcctggccaacatggcaaaaccccatctctactaaaaatacaaaaaattagctgggcatggtggcatgcacctgtaaccccagctactcgggtgactgaggcatacgaatcgcttaaacccgggaggcggagctgcagtgagccgagatcatgctgctgcactccagcctcagtggca

SEQ ID NO: 17284 - DNA, 452 bp, Homo sapiens
ggattacaggagtgagcctctgttcccggccgaacttcaggatcttattggggatcttgtcttgctattttttgacctgcatcatataaaatgttgttgatgaaactgtaagagaaaggcattttaatgtttacttaaggcccagtcccaaatctctaaagaaaatgaatactgtttatttactgtaaactctgtaaaccgtagaccatatgtattcacattgtaaactgttaagcactatataaaggttgattgttaatatccttttatggtatgtcttgacagggcaagctggctttccattttttcttcctgcttttgtggacattcggttattaacctctaaagataaagttggatagatgtgtaatatgtagttgcaggtatgctgattcatcatctgaatggcattttattaagtgtttattgtgtgccaaagtaatattttagcc

SEQ ID NO: 17285 - DNA, 231 bp, Homo sapiens
actcgtgatcttctaaggtaactggaaaagtttctcctaaataccttaccttgcttttcttcatcagcctttcaaatccttggagtgtaatcgtgccaacttagagtttctctactctatgtaaagctccaatatgcatcctgcagtcccaacattttaaattagctcagtcaatccaaggaacaccactgtttatactttcccatctagaggaatggttctttattatgt

SEQ ID NO: 17286 - DNA, 278 bp, Homo sapiens
ggactcttgaatacatgattgaagcaactccaaacaggttaacagtctagaagtgttattgaatgtatttttctaacgtaaattaaatgttatttttttcttactgaaacacaccacctacttctttctagaggaagaacaattcacatgtaaatatggattttccatgagatgcaacattaacatatttttaaatcacataatttttaaggtttaataagaattatttcaggacttctgaaaataattaatgggaacctaagtagaatattttatca

SEQ ID NO: 17287 - DNA, 551 bp, Homo sapiens
  misc_feature (20)..(21): n is a, c, g, or t
  misc_feature (32)..(32): n is a, c, g, or t
  misc_feature (40)..(40): n is a, c, g, or t
  misc_feature (95)..(95): n is a, c, g, or t
gggcaggagtagcagctgcnncttggcgcgantgctggancgcgaactagagaaacacagacacgcctcatagagcaacagcgtctctcggagcntggagccgccaagctcgagctgagctttcgcttgccgtccaccactgcccaccactgtcgtttgctgccatcgcagacctgctgctgacttccatccctctggatccggcaaggtgtgtgctgtgctcctgatccagcaaggtgcccattgccagtcccgattgggctaaaggcttgccattgttcctgcacggctaagtgcctgggttcatcctaatcgagctgaacactagtcactgggttctacggttctcttccatgacccacggcttctaatagagctataacactcaccacatggcctaagattccattccttggaatccgtgaggccaagaaccccaggtcagagaacacgaggcttgccaccatcttggaagcgacccaccaccatcttggaagtggctcgccaccatcttgggagctctgtgagcaaggacccctggtaacacaacc

SEQ ID NO: 17288 - DNA, 169 bp, Homo sapiens
aaatatttgaaaagaactgcacaatctattagaaatgtctaaagcagggccgggcacagtggttcatgcctgtaatcccagaactttgagaggacaaggcggcagaatggcttgagcccaggagttcaagaccagcctgggcaacatagcaaaaccccaacactgcaac

SEQ ID NO: 17289 - DNA, 276 bp, Homo sapiens
aattaaaattaaattagtgatgtattatattagttgtgcttttatgtaatgtagtacattcataaatttttagattatatgtaaacttaattttttaaacattttttgacatgttaagtctgttgtacattcaatgaagtgttattatgccactcgctttaacctatcccaccttactcaagggtgtaggtaagagatggcaacagtttactatttggtaagagtggaataacatctctagtaatctctttttttcagtggctttaacctgcaaat

SEQ ID NO: 17290 - DNA, 373 bp, Homo sapiens
gacattttccatctagattaaagacctagattaagggattgtttgagtctattttataacagattgtcactgtctttcttactaggcacttcttcacttgaaagcctaggctgtggtctttctccttcaccagacagttaaacactgtagtgttggtcacatttttctaaaactatgttgtttatccacattcaattcctcttcttaagatctctctttaaaaattttggctatattcatggaaatttaaatttctgtttgggatggactttgttccccctttattactgtcaccattcctattattctctttggcctcccatgctggacacttatacttctataaatcttatagatggagctggtattattt

SEQ ID NO: 17291 - DNA, 460 bp, Homo sapiens
  misc_feature (278)..(278): n is a, c, g, or t
ctcatgcaggacgctgtaagcagtcatgaacgttctggtttatattccgaatgtgacagacagccaggaagctacgaagccattttagttttttgagcagaagcatgacatcagttgattcgtgtttttaaaaaagtatgtgctgttgaatggagaagatgctgaaggagggtgctgtggtttaaatgtgtgttccctccaaaattcatgcagaaacttaatcctaattgtggtgatattaagaggctggaccttttgggaagtgactgagtcatganggctctgcctccatggagggagtaatacccatacagaaggggcttcggaggccaggctcgatggctcatgcctgtaatctcagcacttttggaggtcaaggcgggaggatcgcttgagtccaggagttcttatttcccccttttggaccagcctgggcgacacaaggagaccctgtctctac

SEQ ID NO: 17292 - DNA, 397 bp, Homo sapiens
catctagggttttgaaataaatattttcttcagataactgtttactttttgataaacaccttctgacttgctactaggtagatattgaatgcataattatggagtgtcaggttatcatgtggaccaagtttcccatcattatctgggtaaaatctgacctatctttccataaggttagcgatgtacaacagcaatatatcattgagtggaaatagtacatgagacagaactagagcagatctggataggacaaataagttgcatgaaccagggactcagacttctttggtagcaactctaatggcattgccttgtctctttcaactcatgcctgtggcttcttggcgattcccttagtccatttgttagaagaaaaaacaacaacaacaacaacaac

SEQ ID NO: 17293 - DNA, 768 bp, Homo sapiens
caaaaaggggaaagacggtcagtgttgggcagaatgaaaagaaaagggaaccattgtacactgctggtgggaaagtaaatcaatactactattatcaaaaacaatacagaggttcttcaaaaaaattaccatatgatccagcaattcgacttctaggtaaatatccaaagaaaatgtaatcagtatttcaagagatatctgcactcccatattatttacattattcaccacagctgaaatatggatgcaacctaaatgtccattgacaaatgaatggataaagaaactgtggtatatacacacatggaatactctttagccttctaaaaggatatcctgtcatttggggaaacatgggtgaacccagaggataatgtgttatgtgaaataagccgagcaccgaaagacaaaaactccgtgatctcacttatatgtggaatctaaaaatgatagattcacagaagcagagtgtagacaggagccctgttggggaagtgggagatagaggagatattggttaaaggatagaaaattttagttagacaagaggaataagttcaagaatattgtctaacatggtgactatacttacaacaatgcattaatgatatattttgtacttgaaatttgcttagagtagattttaagtgttttcaccacaaaaataaatatccaaggtaatgcatatgtgaattagcttgatttagccacttcacaatgtatacatactttaagaaatcatgttgtacaccataaatatatataatt

SEQ ID NO: 17294 - DNA, 537 bp, Homo sapiens
ggattaacattttcttttccagccagagcaaaatatgcatgacaaaacatagacattagccactccacttagcacccaatatcaaactggcaaggttaaaacttgccctggttgatgcctgtcatccttaatccattcaaagtgggatggaatgacctcagactagaagtttcaacatgtggtctctgtacaagatggaagagcagacagtgtccacatagtctcctttgagcaggcagtaagtacgtaggtccataaagagtaagaacctggtacctgagtccctgaagcagcctgaggcaaaaagcttgtctcctggaagtttccctgactagatgaagaaagactcagtttcctccctagctctcaggctgacttttccattgccagtgtccacctcatcctgcctgaagtatcaaagctaaaaccctttgctgttttctgaatctagagaggaaagagggtgaggagacccgaattcaaatgttttacttgtaccttgtgaatctgtttcctctataaagagccattcatttc

SEQ ID NO: 17295 - DNA, 230 bp, Homo sapiens
gaagtgtgtcaacattcaaacttcccccagtggttgacttgttggggagagaaatgaaactgaaagtgggctgtcactgacctcctgactcaggccagtgtggttctgtggagaggggctggaagaggctgttctggaaggaagggcaggtgagtgtggatggagcccaagcaggagaatggacatagggacaatgtggaggtgacagcttgaggaggtagaggagtaaa

SEQ ID NO: 17296 - DNA, 461 bp, Homo sapiens
ttttttttaaatcttaacttctttatacagtttctatctagcatataacaggaatttaaaaagttaatcaatagtgtacaaataatttcatagaaaacatttattgaatactcactatgctttagatgcattactacattgaattctcacaatatgtaagtgctattattgctgtcatttagagatgatatagctaaagtttaccggagttaagtataataacttgcttagttacctagatggtaactcgtggaggcaggatttgaacctaggcaatttgactgtggcttagactcttcatcatcatactgcacatataggtaataagtcctctaactttagaagaagaaatgattgctgaggactgggtagtggggacgtctttatgaagaaagcagaacttatggtaggtttttaaagaagaccagagatgagtaaggggcaagaagataagtgaacaa

SEQ ID NO: 17297 - DNA, 384 bp, Homo sapiens
tattataatttctcatcttgtctgcttcctccattagactctgcacttcttaggcatagggggcacttttgtcctttttttttttcctgagagggagtgacaaactctagtacctctggggccagacagggagcataaatgagtaaagcactgagtctgttattgggatgataggagggtatggtggggactgtgacaagctggctggagggcatgtcctttgctggagcggtcagtggcttctctgctccagcttagagttgccagtgagagaatgctgggcccatgttgctagatctttcatttttttcaagaagccagatatctggatgtttctgtgagatctcccaacttttaagcatatcttcaaattacaaaataaat

SEQ ID NO: 17298 - DNA, 472 bp, Homo sapiens
aggactcattattagagttttaaagtttctgatggaaggtataagtgtctatcttaaattatttatatattaatgaaatacaacagggaaaagatcaatttgtaaaaaatttcaccatctttagaattctcaggggacccaagggagaaggggaactttattttctttctttccatggtaccttcgtatttgaagactaattatcagaactcttggagtttttaatcctggggagatacagctcttagataattataggtaatttatgagttaaagggtattgatgggagtcttcccataattatgttaaaatttggaaccccatagagccagctgctggacatctgtcttgtgggaccagaactcaaaacccaatggacagaaccttgtgtagggttaaccttgtttttttaaatcaggatatttgtcttcatagcccagcttgcccatttcctgacagtattgccttggg

SEQ ID NO: 17299 - DNA, 511 bp, Homo sapiens
gactaaaataatgcatgtcagacatttgataagatgtcaacactcaatcgaggagtgtgacggtcatcatcattgctagattttattacttttatggatgggcatgctagctaaaattgcaaaacctctaatattttctaactgcctctgctgtttttctcctcggcccttagcactctctcctacaccatgtgataatttatattgattgctgtctatactgttccactcaatggaagcttcgtgaagtaggaacttttagtctattttatgcactgctgtatctctaagatggctggcacgtaaagagggtctcaataaatatgccttgaattaatgaaaacagtggtttctgaatcatggcctccaaagagcatttgccttttcccctctcacccttctgaaggtgcccaggctgccctggcaggatgcctctttctctgtggggtggcattctctgctctctctctaatactctttctttttcttccctcctctcccccaactgcag

SEQ ID NO: 17300 - DNA, 791 bp, Homo sapiens
  misc_feature (670)..(670): n is a, c, g, or t
  misc_feature (678)..(679): n is a, c, g, or t
  misc_feature (685)..(686): n is a, c, g, or t
  misc_feature (697)..(698): n is a, c, g, or t
  misc_feature (740)..(740): n is a, c, g, or t
gcggacggcgtgggtcgacccacgcgtccgcaacaacaaaaaagaggtaaagacgaatctataaagtaccgagacttcctgggcaaagaatggacaatcagtttccttcctgtgtcgatgtcgatgttgtctgtgcaggagatgcagtttttgtgtagagaatgtaaattttctgtaaccttttgaaatctagttactaataagcactactgtaatttagcacagtttaactccaccctcatttaaacttcctttgattctttccgaccatgaaatagtgcatagtttgcctggagaatccactcacgttcataaagagaatgttgatggcgccgtgtagaagccgctctgtatccatccacgcgtgcagagctgccagcagggagctcacagaaggggagggagcaccaggccagctgagctgcacccacagtcccgagactgggatcccccaccccaacagtgattttggaaaaaaaaatgaaagttctgttcgtttatccattgcgatctggggagccccatctcgatatttccaatcctggctacttttcttagagaaaataagtcctttttttctggccttgctaatggcaacagaagaaagggcttctttgcgtggtcccctgctggtgggggtgggtccccagggggccccctgcggctgggnccccctgnnccacgnncagcttcctgnngatgaacatgctgtggtatggttttaggaaaccaggctgttntgtgaataaaacgaatgctgtttgtgtcacgaaaaaaaaaaaaaacataaa

SEQ ID NO: 17301 - DNA, 2165 bp, Homo sapiens
  misc_feature (2044)..(2044): n is a, c, g, or t
  misc_feature (2052)..(2053): n is a, c, g, or t
  misc_feature (2059)..(2060): n is a, c, g, or t
  misc_feature (2071)..(2072): n is a, c, g, or t
  misc_feature (2114)..(2114): n is a, c, g, or t
caagtcggcggaaagtttggctgcgcgggttcccccgaagttcagagtgaagacatttccacctggacacctgaccatgtgcctgccctgagcagcgaggcccaccaggcatctctgttgtgggcagcagggccaggtcctggtctgtggaccctcggcagttggcaggctccctctgcagtggggtctgggcctcggccccaccatgtcgagcctcggcggtggctcccaggatgccggcggcagtagcagcagcagcaccaatggcagcggtggcagtggcagcagtggcccaaaggcaggagcagcagacaagagtgcagtggtggctgccgccgcaccagcctcagtggcagatgacacaccaccccccgagcgtcggaacaagagcggtatcatcagtgagcccctcaacaagagcctgcgccgctcccgcccgctctcccactactcttcttttggcagcagtggtggtagtggcggtggcagcatgatgggcggagagtctgctgacaaggccactgcggctgcagccgctgcctccctgttggccaatgggcatgacctggcggcggccatggcggtggacaaaagcaaccctacctcaaagcacaaaagtggtgctgtggccagcctgctgagcaaggcagagcgggccacggagctggcagccgagggacagctgacgctgcagcagtttgcgcagtccacagagatgctgaagcgcgtggtgcaggagcatctcccgctgatgagcgaggcgggtgctggcctgcctgacatggaggctgtggcaggtgccgaagccctcaatggccagtccgacttcccctacctgggcgctttccccatcaacccaggcctcttcattatgaccccggcaggtgtgttcctggccgagagcgcgctgcacatggcgggcctggctgagtaccccatgcagggagagctggcctctgccatcagctccggcaagaagaagcggaaacgctgcggcatgtgcgcgccctgccggcggcgcatcaactgcgagcagtgcagcagttgtaggaatcgaaagactggccatcagatttgcaaattcagaaaatgtgaggaactcaaaaagaagccttccgctgctctggagaaggtgatgcttccgacgggagccgccttccggtggtttcagtgacggcggcggaacccaaagctgccctctccgtgcaatgtcactgctcgtgtggtctccagcaagggattcgggcgaagacaaacggatgcacccgtctttagaaccaaaaatattctctcacagatttcattcctgtttttatatatatattttttgttgtcgttttaacatctccacgtccctagcataaaaagaaaaagaaaaaaatttaaactgctttttcggaagaacaacaacaaaaaagaggtaaagacgaatctataaagtaccgagacttcctgggcaaagaatggacaatcagtttccttcctgtgtcgatgtcgatgttgtctgtgcaggagatgcagtttttgtgtagagaatgtaaattttctgtaaccttttgaaatctagttactaataagcactactgtaatttagcacagtttaactccaccctcatttaaacttcctttgattctttccgaccatgaaatagtgcatagtttgcctggagaatccactcacgttcataaagagaatgttgatggcgccgtgtagaagccgctctgtatccatccacgcgtgcagagctgccagcagggagctcacagaaggggagggagcaccaggccagctgagctgcacccacagtcccgagactgggatcccccaccccaacagtgattttggaaaaaaaaatgaaagttctgttcgtttatccattgcgatctggggagccccatctcgatatttccaatcctggctacttttcttagagaaaataagtcctttttttctggccttgctaatggcaacagaagaaagggcttctttgcgtggtcccctgctggtgggggtgggtccccagggggccccctgcggctgggnccccctgnnccacgnncagcttcctgnngatgaacatgctgtggtatggttttaggaaaccaggctgttntgtgaataaaacgaatgctgtttgtgtcacgaaaaaaaaaaaaaacataaa

SEQ ID NO: 17302 - DNA, 2306 bp, Homo sapiens
  misc_feature (2185)..(2185): n is a, c, g, or t
  misc_feature (2193)..(2194): n is a, c, g, or t
  misc_feature (2200)..(2201): n is a, c, g, or t
  misc_feature (2212)..(2213): n is a, c, g, or t
  misc_feature (2255)..(2255): n is a, c, g, or t
cccgtcagtgtgcgactcgggctctcgtgaccctgggcacatgcctggctggctggacgctggagcagcacctgctggcgtgtgtgtgcccagagctggagcgcagctccctgccccgcccttccccctcggcctcgctggcgactggtgcgtgctggtggcggcttgtgacgactcggagagccgagtgaagacatttccacctggacacctgaccatgtgcctgccctgagcagcgaggcccaccaggcatctctgttgtgggcagcagggccaggtcctggtctgtggaccctcggcagttggcaggctccctctgcagtggggtctgggcctcggccccaccatgtcgagcctcggcggtggctcccaggatgccggcggcagtagcagcagcagcaccaatggcagcggtggcagtggcagcagtggcccaaaggcaggagcagcagacaagagtgcagtggtggctgccgccgcaccagcctcagtggcagatgacacaccaccccccgagcgtcggaacaagagcggtatcatcagtgagcccctcaacaagagcctgcgccgctcccgcccgctctcccactactcttcttttggcagcagtggtggtagtggcggtggcagcatgatgggcggagagtctgctgacaaggccactgcggctgcagccgctgcctccctgttggccaatgggcatgacctggcggcggccatggcggtggacaaaagcaaccctacctcaaagcacaaaagtggtgctgtggccagcctgctgagcaaggcagagcgggccacggagctggcagccgagggacagctgacgctgcagcagtttgcgcagtccacagagatgctgaagcgcgtggtgcaggagcatctcccgctgatgagcgaggcgggtgctggcctgcctgacatggaggctgtggcaggtgccgaagccctcaatggccagtccgacttcccctacctgggcgctttccccatcaacccaggcctcttcattatgaccccggcaggtgtgttcctggccgagagcgcgctgcacatggcgggcctggctgagtaccccatgcagggagagctggcctctgccatcagctccggcaagaagaagcggaaacgctgcggcatgtgcgcgccctgccggcggcgcatcaactgcgagcagtgcagcagttgtaggaatcgaaagactggccatcagatttgcaaattcagaaaatgtgaggaactcaaaaagaagccttccgctgctctggagaaggtgatgcttccgacgggagccgccttccggtggtttcagtgacggcggcggaacccaaagctgccctctccgtgcaatgtcactgctcgtgtggtctccagcaagggattcgggcgaagacaaacggatgcacccgtctttagaaccaaaaatattctctcacagatttcattcctgtttttatatatatattttttgttgtcgttttaacatctccacgtccctagcataaaaagaaaaagaaaaaaatttaaactgctttttcggaagaacaacaacaaaaaagaggtaaagacgaatctataaagtaccgagacttcctgggcaaagaatggacaatcagtttccttcctgtgtcgatgtcgatgttgtctgtgcaggagatgcagtttttgtgtagagaatgtaaattttctgtaaccttttgaaatctagttactaataagcactactgtaatttagcacagtttaactccaccctcatttaaacttcctttgattctttccgaccatgaaatagtgcatagtttgcctggagaatccactcacgttcataaagagaatgttgatggcgccgtgtagaagccgctctgtatccatccacgcgtgcagagctgccagcagggagctcacagaaggggagggagcaccaggccagctgagctgcacccacagtcccgagactgggatcccccaccccaacagtgattttggaaaaaaaaatgaaagttctgttcgtttatccattgcgatctggggagccccatctcgatatttccaatcctggctacttttcttagagaaaataagtcctttttttctggccttgctaatggcaacagaagaaagggcttctttgcgtggtcccctgctggtgggggtgggtccccagggggccccctgcggctgggnccccctgnnccacgnncagcttcctgnngatgaacatgctgtggtatggttttaggaaaccaggctgttntgtgaataaaacgaatgctgtttgtgtcacgaaaaaaaaaaaaaacataaa

SEQ ID NO: 17303 - DNA, 2159 bp, Homo sapiens
  misc_feature (2038)..(2038): n is a, c, g, or t
  misc_feature (2046)..(2047): n is a, c, g, or t
  misc_feature (2053)..(2054): n is a, c, g, or t
  misc_feature (2065)..(2066): n is a, c, g, or t
  misc_feature (2108)..(2108): n is a, c, g, or t
tgacagcttgcccccaaccacggagaggtgacaggcacgagtgaagacatttccacctggacacctgaccatgtgcctgccctgagcagcgaggcccaccaggcatctctgttgtgggcagcagggccaggtcctggtctgtggaccctcggcagttggcaggctccctctgcagtggggtctgggcctcggccccaccatgtcgagcctcggcggtggctcccaggatgccggcggcagtagcagcagcagcaccaatggcagcggtggcagtggcagcagtggcccaaaggcaggagcagcagacaagagtgcagtggtggctgccgccgcaccagcctcagtggcagatgacacaccaccccccgagcgtcggaacaagagcggtatcatcagtgagcccctcaacaagagcctgcgccgctcccgcccgctctcccactactcttcttttggcagcagtggtggtagtggcggtggcagcatgatgggcggagagtctgctgacaaggccactgcggctgcagccgctgcctccctgttggccaatgggcatgacctggcggcggccatggcggtggacaaaagcaaccctacctcaaagcacaaaagtggtgctgtggccagcctgctgagcaaggcagagcgggccacggagctggcagccgagggacagctgacgctgcagcagtttgcgcagtccacagagatgctgaagcgcgtggtgcaggagcatctcccgctgatgagcgaggcgggtgctggcctgcctgacatggaggctgtggcaggtgccgaagccctcaatggccagtccgacttcccctacctgggcgctttccccatcaacccaggcctcttcattatgaccccggcaggtgtgttcctggccgagagcgcgctgcacatggcgggcctggctgagtaccccatgcagggagagctggcctctgccatcagctccggcaagaagaagcggaaacgctgcggcatgtgcgcgccctgccggcggcgcatcaactgcgagcagtgcagcagttgtaggaatcgaaagactggccatcagatttgcaaattcagaaaatgtgaggaactcaaaaagaagccttccgctgctctggagaaggtgatgcttccgacgggagccgccttccggtggtttcagtgacggcggcggaacccaaagctgccctctccgtgcaatgtcactgctcgtgtggtctccagcaagggattcgggcgaagacaaacggatgcacccgtctttagaaccaaaaatattctctcacagatttcattcctgtttttatatatatattttttgttgtcgttttaacatctccacgtccctagcataaaaagaaaaagaaaaaaatttaaactgctttttcggaagaacaacaacaaaaaagaggtaaagacgaatctataaagtaccgagacttcctgggcaaagaatggacaatcagtttccttcctgtgtcgatgtcgatgttgtctgtgcaggagatgcagtttttgtgtagagaatgtaaattttctgtaaccttttgaaatctagttactaataagcactactgtaatttagcacagtttaactccaccctcatttaaacttcctttgattctttccgaccatgaaatagtgcatagtttgcctggagaatccactcacgttcataaagagaatgttgatggcgccgtgtagaagccgctctgtatccatccacgcgtgcagagctgccagcagggagctcacagaaggggagggagcaccaggccagctgagctgcacccacagtcccgagactgggatcccccaccccaacagtgattttggaaaaaaaaatgaaagttctgttcgtttatccattgcgatctggggagccccatctcgatatttccaatcctggctacttttcttagagaaaataagtcctttttttctggccttgctaatggcaacagaagaaagggcttctttgcgtggtcccctgctggtgggggtgggtccccagggggccccctgcggctgggnccccctgnnccacgnncagcttcctgnngatgaacatgctgtggtatggttttaggaaaccaggctgttntgtgaataaaacgaatgctgtttgtgtcacgaaaaaaaaaaaaaacataaa

SEQ ID NO: 17304 - DNA, 1921 bp, Homo sapiens
  misc_feature (1800)..(1800): n is a, c, g, or t
  misc_feature (1808)..(1809): n is a, c, g, or t
  misc_feature (1815)..(1816): n is a, c, g, or t
  misc_feature (1827)..(1828): n is a, c, g, or t
  misc_feature (1870)..(1870): n is a, c, g, or t
tctcgtgctgttcttgaggatcccctgtagtcggctacggggagtggcccaaaggcaggagcagcagacaagagtgcagtggtggctgccgccgcaccagcctcagtggcagatgacacaccaccccccgagcgtcggaacaagagcggtatcatcagtgagcccctcaacaagagcctgcgccgctcccgcccgctctcccactactcttcttttggcagcagtggtggtagtggcggtggcagcatgatgggcggagagtctgctgacaaggccactgcggctgcagccgctgcctccctgttggccaatgggcatgacctggcggcggccatggcggtggacaaaagcaaccctacctcaaagcacaaaagtggtgctgtggccagcctgctgagcaaggcagagcgggccacggagctggcagccgagggacagctgacgctgcagcagtttgcgcagtccacagagatgctgaagcgcgtggtgcaggagcatctcccgctgatgagcgaggcgggtgctggcctgcctgacatggaggctgtggcaggtgccgaagccctcaatggccagtccgacttcccctacctgggcgctttccccatcaacccaggcctcttcattatgaccccggcaggtgtgttcctggccgagagcgcgctgcacatggcgggcctggctgagtaccccatgcagggagagctggcctctgccatcagctccggcaagaagaagcggaaacgctgcggcatgtgcgcgccctgccggcggcgcatcaactgcgagcagtgcagcagttgtaggaatcgaaagactggccatcagatttgcaaattcagaaaatgtgaggaactcaaaaagaagccttccgctgctctggagaaggtgatgcttccgacgggagccgccttccggtggtttcagtgacggcggcggaacccaaagctgccctctccgtgcaatgtcactgctcgtgtggtctccagcaagggattcgggcgaagacaaacggatgcacccgtctttagaaccaaaaatattctctcacagatttcattcctgtttttatatatatattttttgttgtcgttttaacatctccacgtccctagcataaaaagaaaaagaaaaaaatttaaactgctttttcggaagaacaacaacaaaaaagaggtaaagacgaatctataaagtaccgagacttcctgggcaaagaatggacaatcagtttccttcctgtgtcgatgtcgatgttgtctgtgcaggagatgcagtttttgtgtagagaatgtaaattttctgtaaccttttgaaatctagttactaataagcactactgtaatttagcacagtttaactccaccctcatttaaacttcctttgattctttccgaccatgaaatagtgcatagtttgcctggagaatccactcacgttcataaagagaatgttgatggcgccgtgtagaagccgctctgtatccatccacgcgtgcagagctgccagcagggagctcacagaaggggagggagcaccaggccagctgagctgcacccacagtcccgagactgggatcccccaccccaacagtgattttggaaaaaaaaatgaaagttctgttcgtttatccattgcgatctggggagccccatctcgatatttccaatcctggctacttttcttagagaaaataagtcctttttttctggccttgctaatggcaacagaagaaagggcttctttgcgtggtcccctgctggtgggggtgggtccccagggggccccctgcggctgggnccccctgnnccacgnncagcttcctgnngatgaacatgctgtggtatggttttaggaaaccaggctgttntgtgaataaaacgaatgctgtttgtgtcacgaaaaaaaaaaaaaacataaa

SEQ ID NO: 17305 - DNA, 1150 bp, Homo sapiens
cccgtcagtgtgcgactcgggctctcgtgaccctgggcacatgcctggctggctggacgctggagcagcacctgctggcgtgtgtgtgcccagagctggagcgcagctccctgccccgcccttccccctcggcctcgctggcgactggtgcgtgctggtggcggcttgtgacgactcggagagccgagtgaagacatttccacctggacacctgaccatgtgcctgccctgagcagcgaggcccaccaggcatctctgttgtgggcagcagggccaggtcctggtctgtggaccctcggcagttggcaggctccctctgcagtggggtctgggcctcggccccaccatgtcgagcctcggcggtggctcccaggatgccggcggcagtagcagcagcagcaccaatggcagcggtggcagtggcagcagtggcccaaaggcaggagcagcagacaagagtgcagtggtggctgccgccgcaccagcctcagtggcagatgacacaccaccccccgagcgtcggaacaagagcggtatcatcagtgagcccctcaacaagagcctgcgccgctcccgcccgctctcccactactcttcttttggcagcagtggtggtagtggcggtggcagcatgatgggcggagagtctgctgacaaggccactgcggctgcagccgctgcctccctgttggccaatgggcatgacctggcggcggccatggcggtggacaaaagcaaccctacctcaaagcacaaaagtggtgctgtggccagcctgctgagcaaggcagagcgggccacggagctggcagccgagggacagctgacgctgcagcagtttgcgcagtccacagagatgctgaagcgggagatgctcctgtcgatgactgctacacctcagcccggggctgcactgccaccctgggcaacttcgccaaggccacctttgatgccatttctaagacctacagctacctgacccccgacctctggaaggagactgtattcaccaagtctccctatcaggagttcactgaccacctcgtcaagacccacaccagagtctccgtgcagcggactcaggctccagctgtggctacaacatagggtttttatacaagaaaaataaagtgaattaagcgtgaaaaaa

SEQ ID NO: 17306 - DNA, 370 bp, Homo sapiens
tgaacatagctagaaagagtaaataaaaagaatactgaccatttaaagtaacaataataaaaatgtctcttaggttttataacatgtagaagtaaaacatatgacaacagtagcataaagggcaggaggaaggaaaggagttaaactattctaagattgatgcaatagggaaataggaaaagtatacatttaaaattattagaaataattcaagaatgcatattgcaatctctaggacaaccaccaaaaaatacataaagctagtagaggagctaaaaatggaataataaaaaatactcagttaatccaaaggaagatagaaaagacaggatcaaaggacaaaaagcagatgagataaatagaaaaaaaa

SEQ ID NO: 17307 - DNA, 966 bp, Homo sapiens
ggaggttcagggaccagcaagaaaaccagggagacgaagagcctggggcgaagggaaggtgagaagacaaaaggttatagcggtaagtgttgtctaaggactccagcttttcctccaagtgagatgggggtcattggaaaggtcacagcagaggagtgatccagcgggaggcatgggtctgtggccgtcatggcccaagagaagccttccaaccataagcagggtcccccagtggagtgggctctgctgggagctaaagtctccccacccctggaagtggtcagcagtgactgggtggccggtcagggcacgaggataaaagaaagatgttcctgctttataactttttaataaactttcactcctgctctaaaaaaaaagaaaagaaaagagaaaagagaaaagaaaagatgttccaactgcacaacgtgccgctcccattattctaaacctctggtttctaagcttttaaaacttcagtatttcaagattctgtctttaagacttttaggttccaggattccgaggcagggtttctaagattccttgcagtggagatgtagcataggttcatttgatttacataaatgcaaatgtaagcatttggccaacaaaggacaccaaatagtatttgatattcaacgtggctgcaaatactagctgacttctttacctgttggccaaccaaagaatcaaaaacctgtggggatgaatgaagggaggccctgctgatctccccgagagaggtttgctatgtgtgcaaccctcagtaacatacatgtgagtcattataggtattttcacaagagattttagtacacccatgtttggccacatgtgctgattttaaaaccttaacccctgagtgagatgaattgccaatacattctcagcttccaaaatgctttgattttaagatttgatgatggaaaccagtgattgtcaaccatgcactgggagaggtga

SEQ ID NO: 17308 - DNA, 424 bp, Homo sapiens
cacctccagttccaactcctccacttccttccattttcttactccaagaactcaacccctcaaccctttgatgtcaagaaatgggtgagtagggactgtggccatggggaaaggtctgcagggcaaaatagtaaacaggatcatcctcaatgagtgtggggtgagctgggaactgcagtgtacacagagccacttgtgcacacacactcacggttttcagagccagcatggctaccccttggaggctcatgttatctctcctccttgcattttcctgcttgtgccctctgcctgtcccccttggccatttacaaacctattgctcttgctcgttctcccttgcccagactagagtgcagtgagccgagagcacgccattgcactccagcctgggcaacaagagcgaaaatccatctcaaaaaaa

SEQ ID NO: 17309 - DNA, 390 bp, Homo sapiens
  misc_feature (372)..(373): n is a, c, g, or t
  misc_feature (375)..(375): n is a, c, g, or t
agctgcacttcagagagtcccactgtaatctgttaatagaatctgctttaaatgagtcactccttagactggcaatgacacccagcttagtctgtaaaatcaggaatctttgtgttggctgaaggaacttagtaatcttagttgaattcctcttccccatgtctttcaaaaccagagcactgggtcgaacctaacccacaaaataattcgtccaaattaaattgacttttttacataacatcagcaccaccccttacacttttaaagttaaagaccctgttgatcaggttacctgggaaattttcaagtgcatctgaccggggattatcaagctccttgtggacatctgtttctggatgctgtggaatgtgnngntcacccaaatagggg

SEQ ID NO: 17310 - DNA, 382 bp, Homo sapiens
aaaaggagaaggtcataagacagtttgaggaaggcattggaagaggaagaggggcaatgtctcctttgtgttattgttggtatataaacttaaaatctcagttctttttatggcacttgtggagccacttcctctcctcaccaaaaaatgcccagtaccctgaatccgatcaaattactctcctaaagtataaggcttagtttctgtgtgctgcttcgcgagacagttcccacaaatcgagagtgttaatcagacttttgtgttttcttttttggattgctgttgtttgttttcatttatcatttgtctttgcctaagccaggctcatcaagaattaacagccatcaggctgccgatgtgctgacagcagacccacttagag

SEQ ID NO: 17311 - DNA, 434 bp, Homo sapiens
ctttcaggagaaaaccacatttaatttatctagagtaccttataaaagataggaatactgctaacatctactatagagcctgcaacttcaaccacttgagcggaactcaaaactctttacatagatgtctggccattaatgggaaaagggcatagaagcctattagctgttgcagtgtgatcaggggaaaattattattattttttcctgaattaaaaaaaaaatcactctacattgcatgatcccaaataactgtgagagagaaaaaaaaagtagcaatattaataagacaattcccaagcgttccctttcagtttcaattattttacctcctttttttcttaaataagatacaagtatttttatgtataaaaaaatgataatgtcatcttagtgagtcactaaatgtatctgacaccaaactactgtttttg

SEQ ID NO: 17312 - DNA, 437 bp, Homo sapiens
actacaccccactaattttttgtatttttagtagagggttttgctgtgttgaccaggctggtctcgaactcctgacctcaagtgatctaccctccttggcctcccaaagtgctgggattacaggtgtgagccaccgcacccagcctgaaatttaaattcttgaaagctttaggtgatgcaaccattgaagaactttaaatagggtcatggtatgatcgaggtgttgtgttgttttgtttggggaagaggggctggagatcccagctagtactgttgaggttgatttgaagttagagcagtgcagggggcatgcagctatgatgggctaagagtcacttaggcagctgttgcacaatgatgaattccctgttcgtggggcacctcgccagatttctgtttctgtctaatctgtagagatcctgttgaaaagtactctg

SEQ ID NO: 17313 - DNA, 381 bp, Homo sapiens
tgctcatggacataaagatgggaacagtagacactggggatgactagagggggaagggagggagagggacaagagttgaaaaattaaatgttggttactatgctcggtacctcggtgggcgggtgggggtcattcataccccaaacctcagcatcatgcaatatatccaggtagcaaacctgcccatgtaccctgggtctaaaataaaagctgaaaaggaaaaaaagagtgttttctcaagctctaaaaaaaaaaaaatagtaatacactttatgacaaaaaactaatttttctttctccaaaaaaaatatagtaaatgatattcatgtatttgccgtggtcattaatatcataaattaaattcatatgttggcttgaggg

SEQ ID NO: 17314 - DNA, 583 bp, Homo sapiens
tcatgccacacatgaaaagaaaggcaactggagtatgaattatgtccttgtttcacttggcattaacaatagagacagggtgaggagactgtgagaactactggtctgagggaggtggttctccattcgtaattgacaaatgctgtgtgtgtccacaacggtttcctcagagccaacctcaaactgtatatattacattgaacagtcaacatgggtaactacaatcctgggtatgatactgcagtaagtgcagcctgaactgtctctactgtgcatgtgggaacagttcattgtttgtcaccaaataattcagacatttgactccattcatactttgactgaaacaatgcaggagtcttctcactggttttatactaaagagattgagcacttaatctgtagtgtacctaaaatggctttcagaattatcagtttacaaacagagtttttggatatgttgaggaggtagatcgcatgccatctcctctctgacgccctccttgacaccccaggcagaagcaatcactgtgcttgatgatgccttgtgcttccatagcattttgtatgtagttcaaccatgtcc

SEQ ID NO: 17315 - DNA, 751 bp, Homo sapiens
gagtcatattgcctcccccttaccaaccaagtgatggcaatactaggaagaggggcaaaagaaaagtcagaaatataagtgataaaataaatggaaatgtttgaaatggatcatcgacctccttttacctattttagcacctcacaaatatcccactctgacagtgctttgttagttatttataaaatattccttaggagattggtcttgcataagacatgcttttaccgtggtccttttcccggtaatagtcactgtcagggacaaaaagtgcctgattgtgttctgtttgtcatgtaggtgggagggaaagagggagagaaagctgagttgaactgaagcagagctttttacagctctattgttctactgtcagagagcaattatactccaacttccatccacctcagacatcccaacctcctcctcctgccaatgcttccccacacacttaacatacagccacacaaccgagttctctggggagaatagggtgctctttaatacctccctctgcccttcagtgagttcagggctctgctttttaactgctaatgtattttagtaaagtttggcaattcaagcttttctagatgtttccttttcggctctggaaaattggaaaaaataatttttaactatatatatttaaaatattcagtggcattatgatattgtctgaaaggcattctgtgacttgatgcaagatcagaagttttttttctttcttggagaagtaataaaaagaaaa

SEQ ID NO: 17316 - DNA, 474 bp, Homo sapiens
cccagccagtcacaggaggcagcactggccctgcgggaagtggccactccgagcttaggggccttcttagatggctgagtgccggcaatgcaggaccctggaggtgtttcagtttcctggagctatctcaacaaagtacccggaactggggggcttaaaataacggcaatttattctctcccagttctggaggccagaagtctcagatcagtattgctgggctgaagtggagacagaagctccttccagggccctcggggaggatcctagcctcctccagcctccggtggaggccgcagcccttcctggtctttcctcctcgcctccgtcacctcatggccttttcctctgtgcctgtgtctcttcttataaggacactcatctggatttagagcccaccctaatccaggataacctcatcgtcttgtgattatatctgcaaagaacctatttctaaataaagtcacgcaggta

SEQ ID NO: 17317 - DNA, 408 bp, Homo sapiens
atatacataacataacttcagcaggagttcatatattattaaatggtcttgtgaataaaggaaactcacatctaaacactgactagacctggcaaacattcaggttaagagtacaacacatatagtattactttaattggtaggtttctattaccaataatttgctctctacatatgaaaaggaatattacactgtataattatagccagtttcgtgagcatctacatacagaactggagaaatcacatggtcatgtataactttgaagctggtggaatcgttttgtaattacttaaaagattaaagaatattcaagattatatctttaaaccattttgattgtaatttgcctcgtagtatctattttcattgggtagtccaaagtatttatatttgacagcatggga

SEQ ID NO: 17318 - DNA, 446 bp, Homo sapiens
ggcggcgggcagctacagcacatcggtgggagggcctaatcggattgtaagctcgtcgaggccgctggtctcttgctctcgaggactccatcccagcattggcagcctccgcctccccatgtcccaaaagaggaaactgggctggagaaagtttcgcagcccaaggacgcgtggctggaagtggcagaacccgggcttccgaggttgggcgagtggggtcctccaaggccctcagcacgggtcggagggattgggactgaacccgccatccccctggaccttggtgccctccaagccccgcgctcgcgccctgtccgtcgcctcccccagagatgctctgcagggacgatgagaccttggtgttccccggttctctgtcccctggcaccacctgaacgattgacatcgcatttgtacttttgtttacttaaattttttcctgtaaa

SEQ ID NO: 17319 - DNA, 427 bp, Homo sapiens
ctaactggatgattattttctgagatcctatcatgtccttcaataccaatgtcacctcacttataatacctgtttactacttgtctcatgctccaccttcccatgcccagactctgagcatcctgagtatgggaatcaggtgacttcattttgtagccctcttacctggcacagtacatgacacatggcaggtgctcaataaaagaattgctgaaccagctcataaggatatcagtttgcccatgtagagtgctttacaatctgcaaacctccttcatgtgcattttgtcagattatctaaatcaaataagatttgttgggattaacattttgggggaaataggcaaaggagtatagctgaattagcaactgcatgatgtgatatgtaaaaatatgtaaaaataaatcagcgtaagttaaacccttg

SEQ ID NO: 17320 - DNA, 320 bp, Homo sapiens
ttgtcaattaaagtgaaccttccttactaaaaagaaactagattttaatgggtgtagactttcagttttgcaaaagagaaacaattctgaagatggatggtggtgatggttttacaacagtgtgaatgtgattaatgccactgactgtatacttgaaaatggtgaagatgggggtgcagggggagggagggcatcaggaaaaccagctaatatatgtcaggcttaatacctaggtgatgatgggttgacaggtgcagcaaaccaccgtggcacacgtttacctatgtaataaacctgcacatcctgcacatataccccgg

SEQ ID NO: 17321 - DNA, 612 bp, Homo sapiens
aataagatactttagcacctagtgaggtatgtcaggttttatgaagctactgtttcctcccagtttctataacctatttctttctgctaatctgtttagactgtaggcattgttcaggtactaatagaaagttgtcatctatgtgtttggtttccttatatgaacagttaaaaggatggagaggtggatagagaacaagattccccattgacacccataacaagaaacatctaaattctacatataaccacaaaaagactatttgaaattagttcagataatgtattttctcatgatttgaattgaatgttatagagaagagaaaggccaggtgcagtggttcacacctgtaatcccagcactttgggaagccgaggtgggtggatcacctgaggtcaggagttccagaccagcctggtcaacatggtgaaacctcgtttctactgtgaaacctctgcctcctgtagccaggcatggtggtgggcgcctataatcccagctccttgggaggctgaggcaggagagtcgtttgaactcaggaggcagaggttgcagtgtgccgagattgcaccactgcactccagcctgggcgacaaagcaagaccttgtctc

SEQ ID NO: 17322 - DNA, 566 bp, Homo sapiens
  misc_feature (387)..(387): n is a, c, g, or t
  misc_feature (391)..(391): n is a, c, g, or t
  misc_feature (395)..(395): n is a, c, g, or t
  misc_feature (398)..(398): n is a, c, g, or t
  misc_feature (404)..(404): n is a, c, g, or t
  misc_feature (415)..(415): n is a, c, g, or t
  misc_feature (430)..(430): n is a, c, g, or t
  misc_feature (440)..(440): n is a, c, g, or t
  misc_feature (464)..(464): n is a, c, g, or t
  misc_feature (476)..(476): n is a, c, g, or t
  misc_feature (480)..(480): n is a, c, g, or t
  misc_feature (482)..(482): n is a, c, g, or t
  misc_feature (484)..(484): n is a, c, g, or t
  misc_feature (493)..(494): n is a, c, g, or t
  misc_feature (502)..(502): n is a, c, g, or t
gggaaacaaagctcatacagctttatgcagcttcaggtaggataatcaatggataattacttatgtcaatttctgatggagtaagttgcatagctcttgttttctttatgttcaagctatttggatctgtgttaacactgatattttgttaacagctgttttctagagcgagacgtgttaatgcacttatgtctgatatatgttcttctgaggtagccttttcaactttttcttagtgtaataatattcattattctactaggacagtaaaattaccaaatatagagtatatgaggggttttgttgttatgcttgctgtttaataattgaatagtcagaaatcagccaggcatggtggtgtgcatgcctttagtcccagctacttcnggangctnagncatganaatcacttgancccaggaggtgaagnttgcagtganagccgagatcatgcaccactgcantccagcctgggngacngngngacagagtnngactcttnaaaaaaaaaaaggaatagtcaaatcatagcaattaaatgatattacctcagtgatctatgtctt

SEQ ID NO: 17323 - DNA, 380 bp, Homo sapiens
accattatgtatggttatttacattatacattatatgccatttaataacatttaaagtgttataaagatgcaattttaaattacaagtggatttgtgacaagataattgaatccacaatttatgtcaacagagttggaaattgttgaggcatgtttctaaacttttaaaataggtcttcatttgagtagattttctttttttttctttctttctttttttttttttttccttgagacagggtttcactcccgtcatccagactggagtgcagtggtgtgatctcagctcgctacaacttctgcctcctgggctcaagtgattctcatgcctcagcctcctgagtagctgggattacaggcatgcaccacagtgcccagct

SEQ ID NO: 17324 - DNA, 298 bp, Homo sapiens
gagtatctttgccgctggtacaggcaagaattgtaaaaacaccctcccctgataggttcgaattcaacatctctttcttagtgcttgcaagagtttatgttatggatcataaagtcctctatttttctgaaaaggtctttgcccaaaggccccttcagttgtgcaaggagacattttttgatttgcaacctgtctcttttcccctcccaattccttagaggaaatcaccagtacattatcacttgaatgggccattaaggttagacataccctacccgtcttttcctgcttttccctt

SEQ ID NO: 17325 - DNA, 2016 bp, Homo sapiens
agctgagagtgacgcctctgagccgcggaggattgtgggaggaggttgtctccaatttctcctccccctcccggccaagatgtctgacatggaggatgatttcatgtgcgatgatgaggaggactacgacctggaatactctgaagatagtaactccgagccaaatgtggatttggaaaatcagtactataattccaaagcattaaaagaagatgacccaaaagcggcattaagcagtttccaaaaggttttggaacttgaaggtgaaaaaggagaatggggatttaaagcactgaaacaaatgattaagattaacttcaagttgacaaactttccagaaatgatgaatagatataagcagctattgacctatattcggagtgcagtcacaagaaattattctgaaaaatccattaattctattcttgattatatctctacttctaaacagatggatttactgcaggaattctatgaaacaacactggaagctttgaaagatgctaagaatgatagactgtggtttaagacaaacacaaagcttggaaaattatatttagaacgagaggaatatggaaagcttcaaaaaattttacgccagttacatcagtcgtgccagactgatgatggagaagatgatctgaaaaaaggtacacagttattagaaatatatgctttggaaattcaaatgtacacagcacagaaaaataacaaaaaacttaaagcactctatgaacagtcacttcacatcaagtctgccatccctcatccactgattatgggagttatcagagaatgtggtggtaaaatgcacttgagggaaggtgaatttgaaaaggcacacactgatttttttgaagccttcaagaattatgatgaatctggaagtccaagacgaaccacttgcttaaaatatttggtcttagcaaatatgcttatgaaatcgggaataaatccatttgactcacaggaggccaagccgtacaaaaatgatccagaaattttagcaatgacgaatttagtaagtgcctatcagaataatgacatcactgaatttgaaaagattctaaaaacaaatcacagcaacatcatggatgatcctttcataagagaacacattgaagagcttttgcgaaacatcagaacacaagtgcttataaaattaattaagccttacacaagaatacatattccttttatttctaaggagttaaacatagatgtagctgatgtggagagcttgctggtgcagtgcatattggataacactattcatggccgaattgatcaagtcaaccaactccttgaactggatcatcagaagaggggtggtgcacgatatactgcactagataaatggaccaaccaactaaattctctcaaccaggctgtagtcagtaaactggcttaacagagaacaagcttttacagacgtccttaaggcaacagtgcagagatgtaatccttaaaagaactgggaatggcaaaactactgtcggttgatgtgtcctgaaaattattggagttatggcagaagtgcttttttgatcaactggtttgtgttttgctgctgcatttatcccaagaaaaacagctttaatctccagaagaaaaccaaaataccatgggatttatgctgtattgacatcttgccctaaacgtacaacatcatagtaatttgtcatgggcaacatgaccagagagaagatttttgtcatgattttaaatacactgacacgctactgttggttaaatttaaacatgttttacctgcagaaattctctcacaaataacctgcaataacttgaaatgcatacccttttgaacacttccttttctcatgtataaattaaaatgtttgctgcattttgcaaaatgtcaattctctaaaaatgtgtccgtatatttctgtacctgcagtgtagtaaaggtttagacgaaaccccataattatagtggcatactgtcacttaggtttcaagcagcaaaataaacagtgcagctcagaaattgta

SEQ ID NO: 17326 - DNA, 2040 bp, Homo sapiens
agctgagagtgacgcctctgagccgcggaggattgtgggaggaggttgtctccaatttctcctccccctcccggccaagatgtctgacatggaggatgatttcatgtgcgatgatgaggaggactacgacctggaatactctgaagatagtaactccgagccaaatgtggatttggaaaatcagtactataattccaaagcattaaaagaagatgacccaaaagcggcattaagcagtttccaaaaggttttggaacttgaaggtgaaaaaggagaatggggatttaaagcactgaaacaaatgattaagattaacttcaagttgacaaactttccagaaatgatgaatagatataagcagctattgacctatattcggagtgcagtcacaagaaattattctgaaaaatccattaattctattcttgattatatctctacttctaaacagaattctgattttttatgtcagatgatggatttactgcaggaattctatgaaacaacactggaagctttgaaagatgctaagaatgatagactgtggtttaagacaaacacaaagcttggaaaattatatttagaacgagaggaatatggaaagcttcaaaaaattttacgccagttacatcagtcgtgccagactgatgatggagaagatgatctgaaaaaaggtacacagttattagaaatatatgctttggaaattcaaatgtacacagcacagaaaaataacaaaaaacttaaagcactctatgaacagtcacttcacatcaagtctgccatccctcatccactgattatgggagttatcagagaatgtggtggtaaaatgcacttgagggaaggtgaatttgaaaaggcacacactgatttttttgaagccttcaagaattatgatgaatctggaagtccaagacgaaccacttgcttaaaatatttggtcttagcaaatatgcttatgaaatcgggaataaatccatttgactcacaggaggccaagccgtacaaaaatgatccagaaattttagcaatgacgaatttagtaagtgcctatcagaataatgacatcactgaatttgaaaagattctaaaaacaaatcacagcaacatcatggatgatcctttcataagagaacacattgaagagcttttgcgaaacatcagaacacaagtgcttataaaattaattaagccttacacaagaatacatattccttttatttctaaggagttaaacatagatgtagctgatgtggagagcttgctggtgcagtgcatattggataacactattcatggccgaattgatcaagtcaaccaactccttgaactggatcatcagaagaggggtggtgcacgatatactgcactagataaatggaccaaccaactaaattctctcaaccaggctgtagtcagtaaactggcttaacagagaacaagcttttacagacgtccttaaggcaacagtgcagagatgtaatccttaaaagaactgggaatggcaaaactactgtcggttgatgtgtcctgaaaattattggagttatggcagaagtgcttttttgatcaactggtttgtgttttgctgctgcatttatcccaagaaaaacagctttaatctccagaagaaaaccaaaataccatgggatttatgctgtattgacatcttgccctaaacgtacaacatcatagtaatttgtcatgggcaacatgaccagagagaagatttttgtcatgattttaaatacactgacacgctactgttggttaaatttaaacatgttttacctgcagaaattctctcacaaataacctgcaataacttgaaatgcatacccttttgaacacttccttttctcatgtataaattaaaatgtttgctgcattttgcaaaatgtcaattctctaaaaatgtgtccgtatatttctgtacctgcagtgtagtaaaggtttagacgaaaccccataattatagtggcatactgtcacttaggtttcaagcagcaaaataaacagtgcagctcagaaattgta

SEQ ID NO: 17327 - DNA, 1890 bp, Homo sapiens
agctgagagtgacgcctctgagccgcggaggattgtgggaggaggttgtctccaatttctcctccccctcccggccaagatgtctgacatggaggatgatttcatgtgcgatgatgaggaggactacgacctggaatactctgaagatagtaactccgagccaaatgtggatttggaaaatcagtactataattccaaagcattaaaagaagatgacccaaaagcggcattaagcagtttccaaaaggttttggaacttgaaggtgaaaaaggagaatggggatttaaagcactgaaacaaatgattaagattaacttcaagttgacaaactttccagaaatgatgaatagatataagcagctattgacctatattcggagtgcagtcacaagaaattattctgaaaaatccattaattctattcttgattatatctctacttctaaacagatggatttactgcaggaattctatgaaacaacactggaagctttgaaagatgctaagaatgatagactgtggtttaagacaaacacaaagcttggaaaattatatttagaacgagaggaatatggaaagcttcaaaaaattttacgccagttacatcagtcgtgccagactgatgatggagaagatgatctgaaaaaaggtacacagttattagaaatatatgctttggaaattcaaatgtacacagcacagaaaaataacaaaaaacttaaagcactctatgaacagtcacttcacatcaagtctgccatccctcatccactgattatgggagttatcagagaatgtggtggtaaaatgcacttgagggaaggtgaatttgaaaaggcacacactgatttttttgaagccttcaagaattatgatgaatctggaagtccaagacgaaccacttgcttaaaatatttggtcttagcaaatatgcttatgaaatcgggaataaatccatttgactcacaggaggccaagccgtacaaaaatgatccagaaattttagcaatgacgaatttagtaagtgcctatcagaataatgacatcactgaatttgaaaagattctaaaaacaaatcacagcaacatcatggatgatcctttcataagagaacacattgaagagcttttgcgaaacatcagaacacaagtgcttataaaattaattaagccttacacaagaatacatattccttttatttctaaggagttaaacatagatgtagctgatgtggagagcttgctggtgcagtgcatattggataacactattcatggccgaattgatcaagtcaaccaactccttgaactggatcatcagaagaggggtggtgcacgatatactgcactagataaatggaccaaccaactaaattctctcaaccaggctgtagtcagtaaactggcttaacagagaacaagcttttacagacgtccttaaggcaacagtgcagagatgtaatccttaaaagaactgggaatggcaaaactactgtcggttgatgtgtcctgaaaattattggagttatggcagaagtgcttttttgatcaactggtttgtgttttgctgctgcatttatcccaagaaaaacagctttaatctccagaagaaaaccaaaataccatgggatttatgctgtattgacatcttgccctaaacgtacaacatcatagtaatttgtcatgggcaacatgaccagagagaagatttttgtcatgattttaaatacactgacacgctactgttggttaaatttaaacatgttttacctgcagaaattctctcacaaataacctgcaataacttgaaatgcatacccttttgaacacttccttttctcatgtataaattaaaatgtttgctgcattttgcaaaatgtcaattctcta

SEQ ID NO: 17328 - DNA, 4084 bp, Homo sapiens
agctgagagtgacgcctctgagccgcggaggattgtgggaggaggttgtctccaatttctcctccccctcccggccaagatgtctgacatggaggatgatttcatgtgcgatgatgaggaggactacgacctggaatactctgaagatagtaactccgagccaaatgtggatttggaaaatcagtactataattccaaagcattaaaagaagatgacccaaaagcggcattaagcagtttccaaaaggttttggaacttgaaggtgaaaaaggagaatggggatttaaagcactgaaacaaatgattaagattaacttcaagttgacaaactttccagaaatgatgaatagatataagcagctattgacctatattcggagtgcagtcacaagaaattattctgaaaaatccattaattctattcttgattatatctctacttctaaacagatggatttactgcaggaattctatgaaacaacactggaagctttgaaagatgctaagaatgatagactgtggtttaagacaaacacaaagcttggaaaattatatttagaacgagaggaatatggaaagcttcaaaaaattttacgccagttacatcagtcgtgccagactgatgatggagaagatgatctgaaaaaaggtacacagttattagaaatatatgctttggaaattcaaatgtacacagcacagaaaaataacaaaaaacttaaagcactctatgaacagtcacttcacatcaagtctgccatccctcatccactgattatgggagttatcagagaatgtggtggtaaaatgcacttgagggaaggtgaatttgaaaaggcacacactgatttttttgaagccttcaagaattatgatgaatctggaagtccaagacgaaccacttgcttaaaatatttggtcttagcaaatatgcttatgaaatcgggaataaatccatttgactcacaggaggccaagccgtacaaaaatgatccagaaattttagcaatgacgaatttagtaagtgcctatcagaataatgacatcactgaatttgaaaagattctaaaaacaaatcacagcaacatcatggatgatcctttcataagagaacacattgaagagcttttgcgaaacatcagaacacaagtgcttataaaattaattaagccttacacaagaatacatattccttttatttctaaggagttaaacatagatgtagctgatgtggagagcttgctggtgcagtgcatattggataacactattcatggccgaattgatcaagtcaaccaactccttgaactggatcatcagaagaggggtggtgcacgatatactgcactagataaatggaccaaccaactaaattctctcaaccaggctgtagtcagtaaactggcttaacagagaacaagcttttacagacgtccttaaggcaacagtgcagagatgtaatccttaaaagaactgggaatggcaaaactactgtcggttgatgtgtcctgaaaattattggagttatggcagaagtgcttttttgatcaactggtttgtgttttgctgctgcatttatcccaagaaaaacagctttaatctccagaagaaaaccaaaataccatgggatttatgctgtattgacatcttgccctaaacgtacaacatcatagtaatttgtcatgggcaacatgaccagagagaagatttttgtcatgattttaaatacactgacacgctactgttggttaaatttaaacatgttttacctgcagaaattctctcacaaataacctgcaataacttgaaatgcatacccttttgaacacttccttttctcatgtataaattaaaatgtttgctgcattttgcaaaatgtcaattctctaaaaatgtgtccgtatatttctgtacctgcagtgtagtaaaggtttagacgaaaccccataattatagtggcatactgtcacttaggtttcaagcagcaaaataaacagtgcagctcagaaattgtagtttggttcttgatgtgtttttattacatttggagttgttttgttttttagtaccttcgaaatttcaaattattttatcttcagttaatgattttaaaaagcctgggggcaaataagttggttatttgctttcaagtttttaaaagtagtctttattgatagagtaaggagaactactttctaacaaaacacgtgcatagttatgacagtgatgctttaaaggaataaaattctttttttttaaagagtgatattccttttcaaaagaatactaactctcagaatgttcactttaaacgaatatgccagaacatagacagctaaatgaatgttactctgcatagtgatcatgctggaaggttatttcctaatgccagcaatctaccattgcccaaaacctgctgagtttactcttttagaattgcattcaaagttaatttgtcacacacactaaactttatgattatacatgttttaaaaaatatagtattaggaagcttgattatttttagttaccattacttggcaccaaatgaaagtttccaaaacttccacctaactttgaggtaatgcagaaagtatataactggctttgaaggcaatcccaaaagagttttaaaggttttttgagcagtggcagtatacttaggagaatgaactgtggccttccaaggtaactaccttaaaggaactcagctcatttgaatgtattgagttttggatgtatttgtttcattttttaaaaagttcacattattttatagtgtcgaaaggaagaactaggattaacataatttctttggtttttctattgcttgttattattatgtaaaaactgggtggcagttcagaaggaagattgtggttacagaagagtgacaaccaagaattttttgatcattaaatcagattttataaacagtggaaggagcatggacttaaaacaaggcatgcttattcggttttgtcaaaattttacgaaaatatgtgatatatatttatactaaaaatatataatccttagatttagaaaagcaatcagttaatgtctttagcagactaaagcagtattaaacacaggtacaagttggaaattgtagaaaacggaaagaaaacaaaagacaaaatgtctatggtagggaataaaagtttaagatattataaaattatgtgtattttctcttttacataaatcatttgtgaaaagtgtgctaaactttttttacaagagtgatattaattaggatttatttttcaatataatttggagaccctttgttatccaaataaaaatgatgagtttttgtgcctgtattcaaatatgtatgcatgtgataacccttgaaagctaaagcccttcttaacttttgagttgatggaattagaattcaaagatttgaatgaaatgatttaacctttatcctccaattcttacagtgcccagttctcctgtgctatctttgctttgtacaatagtgcatcttccactttctagagagaaagcatgcacttgttatttggaaaactgggctaaatatataacagtatccaaagttataccataataatttattgtaattgtgtattacatagctttgtttacccagatataggtgcgttcttttttttctgttagtcatctgtgacttttgttctggaatacaggtttttaaatatatcttaacagtctgactaacttaaaataatttattcttcccttaaaacatttttctgtgtttttgtgcatcaaatattgtagagttgaaatcttagagattgcttatcgaaatataaatttaggggaagttaaaaatcgattggcaaatttgtagcatttattcactgattaaatcttttccacttttgtgaaaaccataccagtggtttacatcatattgtaatgtgttcatctcattcttctttttatccctaaacctagctaaaagttactgcaaagaaatctttggctgccacaagtagatgctctctactaccagagctggatttccattactcactcttgctcttacattaaagttgttgattaaatactttttctctaaattaa

SEQ ID NO: 17329 - DNA, 3891 bp, Homo sapiens
agctgagagtgacgcctctgagccgcggaggattgtgggaggaggttgtctccaatttctcctccccctcccggccaagatgtctgacatggaggatgatttcatgtgcgatgatgaggaggactacgacctggaatactctgaagatagtaactccgagccaaatgtggatttggaaaatcagtactataattccaaagcattaaaagaagatgacccaaaagcggcattaagcagtttccaaaaggttttggaacttgaaggtgaaaaaggagaatggggatttaaagcactgaaacaaatgattaagattaacttcaagttgacaaactttccagaaatgatgaatagatataagcagctattgacctatattcggagtgcagtcacaagaaattattctgaaaaatccattaattctattcttgattatatctctacttctaaacagatggatttactgcaggaattctatgaaacaacactggaagctttgaaagatgctaagaatgatagactgtggtttaagacaaacacaaagcttggaaaattatatttagaacgagaggaatatggaaagcttcaaaaaattttacgccagttacatcagtcgtgccagactgatgatggagaagatgatctgaaaaaaggtacacagttattagaaatatatgctttggaaattcaaatgtacacagcacagaaaaataacaaaaaacttaaagcactctatgaacagtcacttcacatcaagtctgccatccctcatccactgattatgggagttatcagagaatgtggtggtaaaatgcacttgagggaaggtgaatttgaaaaggcacacactgatttttttgaagccttcaagaattatgatgaatctggaagtccaagacgaaccacttgcttaaaatatttggtcttagcaaatatgcttatgaaatcgggaataaatccatttgactcacaggaggccaagccgtacaaaaatgatccagaaattttagcaatgacgaatttagtaagtgcctatcagaataatgacatcactgaatttgaaaagattctaaaaacaaatcacagcaacatcatggatgatcctttcataagagaacacattgaagagcttttgcgaaacatcagaacacaagtgcttataaaattaattaagccttacacaagaatacatattccttttatttctaaggagttaaacatagatgtagctgatgtggagagcttgctggtgcagtgcatattggataacactattcatggccgaattgatcaagtcaaccaactccttgaactggatcatcagaagaggggtggtgcacgatatactgcactagataaatggaccaaccaactaaattctctcaaccaggctgtagtcagtaaactggcttaacagagaacaagcttttacagacgtccttaaggcaacagtgcagagatgtaatccttaaaagaactgggaatggcaaaactactgtcggttgatgtgtcctgaaaattattggagttatggcagaagtgcttttttgatcaactggtttgtgttttgctgctgcatttatcccaagaaaaacagctttaatctccagaagaaaaccaaaataccatgggatttatgctgtattgacatcttgccctaaacgtacaacatcatagtaatttgtcatgggcaacatgaccagagagaagatttttgtcatgattttaaatacactgacacgctactgttggttaaatttaaacatgttttacctgcagaaattctctcacaaataacctgcaataacttgaaatgcatacccttttgaacacttccttttctcatgtataaattaaaatgtttgctgcattttgcaaaatgtcaattctctaaaaatgtgtccgtatatttctgtacctgcagtgtagtaaaggtttagacgaaaccccataattatagtggcatactgtcacttaggtttcaagcagcaaaataaacagtgcagctcagaaattgtagtttggttcttgatgtgtttttattacatttggagttgttttgttttttagtaccttcgaaatttcaaattattttatcttcagttaatgattttaaaaagcctgggggcaaataagttggttatttgctttcaagtttttaaaagtagtctttattgatagagtaaggagaactactttctaacaaaacacgtgcatagttatgacagtgatgctttaaaggaataaaattctttttttttaaagagtgatattccttttcaaaagaatactaactctcagaatgttcactttaaacgaatatgccagaacatagacagctaaatgaatgttactctgcatagtgatcatgctggaaggttatttcctaatgccagcaatctaccattgcccaaaacctgctgagtttactcttttagaattgcattcaaagttaatttgtcacacacactaaactttatgattatacatgttttaaaaaatatagtattaggaagcttgattatttttagttaccattacttggcaccaaatgaaagtttccaaaacttccacctaactttgaggtaatgcagaaagtatataactggctttgaaggcaatcccaaaagagttttaaaggttttttgagcagtggcagtatacttaggagaatgaactgtggccttccaaggtaactaccttaaaggaactcagctcatttgaatgtattgagttttggatgtatttgtttcattttttaaaaagttcacattattttatagtgtcgaaaggaagaactaggattaacataatttctttggtttttctattgcttgttattattatgtaaaaactgggtggcagttcagaaggaagattgtggttacagaagagtgacaaccaagaattttttgatcattaaatcagattttataaacagtggaaggagcatggacttaaaacaaggcatgcttattcggttttgtcaaaattttacgaaaatatgtgatatatatttatactaaaaatatataatccttagatttagaaaagcaatcagttaatgtctttagcagactaaagcagtattaaacacaggtacaagttggaaattgtagaaaacggaaagaaaacaaaagacaaaatgtctatggtagggaataaaagtttaagatattataaaattatgtgtattttctcttttacataaatcatttgtgaaaagtgtgctaaactttttttacaagagtgatattaattaggatttatttttcaatataatttggagaccctttgttatccaaataaaaatgatgagtttttgtgcctgtattcaaatatgtatgcatgtgataacccttgaaagctaaagcccttcttaacttttgagttgatggaattagaattcaaagatttgaatgaaatgatttaacctttatcctccaattcttacagtgcccagttctcctgtgctatctttgctttgtacaatagtgcatcttccactttctagagagaaagcatgcacttgttatttggaaaactgggctaaatatataacagtatccaaagttataccataataatttattgtaattgtgtattacatagctttgtttacccagatataggtgcgttcttttttttctgttagtcatctgtgacttttgttctggaatacaggtttttaaatatatcttaacagtctgactaacttaaaataatttattcttcccttaaaacatttttctgtgtttttgtgcatcaaatattgtagagttgaaatcttagagattgcttatcgaaatataaatttaggggaagttaaaaatcgattggcaaatttgtagcatttattcactgattaaatcttttccacttttgtgaaaacca

SEQ ID NO: 17330 - DNA, 4040 bp, Homo sapiens
agctgagagtgacgcctctgagccgcggaggattgtgggaggaggttgtctccaatttctcctccccctcccggccaagatgtctgacatggaggatgatttcatgtgcgatgatgaggaggactacgacctggaatactctgaagatagtaactccgagccaaatgtggatttggaaaatcagtactataattccaaagcattaaaagaagatgacccaaaagcggcattaagcagtttccaaaaggttttggaacttgaaggtgaaaaaggagaatggggatttaaagcactgaaacaaatgattaagattaacttcaagttgacaaactttccagaaatgatgaatagatataagcagctattgacctatattcggagtgcagtcacaagaaattattctgaaaatggatttactgcaggaattctatgaaacaacactggaagctttgaaagatgctaagaatgatagactgtggtttaagacaaacacaaagcttggaaaattatatttagaacgagaggaatatggaaagcttcaaaaaattttacgccagttacatcagtcgtgccagactgatgatggagaagatgatctgaaaaaaggtacacagttattagaaatatatgctttggaaattcaaatgtacacagcacagaaaaataacaaaaaacttaaagcactctatgaacagtcacttcacatcaagtctgccatccctcatccactgattatgggagttatcagagaatgtggtggtaaaatgcacttgagggaaggtgaatttgaaaaggcacacactgatttttttgaagccttcaagaattatgatgaatctggaagtccaagacgaaccacttgcttaaaatatttggtcttagcaaatatgcttatgaaatcgggaataaatccatttgactcacaggaggccaagccgtacaaaaatgatccagaaattttagcaatgacgaatttagtaagtgcctatcagaataatgacatcactgaatttgaaaagattctaaaaacaaatcacagcaacatcatggatgatcctttcataagagaacacattgaagagcttttgcgaaacatcagaacacaagtgcttataaaattaattaagccttacacaagaatacatattccttttatttctaaggagttaaacatagatgtagctgatgtggagagcttgctggtgcagtgcatattggataacactattcatggccgaattgatcaagtcaaccaactccttgaactggatcatcagaagaggggtggtgcacgatatactgcactagataaatggaccaaccaactaaattctctcaaccaggctgtagtcagtaaactggcttaacagagaacaagcttttacagacgtccttaaggcaacagtgcagagatgtaatccttaaaagaactgggaatggcaaaactactgtcggttgatgtgtcctgaaaattattggagttatggcagaagtgcttttttgatcaactggtttgtgttttgctgctgcatttatcccaagaaaaacagctttaatctccagaagaaaaccaaaataccatgggatttatgctgtattgacatcttgccctaaacgtacaacatcatagtaatttgtcatgggcaacatgaccagagagaagatttttgtcatgattttaaatacactgacacgctactgttggttaaatttaaacatgttttacctgcagaaattctctcacaaataacctgcaataacttgaaatgcatacccttttgaacacttccttttctcatgtataaattaaaatgtttgctgcattttgcaaaatgtcaattctctaaaaatgtgtccgtatatttctgtacctgcagtgtagtaaaggtttagacgaaaccccataattatagtggcatactgtcacttaggtttcaagcagcaaaataaacagtgcagctcagaaattgtagtttggttcttgatgtgtttttattacatttggagttgttttgttttttagtaccttcgaaatttcaaattattttatcttcagttaatgattttaaaaagcctgggggcaaataagttggttatttgctttcaagtttttaaaagtagtctttattgatagagtaaggagaactactttctaacaaaacacgtgcatagttatgacagtgatgctttaaaggaataaaattctttttttttaaagagtgatattccttttcaaaagaatactaactctcagaatgttcactttaaacgaatatgccagaacatagacagctaaatgaatgttactctgcatagtgatcatgctggaaggttatttcctaatgccagcaatctaccattgcccaaaacctgctgagtttactcttttagaattgcattcaaagttaatttgtcacacacactaaactttatgattatacatgttttaaaaaatatagtattaggaagcttgattatttttagttaccattacttggcaccaaatgaaagtttccaaaacttccacctaactttgaggtaatgcagaaagtatataactggctttgaaggcaatcccaaaagagttttaaaggttttttgagcagtggcagtatacttaggagaatgaactgtggccttccaaggtaactaccttaaaggaactcagctcatttgaatgtattgagttttggatgtatttgtttcattttttaaaaagttcacattattttatagtgtcgaaaggaagaactaggattaacataatttctttggtttttctattgcttgttattattatgtaaaaactgggtggcagttcagaaggaagattgtggttacagaagagtgacaaccaagaattttttgatcattaaatcagattttataaacagtggaaggagcatggacttaaaacaaggcatgcttattcggttttgtcaaaattttacgaaaatatgtgatatatatttatactaaaaatatataatccttagatttagaaaagcaatcagttaatgtctttagcagactaaagcagtattaaacacaggtacaagttggaaattgtagaaaacggaaagaaaacaaaagacaaaatgtctatggtagggaataaaagtttaagatattataaaattatgtgtattttctcttttacataaatcatttgtgaaaagtgtgctaaactttttttacaagagtgatattaattaggatttatttttcaatataatttggagaccctttgttatccaaataaaaatgatgagtttttgtgcctgtattcaaatatgtatgcatgtgataacccttgaaagctaaagcccttcttaacttttgagttgatggaattagaattcaaagatttgaatgaaatgatttaacctttatcctccaattcttacagtgcccagttctcctgtgctatctttgctttgtacaatagtgcatcttccactttctagagagaaagcatgcacttgttatttggaaaactgggctaaatatataacagtatccaaagttataccataataatttattgtaattgtgtattacatagctttgtttacccagatataggtgcgttcttttttttctgttagtcatctgtgacttttgttctggaatacaggtttttaaatatatcttaacagtctgactaacttaaaataatttattcttcccttaaaacatttttctgtgtttttgtgcatcaaatattgtagagttgaaatcttagagattgcttatcgaaatataaatttaggggaagttaaaaatcgattggcaaatttgtagcatttattcactgattaaatcttttccacttttgtgaaaaccataccagtggtttacatcatattgtaatgtgttcatctcattcttctttttatccctaaacctagctaaaagttactgcaaagaaatctttggctgccacaagtagatgctctctactaccagagctggatttccattactcactcttgctcttacattaaagttgttgattaaatactttttctctaaattaa

SEQ ID NO: 17331 - DNA, 4025 bp, Homo sapiens
cagctcggacccacaccacctgagtcgatgatgaggaggactacgacctggaatactctgaagatagtaactccgagccaaatgtggatttggaaaatcagtactataattccaaagcattaaaagaagatgacccaaaagcggcattaagcagtttccaaaaggttttggaacttgaaggtgaaaaaggagaatggggatttaaagcactgaaacaaatgattaagattaacttcaagttgacaaactttccagaaatgatgaatagatataagcagctattgacctatattcggagtgcagtcacaagaaattattctgaaaaatccattaattctattcttgattatatctctacttctaaacagaattctgattttttatgtcagatgatggatttactgcaggaattctatgaaacaacactggaagctttgaaagatgctaagaatgatagactgtggtttaagacaaacacaaagcttggaaaattatatttagaacgagaggaatatggaaagcttcaaaaaattttacgccagttacatcagtcgtgccagactgatgatggagaagatgatctgaaaaaaggtacacagttattagaaatatatgctttggaaattcaaatgtacacagcacagaaaaataacaaaaaacttaaagcactctatgaacagtcacttcacatcaagtctgccatccctcatccactgattatgggagttatcagagaatgtggtggtaaaatgcacttgagggaaggtgaatttgaaaaggcacacactgatttttttgaagccttcaagaattatgatgaatctggaagtccaagacgaaccacttgcttaaaatatttggtcttagcaaatatgcttatgaaatcgggaataaatccatttgactcacaggaggccaagccgtacaaaaatgatccagaaattttagcaatgacgaatttagtaagtgcctatcagaataatgacatcactgaatttgaaaagattctaaaaacaaatcacagcaacatcatggatgatcctttcataagagaacacattgaagagcttttgcgaaacatcagaacacaagtgcttataaaattaattaagccttacacaagaatacatattccttttatttctaaggagttaaacatagatgtagctgatgtggagagcttgctggtgcagtgcatattggataacactattcatggccgaattgatcaagtcaaccaactccttgaactggatcatcagaagaggggtggtgcacgatatactgcactagataaatggaccaaccaactaaattctctcaaccaggctgtagtcagtaaactggcttaacagagaacaagcttttacagacgtccttaaggcaacagtgcagagatgtaatccttaaaagaactgggaatggcaaaactactgtcggttgatgtgtcctgaaaattattggagttatggcagaagtgcttttttgatcaactggtttgtgttttgctgctgcatttatcccaagaaaaacagctttaatctccagaagaaaaccaaaataccatgggatttatgctgtattgacatcttgccctaaacgtacaacatcatagtaatttgtcatgggcaacatgaccagagagaagatttttgtcatgattttaaatacactgacacgctactgttggttaaatttaaacatgttttacctgcagaaattctctcacaaataacctgcaataacttgaaatgcatacccttttgaacacttccttttctcatgtataaattaaaatgtttgctgcattttgcaaaatgtcaattctctaaaaatgtgtccgtatatttctgtacctgcagtgtagtaaaggtttagacgaaaccccataattatagtggcatactgtcacttaggtttcaagcagcaaaataaacagtgcagctcagaaattgtagtttggttcttgatgtgtttttattacatttggagttgttttgttttttagtaccttcgaaatttcaaattattttatcttcagttaatgattttaaaaagcctgggggcaaataagttggttatttgctttcaagtttttaaaagtagtctttattgatagagtaaggagaactactttctaacaaaacacgtgcatagttatgacagtgatgctttaaaggaataaaattctttttttttaaagagtgatattccttttcaaaagaatactaactctcagaatgttcactttaaacgaatatgccagaacatagacagctaaatgaatgttactctgcatagtgatcatgctggaaggttatttcctaatgccagcaatctaccattgcccaaaacctgctgagtttactcttttagaattgcattcaaagttaatttgtcacacacactaaactttatgattatacatgttttaaaaaatatagtattaggaagcttgattatttttagttaccattacttggcaccaaatgaaagtttccaaaacttccacctaactttgaggtaatgcagaaagtatataactggctttgaaggcaatcccaaaagagttttaaaggttttttgagcagtggcagtatacttaggagaatgaactgtggccttccaaggtaactaccttaaaggaactcagctcatttgaatgtattgagttttggatgtatttgtttcattttttaaaaagttcacattattttatagtgtcgaaaggaagaactaggattaacataatttctttggtttttctattgcttgttattattatgtaaaaactgggtggcagttcagaaggaagattgtggttacagaagagtgacaaccaagaattttttgatcattaaatcagattttataaacagtggaaggagcatggacttaaaacaaggcatgcttattcggttttgtcaaaattttacgaaaatatgtgatatatatttatactaaaaatatataatccttagatttagaaaagcaatcagttaatgtctttagcagactaaagcagtattaaacacaggtacaagttggaaattgtagaaaacggaaagaaaacaaaagacaaaatgtctatggtagggaataaaagtttaagatattataaaattatgtgtattttctcttttacataaatcatttgtgaaaagtgtgctaaactttttttacaagagtgatattaattaggatttatttttcaatataatttggagaccctttgttatccaaataaaaatgatgagtttttgtgcctgtattcaaatatgtatgcatgtgataacccttgaaagctaaagcccttcttaacttttgagttgatggaattagaattcaaagatttgaatgaaatgatttaacctttatcctccaattcttacagtgcccagttctcctgtgctatctttgctttgtacaatagtgcatcttccactttctagagagaaagcatgcacttgttatttggaaaactgggctaaatatataacagtatccaaagttataccataataatttattgtaattgtgtattacatagctttgtttacccagatataggtgcgttcttttttttctgttagtcatctgtgacttttgttctggaatacaggtttttaaatatatcttaacagtctgactaacttaaaataatttattcttcccttaaaacatttttctgtgtttttgtgcatcaaatattgtagagttgaaatcttagagattgcttatcgaaatataaatttaggggaagttaaaaatcgattggcaaatttgtagcatttattcactgattaaatcttttccacttttgtgaaaaccataccagtggtttacatcatattgtaatgtgttcatctcattcttctttttatccctaaacctagctaaaagttactgcaaagaaatctttggctgccacaagtagatgctctctactaccagagctggatttccattactcactcttgctcttacattaaagttgttgattaaatactttttctctaaattaa

SEQ ID NO: 17332 - DNA, 3138 bp, Homo sapiens
atcctctataagcggcgtgaaacctgacccgtgacaaaaatgatccagaaatattgagcaatgacgaactttagataatgtgcctatcagaataatgacatcactgaatttgaaaagattctaaaaacaaatcacagcaacatcatggatgatcctttcataagagaacacattgaagagcttttgcgaaacatcagaacacaagtgcttataaaattaattaagccttacacaagaatacatattccttttatttctaaggagttaaacatagatgtagctgatgtggagagcttgctggtgcagtgcatattggataacactattcatggccgaattgatcaagtcaaccaactccttgaactggatcatcagaagaggggtggtgcacgatatactgcactagataaatggaccaaccaactaaattctctcaaccaggctgtagtcagtaaactggcttaacagagaacaagcttttacagacgtccttaaggcaacagtgcagagatgtaatccttaaaagaactgggaatggcaaaactactgtcggttgatgtgtcctgaaaattattggagttatggcagaagtgcttttttgatcaactggtttgtgttttgctgctgcatttatcccaagaaaaacagctttaatctccagaagaaaaccaaaataccatgggatttatgctgtattgacatcttgccctaaacgtacaacatcatagtaatttgtcatgggcaacatgaccagagagaagatttttgtcatgattttaaatacactgacacgctactgttggttaaatttaaacatgttttacctgcagaaattctctcacaaataacctgcaataacttgaaatgcatacccttttgaacacttccttttctcatgtataaattaaaatgtttgctgcattttgcaaaatgtcaattctctaaaaatgtgtccgtatatttctgtacctgcagtgtagtaaaggtttagacgaaaccccataattatagtggcatactgtcacttaggtttcaagcagcaaaataaacagtgcagctcagaaattgtagtttggttcttgatgtgtttttattacatttggagttgttttgttttttagtaccttcgaaatttcaaattattttatcttcagttaatgattttaaaaagcctgggggcaaataagttggttatttgctttcaagtttttaaaagtagtctttattgatagagtaaggagaactactttctaacaaaacacgtgcatagttatgacagtgatgctttaaaggaataaaattctttttttttaaagagtgatattccttttcaaaagaatactaactctcagaatgttcactttaaacgaatatgccagaacatagacagctaaatgaatgttactctgcatagtgatcatgctggaaggttatttcctaatgccagcaatctaccattgcccaaaacctgctgagtttactcttttagaattgcattcaaagttaatttgtcacacacactaaactttatgattatacatgttttaaaaaatatagtattaggaagcttgattatttttagttaccattacttggcaccaaatgaaagtttccaaaacttccacctaactttgaggtaatgcagaaagtatataactggctttgaaggcaatcccaaaagagttttaaaggttttttgagcagtggcagtatacttaggagaatgaactgtggccttccaaggtaactaccttaaaggaactcagctcatttgaatgtattgagttttggatgtatttgtttcattttttaaaaagttcacattattttatagtgtcgaaaggaagaactaggattaacataatttctttggtttttctattgcttgttattattatgtaaaaactgggtggcagttcagaaggaagattgtggttacagaagagtgacaaccaagaattttttgatcattaaatcagattttataaacagtggaaggagcatggacttaaaacaaggcatgcttattcggttttgtcaaaattttacgaaaatatgtgatatatatttatactaaaaatatataatccttagatttagaaaagcaatcagttaatgtctttagcagactaaagcagtattaaacacaggtacaagttggaaattgtagaaaacggaaagaaaacaaaagacaaaatgtctatggtagggaataaaagtttaagatattataaaattatgtgtattttctcttttacataaatcatttgtgaaaagtgtgctaaactttttttacaagagtgatattaattaggatttatttttcaatataatttggagaccctttgttatccaaataaaaatgatgagtttttgtgcctgtattcaaatatgtatgcatgtgataacccttgaaagctaaagcccttcttaacttttgagttgatggaattagaattcaaagatttgaatgaaatgatttaacctttatcctccaattcttacagtgcccagttctcctgtgctatctttgctttgtacaatagtgcatcttccactttctagagagaaagcatgcacttgttatttggaaaactgggctaaatatataacagtatccaaagttataccataataatttattgtaattgtgtattacatagctttgtttacccagatataggtgcgttcttttttttctgttagtcatctgtgacttttgttctggaatacaggtttttaaatatatcttaacagtctgactaacttaaaataatttattcttcccttaaaacatttttctgtgtttttgtgcatcaaatattgtagagttgaaatcttagagattgcttatcgaaatataaatttaggggaagttaaaaatcgattggcaaatttgtagcatttattcactgattaaatcttttccacttttgtgaaaaccataccagtggtttacatcatattgtaatgtgttcatctcattcttctttttatccctaaacctagctaaaagttactgcaaagaaatctttggctgccacaagtagatgctctctactaccagagctggatttccattactcactcttgctcttacattaaagttgttgattaaatactttttctctaaattaa

SEQ ID NO: 17333 - DNA, 2395 bp, Homo sapiens
gtgactctagacggatccccttcaatttctacactaaatacactgacacgctactgttggttaaatttaaacatgttttacctgcagaaattctctcacaaataacctgcaataacttgaaatgcatacccttttgaacacttccttttctcatgtataaattaaaatgtttgctgcattttgcaaaatgtcaattctctaaaaatgtgtccgtatatttctgtacctgcagtgtagtaaaggtttagacgaaaccccataattatagtggcatactgtcacttaggtttcaagcagcaaaataaacagtgcagctcagaaattgtagtttggttcttgatgtgtttttattacatttggagttgttttgttttttagtaccttcgaaatttcaaattattttatcttcagttaatgattttaaaaagcctgggggcaaataagttggttatttgctttcaagtttttaaaagtagtctttattgatagagtaaggagaactactttctaacaaaacacgtgcatagttatgacagtgatgctttaaaggaataaaattctttttttttaaagagtgatattccttttcaaaagaatactaactctcagaatgttcactttaaacgaatatgccagaacatagacagctaaatgaatgttactctgcatagtgatcatgctggaaggttatttcctaatgccagcaatctaccattgcccaaaacctgctgagtttactcttttagaattgcattcaaagttaatttgtcacacacactaaactttatgattatacatgttttaaaaaatatagtattaggaagcttgattatttttagttaccattacttggcaccaaatgaaagtttccaaaacttccacctaactttgaggtaatgcagaaagtatataactggctttgaaggcaatcccaaaagagttttaaaggttttttgagcagtggcagtatacttaggagaatgaactgtggccttccaaggtaactaccttaaaggaactcagctcatttgaatgtattgagttttggatgtatttgtttcattttttaaaaagttcacattattttatagtgtcgaaaggaagaactaggattaacataatttctttggtttttctattgcttgttattattatgtaaaaactgggtggcagttcagaaggaagattgtggttacagaagagtgacaaccaagaattttttgatcattaaatcagattttataaacagtggaaggagcatggacttaaaacaaggcatgcttattcggttttgtcaaaattttacgaaaatatgtgatatatatttatactaaaaatatataatccttagatttagaaaagcaatcagttaatgtctttagcagactaaagcagtattaaacacaggtacaagttggaaattgtagaaaacggaaagaaaacaaaagacaaaatgtctatggtagggaataaaagtttaagatattataaaattatgtgtattttctcttttacataaatcatttgtgaaaagtgtgctaaactttttttacaagagtgatattaattaggatttatttttcaatataatttggagaccctttgttatccaaataaaaatgatgagtttttgtgcctgtattcaaatatgtatgcatgtgataacccttgaaagctaaagcccttcttaacttttgagttgatggaattagaattcaaagatttgaatgaaatgatttaacctttatcctccaattcttacagtgcccagttctcctgtgctatctttgctttgtacaatagtgcatcttccactttctagagagaaagcatgcacttgttatttggaaaactgggctaaatatataacagtatccaaagttataccataataatttattgtaattgtgtattacatagctttgtttacccagatataggtgcgttcttttttttctgttagtcatctgtgacttttgttctggaatacaggtttttaaatatatcttaacagtctgactaacttaaaataatttattcttcccttaaaacatttttctgtgtttttgtgcatcaaatattgtagagttgaaatcttagagattgcttatcgaaatataaatttaggggaagttaaaaatcgattggcaaatttgtagcatttattcactgattaaatcttttccacttttgtgaaaaccataccagtggtttacatcatattgtaatgtgttcatctcattcttctttttatccctaaacctagctaaaagttactgcaaagaaatctttggctgccacaagtagatgctctctactaccagagctggatttccattactcactcttgctcttacattaaagttgttgattaaatactttttctctaaattaa

SEQ ID NO: 17334 - DNA, 2655 bp, Homo sapiens
agctgagagtgacgcctctgagccgcggaggattgtgggaggaggttgtctccaatttctcctccccctcccggccaagatgtctgacatggaggatgatttcatgtgcgatgatgaggaggactacgacctggaatactctgaagatagtaactccgagccaaatgtggatttggaaaatcagtactataattccaaagcattaaaagaagatgacccaaaagcggcattaagcagtttccaaaaggttttggaacttgaaggtgaaaaaggagaatggggatttaaagcactgaaacaaatgattaagattaacttcaagttgacaaactttccagaaatgatgaatagatataagcagctattgacctatattcggagtgcagtcacaagaaattattctgaaaaatccattaattctattcttgattatatctctacttctaaacagatggatttactgcaggaattctatgaaacaacactggaagctttgaaagatgctaagaatgatagactgtggtttaagacaaacacaaagcttggaaaattatatttagaacgagaggaatatggaaagcttcaaaaaattttacgccagttacatcagtcgtgccagactgatgatggagaagatgatctgaaaaaaggtacacagttattagaaatatatgctttggaaattcaaatgtacacagcacagaaaaataacaaaaaacttaaagcactctatgaacagtcacttcacatcaagtctgccatccctcatccactgattatgggagttatcagagaatgtggtggtaaaatgcacttgagggaaggtgaatttgaaaaggcacacactgatttttttgaagccttcaagaattatgatgaatctggaagtccaagacgaaccacttgcttaaaatatttggtcttagcaaatatgcttatgaaatcgggaataaatccatttgactcacaggaggccaagccgtacaaaaatgatccagaaattttagcaatgacgaatttagtaagtgcctatcagaataatgacatcactgaatttgaaaagattctaaaaacaaatcacagcaacatcatggatgatcctttcataagagaacacattgaagagcttttgcgaaacatcagaacacaagtgcttataaaattaattaagccttacacaagaatacatattccttttatttctaaggagttaaacatagatgtagctgatgtggagagcttgctggtgcagtgcatattggataacactattcatggccgaattgatcaagtcaaccaactccttgaactggatcatcagaagaggggtggtgcacgatatactgcactagataaatggaccaaccaactaaattctctcaaccaggctgtagtcagtaaactggcttaacagagaacaagcttttacagacgtccttaaggcaacagtgcagagatgtaatccttaaaagaactgggaatggcaaaactactgtcggttgatgtgtcctgaaaattattggagttatggcagaagtgcttttttgatcaactggtttgtgttttgctgctgcatttatcccaagaaaaacagctttaatctccagaagaaaaccaaaataccatgggatttatgctgtattgacatcttgccctaaacgtacaacatcatagtaatttgtcatgggcaacatgaccagagagaagatttttgtcatgattttaaatacactgacacgctactgttggttaaatttaaacatgttttacctgcagaaattctctcacaaataacctgcaataacttgaaatgcatacccttttgaacacttccttttctcatgtataaattaaaatgtttgctgcattttgcaaaatgtcaattctctaaaaatgtgtccgtatatttctgtacctgcagtgtagtaaaggtttagacgaaaccccataattatagtggcatactgtcacttaggtttcaagcagcaaaataaacagtgcagctcagaaattgtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaggggaggcggagccctcaaaaaatgccagccatcgaggcacgaccacagacaccgcccccagtcatgtaatgaagcagacggcgccccacacaggggaggagagactaatattaatagcaggagaaggacgggcgaacgacaccaacacaaacaaaagacgagagagaagaaaaaaaaataccagacacacggcaacaaaaccatagaaaaagaaaaaacaaaacacaatgcagagaagaagaagaacagagagagaggcaaaaaaaacagcacagacaataccagaacgacacccgacaccgaaacaaaacaaaacaacaacacacgagaaaagagacaatatcaatcaagagacgaggcaagaaaacacacggcgagaagaaaagacgacacaggagcacacggaaagagaaccaaccacgacacaaacaggaaacaggaggacatcacgaaaaaaaagataacaaaccacagggggcgccggaaacaacaacaaagaaaaaacaggcgaga

SEQ ID NO: 17335 - DNA, 1962 bp, Homo sapiens
agctgagagtgacgcctctgagccgcggaggattgtgggaggaggttgtctccaatttctcctccccctcccggccaagatgtctgacatggaggatgatttcatgtgcgatgatgaggaggactacgacctggaatactctgaagatagtaactccgagccaaatgtggatttggaaaatcagtactataattccaaagcattaaaagaagatgacccaaaagcggcattaagcagtttccaaaaggttttggaacttgaaggtgaaaaaggagaatggggatttaaagcactgaaacaaatgattaagattaacttcaagttgacaaactttccagaaatgatgaatagatataagcagctattgacctatattcggagtgcagtcacaagaaattattctgaaaaatccattaattctattcttgattatatctctacttctaaacagatggatttactgcaggaattctatgaaacaacactggaagctttgaaagatgctaagaatgatagactgtggtttaagacaaacacaaagcttggaaaattatatttagaacgagaggaatatggaaagcttcaaaaaattttacgccagttacatcagtcgtgccagactgatgatggagaagatgatctgaaaaaaggtacacagttattagaaatatatgctttggaaattcaaatgtacacagcacagaaaaataacaaaaaacttaaagcactctatgaacagtcacttcacatcaagtctgccatccctcatccactgattatgggagttatcagagaatgtggtggtaaaatgcacttgagggaaggtgaatttgaaaaggcacacactgatttttttgaagccttcaagaattatgatgaatctggaagtccaagacgaaccacttgcttaaaatatttggtcttagcaaatatgcttatgaaatcgggaataaatccatttgactcacaggaggccaagccgtacaaaaatgatccagaaattttagcaatgacgaatttagtaagtgcctatcagaataatgacatcactgaatttgaaaagattctaaaaacaaatcacagcaacatcatggatgatcctttcataagagaacacattgaagagcttttgcgaaacatcagaacacaagtgcttataaaattaattaagccttacacaagaatacatattccttttatttctaaggagttaaacatagatgtagctgatgtggagagcttgctggtgcagtgcatattggataacactattcatggccgaattgatcaagtcaaccaactccttgaactggatcatcagaagaggggtggtgcacgatatactgcactagataaatggaccaaccaactaaattctctcaaccaggctgtagtcagtaaactggcttaacagagaacaagcttttacagacgtccttaaggcaacagtgcagagatgtaatccttaaaagaactgggaatggcaaaactactgtcggttgatgtgtcctgaaaattattggagttatggcagaagtgcttttttgatcaactggtttgtgttttgctgctgcatttatcccaagaaaaacagctttaatctccagaagaaaaccaaaataccatgggatttatgctgtattgacatcttgccctaaacgtacaacatcatagtaatttgtcatgggcaacatgaccagagagaagatttttgtcatgattttaaatacactgacacgctactgttggttaaatttaaacatgttttacctgcagaaattctctcacaaataacctgcaataacttgaaatgcatacccttttgaacacttccttttctcatgtataaattaaaatgtttgctgcattttgcaaaatgtcaattctctacccataattatagtggcatactgtcacttaggtttcaagcagcaaaataaacagtgcagctcagaaattgta

SEQ ID NO: 17336 - DNA, 760 bp, Homo sapiens
gatggggaaggcggcggcggcggtggcctttggggccgaagtgggcgtgcggctcgcgctgttcgcggccttcctggtgacggagctgctccccccgttccagagactcatccagccggaggagatgtggctctaccggaacccctacgtggaggcggagtatttccccaccaagccgatgtttgttattgcatttctctctccactgtctctgatcttcctggccaaatttctcaagaaggcagacacaagagacagcagacaagcctgcctggctgccagccttgccctggctctgaatggcgtctttaccaacacaataaaactgatcgtagggaggccacgcccagatttcttctaccgctgcttccctgatgggctagcccattctgacttgatgtgtacaggggataaggacgtggtgaatgagggccgaaagagcttccccagtggacattcttcctgtatgaatatcatatggactctaccctatgcttgttttcacatcattgaatttaacctagaaagctagtagggatgggaaaatctgactactcttgtttctacaatttggaaaatccccccttctttagtaactccacagtttaacaagtctgagccttgactatttgggtaaatattacagaacagaaaggtagtttaccttcatgagatttgcacatttaattgttatattatttgcctagatcctgcaatcttgtactagcaataaaaatacctttaacgaagaaaaaaaaag

SEQ ID NO: 17337 - DNA, 2345 bp, Homo sapiens
atgttccttctcctcgccctcctcactgagcttggaagactgcaagcccacgaaggttctgaaggaatatttctgcatgtcacagttccacggaagattaagtcaaatgacagtgaagtttcagagaggaagatgatttacatcattacaattgatggacaaccttacactctacatctcggaaaacaatcattcttaccccagaactttttggtttatacatataatgaaactggatctttgcattctgtgtctccatattttatgatgcattgccattaccaaggatatgctgccgaatttccaaattcatttgtgacactcagtatatgttctggtctcaggggatttctccagtttgaaaatatcagttatggaattgaaccagtagaatcttcagcaagatttgagcatataatttatcaaatgaaaaataatgatccaaatgtatccattttagcagtaaattacagtcatatttggcagaaagaccagccctacaaagttcctttaaactcacagataaaaaatctttcaaaactattaccccaatatctggaaatatacattatagtggaaaaagctttgtatgattatatgggatctgaaatgatggctgtaacacaaaaaattgtccaggttattgggcttgtcaacactatgtttacccagttcaaattgactgttatactgtcttccttggaattgtggtcaaatgaaaaccagatttccaccagtggggatgctgatgatatattacaaagatttttggcatggaaacgggactatctcatcctacggccccatgacatagcatacttacttgtttacaggaaacatcctaaatatgtgggagcaacatttcctggcaccgtatgcaataaaagctatgatgcaggtattgctatgtatccagatgcaataggtttggagggattttcggttattatagctcaactgcttggccttaatgtaggattaacatatgatgacatcactcagtgtttctgtctgagagctacatgcatcatgaatcatgaagcagtgagtgccagtggtagaaagatttttagcaactgcagcatgcacgactatagatattttgtttcaaaatttgagactaaatgccttcagaagctttcaaatttgcaaccattacatcaaaatcaaccagtgtgtggtaatgggattttggaatccaatgaagaatgtgactgtggtaataaaaatgaatgtcaatttaagaagtgctgtgattataacacatgtaaactgaagggctcagtaaaatgtggttctggaccatgttgtacatcaaagtgtgagttgtcaatagcaggcactccatgtagaaagagtattgatccagagtgtgattttacagagtactgcaatggaacctctagtaattgtgttcctgacacttatgcattgaatggccgtttgtgcaagttgggaactgcctattgctataacggacaatgtcaaactactgataaccagtgtgccaagatatttggaaaaggtgctcaaggtgctccatttgcctgttttaaagaagttaattctctgcatgaaagatctgaaaactgtggttttaaaaattcacaaccattaccttgtgaacggaaggatgttctctgtggaaaattagcttgtgttcagccacataaaaatgctaataaaagtgacgctcaatctacagtttattcatatattcaagaccatgtatgtgtatctatagccactggttcctccatgagatcagatggaacagacaatgcctatgtggctgatggcaccatgtgtggtccagaaatgtactgtgtaaataaaacctgcagaaaagttcatttaatgggatataactgtaatgccaccacaaaatgcaaagggaaagggatatgtaataattttggtaattgtcaatgcttccctggacatagacctccagattgtaaattccagtttggttccccagggggtagtattgatgatggaaattttcagaaatctggtgacttttatactgaaaaaggctacaatacacactggaacaactggtttattctgagtttctgcatttttctgccgtttttcatagttttcaccactgtgatctttaaaagaaatgaaataagtaaatcatgtaacagagagaatgcagagtataatcgtaattcatccgttgtatcagaaagcgatgacgtgggacattaatattgcacagaacttccatagcaaataacctaaaggaacgaatgtgctttatttataaccttacgttatccccaatgcattgtaaatgtcaaacttttggaaaataaagcctgcgtgccctccca

SEQ ID NO: 17338 - DNA, 852 bp, Homo sapiens
gatggggaaggcggcggcggcggtggcctttggggccgaagtgggcgtgcggctcgcgctgttcgcggccttcctggtgacggagctgctccccccgttccagagactcatccagccggaggagatgtggctctaccggaacccctacgtggaggcggagtatttccccaccaagccgatgtttgttattgcatttctctctccactgtctctgatcttcctggccaaatttctcaagaaggcagacacaagagacagcagacaagcctgcctggctgccagccttgccctggctctgaatggcgtctttaccaacacaataaaactgatcgtagggaggccacgcccagatttcttctaccgctgcttccctgatgggctagcccattctgacttgatgtgtacaggggataaggacgtggtgaatgagggccgaaagagcttccccagtggacattcttcctttgcatttgctggtctggcctttgcgtccttctacctggcagggaagttacactgcttcacaccacaaggccgtgggaaatcttggaggttctgtgcctttctgtcacctctactttttgcagctgtgattgcactgtcccgcacatgtgactacaagcatcactggcaaggaccctttaaatggtgaaaatgggcagatgaatagcaataagtggacctttgttactcttctgagttagaaaaattctaatttagtacactctgaacaaagcttattatacttacttaagatgtgttttgatttggtgttcagaaagcaacctgacaatgataatactgtaactatgataaaattgagaataaaaagattttatttagaaaaaaaaa

SEQ ID NO: 17339 - DNA, 537 bp, Homo sapiens
attttgcctggggcactatttgaccaatagttaacaggattattaatgtctgctacaactgaaaaataatttctggagttaatgatttacgttccaaccatgctgctttcttccaggccacgcccagatttcttctaccgctgcttccctgatgggctagcccattctgacttgatgtgtacaggggataaggacgtggtgaatgagggccgaaagagcttccccagtggacattcttcctgtatgaatatcatatggactctaccctatgcttgttttcacatcattgaatttaacctagaaagctagtagggatgggaaaatctgactactcttgtttctacaatttggaaaatccccccttctttagtaactccacagtttaacaagtctgagccttgactatttgggtaaatattacagaacagaaaggtagtttaccttcatgagatttgcacatttaattgttatattatttgcctagatcctgcaatcttgtactagcaataaaaatacctttaacgaagaaaaaaaaag

SEQ ID NO: 17340 - DNA, 659 bp, Homo sapiens
aacagagaggttaatggtgtccaccacacgtctttctcattcttttctcctttatcttcactctgatttttcttttgtcattcaacgcttactcccttccccatacctcagtcctccaggtgacacctgggctcttttctgcctgaacagcatttcccaccaacggccacagcagtcggtcagtgtcctcttgagcacctcctgaagctgcagtgtcatttgctgtttgccctaaaaagccacgcccagatttcttctaccgctgcttccctgatgggctagcccattctgacttgatgtgtacaggggataaggacgtggtgaatgagggccgaaagagcttccccagtggacattcttcctgtatgaatatcatatggactctaccctatgcttgttttcacatcattgaatttaacctagaaagctagtagggatgggaaaatctgactactcttgtttctacaatttggaaaatccccccttctttagtaactccacagtttaacaagtctgagccttgactatttgggtaaatattacagaacagaaaggtagtttaccttcatgagatttgcacatttaattgttatattatttgcctagatcctgcaatcttgtactagcaataaaaatacctttaacgaagaaaaaaaaag

SEQ ID NO: 17341 - DNA, 936 bp, Homo sapiens
tgcatatttcactcattttattcctagcacctagcacagaggagatgcttactaaatatctgctgaatgaacaaattaatgagtatggatggtctgggttctgtactaagtacatttaaaattataggaaagataagacaaaaagagtttaccaaagataaacatcctaatttttccattatttgaagcattgtaagttcaagttaaactgcatctacaggaaatttaaaacctcaaagttcaatttactctcttaaaaatcaggttcattgtcataggacttttgttcaaaaacataagtaaaattcaagaaaacataaaattataattaaaccaaacaaatttaagctgaatgctatagtaagtaaaatatccaaattacagaacacctggcttggcgcggtggctcacacctcagcactttgggaggctgaggcaggcggatcacctgtagtcaggaattcgagaccagcctggccaacatattgaaaccccgtctctactaaaaatacaaaaattgaggccaggtgcagtggctcatgcctgtaatcacagcactttgggaaggtgaggtaggtggatcacctgaggtcaggctggtctcaatctcctgacctcgggatccatctgcctggtcctcccaaagtgctgggattacaggcgtgagtcaccgtgcccggcgagaagcaactcttaaaatactttattccttcctctaggaccctttaaatggtgaaaatgggcagatgaatagcaataagtggacctttgttactcttctgagttagaaaaattctaatttagtacactctgaacaaagcttattatacttacttaagatgtgttttgatttggtgttcagaaagcaacctgacaatgataatactgtaactatgataaaattgagaataaaaagattttatttagaaaaaaaaa

SEQ ID NO: 17342 - DNA, 322 bp, Homo sapiens
aacagagaggttaatggtgtccaccacacgtctttctcattcttttctcctttatcttcactctgatttttcttttgtcattcaacgcttactcccttccccatacctcagtcctccaggtgacacctgggctcttttctgcctgaacagcatttcccaccaacggccacagcagtcggtcagtgtcctcttgagcacctcctgaagctgcagtgtcatttgctgtttgccctaaaaagtaatcatgtgctggaatgggcgtttttcccctaatttaaatgctcaccttgaaaggcttttctcttagtgtggtgactatact

SEQ ID NO: 17343 - DNA, 2938 bp, Homo sapiens
gatggggaaggcggcggcggcggtggcctttggggccgaagtgggcgtgcggctcgcgctgttcgcggccttcctggtgacggagctgctccccccgttccagagactcatccagccggaggagatgtggctctaccggaacccctacgtggaggcggagtatttccccaccaagccgatgtttgtgcgtggagaaagatcgtctttcctccctccccatgacccggcttcccgcgggcacctgtgcgttttccaccccgagacggcctttgtagggacccactgcccactccgctgctgtgcgctgggttccgcctcctagggctcgagtgtttaagatcctgattgagagaggagggtgtccgagcctctttgggctgagacaacgttttcccgggcgctctgtgcctcagcctgaggtaccggggcccgagccgcacgggcgctgctgttcactggtggcgctgcctggcgcccggttacgcgcactcagagaccttatgttagctccagtgagtcctgctgtgtcacatccctctttcctgtaggagcacgagtgtggcttttttttggattgtttttaacctctgacattctgattcaggttattgcatttctctctccactgtctctgatcttcctggccaaatttctcaagaaggcagacacaagagacagcagacaagcctgcctgggtgagcgctagccctttcgggccggtttcttcgtgctgggaacctaggaggtcgttgtgggattcagccacggtgagcctgtgtggaggccactgagttctgcattcctaaaggaactctatccccgcgggagaggaaaatagcactgcagggacttggttacgcaggctacacggcaggcagccctgtgcctaaatgcactgggttatttgtacctcagaaatgtctttggcctagtacaaaagttctcggctacaaaagagtgatcactgaggaccctaattatttttgtgcccaggcctggttggattctatccatctcagaaacagcacggctgctctcataacgaggccatgaccatacctttcctcctagacagatcctttcaactaatggctttgctttgcagctgccagccttgccctggctctgaatggcgtctttaccaacacaataaaactgatcgtagggaggccacgcccagatttcttctaccgctgcttccctgatgggctagcccattctgacttgatgtgtacaggggataaggacgtggtgaatgagggccgaaagagcttccccagtggacattcttcctttgcatttgctggtctggcctttgcgtccttctacctggcagggaagttacactgcttcacaccacaaggccgtgggaaatcttggaggttctgtgcctttctgtcacctctactttttgcagctgtgattgcactgtcccgcacatgtgactacaagcatcactggcaagatgtactagttggatccatgattggaatgacatttgcctatgtctgctatcggcagtattatcctcctctgactgatgcagaatgccataaaccatttcaagacaaacttgtactttccactgcacagaagcctggggattcttattgttttgatatttaaaaattgaatctggccgggcgtggtggctcatgcctgtaatcccaacactttgggaggctgaggagggtggatcacctgaggtcaggaccagcctggccaacatggtgaaccctgtctctactaaaaatacaaaaattagccaggagttgtgtgccgtaatcccagctacctgggaggctgaggtaggagaattgcttgaacctgggagctggaggttccagtgagccgagatcgcaccactgcactccagcctaggcaacagagtgagaccccatctcaaaaaaaaaaaaaaattgaatctatctcaatagagaacaggtgaactagccctcctaaccggaccatgcacaagacaagaaattctagcctttttttccccttccaaggtgcaagtgaggacataagccacactgtattctgcctccaaatgattacacacttttgcccctgctcatctatcttgaggagttacggttcttttccactactgtatgccacatgttctagtaaaaggatctttcaaaggtgtccaacaccttatgaatctggtctatcagattaatatctgaagatctacagtgtttttacatttaatttaaatgccattcttagaaggatcttgtcacaaagaagcctttacatagccccaccttgtctcagaagctagagttcattatcaaaacttaatttccatttcatatagctcaaaatcttaaaatctagggcatggccaactaaattactttgattctgtttaccttctctgatgacaattccatcaagccttaaataggaaaatgtcgaatctagggtaatttatcacttttgtgtgcatcttatctgagtccagccatctggtactgctgtgcattttgaacaccgtgggcataaacaatttgttgaattactaagtgaaaacaataataaagaagaaaatggtcaggagtgtggtttcagcactactaacagatgactgtttctacctcatttgaccataactgtacttgtgagcttctttccttccattcatgactgaagatctgctcaaatgcaccaacactgccaagtgactaaggtagaaaagaaaaatgacaggtatcgtcatctgaaggacagatgaatctttttctgccccttcttcacaatggaatataaggaacaattatgggatgtcatcagaatggatgccataggacctacagctccctttctctttattgtgattatactttaaatatgacattgtcttttatgtgtatgttcctatattttcaatgtatctttttccttcagtaaacctgatattcaaata

SEQ ID NO: 17344 - DNA, 2108 bp, Homo sapiens
gatggggaaggcggcggcggcggtggcctttggggccgaagtgggcgtgcggctcgcgctgttcgcggccttcctggtgacggagctgctccccccgttccagagactcatccagccggaggagatgtggctctaccggaacccctacgtggaggcggagtatttccccaccaagccgatgtttgttattgcatttctctctccactgtctctgatcttcctggccaaatttctcaagaaggcagacacaagagacagcagacaagcctgcctggctgccagccttgccctggctctgaatggcgtctttaccaacacaataaaactgatcgtagggaggccacgcccagatttcttctaccgctgcttccctgatgggctagcccattctgacttgatgtgtacaggggataaggacgtggtgaatgagggccgaaagagcttccccagtggacattcttcctttgcatttgctggtctggcctttgcgtccttctacctggcagggaagttacactgcttcacaccacaaggccgtgggaaatcttggaggttctgtgcctttctgtcacctctactttttgcagctgtgattgcactgtcccgcacatgtgactacaagcatcactggcaagatgtactagttggatccatgattggaatgacatttgcctatgtctgctatcggcagtattatcctcctctgactgatgcagaatgccataaaccatttcaagacaaacttgtactttccactgcacagaagcctggggattcttattgttttgatatttaaaaattgaatctggccgggcgtggtggctcatgcctgtaatcccaacactttgggaggctgaggagggtggatcacctgaggtcaggaccagcctggccaacatggtgaaccctgtctctactaaaaatacaaaaattagccaggagttgtgtgccgtaatcccagctacctgggaggctgaggtaggagaattgcttgaacctgggagctggaggttccagtgagccgagatcgcaccactgcactccagcctaggcaacagagtgagaccccatctcaaaaaaaaaaaaaaattgaatctatctcaatagagaacaggtgaactagccctcctaaccggaccatgcacaagacaagaaattctagcctttttttccccttccaaggtgcaagtgaggacataagccacactgtattctgcctccaaatgattacacacttttgcccctgctcatctatcttgaggagttacggttcttttccactactgtatgccacatgttctagtaaaaggatctttcaaaggtgtccaacaccttatgaatctggtctatcagattaatatctgaagatctacagtgtttttacatttaatttaaatgccattcttagaaggatcttgtcacaaagaagcctttacatagccccaccttgtctcagaagctagagttcattatcaaaacttaatttccatttcatatagctcaaaatcttaaaatctagggcatggccaactaaattactttgattctgtttaccttctctgatgacaattccatcaagccttaaataggaaaatgtcgaatctagggtaatttatcacttttgtgtgcatcttatctgagtccagccatctggtactgctgtgcattttgaacaccgtgggcataaacaatttgttgaattactaagtgaaaacaataataaagaagaaaatggtcaggagtgtggtttcagcactactaacagatgactgtttctacctcatttgaccataactgtacttgtgagcttctttccttccattcatgactgaagatctgctcaaatgcaccaacactgccaagtgactaaggtagaaaagaaaaatgacaggtatcgtcatctgaaggacagatgaatctttttctgccccttcttcacaatggaatataaggaacaattatgggatgtcatcagaatggatgccataggacctacagctccctttctctttattgtgattatactttaaatatgacattgtcttttatgtgtatgttcctatattttcaatgtatctttttccttcagtaaacctgatattcaaata

SEQ ID NO: 17345 - DNA, 3073 bp, Homo sapiens
gatggggaaggcggcggcggcggtggcctttggggccgaagtgggcgtgcggctcgcgctgttcgcggccttcctgtaagaaagatccacggccgggcccgggcggccccgcttcccaggcaggcgggcggcacggggcggcgggtcgggcagtggggaagcggggaggaagccaggcgacctgctctgcgcttctttgttcccctctagggtgacggagctgctccccccgttccagagactcatccagccggaggagatgtggctctaccggaacccctacgtggaggcggagtatttccccaccaagccgatgtttgtgcgtggagaaagatcgtctttcctccctccccatgacccggcttcccgcgggcacctgtgcgttttccaccccgagacggcctttgtagggacccactgcccactccgctgctgtgcgctgggttccgcctcctagggctcgagtgtttaagatcctgattgagagaggagggtgtccgagcctctttgggctgagacaacgttttcccgggcgctctgtgcctcagcctgaggtaccggggcccgagccgcacgggcgctgctgttcactggtggcgctgcctggcgcccggttacgcgcactcagagaccttatgttagctccagtgagtcctgctgtgtcacatccctctttcctgtaggagcacgagtgtggcttttttttggattgtttttaacctctgacattctgattcaggttattgcatttctctctccactgtctctgatcttcctggccaaatttctcaagaaggcagacacaagagacagcagacaagcctgcctgggtgagcgctagccctttcgggccggtttcttcgtgctgggaacctaggaggtcgttgtgggattcagccacggtgagcctgtgtggaggccactgagttctgcattcctaaaggaactctatccccgcgggagaggaaaatagcactgcagggacttggttacgcaggctacacggcaggcagccctgtgcctaaatgcactgggttatttgtacctcagaaatgtctttggcctagtacaaaagttctcggctacaaaagagtgatcactgaggaccctaattatttttgtgcccaggcctggttggattctatccatctcagaaacagcacggctgctctcataacgaggccatgaccatacctttcctcctagacagatcctttcaactaatggctttgctttgcagctgccagccttgccctggctctgaatggcgtctttaccaacacaataaaactgatcgtagggaggccacgcccagatttcttctaccgctgcttccctgatgggctagcccattctgacttgatgtgtacaggggataaggacgtggtgaatgagggccgaaagagcttccccagtggacattcttcctttgcatttgctggtctggcctttgcgtccttctacctggcagggaagttacactgcttcacaccacaaggccgtgggaaatcttggaggttctgtgcctttctgtcacctctactttttgcagctgtgattgcactgtcccgcacatgtgactacaagcatcactggcaagatgtactagttggatccatgattggaatgacatttgcctatgtctgctatcggcagtattatcctcctctgactgatgcagaatgccataaaccatttcaagacaaacttgtactttccactgcacagaagcctggggattcttattgttttgatatttaaaaattgaatctggccgggcgtggtggctcatgcctgtaatcccaacactttgggaggctgaggagggtggatcacctgaggtcaggaccagcctggccaacatggtgaaccctgtctctactaaaaatacaaaaattagccaggagttgtgtgccgtaatcccagctacctgggaggctgaggtaggagaattgcttgaacctgggagctggaggttccagtgagccgagatcgcaccactgcactccagcctaggcaacagagtgagaccccatctcaaaaaaaaaaaaaaattgaatctatctcaatagagaacaggtgaactagccctcctaaccggaccatgcacaagacaagaaattctagcctttttttccccttccaaggtgcaagtgaggacataagccacactgtattctgcctccaaatgattacacacttttgcccctgctcatctatcttgaggagttacggttcttttccactactgtatgccacatgttctagtaaaaggatctttcaaaggtgtccaacaccttatgaatctggtctatcagattaatatctgaagatctacagtgtttttacatttaatttaaatgccattcttagaaggatcttgtcacaaagaagcctttacatagccccaccttgtctcagaagctagagttcattatcaaaacttaatttccatttcatatagctcaaaatcttaaaatctagggcatggccaactaaattactttgattctgtttaccttctctgatgacaattccatcaagccttaaataggaaaatgtcgaatctagggtaatttatcacttttgtgtgcatcttatctgagtccagccatctggtactgctgtgcattttgaacaccgtgggcataaacaatttgttgaattactaagtgaaaacaataataaagaagaaaatggtcaggagtgtggtttcagcactactaacagatgactgtttctacctcatttgaccataactgtacttgtgagcttctttccttccattcatgactgaagatctgctcaaatgcaccaacactgccaagtgactaaggtagaaaagaaaaatgacaggtatcgtcatctgaaggacagatgaatctttttctgccccttcttcacaatggaatataaggaacaattatgggatgtcatcagaatggatgccataggacctacagctccctttctctttattgtgattatactttaaatatgacattgtcttttatgtgtatgttcctatattttcaatgtatctttttccttcagtaaacctgatattcaaata

SEQ ID NO: 17346 - DNA, 2054 bp, Homo sapiens
gatggggaaggcggcggcggcggtggcctttggggccgaagtgggcgtgcggctcgcgctgttcgcggccttcctggtgacggagctgctccccccgttccagagactcatccagccggaggagatgtggctctaccggaacccctacgtggaggcggagtatttccccaccaagccgatgtttgttattgcatttctctctccactgtctctgatcttcctggccaaatttctcaagaaggcagacacaagagacagcagacaagcctgcctggctgccagccttgccctggctctgaatggcgtctttaccaacacaattgggctagcccattctgacttgatgtgtacaggggataaggacgtggtgaatgagggccgaaagagcttccccagtggacattcttcctttgcatttgctggtctggcctttgcgtccttctacctggcagggaagttacactgcttcacaccacaaggccgtgggaaatcttggaggttctgtgcctttctgtcacctctactttttgcagctgtgattgcactgtcccgcacatgtgactacaagcatcactggcaagatgtactagttggatccatgattggaatgacatttgcctatgtctgctatcggcagtattatcctcctctgactgatgcagaatgccataaaccatttcaagacaaacttgtactttccactgcacagaagcctggggattcttattgttttgatatttaaaaattgaatctggccgggcgtggtggctcatgcctgtaatcccaacactttgggaggctgaggagggtggatcacctgaggtcaggaccagcctggccaacatggtgaaccctgtctctactaaaaatacaaaaattagccaggagttgtgtgccgtaatcccagctacctgggaggctgaggtaggagaattgcttgaacctgggagctggaggttccagtgagccgagatcgcaccactgcactccagcctaggcaacagagtgagaccccatctcaaaaaaaaaaaaaaattgaatctatctcaatagagaacaggtgaactagccctcctaaccggaccatgcacaagacaagaaattctagcctttttttccccttccaaggtgcaagtgaggacataagccacactgtattctgcctccaaatgattacacacttttgcccctgctcatctatcttgaggagttacggttcttttccactactgtatgccacatgttctagtaaaaggatctttcaaaggtgtccaacaccttatgaatctggtctatcagattaatatctgaagatctacagtgtttttacatttaatttaaatgccattcttagaaggatcttgtcacaaagaagcctttacatagccccaccttgtctcagaagctagagttcattatcaaaacttaatttccatttcatatagctcaaaatcttaaaatctagggcatggccaactaaattactttgattctgtttaccttctctgatgacaattccatcaagccttaaataggaaaatgtcgaatctagggtaatttatcacttttgtgtgcatcttatctgagtccagccatctggtactgctgtgcattttgaacaccgtgggcataaacaatttgttgaattactaagtgaaaacaataataaagaagaaaatggtcaggagtgtggtttcagcactactaacagatgactgtttctacctcatttgaccataactgtacttgtgagcttctttccttccattcatgactgaagatctgctcaaatgcaccaacactgccaagtgactaaggtagaaaagaaaaatgacaggtatcgtcatctgaaggacagatgaatctttttctgccccttcttcacaatggaatataaggaacaattatgggatgtcatcagaatggatgccataggacctacagctccctttctctttattgtgattatactttaaatatgacattgtcttttatgtgtatgttcctatattttcaatgtatctttttccttcagtaaacctgatattcaaata

SEQ ID NO: 17347 - DNA, 2243 bp, Homo sapiens
gatggggaaggcggcggcggcggtggcctttggggccgaagtgggcgtgcggctcgcgctgttcgcggccttcctgtaagaaagatccacggccgggcccgggcggccccgcttcccaggcaggcgggcggcacggggcggcgggtcgggcagtggggaagcggggaggaagccaggcgacctgctctgcgcttctttgttcccctctagggtgacggagctgctccccccgttccagagactcatccagccggaggagatgtggctctaccggaacccctacgtggaggcggagtatttccccaccaagccgatgtttgttattgcatttctctctccactgtctctgatcttcctggccaaatttctcaagaaggcagacacaagagacagcagacaagcctgcctggctgccagccttgccctggctctgaatggcgtctttaccaacacaataaaactgatcgtagggaggccacgcccagatttcttctaccgctgcttccctgatgggctagcccattctgacttgatgtgtacaggggataaggacgtggtgaatgagggccgaaagagcttccccagtggacattcttcctttgcatttgctggtctggcctttgcgtccttctacctggcagggaagttacactgcttcacaccacaaggccgtgggaaatcttggaggttctgtgcctttctgtcacctctactttttgcagctgtgattgcactgtcccgcacatgtgactacaagcatcactggcaagatgtactagttggatccatgattggaatgacatttgcctatgtctgctatcggcagtattatcctcctctgactgatgcagaatgccataaaccatttcaagacaaacttgtactttccactgcacagaagcctggggattcttattgttttgatatttaaaaattgaatctggccgggcgtggtggctcatgcctgtaatcccaacactttgggaggctgaggagggtggatcacctgaggtcaggaccagcctggccaacatggtgaaccctgtctctactaaaaatacaaaaattagccaggagttgtgtgccgtaatcccagctacctgggaggctgaggtaggagaattgcttgaacctgggagctggaggttccagtgagccgagatcgcaccactgcactccagcctaggcaacagagtgagaccccatctcaaaaaaaaaaaaaaattgaatctatctcaatagagaacaggtgaactagccctcctaaccggaccatgcacaagacaagaaattctagcctttttttccccttccaaggtgcaagtgaggacataagccacactgtattctgcctccaaatgattacacacttttgcccctgctcatctatcttgaggagttacggttcttttccactactgtatgccacatgttctagtaaaaggatctttcaaaggtgtccaacaccttatgaatctggtctatcagattaatatctgaagatctacagtgtttttacatttaatttaaatgccattcttagaaggatcttgtcacaaagaagcctttacatagccccaccttgtctcagaagctagagttcattatcaaaacttaatttccatttcatatagctcaaaatcttaaaatctagggcatggccaactaaattactttgattctgtttaccttctctgatgacaattccatcaagccttaaataggaaaatgtcgaatctagggtaatttatcacttttgtgtgcatcttatctgagtccagccatctggtactgctgtgcattttgaacaccgtgggcataaacaatttgttgaattactaagtgaaaacaataataaagaagaaaatggtcaggagtgtggtttcagcactactaacagatgactgtttctacctcatttgaccataactgtacttgtgagcttctttccttccattcatgactgaagatctgctcaaatgcaccaacactgccaagtgactaaggtagaaaagaaaaatgacaggtatcgtcatctgaaggacagatgaatctttttctgccccttcttcacaatggaatataaggaacaattatgggatgtcatcagaatggatgccataggacctacagctccctttctctttattgtgattatactttaaatatgacattgtcttttatgtgtatgttcctatattttcaatgtatctttttccttcagtaaacctgatattcaaata

SEQ ID NO: 17348 - DNA, 2982 bp, Homo sapiens
gatggggaaggcggcggcggcggtggcctttggggccgaagtgggcgtgcggctcgcgctgttcgcggccttcctgtaagaaagatccacggccgggcccgggcggccccgcttcccagggtgacggagctgctccccccgttccagagactcatccagccggaggagatgtggctctaccggaacccctacgtggaggcggagtatttccccaccaagccgatgtttgtgcgtggagaaagatcgtctttcctccctccccatgacccggcttcccgcgggcacctgtgcgttttccaccccgagacggcctttgtagggacccactgcccactccgctgctgtgcgctgggttccgcctcctagggctcgagtgtttaagatcctgattgagagaggagggtgtccgagcctctttgggctgagacaacgttttcccgggcgctctgtgcctcagcctgaggtaccggggcccgagccgcacgggcgctgctgttcactggtggcgctgcctggcgcccggttacgcgcactcagagaccttatgttagctccagtgagtcctgctgtgtcacatccctctttcctgtaggagcacgagtgtggcttttttttggattgtttttaacctctgacattctgattcaggttattgcatttctctctccactgtctctgatcttcctggccaaatttctcaagaaggcagacacaagagacagcagacaagcctgcctgggtgagcgctagccctttcgggccggtttcttcgtgctgggaacctaggaggtcgttgtgggattcagccacggtgagcctgtgtggaggccactgagttctgcattcctaaaggaactctatccccgcgggagaggaaaatagcactgcagggacttggttacgcaggctacacggcaggcagccctgtgcctaaatgcactgggttatttgtacctcagaaatgtctttggcctagtacaaaagttctcggctacaaaagagtgatcactgaggaccctaattatttttgtgcccaggcctggttggattctatccatctcagaaacagcacggctgctctcataacgaggccatgaccatacctttcctcctagacagatcctttcaactaatggctttgctttgcagctgccagccttgccctggctctgaatggcgtctttaccaacacaataaaactgatcgtagggaggccacgcccagatttcttctaccgctgcttccctgatgggctagcccattctgacttgatgtgtacaggggataaggacgtggtgaatgagggccgaaagagcttccccagtggacattcttcctttgcatttgctggtctggcctttgcgtccttctacctggcagggaagttacactgcttcacaccacaaggccgtgggaaatcttggaggttctgtgcctttctgtcacctctactttttgcagctgtgattgcactgtcccgcacatgtgactacaagcatcactggcaagatgtactagttggatccatgattggaatgacatttgcctatgtctgctatcggcagtattatcctcctctgactgatgcagaatgccataaaccatttcaagacaaacttgtactttccactgcacagaagcctggggattcttattgttttgatatttaaaaattgaatctggccgggcgtggtggctcatgcctgtaatcccaacactttgggaggctgaggagggtggatcacctgaggtcaggaccagcctggccaacatggtgaaccctgtctctactaaaaatacaaaaattagccaggagttgtgtgccgtaatcccagctacctgggaggctgaggtaggagaattgcttgaacctgggagctggaggttccagtgagccgagatcgcaccactgcactccagcctaggcaacagagtgagaccccatctcaaaaaaaaaaaaaaattgaatctatctcaatagagaacaggtgaactagccctcctaaccggaccatgcacaagacaagaaattctagcctttttttccccttccaaggtgcaagtgaggacataagccacactgtattctgcctccaaatgattacacacttttgcccctgctcatctatcttgaggagttacggttcttttccactactgtatgccacatgttctagtaaaaggatctttcaaaggtgtccaacaccttatgaatctggtctatcagattaatatctgaagatctacagtgtttttacatttaatttaaatgccattcttagaaggatcttgtcacaaagaagcctttacatagccccaccttgtctcagaagctagagttcattatcaaaacttaatttccatttcatatagctcaaaatcttaaaatctagggcatggccaactaaattactttgattctgtttaccttctctgatgacaattccatcaagccttaaataggaaaatgtcgaatctagggtaatttatcacttttgtgtgcatcttatctgagtccagccatctggtactgctgtgcattttgaacaccgtgggcataaacaatttgttgaattactaagtgaaaacaataataaagaagaaaatggtcaggagtgtggtttcagcactactaacagatgactgtttctacctcatttgaccataactgtacttgtgagcttctttccttccattcatgactgaagatctgctcaaatgcaccaacactgccaagtgactaaggtagaaaagaaaaatgacaggtatcgtcatctgaaggacagatgaatctttttctgccccttcttcacaatggaatataaggaacaattatgggatgtcatcagaatggatgccataggacctacagctccctttctctttattgtgattatactttaaatatgacattgtcttttatgtgtatgttcctatattttcaatgtatctttttccttcagtaaacctgatattcaaata

SEQ ID NO: 17349 - DNA, 2167 bp, Homo sapiens
gatggggaaggcggcggcggcggtggcctttggggccgaagtgggcgtgcggctcgcgctgttcgcggccttcctggtgacggagctgctccccccgttccagagactcatccagccggaggagatgtggctctaccggaacccctacgtggaggcggagtatttccccaccaagccgatgtttgtgcgtggagaaagatcgtctttcctccctccccatgacccggcttcccgcgggcacctgttattgcatttctctctccactgtctctgatcttcctggccaaatttctcaagaaggcagacacaagagacagcagacaagcctgcctggctgccagccttgccctggctctgaatggcgtctttaccaacacaataaaactgatcgtagggaggccacgcccagatttcttctaccgctgcttccctgatgggctagcccattctgacttgatgtgtacaggggataaggacgtggtgaatgagggccgaaagagcttccccagtggacattcttcctttgcatttgctggtctggcctttgcgtccttctacctggcagggaagttacactgcttcacaccacaaggccgtgggaaatcttggaggttctgtgcctttctgtcacctctactttttgcagctgtgattgcactgtcccgcacatgtgactacaagcatcactggcaagatgtactagttggatccatgattggaatgacatttgcctatgtctgctatcggcagtattatcctcctctgactgatgcagaatgccataaaccatttcaagacaaacttgtactttccactgcacagaagcctggggattcttattgttttgatatttaaaaattgaatctggccgggcgtggtggctcatgcctgtaatcccaacactttgggaggctgaggagggtggatcacctgaggtcaggaccagcctggccaacatggtgaaccctgtctctactaaaaatacaaaaattagccaggagttgtgtgccgtaatcccagctacctgggaggctgaggtaggagaattgcttgaacctgggagctggaggttccagtgagccgagatcgcaccactgcactccagcctaggcaacagagtgagaccccatctcaaaaaaaaaaaaaaattgaatctatctcaatagagaacaggtgaactagccctcctaaccggaccatgcacaagacaagaaattctagcctttttttccccttccaaggtgcaagtgaggacataagccacactgtattctgcctccaaatgattacacacttttgcccctgctcatctatcttgaggagttacggttcttttccactactgtatgccacatgttctagtaaaaggatctttcaaaggtgtccaacaccttatgaatctggtctatcagattaatatctgaagatctacagtgtttttacatttaatttaaatgccattcttagaaggatcttgtcacaaagaagcctttacatagccccaccttgtctcagaagctagagttcattatcaaaacttaatttccatttcatatagctcaaaatcttaaaatctagggcatggccaactaaattactttgattctgtttaccttctctgatgacaattccatcaagccttaaataggaaaatgtcgaatctagggtaatttatcacttttgtgtgcatcttatctgagtccagccatctggtactgctgtgcattttgaacaccgtgggcataaacaatttgttgaattactaagtgaaaacaataataaagaagaaaatggtcaggagtgtggtttcagcactactaacagatgactgtttctacctcatttgaccataactgtacttgtgagcttctttccttccattcatgactgaagatctgctcaaatgcaccaacactgccaagtgactaaggtagaaaagaaaaatgacaggtatcgtcatctgaaggacagatgaatctttttctgccccttcttcacaatggaatataaggaacaattatgggatgtcatcagaatggatgccataggacctacagctccctttctctttattgtgattatactttaaatatgacattgtcttttatgtgtatgttcctatattttcaatgtatctttttccttcagtaaacctgatattcaaata

SEQ ID NO: 17350 - DNA, 2120 bp, Homo sapiens
gatggggaaggcggcggcggcggtggcctttggggccgaagtgggcgtgcggctcgcgctgttcgcggccttcctgtaagaaagatccacggccgggcccgggcggccccgcttcccagggtgacggagctgctccccccgttccagagactcatccagccggaggagatgtggctctaccggaacccctacgtggaggcggagtatttccccaccaagccgatgtttgtgcgtggagaaagatcgtctttcctccctccccatgacccggcttcccgcgggcacctctgccagccttgccctggctctgaatggcgtctttaccaacacaataaaactgatcgtagggaggccacgcccagatttcttctaccgctgcttccctgatgggctagcccattctgacttgatgtgtacaggggataaggacgtggtgaatgagggccgaaagagcttccccagtggacattcttcctttgcatttgctggtctggcctttgcgtccttctacctggcagggaagttacactgcttcacaccacaaggccgtgggaaatcttggaggttctgtgcctttctgtcacctctactttttgcagctgtgattgcactgtcccgcacatgtgactacaagcatcactggcaagatgtactagttggatccatgattggaatgacatttgcctatgtctgctatcggcagtattatcctcctctgactgatgcagaatgccataaaccatttcaagacaaacttgtactttccactgcacagaagcctggggattcttattgttttgatatttaaaaattgaatctggccgggcgtggtggctcatgcctgtaatcccaacactttgggaggctgaggagggtggatcacctgaggtcaggaccagcctggccaacatggtgaaccctgtctctactaaaaatacaaaaattagccaggagttgtgtgccgtaatcccagctacctgggaggctgaggtaggagaattgcttgaacctgggagctggaggttccagtgagccgagatcgcaccactgcactccagcctaggcaacagagtgagaccccatctcaaaaaaaaaaaaaaattgaatctatctcaatagagaacaggtgaactagccctcctaaccggaccatgcacaagacaagaaattctagcctttttttccccttccaaggtgcaagtgaggacataagccacactgtattctgcctccaaatgattacacacttttgcccctgctcatctatcttgaggagttacggttcttttccactactgtatgccacatgttctagtaaaaggatctttcaaaggtgtccaacaccttatgaatctggtctatcagattaatatctgaagatctacagtgtttttacatttaatttaaatgccattcttagaaggatcttgtcacaaagaagcctttacatagccccaccttgtctcagaagctagagttcattatcaaaacttaatttccatttcatatagctcaaaatcttaaaatctagggcatggccaactaaattactttgattctgtttaccttctctgatgacaattccatcaagccttaaataggaaaatgtcgaatctagggtaatttatcacttttgtgtgcatcttatctgagtccagccatctggtactgctgtgcattttgaacaccgtgggcataaacaatttgttgaattactaagtgaaaacaataataaagaagaaaatggtcaggagtgtggtttcagcactactaacagatgactgtttctacctcatttgaccataactgtacttgtgagcttctttccttccattcatgactgaagatctgctcaaatgcaccaacactgccaagtgactaaggtagaaaagaaaaatgacaggtatcgtcatctgaaggacagatgaatctttttctgccccttcttcacaatggaatataaggaacaattatgggatgtcatcagaatggatgccataggacctacagctccctttctctttattgtgattatactttaaatatgacattgtcttttatgtgtatgttcctatattttcaatgtatctttttccttcagtaaacctgatattcaaata

SEQ ID NO: 17351 - DNA, 2007 bp, Homo sapiens
aacagagaggttaatggtgtccaccacacgtctttctcattcttttctcctttatcttcactctgatttttcttttgtcattcaacgcttactcccttccccatacctcagtcctccaggtgacacctgggctcttttctgcctgaacagcatttcccaccaacggccacagcagtcggtcagtgtcctcttgagcacctcctgaagctgcagtgtcatttgctgtttgccctaaaaagccacgcccagatttcttctaccgctgcttccctgatgggctagcccattctgacttgatgtgtacaggggataaggacgtggtgaatgagggccgaaagagcttccccagtggacattcttcctttgcatttgctggtctggcctttgcgtccttctacctggcagggaagttacactgcttcacaccacaaggccgtgggaaatcttggaggttctgtgcctttctgtcacctctactttttgcagctgtgattgcactgtcccgcacatgtgactacaagcatcactggcaagatgtactagttggatccatgattggaatgacatttgcctatgtctgctatcggcagtattatcctcctctgactgatgcagaatgccataaaccatttcaagacaaacttgtactttccactgcacagaagcctggggattcttattgttttgatatttaaaaattgaatctggccgggcgtggtggctcatgcctgtaatcccaacactttgggaggctgaggagggtggatcacctgaggtcaggaccagcctggccaacatggtgaaccctgtctctactaaaaatacaaaaattagccaggagttgtgtgccgtaatcccagctacctgggaggctgaggtaggagaattgcttgaacctgggagctggaggttccagtgagccgagatcgcaccactgcactccagcctaggcaacagagtgagaccccatctcaaaaaaaaaaaaaaattgaatctatctcaatagagaacaggtgaactagccctcctaaccggaccatgcacaagacaagaaattctagcctttttttccccttccaaggtgcaagtgaggacataagccacactgtattctgcctccaaatgattacacacttttgcccctgctcatctatcttgaggagttacggttcttttccactactgtatgccacatgttctagtaaaaggatctttcaaaggtgtccaacaccttatgaatctggtctatcagattaatatctgaagatctacagtgtttttacatttaatttaaatgccattcttagaaggatcttgtcacaaagaagcctttacatagccccaccttgtctcagaagctagagttcattatcaaaacttaatttccatttcatatagctcaaaatcttaaaatctagggcatggccaactaaattactttgattctgtttaccttctctgatgacaattccatcaagccttaaataggaaaatgtcgaatctagggtaatttatcacttttgtgtgcatcttatctgagtccagccatctggtactgctgtgcattttgaacaccgtgggcataaacaatttgttgaattactaagtgaaaacaataataaagaagaaaatggtcaggagtgtggtttcagcactactaacagatgactgtttctacctcatttgaccataactgtacttgtgagcttctttccttccattcatgactgaagatctgctcaaatgcaccaacactgccaagtgactaaggtagaaaagaaaaatgacaggtatcgtcatctgaaggacagatgaatctttttctgccccttcttcacaatggaatataaggaacaattatgggatgtcatcagaatggatgccataggacctacagctccctttctctttattgtgattatactttaaatatgacattgtcttttatgtgtatgttcctatattttcaatgtatctttttccttcagtaaacctgatattcaaata

SEQ ID NO: 17352 - DNA, 1885 bp, Homo sapiens
attttgcctggggcactatttgaccaatagttaacaggattattaatgtctgctacaactgaaaaataatttctggagttaatgatttacgttccaaccatgctgctttcttccaggccacgcccagatttcttctaccgctgcttccctgatgggctagcccattctgacttgatgtgtacaggggataaggacgtggtgaatgagggccgaaagagcttccccagtggacattcttcctttgcatttgctggtctggcctttgcgtccttctacctggcagggaagttacactgcttcacaccacaaggccgtgggaaatcttggaggttctgtgcctttctgtcacctctactttttgcagctgtgattgcactgtcccgcacatgtgactacaagcatcactggcaagatgtactagttggatccatgattggaatgacatttgcctatgtctgctatcggcagtattatcctcctctgactgatgcagaatgccataaaccatttcaagacaaacttgtactttccactgcacagaagcctggggattcttattgttttgatatttaaaaattgaatctggccgggcgtggtggctcatgcctgtaatcccaacactttgggaggctgaggagggtggatcacctgaggtcaggaccagcctggccaacatggtgaaccctgtctctactaaaaatacaaaaattagccaggagttgtgtgccgtaatcccagctacctgggaggctgaggtaggagaattgcttgaacctgggagctggaggttccagtgagccgagatcgcaccactgcactccagcctaggcaacagagtgagaccccatctcaaaaaaaaaaaaaaattgaatctatctcaatagagaacaggtgaactagccctcctaaccggaccatgcacaagacaagaaattctagcctttttttccccttccaaggtgcaagtgaggacataagccacactgtattctgcctccaaatgattacacacttttgcccctgctcatctatcttgaggagttacggttcttttccactactgtatgccacatgttctagtaaaaggatctttcaaaggtgtccaacaccttatgaatctggtctatcagattaatatctgaagatctacagtgtttttacatttaatttaaatgccattcttagaaggatcttgtcacaaagaagcctttacatagccccaccttgtctcagaagctagagttcattatcaaaacttaatttccatttcatatagctcaaaatcttaaaatctagggcatggccaactaaattactttgattctgtttaccttctctgatgacaattccatcaagccttaaataggaaaatgtcgaatctagggtaatttatcacttttgtgtgcatcttatctgagtccagccatctggtactgctgtgcattttgaacaccgtgggcataaacaatttgttgaattactaagtgaaaacaataataaagaagaaaatggtcaggagtgtggtttcagcactactaacagatgactgtttctacctcatttgaccataactgtacttgtgagcttctttccttccattcatgactgaagatctgctcaaatgcaccaacactgccaagtgactaaggtagaaaagaaaaatgacaggtatcgtcatctgaaggacagatgaatctttttctgccccttcttcacaatggaatataaggaacaattatgggatgtcatcagaatggatgccataggacctacagctccctttctctttattgtgattatactttaaatatgacattgtcttttatgtgtatgttcctatattttcaatgtatctttttccttcagtaaacctgatattcaaata

SEQ ID NO: 17353 - DNA, 3096 bp, Homo sapiens
gatggggaaggcggcggcggcggtggcctttggggccgaagtgggcgtgcggctcgcgctgttcgcggccttcctggtgacggagctgctccccccgttccagagactcatccagccggaggagatgtggctctaccggaacccctacgtggaggcggagtatttccccaccaagccgatgtttgtgcgtggagaaagatcgtctttcctccctccccatgacccggcttcccgcgggcacctgtgcgttttccaccccgagacggcctttgtagggacccactgcccactccgctgctgtgcgctgggttccgcctcctagggctcgagtgtttaagatcctgattgagagaggagggtgtccgagcctctttgggctgagacaacgttttcccgggcgctctgtgcctcagcctgaggtaccggggcccgagccgcacgggcgctgctgttcactggtggcgctgcctggcgcccggttacgcgcactcagagaccttatgttagctccagtgagtcctgctgtgtcacatccctctttcctgtaggagcacgagtgtggcttttttttggattgtttttaacctctgacattctgattcaggttattgcatttctctctccactgtctctgatcttcctggccaaatttctcaagaaggcagacacaagagacagcagacaagcctgcctgggtgagcgctagccctttcgggccggtttcttcgtgctgggaacctaggaggtcgttgtgggattcagccacggtgagcctgtgtggaggccactgagttctgcattcctaaaggaactctatccccgcgggagaggaaaatagcactgcagggacttggttacgcaggctacacggcaggcagccctgtgcctaaatgcactgggttatttgtacctcagaaatgtctttggcctagtacaaaagttctcggctacaaaagagtgatcactgaggaccctaattatttttgtgcccaggcctggttggattctatccatctcagaaacagcacggctgctctcataacgaggccatgaccatacctttcctcctagacagatcctttcaactaatggctttgctttgcagctgccagccttgccctggctctgaatggcgtctttaccaacacaataaaactgatcgtagggaggccacgcccagatttcttctaccgctgcttccctgatgggctagcccattctgacttgatgtgtacaggggataaggacgtggtgaatgagggccgaaagagcttccccagtggacattcttcctttgcatttgctggtctggcctttgcgtccttctacctggcagggaagttacactgcttcacaccacaaggccgtgggaaatcttggaggttctgtgcctttctgtcacctctactttttgcagctgtgattgcactgtcccgcacatgtgactacaagcatcactggcaagatgtactagttggatccatgattggaatgacatttgcctatgtctgctatcggcagtattatcctcctctgactgatgcagaatgccataaaccatttcaagacaaacttgtactttccactgcacagaagcctggggattcttattgttttgatatttaaaaattgaatctggccgggcgtggtggctcatgcctgtaatcccaacactttgggaggctgaggagggtggatcacctgaggtcaggaccagcctggccaacatggtgaaccctgtctctactaaaaatacaaaaattagccaggagttgtgtgccgtaatcccagctacctgggaggctgaggtaggagaattgcttgaacctgggagctggaggttccagtgagccgagatcgcaccactgcactccagcctaggcaacagagtgagaccccatctcaaaaaaaaaaaaaaattgaatctatctcaatagagaacaggtgaactagccctcctaaccggaccatgcacaagacaagaaattctagcctttttttccccttccaaggtgcaagtgaggacataagccacactgtattctgcctccaaatgattacacacttttgcccctgctcatctatcttgaggagttacggttcttttccactactgtatgccacatgttctagtaaaaggatctttcaaaggtgtccaacaccttatgaatctggtctatcagattaatatctgaagatctacagtgtttttacatttaatttaaatgccattcttagaaggatcttgtcacaaagaagcctttacatagccccaccttgtctcagaagctagagttcattatcaaaacttaatttccatttcatatagctcaaaatcttaaaatctagggcatggccaactaaattactttgattctgtttaccttctctgatgacaattccatcaagccttaaataggaaaatgtcgaatctagggtaatttatcacttttgtgtgcatcttatctgagtccagccatctggtactgctgtgcattttgaacaccgtgggcataaacaatttgttgaattactaagtgaaaacaataataaagaagaaaatggtcaggagtgtggtttcagcactactaacagatgactgtttctacctcatttgaccataactgtacttgtgagcttctttccttccattcatgactgaagatctgctcaaatgcaccaacactgccaagtgactaaggtagaaaagaaaaatgacaggtatcgtcatctgaaggacagatgaatctttttctgccccttcttcacaatggaatataaggaacaattatgggatgtcatcagaatggatgccataggacctacagctccctttctctttattgtgattatactttaaatatgacattgtcttttatgtgtatgttcctatattttcaatgtatctttttccttcagtaaacctgatattcaaataaaatggtaaatgtgtgcttttttaaatatttaaagtacattaaggggctggaactttagtaaagcaaaacattgaattccccatccgccctaagtgattcaactgctgttatctatagtactggctaatatttataaataccaaaggaaagtctctta

SEQ ID NO: 17354 - DNA, 1590 bp, Homo sapiens
gatggggaaggcggcggcggcggtggcctttggggccgaagtgggcgtgcggctcgcgctgttcgcggccttcctggtgacggagctgctccccccgttccagagactcatccagccggaggagatgtggctctaccggaacccctacgtggaggcggagtatttccccaccaagccgatgtttgtgcgtggagaaagatcgtctttcctccctccccatgacccggcttcccgcgggcacctgtgcgttttccaccccgagacggcctttgtagggacccactgcccactccgctgctgtgcgctgggttccgcctcctagggctcgagtgtttaagatcctgattgagagaggagggtgtccgagcctctttgggctgagacaacgttttcccgggcgctctgtgcctcagcctgaggtaccggggcccgagccgcacgggcgctgctgttcactggtggcgctgcctggcgcccggttacgcgcactcagagaccttatgttagctccagtgagtcctgctgtgtcacatccctctttcctgtaggagcacgagtgtggcttttttttggattgtttttaacctctgacattctgattcaggttattgcatttctctctccactgtctctgatcttcctggccaaatttctcaagaaggcagacacaagagacagcagacaagcctgcctgggtgagcgctagccctttcgggccggtttcttcgtgctgggaacctaggaggtcgttgtgggattcagccacggtgagcctgtgtggaggccactgagttctgcattcctaaaggaactctatccccgcgggagaggaaaatagcactgcagggacttggttacgcaggctacacggcaggcagccctgtgcctaaatgcactgggttatttgtacctcagaaatgtctttggcctagtacaaaagttctcggctacaaaagagtgatcactgaggaccctaattatttttgtgcccaggcctggttggattctatccatctcagaaacagcacggctgctctcataacgaggccatgaccatacctttcctcctagacagatcctttcaactaatggctttgctttgcagctgccagccttgccctggctctgaatggcgtctttaccaacacaataaaactgatcgtagggaggccacgcccagatttcttctaccgctgcttccctgatgggctagcccattctgacttgatgtgtacaggggataaggacgtggtgaatgagggccgaaagagcttccccagtggacattcttcctgtatgaatatcatatggactctaccctatgcttgttttcacatcattgaatttaacctagaaagctagtagggatgggaaaatctgactactcttgtttctacaatttggaaaatccccccttctttagtaactccacagtttaacaagtctgagccttgactatttgggtaaatattacagaacagaaaggtagtttaccttcatgagatttgcacatttaattgttatattatttgcctagatcctgcaatcttgtactagcaataaaaatacctttaacgaagaaaaaaaaag

SEQ ID NO: 17355 - DNA, 535 bp, Homo sapiens
ctgttgatagctgactcttgagggtaaaactagggtaatttatcacttttgtgtgcatcttatctgagtccagccatctggtactgctgtgcattttgaacaccgtgggcataaacaatttgttgaattactaagtgaaaacaataataaagaagaaaatggtcaggagtgtggtttcagcactactaacagatgactgtttctacctcatttgaccataactgtacttgtgagcttctttccttccattcatgactgaagatctgctcaaatgcaccaacactgccaagtgactaaggtagaaaagaaaaatgacaggtatcgtcatctgaaggacagatgaatctttttctgccccttcttcacaatggaatataaggaacaattatgggatgtcatcagaatggatgccataggacctacagctccctttctctttattgtgattatactttaaatatgacattgtcttttatgtgtatgttcctatattttcaatgtatctttttccttcagtaaacctgatattcaaata

SEQ ID NO: 17356 - DNA, 1261 bp, Homo sapiens
gatggggaaggcggcggcggcggtggcctttggggccgaagtgggcgtgcggctcgcgctgttcgcggccttcctggtgacggagctgctccccccgttccagagactcatccagccggaggagatgtggctctaccggaacccctacgtggaggcggagtatttccccaccaagccgatgtttgttattgcatttctctctccactgtctctgatcttcctggccaaatttctcaagaaggcagacacaagagacagcagacaagcctgcctggctgccagccttgccctggctctgaatggcgtctttaccaacacaataaaactgatcgtagggaggccacgcccagatttcttctaccgctgcttccctgatgggctagcccattctgacttgatgtgtacaggggataaggacgtggtgaatgagggccgaaagagcttccccagtggacattcttcctttgcatttgctggtctggcctttgcgtccttctacctggcagggaagttacactgcttcacaccacaaggccgtgggaaatcttggaggttctgtgcctttctgtcacctctactttttgcagctgtgattgcactgtcccgcacatgtgactacaagcatcactggcaagatgtactagttggatccatgattggaatgacatttgcctatgtctgctatcggcagtattatcctcctctgactgatgcagaatgccataaaccatttcaagacaaacttgtaactttccactgcacagaagcctggggattcttcatgttgatatttaaccaattgaatctggccgggcgtggtgggctcatgcctgtaatcacagcactttgggaaggtgaggtcaggctggtctcaatctcctgacctcgggatccatctgcctggtcctcccaaagtgctgggattacaggcgtgagtcaccgtgcccggcgagaagcaactcttaaaatactttattccttcctctaggaccctttaaatggtgaaaatgggcagatgaatagcaataagtggacctttgttactcttctgagttagaaaaattctaatttagtacactctgaacaaagcttattatacttacttaagatgtgttttgatttggtgttcagaaagcaacctgacaatgataatactgtaactatgataaaattgagaataagtagagtatcctggagggccaggtcctctatgctatgtgtatgtaataggatttaggagcctaatattaagagaagacct

SEQ ID NO: 17357 - DNA, 847 bp, Homo sapiens
gatggggaaggcggcggcggcggtggcctttggggccgaagtgggcgtgcggctcgcgctgttcgcggccttcctggtgacggagctgctccccccgttccagagactcatccagccggaggagatgtggctctaccggaacccctacgtggaggcggagtatttccccaccaagccgatgtttgttattgcatttctctctccactgtctctgatcttcctggccaaatttctcaagaaggcagacacaagagacagcagacaagcctgcctggctgccagccttgccctggctctgaatggcgtctttaccaacacaataaaactgatcgtagggaggccacgcccagatttcttctaccgctgcttccctgatgggctagcccattctgacttgatgtgtacaggggataaggacgtggtgaatgagggccgaaagagcttccccagtggacattcttcctttgcatttgctggtctggcctttgcgtccttctacctggcagggaagttacactgcttcacaccacaaggccgtgggaaatcttggaggttctgtgcctttctgtcacctctactttttgcagctgtgattgcactgtcccgcacatgtgactacaagcatcactggcaagatgtactagttggatccatgattggaatgacatttgcctatgtctgctatcggcagtattatcctcctctgactgatgcagaatgccataaaccatttcaagacaaacttgtactttccactgcacagaagcctggggattcttattattcacatgctcataaaaatgcttttacaggccaggcacggtggctcacgcctgtaatcctagca

SEQ ID NO: 17358 - DNA, 1633 bp, Homo sapiens
gatggggaaggcggcggcggcggtggcctttggggccgaagtgggcgtgcggctcgcgctgttcgcggccttcctggtgacggagctgctccccccgttccagagactcatccagccggaggagatgtggctctaccggaacccctacgtggaggcggagtatttccccaccaagccgatgtttgtgcgtggagaaagatcgtctttcctccctccccatgacccggcttcccgcgggcacctgtgcgttttccaccccgagacggcctttgtagggacccactgcccactccgctgctgtgcgctgggttccgcctcctagggctcgagtgtttaagatcctgattgagagaggagggtgtccgagcctctttgggctgagacaacgttttcccgggcgctctgtgcctcagcctgaggtaccggggcccgagccgcacgggcgctgctgttcactggtggcgctgcctggcgcccggttacgcgcactcagagaccttatgttagctccagtgagtcctgctgtgtcacatccctctttcctgtaggagcacgagtgtggcttttttttggattgtttttaacctctgacattctgattcaggttattgcatttctctctccactgtctctgatcttcctggccaaatttctcaagaaggcagacacaagagacagcagacaagcctgcctgggtgagcgctagccctttcgggccggtttcttcgtgctgggaacctaggaggtcgttgtgggattcagccacggtgagcctgtgtggaggccactgagttctgcattcctaaaggaactctatccccgcgggagaggaaaatagcactgcagggacttggttacgcaggctacacggcaggcagccctgtgcctaaatgcactgggttatttgtacctcagaaatgtctttggcctagtacaaaagttctcggctacaaaagagtgatcactgaggaccctaattatttttgtgcccaggcctggttggattctatccatctcagaaacagcacggctgctctcataacgaggccatgaccatacctttcctcctagacagatcctttcaactaatggctttgctttgcagctgccagccttgccctggctctgaatggcgtctttaccaacacaataaaactgatcgtagggaggccacgcccagatttcttctaccgctgcttccctgatgggctagcccattctgacttgatgtgtacaggggataaggacgtggtgaatgagggccgaaagagcttccccagtggacattcttcctttgcatttgctggtctggcctttgcgtccttctacctggcagggaagttacactgcttcacaccacaaggccgtgggaaatcttggaggttctgtgcctttctgtcacctctactttttgcagctgtgattgcactgtcccgcacatgtgactacaagcatcactggcaagtaattcatccgttgtatcagaaagcgatgacgtgggacattaatattgcacagaacttccatagcaaataacctaaaggaacgaatgtgctttatttataaccttacgttatccccaatgcattgtaaatgtcaaacttttggaaaataaagcctgcgtgccctccca

SEQ ID NO: 17359 - DNA, 1071 bp, Homo sapiens
tgcatatttcactcattttattcctagcacctagcacagaggagatgcttactaaatatctgctgaatgaacaaattaatgagtatggatggtctgggttctgtactaagtacatttaaaattataggaaagataagacaaaaagagtttaccaaagataaacatcctaatttttccattatttgaagcattgtaagttcaagttaaactgcatctacaggaaatttaaaacctcaaagttcaatttactctcttaaaaatcaggttcattgtcataggacttttgttcaaaaacataagtaaaattcaagaaaacataaaattataattaaaccaaacaaatttaagctgaatgctatagtaagtaaaatatccaaattacagaacacctggcttggcgcggtggctcacacctcagcactttgggaggctgaggcaggcggatcacctgtagtcaggaattcgagaccagcctggccaacatattgaaaccccgtctctactaaaaatacaaaaattgaggccaggtgcagtggctcatgcctgtaatcacagcactttgggaaggtgaggtaggtggatcacctgaggtcaggagttgaagaccagcctgaccaacagtgaaacgctatctctactaaaaatacaaaatcagctgggcatggtggcacacgcctttaatcccagctacttgggaggctgaggcaggagaatggcttgaacctgacacaattccaaaaaaaacgctggaggtattgcccacaggtcctcaggaaccctattttaaatttttaaataaactagttttttgcaaagagaagcaacttcttaaaatactttattccttcctctaggaccctttaaatggtgaaaatgggcagatgaatagcaataagtggacctttgttactcttctgagttagaaaaattctaatttagtacactctgaacaaagcttattatacttacttaagatgtgttttgatttggtgttcagaaagcaacctgacaatgataatactgtaactatgataaaattgagaataaaaagattttatttagaaaaaaaaa

SEQ ID NO: 17360 - DNA, 450 bp, Homo sapiens
taactaaagaaggtattggaaggagttttgaaagacaagaatgaacatttcaaatagctaacaggtctttctttatttcaactaacagagaaaccatttatgggaggatgtggtatttcacttcagacttctccagaggtgacactgcgtacaccaagctagctctggatcggcacactgacactacctattttcaagagccctgtgggtaggtggattagacttttacagtgtaaagtctttatatgtgatagtcttgagtggtttcttaattattttccattctgttcgaaccaagatcatatctgctcctgcagatttgtatgactttctcttcccctggaaacatgatcattttgaaataccttaactcagtttttagattctgtattaggccattcttgcattgctataaataaatacctgagactgggtaatttataaaaaaaa

SEQ ID NO: 17361 - DNA, 733 bp, Homo sapiens
attcagccctaaaacttcaaaggaatgcctatttcactatgagagatggccatagtcatgcctatcaccacatggttcatagaagtatcagtgccatttaaaatgccagagacagagtggacaacctcagaccagccacaagattacttccttaaagaatgaaaatagacagtttccttccaattctaaggatgtggtaccacagattgtcccacctacacagcaggcttcaggacttgctgaagggaggagtcatatatccggcccttccacagcccaacttcaaaagcttacttcctttagctgtccattggcaccatacagcctccaagtctctgacttgtgcttggcagcaacatgaagatcattttgagctgaaatatgctaataccgtgatgcgctttgattacgtctggcttcgagaccactgccgctcagcatcgtgctacaactctaagactcaccagcgcagcctggatactgccagtgtggatttatgtatcaagccaaagaccattcgtctggatgagaccacactctttttcacttgtgagtggacaggagacttgatcttctttgggggtactcttctgaaggacagttattttgtggaaaatggtttgttcctttcaaaaataggttattacttacttttctttttttcttgttttggaaggattttttgaaacattttatttttctcttcaaataaaattgttacaatccacagcta

SEQ ID NO: 17362 - DNA, 653 bp, Homo sapiens
tggggcggggcctacaggctctccgctgggcccgagcgggctgggggaggggagcgtggggccgacagttttgggggtgaaaaggcaaaaggcgggtgaaaggctgcctcccgagactctccttgcttggaattctgcccactctgcggagttagcagtcacgacctccagcacagggttgtcgtcacgatctgtgccagttgcgcgacagagtctgcccggagatcagcgtgaggccggatgggcctagcgctcaggaagagctggaagagctggagcaagctcgcgttgggactgacgcccagtgtacattgtttcaatctcggtcggactttacagccctggatctgtcactgacttggtgtttagctttcagcgagtccctaccctcttcctgcctcactttgttcggcagtagagtggaaggtggaactcagctgtctgcaagatcttgcagcactttctttcgttctcatatccactaatgttctctgcccagattttaccctttgtctgccccctctggagcaaggctctgggtaagtaagttaggctaggaagttttctttctcttccgaaaacaatggaaaagcctttaaatactcctgactgccctggaaacgacattcaaaccattaattgaatgtcaactc

SEQ ID NO: 17363 - DNA, 330 bp, Homo sapiens
tggggcggggcctacaggctctccgctgggcccgagcgggctgggggaggggagcgtggggccgacagttttgggggtgaaaaggcaaaaggcgggtgaaaggctgcctcccgagactctccttgcttggaattctgcccactctgcggagttagcagtcacgacctccagcacaggcaatcaatgaatgtcaactctgtgccaggatgctgatccattcactgagattggcagcacaggacagccagttcgggaggacaacaggaattcaactttaagcatactcagtctgaggcctcctcacctttccccactccctatatctaactg

SEQ ID NO: 17364 - DNA, 3982 bp, Homo sapiens
tggggcggggcctacaggctctccgctgggcccgagcgggctgggggaggggagcgtggggccgacagttttgggggtgaaaaggcaaaaggcgggtgaaaggctgcctcccgagactctccttgcttggaattctgcccactctgcggagttagcagtcacgacctccagcacaggatgtggtaccacagattgtcccacctacacagcaggcttcaggacttgctgaagggaggagtcatatatccggcccttccacagcccaacttcaaaagcttacttcctttagctgtccattggcaccatacagcctccaagtctctgacttgtgcttggcagcaacatgaagatcattttgagctgaaatatgctaataccgtgatgcgctttgattacgtctggcttcgagaccactgccgctcagcatcgtgctacaactctaagactcaccagcgcagcctggatactgccagtgtggatttatgtatcaagccaaagaccattcgtctggatgagaccacactctttttcacttggccagatggtcatgtgactaaatatgatttgaattggctggtgaaaaacagctatgaagggcagaaacaaaaagtcatccagcctagaatactatggaatgctgaaatctaccagcaagcccaagttccatcggtagattgccagagcttcttagaaaccaacgagggactgaagaagtttctgcaaaactttctgctctatggaattgcattcgtagaaaatgtccctcccactcaagagcacacagagaagttggcagaaaggatcagcttaatcagagaaaccatttatgggaggatgtggtatttcacttcagacttctccagaggtgacactgcgtacaccaagctagctctggatcggcacactgacactacctattttcaagagccctgtggcattcaagtgtttcattgtcttaaacatgaaggaactggtggcaggacactgctagtagatggattctatgcagcagaacaggtacttcaaaaggcacctgaggaatttgaactcctcagtaaagtgccattgaagcatgaatatattgaagatgttggagaatgtcacaaccacatgattgggattgggccagtcttaaatatctacccatggaataaagagctgtatttgatcaggtacaacaactatgaccgggctgtcatcaataccgttccttatgatgtcgtccatcgctggtatacagcacaccggactctaacgatagagttgaggagacctgagaatgagttttgggtcaaactaaagcctggcagggtcctatttatagacaactggcgtgtcctacatggcagggaatgcttcactggctaccgccaactgtgtggctgctatttaacaagagatgatgtattaaacactgctcgcctcttggggcttcaggcttaaaattgacagcatctggattatgaatacacctggcaccctggctaccagaatttcatatgggcagaataatattgtgtcaaactctacttcagattgtctccttatcccatcccacaaaacagaatctgtccgtttctctagtaagggagacttgttggagaggcgggactctgagttatctaatgtcagacatctagtggggcagctctcttcctcatgttataacatggatccacttgttttatttaaaccttttaatataattttggtcagtctccttcagaaatataatctccatattgataggaaagcaataattgccatgaggtaacgatttttttcccaagtagatcagttagaaagaaatgcattctagaaataacaaaaatcctgataaagcaacaatttgcaaaatgtttggtcttaggacaccttaacactcttaaaagttattgaaggccccaaggagttcttgggtgtgggttctatctattgatactaattattttaggtattaagactgagaaatatttaaagctcaagaagaacacagaagcacacatccctcagctatgagagagatgacataaccatatgtcatgtagcctctggaaaagtcctctgtatcctcatgagataacgagagggggaaaaaaagctactactgcctttgtaacttccacttagcctactacagggctatgcacatcttagtttccaaaagtctgcttaatttcaaaagaaaaatgcctaattgaatgtaactcatcttggtgttattatacaaaataatttttaatctgcagacccacgaaaagggtctcagggactcctccaggggtcttcagaccatactttgagaacccatgggctagcgactaccttgagacagtcctttacctaggcctgtggattaaagggtttagctgaaaccctagattcttctctgtagtctaatagaactccaaacattgtaagaattgcttggtagcataagctcagggataaggtgggaattgagttcaaatatagtgttttatcttccacacaaatcatctctataggagttaaattaggaagtcacaacagcgcctgttgaacaaactcatcagtgtggtaatcctatgagggataattgcagaaaggttttagagacttgtgaggttccatatgataattctttacacctcccccccccaagagaaagtacacagggctattctgtaatattgttcagggaaatcagcatgatagatgctgtgcctccagagagttctctggagattactacccaaatgtgtattttggcaatttggtggtatttaggatgtaatatgttttcctccatttctgctaattttctctctctctctctcataacatactatacatgctaattgccaagatttgaatgagtcaaatttagtagcttgctgcttttattttttaaatggcttcttttacgtattggcgggggcggggggggggaggggggcagggtatgaggcttcttttccctcagctttcattgaaagtgaagctgtacaataaccacattgaccactgtagaatgatgaaagagaatataggctaggatgcacacaagaggggggaaaaggcattattagtgaagataggagttacaaagcaaagcaaagtcagtattcagatagagaatagagcctaatctgatgtttgcagggagttcctagatcacatttggcaatttacacattattttattgacctatccagtgctccaaaatgtgttccaaaatattttggcattttatttgtactatataggaatctttaggggagtccctgaaatttgttttcctcttaggtcaaaggactgataattaactttggttcttaaggagtatgccctttagcaataagaacagcaataacattttaccctgcagttttttctctatacctactattatgcactcctaaaatatgtcatcattagtcttcatgaggatgtttaccatttctgaagttttgcgtaaattagccttgaagattacactataactgaggtcatcagcattgacttatggccagcaaaggacatgctcatggccctggagagatgaggacacaaaacaaatcaatttccccacttactgaaggactccccttaccttctgtctctcctgagaccttgactcattaattattttactctcctttttggaaatttgcaaccggtccttctcaacaatgtgctccctttagtacactgaagaaaaagagaagggaattatttgagtcctgatcacgatgcattgaaaacttcctatgtgagatgtttctgtttttatatctcttccaggtgtccctgagtatataagcatgggtctatgtctaccaagctcactgtagagtcacttttaccttttgctatggtggaatgggatctgtagggtcaggaacacagcacctaacacagtgccttatggatagtagttttataatacagatgtgttggaagaataaatgaatgggtccttttcaaacaaattcacca

SEQ ID NO: 17365 - DNA, 4187 bp, Homo sapiens
tggggcggggcctacaggctctccgctgggcccgagcgggctgggggaggggagcgtggggccgacagttttgggggtgaaaaggcaaaaggcgggtgaaaggctgcctcccgagactctccttgcttggaattctgcccactctgcggagttagcagtcacgacctccagcacaggatgtggtaccacagattgtcccacctacacagcaggcttcaggacttgctgaagggaggagtcatatatccggcccttccacagcccaacttcaaaagcttacttcctttagctgtccattggcaccatacagcctccaagtctctgacttgtgcttggcagcaacatgaagatcattttgagctgaaatatgctaataccgtgatgcgctttgattacgtctggcttcgagaccactgccgctcagcatcgtgctacaactctaagactcaccagcgcagcctggatactgccagtgtggatttatgtatcaagccaaagaccattcgtctggatgagaccacactctttttcacttggccagatggtcatgtgactaaatatgatttgaattggctggtgaaaaacagctatgaagggcagaaacaaaaagtcatccagcctagaatactatggaatgctgaaatctaccagcaagcccaagttccatcggtagattgccagagcttcttagaaaccaacgagggactgaagaagtttctgcaaaactttctgctctatggaattgcattcgtagaaaatgtccctcccactcaagagcacacagagaagttggcagaaaggatcagcttaatcagagaaaccatttatgggaggatgtggtatttcacttcagacttctccagaggtgacactgcgtacaccaagctagctctggatcggcacactgacactacctattttcaagagccctgtggcattcaagtgtttcattgtcttaaacatgaaggaactggtggcaggacactgctagtagatggattctatgcagcagaacaggtacttcaaaaggcacctgaggaatttgaactcctcagtaaagtgccattgaagcatgaatatattgaagatgttggagaatgtcacaaccacatgattgggattgggccagtcttaaatatctacccatggaataaagagctgtatttgatcagattattcaaagaaaaacaaaacacggtcaacaggcagtggaactcctcactccaatgtgatattcctgagagaatattgacttatcgtcacttcgtctctgggacaagtattgaacataggggaagccttatataaaattgttcaataaacaaaagatgtctttaacatgtgtttgagatctttcttctcatgattccatgttaggtacaacaactatgaccgggctgtcatcaataccgttccttatgatgtcgtccatcgctggtatacagcacaccggactctaacgatagagttgaggagacctgagaatgagttttgggtcaaactaaagcctggcagggtcctatttatagacaactggcgtgtcctacatggcagggaatgcttcactggctaccgccaactgtgtggctgctatttaacaagagatgatgtattaaacactgctcgcctcttggggcttcaggcttaaaattgacagcatctggattatgaatacacctggcaccctggctaccagaatttcatatgggcagaataatattgtgtcaaactctacttcagattgtctccttatcccatcccacaaaacagaatctgtccgtttctctagtaagggagacttgttggagaggcgggactctgagttatctaatgtcagacatctagtggggcagctctcttcctcatgttataacatggatccacttgttttatttaaaccttttaatataattttggtcagtctccttcagaaatataatctccatattgataggaaagcaataattgccatgaggtaacgatttttttcccaagtagatcagttagaaagaaatgcattctagaaataacaaaaatcctgataaagcaacaatttgcaaaatgtttggtcttaggacaccttaacactcttaaaagttattgaaggccccaaggagttcttgggtgtgggttctatctattgatactaattattttaggtattaagactgagaaatatttaaagctcaagaagaacacagaagcacacatccctcagctatgagagagatgacataaccatatgtcatgtagcctctggaaaagtcctctgtatcctcatgagataacgagagggggaaaaaaagctactactgcctttgtaacttccacttagcctactacagggctatgcacatcttagtttccaaaagtctgcttaatttcaaaagaaaaatgcctaattgaatgtaactcatcttggtgttattatacaaaataatttttaatctgcagacccacgaaaagggtctcagggactcctccaggggtcttcagaccatactttgagaacccatgggctagcgactaccttgagacagtcctttacctaggcctgtggattaaagggtttagctgaaaccctagattcttctctgtagtctaatagaactccaaacattgtaagaattgcttggtagcataagctcagggataaggtgggaattgagttcaaatatagtgttttatcttccacacaaatcatctctataggagttaaattaggaagtcacaacagcgcctgttgaacaaactcatcagtgtggtaatcctatgagggataattgcagaaaggttttagagacttgtgaggttccatatgataattctttacacctcccccccccaagagaaagtacacagggctattctgtaatattgttcagggaaatcagcatgatagatgctgtgcctccagagagttctctggagattactacccaaatgtgtattttggcaatttggtggtatttaggatgtaatatgttttcctccatttctgctaattttctctctctctctctcataacatactatacatgctaattgccaagatttgaatgagtcaaatttagtagcttgctgcttttattttttaaatggcttcttttacgtattggcgggggcggggggggggaggggggcagggtatgaggcttcttttccctcagctttcattgaaagtgaagctgtacaataaccacattgaccactgtagaatgatgaaagagaatataggctaggatgcacacaagaggggggaaaaggcattattagtgaagataggagttacaaagcaaagcaaagtcagtattcagatagagaatagagcctaatctgatgtttgcagggagttcctagatcacatttggcaatttacacattattttattgacctatccagtgctccaaaatgtgttccaaaatattttggcattttatttgtactatataggaatctttaggggagtccctgaaatttgttttcctcttaggtcaaaggactgataattaactttggttcttaaggagtatgccctttagcaataagaacagcaataacattttaccctgcagttttttctctatacctactattatgcactcctaaaatatgtcatcattagtcttcatgaggatgtttaccatttctgaagttttgcgtaaattagccttgaagattacactataactgaggtcatcagcattgacttatggccagcaaaggacatgctcatggccctggagagatgaggacacaaaacaaatcaatttccccacttactgaaggactccccttaccttctgtctctcctgagaccttgactcattaattattttactctcctttttggaaatttgcaaccggtccttctcaacaatgtgctccctttagtacactgaagaaaaagagaagggaattatttgagtcctgatcacgatgcattgaaaacttcctatgtgagatgtttctgtttttatatctcttccaggtgtccctgagtatataagcatgggtctatgtctaccaagctcactgtagagtcacttttaccttttgctatggtggaatgggatctgtagggtcaggaacacagcacctaacacagtgccttatggatagtagttttataatacagatgtgttggaagaataaatgaatgggtccttttcaaacaaattcacca

SEQ ID NO: 17366 - DNA, 4057 bp, Homo sapiens
tggggcggggcctacaggctctccgctgggcccgagcgggctgggggaggggagcgtggggccgacagttttgggggtgaaaaggcaaaaggcgggtgaaaggctgcctcccgagactctccttgcttggaattctgcccactctgcggagttagcagtcacgacctccagcacaggatgtggtaccacagattgtcccacctacacagcaggcttcaggacttgctgaagggaggagtcatatatccggcccttccacagcccaacttcaaaagcttacttcctttagctgtccattggcaccatacagcctccaagtctctgacttgtgcttggcagcaacatgaagatcattttgagctgaaatatgctaataccgtgatgcgctttgattacgtctggcttcgagaccactgccgctcagcatcgtgctacaactctaagactcaccagcgcagcctggatactgccagtgtggatttatgtatcaagccaaagaccattcgtctggatgagaccacactctttttcacttggccagatggtcatgtgactaaatatgatttgaattggctggtgaaaaacagctatgaagggcagaaacaaaaagtcatccagcctagaatactatggaatgctgaaatctaccagcaagcccaagttccatcggtagattgccagagcttcttagaaaccaacgagggactgaagaagtttctgcaaaactttctgctctatggaattgcattcgtagaaaatgtccctcccactcaagagcacacagagaagttggcagaaaggatcagcttaatcagagaaaccatttatgggaggatgtggtatttcacttcagacttctccagaggtgacactgcgtacaccaagctagctctggatcggcacactgacactacctattttcaagagccctgtggcattcaagtgtttcattgtcttaaacatgaaggaactggtggcaggacactgctagtagatggattctatgcagcagaacaggtacttcaaaaggcacctgaggaatttgaactcctcagtaaagtgccattgaagcatgaatatattgaagatgttggagaatgtcacaaccacatgattgggattgggccagtcttaaatatctacccatggaataaagagctgtatttgatcaggtacaacaactatgaccgggctgtcatcaataccgttccttatgatgtcgtccatcgctggtatacagcacaccggactctaacgatagagttgaggagacctgagaatgagttttgggtcaaactaaagcctggcagggtgggtcctaatctctaaagatgtcaagcaagcttgtaatactgaagcagtgaagaacgggtacttacttaatatgtcctatttatagacaactggcgtgtcctacatggcagggaatgcttcactggctaccgccaactgtgtggctgctatttaacaagagatgatgtattaaacactgctcgcctcttggggcttcaggcttaaaattgacagcatctggattatgaatacacctggcaccctggctaccagaatttcatatgggcagaataatattgtgtcaaactctacttcagattgtctccttatcccatcccacaaaacagaatctgtccgtttctctagtaagggagacttgttggagaggcgggactctgagttatctaatgtcagacatctagtggggcagctctcttcctcatgttataacatggatccacttgttttatttaaaccttttaatataattttggtcagtctccttcagaaatataatctccatattgataggaaagcaataattgccatgaggtaacgatttttttcccaagtagatcagttagaaagaaatgcattctagaaataacaaaaatcctgataaagcaacaatttgcaaaatgtttggtcttaggacaccttaacactcttaaaagttattgaaggccccaaggagttcttgggtgtgggttctatctattgatactaattattttaggtattaagactgagaaatatttaaagctcaagaagaacacagaagcacacatccctcagctatgagagagatgacataaccatatgtcatgtagcctctggaaaagtcctctgtatcctcatgagataacgagagggggaaaaaaagctactactgcctttgtaacttccacttagcctactacagggctatgcacatcttagtttccaaaagtctgcttaatttcaaaagaaaaatgcctaattgaatgtaactcatcttggtgttattatacaaaataatttttaatctgcagacccacgaaaagggtctcagggactcctccaggggtcttcagaccatactttgagaacccatgggctagcgactaccttgagacagtcctttacctaggcctgtggattaaagggtttagctgaaaccctagattcttctctgtagtctaatagaactccaaacattgtaagaattgcttggtagcataagctcagggataaggtgggaattgagttcaaatatagtgttttatcttccacacaaatcatctctataggagttaaattaggaagtcacaacagcgcctgttgaacaaactcatcagtgtggtaatcctatgagggataattgcagaaaggttttagagacttgtgaggttccatatgataattctttacacctcccccccccaagagaaagtacacagggctattctgtaatattgttcagggaaatcagcatgatagatgctgtgcctccagagagttctctggagattactacccaaatgtgtattttggcaatttggtggtatttaggatgtaatatgttttcctccatttctgctaattttctctctctctctctcataacatactatacatgctaattgccaagatttgaatgagtcaaatttagtagcttgctgcttttattttttaaatggcttcttttacgtattggcgggggcggggggggggaggggggcagggtatgaggcttcttttccctcagctttcattgaaagtgaagctgtacaataaccacattgaccactgtagaatgatgaaagagaatataggctaggatgcacacaagaggggggaaaaggcattattagtgaagataggagttacaaagcaaagcaaagtcagtattcagatagagaatagagcctaatctgatgtttgcagggagttcctagatcacatttggcaatttacacattattttattgacctatccagtgctccaaaatgtgttccaaaatattttggcattttatttgtactatataggaatctttaggggagtccctgaaatttgttttcctcttaggtcaaaggactgataattaactttggttcttaaggagtatgccctttagcaataagaacagcaataacattttaccctgcagttttttctctatacctactattatgcactcctaaaatatgtcatcattagtcttcatgaggatgtttaccatttctgaagttttgcgtaaattagccttgaagattacactataactgaggtcatcagcattgacttatggccagcaaaggacatgctcatggccctggagagatgaggacacaaaacaaatcaatttccccacttactgaaggactccccttaccttctgtctctcctgagaccttgactcattaattattttactctcctttttggaaatttgcaaccggtccttctcaacaatgtgctccctttagtacactgaagaaaaagagaagggaattatttgagtcctgatcacgatgcattgaaaacttcctatgtgagatgtttctgtttttatatctcttccaggtgtccctgagtatataagcatgggtctatgtctaccaagctcactgtagagtcacttttaccttttgctatggtggaatgggatctgtagggtcaggaacacagcacctaacacagtgccttatggatagtagttttataatacagatgtgttggaagaataaatgaatgggtccttttcaaacaaattcacca

SEQ ID NO: 17367 - DNA, 3800 bp, Homo sapiens
tggggcggggcctacaggctctccgctgggcccgagcgggctgggggaggggagcgtggggccgacagttttgggggtgaaaaggcaaaaggcgggtgaaaggctgcctcccgagactctccttgcttggaattctgcccactctgcggagttagcagtcacgacctccagcacagagctgaaatatgctaataccgtgatgcgctttgattacgtctggcttcgagaccactgccgctcagcatcgtgctacaactctaagactcaccagcgcagcctggatactgccagtgtggatttatgtatcaagccaaagaccattcgtctggatgagaccacactctttttcacttggccagatggtcatgtgactaaatatgatttgaattggctggtgaaaaacagctatgaagggcagaaacaaaaagtcatccagcctagaatactatggaatgctgaaatctaccagcaagcccaagttccatcggtagattgccagagcttcttagaaaccaacgagggactgaagaagtttctgcaaaactttctgctctatggaattgcattcgtagaaaatgtccctcccactcaagagcacacagagaagttggcagaaaggatcagcttaatcagagaaaccatttatgggaggatgtggtatttcacttcagacttctccagaggtgacactgcgtacaccaagctagctctggatcggcacactgacactacctattttcaagagccctgtggcattcaagtgtttcattgtcttaaacatgaaggaactggtggcaggacactgctagtagatggattctatgcagcagaacaggtacttcaaaaggcacctgaggaatttgaactcctcagtaaagtgccattgaagcatgaatatattgaagatgttggagaatgtcacaaccacatgattgggattgggccagtcttaaatatctacccatggaataaagagctgtatttgatcaggtacaacaactatgaccgggctgtcatcaataccgttccttatgatgtcgtccatcgctggtatacagcacaccggactctaacgatagagttgaggagacctgagaatgagttttgggtcaaactaaagcctggcagggtcctatttatagacaactggcgtgtcctacatggcagggaatgcttcactggctaccgccaactgtgtggctgctatttaacaagagatgatgtattaaacactgctcgcctcttggggcttcaggcttaaaattgacagcatctggattatgaatacacctggcaccctggctaccagaatttcatatgggcagaataatattgtgtcaaactctacttcagattgtctccttatcccatcccacaaaacagaatctgtccgtttctctagtaagggagacttgttggagaggcgggactctgagttatctaatgtcagacatctagtggggcagctctcttcctcatgttataacatggatccacttgttttatttaaaccttttaatataattttggtcagtctccttcagaaatataatctccatattgataggaaagcaataattgccatgaggtaacgatttttttcccaagtagatcagttagaaagaaatgcattctagaaataacaaaaatcctgataaagcaacaatttgcaaaatgtttggtcttaggacaccttaacactcttaaaagttattgaaggccccaaggagttcttgggtgtgggttctatctattgatactaattattttaggtattaagactgagaaatatttaaagctcaagaagaacacagaagcacacatccctcagctatgagagagatgacataaccatatgtcatgtagcctctggaaaagtcctctgtatcctcatgagataacgagagggggaaaaaaagctactactgcctttgtaacttccacttagcctactacagggctatgcacatcttagtttccaaaagtctgcttaatttcaaaagaaaaatgcctaattgaatgtaactcatcttggtgttattatacaaaataatttttaatctgcagacccacgaaaagggtctcagggactcctccaggggtcttcagaccatactttgagaacccatgggctagcgactaccttgagacagtcctttacctaggcctgtggattaaagggtttagctgaaaccctagattcttctctgtagtctaatagaactccaaacattgtaagaattgcttggtagcataagctcagggataaggtgggaattgagttcaaatatagtgttttatcttccacacaaatcatctctataggagttaaattaggaagtcacaacagcgcctgttgaacaaactcatcagtgtggtaatcctatgagggataattgcagaaaggttttagagacttgtgaggttccatatgataattctttacacctcccccccccaagagaaagtacacagggctattctgtaatattgttcagggaaatcagcatgatagatgctgtgcctccagagagttctctggagattactacccaaatgtgtattttggcaatttggtggtatttaggatgtaatatgttttcctccatttctgctaattttctctctctctctctcataacatactatacatgctaattgccaagatttgaatgagtcaaatttagtagcttgctgcttttattttttaaatggcttcttttacgtattggcgggggcggggggggggaggggggcagggtatgaggcttcttttccctcagctttcattgaaagtgaagctgtacaataaccacattgaccactgtagaatgatgaaagagaatataggctaggatgcacacaagaggggggaaaaggcattattagtgaagataggagttacaaagcaaagcaaagtcagtattcagatagagaatagagcctaatctgatgtttgcagggagttcctagatcacatttggcaatttacacattattttattgacctatccagtgctccaaaatgtgttccaaaatattttggcattttatttgtactatataggaatctttaggggagtccctgaaatttgttttcctcttaggtcaaaggactgataattaactttggttcttaaggagtatgccctttagcaataagaacagcaataacattttaccctgcagttttttctctatacctactattatgcactcctaaaatatgtcatcattagtcttcatgaggatgtttaccatttctgaagttttgcgtaaattagccttgaagattacactataactgaggtcatcagcattgacttatggccagcaaaggacatgctcatggccctggagagatgaggacacaaaacaaatcaatttccccacttactgaaggactccccttaccttctgtctctcctgagaccttgactcattaattattttactctcctttttggaaatttgcaaccggtccttctcaacaatgtgctccctttagtacactgaagaaaaagagaagggaattatttgagtcctgatcacgatgcattgaaaacttcctatgtgagatgtttctgtttttatatctcttccaggtgtccctgagtatataagcatgggtctatgtctaccaagctcactgtagagtcacttttaccttttgctatggtggaatgggatctgtagggtcaggaacacagcacctaacacagtgccttatggatagtagttttataatacagatgtgttggaagaataaatgaatgggtccttttcaaacaaattcacca

SEQ ID NO: 17368 - DNA, 3996 bp, Homo sapiens
attcagccctaaaacttcaaaggaatgcctatttcactatgagagatggccatagtcatgcctatcaccacatggttcatagaagtatcagtgccatttaaaatgccagagacagagtggacaacctcagaccagccacaagattacttccttaaagaatgaaaatagacagtttccttccaattctaaggatgtggtaccacagattgtcccacctacacagcaggcttcaggacttgctgaagggaggagtcatatatccggcccttccacagcccaacttcaaaagcttacttcctttagctgtccattggcaccatacagcctccaagtctctgacttgtgcttggcagcaacatgaagatcattttgagctgaaatatgctaataccgtgatgcgctttgattacgtctggcttcgagaccactgccgctcagcatcgtgctacaactctaagactcaccagcgcagcctggatactgccagtgtggatttatgtatcaagccaaagaccattcgtctggatgagaccacactctttttcacttggccagatggtcatgtgactaaatatgatttgaattggctggtgaaaaacagctatgaagggcagaaacaaaaagtcatccagcctagaatactatggaatgctgaaatctaccagcaagcccaagttccatcggtagattgccagagcttcttagaaaccaacgagggactgaagaagtttctgcaaaactttctgctctatggaattgcattcgtagaaaatgtccctcccactcaagagcacacagagaagttggcagaaaggatcagcttaatcagagaaaccatttatgggaggatgtggtatttcacttcagacttctccagaggtgacactgcgtacaccaagctagctctggatcggcacactgacactacctattttcaagagccctgtggcattcaagtgtttcattgtcttaaacatgaaggaactggtggcaggacactgctagtagatggattctatgcagcagaacaggtacttcaaaaggcacctgaggaatttgaactcctcagtaaagtgccattgaagcatgaatatattgaagatgttggagaatgtcacaaccacatgattgggattgggccagtcttaaatatctacccatggaataaagagctgtatttgatcaggtacaacaactatgaccgggctgtcatcaataccgttccttatgatgtcgtccatcgctggtatacagcacaccggactctaacgatagagttgaggagacctgagaatgagttttgggtcaaactaaagcctggcagggtcctatttatagacaactggcgtgtcctacatggcagggaatgcttcactggctaccgccaactgtgtggctgctatttaacaagagatgatgtattaaacactgctcgcctcttggggcttcaggcttaaaattgacagcatctggattatgaatacacctggcaccctggctaccagaatttcatatgggcagaataatattgtgtcaaactctacttcagattgtctccttatcccatcccacaaaacagaatctgtccgtttctctagtaagggagacttgttggagaggcgggactctgagttatctaatgtcagacatctagtggggcagctctcttcctcatgttataacatggatccacttgttttatttaaaccttttaatataattttggtcagtctccttcagaaatataatctccatattgataggaaagcaataattgccatgaggtaacgatttttttcccaagtagatcagttagaaagaaatgcattctagaaataacaaaaatcctgataaagcaacaatttgcaaaatgtttggtcttaggacaccttaacactcttaaaagttattgaaggccccaaggagttcttgggtgtgggttctatctattgatactaattattttaggtattaagactgagaaatatttaaagctcaagaagaacacagaagcacacatccctcagctatgagagagatgacataaccatatgtcatgtagcctctggaaaagtcctctgtatcctcatgagataacgagagggggaaaaaaagctactactgcctttgtaacttccacttagcctactacagggctatgcacatcttagtttccaaaagtctgcttaatttcaaaagaaaaatgcctaattgaatgtaactcatcttggtgttattatacaaaataatttttaatctgcagacccacgaaaagggtctcagggactcctccaggggtcttcagaccatactttgagaacccatgggctagcgactaccttgagacagtcctttacctaggcctgtggattaaagggtttagctgaaaccctagattcttctctgtagtctaatagaactccaaacattgtaagaattgcttggtagcataagctcagggataaggtgggaattgagttcaaatatagtgttttatcttccacacaaatcatctctataggagttaaattaggaagtcacaacagcgcctgttgaacaaactcatcagtgtggtaatcctatgagggataattgcagaaaggttttagagacttgtgaggttccatatgataattctttacacctcccccccccaagagaaagtacacagggctattctgtaatattgttcagggaaatcagcatgatagatgctgtgcctccagagagttctctggagattactacccaaatgtgtattttggcaatttggtggtatttaggatgtaatatgttttcctccatttctgctaattttctctctctctctctcataacatactatacatgctaattgccaagatttgaatgagtcaaatttagtagcttgctgcttttattttttaaatggcttcttttacgtattggcgggggcggggggggggaggggggcagggtatgaggcttcttttccctcagctttcattgaaagtgaagctgtacaataaccacattgaccactgtagaatgatgaaagagaatataggctaggatgcacacaagaggggggaaaaggcattattagtgaagataggagttacaaagcaaagcaaagtcagtattcagatagagaatagagcctaatctgatgtttgcagggagttcctagatcacatttggcaatttacacattattttattgacctatccagtgctccaaaatgtgttccaaaatattttggcattttatttgtactatataggaatctttaggggagtccctgaaatttgttttcctcttaggtcaaaggactgataattaactttggttcttaaggagtatgccctttagcaataagaacagcaataacattttaccctgcagttttttctctatacctactattatgcactcctaaaatatgtcatcattagtcttcatgaggatgtttaccatttctgaagttttgcgtaaattagccttgaagattacactataactgaggtcatcagcattgacttatggccagcaaaggacatgctcatggccctggagagatgaggacacaaaacaaatcaatttccccacttactgaaggactccccttaccttctgtctctcctgagaccttgactcattaattattttactctcctttttggaaatttgcaaccggtccttctcaacaatgtgctccctttagtacactgaagaaaaagagaagggaattatttgagtcctgatcacgatgcattgaaaacttcctatgtgagatgtttctgtttttatatctcttccaggtgtccctgagtatataagcatgggtctatgtctaccaagctcactgtagagtcacttttaccttttgctatggtggaatgggatctgtagggtcaggaacacagcacctaacacagtgccttatggatagtagttttataatacagatgtgttggaagaataaatgaatgggtccttttcaaacaaattcacca

SEQ ID NO: 17369 - DNA, 1492 bp, Homo sapiens
tggggcggggcctacaggctctccgctgggcccgagcgggctgggggaggggagcgtggggccgacagttttgggggtgaaaaggcaaaaggcgggtgaaaggctgcctcccgagactctccttgcttggaattctgcccactctgcggagttagcagtcacgacctccagcacaggatgtggtaccacagattgtcccacctacacagcaggcttcaggacttgctgaagggaggagtcatatatccggcccttccacagcccaacttcaaaagcttacttcctttagctgtccattggcaccatacagcctccaagtctctgacttgtgcttggcagcaacatgaagatcattttgagctgaaatatgctaataccgtgatgcgctttgattacgtctggcttcgagaccactgccgctcagcatcgtgctacaactctaagactcaccagcgcagcctggatactgccagtgtggatttatgtatcaagccaaagaccattcgtctggatgagaccacactctttttcacttggccagatggtcatgtgactaaatatgatttgaattggctggtgaaaaacagctatgaagggcagaaacaaaaagtcatccagcctagaatactatggaatgctgaaatctaccagcaagcccaagttccatcggtagattgccagagcttcttagaaaccaacgagggactgaagaagtttctgcaaaactttctgctctatggaattgcattcgtagaaaatgtccctcccactcaagagcacacagagaagttggcagaaaggatcagcttaatcagagaaaccatttatgggaggatgtggtatttcacttcagacttctccagaggtgacactgcgtacaccaagctagctctggatcggcacactgacactacctattttcaagagccctgtggcattcaagtgtttcattgtcttaaacatgaaggaactggtggcaggacactgctagtagatggattctatgcagcagaacaggtacttcaaaaggcacctgaggaatttgaactcctcagtaaagtgccattgaagcatgaatatattgaagatgttggagaatgtcacaaccacatgattgggattgggccagtcttaaatatctacccatggaataaagagctgtatttgatcaggtacaacaactatgaccgggctgtcatcaataccgttccttatgatgtcgtccatcgctggtatacagcacaccggactctaacgatagagttgaggagacctgagaatgagttttgggtcaaactaaagcctggcagggtcctatttatagacaactggcgtgtcctacatggcagggaatgcttcactggctaccgccaactgtgtggctgctatttaacaagagatgatgtattaaacactgctcgcctcttggggcttcaggcttaaaattgacagcatctggattatgaatacacctggcaccctggctaccaga

SEQ ID NO: 17370 - DNA, 3658 bp, Homo sapiens
gaggtgactctagaggaccccgaagatcattttgagctgaaatatgctaataccgtgatgcgctttgattacgtctggcttcgagaccactgccgctcagcatcgtgctacaactctaagactcaccagcgcagcctggatactgccagtgtggatttatgtatcaagccaaagaccattcgtctggatgagaccacactctttttcacttggccagatggtcatgtgactaaatatgatttgaattggctggtgaaaaacagctatgaagggcagaaacaaaaagtcatccagcctagaatactatggaatgctgaaatctaccagcaagcccaagttccatcggtagattgccagagcttcttagaaaccaacgagggactgaagaagtttctgcaaaactttctgctctatggaattgcattcgtagaaaatgtccctcccactcaagagcacacagagaagttggcagaaaggatcagcttaatcagagaaaccatttatgggaggatgtggtatttcacttcagacttctccagaggtgacactgcgtacaccaagctagctctggatcggcacactgacactacctattttcaagagccctgtggcattcaagtgtttcattgtcttaaacatgaaggaactggtggcaggacactgctagtagatggattctatgcagcagaacaggtacttcaaaaggcacctgaggaatttgaactcctcagtaaagtgccattgaagcatgaatatattgaagatgttggagaatgtcacaaccacatgattgggattgggccagtcttaaatatctacccatggaataaagagctgtatttgatcaggtacaacaactatgaccgggctgtcatcaataccgttccttatgatgtcgtccatcgctggtatacagcacaccggactctaacgatagagttgaggagacctgagaatgagttttgggtcaaactaaagcctggcagggtcctatttatagacaactggcgtgtcctacatggcagggaatgcttcactggctaccgccaactgtgtggctgctatttaacaagagatgatgtattaaacactgctcgcctcttggggcttcaggcttaaaattgacagcatctggattatgaatacacctggcaccctggctaccagaatttcatatgggcagaataatattgtgtcaaactctacttcagattgtctccttatcccatcccacaaaacagaatctgtccgtttctctagtaagggagacttgttggagaggcgggactctgagttatctaatgtcagacatctagtggggcagctctcttcctcatgttataacatggatccacttgttttatttaaaccttttaatataattttggtcagtctccttcagaaatataatctccatattgataggaaagcaataattgccatgaggtaacgatttttttcccaagtagatcagttagaaagaaatgcattctagaaataacaaaaatcctgataaagcaacaatttgcaaaatgtttggtcttaggacaccttaacactcttaaaagttattgaaggccccaaggagttcttgggtgtgggttctatctattgatactaattattttaggtattaagactgagaaatatttaaagctcaagaagaacacagaagcacacatccctcagctatgagagagatgacataaccatatgtcatgtagcctctggaaaagtcctctgtatcctcatgagataacgagagggggaaaaaaagctactactgcctttgtaacttccacttagcctactacagggctatgcacatcttagtttccaaaagtctgcttaatttcaaaagaaaaatgcctaattgaatgtaactcatcttggtgttattatacaaaataatttttaatctgcagacccacgaaaagggtctcagggactcctccaggggtcttcagaccatactttgagaacccatgggctagcgactaccttgagacagtcctttacctaggcctgtggattaaagggtttagctgaaaccctagattcttctctgtagtctaatagaactccaaacattgtaagaattgcttggtagcataagctcagggataaggtgggaattgagttcaaatatagtgttttatcttccacacaaatcatctctataggagttaaattaggaagtcacaacagcgcctgttgaacaaactcatcagtgtggtaatcctatgagggataattgcagaaaggttttagagacttgtgaggttccatatgataattctttacacctcccccccccaagagaaagtacacagggctattctgtaatattgttcagggaaatcagcatgatagatgctgtgcctccagagagttctctggagattactacccaaatgtgtattttggcaatttggtggtatttaggatgtaatatgttttcctccatttctgctaattttctctctctctctctcataacatactatacatgctaattgccaagatttgaatgagtcaaatttagtagcttgctgcttttattttttaaatggcttcttttacgtattggcgggggcggggggggggaggggggcagggtatgaggcttcttttccctcagctttcattgaaagtgaagctgtacaataaccacattgaccactgtagaatgatgaaagagaatataggctaggatgcacacaagaggggggaaaaggcattattagtgaagataggagttacaaagcaaagcaaagtcagtattcagatagagaatagagcctaatctgatgtttgcagggagttcctagatcacatttggcaatttacacattattttattgacctatccagtgctccaaaatgtgttccaaaatattttggcattttatttgtactatataggaatctttaggggagtccctgaaatttgttttcctcttaggtcaaaggactgataattaactttggttcttaaggagtatgccctttagcaataagaacagcaataacattttaccctgcagttttttctctatacctactattatgcactcctaaaatatgtcatcattagtcttcatgaggatgtttaccatttctgaagttttgcgtaaattagccttgaagattacactataactgaggtcatcagcattgacttatggccagcaaaggacatgctcatggccctggagagatgaggacacaaaacaaatcaatttccccacttactgaaggactccccttaccttctgtctctcctgagaccttgactcattaattattttactctcctttttggaaatttgcaaccggtccttctcaacaatgtgctccctttagtacactgaagaaaaagagaagggaattatttgagtcctgatcacgatgcattgaaaacttcctatgtgagatgtttctgtttttatatctcttccaggtgtccctgagtatataagcatgggtctatgtctaccaagctcactgtagagtcacttttaccttttgctatggtggaatgggatctgtagggtcaggaacacagcacctaacacagtgccttatggatagtagttttataatacagatgtgttggaagaataaatgaatgggtccttttcaaacaaattcacca

SEQ ID NO: 17371 - DNA, 1672 bp, Homo sapiens
tggggcggggcctacaggctctccgctgggcccgagcgggctgggggaggggagcgtggggccgacagttttgggggtgaaaaggcaaaaggcgggtgaaaggctgcctcccgagactctccttgcttggaattctgcccactctgcggagttagcagtcacgacctccagcacaggatgtggtaccacagattgtcccacctacacagcaggcttcaggacttgctgaagggaggagtcatatatccggcccttccacagcccaacttcaaaagcttacttcctttagctgtccattggcaccatacagcctccaagtctctgacttgtgcttggcagcaacatgaagatcattttgagctgaaatatgctaataccgtgatgcgctttgattacgtctggcttcgagaccactgccgctcagcatcgtgctacaactctaagactcaccagcgcagcctggatactgccagtgtggatttatgtatcaagccaaagaccattcgtctggatgagaccacactctttttcacttggccagatggtcatgtgactaaatatgatttgaattggctggtgaaaaacagctatgaagggcagaaacaaaaagtcatccagcctagaatactatggaatgctgaaatctaccagcaagcccaagttccatcggtagattgccagagcttcttagaaaccaacgagggactgaagaagtttctgcaaaactttctgctctatggaattgcattcgtagaaaatgtccctcccactcaagagcacacagagaagttggcagaaaggatcagcttaatcagagaaaccatttatgggaggatgtggtatttcacttcagacttctccagaggtgacactgcgtacaccaagctagctctggatcggcacactgacactacctattttcaagagccctgtggcattcaagtgtttcattgtcttaaacatgaaggaactggtggcaggacactgctagtagatggattctatgcagcagaacaggtacttcaaaaggcacctgaggaatttgaactcctcagtaaagtgccattgaagcatgaatatattgaagatgttggagaatgtcacaaccacatgattgggattgggccagtcttaaatatctacccatggaataaagagctgtatttgatcaggtacaacaactatgaccgggctgtcatcaataccgttccttatgatgtcgtccatcgctggtatacagcacaccggactctaacgatagagttgaggagacctgagaatgagttttgggtcaaactaaagcctggcagggtgggtcctaatctctaaagatgtcaagcaagcttgtaatactgaagcagtgaagaacgggtacttacttaatatgtgagtcacgatgttgcaaaggaaaaagagaaaagagtccttggttttgtttatggtcctgccgcccactcactgaatgctctggaagcaagcctcatcccatctctaaggcatcagtgactctatttgtatgatgaaggggtttaactagatgacccccaagggtccttccagcttcatgattccatagtttttatttttggtatttcctctggatgaaaaataccttcagcttagcataaaatgtcatgagataatttaaccctttgagaaagggtagaataag

SEQ ID NO: 17372 - DNA, 1177 bp, Homo sapiens
tggggcggggcctacaggctctccgctgggcccgagcgggctgggggaggggagcgtggggccgacagttttgggggtgaaaaggcaaaaggcgggtgaaaggctgcctcccgagactctccttgcttggaattctgcccactctgcggagttagcagtcacgacctccagcacaggatgtggtaccacagattgtcccacctacacagcaggcttcaggacttgctgaagggaggagtcatatatccggcccttccacagcccaacttcaaaagcttacttcctttagctgtccattggcaccatacagcctccaagtctctgacttgtgcttggcagcaacatgaagatcattttgagctgaaatatgctaataccgtgatgcgctttgattacgtctggcttcgagaccactgccgctcagcatcgtgctacaactctaagactcaccagcgcagcctggatactgccagtgtggatttatgtatcaagccaaagaccattcgtctggatgagaccacactctttttcacttggccagatggtcatgtgactaaatatgatttgaattggctggtgaaaaacagctatgaagggcagaaacaaaaagtcatccagcctagaatactatggaatgctgaaatctaccagcaagcccaagttccatcggtagattgccagagcttcttagaaaccaacgagggactgaagaagtttctgcaaaactttctgctctatggaattgcattcgtagaaaatgtccctcccactcaagagcacacagagaagttggcagaaaggatcagcttaatcagagaaaccatttatgggaggatgtggtatttcacttcagacttctccagaggtgacactgcgtacaccaagctagctctggatcggcacactgacactacctattttcaagagccctgtgggtaggtggattagacttttacagtgtaaagtctttatatgtgatagtcttgagtggtttcttaattattttccattctgttcgaaccaagatcatatctgctcctgcagatttgtatgactttctcttcccctggaaacatgatcattttgaaataccttaactcagtttttagattctgtattaggccattcttgcattgctataaataaatacctgagactgggtaatttataaaaaaaa

SEQ ID NO: 17373 - DNA, 3133 bp, Homo sapiens
tgagagaaacagttggaacttaacttctatcccgtatccttagattattcaaagaaaaacaaaacacggtcaacaggcagtggaactcctcactccaatgtgatattcctgagagaatattgacttatcgtcacttcgtctctgggacaagtattgaacataggggaagccttatataaaattgttcaataaacaaaagatgtctttaacatgtgtttgagatctttcttctcatgattccatgttaggtacaacaactatgaccgggctgtcatcaataccgttccttatgatgtcgtccatcgctggtatacagcacaccggactctaacgatagagttgaggagacctgagaatgagttttgggtcaaactaaagcctggcagggtgggtcctaatctctaaagatgtcaagcaagcttgtaatactgaagcagtgaagaacgggtacttacttaatatgtcctatttatagacaactggcgtgtcctacatggcagggaatgcttcactggctaccgccaactgtgtggctgctatttaacaagagatgatgtattaaacactgctcgcctcttggggcttcaggcttaaaattgacagcatctggattatgaatacacctggcaccctggctaccagaatttcatatgggcagaataatattgtgtcaaactctacttcagattgtctccttatcccatcccacaaaacagaatctgtccgtttctctagtaagggagacttgttggagaggcgggactctgagttatctaatgtcagacatctagtggggcagctctcttcctcatgttataacatggatccacttgttttatttaaaccttttaatataattttggtcagtctccttcagaaatataatctccatattgataggaaagcaataattgccatgaggtaacgatttttttcccaagtagatcagttagaaagaaatgcattctagaaataacaaaaatcctgataaagcaacaatttgcaaaatgtttggtcttaggacaccttaacactcttaaaagttattgaaggccccaaggagttcttgggtgtgggttctatctattgatactaattattttaggtattaagactgagaaatatttaaagctcaagaagaacacagaagcacacatccctcagctatgagagagatgacataaccatatgtcatgtagcctctggaaaagtcctctgtatcctcatgagataacgagagggggaaaaaaagctactactgcctttgtaacttccacttagcctactacagggctatgcacatcttagtttccaaaagtctgcttaatttcaaaagaaaaatgcctaattgaatgtaactcatcttggtgttattatacaaaataatttttaatctgcagacccacgaaaagggtctcagggactcctccaggggtcttcagaccatactttgagaacccatgggctagcgactaccttgagacagtcctttacctaggcctgtggattaaagggtttagctgaaaccctagattcttctctgtagtctaatagaactccaaacattgtaagaattgcttggtagcataagctcagggataaggtgggaattgagttcaaatatagtgttttatcttccacacaaatcatctctataggagttaaattaggaagtcacaacagcgcctgttgaacaaactcatcagtgtggtaatcctatgagggataattgcagaaaggttttagagacttgtgaggttccatatgataattctttacacctcccccccccaagagaaagtacacagggctattctgtaatattgttcagggaaatcagcatgatagatgctgtgcctccagagagttctctggagattactacccaaatgtgtattttggcaatttggtggtatttaggatgtaatatgttttcctccatttctgctaattttctctctctctctctcataacatactatacatgctaattgccaagatttgaatgagtcaaatttagtagcttgctgcttttattttttaaatggcttcttttacgtattggcgggggcggggggggggaggggggcagggtatgaggcttcttttccctcagctttcattgaaagtgaagctgtacaataaccacattgaccactgtagaatgatgaaagagaatataggctaggatgcacacaagaggggggaaaaggcattattagtgaagataggagttacaaagcaaagcaaagtcagtattcagatagagaatagagcctaatctgatgtttgcagggagttcctagatcacatttggcaatttacacattattttattgacctatccagtgctccaaaatgtgttccaaaatattttggcattttatttgtactatataggaatctttaggggagtccctgaaatttgttttcctcttaggtcaaaggactgataattaactttggttcttaaggagtatgccctttagcaataagaacagcaataacattttaccctgcagttttttctctatacctactattatgcactcctaaaatatgtcatcattagtcttcatgaggatgtttaccatttctgaagttttgcgtaaattagccttgaagattacactataactgaggtcatcagcattgacttatggccagcaaaggacatgctcatggccctggagagatgaggacacaaaacaaatcaatttccccacttactgaaggactccccttaccttctgtctctcctgagaccttgactcattaattattttactctcctttttggaaatttgcaaccggtccttctcaacaatgtgctccctttagtacactgaagaaaaagagaagggaattatttgagtcctgatcacgatgcattgaaaacttcctatgtgagatgtttctgtttttatatctcttccaggtgtccctgagtatataagcatgggtctatgtctaccaagctcactgtagagtcacttttaccttttgctatggtggaatgggatctgtagggtcaggaacacagcacctaacacagtgccttatggatagtagttttataatacagatgtgttggaagaataaatgaatgggtccttttcaaacaaattcacca

SEQ ID NO: 17374 - DNA, 713 bp, Homo sapiens
tggggcggggcctacaggctctccgctgggcccgagcgggctgggggaggggagcgtggggccgacagttttgggggtgaaaaggcaaaaggcgggtgaaaggctgcctcccgagactctccttgcttggaattctgcccactctgcggagttagcagtcacgacctccagcacaggatgtggtaccacagattgtcccacctacacagcaggcttcaggacttgctgaagggaggagtcatatatccggcccttccacagcccaacttcaaaagcttacttcctttagctgtccattggcaccatacagcctccaagtctctgacttgtgcttggcagcaacatgaagatcattttggtaagagatgtgtgaagacagatactttttaaaacttgtggtaagaaatgtttgctttggcagcacatatatcaaaaattggaatgataaaattgtggtaagaaaacacatagtacaaaatttactatcttaaccattttaagtgtacaattcacattgttatgcaatgataaataccttttgtgtggtctgaaaatactttttgtggagttgacaggacctctagccatttatttttaagattagcctacaagttgggagaaagacaaaaataacagagggcaatagtgaaatcccttctcaactaggggaaggcaactcagcctgctccagccccactccatctccctgtctt

SEQ ID NO: 17375 - DNA, 341 bp, Homo sapiens
ggcggagaggaaggccactcctgccttgccgcagggttgtcgtcacgatctgtgccagttgcgcgacagagtctgcccggagatcagcgtgaggccggatgggcctagcgctcaggaagagctggaagagctggagcaagctcgcgttgggactgacgcccagtgtacattgtttcaatctcggtcggactttacagccctggatctgtcactgacttggtgtttagctttcagcgagtccctaccctcttcctgcctcactttgttcggcagtagagtggaaggtggaactcagctgtctgcaagatcttgcagcactttctttcgttctcatatccact

SEQ ID NO: 17376 - DNA, 1208 bp, Homo sapiens
  misc_feature (5)..(6): n is a, c, g, or t
ggcgnnggtcgctggcagctgagcggcggaacccttcgctggcgggagcgcggttcggggccgcagaggggacattgaataaacctgagtattgtgtgcctgtattttgactgcgacctatcagatgagatcaggtcaagagacaactgcctttgaaagagagtgagtgactgtttccaaaacagcaagcatagggagagccgccggaagtattgacggaaagcttgaattacctacatgattgatgatggtctccagctgtcaaagaagattgtggttgccaagagaaaggtaaccatttctcatccccttgagtggaattggatgcctctaggagcccacattggctggcagtagacatggccgaatttacaagctacaaggagacggcctccagccgccacttgcggtttaagctacagagtctaagccgccgccttgatgagttggaggaagccacaaaaaacctccagaaagcagaggatgaactcctggatctccaggacaaggtgattcaggcagaaggtagcaactccagcatgttggcggagattgaagtgctgcgccagcgggtgctgagaattgaaggcaaagacgaggaaattaagagagcagaggatctgtgtcgtctgatgaaggagaaacttgaagaggaagaaaacctcacccgggagctgaaatctgagattgagcggcttcagaaacgaatggctgaattagagaagctagaagaggccttcagcaggagtaagaatgactgtacccagctgtgtctgagcctgaatgaggagagaaatctgaccaagaaaatctcctctgagctggaaatgctcagagtcaaagtgaaagaactagaatcttctgaggaccgcctggataaaactgagcagagtttagcgtcagagttagaaaagctgaaatcattaactctgagctttgtaagtgagagaaaatacttgaatgaaaaggagaaagaaaatgagaaattgataaaagaactcactcaaaaactagagcagaacaaaaaaatgaaccgagattatacaaggaatgcttctaatctggaaagaaatgacctacggattgaggatggcatctcttccacactgccgtccaaagaatcaagaaggaagggtggtctggactacctaaagcaggtagtccaggcaccctccttcctgtttttatctaataaaatgctaacctgc

SEQ ID NO: 17377 - DNA, 1359 bp, Homo sapiens
gcaattctcttacctcagcctctcccaagtagctgggaccagaggcgtgcgccaccatgccaggctaattttaaaaatttttttgtagagacagggtctcaccatgttgcccaggctggtctcaaactcctgggctcaagcagtcctctcgcctcggccttccagagtgctgggattacaggcatgagccactgcgcccagtctgtctcattgttgatggggacattgaataaacctgagtattgtgtgcctgtattttgactgcgacctatcagatgagatcaggtcaagagacaactgcctttgaaagagagtgagtgactgtttccaaaacagcaagcatagggagagccgccggaagtattgacggaaagcttgaattacctacatgattgatgatggtctccagctgtcaaagaagattgtggttgccaagagaaaggtaaccatttctcatccccttgagtggaattggatgcctctaggagcccacattggctggcagtagacatggccgaatttacaagctacaaggagacggcctccagccgccacttgcggtttaagctacagagtctaagccgccgccttgatgagttggaggaagccacaaaaaacctccagaaagcagaggatgaactcctggatctccaggacaaggtgattcaggcagaaggtagcaactccagcatgttggcggagattgaagtgctgcgccagcgggtgctgagaattgaaggcaaagacgaggaaattaagagagcagaggatctgtgtcgtctgatgaaggagaaacttgaagaggaagaaaacctcacccgggagctgaaatctgagattgagcggcttcagaaacgaatggctgaattagagaagctagaagaggccttcagcaggagtaagaatgactgtacccagctgtgtctgagcctgaatgaggagagaaatctgaccaagaaaatctcctctgagctggaaatgctcagagtcaaagtgaaagaactagaatcttctgaggaccgcctggataaaactgagcagagtttagcgtcagagttagaaaagctgaaatcattaactctgagctttgtaagtgagagaaaatacttgaatgaaaaggagaaagaaaatgagaaattgataaaagaactcactcaaaaactagagcagaacaaaaaaatgaaccgagattatacaaggaatgcttctaatctggaaagaaatgacctacggattgaggatggcatctcttccacactgccgtccaaagaatcaagaaggaagggtggtctggactacctaaagcaggtagtccaggcaccctccttcctgtttttatctaataaaatgctaacctgc

SEQ ID NO: 17378 - DNA, 1142 bp, Homo sapiens
  misc_feature (5)..(6): n is a, c, g, or t
ggcgnnggtcgctggcagctgagcggcggaacccttcgctggcgggagcgcggttcggggccgcagaggtcaagagacaactgcctttgaaagagagtgagtgactgtttccaaaacagcaagcatagggagagccgccggaagtattgacggaaagcttgaattacctacatgattgatgatggtctccagctgtcaaagaagattgtggttgccaagagaaaggtaaccatttctcatccccttgagtggaattggatgcctctaggagcccacattggctggcagtagacatggccgaatttacaagctacaaggagacggcctccagccgccacttgcggtttaagctacagagtctaagccgccgccttgatgagttggaggaagccacaaaaaacctccagaaagcagaggatgaactcctggatctccaggacaaggtgattcaggcagaaggtagcaactccagcatgttggcggagattgaagtgctgcgccagcgggtgctgagaattgaaggcaaagacgaggaaattaagagagcagaggatctgtgtcgtctgatgaaggagaaacttgaagaggaagaaaacctcacccgggagctgaaatctgagattgagcggcttcagaaacgaatggctgaattagagaagctagaagaggccttcagcaggagtaagaatgactgtacccagctgtgtctgagcctgaatgaggagagaaatctgaccaagaaaatctcctctgagctggaaatgctcagagtcaaagtgaaagaactagaatcttctgaggaccgcctggataaaactgagcagagtttagcgtcagagttagaaaagctgaaatcattaactctgagctttgtaagtgagagaaaatacttgaatgaaaaggagaaagaaaatgagaaattgataaaagaactcactcaaaaactagagcagaacaaaaaaatgaaccgagattatacaaggaatgcttctaatctggaaagaaatgacctacggattgaggatggcatctcttccacactgccgtccaaagaatcaagaaggaagggtggtctggactacctaaagcaggtagtccaggcaccctccttcctgtttttatctaataaaatgctaacctgc

SEQ ID NO: 17379 - DNA, 1036 bp, Homo sapiens
  misc_feature (5)..(6): n is a, c, g, or t
ggcgnnggtcgctggcagctgagcggcggaacccttcgctggcgggagcgcggttcggggccgcagagattgatgatggtctccagctgtcaaagaagattgtggttgccaagagaaaggtaaccatttctcatccccttgagtggaattggatgcctctaggagcccacattggctggcagtagacatggccgaatttacaagctacaaggagacggcctccagccgccacttgcggtttaagctacagagtctaagccgccgccttgatgagttggaggaagccacaaaaaacctccagaaagcagaggatgaactcctggatctccaggacaaggtgattcaggcagaaggtagcaactccagcatgttggcggagattgaagtgctgcgccagcgggtgctgagaattgaaggcaaagacgaggaaattaagagagcagaggatctgtgtcgtctgatgaaggagaaacttgaagaggaagaaaacctcacccgggagctgaaatctgagattgagcggcttcagaaacgaatggctgaattagagaagctagaagaggccttcagcaggagtaagaatgactgtacccagctgtgtctgagcctgaatgaggagagaaatctgaccaagaaaatctcctctgagctggaaatgctcagagtcaaagtgaaagaactagaatcttctgaggaccgcctggataaaactgagcagagtttagcgtcagagttagaaaagctgaaatcattaactctgagctttgtaagtgagagaaaatacttgaatgaaaaggagaaagaaaatgagaaattgataaaagaactcactcaaaaactagagcagaacaaaaaaatgaaccgagattatacaaggaatgcttctaatctggaaagaaatgacctacggattgaggatggcatctcttccacactgccgtccaaagaatcaagaaggaagggtggtctggactacctaaagcaggtagtccaggcaccctccttcctgtttttatctaataaaatgctaacctgc

SEQ ID NO: 17380 - DNA, 1050 bp, Homo sapiens
gcccatagtaggccaatgttggtgctggcaaaaagtgagctggagattggatcacagccgaaggagtaaaggtgctgcaatgattgatgatggtctccagctgtcaaagaagattgtggttgccaagagaaaggtaaccatttctcatccccttgagtggaattggatgcctctaggagcccacattggctggcagtagacatggccgaatttacaagctacaaggagacggcctccagccgccacttgcggtttaagctacagagtctaagccgccgccttgatgagttggaggaagccacaaaaaacctccagaaagcagaggatgaactcctggatctccaggacaaggtgattcaggcagaaggtagcaactccagcatgttggcggagattgaagtgctgcgccagcgggtgctgagaattgaaggcaaagacgaggaaattaagagagcagaggatctgtgtcgtctgatgaaggagaaacttgaagaggaagaaaacctcacccgggagctgaaatctgagattgagcggcttcagaaacgaatggctgaattagagaagctagaagaggccttcagcaggagtaagaatgactgtacccagctgtgtctgagcctgaatgaggagagaaatctgaccaagaaaatctcctctgagctggaaatgctcagagtcaaagtgaaagaactagaatcttctgaggaccgcctggataaaactgagcagagtttagcgtcagagttagaaaagctgaaatcattaactctgagctttgtaagtgagagaaaatacttgaatgaaaaggagaaagaaaatgagaaattgataaaagaactcactcaaaaactagagcagaacaaaaaaatgaaccgagattatacaaggaatgcttctaatctggaaagaaatgacctacggattgaggatggcatctcttccacactgccgtccaaagaatcaagaaggaagggtggtctggactacctaaagcaggtagtccaggcaccctccttcctgtttttatctaataaaatgctaacctgc

SEQ ID NO: 17381 - DNA, 1066 bp, Homo sapiens
ggcagtgcaccgtgattgctgctagtctgctctagagtatcccctctcattcttgaatccctggaagtattgattggaaagcttgaattacctacatgattgatgatggtctccagctgtcaaagaagattgtggttgccaagagaaaggtaaccatttctcatccccttgagtggaattggatgcctctaggagcccacattggctggcagtagacatggccgaatttacaagctacaaggagacggcctccagccgccacttgcggtttaagctacagagtctaagccgccgccttgatgagttggaggaagccacaaaaaacctccagaaagcagaggatgaactcctggatctccaggacaaggtgattcaggcagaaggtagcaactccagcatgttggcggagattgaagtgctgcgccagcgggtgctgagaattgaaggcaaagacgaggaaattaagagagcagaggatctgtgtcgtctgatgaaggagaaacttgaagaggaagaaaacctcacccgggagctgaaatctgagattgagcggcttcagaaacgaatggctgaattagagaagctagaagaggccttcagcaggagtaagaatgactgtacccagctgtgtctgagcctgaatgaggagagaaatctgaccaagaaaatctcctctgagctggaaatgctcagagtcaaagtgaaagaactagaatcttctgaggaccgcctggataaaactgagcagagtttagcgtcagagttagaaaagctgaaatcattaactctgagctttgtaagtgagagaaaatacttgaatgaaaaggagaaagaaaatgagaaattgataaaagaactcactcaaaaactagagcagaacaaaaaaatgaaccgagattatacaaggaatgcttctaatctggaaagaaatgacctacggattgaggatggcatctcttccacactgccgtccaaagaatcaagaaggaagggtggtctggactacctaaagcaggtagtccaggcaccctccttcctgtttttatctaataaaatgctaacctgc

SEQ ID NO: 17382 - DNA, 337 bp, Homo sapiens
cttcctagctgtaagatgtcatgtacatttttagactgttgaggaatgttcgggtgttttaatttaagcaaagacagtgggttctaccctaggaccatatcatcttataggaaaggggaagtctcctacagccaaattctttcttgactttcctgagagagacatagccagcttagccaggttcctttagtgtcaggatctagatgcagatcttaccttggccccttgctgacagtgaattgtatgtgaaagtctttgggacagccctctgggtcacctcagtcttggtatgattcatgcattacctatctcttccattctgtttatattctatcca

SEQ ID NO: 17383 - DNA, 413 bp, Homo sapiens
ggctcactgcagcctccccctcctaggttcaagtgatcctcccgcctcagcctcccaagaagctgggatgacaagtgtgtgccaccatgcctggctaatttttgtatttttagtagaaacagggtttcaccattttggccaggctgttctcaaactcctgacttcaagtcatccactcgcctcggccttccagagtgctgggattacaggcatgagccactgcgcccagtctgtctcattgttgatggtaagttttatctttccgttgtagggatccctacttccctttgtgagaaatctgtacggtgactttgagagagtataaatatcctattttccaaccaaatggttttagcatccactgataatcttagcttgaatcaattattacactggcggttgtgattatagtt

SEQ ID NO: 17384 - DNA, 199 bp, Homo sapiens
acaggagactaatatccagaattacgaggaactcaactcaacaactacaacaataaaagccataatttcatttaaagtgggcaaaggacacagatagacatttttcaaaagacaccttaatggatgacaagcatatgaaaaaatgctcaacattactactaaaagaaatgcaaattaaaaccacaatgaaatgtaatct

SEQ ID NO: 17385 - DNA, 426 bp, Homo sapiens
tggaacagccctgagcaacatataaatatatacatacatatctatgtatgcaatatcctacacctgcgaattactacccatcctattcctcactgccaatggaaacaaactactcttttctttggattcattgatggatataaaaaattaatttgctattaactgctttcatattctgtttagttcttatagtatggtaaatgatacaggtgcagtatcagtattgtaaaattgtatggtgaaaactacaaaagtcattctgtggatatattttaaaaggaagaacagaaactatatttcagattcttgtgtgaatataattacagaataggtaactatttttatgtgtttccataaatgactccatttcatatgcattgtaatttagcacaaatcataataaatcatttggtaacaaaaaaaaaa

SEQ ID NO: 17386 - DNA, 338 bp, Homo sapiens
gattccagtcctagctgtgtcactgagttgctgtgaccttgggctagtccctgctcctctctcagcctcagtttacccatctataaaatgagtggggggaagggcaccgtggctcatgcctgtaatcccagcactttgggaggccgaggcaggtggatcacttgagatcaggagtttgagaccagcctggccaatgtggtgcaaccccgtctctactaaaaattagccggatgtggtggttcacacctgtagtcacagctactcgggaggctgaggcagaagaatcacttgaacccaggaggtggaggttgcagtgagctgaggtcatgccactgcac

SEQ ID NO: 17387 - DNA, 468 bp, Homo sapiens
ttaaaaggtattttcaccagaaatctaccaatgggactttaaaaaaaaacactaaatgaagtataataataagaatgaatagctcacatatatttaacacacagcagcttcatgggaaaacaactgtattttaaatgaagaacaggcctcctcagtgataactctaaaatttctcaacaatgtacagacacagactaatcatgaaagaagataatgacgatgctgggcagtgtctggaggtagccttttctcctggcattcactctagatgctcaaacttgggagtgcagcgctctggcagagttgggagatgttctctggagggctctggcggtgcttatttatcagccagtattgaaatttgtcaatatatcaaaaacgatttagtagctatatcagaccttatcacctgaatgcagcctttggcccacattctaaaggtggtgacacacatagataaggaatgag

SEQ ID NO: 17388 - DNA, 464 bp, Homo sapiens
tgtaatcgtgtatactgatatcataatttataggactgttgtaagattcagaggagagaatgtgtatgcaatggctaccgcgttgcctggcagggaactggcctcagtaaagctcagttccttccctgcagtttctctcccctgctttcctcaccagcaacagtcacggggtgaccagttagcttttgtaaatgatgaagccaaaacttttctttggtgggagtgtcaatggtattgtaatttagtaattatgtggtataaatagtcatcatctatagctgtgttcacataactcgagtagattcaaattcaattattatatagaaaggaattcgatttttgtaaagtcagagcaaactgcatctcaaggcttttattttcagttttggattgatgactcaaactaagcggggagatttgctttttcccctagaaaaacaagtatggtttatgcttgtattttt

SEQ ID NO: 17389 - DNA, 298 bp, Homo sapiens
tgtgccagagccctacacctacaatggcatcttcaccaccttaaatttccaaggaaactatatttcatacattgatggaaatgtatggaaagcatacagttggaccgagaaactaattctcagtgaaaattatttgactgaattacctaaggattcatttgaaggcctgctatccctccagtatttacagattctttcaaatgtgaaaggcttaaggaaagtgggtgtaaagaccctcaagtggatgccaaagtgctgcagaggccatgaagtaataaaactacatttgctttaaaat

SEQ ID NO: 17390 - DNA, 530 bp, Homo sapiens
aacaaaccacatgacccaccacctgcctatcttcctcacaggacactcgagggctctgtgtgggcagctcatcttccacggggctcagaacattattgacagtcgggaaaatggtcgttcccttcacattgtagttggcaaggtggggcagtgggggttgtcgcgcctcattagttttctgttgtacaaagttgagaacttttagagttctcaaactcaacgagggctacaaacaccctgttcctcttgtgcggcaagcactgctgggtgtgccccaggcctgtttctcatgccctgccttttatcagcccactgggagccccacaaaacagcagagcaggatttctggggtgggaggatggcagcgcagggtcacagcatgaggggttaagcacctggctctagccacacaccaacaagtcaccttcagtgttccgggctgtttcacctggtgcttccacccctcgtgggctgggctggcaaatgaaagcttggcttttctgcacagaatagactgtctgaggtggtgc

SEQ ID NO: 17391 - DNA, 347 bp, Homo sapiens
aactgagatatgttctgggaccacaaaattgaataagacacagtcccactcttagacacttttcttcagcggggataaaataaaagcaaatgaactaacataatattgtggctaagtataatactagtgtaaaagaggtaagattgaaggtaggaagaaagaacacctaattgttgggattgaatatcaggaaaggcatcctggaaggaatgttaactgaactgagttttaaagttttaagaaataattaaccatgtatttcttaacagtaggtgttgactaagctttcctactcagtcttcttcccgcccagctccaaacttccttatagcttttatcctaaaaaa

SEQ ID NO: 17392 - DNA, 156 bp, Homo sapiens
gcggccgcctactactactactactactgctcgaattcaagcttctaacgatgtacggggacatgtatttcttaacagtaggtgttgactaagctttcctactcagtcttcttcccgcccagctccaaacttccttatagcttttatcctaaaaaa

SEQ ID NO: 17393 - DNA, 2504 bp, Homo sapiens
ggcacgagggcagcgagtggccttcccggttggcgcgcgcccggggcggcggcgctggaggagctcgagacggagcctagttatgtctgggaggcgaacgcggtccggaggagccgctcagcgctccgggccaagggccccatctcctactaagcctctgcggaggtcccagcggaaatcaggctctgaactcccgagcatcctccctgaaatctggccgaagacacccagtgcggctgcagtcagaaagcccatcgtcttaaagaggatcgtggcccatgctgtagaggtcccagctgtccaatcacctcgcaggagccctaggatttcctttttcttggagaaagaaaacgagccccctggcagggagcttactaaggaggaccttttcaagacacacagcgtccctgccacccccaccagcactcctgtgccgaaccctgaggccgagtccagctccaaggaaggagagctggacgccagagacttggaaatgtctaagaaagtcaggcgttcctacagccggctggagaccctgggctctgcctctacctccaccccaggccgccggtcctgctttggcttcgaggggctgctgggggcagaagacttgtccggagtctcgccagtggtgtgctccaaactcaccgaggtccccagggtttgtgcaaagccctgggccccagacatgactctccctggaatctccccaccacccgagaaacagaaacgtaagaagaagaaaatgccagagatcttgaaaacggagctggatgagtgggctgcggccatgaatgccgagtttgaagctgctgagcagtttgatctcctggttgaatgagatgcagtggggggtgcacctggccagactctccctcctgtcctgtacatagccacctccctgtggagaggacacttagggtcccctcccctggtcttgttacctgtgtgtgtgctggtgctgcgcatgaggactgtctgcctttgagggcttgggcagcagcggcagccatcttggttttaggaaatggggccgcctggcccagccactcactggtgtcctgtctcttgtcgtcctgtccttcctatctccccaaagtaccatagccagtttccagatgggccacagactggggaggagaatcagtggcccagccagaagttaaagggctgagggttgaggtgagaggcacctctgctcttgttgggaggggtggctgcttggaaataggcccaggggctctgccagcctcggcctctccctcctgagttgccttctgttggtggctttcttcttgaacccacctgtgtaaagaggttttcagttccgtgggtttcccctttgattctgtaaatagtcccagagagaattcgtgggctgagggcaattctgtcttggaggaagaagctggacattcagcctgtggagtctgagttttgaaggatgtagggagccttagttgggtctcagaccataagtgtgtactacacagaagctgtgttttctagttctggtctgctgttgagatgtttggtaaatgccaggttgatagggcgctggctgcttggagcaaagggtgcatttcagggtgtggccaccaggtgctgtgagtttctgtggctcatggcctctgggctggtcccttgcacagggcccacgctggagtcttaccactctgctgcaggggtggaaggtggcccctcttgtcacccatacccatttcttacaaaataagttacaccgagtctacttggccctagaagagaaagttgaagagtcccagacctactagcattttgcaactatgcttgtaaagtcctcggaaagtttcctcgcgtaccagacagcggcgggggctgatagcaattttagtttttggcctccctatcctctcacatgagaacactgcctggatgcatctcatgatctctggagaatttccccatctttctcttctttccatcgtgtggattcaatagtttggatttgaaggctgccctgcccccgactctcctgccgcacccctggccattgtaccttttgatgtttagaagttcgtggaagtagacgctgaggtgtgcagaggagctggtggataacagagaatgccagggaagatgagtgctgggtcagggtacttggatgaaacggtgcaggccaggcgggccctaataaaaccctctgccaggtctgggagtcccaggccatctgctcaacgctctgtggtttgtcagacctgcaagcaagccccctgctggggaagcctaggtgtccttgagctgaaccgcactgaagaactcttgtcctcactggctgatgcagcagaactcttgggaaatgtcttagtcctgcagaatcaggagtcaccagatgatgcagagttgagatcatcattgcaaagttctctgttcctgaggaactaaatttaaggaaaaaatgggattttgttttagagttggaaaaaaagcctgattaaagagtttctgcctgttcatggactgtg

SEQ ID NO: 17394 - DNA, 1940 bp, Homo sapiens
ggcacgagggcagcgagtggccttcccggttggcgcgcgcccggggcggcggcgctggaggagctcgagacggagcctagttatgtctgggaggcgaacgcggtccggaggagccgctcagcgctccgggccaagggccccatctcctactaagcctctgcggaggtcccagcggaaatcaggctctgaactcccgagcatcctccctgaaatctggccgaagacacccagtgcggctgcagtcagaaagcccatcgtcttaaagaggatcgtggcccatgctgtagaggtcccagctgtccaatcacctcgcaggagccctaggatttcctttttcttggagaaagaaaacgagccccctggcagggagcttactaaggaggaccttttcaagacacacagcgtccctgccacccccaccagcactcctgtgccgaaccctgaggccgagtccagctccaaggaaggagagctggacgccagagacttggaaatgtctaagaaagtcaggcgttcctacagccggctggagaccctgggctctgcctctacctccaccccaggccgccggtcctgctttggcttcgaggggctgctgggggcagaagacttgtccggagtctcgccagtggtgtgctccaaactcaccgaggtccccagggtttgtgcaaagccctgggccccagacatgactctccctcctgagttgccttctgttggtggctttcttcttgaacccacctgtgtaaagaggttttcagttccgtgggtttcccctttgattctgtaaatagtcccagagagaattcgtgggctgagggcaattctgtcttggaggaagaagctggacattcagcctgtggagtctgagttttgaaggatgtagggagccttagttgggtctcagaccataagtgtgtactacacagaagctgtgttttctagttctggtctgctgttgagatgtttggtaaatgccaggttgatagggcgctggctgcttggagcaaagggtgcatttcagggtgtggccaccaggtgctgtgagtttctgtggctcatggcctctgggctggtcccttgcacagggcccacgctggagtcttaccactctgctgcaggggtggaaggtggcccctcttgtcacccatacccatttcttacaaaataagttacaccgagtctacttggccctagaagagaaagttgaagagtcccagacctactagcattttgcaactatgcttgtaaagtcctcggaaagtttcctcgcgtaccagacagcggcgggggctgatagcaattttagtttttggcctccctatcctctcacatgagaacactgcctggatgcatctcatgatctctggagaatttccccatctttctcttctttccatcgtgtggattcaatagtttggatttgaaggctgccctgcccccgactctcctgccgcacccctggccattgtaccttttgatgtttagaagttcgtggaagtagacgctgaggtgtgcagaggagctggtggataacagagaatgccagggaagatgagtgctgggtcagggtacttggatgaaacggtgcaggccaggcgggccctaataaaaccctctgccaggtctgggagtcccaggccatctgctcaacgctctgtggtttgtcagacctgcaagcaagccccctgctggggaagcctaggtgtccttgagctgaaccgcactgaagaactcttgtcctcactggctgatgcagcagaactcttgggaaatgtcttagtcctgcagaatcaggagtcaccagatgatgcagagttgagatcatcattgcaaagttctctgttcctgaggaactaaatttaaggaaaaaatgggattttgttttagagttggaaaaaaagcctgattaaagagtttctgcctgttcatggactgtg

SEQ ID NO: 17395 - DNA, 769 bp, Homo sapiens
cggccgctactactactaaattcgcggcccgtcgattgaagagtcccagacctactagcattttgcaactatgcttgtaaagtcctcggaaagtttcctcgcgtaccagacagcggcgggggctgatagcaattttagtttttggcctccctatcctctcacatgagaacactgcctggatgcatctcatgatctctggagaatttccccatctttctcttctttccatcgtgtggattcaatagtttggatttgaaggctgccctgcccccgactctcctgccgcacccctggccattgtaccttttgatgtttagaagttcgtggaagtagacgctgaggtgtgcagaggagctggtggataacagagaatgccagggaagatgagtgctgggtcagggtacttggatgaaacggtgcaggccaggcgggccctaataaaaccctctgccaggtctgggagtcccaggccatctgctcaacgctctgtggtttgtcagacctgcaagcaagccccctgctggggaagcctaggtgtccttgagctgaaccgcactgaagaactcttgtcctcactggctgatgcagcagaactcttgggaaatgtcttagtcctgcagaatcaggagtcaccagatgatgcagagttgagatcatcattgcaaagttctctgttcctgaggaactaaatttaaggaaaaaatgggattttgttttagagttggaaaaaaagcctgattaaagagtttctgcctgttcatggactgtg

SEQ ID NO: 17396 - DNA, 271 bp, Homo sapiens
caaagtaatattcaactcaacaattttaaaaaacacagaaatattcaattacatagacccaaacacagtgagcacttatcaagatcacgaacagactagagcatctgacaaagctcagagacttagaatttttgctccatatatagaaccatttaataagatcatgtatggttatgttcatacactttgaattaggaggaaattttaatatatttatccctgatgaaaattaaatagtccttaactatcctgtgtggattcaatgctaggt

SEQ ID NO: 17397 - DNA, 516 bp, Homo sapiens
ttctagacccctgaccagacatccatgcactggaatttacatatattttcaccttgggccactgtcttgtctgttttgtgttgctataacagaatacttgaggctgggtcatttataaagaaagagctttatttggctcacaattctggtgactggaagattctagattggccacctgcatccaatgagggcctcagactgcttctactcatggcaaaaagtgaaaggggagcaagtgtgtgcaagatcacatggcaggctgggcgcagtggctcacgcctgtaatctcagcactttgggaagccaaggcagaattgcttgagcccaggagttcgagaccagcctgggcagcaaagcaagaccttgtctctacagaaaataaaataaataaataaataaaactaaatgggcatggtgttgtgtgcatgtgcctgtagtcccagctactcaggaatctgaggtgggacgattgcttgagcccaggaggttggggctgcagtgagccatgctgatgct

SEQ ID NO: 17398 - DNA, 1433 bp, Homo sapiens
atgcatagtggaagggagaagccaagcaattgggagcctttccggaaggtggtgtccgggaggatcatcaagcggctactgcaggggagactggctgctgagtttcgtgtaccgcacatcctcggtgcagctccgtgtcgccggcctacagcccgtgctgctgcaggacaggagggtggagaacgtggacctgacctctgtggtcagcggccacctggactatgccaagcagatggatgccatcctgaaggccgtgggcatccgcaccaagccaggctgggacgagaaggggctcttgctggccccaggctgcctgccctccgaggagcctcgccaggcagcagctgccgcctcatcaggcgagaccccccaccaggttgggcaaacccagggtcccatatccggagacacctccaaattggccatgtccacagaccccagccaagcccaggtgccagtagggctggaccagtctgaaggggcctcccttcctgctgctgccagccctgaaaggccccccatctgcagccatggcatggaccccaacccactgggctgccccgattgtgcctgcaagacccagggccccagcacggggctggactgaccacagcaggggacctgagccgtcttccccagtctccatatgcagctctctcttataccctcgggttcctcccaggagctctggaggtacaggatttccacaggcctctttcctaaatggaaggaattggaactgaaagggaaaggaaatggaaggaaggggaatttggaggagagaacacgcccacccttgggaagctgcctgtccccagaggagccccaccagggagcagctgccccctcatcagagacctgcagagtcaaccaagcacaggttagagtcccaggaccggaaaccaactgtgggctttctgtacttctcatagctttggagtctggctgtccatcaggaggtcccgagggctctctggggcctgaggctcccacaccagctctcccctggcctcaataaaaccaggtgcatgcctgttcttccatccacactccagggctgcccaccagctgacaggcaccatcaactggcagcaacagagcaggcgcaggtacaaagaaggcagctcactcctgctcttaggagatccaatcagatctgccctgtacagccatgtaggctgtgcgctgcataactccagggacatgagtcacacagacacaatgtgagtgtgctcccccgtcatgcaacatctggacacaactaacagagcatggtgaatacatgctgaattgcattcagtatggctgtgaactaggcctggggacaagaatgaattttacatggaaagaatttcctgtagcaggaacagaggggataacaacagcaataaataataataagaagaagctaccacttcttgagcatgtaccac

SEQ ID NO: 17399 - DNA, 401 bp, Homo sapiens
ctctcgggccctggagtgtggatggaagaacaggcatgcacctggttttattgaggccaggggagagctggtgtgggagcctcagaaggcagctcactcctgctcttaggagatccaatcagatctgccctgtacagccatgtaggctgtgcgctgcataactccagggacatgagtcacacagacacaatgtgagtgtgctcccccgtcatgcaacatctggacacaactaacagagcatggtgaatacatgctgaattgcattcagtatggctgtgaactaggcctggggacaagaatgaattttacatggaaagaatttcctgtagcaggaacagaggggataacaacagcaataaataataataagaagaagctaccacttcttgagcatgtaccac

SEQ ID NO: 17400 - DNA, 368 bp, Homo sapiens
ttctgaatgccaagaagacagggagctttgttttgttcacctagtggatttcatgtgcctgacacatagaaggtaatgaatatttgttagattaatgaagattttattctggtacaggttgtagtccactaaatcagtttcctatccactagtaggtcatgatccagagcttgaaaaacactcatttaaggaataaaggaaaaaatttgaaaaacacttatttaaggaataaaggtcatacattgattcattcaatacatatttattgttgtagactgatctagttaatatactgtagtaccattgccactcctaactcttgttttcatgggtttagggtatttattccgaagttactcataactagt

SEQ ID NO: 17401 - DNA, 113 bp, Homo sapiens
gagaaaggttgttttctagttgtttattaggtgagaaagcctggtaccagttactgtgttcatggctatgatataacaatttaattttgtatctgcttctgtaagtagatttt

SEQ ID NO: 17402 - DNA, 175 bp, Homo sapiens
aataactgaagtgcatgtactaagccatttcctagagttcctcagcaggattcagctctggttgctgagaggtggtaactcccttgataaagtatgttttgtttgcctcattcccttctctatgcccctcccaacatttcctgaaattactatccagagagactacttgcactta

SEQ ID NO: 17403 - DNA, 490 bp, Homo sapiens
agggcctcgctctgttgcccaggatggagtgcagtggtgcaatcatggctcactgcagcctcaacctcctggactcaagcaatcctcccacctcagcctcctgagtagctgggactacaggcatgtgttgggaaaaaggcttatggggtgcctgcatagactagccataaaaatatgggacaataagttgtggaaagccacaaaaggcctctcagaaggaaagcctcctaattgccatcatgttgccctgctcagagcaagacacactctcttatttgtaaacactgttcaaggagaaagacactcctttgaaacactggaaggtgaacagatgtgcaggctcctagttaagccactcccactagctactctctgataagttaaagatatgctgtttgagcacaaaggagattcatttaaaccgctattactatagattacgtctatgacgcatagcctccctttcactgtttcgccctgaacatctgct

SEQ ID NO: 17404 - DNA, 82 bp, Homo sapiens
aaaatgtgtgagagaaaaggacttctgacgagcccagggatttacgtgctgctttgggaatgttctctccagacttttaaaa

SEQ ID NO: 17405 - DNA, 415 bp, Homo sapiens
gaaataaaacatgcatactaaccatgcatacacacacatctacgtctatttctgtatctgtctgtatacatattaaaataaacatgggttgataactaatgtttctgctgtaatccacagccttcatcctagcctgccactcttcttctttttagctttttcaacagtgggaaatgtggctcttgttatgtacactttattcacttatttgtttgaccctagtatcataaagtagttccgtatgcctgtaacagatcgactaactagagtccattatttgcggaaagatctttttgtccgaagcgttaccgcaggggtgtccaatcttttggcttccctgggccacactagaaaaagaagaattgtcttgggccacacgtaaaatacactaacactaacgatagctgataagcta

SEQ ID NO: 17406 - DNA, 377 bp, Homo sapiens
cacttcaagatagtggggatgtatattttaaaaaatttcacgctcatgggccaaagattttcccggggctgtgtgctgatttgcagcctatcatgtgtggctttgggacactggggaaggtgtggagcagtttaagtgacaaacgggttggaaaagcaaaggacaccaggtgaggatgatggaatttacatcctgttgcttccctgatagttcctgccaatatgggatcccactactatctttctgccctaaaaatatgtgtatattgagatagaaactgttgtaatggctgcatgcattcagtagaggaaaggagagaagaaagaaggaacagatttagtcctgcccagaatctgcacttccacggaggacgccag

SEQ ID NO: 17407 - DNA, 423 bp, Homo sapiens
aattactctttgtctactgcagttcccctgtcttgataaattggctctgtctaggcagcaggcaaggtgaacccatgggtggttacaagaggatcacatgagcccagtaggtcaaggctgcagtgagctgtgaccacaccattgcactccagcctttgggacagagcaagatcctgtctcaaaaaaaaaaaaaatctttttttcaaagagaacgatttacaagctaatctctgttccctgatccattcattctccctagcaatcgtttattgtacctcaacagaattacctatattccccatctcctcactcccctctcaaataaggctatataagtatttgggccccactgggatattgagtgatcactctgattctcccctgtgtacacattaataagttttgatgcctttttcctactaa

SEQ ID NO: 17408 - DNA, 286 bp, Homo sapiens
ccccctagcaatgctctgaggtcgttttcttaatgaccttattttattgctgagtaaattgaggttcagagaggttcaacgactcacccagagtcacgcagcaaatgcagttgtgaaacccaaattcagatgttcctacagccgcagcatccactgcacccaccagcaggttgcaccacaagaggccccagtccccccaggcggccccagctcagtaggggaagttccgtgccgatggtacgaggacgaggagctgttcggtggaaagcccctgaaggccactgtc

SEQ ID NO: 17409 - DNA, 347 bp, Homo sapiens
tcaagggtggaatgtcagtgaaatagaaattgttccagggtttgtctctgtcttgcagtggaatgaagggagggcaatttggcagctgcttgccctctgctttgcattaacatggcatcacaaaaactctgatcgtttgagttgtgatagtgtgaagaactggggctgaacctgggcccctagggctgagactgtgaggagcttaggggtgcatttagggaatcaaggcaggtgggcagaggaggagcagatcctggctgaaccttggtggctgaagcaggaagccagcaggtcttcagcttcctggggggagctgggagtggaacctcctgccccccaatgccctt

SEQ ID NO: 17410 - DNA, 801 bp, Homo sapiens
cccacatacttcatgtgttcatctcccatccagaatgtcctgaggttgtttttctggttggttctcataatccatagtccttggggtcccagcaaagtcagttttcctacaagttgtgtttgttttgtggaagcccaaagaagtggattgagagagaagagatttttatctaaggtggaaggtttttcaactagcccctaaaggtctttggtagttaattaacattcaacagacccacagcaactctggtgtcagaagctataaatggtctggccaaacaagactcagagtattttctgaaatcctgagctgcaaggttctgcctcacctgtctctccactctgacatcacgaaatcagcaaaaccagatatttattctcctcactcccagcagatacgaggacaccaacaatgcagttgatccctctgggcctgagtctcccatctgaaacatggggaattggggtaggtcaagctttttgaaactgcaaaacctctacctgtttttaaaaatgagatcttttgaccaggcacagtggctcacacctaaaatcccagcactttgggaggctgaagcaggtggatcatctgaggtcaggagtttgagatcagcctggtcaacatggtgaaaccccgtctctactaaaaatacaaacattagctgggcatggtggtgggtgcctgtaatcccaactactcgagaggctgaggcaggagaatcgcttaaacttgggaggttgcagtgagctgagaccacaccactgccctctagcctgggtgacggagtgagactatctcaaa

SEQ ID NO: 17411 - DNA, 391 bp, Homo sapiens
gatactcgatccatgagtgactcaagtcttggtctctgctacctaatagaagtgggttaggtccaagataatatctgtctctaaccctctgattattttcctgttgtcattttccctttccttcataccttctcttctgatttccgtaatctccaaacaaaaggcttttttccctatgactgccaaaaacaattatcacccaagacttttgtcagtcttagtgatcttttgagtcatttgatccacacctgctcttaggaccaagataatgaagttcttacaagttgcactcaagagagaaggattccctcaggctgggtgcagtggctcatacctgtaatcccaacactttgggaggccaaggtgagggatctttagctcaagactaccc

SEQ ID NO: 17412 - DNA, 304 bp, Homo sapiens
tgtgacaactaagcccttgcaatgtgtcttgtccacttcaagagatgctataaatgtaaaatacacactatattttgagagcttactatgaaaaaataatgtaaatatgtcactagtaatctttttttttcttttacttttttttttttttttttgagtcttgcactgtcgcccaggctggagtgcaatggtgcaatctcggctcaccgcaacctctgcctcctgggtttaagtgattctcctgcctcagcctcccagctactcgggaggctgaggcaggagaatggcgtgaacccgggaagcg

SEQ ID NO: 17413 - DNA, 486 bp, Homo sapiens
gtgagctatgattgcaccactgtacactagcctgggtgacagaatgagactctgtctctaaaaaaaaagaaatcctcatttctgttgaactaagtaaacatagagttctttaagggaattatttcacgtatgggttaaatagcttagcaggaggagtcaactgggctgttatctccaagaagcctgcacaaacaggttaatttttaaagtctgtgtaatagtttttagctggattttaataaagtccaaagttcaaagtcacattactactagaatattcagtctagtagaaggaatttctgatacacacacacgaactttgtcctatctcaaaagtctgacaacccaccaagaatcagaactggtgcctcataaaataacgggggtgatttttagccttggagcaaaagcaggaggctgggtccaggctggttctcccagtaaggaggctagaactcgtgcaaatacaccacttagcctcactgg

SEQ ID NO: 17414 - DNA, 952 bp, Homo sapiens
aggagatctgatcacacttcctcctgaggcacctctcatggatgttgcaataagcattcgggtactatcacccagaaatatgaattgccagaatagaacatttagcatgttaagcgttgatgcatataaaatcagaaatagatgtgagaatggtggaactttttaaaagaacccagtcaaatgtattttctgctgaaatctgcgctgcctctgtgactttcctcctcttctcagtcttacaccgcctggtcttaggtcatctgctaagctgtcacagaaagtgacgtaccctccacacctgtggatggtctgaagggcaaggaggaaatttcagaaagctgtcaggcacttgatgaaatgaaaccacagcatctggaagttgatgtccttaagccaatgaccagaaggaatgaaccagagaactgatgttgttgtccatggacctgatgtttcttatgagattccaagtagaaaaatttattagattttgaacacttaacggctggataaggacaactttcttatatatatatatatatatgtcatatgtggcaatactcttgtcaattaacatattaagtttggattgaggtaagtaatacttgaaagtgccattaattaataactcagagcatgaaaattatttgattaaaagctcaatgaggctgggtgtggtggctcatgcctgtaatcccagcactttgggaggccaaggtgggtggatcacgaggtcagtagttcaagaccagcctggccaagacggtgaaaccccatctctactgaaaatacaaaaattagtcaggcgtggtggcaggtgcttgtaatcccagctactcaggagactgaggcaggagaattgcttgaacctgggcagcaggggtcgcagtgagcctagatccggccactgcactccagcctaggcgatacagtgagactctgtctcaaaaaaaaa

SEQ ID NO: 17415 - DNA, 1525 bp, Homo sapiens
aggagatctgatcacacttcctcctgaggcacctctcatggatgttgcaataagcattcgggtactatcacccagaaatatgaattgccagaatagaacatttagcatgttaagcgttgatgcatataaaatcagaaatagatgtgagaatggtggaactttttaaaagaacccagtcaaatgtattttctgctgaaatctgcatatttgggaggcatttcccaccaccgattcacagcccatttgatagtgtgggtagttaggggacttcgtgggagtggtgttcagacgtccccggggggctttaaatctcttcatatttaggtccatcatttgttaactatggggctttatttgcagagcttctaaaaggcgtataactgtgtgagtggccagatattcactttttaaatcaaaaacctctcttatggaagctttaaaagtttccgtcacacacaattctcttctcaggaagtatttctcatttaggtcttcaaagtagcctgactgtgtgcatgtgtgtgtgtgataggttatttataaagactttggatagaaggagatgtattttattacctcctattctagagccccatgctcctaacaagccagagaggccccaaacaggattgtttctttcctccacagcccttctgcccatctgagattgagggagcatcgtccacttgagatcagggatggggtggagaatgggtcatgtcatgtaatgagaaaagccctcttcgggatcatgagacttggttctagtccaatttctgccactgaggatgaatgtaactgtgggcaaactatttaccctcctttatctgtgaaatgaaagggttgaattgatggatctctaaaggcttttgtcctctatgaggatgtgaaaaactagggaccacaaaagggaacaagcaaaaaagtttggattcgataaagtgatatgtaatagttgcagaaggctttatatatgcttataatgaaaagatattttttgtatattgacagcataatttatttttaatgctgtcattacacttaaagtcacaggaaaaaaatatacatgcttactcaggctttcttaaaaataaatttttatagagatccttgagtaaagacattttgcttaatttcttttttcttattccccacttgtatatcccctaccagtaccgggatctgcacacatctttttgcagttacctcttcatagccatgaaccaaaacgttctatgaggagcatgcaagtaagtcaagcctcctattctgttagtacttattagaggaggagatggttttcattgcatagtgacattttcttagccttaacgttctgatagtagcttactactcacttctctttttcagttttcataataagtattcatttttttgccataatgcttcctgtaaagccaattttatatactaataaaacatgaactgcccactcttcatgcctgccaaacttggggcaattgatgctaaatggtatttttaaaataaatgtttttattcttta

SEQ ID NO: 17416 - DNA, 1678 bp, Homo sapiens
aggagatctgatcacacttcctcctgaggcacctctcatggatgttgcaataagcattcgggtactatcacccagaaatatgaattgccagaatagaacatttagcatgttaagcgttgatgcatataaaatcagaaatagatgtgagaatggtggaactttttaaaagaacccagtcaaatgtattttctgctgaaatctgcatatttgggaggcatttcccaccaccgattcacagcccatttgatagtgtgggtagttaggggacttcgtgggagtggtgttcagacgtccccggggggctttaaatctcttcatatttaggtccatcatttgttaactatggggctttatttgcagagcttctaaaaggcgtataactgtgtgagtggccagatattcactttttaaatcaaaaacctctcttatggaagctttaaaagtttccgtcacacacaattctcttctcaggaagtatttctcatttaggtcttcaaagtagcctgactgtgtgcatgtgtgtgtgtgataggttatttataaagactttggatagaaggagatgtattttattacctcctattctagagccccatgctcctaacaagccagagaggccccaaacaggattgtttctttcctccacagcccttctgcccatctgagattgagggagcatcgtccacttgagatcagggatggggtggagaatgggtcatgtcatgtaatgagaaaagccctcttcgggatcatgagacttggttctagtccaatttctgccactgaggatgaatgtaactgtgggcaaactatttaccctcctttatctgtgaaatgaaagggttgaattgatggatctctaaaggcttttgtcctctatgaggatgtgaaaaactagggaccacaaaagggaacaagcaaaaaagtttggattcgataaagtgatatgtaatagttgcagaaggctttatatatgcttataatgaaaagatattttttgtatattgacagcataatttatttttaatgctgtcattacacttaaagtcacaggaaaaaaatatacatgcttactcaggctttcttaaaaataaatttttatagagatccttgagtaaagacattttgcttaatttcttttttcttattccccacttgtatatcccctaccagtaccgggatctgcacacatctttttgcagttacctcttcatagccatgaaccaaaacgttctatgaggagcatgcaagtaagtcaagcctcctattctgttagtacttattagaggaggagatggttttcattgcatagtgacattttcttagccttaacgttctgatagtagcttactactcacttctctttttcagttttcataataagtattcatttttttgccataatgcttcctgtaaagccaattttatatactaataaaacatgaactgcccactcttcatgcctgccaaacttggggcaattgatgctaaatggtatttttaaaataaatgtttttattctttactcttgactaaacttgtttattttcaactccaatgaagattgtggaagagtgttttgaaatgaagcatcgatttgtacttcatagagcaccagacacaatgtctcacccaatttggagttccatattttttttatgataaagaaaaatgttgg

SEQ ID NO: 17417 - DNA, 860 bp, Homo sapiens
tccattgatccatgagtgtggtggggctggccccagggctagtgagaagctgttgccatggctgcattgctggtaaggtgggattccgtgtgtttgccctgagcaatctgcgctgcctctgtgactttcctcctcttctcagtcttacaccgcctggtcttaggtcatctgctaagctgtcacagaaagtgacgtaccctccacacctgtggatggtctgaagggcaaggaggaaatttcagaaagctgtcaggcacttgatgaaatgaaaccacagcatctggaagttgatgtccttaagccaatgaccagaaggaatgaaccagagaactgatgttgttgtccatggacctgatgtttcttatgagattccaagtagaaaaatttattagattttgaacacttaacggctggataaggacaactttcttatatatatatatatatatgtcatatgtggcaatactcttgtcaattaacatattaagtttggattgaggtaagtaatacttgaaagtgccattaattaataactcagagcatgaaaattatttgattaaaagctcaatgaggctgggtgtggtggctcatgcctgtaatcccagcactttgggaggccaaggtgggtggatcacgaggtcagtagttcaagaccagcctggccaagacggtgaaaccccatctctactgaaaatacaaaaattagtcaggcgtggtggcaggtgcttgtaatcccagctactcaggagactgaggcaggagaattgcttgaacctgggcagcaggggtcgcagtgagcctagatccggccactgcactccagcctaggcgatacagtgagactctgtctcaaaaaaaaa

SEQ ID NO: 17418 - DNA, 706 bp, Homo sapiens
ggtattttctctttcagaatgaagaagtcaaattcattgaaaatgagctcgagattcaaaagcaaaaatactttaaacttcagacttttgttagaagcttgatattagcaatgaaagctgatgataaggaacaacagcaggcactgctgtcagatttacctcctgaattagaggaaatggatttcaatcatgcctcactggagcctgatgatacctcattcagtgtatcttctttgtcagagaaaaatgtctcagaaagtttgtgatttcagttggagggaatatatgatacagtcttttggcttcgtaacaggtgtgcatttcaagataactgcattctgttgccctggtattctttagttgggaaaacacattgttgaaacggacgtattctgtgaagaatgtacaagatataatggctacagtgcaacaaaaatgtaggtgaaatttaaaagcattgtttgagagagtatttttttaactgatggaactctggaaaaaaattatatttaagtttcagcagtttaaccctgaaattcattatgtctaatttctaaccagagacaaaataactaaagacatttcagcattgcttatcaagttgctacagcttgattagtcttgtttttgtagccattacatcttctttcttcttctctccttttcctatcatccacttacactttttctcaggaaagtggactga

SEQ ID NO: 17419 - DNA, 298 bp, Homo sapiens
atgaacttcctttgttgactttctttgccattaatttaaaagttccagtatcctcaatatttgatgtcttatatgtacagaatcctttccagctgtaagtcatcagcaagtaaaaaatttagtatggcaatagttttcataagaggttttttaaaacagaaaaatgttgacattgccagcctctgggttgcattttgggatatgctacatttcaaaggtatcttttaaatctgaaggcaaagactttttcaacatctgaatattctgatttacagaaattaaaaaaaaaaaaccccgg

SEQ ID NO: 17420 - DNA, 248 bp, Homo sapiens
ggaaatcatgatgctggcttttttgactaggacttcagagatcatgggagcatcgggaagtctctgcaagtgagtgcagagagtgtgagctgtggagtcagaggggtttgcatttgcttaccagctcttgcccacttatgatcttcttacctaacatcttgcaacttatttttgtcatctttgacattcagagataaggactcacctcaaagggttgcgagagagagagagtgtacaaattattcagc

SEQ ID NO: 17421 - DNA, 253 bp, Homo sapiens
tgacagcttcttcccaactgcaatccccgcttttccacacttgagctcgtcctggcctgttgggccaggcttctggggtcttctgggggtggcttgtgatagaaacaatgctgaagcttccgcggagagcccgtcgcttgttgaggcccaacagacttccaggaaatcagggtttatcatcagtgttgagaatggtcccagcaagctctggtcatacgaagtcctctcttccctgccccttcagcacttcccc

SEQ ID NO: 17422 - DNA, 324 bp, Homo sapiens
agagtaggtagatgggtgtttaaatgatattttctaaaatatctttcttcagacatctttttggtcagcaatttttaaaagagatgccgtgaactggaagtacttggcacatgggcaatcatttggaaaagaacaaaatagtactggaacatgggggtaaaataggtttcaattttttaacataaaatatccatcataatccacatagtaagcaaaatctttcaaaggagcttaacttagaaaaaatactttttttaaagctaaaaacatagtgaaatatatttttgatttaaagcttgtaacagcatgccactcaagtcattg

SEQ ID NO: 17423 - DNA, 468 bp, Homo sapiens
gcactaaccattgacttctatgatcccttgttacatttcaggaacctgatcctatttgattcagatattaatattcttttgtatgtgactttcccccctgtattagtccattttcacactgctataaggaactacctgaaactgggtaatttgtaaggaaaaggggtttaattgactcacagttccacacagctggggaggcctccggaaacttaaaatcatggcggaaggggaaggggaagcaaggcacattttacatagcagcaggggttggggaagtgccacacttataaaccatcaggtcttgtgatagtttactgagaatgatgatttccaatttcattcatgtcctttgcaagggcatggatgaagctagaagccatcattctcagttcatcagttttttaggttatgtttattttttcttaagcctaagaaaattatttccttggaattcagaaagctact

SEQ ID NO: 17424 - DNA, 415 bp, Homo sapiens
ttacattggttggtggcattagcctgtcaacagctggatgagatagaagttagaaaatggactttttgaggtcaggaagctaagcaaccagaagaaccaatttgtcaacttaaatcatctggggaatggaaaaaattattccacaatgtgggaaataaaagaccgcctggagctactggtttttgtttttattttctttttgttattcctctttgcacttcccttttccgagcagcattatgtgtgggttatagaaagcttacatgttgactttgttatgtggtcatttgatgtggtcgcgctaacgtttattgtaaatactgtgagtatttttcacccttctggcttaattacctgtggccacatcaacctgaatgtatttgagaggtaaaggggcccaagacttcagtaagag

SEQ ID NO: 17425 - DNA, 471 bp, Homo sapiens
tttgctttcctgatggaaaatctgaaaactagtttggtctgtggtaataaaaatccactggctctcctgccctggaaaagaccctaagagttcccctactgtaaatgctcagctaactagaacatagcaatatttattttcaacaaatatttattgggcacctactttgtgccgctcatttcaggtgcctaggaatacaacactaagcaaaatagaccaaaaaacaccgccctcatagagcttgtattttagtgaatacatcagaatatacagaatattttcaactaaaatttgatgggtttcatgcaatgaatgaacaaatagaaaatcagaaagtctgttcctggtctttccttctatatgactgttctatatgccaatcttcgtcactgaatctctctctgtcttcaaatgctcatgttaataatgtactaatgcattattatccaggtttttttccccaaaaaaaga

SEQ ID NO: 17426 - DNA, 429 bp, Homo sapiens
atgatttaaatcatctgttttttactaatgcatccagaagctttttttgtgtgtgtgggattaggccttatctgcaaataaactttggtagtgatataattataagagaacaataatatatttctgtagtctaccatttagtccatgttttatgcacgtttagaccattgaattaatctctgaaacaatagaaataaattctttactagaaatagcttgcttttgccttggctttgtggcaaagcgacattagggaacatatatggttgttgttgaacctgattgctttagcagcccttgggttgatagtatcaggttccagcctgccctgctaggtcaacgtggacccagggctttaaagagaaaagttcagggaaagttcacttctattgttttaccatggttacaaaacagaaaggaaaaaaaaaa

SEQ ID NO: 17427 - DNA, 357 bp, Homo sapiens
acagatggtacatgcagctttcctcccctttcctgactactgatcattcagctatgtcagttacaaaatgaactgcactttcagactcgctgggagggctggactggaaatttcacgggggcggaggcagggggccacgtaattatctattatcattacatcctcagcaccagcacagcagcctgttagcacttagtaggtattcaataaatattgcttgaataaatgagttaataagactgcataaataaacagaaactgtattgatagtacaagcttgttaaaaagtattagaatggagaggaagtgacactttcccacattactttacaagtgaatgagatcaaaaagaaaaat

SEQ ID NO: 17428 - DNA, 956 bp, Homo sapiens
gcaccagcagcttcatccgcaggcccactcggggtgaatagtgtgggagctctcaagagaaagaattttaggtttgtcgatagtaatcaccaccttcagcgctcctcccactgctggagagaccgcggactgggtgacaagtcttccaggctcccagaaagtttctgctgcaaagcgcagggtccgcctcccacttccaggagggaccaggagggaaccatcgcgaaaccccgaggctgccggggactctgactgaggcctttcctcctgtgtccctctcccccacgccggcctcccctcctttcaactctctgcgctttgaaaccgcggagttggggtagctaggccctccagcccggcgacaggcctcggccacaggcagcggggcggggtgtggacaggaacaaggaggtggggtggggaggaagcctcgggcagagcaggttctctgcggagtttcggcagccgggtttatccattttgattaaagaaaagtaaaaaaaatcccccaaaaccaaacaacaaaaaccctctcccaacccccaacccgcctccacagctgcattttgttcctgggactgttggtgtcaccagagcctctttttttatgcaatcctagactccattgcaaaggacttgtaaagcctattaatttttcaggcaaaacagatcaagcctgcctttgatgctgctgtttcctaatttagtattcaaaggtaaagaatcctactaccgctcttcactttttacataattaaaagagatttttcccccaggggcaaagaactagttgcttagtattttttgaagtgaaaggtctaactttatatcacatctgtttttatgctctttcctaaacataaccaatatttactctttgctggtacttagttgcatgctattcacccttgcattttaatttctgacagagaggggattagtattcctcttctaaa

SEQ ID NO: 17429 - DNA, 461 bp, Homo sapiens
aattcgcgccgcgtcgacacggctgcgagaaacgacagaagggtgattaaagaaaagtacacagctgcattttgttcctgggactgttggtgtcaccagagcctctttttttatgcaatcctagactccattgcaaaggacttgtaaagcctattaatttttcaggcaaaacagatcaagcctgcctttgatgctgctgtttcctaatttagtattcaaaggtaaagaatcctactaccgctcttcactttttacataattaaaagagatttttcccccaggggcaaagaactagttgcttagtattttttgaagtgaaaggtctaactttatatcacatctgtttttatgctctttcctaaacataaccaatatttactctttgctggtacttagttgcatgctattcacccttgcattttaatttctgacagagaggggattagtattcctcttctaaa

SEQ ID NO: 17430 - DNA, 1670 bp, Homo sapiens
ttagatgcaaggtttcagtcaggccagtaatttcagtccttaagttgcttaccatccaagagagccaataatgatcaaacaaggtggaaaaaggtcagtgccctacacaggtaaagtacttactcacgtagagatgagagaaggaaggcttgatggctctgaggccatttgggaagaattctggggaatggataaaatttagacatgaatgatggattatgccttccagaaagagagaatgaatcaaataagggaaaatatatggaggtagaataaggttgggcatggagagtttgaaaaacataaaatagagtgatgaggtggctgggacaagtggccctgaagggaagtttctagagagaaggatggagagaagatggaaccaagtgaggaaagtcctccgatgctagctccctgatgttaggccttcagatgctaggccctttcatgctgagcctccagatgctatgccctcccatgccatgccccaaagttattcattaggctgtgggaactatggaaagttgccagttccccatctctggtgataagagtcgcccctctttctggtactgtgtgggcgccttctcaatgggaaatttatgccctccttttaggcagataggcagataaggggagggcagagaactcttcctgcatctgttggttctctgttgccctcatctcaaaataatctttatgccaacgtggcataatttaggggtgacatattctgatccccttcactggggctggggaatatggaggatcaaattggcatctgctctccatctggtcatgaacagaattttaaaaggcatttctgcttcatcccttcctcatttccttccttccttcttcctttttctttctttctttttaaatgtttcatgctatagattggccctgcagatacttcagtttgccaccactattctacatttaagcttctgaacctcctataagtacagaatacatttttctcttggcatattttgactaataaaactgtgagatgttcaatgggcattgaattttgaagtcagtccaggagatgtacaaataatatccaaagtctgaaggcttaagctgtcatcacagagttactagaggacacttatctttgacatgatctgatatcagaaacgagtgtagacttgtagtcatttagaactcaaaagagatcttagagtcttctagatcagtggctcctaaaagctactcaagaatagggctcatgtttttaatggggaactttaagtggttgtttagacccccaccccaagatataaactgtggtggggcatgggcctgagaagcagagaatccttttcttttaagctgcccaggtgatgttaattcaaatccagtgataacagtgataagtaacacttagccaagtgtttcccatggctcttagcttcagagtgtgacccctatctaagtcaagtatcaaagatttttcttcatgccattactacagaaacagggtagaatactcatattccttcagctcaagagcagcagagagtttctgacaagtatttttgcatttggtaaaatggtagtctaagttggaactcagtaaactatttttgttttcaatgaggggaagtgtagaactgtagtactctcaaattattttttctcaaattggcctttgtgcaaaa

SEQ ID NO: 17431 - DNA, 726 bp, Homo sapiens
tttttaggatgttctgaggaaggaagaggccaacatggtcagttttatatgaagagaagattttgttccaaaggaaatgatggggaaaagcccagcttggggaggggtcagggaacagtgggcaagtgggaaatgagtccaccttctgccaggaagcccaagggggcatgtctttgagctgcaaaagaacaggtccacaaatcatagctgagattggcccagcggtaggaaaagcaacacagaatcaatttagtgtggttgaagcttgtgcgatgactcgggctatcacgctcctcagggcctgaatcatgggacacaatggatccgccagcttattccggcatcctttaactcttgaggagcaaatgccctggcaaggaatccgtcagaatctccttcccctcctgctgctgcgtgcagtgggccgtgccctggtgaggttcctgtgtcctctgtagaaggtaacagattagaaaagcagaagtcccttctctgtctagcatccttccaccttcttctcctcatctgcaaaatggggatgaaacacataaccccagggttgggagaaaggtctgacacagaggcaagtgtcagtgaacgtttgagaactctgaagcggtgatggaaatggggtattcctggtaaccagcaccctctctgacccacgtggtagttatccttttgccaaaatgtgtgactctcttaatacattttgagtctctaggg

SEQ ID NO: 17432 - DNA, 2137 bp, Homo sapiens
acacaaccttggacattagagcctgtccgtctgatctagagaaggaatgttgctggggaaggaaaactcagggcgaggtgagagaggacagaacctctaaccaggaagaggctgtccccgccaagctccggagaggcgcggaagcatgaccctcaggtggtaacagaaaacaatccagatggggtgcaggtgctgtaaaataatacaaagctatctctttgatccagtccaagtgccctctcctggctatgtcaatgaagtcaacagctgcaagctagatgaagacgacactgataaattaaaaggcaaatggagcagtgaagtcttggtgcagaaaaatgaccctcagaggcagggctcaaagaagactgagagcagcagcaggacagctgatccatgggagccctgctggcctcaccaagggccgctcccacagggggacgctggaggggaacaccatgcctgcggtgtcaacggcatcggccctgctgccactccacagcccactgggaattccagccccacccaggatgacaggggctcctgggccagtactgcaaatactgttcccccaactcaacccttcctggaaggagggggcaccaggaaacaggactgtgtgctgctggcctcagaagggacccaagtcatgagaaatggagactccagagctccttctgaggcagaaagttttgccttggaagtacaagaccatgtcttccagataccagccccagattaccttcagcattggggcccagctggagacaacgttgatcataatgaaaaggactgtgttttcaagaaccatactgaggatgaatccctagagggaattcagcccccagtgggggagcatggtttgaatacgcccttctctgtgaggagaagctgggattcattgaatgaggatgtggaaacagaagttctaagcatctgctttaatgagaagggtcctgttcatgccatgcctgtggttgactcaggaaacaggcaggaggatacccatggctccgatggagatggggatggggagattgtggacgaggatgcagcggtggcggaggcccttgcagctttagaagctgctactgcaggagaagatttggatgagactgattaggggaggggatttgcacagggaggtaagctggtgtcatgctgagcatgcagatgcatttgctccctggatgcatagcaggtgattctgccagcatgcaccagtgcagccttaccagttgtttacatccagcatctgttctgattgtcagcatctgtcccatgctgcttgtcacatatctggagtttcactctgtgtagatgagctgtcattcaggacactaggagaaaaatctgagtgggtcattgtgcccatatccacagaaaatgcagaagttgaacagcttgcttgacaaccctcaaacatctttgagcacctggtacagatgtttatgagaatactctaagatctcaacccttgatcccaaaggcacacaatcacagagcattccttttgactgtaaactgtttaccttgcttttgagagccaaacattgtacccaacctggaaaaagtaactaccccaattaaagtgcctcatgtgtccccagagcatggcttaacttcagggacaatcacccagggaactaataactaaccagttgttcaacagcgggttaagctcagcagttttcacagtagagcagaagtccccaggaaacaaagggttagtcattagctgagatgttgattttaaaacaccttgaccttaacttttttacattattacttttaaatctcctttgggattggggaggctggccaaaataagtcttaaaactgcttatgtcatatttggattttaagttcatgacattcggaacagcaaagccatatatgcaatgtttttatgccattaaatgtctgattccaattaaaatataacaacgtatgtgtctttctagaagtcttaactcaaaggtggttctaattttctcagaatatcagtgaccctggatgttactttcaatgtaaagaactaatctagatggccgggcgtggtggctcatgcctgtaatcccagcactttgggaggccgaggcgggtggatcacaaggtcaggagttcaagatcagcc

SEQ ID NO: 17433 - DNA, 726 bp, Homo sapiens
  misc_feature (27)..(27): n is a, c, g, or t
aacctttaaaatttttttgggaaactngaaaaggaggttagggggaaaattctaagatctcaacccttgatcccaaaggcacacaatcacagagcattccttttgactgtaaactgtttaccttgcttttgagagccaaacattgtacccaacctggaaaaagtaactaccccaattaaagtgcctcatgtgtccccagagcatggcttaacttcagggacaatcacccagggaactaataactaaccagttgttcaacagcgggttaagctcagcagttttcacagtagagcagaagtccccaggaaacaaagggttagtcattagctgagatgttgattttaaaacaccttgaccttaacttttttacattattacttttaaatctcctttgggattggggaggctggccaaaataagtcttaaaactgcttatgtcatatttggattttaagttcatgacattcggaacagcaaagccatatatgcaatgtttttatgccattaaatgtctgattccaattaaaatataacaacgtatgtgtctttctagaagtcttaactcaaaggtggttctaattttctcagaatatcagtgaccctggatgttactttcaatgtaaagaactaatctagatggccgggcgtggtggctcatgcctgtaatcccagcactttgggaggccgaggcgggtggatcacaaggtcaggagttcaagatcagcc

SEQ ID NO: 17434 - DNA, 832 bp, Homo sapiens
  misc_feature (8)..(8): n is a, c, g, or t
ccggcgcnatgggcgccgggacccgccgccgccgccgccgccgccgtctggccccaggaagagaagttaaacttctagagaaacctaacagacaatatccacaacaggtggtaacagaaaacaatccagatggggtgcaggtgctgtaaaataatacaaagacagagtcttgctgttgtcaccccggctgaagtgcagtggcatgatctcggctcacggcaacctctgcctcccgggttcaactgactctcctgcctcagcctcccgagtagctgggactacaggtgcccgccaccatgcctacctaatttttgtatttttagtagagatggggtttcaccgtgttgtccaggctggtctcgaactcctgacctcatgatctgcccaccttggcctcccaaagtgctgagattacaggtgtgagccaccgcacccggccaagaaatactttttaaagatataattgtacctccattgatctgaactagcaatcacagctgctctggagtctgcaagtctatgaccttcatctacctggaagaaaactgaatggctcacacacctggacctgatccagacagagccttaaaatccatcagctgctcatcagatgatcccatcggatgccaaggaggccatccaaaggctggaatgatcagttctgtgagctattgagctatgtgaagaaacggcggttgatttgctttcttgccaagaaaagcaaagctccctcacactccacggccactgagcatgtaagctcccaagtataaatttcttcccatccaagccctctcactacctagccctgagatatggggaacattaatcc

SEQ ID NO: 17435 - DNA, 2088 bp, Homo sapiens
  misc_feature (8)..(8): n is a, c, g, or t
ccggcgcnatgggcgccgggacccgccgccgccgccgccgccgccgtctggccccaggaagagaagttaaacttctagagaaacctaacagacaatatccacaacaggtggtaacagaaaacaatccagatggggtgcaggtgctgtaaaataatacaaagctatctctttgatccagtccaagtgccctctcctggctatgtcaatgaagtcaacagctgcaagctagatgaagacgacactgataaattaaaaggcaaatggagcagtgaagtcttggtgcagaaaaatgaccctcagaggcagggctcaaagaagactgagagcagcagcaggacagctgatccatgggagccctgctggcctcaccaagggccgctcccacagggggacgctggaggggaacaccatgcctgcggtgtcaacggcatcggccctgctgccactccacagcccactgggaattccagccccacccaggatgacaggggctcctgggccagtactgcaaatactgttcccccaactcaacccttcctggaaggagggggcaccaggaaacaggactgtgtgctgctggcctcagaagggacccaagtcatgagaaatggagactccagagctccttctgaggcagaaagttttgccttggaagtacaagaccatgtcttccagataccagccccagattaccttcagcattggggcccagctggagacaacgttgatcataatgaaaaggactgtgttttcaagaaccatactgaggatgaatccctagagggaattcagcccccagtgggggagcatggtttgaatacgcccttctctgtgaggagaagctgggattcattgaatgaggatgtggaaacagaagttctaagcatctgctttaatgagaagggtcctgttcatgccatgcctgtggttgactcaggaaacaggcaggaggatacccatggctccgatggagatggggatggggagattgtggacgaggatgcagcggtggcggaggcccttgcagctttagaagctgctactgcaggagaagatttggatgagactgattaggggaggggatttgcacagggaggtaagctggtgtcatgctgagcatgcagatgcatttgctccctggatgcatagcaggtgattctgccagcatgcaccagtgcagccttaccagttgtttacatccagcatctgttctgattgtcagcatctgtcccatgctgcttgtcacatatctggagtttcactctgtgtagatgagctgtcattcaggacactaggagaaaaatctgagtgggtcattgtgcccatatccacagaaaatgcagaagttgaacagcttgcttgacaaccctcaaacatctttgagcacctggtacagatgtttatgagaatactctaagatctcaacccttgatcccaaaggcacacaatcacagagcattccttttgactgtaaactgtttaccttgcttttgagagccaaacattgtacccaacctggaaaaagtaactaccccaattaaagtgcctcatgtgtccccagagcatggcttaacttcagggacaatcacccagggaactaataactaaccagttgttcaacagcgggttaagctcagcagttttcacagtagagcagaagtccccaggaaacaaagggttagtcattagctgagatgttgattttaaaacaccttgaccttaacttttttacattattacttttaaatctcctttgggattggggaggctggccaaaataagtcttaaaactgcttatgtcatatttggattttaagttcatgacattcggaacagcaaagccatatatgcaatgtttttatgccattaaatgtctgattccaattaaaatataacaacgtatgtgtctttctagaagtcttaactcaaaggtggttctaattttctcagaatatcagtgaccctggatgttactttcaatgtaaagaactaatctagatggccgggcgtggtggctcatgcctgtaatcccagcactttgggaggccgaggcgggtggatcacaaggtcaggagttcaagatcagcc

SEQ ID NO: 17436 - DNA, 2022 bp, Homo sapiens
  misc_feature (8)..(8): n is a, c, g, or t
ccggcgcnatgggcgccgggacccgccgccgccgccgccgccgccgtctggccccaggaagagaagttaaacttctagagaaacctaacagacaatatccacaacaggtggtaacagaaaacaatccagatggggtgcaggtgctgtaaaataatacaaagctatctctttgatccagtccaagtgccctctcctggctatgtcaatgaagtcaacagctgcaagctagatgaagacgacactgataaattaaaaggcaaatggagcagtgaagtcttggtgcagaaaaatgaccctcagaggcagggctcaaagaagactgagagcagcagcaggacagctgatccatgggagccctgctggcctcaccaagggccgctcccacagggggacgctggaggggaacaccatgcctgcggtgtcaacggcatcggccctgctgccactccacagcccactgggaattccagccccacccaggatgacaggggctcctgggccagtactgcaaatactgttcccccaactcaacccttcctggaaggagggggcaccaggaaacaggactgtgtgctgctggcctcagaagggacccaagtcatgagaaatggagactccagagctccttctgaggcagaaagttttgccttggaagtacaagaccatgtcttccagataccagccccagattaccttcagcattggggcccagctggagacaacgttgatcataatgaaaaggactgtgttttcaagaaccatactgaggatgaatccctagagggaattcagcccccagtgggggagcatggtttgaatacgcccttctctgtgaggagaagctgggattcattgaatgaggatgtggaaacagaagttctaagcatctgctttaatgagaagggtcctgttcatgccatgcctgtggttgactcaggaaacaggcaggaggatacccatggctccgatggagatggggatggggagattgtggacgaggatgcagcggtggcggaggcccttgcagctttagaagctgctactgcaggagaagatttggatgagactgattaggggaggggatttgcacagggaggtaagctggtgtcatgctgagcatgcagatgcatttgctccctggatgcatagcaggtgattctgccagcatgcaccagtgcagccttaccagttgtttacatccagcatctgttctgattgtcagcatctgtcccatgctgcttgtcacatatctggagtttcactctgtgtagatgagctgtcattcaggacactaggagaaaaatctgagtgggtcattgtgcccatatccacagaaaatgcagaagttgaacagcttgcttgacaaccctcaaacatctttgagcacctggtacagatgtttatgagaatactctaagatctcaacccttgatcccaaaggcacacaatcacagagcattccttttgactgtaaactgtttaccttgcttttgagagccaaacattgtacccaacctggaaaaagtaactaccccaattaaagtgcctcatgtgtccccagagcatggcttaacttcagggacaatcacccagggaactaataactaaccagttgttcaacagcgggttaagctcagcagttttcacagtagagcagaagtccccaggaaacaaagggttagtcattagctgagatgttgattttaaaacaccttgaccttaacttttttacattattacttttaaatctcctttgggattggggaggctggccaaaataagtcttaaaactgcttatgtcatatttggattttaagttcatgacattcggaacagcaaagccatatatgcaatgtttatgcattaatgttgttcacaaaaaaaaaaagaaaaaaaaaattgtggggctgggccaaaattttaaaactgtgggggggccaaggaagaatggaggtcggaatgtggaaggtgggtccccaaagcgggggggtgaacagggtgggtggtaacaagcggtacgag

SEQ ID NO: 17437 - DNA, 1161 bp, Homo sapiens
acacaaccttggacattagagcctgtccgtctgatctagagaaggaatgttgctggggaaggaaaactcagggcgaggtgagagaggacagaacctctaaccaggaagaggctgtccccgccaagctccggagaggcgcggaagcatgaccctcaggtggtaacagaaaacaatccagatggggtgcaggtgctgtaaaataatacaaagctatctctttgatccagtccaagtgccctctcctggctatgtcaatgaagtcaacagctgcaagctagatgaagacgacactgataaattaaaaggcaaatggagcagtgaagtcttggtgcagaaaaatgaccctcagaggcagggctcaaagaagactgagagcagcagcaggacagctgatccatgggagccctgctggcctcaccaagggccgctcccacagggggacgctggaggggaacaccatgcctgcggtgtcaacggcatcggccctgctgccactccacagcccactgggaattccagccccacccaggatgacaggggctcctgggccagtactgcaaatactgttcccccaactcaacccttcctggaaggagggggcaccaggaaacaggactgtgtgctgctggcctcagaagggacccaagtcatgagaaatggagactccagagctccttctgaggcagaaagttttgccttggaagtacaagaccatgtcttccagataccagccccagattaccttcagcattggggcccagctggagacaacgttgatcataatgaaaaggactgtgttttcaagaaccatactgaggatgaatccctagagggaattcagcccccagtgggggagcatggtttgaatacgcccttctctgtgaggagaagctgggattcattgaatgaggatgtggaaacagaagttctaagcatctgctttaatgagaagggtcctgttcatgccatgcctgtggttgactcaggaccccgccgccgccgccgccgccgccgtctggccccaggaagagaagttaaacttctagagaaacctaacagacaatatccacaacaggtggtaacagaaaacaatccagatggggtgcaggtgctgtaaaataacaaagctatctcttgatccagtctctggccccgggtacc

SEQ ID NO: 17438 - DNA, 470 bp, Homo sapiens
accagtggctcccattttcattttagccattttgtcgcctgcacccactcccttcatacaatctagtcagaatagcagttctagagcacaggttctcagtctaagctatggaaaagctccccttatccaacagagtttaaaagtagtgacttgggtttttgcgagtgctttgtttactaaggactttggggaggaaccatgctaagccatgaccagtgaggagaagcaacagagcctgtctgtccccatgagcggagtctgtcctctgctcttctgcagtcaggtcactgcctactgcctgggggctctagtcattccagtggaagacgaatgtaacctgcgtggtgatgtgacaactgtttcctccctgaccccagaggatctggctctaggttgggatcaatcctgaatttcgttatgtgttaatttacttttattaaaaaagtatagtatatataaataatacaaaa

SEQ ID NO: 17439 - DNA, 143 bp, Homo sapiens
attaaatggaaatgtttgaatgctttataaaatagtttatataaatttaaggtgaagcagagaagctagtaatgtatctcaagtcaagctttgctacttaattctctccacacagattagcaaacccactgttcaggctgctc

SEQ ID NO: 17440 - DNA, 442 bp, Homo sapiens
gagaaaaaaaaaaaggggtctctgcccaaaaatatctgtaggaaagagaaaggacaaagtaatcagagcaagagatcccttctacatagaatttcttctaaaagaagaggatgggaaaagtcaacaatttcaagaaacaatctagattatatattagctgttcactttaactggtagggatctgacagaaaataaacaatgaagagcattcctaatgcgttccttacaaatgtatatattttaaagtctctcatacttgttttaggctattctttggtatacgacttttcaagtgctattttttattccatgtatactgaaaaacagatgtaataaaaataattcagccagtggttttacttatgtctgcatattagaatcgtttgggaaaactttgaaacaaacaaacaaaaccaataaagctctgacactaacccagagc

SEQ ID NO: 17441 - DNA, 528 bp, Homo sapiens
aaaaaaaaaaaaagacagatttaatcataagaatatgcagtgcatcttctcaccaatacgataccatcagtagggctccaggataacagtggattacaactgagagctgcaagacatggactctattttaagaaggaatttctagggaaacccaaagacaacaggggagacaaggatattgaggaaaattggagcctctagcacctacagcgaacatcagatgcagcctgttagccagataaacatacaactcacattaaaggtctgtttacgtaagttcttgttacctaatatatcatgtctggcttcagtaaaaaagtacaaagcatgctaaaagggaaaaaagaagagacaaagcgagcatcagagccagactcagatatgtcagaaatttgagagttatcagactgggaatttaaaataactgattaatgtgccagatttctaatagaaaaaatgaacaacatgcaagaatagtcacgtagtataagcaacagatggaaacttagaatcaaaaagaaatgcaaa

SEQ ID NO: 17442 - DNA, 385 bp, Homo sapiens
caaatatattagtgttgttgtatgtttttaaatacttacttccaaatgatttaatctattttggtcattaaaatatgtcttaatttctcaaagaaaggcatgaagtcttaaattttatgagttttttatgctatcaatgagaaagataaagtaaaaattacagtagaaaaagacaaagtccttcaacaaagttaagaaagtttataataattggctaatttttttgaggtagttcatgtagagtgtgttgggagctatcctgaaggttaagtttattaaaatttagggtaaagtagtaagtagttccaagttcaggagatacacctgaataattctgaccacagtataaattttgcaatatgtcgaaaatgaaatcccaagcata

SEQ ID NO: 17443 - DNA, 638 bp, Homo sapiens
taaactgctctcccaacttacaaacgagtaaatttaattgataccagagtatccagctcttcccacctttccccaggaaccccttccgtcttgccgtgggtggcaggcatcttgctgctgtcctaactggcactcttaaacaatttcctacagggatgtcttaatccatttcacactgctgtaaagaactacctgagattgggtaatttatgaagaaagaggtttaagtcactcacagttccgcaggcttaacaggacgcatggctggggaggcctcaggaaacttacaatcatagcgaaaaggtgaaggggaaacaagcacatcttccccatggcagagcaggagagagagagaagggggaagtgccacacactttcaaacaaccagatctcctgagaactcactgtcacgggaacagcaagggggaagtccacccccctgattcagtcatctgccaccaggcctctcccctcacacatggggattattatacaattcgagatgagatttgggtgggaacacagagccaaaccacatcaaggggtgtccaatcatttggcttcccagggccacattggaagaagaattgtctcaggccacacataaaataatactaacgatagctgatgagcttaaa

SEQ ID NO: 17444 - DNA, 831 bp, Homo sapiens
cagacaaaaccttcataccattttattatttaacgtgtttcatattattttaacgtgtgacatgaaacaatttcaggaaattgtattaggtattgcgctcgtgtcttcttaggcgtcctcatcccttttcacctcggagctcagcgtcttcctcagcagcacttccatgtcatctgccccgtgaaatcagcctaacgccgtttctcaatgacgtggatcgccctaggccaccgcaaccttccggaagctctctcagctcagttcccattctcccaccatctcttggttctccttctacctcaccggttgctagtcctccgcttcgcagctgaaaatgtgcccggggcctactgtgggcctagccaggcctgcttacgcagtgcagtttcccatgaatgatgcccagtcattatcacataacctgtggcaagccagcaagatggccctggtgacagcaaaagaaactgcactaggacctgaatgtagatctcagtcatgttccttactaacagcacgttttgcaaccatgcgttaaagaaacatctgactcacaacaaaattttaaagggtttatttgagtgaaaagcaatttatgaattggggaacacctgactgaaagagcgttagtattccagagacaaaacatcaagtgcaagtttttattgggaaaatgtagaagcacaataaagaaattatttgattggttacagttatagagttgctttctttggcttatcctgttggaaagtcagtagttatataatcatgatagttggttacttatgattgggtagattaaaatttatctctgtctaatggaagcatttatca

SEQ ID NO: 17445 - DNA, 539 bp, Homo sapiens
tggctggtacctcctagccctggctcaggccggcatgtaggtacttctgttggatgtgagcacttgcttcctgagggagaagcctgggctcctccacctgctccttgcttaatcccatctcaggagtgtctcgggccaggtgccaggtgaggctcagacaagaaaaagagcctggagtccctgggacaaaggcagggctccctggaaagtaccgtgtgtatttttccttcctctgggacacagcaggcctggggatttctcccttactcaagcagcaaggagatggcctaggagtgtccctggcacccagcctgaaccctactgagcctcaggcgtcctcatcccttttcacctcggagctcagcgtcttcctcagcagcactccagcctgggcaacagagaagactctgtctcaaaaaagaaaaaaaagaaatgactcatgcctgtaatcccagcactttgggtgtgaggccgaggcagggcagatgactagtctttgagaccagcctgggcaacatagcaagaccttgtctctactg

SEQ ID NO: 17446 - DNA, 1051 bp, Homo sapiens
tggctggtacctcctagccctggctcaggccggcatgtaggtacttctgttggatgtgagcacttgcttcctgagggagaagcctgggctcctccacctgctccttgcttaatcccatctcaggagtgtctcgggccaggtgccaggtgaggctcagacaagaaaaagagcctggagtccctgggacaaaggcagggctccctggaaagtaccgtgtgtatttttccttcctctgggacacagcaggcctggggatttctcccttactcaagcagcaaggagatggcctaggagtgtccctggcacccagcctgaaccctactgagcctcaggcgtcctcatcccttttcacctcggagctcagcgtcttcctcagcagcacttccatgtcatctgccccgtgaaatcagcctaacgccgtttctcaatgacgtggatcgccctaggccaccgcaaccttccggaagctctctcagctcagttcccattctcccaccatctcttggttctccttctacctcaccggttgctagtcctccgcttcgcagctgaaaatgtgcccggggcctactgtgggcctagccaggcctgcttacgcagtgcagtttcccatgaatgatgcccagtcattatcacataacctgtggcaagccagcaagatggccctggtgacagcaaaagaaactgcactaggacctgaatgtagatctcagtcatgttccttactaacagcacgttttgcaaccatgcgttaaagaaacatctgactcacaacaaaattttaaagggtttatttgagtgaaaagcaatttatgaattggggaacacctgactgaaagagcgttagtattccagagacaaaacatcaagtgcaagtttttattgggaaaatgtagaagcacaataaagaaattatttgattggttacagttatagagttgctttctttggcttatcctgttggaaagtcagtagttatataatcatgatagttggttacttatgattgggtagattaaaatttatctctgtctaatggaagcatttatca

SEQ ID NO: 17447 - DNA, 481 bp, Homo sapiens
ttaagggctgggtatgctttgaagtaccagtaagagagcagaaggatatgaaaatgctccccaaataagcagattagtactttgagatgtggcacaaccttgtgttgatggattctgtgaaaattaccaagatttgtgactttgactcttcaccatgaggggctggggatagaggtgggctatagtataagaatatgccggccgtgcacagtggctcacgcctgtaatcccagcactttgggaggccaaagcgggcagatcacgaggtcaggagatcgagaccatcctggctaacacggtgaaaccccgtctctactaaaaaatacaaaaaaattagccgggcatggtggcgggtgcttgtagtcccagctactcgggaggctgaggcaggagaatggcatgaacccgggaggtggagctcgcagtgagccgagatcgcgccactgcactccagcctgggcaatggaacgagactccatct

SEQ ID NO: 17448 - DNA, 473 bp, Homo sapiens
tttattttggagatgtgtgctttactcatgtgtttcaagagatccatgatttatgaagtacttttaacacatttcgtgcacttacttccataggaatgtggctgctagagaccctggtgcttcccggggatagttggccgtagatttgcaccacagcagtcatattaaattaaagctcttgcttctactgagcccaaactggagtttagactgtccttcagcatgatgttcccaggtggtaccatcaagtccacgagctggctgccatctgtgaactagactttgctttggctcagccgagttactgtttcagtgttcatctaaatgacttattatatgactaaaatattataaatgcaagaaatggagctatgtgtaatcaccataaacttttaaaatctcatactaaatgtacaaacccttcatcagtgacttccttctctttttctcacattaaaacaataccttgacta

SEQ ID NO: 17449 - DNA, 1120 bp, Homo sapiens
tagcacttcatagactgctatcacgcattcatttttactagtacctattgaacactaagttccaggcactgggctaggcactgggatggtgtggtgagcaaaaactgaccagtcctgccgtggagtttgctgggggagacacatgttactcaaagaatcacactaaggatagcaatttatctcaaagctgcaagttcctgccatctacatgtgcccagagtccccaaaattgagtgtcaaacagaggctgggtgacctcctgtccaggattgctctcatcgtatgaatcgaagttttcatcttaacgtgtttttttctcctgagaataggccaaccaatcaatggctcagacagataagccaacatgcatcccgccggagctgccgaagatgctgaaggagtttgccaaagccgccattagggtgcagccgcaggacctcatccagtgggcagccgattattttgaggccctgtcccgtggagagacgcctccggtgagagagcggtctgagcgagtcgctttgtgtaaccgggcagagctaacacctgagctgttaaagatcctgcattctcaggttgctggcagactgatcatccgtgcagaggagctggcccagatgtggaaagtggtgaatctcccaacagatctgtttaatagtgtgatgaatgtgggtcgcttcacggaggagatcgagtggctgaagtttttagcccttgcttgcagcgctctgggagttactattaccaaaactctcaagatagtgtgtgaggtcttatcatgtgaccataatggtgggtcgccccggatcccgttcagcaccttccagtttctctacacgtatattgccaaagtggatggggagatctctgcatcacatgtcagcaggatgctaaactacatggaacaggaagtaattggccctgatggtataatcacagtgaatgactttacccaaaaccccagggttcagctggagtaaaagcacaattttggcaattttaaaggaagatacagagatgattgtacttcagaatgactgaaacccatataccacccaaaatcaattttcttgtacaactggtacacactaataaacaattaaacatatgagatcagaaa

SEQ ID NO: 17450 - DNA, 905 bp, Homo sapiens
ctggcagcggagcccgcgcagggtttgccaggcgaaggcggagcgctaacgtctaacgctaacggcggtcgtgccccgccgctgctgtcacccccggccgctgctgccctccccgccgaggttctactgctctccttcttaagaagggtgggaggcactcggtctctccccacacctctcgcctgaggccaggcgccaggtgtcgcctgaagccagacagccggtttgggagcgagcctgagttattttgaggccctgtcccgtggagagacgcctccggtgagagagcggtctgagcgagtcgctttgtgtaaccgggcagagctaacacctgagctgttaaagatcctgcattctcaggttgctggcagactgatcatccgtgcagaggagctggcccagatgtggaaagtggtgaatctcccaacagatctgtttaatagtgtgatgaatgtgggtcgcttcacggaggagatcgagtggctgaagtttttagcccttgcttgcagcgctctgggagttactattaccaaaactctcaagatagtgtgtgaggtcttatcatgtgaccataatggtgggtcgccccggatcccgttcagcaccttccagtttctctacacgtatattgccaaagtggatggggagatctctgcatcacatgtcagcaggatgctaaactacatggaacaggaagtaattggccctgatggtataatcacagtgaatgactttacccaaaaccccagggttcagctggagtaaaagcacaattttggcaattttaaaggaagatacagagatgattgtacttcagaatgactgaaacccatataccacccaaaatcaattttcttgtacaactggtacacactaataaacaattaaacatatgagatcagaaa

SEQ ID NO: 17451 - DNA, 1032 bp, Homo sapiens
ctggcagcggagcccgcgcagggtttgccaggcgaaggcggagcgctaacgtctaacgctaacggcggtcgtgccccgccgctgctgtcacccccggccgctgctgccctccccgccgaggttctactgctctccttcttaagaagggtgggaggcactcggtctctccccacacctctcgcctgaggccaggcgccaggtgtcgcctgaagccagacagccggtttgggagcgagcctgagccaaccaatcaatggctcagacagataagccaacatgcatcccgccggagctgccgaagatgctgaaggagtttgccaaagccgccattagggtgcagccgcaggacctcatccagtgggcagccgattattttgaggccctgtcccgtggagagacgcctccggtgagagagcggtctgagcgagtcgctttgtgtaaccgggcagagctaacacctgagctgttaaagatcctgcattctcaggttgctggcagactgatcatccgtgcagaggagctggcccagatgtggaaagtggtgaatctcccaacagatctgtttaatagtgtgatgaatgtgggtcgcttcacggaggagatcgagtggctgaagtttttagcccttgcttgcagcgctctgggagttactattaccaaaactctcaagatagtgtgtgaggtcttatcatgtgaccataatggtgggtcgccccggatcccgttcagcaccttccagtttctctacacgtatattgccaaagtggatggggagatctctgcatcacatgtcagcaggatgctaaactacatggaacaggaagtaattggccctgatggtataatcacagtgaatgactttacccaaaaccccagggttcagctggagtaaaagcacaattttggcaattttaaaggaagatacagagatgattgtacttcagaatgactgaaacccatataccacccaaaatcaattttcttgtacaactggtacacactaataaacaattaaacatatgagatcagaaa

SEQ ID NO: 17452 - DNA, 1190 bp, Homo sapiens
ctggcagcggagcccgcgcagggtttgccaggcgaaggcggagcgctaacgtctaacgctaacggcggtcgtgccccgccgctgctgtcacccccggccgctgctgccctccccgccgaggttctactgctctccttcttaagaagggtgggaggcactcggtctctccccacacctctcgcctgaggccaggcgccaggtgtcgcctgaagccagacagccggtttgggagcgagcctgagcaatttatctcaaagctgcaagttcctgccatctacatgtgcccagagtccccaaaattgagtgtcaaacagaggctgggtgacctcctgtccaggattgctctcatcgtatgaatcgaagttttcatcttaacgtgtttttttctcctgagaataggccaaccaatcaatggctcagacagataagccaacatgcatcccgccggagctgccgaagatgctgaaggagtttgccaaagccgccattagggtgcagccgcaggacctcatccagtgggcagccgattattttgaggccctgtcccgtggagagacgcctccggtgagagagcggtctgagcgagtcgctttgtgtaaccgggcagagctaacacctgagctgttaaagatcctgcattctcaggttgctggcagactgatcatccgtgcagaggagctggcccagatgtggaaagtggtgaatctcccaacagatctgtttaatagtgtgatgaatgtgggtcgcttcacggaggagatcgagtggctgaagtttttagcccttgcttgcagcgctctgggagttactattaccaaaactctcaagatagtgtgtgaggtcttatcatgtgaccataatggtgggtcgccccggatcccgttcagcaccttccagtttctctacacgtatattgccaaagtggatggggagatctctgcatcacatgtcagcaggatgctaaactacatggaacaggaagtaattggccctgatggtataatcacagtgaatgactttacccaaaaccccagggttcagctggagtaaaagcacaattttggcaattttaaaggaagatacagagatgattgtacttcagaatgactgaaacccatataccacccaaaatcaattttcttgtacaactggtacacactaataaacaattaaacatatgagatcagaaa

SEQ ID NO: 17453 - DNA, 1078 bp, Homo sapiens
ctggcagcggagcccgcgcagggtttgccaggcgaaggcggagcgctaacgtctaacgctaacggcggtcgtgccccgccgctgctgtcacccccggccgctgctgccctccccgccgaggttctactgctctccttcttaagaagggtgggaggcactcggtctctccccacacctctcgcctgaggccaggcgccaggtgtcgcctgaagccagacagccggtttgggagcgagcctgagcaatttatctcaaagctgcaagttcctgccatctacatgtgcccagccaaccaatcaatggctcagacagataagccaacatgcatcccgccggagctgccgaagatgctgaaggagtttgccaaagccgccattagggtgcagccgcaggacctcatccagtgggcagccgattattttgaggccctgtcccgtggagagacgcctccggtgagagagcggtctgagcgagtcgctttgtgtaaccgggcagagctaacacctgagctgttaaagatcctgcattctcaggttgctggcagactgatcatccgtgcagaggagctggcccagatgtggaaagtggtgaatctcccaacagatctgtttaatagtgtgatgaatgtgggtcgcttcacggaggagatcgagtggctgaagtttttagcccttgcttgcagcgctctgggagttactattaccaaaactctcaagatagtgtgtgaggtcttatcatgtgaccataatggtgggtcgccccggatcccgttcagcaccttccagtttctctacacgtatattgccaaagtggatggggagatctctgcatcacatgtcagcaggatgctaaactacatggaacaggaagtaattggccctgatggtataatcacagtgaatgactttacccaaaaccccagggttcagctggagtaaaagcacaattttggcaattttaaaggaagatacagagatgattgtacttcagaatgactgaaacccatataccacccaaaatcaattttcttgtacaactggtacacactaataaacaattaaacatatgagatcagaaa

SEQ ID NO: 17454 - DNA, 532 bp, Homo sapiens
acaggcatgagccaccgtgcccggcctcttcttttgtttttattctggagttacttttagtatgttacagctttgtaggggattacctatttcatttatgttttcaaatttattggcacaaagttgttcatagtattgccttattatttctgattctgtagaattgtctttataattttataatcagactatagtgtaatgtgtttaaaaatcaaagaaacaatacaattagcataataacataaactatgaagatggaatatgaccaaatacatctgcctggacacccagcgaaaagacataccttaaatatggtgacttggaacagctgaaaatcaaagaataagtgaaagcattaggcaagtgcaaacaaattaaagctactgttgtggcttaatattgaacacagatgtatttggggcaaaagccattaggattaaaaacattttataatgccaaagactaaaattcacaatgaaaatataagctatgaatatcaatgcattaagtcacgtagcaaaacttatatgga

SEQ ID NO: 17455 - DNA, 498 bp, Homo sapiens
gaagaaatccaggctcagaccgtcggagtccccacccatgagcacccttctccactgatcactcagaacatggtaggccctagagagacagcagcccgaatcttcccagaaaccctgcaggagattccttcttcccattttatagaagggaggctgaggctcggcacgttgaaatggcttgaccaaggtcccacaggcaaaaaaatggtacagcaagatattgtaacccaatatctggctgcaaaacccagtctctccccaacccacctatcgtcaccgagattgtaaaacttctaaccgggaagaatcaaatacatgcacaacgggttacaggttaacagacagatgggagcggaaagggacattccagcgcttccctgggcgtgtcgcacagggcaactccaaccacaggcgaattttcctgggtgacagttaaactcctttttgcatgaaaaaatacagattcttattaaaacaataatcgattagactataaaa

SEQ ID NO: 17456 - DNA, 380 bp, Homo sapiens
aataataatacccttgtgtcaggcttcctgtggtctagcactgtgtcccgtactttatagtttatttcctttaatactcatgcccatctagggtagtaggtaccatggttgttcccagttgatatatgacggaatcgaggcttagcagaataagaagtcacccaaactcatacccactggtcagcagtacagctagaattcaaagccacacttgtctaggtccaaaatctgcacccctaattaaccactcctggtaagaagctggttataagggctggtcaagtcagctatggaagaattctcagaaagtgactctaaaggtgttctttgaaggttgtgtaggaattcaccaaaactggaaggagacaggccttccttgc

SEQ ID NO: 17457 - DNA, 200 bp, Homo sapiens
catgggactaaagatttgagaatagggactgatttcagaaaggtgatttggggtgtcagttgcagtggctcacgcctgtattctcagagctttgagaggctgaggtgggaagatcacttgagcccaggagttcaaggttacaggaaactgtgattatgccactgcactccagtgtgggtgacacagtgagatgtggtctc

SEQ ID NO: 17458 - DNA, 338 bp, Homo sapiens
tatttaaagtttttgaattcattcaccaagttcttgaatctgttaaagaagatctttgatttgttcttaaatctaaccaagtagagagtaccatttgtttggggctccatgtctgtatggtgtaagtaatctttaaacaagcaaatatcacaaggtgctcacattttctaaacaggtatttgaccctgtattccagctgctaaaacatcaacattgtataaaaattatctgataaatagcatttctgttttcaaaagtcaaaaccaaattattgatatgctttacaatttaggggattaattcaggttgtgttttataaggtccaattttccaaatat

SEQ ID NO: 17459 - DNA, 554 bp, Homo sapiens
atagaacatttcttagtatattcgccatggagtaacctcttaaaaaatctgataaacaattttggcatttattcacctttctcccaagtggaattacaaacatttgaacttgatggactttcataattatctgatactagccatataaccttgaagaagcttctaagcctctctgtgcctcagtttctgcatctgtaaagatgataaccccaccttataggggaaatgcaaagattaaatgtgtcactgcacgtgagacaggtacatgcggagcactcagtgcttgttgattcttacgatgttacgttcaccattatggatattattcaaactgagactgtctgtgacaattactgttcagagttgtacagttgatttaggcagcaagtcttctggttcttaatccagtggtgtttttgtgcaattcagaagacatgtatgttgttcccagtaatgacttggtgtgtttgctgaggtagttcggtaggactgctagagctagccatgaaagcataatatattttcacagagttgagctcagttttcttctagaa

SEQ ID NO: 17460 - DNA, 441 bp, Homo sapiens
agacacacccaaaaaaaaaaaaacaaaacccaagcaaggtacacaccagggcagcttcagacacagccctctctagaggcttcagaagtgtaaactgcctgctgcaagggaatttaactcataattaaaaaaaaaaaaaaaaaggcaaggtgcccagggtggctcaaacctggaatcccagcactttgagcagctgaagcaggaggactgcctaaccctacgagttcaaaatcagtctgggcaatatagcaagatcctgtctctacgaaaaaaccaaaccaaaaccaaaaaaactagccaggtgtggtggtgcacctgtagtcccagctactcggcagaatgaagcgggacgatcgcctgagcccaggaggtcgaggctgcagcgagctatgactgcaccactgcactccagcctgggaaacagagcgagactctgtctca

SEQ ID NO: 17461 - DNA, 5398 bp, Homo sapiens
tgctccggctacttagagtcgtcggcgcggcggtgggaaagcagagccgagccgggactgtccagtgggagcaggcgccccggccagcgcagacctggaggcgcacgggcgccgcaccgcacgattcggctcggggtagagcggagccgcagccccacgcgcagcccaggacccactcgccaccgccgcttcctcagcacccatggggaccaggagactttaaaggagtttggggtttcgggagcagggaaatcacggatccccgctcctggccctcgcctcgccacctcattgatgggcaaccaactggaccgcatcacccacctcaactacagcgagttgcccacaggggacccgtcggggattgaaaaggacgaactgcgggtcggggttgcctacttcttctcggatgatgaggaagacctggacgaacgcgggcagcccgacaagtttggcgtgaaggcccccccgggttgcaccccctgcccggagagccccagccgccaccaccaccacctgctgcaccagctggtcctcaacgagactcagttttccgcctttcggggccaggaatgcatcttttccaaagtgagcggtggccctcagggcgccgacctaagcgtctacgcggtcaccgcgctgccagcgctctgcgaacccggcgacctgctggagctgctgtggctgcagcccgcgccggagccgcccgcgcccgccccgcactgggccgtctacgtgggcggcgggcagatcatccacctgcaccaaggcgagatccgccaggacagcctgtatgaggcgggcgcggccaacgtgggccgggtggtgaatagctggtaccgctaccgcccgctggtggccgagctggtggtgcagaacgcctgcggccacctgggcctcaagagcgaggagatctgctggacgaactcggagagcttcgccgcctggtgccgctttggcaagcgggagttcaaggcgggaggggaggtgccggcaggcacgcagcccccgcagcagcagtactatctcaaggtgcacctgggagagaacaaggtccacaccgccaggtttcacagcctggaagacctcatccgcgagaagcgccgtatcgacgccagcggccgcctgcgagtgctccaggagctcgccgacctcgtggacgacaaggagtagccgcctaggggctgccggcccctctgcctcccccgcacctcgctcccttcccttccccgcacccggacttcgcagtcagcggttctcaacctctgccccgccccgccacgcgcgtccgccgccggtggcccgggcccgggctgcacccccgcatccccaagccagcggcaggaagtctcaggaactgccccagggccgaaagggcgccgctgcgagcgcctggctgacagccacagcggtggtgacggtgctgggagaccccgcgtgcgctttccccttgagatgtaaaccgggaacggggaaggggctgaggggagaaaggacatggccttccccgcgagtccatggccagtgactgtggcccgactcgaaaacaaccctcttctcaaaagggaccatcaccgccccgagcgtgcgcacacagaccggtcggaggcgagaactggtctctacagggcacagttcagctcctctgtggatgcgtccccagatcgcaggatttccaagaaatcgagcctgtcccttgtgcacttgggaataattccccaagacagcacttcgggattccgggttatcctgaggctgcccgggacttttccagctctccagccccaggtctcctgacattgtgttccaggctgcgggctaagccagacagtgttgcctccggttctttccaccgtgggaagcgaacgccacccccacccgcctttgcctgcgagtctccctcgctggcagaagggaagccggcccggtcccgggaggaagatggcgctgcgaattcggtgaggacagccggccccgcccccgacaaggagctcgctcgttcacctggtgtctgggaacttgaatgtgtgaagggcgcttattgttctgaacccttgattgctccctcctcgggctgcatttcaaaaatagtcatatttttaaaggagttggaggagagggagggggaggacatggcaccattccagaaaccagcattgttacaacaccatagccagtatatttagtttggcttttcctaacatagaaatcttcaaagctggggaagtggaaataaagttttaaaaatgagagagcagttttccaactatgtcaacaaagcctatcgtgttgatgtttttattgaccattttagcaacaggctaataaaatttcaaattgaaatttttattttcatggctttaatccatgatagtttaaatactgggggccattaagagtggatgtagctaagagcttagctaacattgccttttcactctatttttctcagatattgtaagcattctgtttttcaatattgtagttaattttttggctttcaacagcagccctagtaatggtggagttgttaattaatgtgtatattgtactgaatttctgtcagttaaggggttcactgctttggtggaaattggtggaaattgctagcaggttccacgatgtttatttttttctccatgttgtatatcattaccatttcacatacgcgtttctatttttcttcctctcctcctgatctccttaaaaatgaatctagagttggtggctttttccccctcctctttggccagttccacagttcagttcttcctgaaaacagggatgatgaacttgtaggatcaggacaaatgtgtgtttttcaaaaacttaaggctgggtgtgaaacaccttctgtggacaaggatttgtaaacttctctcctccctccagctgcggccccagcctaactgatagttacttgattcagtgtgctagacacttaaatagcatctatgtctctttcaagggaatttgtcaaataatgctgtttagctaattgttgcaagcaattgcatattaacagctgtgattttgttggacagcaagtattatggccaaagccagtttcttggcatttcaaaaataatgcaataaaaactagttgaggttagctgaggctggaaatgcctttttcatggtaaatgattcacttctatatttttctttctttttctttttttttctttggttttcatcctggattcatcccctgatcttaaatcaaaacgtcagatcaatgaactatgaactaaagtatttttcttaagcctattgagtgatttattttttaaaaaatgtttaaatgcatatgcttttctttcagcacaaacaacagcaaaaacttttgtaataactaacttacctttgcatgtatgaagaactgagtcatttatttccctaacttactcctctttcaagtaacaggtggcagatcataaaatgaattctttattgtatctacacactccacattctttactgtgtcctactactgtatcttggctccctgctgtattaaacaccatcttaagcacttgttcctgcaggactccttcttgacattttgtctcccccttcaaagtcactcaaagagtgggacttcatcaaaagaaatgaattagtctctatcacaccgaatactaagatttatttcctctgatggtacatagatttctctctcactaagagggtcactctcatagaggaatgtcttgtcagttttatacttgctgaggctagactgacaataaaaatgagctgggcagttaaattagcatttgttactatattggcctataaaggatcaggttgatgataatacctctaaaaatatgcaataataaaacaatagttatgaaagaaacttgaaaggtttgcaaggtttctcctatccctgttaaaattatcatttattatctctttgtcagtgttagtaaggtaacccatgacagaataatttgagtgatagttcatcatgcagaggatatgatcaagatattacctaatggttttatcctgaaaaaggtgtatacttttagggcactgttaacaatgcgagtgaaaccaagatggtgcaagttccctttgcagatggcgtgggcacacttgatttttattatgagtgaatgtaatctttctgtattttaccagagttacagcaattacctgaaaagtttcctaacattttaataatgttagggatttcgttttggttttagttgtcctcaagagacaacaggttcacagtaatttccatgatgttgggtgtggctaagctggggattggttctgttccccctgctcccgtgtagagaaaagctatatttatactgcattctttctcaactttcaggtaaaacaaactatgatttaaaaaaagaaaaaagaaaagacaggtacttttacttcaaagagtgctttgctacatttttatttaaaccaaaaatcaaataaaataaggaggggggctgggtatactttaaacaaaaccagtcctgaaatgctgttattctcaaagtacattccaaaaaaaaaaaaaaaaaaaaaacttattagaaatttcccgttgtgtgttcccatttttaaagttatgtgagttaaatgtgggattattaagggtgttccctcaattttttaattatgtgttaagccgtggtggttcatgttggaccaggttattttttctatagacaaattagattaccgcgttattatttattacgtctatccgaaaacacacgtgttgttgcccagtatttagaaaaccattcagagcacagaaagccagctgtgttttgatttacccgtgttttttgtggaaccccttcaagtgtttaaccctttccccttattgtttttaattttttctctttggggcggtgaaccaccttttttgtgtttaagacaccatgggctttttttataaatttttctctcttgggcgaaacaacattttcgcttattaaagctttttctttcccacacaattaccttttattatcccttgaaattacaggcaggtattattccttaaaaaggtttttttcaaaaacatttacttttcattggactaacacttattgtttgaggggggacgcgctttttcaaaacatctccctataagaagtttaaatgtgttcttaaggccaatctctataattacctggggaaccaggggtctcaaacctttcacgtgaaactttaaatcctttatggcgccaatcattaatttttgggcacccctaagttttcttctaaatacaatataggccattatctttaacgagcttccatcccctcttttttggaccaatttgaagaaaaactccagaatagtattgcgccttcagaaggctaatttgccccggttcacacaggggtcctgtaggtgacaacc

SEQ ID NO: 17462 - DNA, 5641 bp, Homo sapiens
tgctccggctacttagagtcgtcggcgcggcggtgggaaagcagagccgagccgggactgtccagtgggagcaggcgccccggccagcgcagacctggaggcgcacgggcgccgcaccgcacgattcggctcggggtagagcggagccgcagccccacgcgcagcccaggacccactcgccaccgccgcttcctcagcacccatggggaccaggagactttaaaggagtttggggtttcgggagcagggaaatcacggcccacccctcggtccttcctgggtgtccgtctcccacactgccacagccagcactctcctccccaccgggaccccgcaagctctccagccagcctgggtgttttcttctgggagttggaccgagttcccggaaggggtcggaggctgtgtggtggcgtctgctctcgcctgacctgtggcggcttctccgcccctcgtacccctggggaggcacggaggactcggctggaaagggtgactccgatccccgctcctggccctcgcctcgccacctcattgatgggcaaccaactggaccgcatcacccacctcaactacagcgagttgcccacaggggacccgtcggggattgaaaaggacgaactgcgggtcggggttgcctacttcttctcggatgatgaggaagacctggacgaacgcgggcagcccgacaagtttggcgtgaaggcccccccgggttgcaccccctgcccggagagccccagccgccaccaccaccacctgctgcaccagctggtcctcaacgagactcagttttccgcctttcggggccaggaatgcatcttttccaaagtgagcggtggccctcagggcgccgacctaagcgtctacgcggtcaccgcgctgccagcgctctgcgaacccggcgacctgctggagctgctgtggctgcagcccgcgccggagccgcccgcgcccgccccgcactgggccgtctacgtgggcggcgggcagatcatccacctgcaccaaggcgagatccgccaggacagcctgtatgaggcgggcgcggccaacgtgggccgggtggtgaatagctggtaccgctaccgcccgctggtggccgagctggtggtgcagaacgcctgcggccacctgggcctcaagagcgaggagatctgctggacgaactcggagagcttcgccgcctggtgccgctttggcaagcgggagttcaaggcgggaggggaggtgccggcaggcacgcagcccccgcagcagcagtactatctcaaggtgcacctgggagagaacaaggtccacaccgccaggtttcacagcctggaagacctcatccgcgagaagcgccgtatcgacgccagcggccgcctgcgagtgctccaggagctcgccgacctcgtggacgacaaggagtagccgcctaggggctgccggcccctctgcctcccccgcacctcgctcccttcccttccccgcacccggacttcgcagtcagcggttctcaacctctgccccgccccgccacgcgcgtccgccgccggtggcccgggcccgggctgcacccccgcatccccaagccagcggcaggaagtctcaggaactgccccagggccgaaagggcgccgctgcgagcgcctggctgacagccacagcggtggtgacggtgctgggagaccccgcgtgcgctttccccttgagatgtaaaccgggaacggggaaggggctgaggggagaaaggacatggccttccccgcgagtccatggccagtgactgtggcccgactcgaaaacaaccctcttctcaaaagggaccatcaccgccccgagcgtgcgcacacagaccggtcggaggcgagaactggtctctacagggcacagttcagctcctctgtggatgcgtccccagatcgcaggatttccaagaaatcgagcctgtcccttgtgcacttgggaataattccccaagacagcacttcgggattccgggttatcctgaggctgcccgggacttttccagctctccagccccaggtctcctgacattgtgttccaggctgcgggctaagccagacagtgttgcctccggttctttccaccgtgggaagcgaacgccacccccacccgcctttgcctgcgagtctccctcgctggcagaagggaagccggcccggtcccgggaggaagatggcgctgcgaattcggtgaggacagccggccccgcccccgacaaggagctcgctcgttcacctggtgtctgggaacttgaatgtgtgaagggcgcttattgttctgaacccttgattgctccctcctcgggctgcatttcaaaaatagtcatatttttaaaggagttggaggagagggagggggaggacatggcaccattccagaaaccagcattgttacaacaccatagccagtatatttagtttggcttttcctaacatagaaatcttcaaagctggggaagtggaaataaagttttaaaaatgagagagcagttttccaactatgtcaacaaagcctatcgtgttgatgtttttattgaccattttagcaacaggctaataaaatttcaaattgaaatttttattttcatggctttaatccatgatagtttaaatactgggggccattaagagtggatgtagctaagagcttagctaacattgccttttcactctatttttctcagatattgtaagcattctgtttttcaatattgtagttaattttttggctttcaacagcagccctagtaatggtggagttgttaattaatgtgtatattgtactgaatttctgtcagttaaggggttcactgctttggtggaaattggtggaaattgctagcaggttccacgatgtttatttttttctccatgttgtatatcattaccatttcacatacgcgtttctatttttcttcctctcctcctgatctccttaaaaatgaatctagagttggtggctttttccccctcctctttggccagttccacagttcagttcttcctgaaaacagggatgatgaacttgtaggatcaggacaaatgtgtgtttttcaaaaacttaaggctgggtgtgaaacaccttctgtggacaaggatttgtaaacttctctcctccctccagctgcggccccagcctaactgatagttacttgattcagtgtgctagacacttaaatagcatctatgtctctttcaagggaatttgtcaaataatgctgtttagctaattgttgcaagcaattgcatattaacagctgtgattttgttggacagcaagtattatggccaaagccagtttcttggcatttcaaaaataatgcaataaaaactagttgaggttagctgaggctggaaatgcctttttcatggtaaatgattcacttctatatttttctttctttttctttttttttctttggttttcatcctggattcatcccctgatcttaaatcaaaacgtcagatcaatgaactatgaactaaagtatttttcttaagcctattgagtgatttattttttaaaaaatgtttaaatgcatatgcttttctttcagcacaaacaacagcaaaaacttttgtaataactaacttacctttgcatgtatgaagaactgagtcatttatttccctaacttactcctctttcaagtaacaggtggcagatcataaaatgaattctttattgtatctacacactccacattctttactgtgtcctactactgtatcttggctccctgctgtattaaacaccatcttaagcacttgttcctgcaggactccttcttgacattttgtctcccccttcaaagtcactcaaagagtgggacttcatcaaaagaaatgaattagtctctatcacaccgaatactaagatttatttcctctgatggtacatagatttctctctcactaagagggtcactctcatagaggaatgtcttgtcagttttatacttgctgaggctagactgacaataaaaatgagctgggcagttaaattagcatttgttactatattggcctataaaggatcaggttgatgataatacctctaaaaatatgcaataataaaacaatagttatgaaagaaacttgaaaggtttgcaaggtttctcctatccctgttaaaattatcatttattatctctttgtcagtgttagtaaggtaacccatgacagaataatttgagtgatagttcatcatgcagaggatatgatcaagatattacctaatggttttatcctgaaaaaggtgtatacttttagggcactgttaacaatgcgagtgaaaccaagatggtgcaagttccctttgcagatggcgtgggcacacttgatttttattatgagtgaatgtaatctttctgtattttaccagagttacagcaattacctgaaaagtttcctaacattttaataatgttagggatttcgttttggttttagttgtcctcaagagacaacaggttcacagtaatttccatgatgttgggtgtggctaagctggggattggttctgttccccctgctcccgtgtagagaaaagctatatttatactgcattctttctcaactttcaggtaaaacaaactatgatttaaaaaaagaaaaaagaaaagacaggtacttttacttcaaagagtgctttgctacatttttatttaaaccaaaaatcaaataaaataaggaggggggctgggtatactttaaacaaaaccagtcctgaaatgctgttattctcaaagtacattccaaaaaaaaaaaaaaaaaaaaaacttattagaaatttcccgttgtgtgttcccatttttaaagttatgtgagttaaatgtgggattattaagggtgttccctcaattttttaattatgtgttaagccgtggtggttcatgttggaccaggttattttttctatagacaaattagattaccgcgttattatttattacgtctatccgaaaacacacgtgttgttgcccagtatttagaaaaccattcagagcacagaaagccagctgtgttttgatttacccgtgttttttgtggaaccccttcaagtgtttaaccctttccccttattgtttttaattttttctctttggggcggtgaaccaccttttttgtgtttaagacaccatgggctttttttataaatttttctctcttgggcgaaacaacattttcgcttattaaagctttttctttcccacacaattaccttttattatcccttgaaattacaggcaggtattattccttaaaaaggtttttttcaaaaacatttacttttcattggactaacacttattgtttgaggggggacgcgctttttcaaaacatctccctataagaagtttaaatgtgttcttaaggccaatctctataattacctggggaaccaggggtctcaaacctttcacgtgaaactttaaatcctttatggcgccaatcattaatttttgggcacccctaagttttcttctaaatacaatataggccattatctttaacgagcttccatcccctcttttttggaccaatttgaagaaaaactccagaatagtattgcgccttcagaaggctaatttgccccggttcacacaggggtcctgtaggtgacaacc

SEQ ID NO: 17463 - DNA, 4658 bp, Homo sapiens
  misc_feature (8)..(8): n is a, c, g, or t
  misc_feature (11)..(11): n is a, c, g, or t
  misc_feature (30)..(30): n is a, c, g, or t
tttgacgnatnataatacgcgcgattgggnaccgggccccttttgaccccgcgtccgggcgggcgcggccaacgtgggccgggtggtgaatagctggtaccgctaccgcccgctggtggccgagctggtggtgcagaacgcctgcggccacctgggcctcaagagcgaggagatctgctggacgaactcggagagcttcgccgcctggtgccgctttggcaagcgggagttcaaggcgggaggggaggtgccggcaggcacgcagcccccgcagcagcagtactatctcaaggtgcacctgggagagaacaaggtccacaccgccaggtttcacagcctggaagacctcatccgcgagaagcgccgtatcgacgccagcggccgcctgcgagtgctccaggagctcgccgacctcgtggacgacaaggagtagccgcctaggggctgccggcccctctgcctcccccgcacctcgctcccttcccttccccgcacccggacttcgcagtcagcggttctcaacctctgccccgccccgccacgcgcgtccgccgccggtggcccgggcccgggctgcacccccgcatccccaagccagcggcaggaagtctcaggaactgccccagggccgaaagggcgccgctgcgagcgcctggctgacagccacagcggtggtgacggtgctgggagaccccgcgtgcgctttccccttgagatgtaaaccgggaacggggaaggggctgaggggagaaaggacatggccttccccgcgagtccatggccagtgactgtggcccgactcgaaaacaaccctcttctcaaaagggaccatcaccgccccgagcgtgcgcacacagaccggtcggaggcgagaactggtctctacagggcacagttcagctcctctgtggatgcgtccccagatcgcaggatttccaagaaatcgagcctgtcccttgtgcacttgggaataattccccaagacagcacttcgggattccgggttatcctgaggctgcccgggacttttccagctctccagccccaggtctcctgacattgtgttccaggctgcgggctaagccagacagtgttgcctccggttctttccaccgtgggaagcgaacgccacccccacccgcctttgcctgcgagtctccctcgctggcagaagggaagccggcccggtcccgggaggaagatggcgctgcgaattcggtgaggacagccggccccgcccccgacaaggagctcgctcgttcacctggtgtctgggaacttgaatgtgtgaagggcgcttattgttctgaacccttgattgctccctcctcgggctgcatttcaaaaatagtcatatttttaaaggagttggaggagagggagggggaggacatggcaccattccagaaaccagcattgttacaacaccatagccagtatatttagtttggcttttcctaacatagaaatcttcaaagctggggaagtggaaataaagttttaaaaatgagagagcagttttccaactatgtcaacaaagcctatcgtgttgatgtttttattgaccattttagcaacaggctaataaaatttcaaattgaaatttttattttcatggctttaatccatgatagtttaaatactgggggccattaagagtggatgtagctaagagcttagctaacattgccttttcactctatttttctcagatattgtaagcattctgtttttcaatattgtagttaattttttggctttcaacagcagccctagtaatggtggagttgttaattaatgtgtatattgtactgaatttctgtcagttaaggggttcactgctttggtggaaattggtggaaattgctagcaggttccacgatgtttatttttttctccatgttgtatatcattaccatttcacatacgcgtttctatttttcttcctctcctcctgatctccttaaaaatgaatctagagttggtggctttttccccctcctctttggccagttccacagttcagttcttcctgaaaacagggatgatgaacttgtaggatcaggacaaatgtgtgtttttcaaaaacttaaggctgggtgtgaaacaccttctgtggacaaggatttgtaaacttctctcctccctccagctgcggccccagcctaactgatagttacttgattcagtgtgctagacacttaaatagcatctatgtctctttcaagggaatttgtcaaataatgctgtttagctaattgttgcaagcaattgcatattaacagctgtgattttgttggacagcaagtattatggccaaagccagtttcttggcatttcaaaaataatgcaataaaaactagttgaggttagctgaggctggaaatgcctttttcatggtaaatgattcacttctatatttttctttctttttctttttttttctttggttttcatcctggattcatcccctgatcttaaatcaaaacgtcagatcaatgaactatgaactaaagtatttttcttaagcctattgagtgatttattttttaaaaaatgtttaaatgcatatgcttttctttcagcacaaacaacagcaaaaacttttgtaataactaacttacctttgcatgtatgaagaactgagtcatttatttccctaacttactcctctttcaagtaacaggtggcagatcataaaatgaattctttattgtatctacacactccacattctttactgtgtcctactactgtatcttggctccctgctgtattaaacaccatcttaagcacttgttcctgcaggactccttcttgacattttgtctcccccttcaaagtcactcaaagagtgggacttcatcaaaagaaatgaattagtctctatcacaccgaatactaagatttatttcctctgatggtacatagatttctctctcactaagagggtcactctcatagaggaatgtcttgtcagttttatacttgctgaggctagactgacaataaaaatgagctgggcagttaaattagcatttgttactatattggcctataaaggatcaggttgatgataatacctctaaaaatatgcaataataaaacaatagttatgaaagaaacttgaaaggtttgcaaggtttctcctatccctgttaaaattatcatttattatctctttgtcagtgttagtaaggtaacccatgacagaataatttgagtgatagttcatcatgcagaggatatgatcaagatattacctaatggttttatcctgaaaaaggtgtatacttttagggcactgttaacaatgcgagtgaaaccaagatggtgcaagttccctttgcagatggcgtgggcacacttgatttttattatgagtgaatgtaatctttctgtattttaccagagttacagcaattacctgaaaagtttcctaacattttaataatgttagggatttcgttttggttttagttgtcctcaagagacaacaggttcacagtaatttccatgatgttgggtgtggctaagctggggattggttctgttccccctgctcccgtgtagagaaaagctatatttatactgcattctttctcaactttcaggtaaaacaaactatgatttaaaaaaagaaaaaagaaaagacaggtacttttacttcaaagagtgctttgctacatttttatttaaaccaaaaatcaaataaaataaggaggggggctgggtatactttaaacaaaaccagtcctgaaatgctgttattctcaaagtacattccaaaaaaaaaaaaaaaaaaaaaacttattagaaatttcccgttgtgtgttcccatttttaaagttatgtgagttaaatgtgggattattaagggtgttccctcaattttttaattatgtgttaagccgtggtggttcatgttggaccaggttattttttctatagacaaattagattaccgcgttattatttattacgtctatccgaaaacacacgtgttgttgcccagtatttagaaaaccattcagagcacagaaagccagctgtgttttgatttacccgtgttttttgtggaaccccttcaagtgtttaaccctttccccttattgtttttaattttttctctttggggcggtgaaccaccttttttgtgtttaagacaccatgggctttttttataaatttttctctcttgggcgaaacaacattttcgcttattaaagctttttctttcccacacaattaccttttattatcccttgaaattacaggcaggtattattccttaaaaaggtttttttcaaaaacatttacttttcattggactaacacttattgtttgaggggggacgcgctttttcaaaacatctccctataagaagtttaaatgtgttcttaaggccaatctctataattacctggggaaccaggggtctcaaacctttcacgtgaaactttaaatcctttatggcgccaatcattaatttttgggcacccctaagttttcttctaaatacaatataggccattatctttaacgagcttccatcccctcttttttggaccaatttgaagaaaaactccagaatagtattgcgccttcagaaggctaatttgccccggttcacacaggggtcctgtaggtgacaacc

SEQ ID NO: 17464 - DNA, 2323 bp, Homo sapiens
tgctccggctacttagagtcgtcggcgcggcggtgggaaagcagagccgagccgggactgtccagtgggagcaggcgccccggccagcgcagacctggaggcgcacgggcgccgcaccgcacgattcggctcggggtagagcggagccgcagccccacgcgcagcccaggacccactcgccaccgccgcttcctcagcacccatggggaccaggagactttaaaggagtttggggtttcgggagcagggaaatcacggatccccgctcctggccctcgcctcgccacctcattgatgggcaaccaactggaccgcatcacccacctcaactacagcgagttgcccacaggggacccgtcggggattgaaaaggacgaactgcgggtcggggttgcctacttcttctcggatgatgaggaagacctggacgaacgcgggcagcccgacaagtttggcgtgaaggcccccccgggttgcaccccctgcccggagagccccagccgccaccaccaccacctgctgcaccagctggtcctcaacgagactcagttttccgcctttcggggccaggaatgcatcttttccaaagtgagcggtggccctcagggcgccgacctaagcgtctacgcggtcaccgcgctgccagcgctctgcgaacccggcgacctgctggagctgctgtggctgcagcccgcgccggagccgcccgcgcccgccccgcactgggccgtctacgtgggcggcgggcagatcatccacctgcaccaaggcgagatccgccaggacagcctgtatgaggcgggcgcggccaacgtgggccgggtggtgaatagctggtaccgctaccgcccgctggtggccgagctggtggtgcagaacgcctgcggccacctgggcctcaagagcgaggagatctgctggacgaactcggagagcttcgccgcctggtgccgctttggcaagcgggagttcaaggcgggaggggaggtgccggcaggcacgcagcccccgcagcagcagtactatctcaaggtgcacctgggagagaacaaggtccacaccgccaggtttcacagcctggaagacctcatccgcgagaagcgccgtatcgacgccagcggccgcctgcgagtgctccaggagctcgccgacctcgtggacgacaaggagtagccgcctaggggctgccggcccctctgcctcccccgcacctcgctcccttcccttccccgcacccggacttcgcagtcagcggttctcaacctctgccccgccccgccacgcgcgtccgccgccggtggcccgggcccgggctgcacccccgcatccccaagccagcggcaggaagtctcaggaactgccccagggccgaaagggcgccgctgcgagcgcctggctgacagccacagcggtggtgacggtgctgggagaccccgcgtgcgctttccccttgagatgtaaaccgggaacggggaaggggctgaggggagaaaggacatggccttccccgcgagtccatggccagtgactgtggcccgactcgaaaacaaccctcttctcaaaagggaccatcaccgccccgagcgtgcgcacacagaccggtcggaggcgagaactggtctctacagggcacagttcagctcctctgtggatgcgtccccagatcgcaggatttccaagaaatcgagcctgtcccttgtgcacttgggaataattccccaagacagcacttcgggattccgggttatcctgaggctgcccgggacttttccagctctccagccccaggtctcctgacattgtgttccaggctgcgggctaagccagacagtgttgcctccggttctttccaccgtgggaagcgaacgccacccccacccgcctttgcctgcgagtctccctcgctggcagaagggaagccggcccggtcccgggaggaagatggcgctgcgaattcggtgaggacagccggccccgcccccgacaaggagctcgctcgttcacctggtgtctgggaacttgaatgtgtgaagggcgcttattgttctgaacccttgattgctccctcctcgggctgcatttcaaaaatagtcatatttttaaaggagttggaggagagggagggggaggacatggcaccattccagaaaccagcattgttacaacaccatagccagtatatttagtttggcttttcctaacatagaaatcttcaaagctggggaagtggaaataaagttttaaaaatgagagagcagtttcaacattgtcacaagcattcggtgagttatgacattagcacgctataattcaatgattatca

SEQ ID NO: 17465 - DNA, 2590 bp, Homo sapiens
aaatcatagtttgttttacctgaaagttgaggaagaatgcagtataaatatagcttttctctacacgggagcagggggaacagaaccaatccccagcctaactgatagttacttgattcagtgtgctagacacttaaatagcatctatgtctctttcaagggaatttgtcaaataatgctgtttagctaattgttgcaagcaattgcatattaacagctgtgattttgttggacagcaagtattatggccaaagccagtttcttggcatttcaaaaataatgcaataaaaactagttgaggttagctgaggctggaaatgcctttttcatggtaaatgattcacttctatatttttctttctttttctttttttttctttggttttcatcctggattcatcccctgatcttaaatcaaaacgtcagatcaatgaactatgaactaaagtatttttcttaagcctattgagtgatttattttttaaaaaatgtttaaatgcatatgcttttctttcagcacaaacaacagcaaaaacttttgtaataactaacttacctttgcatgtatgaagaactgagtcatttatttccctaacttactcctctttcaagtaacaggtggcagatcataaaatgaattctttattgtatctacacactccacattctttactgtgtcctactactgtatcttggctccctgctgtattaaacaccatcttaagcacttgttcctgcaggactccttcttgacattttgtctcccccttcaaagtcactcaaagagtgggacttcatcaaaagaaatgaattagtctctatcacaccgaatactaagatttatttcctctgatggtacatagatttctctctcactaagagggtcactctcatagaggaatgtcttgtcagttttatacttgctgaggctagactgacaataaaaatgagctgggcagttaaattagcatttgttactatattggcctataaaggatcaggttgatgataatacctctaaaaatatgcaataataaaacaatagttatgaaagaaacttgaaaggtttgcaaggtttctcctatccctgttaaaattatcatttattatctctttgtcagtgttagtaaggtaacccatgacagaataatttgagtgatagttcatcatgcagaggatatgatcaagatattacctaatggttttatcctgaaaaaggtgtatacttttagggcactgttaacaatgcgagtgaaaccaagatggtgcaagttccctttgcagatggcgtgggcacacttgatttttattatgagtgaatgtaatctttctgtattttaccagagttacagcaattacctgaaaagtttcctaacattttaataatgttagggatttcgttttggttttagttgtcctcaagagacaacaggttcacagtaatttccatgatgttgggtgtggctaagctggggattggttctgttccccctgctcccgtgtagagaaaagctatatttatactgcattctttctcaactttcaggtaaaacaaactatgatttaaaaaaagaaaaaagaaaagacaggtacttttacttcaaagagtgctttgctacatttttatttaaaccaaaaatcaaataaaataaggaggggggctgggtatactttaaacaaaaccagtcctgaaatgctgttattctcaaagtacattccaaaaaaaaaaaaaaaaaaaaaacttattagaaatttcccgttgtgtgttcccatttttaaagttatgtgagttaaatgtgggattattaagggtgttccctcaattttttaattatgtgttaagccgtggtggttcatgttggaccaggttattttttctatagacaaattagattaccgcgttattatttattacgtctatccgaaaacacacgtgttgttgcccagtatttagaaaaccattcagagcacagaaagccagctgtgttttgatttacccgtgttttttgtggaaccccttcaagtgtttaaccctttccccttattgtttttaattttttctctttggggcggtgaaccaccttttttgtgtttaagacaccatgggctttttttataaatttttctctcttgggcgaaacaacattttcgcttattaaagctttttctttcccacacaattaccttttattatcccttgaaattacaggcaggtattattccttaaaaaggtttttttcaaaaacatttacttttcattggactaacacttattgtttgaggggggacgcgctttttcaaaacatctccctataagaagtttaaatgtgttcttaaggccaatctctataattacctggggaaccaggggtctcaaacctttcacgtgaaactttaaatcctttatggcgccaatcattaatttttgggcacccctaagttttcttctaaatacaatataggccattatctttaacgagcttccatcccctcttttttggaccaatttgaagaaaaactccagaatagtattgcgccttcagaaggctaatttgccccggttcacacaggggtcctgtaggtgacaacc

SEQ ID NO: 17466 - DNA, 2655 bp, Homo sapiens
gttggaaccgtgcgacctttatacaggaaacagtatacggtatgattgggtagaacgatcaggacaaatgtgtgtttttcaaaaacttaaggctgggtgtgaaacaccttctgtggacaaggatttgtaaacttctctcctccctccagctgcggccccagcctaactgatagttacttgattcagtgtgctagacacttaaatagcatctatgtctctttcaagggaatttgtcaaataatgctgtttagctaattgttgcaagcaattgcatattaacagctgtgattttgttggacagcaagtattatggccaaagccagtttcttggcatttcaaaaataatgcaataaaaactagttgaggttagctgaggctggaaatgcctttttcatggtaaatgattcacttctatatttttctttctttttctttttttttctttggttttcatcctggattcatcccctgatcttaaatcaaaacgtcagatcaatgaactatgaactaaagtatttttcttaagcctattgagtgatttattttttaaaaaatgtttaaatgcatatgcttttctttcagcacaaacaacagcaaaaacttttgtaataactaacttacctttgcatgtatgaagaactgagtcatttatttccctaacttactcctctttcaagtaacaggtggcagatcataaaatgaattctttattgtatctacacactccacattctttactgtgtcctactactgtatcttggctccctgctgtattaaacaccatcttaagcacttgttcctgcaggactccttcttgacattttgtctcccccttcaaagtcactcaaagagtgggacttcatcaaaagaaatgaattagtctctatcacaccgaatactaagatttatttcctctgatggtacatagatttctctctcactaagagggtcactctcatagaggaatgtcttgtcagttttatacttgctgaggctagactgacaataaaaatgagctgggcagttaaattagcatttgttactatattggcctataaaggatcaggttgatgataatacctctaaaaatatgcaataataaaacaatagttatgaaagaaacttgaaaggtttgcaaggtttctcctatccctgttaaaattatcatttattatctctttgtcagtgttagtaaggtaacccatgacagaataatttgagtgatagttcatcatgcagaggatatgatcaagatattacctaatggttttatcctgaaaaaggtgtatacttttagggcactgttaacaatgcgagtgaaaccaagatggtgcaagttccctttgcagatggcgtgggcacacttgatttttattatgagtgaatgtaatctttctgtattttaccagagttacagcaattacctgaaaagtttcctaacattttaataatgttagggatttcgttttggttttagttgtcctcaagagacaacaggttcacagtaatttccatgatgttgggtgtggctaagctggggattggttctgttccccctgctcccgtgtagagaaaagctatatttatactgcattctttctcaactttcaggtaaaacaaactatgatttaaaaaaagaaaaaagaaaagacaggtacttttacttcaaagagtgctttgctacatttttatttaaaccaaaaatcaaataaaataaggaggggggctgggtatactttaaacaaaaccagtcctgaaatgctgttattctcaaagtacattccaaaaaaaaaaaaaaaaaaaaaacttattagaaatttcccgttgtgtgttcccatttttaaagttatgtgagttaaatgtgggattattaagggtgttccctcaattttttaattatgtgttaagccgtggtggttcatgttggaccaggttattttttctatagacaaattagattaccgcgttattatttattacgtctatccgaaaacacacgtgttgttgcccagtatttagaaaaccattcagagcacagaaagccagctgtgttttgatttacccgtgttttttgtggaaccccttcaagtgtttaaccctttccccttattgtttttaattttttctctttggggcggtgaaccaccttttttgtgtttaagacaccatgggctttttttataaatttttctctcttgggcgaaacaacattttcgcttattaaagctttttctttcccacacaattaccttttattatcccttgaaattacaggcaggtattattccttaaaaaggtttttttcaaaaacatttacttttcattggactaacacttattgtttgaggggggacgcgctttttcaaaacatctccctataagaagtttaaatgtgttcttaaggccaatctctataattacctggggaaccaggggtctcaaacctttcacgtgaaactttaaatcctttatggcgccaatcattaatttttgggcacccctaagttttcttctaaatacaatataggccattatctttaacgagcttccatcccctcttttttggaccaatttgaagaaaaactccagaatagtattgcgccttcagaaggctaatttgccccggttcacacaggggtcctgtaggtgacaacc

SEQ ID NO: 17467 - DNA, 495 bp, Homo sapiens
ttctgggagttggaccgagttcccggaaggggtcggaggctgtgtggtggcgtctgctctcgcctgacctgtggcggcttctccgcccctcgtacccctggggaggcacggaggactcggctggaaagggtgactccggtgagggcacgtaagctagccggcaggtcccaggggcactgcacgtcttggggagggacaccgaaaggggcagcccggactctgacggtgtctctgcctctctgtgcctccgcagatccccgctcctggccctcgcctcgccacctcattgatgggcaaccaactggaccgcatcacccacctcaactacagcgagttgcccacaggggacccgtcggggattgaaaaggacgaactgcgggtcggggttgcctacttcttctcggatgatgaggaagacctggacgaacgcgggcagcccgacaagtttggcgtgaaggcccccccgggttgcaccccctgcccggagagccccag

SEQ ID NO: 17468 - DNA, 388 bp, Homo sapiens
tttttttccgggggagtttgaatatttgtttcttttcacactggccttaaagaggatatattagaagttgaagtaggaagggagccagagaggccgatggcgcaaaggtacgacgatctaccccattacgggggcatggatggagtaggcatcccctccacgatgtatggggacccgcatgcagccaggtccatgcagccggtccaccacctgaaccacgggcctcctctgcactcgcatcagtacccgcacacagctcataccaacgccatggcccccagcatgggctcctctgtcaatgacgctttaaagagagataaagatgccatttatgggtaggtacaatgggcagcaggttaagtagttgagactcaacgcttccctcttt

SEQ ID NO: 17469 - DNA, 422 bp, Homo sapiens
tttttttccgggggagtttgaatatttgtttcttttcacactggccttaaagaggatatattagaagttgaagtaggaagggagccagagaggccgatggcgcaaagggtacgtattaaaaaacaattgtggaactcaaatgtgagattaaattgaaacgtggccgaaagacactgctaaaaagtttcctttttttctctctctcttttaaaaaatgaggctcctaaagccgtggcctaagcgagaggatttattcaatgcatttgtagacttatgtatgttacttggagttgttaattaaaggaatctatttatctatagattcctaaccagcagctatataaataaaaatgcaagctcaaacaatcatctgggtttttttttaaaaaagctagatacctaaagctgtaatttgaacattc

SEQ ID NO: 17470 - DNA, 2832 bp, Homo sapiens
tttttttccgggggagtttgaatatttgtttcttttcacactggccttaaagaggatatattagaagttgaagtaggaagggagccagagaggccgatggcgcaaaggtacgacgatctaccccattacgggggcatggatggagtaggcatcccctccacgatgtatggggacccgcatgcagccaggtccatgcagccggtccaccacctgaaccacgggcctcctctgcactcgcatcagtacccgcacacagctcataccaacgccatggcccccagcatgggctcctctgtcaatgacgctttaaagagagataaagatgccatttatggacaccccctcttccctctcttagcactgatttttgagaaatgtgaattagctacttgtaccccccgcgagccgggggtggcgggcggggacgtctgctcgtcagagtcattcaatgaagatatagccgtgttcgccaaacagattcgcgcagaaaaacctctattttcttctaatccagaactggataacttgatgattcaagccatacaagtattaaggtttcatctattggaattagagaaggtacacgaattatgtgacaatttctgccaccggtatattagctgtttgaaagggaaaatgcctatcgatttggtgatagacgatagagaaggaggatcaaaatcagacagtgaagatataacaagatcagcaaatctaactgaccagccctcttggaacagagatcatgatgacacggcatctactcgttcaggaggaaccccaggcccttccagcggtggccacacgtcacacagtggggacaacagcagtgagcaaggtgatggcttggacaacagtgtagcttcccccagcacaggtgacgatgatgaccctgataaggacaaaaagcgtcacaaaaagcgtggcatctttcccaaagtagccacaaatatcatgagggcgtggctgttccagcatctaacacacccttacccttctgaagaacagaaaaagcagttggcacaagacacgggactcaccatccttcaagtgaacaattggtttattaatgcccggagaagaatagtgcagcccatgatagaccagtccaaccgagcagtaagtcaaggaacaccttataatcctgatggacagcccatgggaggtttcgtaatggacggtcagcaacatatgggaattagagcaccaggacctatgagtggaatgggcatgaatatgggcatggaggggcagtggcactacatgtaaccttcatctagttaaccaatcgcaaagcaagggggaaggctgcaaagtatgccaggggagtatgtagcccggggtggtccaatgggtgtgagtatgggacagccaagttatacccaaccccagatgcccccccatcctgctcagctgcgtcatgggccccccatgcatacgtacattcctggacaccctcaccacccaacagtgatgatgcatggaggaccgccccaccctggaatgccaatgtcagcatcaagccccacagttcttaatacaggagacccaacaatgagtggacaagtcatggacattcatgctcagtagcttaagggaatatgcattgtctgcaatggtgactgatttcaaatcatgttttttctgcaatgactgtggagttccattcttggcatctactctggaccaaggagcatccctaattcttcatagggacctttaaaaagcaggaaataccaactgaagtcaatttgggggacatgctaaataactatataagacattaagagaacaaagagtgaaatattgtaaatgctattatactgttatccatattacgttgtttcttatagattttttaaaaaaaatgtgaaatttttccacactatgtgtgttgtttccatagctcttcacttcctccagaagcctccttacattaaaaagccttacagttatcctgcaagggacaggaaggtctgatttgcaggatttttagagcattaaaataactatcaggcagaagaatctttcttctcgcctaggatttcagccatgcgcgcgctctctctctttctctctcttttcctctctctccctctttctagcctggggcttgaatttgcatgtctaattcatttactcaccatatttgaattggcctgaacagatgtaaatcgggaaggatgggaaaaactgcagtcatcaacaatgattaatcagctgttgcaggcagtgtcttaaggagactggtaggaggaggcatggaaaccaaaaggccgtgtgtttagaagcctaattgtcacatcaagcatcattgtccccatgcaacaaccaccaccttatacatcacttcctgttttaagcagctctaaaacatagactgaagatttatttttaatatgttgactttatttctgagcaaagcatcggtcatgtgtgtattttttcatagtcccaccttggagcatttatgtagacattgtaaataaattttgtgcaaaaaggactggaaaaatgaactgtattattgcaatttttttttgtaaaagtagcagtttggtatgagttggcatgcatacaagatttactaagtgggataagctaattatactttttgttgtggataaacaaatgcttgttgatagcctttttctatcaagaaaccaaggagctaattattaataacaatcattgcacactgagtcttagcgtttctgatggaaacagtttggattgtataataacgccaagcccagttgtagtcgtttgagtgcagtaatgaaatctgaatctaaaataaaaacaagattatttttgtcatgctgactccac

SEQ ID NO: 17471 - DNA, 3068 bp, Homo sapiens
gagacatgcccgtttcaccttctaccctcgggagaatgcttctctttctctctttctttcttctttccttcttgccaaaggagcctgaatttctaaactagttgatagggacacaagttagggcaagatcattcatcccagacgagtctcgctgagaattctgtattttttacttaaagctttaattttaaaataagaaaaactcagctttatagatgcaaggccaccgaattccgggtggaaggacccagctgtattgaccttatataagctcggtgccttgccgttctcccatttgcccgcctggcctcctgaaccttctttctctcctgtttgtcatgcagtacgacgatctaccccattacgggggcatggatggagtaggcatcccctccacgatgtatggggacccgcatgcagccaggtccatgcagccggtccaccacctgaaccacgggcctcctctgcactcgcatcagtacccgcacacagctcataccaacgccatggcccccagcatgggctcctctgtcaatgacgctttaaagagagataaagatgccatttatggacaccccctcttccctctcttagcactgatttttgagaaatgtgaattagctacttgtaccccccgcgagccgggggtggcgggcggggacgtctgctcgtcagagtcattcaatgaagatatagccgtgttcgccaaacagattcgcgcagaaaaacctctattttcttctaatccagaactggataacttgatgattcaagccatacaagtattaaggtttcatctattggaattagagaaggtacacgaattatgtgacaatttctgccaccggtatattagctgtttgaaagggaaaatgcctatcgatttggtgatagacgatagagaaggaggatcaaaatcagacagtgaagatataacaagatcagcaaatctaactgaccagccctcttggaacagagatcatgatgacacggcatctactcgttcaggaggaaccccaggcccttccagcggtggccacacgtcacacagtggggacaacagcagtgagcaaggtgatggcttggacaacagtgtagcttcccccagcacaggtgacgatgatgaccctgataaggacaaaaagcgtcacaaaaagcgtggcatctttcccaaagtagccacaaatatcatgagggcgtggctgttccagcatctaacacacccttacccttctgaagaacagaaaaagcagttggcacaagacacgggactcaccatccttcaagtgaacaattggtttattaatgcccggagaagaatagtgcagcccatgatagaccagtccaaccgagcagtaagtcaaggaacaccttataatcctgatggacagcccatgggaggtttcgtaatggacggtcagcaacatatgggaattagagcaccaggacctatgagtggaatgggcatgaatatgggcatggaggggcagtggcactacatgtaaccttcatctagttaaccaatcgcaaagcaagggggaaggctgcaaagtatgccaggggagtatgtagcccggggtggtccaatgggtgtgagtatgggacagccaagttatacccaaccccagatgcccccccatcctgctcagctgcgtcatgggccccccatgcatacgtacattcctggacaccctcaccacccaacagtgatgatgcatggaggaccgccccaccctggaatgccaatgtcagcatcaagccccacagttcttaatacaggagacccaacaatgagtggacaagtcatggacattcatgctcagtagcttaagggaatatgcattgtctgcaatggtgactgatttcaaatcatgttttttctgcaatgactgtggagttccattcttggcatctactctggaccaaggagcatccctaattcttcatagggacctttaaaaagcaggaaataccaactgaagtcaatttgggggacatgctaaataactatataagacattaagagaacaaagagtgaaatattgtaaatgctattatactgttatccatattacgttgtttcttatagattttttaaaaaaaatgtgaaatttttccacactatgtgtgttgtttccatagctcttcacttcctccagaagcctccttacattaaaaagccttacagttatcctgcaagggacaggaaggtctgatttgcaggatttttagagcattaaaataactatcaggcagaagaatctttcttctcgcctaggatttcagccatgcgcgcgctctctctctttctctctcttttcctctctctccctctttctagcctggggcttgaatttgcatgtctaattcatttactcaccatatttgaattggcctgaacagatgtaaatcgggaaggatgggaaaaactgcagtcatcaacaatgattaatcagctgttgcaggcagtgtcttaaggagactggtaggaggaggcatggaaaccaaaaggccgtgtgtttagaagcctaattgtcacatcaagcatcattgtccccatgcaacaaccaccaccttatacatcacttcctgttttaagcagctctaaaacatagactgaagatttatttttaatatgttgactttatttctgagcaaagcatcggtcatgtgtgtattttttcatagtcccaccttggagcatttatgtagacattgtaaataaattttgtgcaaaaaggactggaaaaatgaactgtattattgcaatttttttttgtaaaagtagcagtttggtatgagttggcatgcatacaagatttactaagtgggataagctaattatactttttgttgtggataaacaaatgcttgttgatagcctttttctatcaagaaaccaaggagctaattattaataacaatcattgcacactgagtcttagcgtttctgatggaaacagtttggattgtataataacgccaagcccagttgtagtcgtttgagtgcagtaatgaaatctgaatctaaaataaaaacaagattatttttgtcatgctgactccac

SEQ ID NO: 17472 - DNA, 2435 bp, Homo sapiens
cagcgcggggatttatctcccggcctgtcagcatgtgtgcttaaactttgcggacttcctagccctctaagtcccatcacgagggcagccaccggacaagagcccccaaacaaccagtttgcctgaaaggtatgattcaagccatacaagtattaaggtttcatctattggaattagagaaggtacacgaattatgtgacaatttctgccaccggtatattagctgtttgaaagggaaaatgcctatcgatttggtgatagacgatagagaaggaggatcaaaatcagacagtgaagatataacaagatcagcaaatctaactgaccagccctcttggaacagagatcatgatgacacggcatctactcgttcaggaggaaccccaggcccttccagcggtggccacacgtcacacagtggggacaacagcagtgagcaaggtgatggcttggacaacagtgtagcttcccccagcacaggtgacgatgatgaccctgataaggacaaaaagcgtcacaaaaagcgtggcatctttcccaaagtagccacaaatatcatgagggcgtggctgttccagcatctaacacacccttacccttctgaagaacagaaaaagcagttggcacaagacacgggactcaccatccttcaagtgaacaattggtttattaatgcccggagaagaatagtgcagcccatgatagaccagtccaaccgagcagtaagtcaaggaacaccttataatcctgatggacagcccatgggaggtttcgtaatggacggtcagcaacatatgggaattagagcaccaggacctatgagtggaatgggcatgaatatgggcatggaggggcagtggcactacatgtaaccttcatctagttaaccaatcgcaaagcaagggggaaggctgcaaagtatgccaggggagtatgtagcccggggtggtccaatgggtgtgagtatgggacagccaagttatacccaaccccagatgcccccccatcctgctcagctgcgtcatgggccccccatgcatacgtacattcctggacaccctcaccacccaacagtgatgatgcatggaggaccgccccaccctggaatgccaatgtcagcatcaagccccacagttcttaatacaggagacccaacaatgagtggacaagtcatggacattcatgctcagtagcttaagggaatatgcattgtctgcaatggtgactgatttcaaatcatgttttttctgcaatgactgtggagttccattcttggcatctactctggaccaaggagcatccctaattcttcatagggacctttaaaaagcaggaaataccaactgaagtcaatttgggggacatgctaaataactatataagacattaagagaacaaagagtgaaatattgtaaatgctattatactgttatccatattacgttgtttcttatagattttttaaaaaaaatgtgaaatttttccacactatgtgtgttgtttccatagctcttcacttcctccagaagcctccttacattaaaaagccttacagttatcctgcaagggacaggaaggtctgatttgcaggatttttagagcattaaaataactatcaggcagaagaatctttcttctcgcctaggatttcagccatgcgcgcgctctctctctttctctctcttttcctctctctccctctttctagcctggggcttgaatttgcatgtctaattcatttactcaccatatttgaattggcctgaacagatgtaaatcgggaaggatgggaaaaactgcagtcatcaacaatgattaatcagctgttgcaggcagtgtcttaaggagactggtaggaggaggcatggaaaccaaaaggccgtgtgtttagaagcctaattgtcacatcaagcatcattgtccccatgcaacaaccaccaccttatacatcacttcctgttttaagcagctctaaaacatagactgaagatttatttttaatatgttgactttatttctgagcaaagcatcggtcatgtgtgtattttttcatagtcccaccttggagcatttatgtagacattgtaaataaattttgtgcaaaaaggactggaaaaatgaactgtattattgcaatttttttttgtaaaagtagcagtttggtatgagttggcatgcatacaagatttactaagtgggataagctaattatactttttgttgtggataaacaaatgcttgttgatagcctttttctatcaagaaaccaaggagctaattattaataacaatcattgcacactgagtcttagcgtttctgatggaaacagtttggattgtataataacgccaagcccagttgtagtcgtttgagtgcagtaatgaaatctgaatctaaaataaaaacaagattatttttgtcatgctgactccac

SEQ ID NO: 17473 - DNA, 1668 bp, Homo sapiens
atgaatcaaaagaatgctttacaaaaccatgttcccttaatcacagtgttctctggcttttataggattgtcatagccaggaccacactattgctttttcataacattttctttttgtttctttcttttgaatttcttacagggctgcaaagtatgccaggggagtatgtagcccggggtggtccaatgggtgtgagtatgggacagccaagttatacccaaccccagatgcccccccatcctgctcagctgcgtcatgggccccccatgcatacgtacattcctggacaccctcaccacccaacagtgatgatgcatggaggaccgccccaccctggaatgccaatgtcagcatcaagccccacagttcttaatacaggagacccaacaatgagtggacaagtcatggacattcatgctcagtagcttaagggaatatgcattgtctgcaatggtgactgatttcaaatcatgttttttctgcaatgactgtggagttccattcttggcatctactctggaccaaggagcatccctaattcttcatagggacctttaaaaagcaggaaataccaactgaagtcaatttgggggacatgctaaataactatataagacattaagagaacaaagagtgaaatattgtaaatgctattatactgttatccatattacgttgtttcttatagattttttaaaaaaaatgtgaaatttttccacactatgtgtgttgtttccatagctcttcacttcctccagaagcctccttacattaaaaagccttacagttatcctgcaagggacaggaaggtctgatttgcaggatttttagagcattaaaataactatcaggcagaagaatctttcttctcgcctaggatttcagccatgcgcgcgctctctctctttctctctcttttcctctctctccctctttctagcctggggcttgaatttgcatgtctaattcatttactcaccatatttgaattggcctgaacagatgtaaatcgggaaggatgggaaaaactgcagtcatcaacaatgattaatcagctgttgcaggcagtgtcttaaggagactggtaggaggaggcatggaaaccaaaaggccgtgtgtttagaagcctaattgtcacatcaagcatcattgtccccatgcaacaaccaccaccttatacatcacttcctgttttaagcagctctaaaacatagactgaagatttatttttaatatgttgactttatttctgagcaaagcatcggtcatgtgtgtattttttcatagtcccaccttggagcatttatgtagacattgtaaataaattttgtgcaaaaaggactggaaaaatgaactgtattattgcaatttttttttgtaaaagtagcagtttggtatgagttggcatgcatacaagatttactaagtgggataagctaattatactttttgttgtggataaacaaatgcttgttgatagcctttttctatcaagaaaccaaggagctaattattaataacaatcattgcacactgagtcttagcgtttctgatggaaacagtttggattgtataataacgccaagcccagttgtagtcgtttgagtgcagtaatgaaatctgaatctaaaataaaaacaagattatttttgtcatgctgactccac

SEQ ID NO: 17474 - DNA, 2511 bp, Homo sapiens
tttttttccgggggagtttgaatatttgtttcttttcacactggccttaaagaggatatattagaagttgaagtaggaagggagccagagaggccgatggcgcaaaggtacgacgatctaccccattacgggggcatggatggagtaggcatcccctccacgatgtatggggacccgcatgcagccaggtccatgcagccggtccaccacctgaaccacgggcctcctctgcactcgcatcagtacccgcacacagctcataccaacgccatggcccccagcatgggctcctctgtcaatgacgctttaaagagagataaagatgccatttatggacaccccctcttccctctcttagcactgatttttgagaaatgtgaattagctacttgtaccccccgcgagccgggggtggcgggcggggacgtctgctcgtcagagtcattcaatgaagatatagccgtgttcgccaaacagattcgcgcagaaaaacctctattttcttctaatccagaactggataacttgatgattcaagccatacaagtattaaggtttcatctattggaattagagaaggtacacgaattatgtgacaatttctgccaccggtatattagctgtttgaaagggaaaatgcctatcgatttggtgatagacgatagagaaggaggatcaaaatcagacagtgaagatataacaagatcagcaaatctaactgaccagccctcttggaacagagatcatgatgacacggcatctactcgttcaggaggaaccccaggcccttccagcggtggccacacgtcacacagtggggacaacagcagtgagcaaggtgatggcttggacaacagtgtagcttcccccagcacaggtgacgatgatgaccctgataaggacaaaaagcgtcacaaaaagcgtggcatctttcccaaagtagccacaaatatcatgagggcgtggctgttccagcatctaacacacccttacccttctgaagaacagaaaaagcagttggcacaagacacgggactcaccatccttcaagtgaacaattggtttattaatgcccggagaagaatagtgcagcccatgatagaccagtccaaccgagcagtaagtcaaggaacaccttataatcctgatggacagcccatgggaggtttcgtaatggacggtcagcaacatatgggaattagagcaccaggacctatgagtggaatgggcatgaatatgggcatggaggggcagtggcactacatgtaaccttcatctagttaaccaatcgcaaagcaagggggaaggctgcaaagtatgccaggggagtatgtagcccggggtggtccaatgggtgtgagtatgggacagccaagttatacccaaccccagatgcccccccatcctgctcagctgcgtcatgggccccccatgcatacgtacattcctggacaccctcaccacccaacagtgatgatgcatggaggaccgccccaccctggaatgccaatgtcagcatcaagccccacagttcttaatacaggagacccaacaatgagtggacaagtcatggacattcatgctcagtagcttaagggaatatgcattgtctgcaatggtgactgatttcaaatcatgttttttctgcaatgactgtggagttccattcttggcatctactctggaccaaggagcatccctaattcttcatagggacctttaaaaagcaggaaataccaactgaagtcaatttgggggacatgctaaataactatataagacattaagagaacaaagagtgaaatattgtaaatgctattatactgttatccatattacgttgtttcttatagattttttaaaaaaaatgtgaaatttttccacactatgtgtgttgtttccatagctcttcacttcctccagaagcctccttacattaaaaagccttacagttatcctgcaagggacaggaaggtctgatttgcaggatttttagagcattaaaataactatcaggcagaagaatctttcttctcgcctaggatttcagccatgcgcgcgctctctctctttctctctcttttcctctctctccctctttctagcctggggcttgaatttgcatgtctaattcatttactcaccatatttgaattggcctgaacagatgtaaatcgggaaggatgggaaaaactgcagtcatcaacaatgattaatcagctgttgcaggcagtgtcttaaggagactggtaggaggaggcatggaaaccaaaaggccgtgtgtttagaagcctaattgtcacatcaagcatcattgtccccatgcaacaaccaccaccttatacatcacttcctgttttaagcagctctaaaacatagactgaagatttatttttaatatgttgactttatttctgagcaaagcatcggtcatgtgtgtattttttcatagtcccaccttggagcatttatgtagacattgtaaataaattttgtgcaaaaaggactgga

SEQ ID NO: 17475 - DNA, 864 bp, Homo sapiens
gaatccacctctccgcctgtgcaacacacactttacacacgcacggggactgcaagcgggcagcatcgatcgtggctcctttaagacaaactcagacagacattttttttaaccctccttctctaatctctttctagcctggggcttgaatttgcatgtctaattcatttactcaccatatttgaattggcctgaacagatgtaaatcgggaaggatgggaaaaactgcagtcatcaacaatgattaatcagctgttgcaggcagtgtcttaaggagactggtaggaggaggcatggaaaccaaaaggccgtgtgtttagaagcctaattgtcacatcaagcatcattgtccccatgcaacaaccaccaccttatacatcacttcctgttttaagcagctctaaaacatagactgaagatttatttttaatatgttgactttatttctgagcaaagcatcggtcatgtgtgtattttttcatagtcccaccttggagcatttatgtagacattgtaaataaattttgtgcaaaaaggactggaaaaatgaactgtattattgcaatttttttttgtaaaagtagcagtttggtatgagttggcatgcatacaagatttactaagtgggataagctaattatactttttgttgtggataaacaaatgcttgttgatagcctttttctatcaagaaaccaaggagctaattattaataacaatcattgcacactgagtcttagcgtttctgatggaaacagtttggattgtataataacgccaagcccagttgtagtcgtttgagtgcagtaatgaaatctgaatctaaaataaaaacaagattatttttgtcatgctgactccac

SEQ ID NO: 17476 - DNA, 2346 bp, Homo sapiens
tttttttccgggggagtttgaatatttgtttcttttcacactggccttaaagaggatatattagaagttgaagtaggaagggagccagagaggccgatggcgcaaaggtacgacgatctaccccattacgggggcatggatggagtaggcatcccctccacgatgtatggggacccgcatgcagccaggtccatgcagccggtccaccacctgaaccacgggcctcctctgcactcgcatcagtacccgcacacagctcataccaacgccatggcccccagcatgggctcctctgtcaatgacgctttaaagagagataaagatgccatttatggacaccccctcttccctctcttagcactgatttttgagaaatgtgaattagctacttgtaccccccgcgagccgggggtggcgggcggggacgtctgctcgtcagagtcattcaatgaagatatagccgtgttcgccaaacagattcgcgcagaaaaacctctattttcttctaatccagaactggataacttgatgattcaagccatacaagtattaaggtttcatctattggaattagagaaggtacacgaattatgtgacaatttctgccaccggtatattagctgtttgaaagggaaaatgcctatcgatttggtgatagacgatagagaaggaggatcaaaatcagacagtgaagatataacaagatcagcaaatctaactgaccagccctcttggaacagagatcatgatgacacggcatctactcgttcaggaggaaccccaggcccttccagcggtggccacacgtcacacagtggggacaacagcagtgagcaaggtgatggcttggacaacagtgtagcttcccccagcacaggtgacgatgatgaccctgataaggacaaaaagcgtcacaaaaagcgtggcatctttcccaaagtagccacaaatatcatgagggcgtggctgttccagcatctaacacacccttacccttctgaagaacagaaaaagcagttggcacaagacacgggactcaccatccttcaagtgaacaattggtttattaatgcccggagaagaatagtgcagcccatgatagaccagtccaaccgagcagtaagtcaaggaacaccttataatcctgatggacagcccatgggaggtttcgtaatggacggtcagcaacatatgggaattagagcaccaggacctatgagtggaatgggcatgaatatgggcatggaggggcagtggcactacatgtaaccttcatctagttaaccaatcgcaaagcaagggggaaggctgcaaagtatgccaggggagtatgtagcccggggtggtccaatgggtgtgagtatgggacagccaagttatacccaaccccagatgcccccccatcctgctcagctgcgtcatgggccccccatgcatacgtacattcctggacaccctcaccacccaacagtgatgatgcatggaggaccgccccaccctggaatgccaatgtcagcatcaagccccacagttcttaatacaggagacccaacaatgagtggacaagtcatggacattcatgctcagtagcttaagggaatatgcattgtctgcaatggtgactgatttcaaatcatgttttttctgcaatgactgtggagttccattcttggcatctactctggaccaaggagcatccctaattcttcatagggacctttaaaaagcaggaaataccaactgaagtcaatttgggggacatgctaaataactatataagacattaagagaacaaagagtgaaatattgtaaatgctattatactgttatccatattacgttgtttcttatagattttttaaaaaaaatgtgaaatttttccacactatgtgtgttgtttccatagctcttcacttcctccagaagcctccttacattaaaaagccttacagttatcctgcaagggacaggaaggtctgatttgcaggatttttagagcattaaaataactatcaggcagaagaatctttcttctcgcctaggatttcagccatgcgcgcgctctctctctttctctctcttttcctctctctccctctttctagcctggggcttgaatttgcatgtctaattcatttactcaccatatttgaattggcctgaacagatgtaaatcgggaaggatgggaaaaactgcagtcatcaacaatgattaatcagctgttgcaggcagtgtcttaaggagactggtaggaggaggcatggaaaccaaaaggccgtgtgtttaaaacaggaagtgatgtataatggtggttgttgcatggggacaatgatgcttgctagttc

SEQ ID NO: 17477 - DNA, 2103 bp, Homo sapiens
tttttttccgggggagtttgaatatttgtttcttttcacactggccttaaagaggatatattagaagttgaagtaggaagggagccagagaggccgatggcgcaaaggtacgacgatctaccccattacgggggcatggatggagtaggcatcccctccacgatgtatggggacccgcatgcagccaggtccatgcagccggtccaccacctgaaccacgggcctcctctgcactcgcatcagtacccgcacacagctcataccaacgccatggcccccagcatgggctcctctgtcaatgacgctttaaagagagataaagatgccatttatggacaccccctcttccctctcttagcactgatttttgagaaatgtgaattagctacttgtaccccccgcgagccgggggtggcgggcggggacgtctgctcgtcagagtcattcaatgaagatatagccgtgttcgccaaacagattcgcgcagaaaaacctctattttcttctaatccagaactggataacttgatgattcaagccatacaagtattaaggtttcatctattggaattagagaaggtacacgaattatgtgacaatttctgccaccggtatattagctgtttgaaagggaaaatgcctatcgatttggtgatagacgatagagaaggaggatcaaaatcagacagtgaagatataacaagatcagcaaatctaactgaccagccctcttggaacagagatcatgatgacacggcatctactcgttcaggaggaaccccaggcccttccagcggtggccacacgtcacacagtggggacaacagcagtgagcaaggtgatggcttggacaacagtgtagcttcccccagcacaggtgacgatgatgaccctgataaggacaaaaagcgtcacaaaaagcgtggcatctttcccaaagtagccacaaatatcatgagggcgtggctgttccagcatctaacacacccttacccttctgaagaacagaaaaagcagttggcacaagacacgggactcaccatccttcaagtgaacaattggtttattaatgcccggagaagaatagtgcagcccatgatagaccagtccaaccgagcagtaagtcaaggaacaccttataatcctgatggacagcccatgggaggtttcgtaatggacggtcagcaacatatgggaattagagcaccaggacctatgagtggaatgggcatgaatatgggcatggaggggcagtggcactacatgtaaccttcatctagttaaccaatcgcaaagcaagggggaaggctgcaaagtatgccaggggagtatgtagcccggggtggtccaatgggtgtgagtatgggacagccaagttatacccaaccccagatgcccccccatcctgctcagctgcgtcatgggccccccatgcatacgtacattcctggacaccctcaccacccaacagtgatgatgcatggaggaccgccccaccctggaatgccaatgtcagcatcaagccccacagttcttaatacaggagacccaacaatgagtggacaagtcatggacattcatgctcagtagcttaagggaatatgcattgtctgcaatggtgactgatttcaaatcatgttttttctgcaatgactgtggagttccattcttggcatctactctggaccaaggagcatccctaattcttcatagggacctttaaaaagcaggaaataccaactgaagtcaatttgggggacatgctaaataactatataagacattaagagaacaaagagtgaaatattgtaaatgctattatactgttatccatattacgttgtttcttatagatttactaagtgggataagctaattatactttttgttgtggataaacaaatgcttgttgatagcctttttctatcaagaaaccaaggagctaattattaataacaatcattgcacactgagtcttagcgtttctgatggaaacagtttggattgtataataacgccaagcccagttgtagtcgtttgagtgcagtaatgaaatctgaatctaaaataaaaacaagattatttttgtcatgctgactccac

SEQ ID NO: 17478 - DNA, 1461 bp, Homo sapiens
  misc_feature (1267)..(1267): n is a, c, g, or t
  misc_feature (1289)..(1289): n is a, c, g, or t
  misc_feature (1299)..(1299): n is a, c, g, or t
  misc_feature (1358)..(1358): n is a, c, g, or t
  misc_feature (1365)..(1365): n is a, c, g, or t
  misc_feature (1416)..(1416): n is a, c, g, or t
  misc_feature (1423)..(1423): n is a, c, g, or t
tttttttccgggggagtttgaatatttgtttcttttcacactggccttaaagaggatatattagaagttgaagtaggaagggagccagagaggccgatggcgcaaaggtacgacgatctaccccattacgggggcatggatggagtaggcatcccctccacgatgtatggggacccgcatgcagccaggtccatgcagccggtccaccacctgaaccacgggcctcctctgcactcgcatcagtacccgcacacagctcataccaacgccatggcccccagcatgggctcctctgtcaatgacgctttaaagagagataaagatgccatttatggacaccccctcttccctctcttagcactgatttttgagaaatgtgaattagctacttgtaccccccgcgagccgggggtggcgggcggggacgtctgctcgtcagagtcattcaatgaagatatagccgtgttcgccaaacagattcgcgcagaaaaacctctattttcttctaatccagaactggataacttgatgattcaagccatacaagtattaaggtttcatctattggaattagagaaggtacacgaattatgtgacaatttctgccaccggtatattagctgtttgaaagggaaaatgcctatcgatttggtgatagacgatagagaaggaggatcaaaatcagacagtgaagatataacaagatcagcaaatctaactgaccagccctcttggaacagagatcatgatgacacggcatctactcgttcaggaggaaccccaggcccttccagcggtggccacacgtcacacagtggggacaacagcagtgagcaaggtgatggcttggacaacagtgtagcttcccccagcacaggtgacgatgatgaccctgataaggacaaaaagcgtcacaaaaagcgtggcatctttcccaaagtagccacaaatatcatgagggcgtggctgttccagcatctaacacacccttacccttctgaagaacagaaaaagcagttggcacaagacacgggactcaccatccttcaagtgaacaattggtttattaatgcccggagaagaatagtgcagcccatgatagaccagtccaaccgagcagtaagtcaaggaacaccttataatcctgatggacagcccatgggaggtttcgtaatggacggtcagcaacatatgggaattagagcaccaggacctatgagtggaatgggcatgaatatgggcatggaggggcagtggcactaccaantttgggtttttaaaaccctttncaatccttantttaacccaattccgccaaaagcaaggggggaaggctgcaaagttattgccagggggantatgtancccggggttggtccaattggggtgttgaagttattggggaacagccccaantttattncccccaaccccccaaaattgccccccccatcctggctc

SEQ ID NO: 17479 - DNA, 1690 bp, Homo sapiens
tttttttccgggggagtttgaatatttgtttcttttcacactggccttaaagaggatatattagaagttgaagtaggaagggagccagagaggccgatggcgcaaaggtacgacgatctaccccattacgggggcatggatggagtaggcatcccctccacgatgtatggggacccgcatgcagccaggtccatgcagccggtccaccacctgaaccacgggcctcctctgcactcgcatcagtacccgcacacagctcataccaacgccatggcccccagcatgggctcctctgtcaatgacgctttaaagagagataaagatgccatttatggacaccccctcttccctctcttagcactgatttttgagaaatgtgaattagctacttgtaccccccgcgagccgggggtggcgggcggggacgtctgctcgtcagagtcattcaatgaagatatagccgtgttcgccaaacagattcgcgcagaaaaacctctattttcttctaatccagaactggataacttgatgattcaagccatacaagtattaaggtttcatctattggaattagagaaggtacacgaattatgtgacaatttctgccaccggtatattagctgtttgaaagggaaaatgcctatcgatttggtgatagacgatagagaaggaggatcaaaatcagacagtgaagatataacaagatcagcaaatctaactgaccagccctcttggaacagagatcatgatgacacggcatctactcgttcaggaggaaccccaggcccttccagcggtggccacacgtcacacagtggggacaacagcagtgagcaaggtgatggcttggacaacagtgtagcttcccccagcacaggtgacgatgatgaccctgataaggacaaaaagcgtcacaaaaagcgtggcatctttcccaaagtagccacaaatatcatgagggcgtggctgttccagcatctaacacacccttacccttctgaagaacagaaaaagcagttggcacaagacacgggactcaccatccttcaagtgaacaattggtttattaatgcccggagaagaatagtgcagcccatgatagaccagtccaaccgagcagtaagtcaaggaacaccttataatcctgatggacagcccatgggaggtttcgtaatggacggtcagcaacatatgggaattagagcaccaggacctatgagtggaatgggcatgaatatgggcatggaggggcagtggcactacatgtaaccttcatctagttaaccaatcgcaaagcaagggggaagtaagtacaaatggggtctttgttttcactttgtcctaggaatatttttcctcttgcattttcttatgttctccttgcccatagcttcatgcttgttcattcctttccattaaactcctggtttcttgcttccatcattttctttttggttgtgatcaagcttttaagcttataaatactgtgtatgatgtacatttatcctgtgtgttgctattgtacagtactgaccacatgacaaaacaagaaacagtcaggaggtgggggagtgggttgtcatagcaacagactgatttgcaaaatgtaagcagtctgcagcagtgcaaggagagggaagagcatgtccccaaagtgtcataaatctgtctaaccgcagttgatgcatga

SEQ ID NO: 17480 - DNA, 519 bp, Homo sapiens
ccaacagaacctggaaaggcccaggaactaaggccccaggggaatctcaggtggaagtggaggtgtaaggtgggactgaaaatagaattgttagaaaattcatgagcagcaagtcttccagaacccagtctccacctctgagtaattaggccactaccttcctctgctgcaacagaagatgaaaggtttgcacagccaatatgatgctgggaatacttgtgaaaacacacacacatacacatccctctaacccctacttagctcccaaatagccatgcctatactccctgggaagagaatgtaagaaatgtctttggagaaactaaatggccagaaagaaaagatgtacaggtactaacatttgaagtgccatgaaaaaagcttgctgcctaactaccctaaagataagcctgtctataccaaggagtggagaaattcacaaatatgaaggaaacctaaacaaacagaaagaaaggacgttagaagaaacagggataataaggagtggaagaaaatgta

SEQ ID NO: 17481 - DNA, 147 bp, Homo sapiens
gatcttccaccataaccaacaaaaacattattttctcaaagttagaaacaaccctgtgtggccaaaatatatgaatcccaacttcattctcactctggttgtaagaaatgctggaataattaattactcatttggaaaaaattaaag

SEQ ID NO: 17482 - DNA, 489 bp, Homo sapiens
accactggaatcccacagactggggtggacagctattcttatgaaaagtgtggctccatttctggactaaacaggcgtactggcgctgaagataaggatcccaaactccaagtcaggcctatctgcaagcaaagtctcagcctcgctcacctcttcccttcttccatcagtcattagccctgtgtgagaaagcaggggtgcattgttaccatatgacatggcaaaaagggattacctgctaatgccatttggtttagtgatgccttgttacataaactactctggaggagttcaaatatccctcaggcgaacgcttccatccccaggttggtaacactatagctgagtattgttttatttgccatttttcaaaagagggagaaacatacccaagccattatccagcctaccaataatacatttcaagaaaacaaccgcaactcccaatcctttcttctgagggcaggatgttgtagggctattgttcct

SEQ ID NO: 17483 - DNA, 321 bp, Homo sapiens
tatacatgtgtttatgtgcacgtatacatgtgtttatgtatacatatatattaaaactatatatatacagttttattgtttccttttatccatgaggattttgagatattaaaataattatattaattgaataccaatcattctctaagcattttatatatatcagctctttacgtaaatcctcattttgcttgtaagaaatctgaagctcatggtagttaagaacatggaactacttagtggctgaactggtattcaagtctaggcagtctgattctaagatgggaattcttgactactctgctatagcacctttcataa

SEQ ID NO: 17484 - DNA, 174 bp, Homo sapiens
attgactggatgagccctacaatattttggaaaataatctgcttttctcagaaattactgattttcatgttaatctcatctaacaatactttcagagcaacatctatactggtatttgaatatataactcttttatcttttaaaatatcaaataatacagttatatatatatac

SEQ ID NO: 17485 - DNA, 304 bp, Homo sapiens
catttgctaggacaccgtccctctgccgcataggactctgtcagcccgtggaaatgggtgccactttgcaagcgggcaagatgcttctcagcccactccagaatgcctgtatctgctgaccctggaagtgctgtctccatcaggcccaaatccagaagtccaatctgccccaagaaggccctcgcttctctctggagttcaagagaaccttctgggtattccagatacctctgaccaaccaagggtgagagcaacccccacagagtggtgtcacattaaatatggcacttagagaaatctcagc

SEQ ID NO: 17486 - DNA, 1963 bp, Homo sapiens
cttttctcgcctgcttttttagttttgagatttgttttttttttcaatttttttcctccctatttttaaattttttctattctttctgtggttatccttgatgttttccatatgtgtttaacttataaagtctaaagttaaacaatattttagcccccttcttaaagaatgcaggaagcttagaaaccttcaactctagtcattcctctcctgatcacatactgttgttttcaaatatgttagtttgttcctttttataaacctcacaattttacatcattgtcagtgttattttatatagacagtgtttgtttggacttacatgcatacattcttgtatcacacatcatcctttgggatcattttctttcattatgaatatagtgtttaagtgagtttttttttttttttagtacaggtctcttgatgttaaattcttccagtctttcttatatgtaaatgtctttattttatcctcattcttaaaagatagtttgttacaggtatttttactcaacacttagaatatatggttccattctcttttggctttgagatgtctgttgctattaagaagtcgactatcagactaattgctggttttgtgtgtgtgtgtagtagtagtagtagtagtggtagtagtggtagtagtagtagtggaatgtgcagggggtcctgcagttttactctaacatgtttacatatgtatttttttttaattctactttgggaatgtcatgcttcgtggctcagtgaattcatgcttttcataatttctgggaaattctcaaccattatctcttcaaatattgcctttcattttttctagtttttctttcttggaatacagttagtcatattttggacctcctcattctatcttccgtatctcataacatctctgagattttctatctccttgtctttctgcacttcattctggataatttctttaggtatatctttcagcttactgattctcttttcaactatgtttaatctgctctaatctgcccattgagttttttatttcaaaagttatatttttcatttgtacaaacctcatatattttacttgctaatctgcctagtcatccctaatagtctcttattgcttggtcatcttagtgattacatctgttattacttctttaaaacattttatataatttttgttcaaccagtagtcactgtttgcatgagtatgacattgtaaatattgttcacatcaaaactacatagtatattctgattacatatccttcgttgtataccctttcgttttccttggagctaataattgtgtattttgttttcttttgcttagtgttctagtacctatactattcttctctgaaattctttatacaatccaaatcagatcatgtccttccactattcagaattctcccatggctcccacctccctcaacaaaagccaaagccctcaccatggcccaaagtccctacataatctggttccctttacctctcttaccttgtctcctatcactctcaatatcactcactcttctccagctacactggcctccttgctgttccccaagtgtgctagatacccttccttttcagggcctttgtacttgttcttctcactgcctgaaacacccttcctcctaaataatctgatgagttgccctagtacttccagtgtgctcaaatgtcacctccctagagaagtgtttcctgatcaacatatctaaaatcgccccatcacatgcattttatatccctttatcctattttatgtatgtttttctacaaagcactgatcaccacctggtatattttatatttatttattgtggttagtgttcgtctctcttcagtagactgtaagctccataaagcagggacttctgttttgttcactgctgtatccccagtgccaaaaacaacagtgcatagtagatactcaataaatatttgtggaataaactga

SEQ ID NO: 17487 - DNA, 277 bp, Homo sapiens
caacttgtagtgtaggtctaaatgaccgtagagaggtacagattgttagggcctcataagttcattggaagaaacagttaggagctagaataggcagacaggcttataggaagttgataaagggcatcagcaccagtgtaggagtcagatgggtggaaaggtgaagaaaggacatcccaggcaggagcataaagaatgcaaaagtgttgggaaaagatggtagttatgggacatttgtgaagacatcaaaacagtaccacaaacaaagccctgaatt

SEQ ID NO: 17488 - DNA, 726 bp, Homo sapiens
ttattttaacctcggctaatggaaactttctctaacttcctgtgtaggtcagcaatttaaagttggattatccatagaaatcatatttcattgtaggttcatcctagaggttctaaactaggaaaggaatggactgggggggtctcaggtgagggtgtgtgaggacccctgctgctgcttctctggaggttaaggggatttattacactcagtcctaaatgtttcaagtgcagaaagaactgtgtaagtcctaaatgttagcggtggaggacatcttaggcatgaaatactctttcttattgccaataaagaaattaaagcttttggttgtttcctttctttgcgttcagagagtagtctgtctgtgggaactgtttggagaatcttgttttccacattgtgatctctgattaaatcttattcaccatagatacgatttatatatcacaaatttcctttccttcacataagagatgcttgtctaggcagagtatgcagaagtctcatactaacctcccacggatgtcagccctccctccagggcgctcactctcagtgctctctcttcacctctgactagtttatcacacttatcatgtgtctcctggcatttggttgagtagaattctatctcccttattagctaagtgtctctgctgaggagtcattgctcacttgtgtgtcctactcacaggtaaggtgtattaaggtgtattaccagtaagt

SEQ ID NO: 17489 - DNA, 420 bp, Homo sapiens
ctgaaaacccggcagcacagagcctactgacccccccggacaagaacagtgtcaggggacagtggagcagtccaggctggaggagacagagatgaaaagagaatggaagtcaacatgtctgtgattcttttgagaagttttgctttgaagacagcagcagagaaatggagagtaactgtatttattttattcacagataagtcttgacttgtgaaaggtaaagcattatttgggaaatgaaatcacatgctatacctgctagatttgtttttggcacagtaactgggtgtccttaattaagtcgttatttattaagtcagttcctcaaattctatcttcaggtttgcatttaaaatggtgctaaattaaaatactatattcattttaattaacaaagtttgtaaaactgaaacaaatgtt

SEQ ID NO: 17490 - DNA, 841 bp, Homo sapiens
ttccctctggaaatcccttgttacaggtccttagttttagtttgccacattatgacacgatgggaataatgcacagcagtgatcctcagttggtttgggttttcaatacataattgatccatggttgtggcatgcattgtagcatgtccaactagaatacctattctttcaattactttcattactttcaatggcaaaaccacaattacttttgcactaacctgatagctttgctacaagtcagttgttcagttttctttttttgttgctgtttgtttttatttttgcaaacactttagatactgcatagtggatggattagtttgtggttcctgggatcttctgtgtattctgttgaagctcaataatcacattactgcggacctccaaaattttacaaaggactgcacagtgagtattcagccgataaactaaaccacagcttaatactgtgagatgaaagaaagcacaccaattaaaagtaaacactgtttaaacctaacctcaatgaatttctaaagtgtcatacatttattatattctctacttgtaaaatattttgttgtgtgtattgccaagtatttcaggattttatgggtataatgtattctattaatttaactggaaaacttgtagttattcaacaaacaaactaaaagtgttggcagagatgtaattttaaagcacaatcccactcattcgttcagtattacagctgctccttgtttgtttaataatagaactgatgagtagttaatttgagaggaaagctggtgcaggtgtagtgctatttggatgtcatggaggacacatgtgacatctgcagctagctatatggtaa

SEQ ID NO: 17491 - DNA, 720 bp, Homo sapiens
tacttatatatgtttatatttatatatatacacacacacacacacacatacatttaaaaaagagagagagatgaatagtggtctatgttatgccaggctggtcttggtctcaaactcctggcttcaagcagtcttccaacctcagcctcccaaagtgttgagactatagaagtgagctactgtacccagccagagtttatttttaaaaagaaaacttatatcaagataattaacaaataggcatatttgtattatatttgattgccctcttctgtatgctttctgctgtcccagaaagaatgtttctcacataaaagatgatgctttatcctcaacatagattaaatagtcaaagaaaactatggttcagggtagttttaaacctcatagcacaatgaataataatgaataataaaatgtcattacattctcatcttaaaaattataggctgggcgtagtgctcacgcctgtaatcccacactttgggaagccaagttgggaggatcacctgagcccagaagttcaagaccagcctgggcaacacggcaaaaccccatctctacaaaagatacaaaaattagctgggtgtggtggtgcacaactataattgcagctacttaggaggctgaggtggggggatctcttgaggctgtgaggtcgaggcttcagtgagccgtgactgcaccactgcactcctgcttgggctcgtgccgaattct

SEQ ID NO: 17492 - DNA, 418 bp, Homo sapiens
tcccatttctttccaggcacacctcatatcttctgtctttcttcattctgggatttgggggttagggagatgaaaaggagtaaagaattggaagaaatgtcggtctcagaataaagattatagaaggttaacttttaaaaatctacatggatagacttcgtgaccagctgagaccgcagttgaattgtggtcctctaaactactgaatattcctgatgtattgctggtaagaaaatcccagcagaccccattgtatcagatcaacccctgatgtagtgaagaaggaaaagggcttccttagtcttgcattaattgtgagagataattgatagttttagagcaataaatgttggtttcaagccattaaatccatattcgggaaaagctgatttttctaaataagttgctttctaggaac

SEQ ID NO: 17493 - DNA, 724 bp, Homo sapiens
agtgtgggaaataaaggtcccagcccagctctctgttcaggtgggatttattgagcatctactgtatgtctggccttggagtagaaagagaccagcgaagggtttgtgaggcctgaggcccagccttctcactgctgtgcaccctgggcaagccacaccatctgtggacacaaccttctcacgcagggctgtagtcacatcacagtaagaggacgtttgttactcggtggttgagagtgcaggtctagagccccccaactaaaccctggggatagggcaagggccgctttcagtggtcattgtgaagctgtgtacaaccccctcacacccatgcttctgaggctctgagtgcagagactgagtgccgagtgggaggaggttctttccccctcattacaaaagtcatgttcatcttttagtatttggaaatgagtctgacaaagaaaataaaattcagctgacatctaactgcccagaactagcacttggtctcatgtgggaacattctgcccaggtgctgtgcatttggggagtgtctggccccaggaagggccactctgtgctaagcctgtcctgggctcctggacgccacctgcccggccgcctgcccagcagcccattgtctggcatgtgggggcgcggagcagccgttgttctgcacacatctgatcccgtcttttccacatcagatcatttgtaaccgtcaccaggcaatcgggcccgt

SEQ ID NO: 17494 - DNA, 556 bp, Homo sapiens
tctagtgaaaaactgaatatcccatgataaaaactagatacaagctatctgtgaaaatgctttgcaatgtgtggatttgtctcacaaagttaaacctgtgtttgattcaacgggttggaaacactttttttgtagaatctatgaagaaacatttctgagaccattgaagcctatagtaaaaaattgaatatcctgtgatataaatgagaaacaagttatctacgaaaatgtatattaatctcactgaatgcaacctgtgttttacttcaccaggttaaagatgctctgttggtaaaatctgtgaagggacatttctgagcacattgaggtctatagtgaaaaaacgaatatcctgctataaaaactagaaacaagctatgtgtgaaaatgctttgcaatgtgtggattcacctcacagatttaaacctttgttttgtttcaacaggttggaaacactctttttgtagttggacgaagggacatttttgagtcccttgaggcctatagtaatgaacagaatatcctgcaataaaaattagaaagaagttatctggga

SEQ ID NO: 17495 - DNA, 572 bp, Homo sapiens
caccagaggagttctgaggccaatgctcagacctgtaacagtaaatgacgttatccactcaggctgttagttcggcctctgaaagcgggttttgcaaaacccattgttaattctcaggctctgttgggggtggtcagaaatctaatttgtgagtatcctgtgcattggataagggaatgttttccttgtgtttctcctctgcagactcggattgtctttccttgatgttaactgtcttaggactggctgcttcagagggctgggtatttggtggctgtttgcaggcttataaacagcctttttattttacctttgccgtagactgaggtgcagccctttagcttggcttttcagatgcctgctgtccttgaagcactttcattttacctagcgcctttttggtatggatgcaaagctggtttctaatagactgagaagagaagggggaccgggcttcctccttgccttcccccaggctgctccctgggaacatttttgtgtttgcacagacacctgtccgtctgcagtttgtgccacggggctgcacgattcctaaccttctacccacctaa

SEQ ID NO: 17496 - DNA, 374 bp, Homo sapiens
ctacaagcaatttgcatgtataagattacattacaaatacattattataagcttacattacattgtatacattatacatataatgtataaatattttttgtataagaagcaatctaacaattacttacacaattttaatgctttcataagattcttgtactaaatttggagaaatggagaaatctgaatattttatctatctcagtcagagtttaaaaaatgaatggtacagtgacctaatactttgagctcaaattaaattcaaggtttgctataaaattttttgcattttagcccagaggacatttaaccactttcaattaactacacatattttctcttctatagtacatactatgataatgatattacag

SEQ ID NO: 17497 - DNA, 362 bp, Homo sapiens
gtccactctgaccagcccacagcacagcgcccaccctgcagctccagatgaggcctcactctgtcacccaggttggggtggagtggcacagtcacagctcactataacctcaagctcctgtgctcaagtgatcctgccacctcagcctcctaagtagctggaactacagatgtgcactgccatgccaggcttgtctaacattttaatgtgttgcttcttccagttaactagagtttttggagatttctgtcttcattcatgagggataatagtctgcacatttattttcttgtgatgcttttgtctgatttgttatctgggtaaaactggccccaaaaatgaattgaggttttcctgcttct

SEQ ID NO: 17498 - DNA, 173 bp, Homo sapiens
gagacagggtctggctctgttgcccaggtgggagtgaagtggcacggtcacagctcactgtaacctccatctcctgggctcaagggatccttccttttttttccctccctcatcaacattataatgaaatgatattgaatgaatcaacattattcaagaacctgctgtatttg

SEQ ID NO: 17499 - DNA, 261 bp, Homo sapiens
gtgggttgcaggctgtggatgcatcaggcgactccaaggccattagtgacatggacaggaagagttgtggtgctggtaggaacaaaattctgattgtaatgggtccaaaagaggatggaaggggaaggattggaagcaaagcagattgataactctttttagttttgctacagaaaggtgaagtagtatagtagttcatagggaaaatgggaataagattttttttttactggttagaaataaaacgaaagtataataata

SEQ ID NO: 17500 - DNA, 423 bp, Homo sapiens
acaagtgaagcagttcatacatatgctacagtttaatcctctcactttaaaatcaatagtggaggattttatgtctgggacaggtaataatccctgcacacttggacattaactggagatgtaggcattaaatatgtgcattttacctaggacaaatcaaataatgaagttaatttcatatgtaatgaagttgtgggtgtcgagctgaatttcattcagttgggaataaacctttgtcctctactgattcttttttgtgtcttgtaagtagcagttatcaaagaataatgctgtgaatattgtcctagtttccttaaatagcactcttgaaaactgtgaaccaagaagtgaaataggaaatgttaattctacagaaacactgaaaggttaaatgaaaatataaaattagaattctcttgagat

SEQ ID NO: 17501 - DNA, 499 bp, Homo sapiens
agatcgaggtcgtggtgagccgtgatcgcgccactgtactccagcctgggttacagagcgagacctcatctcaaaaaataaattaaaaagtgcacaattcagtggctttaatatatttatagagttgtacatctatcatgatgaccgatttcagaacattttcattaccccaaaaagaaaattcacaacttttagcaatcaacttccaggcagggcatggtggctcatgcccgtaatcctagcactttgggagactgaggcaggcagatcacctgagcgcaggagttcgagaccactgggcaacatggcgaaaccccatctccactataaaatacaaaaattagccgggcgtagtggcaggcgtctgtaatcccagctactcaggagtctgaggcaggagaattgcttgaacctgggaggcggaggttgcagtaagctgagatcgcgccactacactctagcctgggcgataagagtgagacttcctctcaaaaaaaaa

SEQ ID NO: 17502 - DNA, 329 bp, Homo sapiens
tcagaaatagtctttggctttgattttgattatgattcagtaaaaaatggaaactggggtttggcttagtatagtactctgcaagtcaaagtccattctggctaactgcaggaatctcaaccgaatacactgttggccccggctggtgtcactgaagttccctgaatcatgtagctagtggtcttcaggcagcagttcatccactcaccccagagcctccatgcaggaggccctgaagcaagaattggggcttcaccgtgtgacgacatcacttgctgctgctctctgctggggcacgcccgggggcgggtggggaagcggggatgggc

SEQ ID NO: 17503 - DNA, 490 bp, Homo sapiens
tgaactgccccacaaatcacacctatgtgggggtgtaacacacatacttctaactcagctgcttttaggagctatgcaactaaatgagattgcttttgcagttagggaggcgactactgaaactgtatgaatgaaaaaaactactttctgcataatgagataattttggagacagttgataaaaaccgtaaatccggccgggcacggtggctcatgcctgtaatccaggcactttggggggccgaggcgggtggatcgcgaggtcagaagttcaagaccagcctggccaacatggtgaaacaccgtctctacttaaaatacaaaaataaataaaattacccgggcttggtagcacgcgcctgcaatcctagctactccggaggctgaggcaggagaattgcttgatccaggaagtggaggttgcagtgaagcaagattgcaccactgcactccagcctgggcaacagagcaagactccatctcagaaaaa

SEQ ID NO: 17504 - DNA, 384 bp, Homo sapiens
ttccaaccattggaaggagagggcttccagaaggaggcatcattggttctaagctttgaaccctgagtctgtctattatgttgtctagagacatgcagataatagtgcctgtaacgctgcactctggcgagggtgtccaccgagggctgattccaccagacagtctgtcccagctctctctgtgctcctgtgtgccagcactgggtaggttctcaggttgcccagggcccaacatcctcattgcagaagcagatattccagcgggctcaacagaagcaactatgcacacgagaatgctccttgagagtggcataagggctgttactattattatttatttaatataatataacaataaattccttcacctgcttctttctcatc

SEQ ID NO: 17505 - DNA, 245 bp, Homo sapiens
tggctaagtcactggctttatagcagcaagcaccacagtgcacataaaagaaagaactgttcccagacattacctacagtaaaatcctctctgagttcttttccggaaagaaagaaagaagcaacaaaaaggattaacctagttgcataaagagcagtaaaggactctggcaatgcagttcgcgctcgtaggttcgcatcaccagtgaacagaaggcttgctttaccgctccctcaggagcacgt

SEQ ID NO: 17506 - DNA, 1316 bp, Homo sapiens
taggtctgtatagaatacgactgaaagattttgactgttgatttcctttgaagagattctcctgttctcctcttcagaggaaagagagaggagagagggagagaggagagaaaagagagaagagagggtgacttttcattatatgccttttgtaatatttaatctcctcccttttctcacccccttgagcatgtattgcttttcaacaattaaaaagattaaaaagctcttaaatagataagaatttcttagagcaactagtaagtacactaactgccaattgttttgaaatgtagacattctgaaaaatcaaaatgattgtgccgaatgtattttaaaaggctaaaatattatagcatttcaaagtacatactcatatttataaggacttcctcactaggaagattcctgggttctacagaataaaattcttggctacttgtcttatagctctgaacagacttattttcccagagagtatgtttattatgtaatagcgagttgcctgaccccccaaaaagcttgttctatcatattaaaataaggcaaaatgattactttcagattaagaaattgggactctagatcttgttatatagtgagttctttaaaaaactgaggtcttggttctgaataatagtggtttacataatttatttagaatgtcattggggttatctctgacctatttttataaaataatctcatctttaaaataggagtaaaatgctcatttgcataagccagtaataataatttagtatttttccaagtatttatagtcaatgtgtttgccatgaacttttttaagggatgtttttaattttagaagtgctttaaaaagcaatatggcatctggctctgtagaagtagaaaacatggtaacttcaatgtgatatatttgcttttttcccctcttaggtctttggggtaaaaaaaatccaaagtttactcaattttatttctacatatattacctacaaattatagaggtgagacctgcttgctgcctgttcatacctgtcagtgatactaatacctcccgtctgtacagtgtttcatagtttccaaagggttctcgcatggttcctcacttgagcctggtgaggaaatacctgtaaacatgggtagaagttttagtcccttgtaaaactctggtataatatcaaaaccaggaaattgttcacagattctaaggattggggaaaagagaaaaataaacaaattgctcaggagtagaatttgcaaaaaaaaacgaaacaaaaccaaaaaactctggaaataaggcacgtttagccttacagagcgagaccctg

SEQ ID NO: 17507 - DNA, 453 bp, Homo sapiens
caaaataaatccaaagaaggggtaaaaagggaataaatcaatgatgtagaaaatagacacccaacaaagaggatcaataaaataaaagttgattctttgaagagacctattaaagatacacaagaagtgtctgataagatttttccagaaaaagaaacaccccaaataaatacgagatcagagccagatgtggggctcacgcctgtaatcccaacactttgggaggctaaggcaggtgtatcgcttgagcttaggagcttgagatcagcctgagcaaccctaaccctacaaaaaatacaaaaattagctgagtgtggtggcacatgcctgtgatcccagctactcaggaagctgaggtggaagaattcatagagcccaggaaagtcgaggctgcagtgagccatgatcatgccattgtactccagcctgactgatagagtaagaccctgtctc

SEQ ID NO: 17508 - DNA, 479 bp, Homo sapiens
tcttttcttttcttttttttttttgtgcgcctaggtaggaaaaaaatcactggctaagttcatcaagagaacctaagaataaagacaatattttagataaaaatgggatccttaatttctgtaaaactgagttccttctggcttatacattaggactgtataccaagtcttacagaaatggcaaaacattactaaagatacttagagtggaacattccaaatgaacaacaatgccaatgcatttaaacaacaatgccaagtacatttataaatgagggctctcagtaaagtctctttgactaaaaacagttttggcactattggatgtcaactgctattctttttggaataatctgccttgcactctttgttgactgctgtgggtgacaggatgaggcatgtacagaattgtggtgaatggggagctttttccttctccctacaaataaagaaacttgatagctgatgggactgtgggg

SEQ ID NO: 17509 - DNA, 451 bp, Homo sapiens
aaatggctgacaaggtgcaattatcctcactgattcaaatctgtgaagcacctgctatgtgccaggtggcattgcttgacccttgctctcagtaaataagcaaaggaacacgatgacaggtgtggttttccaccttcttagaccacacaatccagtatcttttatttatttatgtatttgagatggagtgtcactcttgttgcccaggctggagtgcaatggggcgatcttggctcaccgcaacctccgcctcctgggttcaagcgattctcctgcctcagcctcctgagtagctgtgattataggcgcccgccaccacacccggctaatttttgtatttttagtagagacgaggtttcaccatgttggccaggctggtctcgaactcctgaaatcaggtgatctgcccactcggcctcccaaagtgctgggattacaggtgtgagccacc

SEQ ID NO: 17510 - DNA, 1844 bp, Homo sapiens
ctcttttcaaagtaattggggatgcagtgcttagaactgggctggcattgtaagccaactgtgcagtcatctgctgaatcaggctaagggtaggtcctggaagatactccttccaaaccttataatcagaggtgactgcacagttggcttacaagagcctcttttcaaagtaattggggatgcagtgcttagaactgggctggcattgtaatttttttaggaatctgctcccatttacaagacgttccatcataaaaatcaaatcataaaatcaaatccaagtatgttcatttggtatattcattttccacttcttactaggggtggtgggggaggagaagctggtacaggagaaatgtcttttatttcccctctataacaatggtataattccaaatcttatagaccatcacacagttctgttagttgattgttttccgtggattctaccctgccaggagacacaataaataactttttgaaacttcattcttcagtcctgggagtttttacaaataaaaggacacacatgttgagacaaattacatgcttgaaaatctgtcactaacatcaatttcatgttaaaaagtactaagcaactattacagtggcatttcttttgttgttggggaaaataatgtgaatagctatgctaattcagagataattttcaaatttcgtgactaaataaaaaagctaagagtagttcactaggtaatgtttgggagggagttgttggttttgttgatttattatatcttgactggtatgattgaaatgaattaaatgttagacgtgcttaacattttatatgctatatatcatcataatagcaaagtgcacagatcacattattgagtgcctttggattttaaaaataaagattgctattcagatgaataccatttcattattgcctgcactactctgtcaaattaaaaaatataatagctatctttattctcgttttaaagcatgataatcatcaaaatgttgaagtttatcacagttctacattaaaaataagtcatttttgtagatgagttatccaatacagcaaaggccatcaaagagaaagccaatactttcatggagagctcagagccttaatagatcccagcagcaatgcttcaaccattcccaactccatgttccttgctagatgctcctcaccccaaactcctgcaaatttcaagaatttctgtgtatgtgtgtgttaagggaggagttttaaagtatctctgtattcaacaagatacgtcagcttgtaagcagcagaaacctacttaaactagcttacatgagaaaataacattataaagacataggagtgtttctacaccaagagctggaggtattgtttggtttcatgaaggattaaaatctgtaattcaaaagtagactcaggcagctgcacatcaatctgtgtctttctctctggtactgtggactctatcctgtctgacttgctttgttcctgggcatcattcttgctctggaaaacacactttccctgctcatttttttattttaatgcttaggttcaatctgctcatttttccctacagcagaagacagcttactgtgttccagcaaacaacagagcctgaccagcctctctgaatatggggcccccttctcactcacaagtattcttaacctggggtccatgtggggtttgtgaatttggataggattttaaaattacattttcatttccactaatctctaaccgaaattcagtcttttcttcaactgtgaatgtaggcagcaagccacagtggaacttgccgaacctataaatttgtcactgtgattgatgttataatgttacacctagatct

SEQ ID NO: 17511 - DNA, 479 bp, Homo sapiens
gtttggggttgttaaacttttgtttaggttacttgcatctatgttctttagtgaggttgtcttttaattgtctcatactgtccacagtaggttttagtatatggattaaactattttcataaagtgagttggaaactattcctgctttttattcttttatttctccttagaatgttcaatagaacttgtcagaaatgggctgggtgcagtggctaacacctgtaatcccagcactttgggaggccgaggcaggcagatcacgaggtcaagaaatcaagaccatcctggccaacatggtgaaaccccatctctactaaaaatacaaaaattagctgggtgtggtggtgcactcctgtagtcccagctattcaggaggctgaggcaggagaatctcttgaacgcgggaggtggaggttgcagtgagccgagatggcaccactgcactcctgcctggtgacagagcgagactccatctcaaa

SEQ ID NO: 17512 - DNA, 453 bp, Homo sapiens
gcttcccatgaaagaacccctctaatcttcagaacaaccctgtgagaactggctgaagtttactttttggttctccagagacctagcttcttccaatgtggtctatttaatctcctgtcatgtgggaaattatattcaaaatctccatgatcctctgtccatagtaagttatgcatgtagtgagaagtacatgccacaaggtcttgagattatatctgcaatgtgttgctgctggctgttgatcaagataggctgggagaagatcattttcaggtgtgaaaaactgtcacctttatcaaataattcttcttgcatatttcccaagacgttgtagcctgtctaaacttgggaggttaattttgtagcattcattatgaccgaaaatgtagttcacacaatcatgatgctctctttattaggtgttactgttaaacaatattaaaatacacacaa

SEQ ID NO: 17513 - DNA, 569 bp, Homo sapiens
aagcaaatgtagacaacttttgattgcctaactctcagtgaaacttaaccatcatagaggtattctccctattataacaaagttagattccaaaagcttgtaagtaagctgtgtataacttggacatatgttttcctatagcaccatttctgcatgtaagactgtgtttcgaacctcagcttggagcttggacaatcaagaagaggtgtctttgctggcctcagctatgagaatcctatctaggtaccgccatctctagctatctgtagcaccaaccctctgctactactgctgccttctcccgtgggatgaatgtggtgaattgtgcattcatatttcaggaatgattaacattcaaggttggagatattccagaatcacaatttgattttataagatgctttgcagaaatatcttagataatctaaggattcctaatggcttatacaaaagaactaaagtgagtgtgactatccagcttcttctatttcttcctactctttcacttcttttgttcccttcatgattctgctgcatgccaggaatggactcacatgacttctcaaact

SEQ ID NO: 17514 - DNA, 663 bp, Homo sapiens
tcagctctagcatctttttagctctttattttcatgtacacctaaataagattctatcttggagagtttgtctatttttgtgtatgttgtttgtttttagcaactctgttaatcttaaaccccctaaagcatctgcttattttttcagttttttcaaaatcagttatccatgtatatgatctaagaaccaaccagctccacatagcttcccagcttccctttcccatttctgcttccttagaagtaactaccttcaactctttttagtttattcttttggtatttacctccatattgccaagtaacatgtcatttttgctattggtaatttcttactactagatactatctcctgacttccctctagggaagatgagcttgcattccctcccctgcccactctatttatgtatatatttcttacctccacttcccatgatcatacacatgctattcagattttacccaagtaatacctaattatattttcttgtctgtatattttgttttctctggagttagtaatttaaaaaatatgcttgatggacaagtgcagtgacttatgcctgtagtcccagcactttggtaggccaaggtgggaggatagcttgaggccagaagtttgagaccagcctggacaagatagtaagaccctgtctctac

SEQ ID NO: 17515 - DNA, 560 bp, Homo sapiens
acaacgaacagacaagaatgcctacttccaccacttctattcaatgtagtattgaaagttctagctagagcaattaggcaaaacaagtaaataaaggtcatccaaatttgaaaacagaaacaaattgaatacgctttacggtttctacacaaggttagcatttactccctcactacttccaaaaggaatttgagatgacttaaaataaaatgcagattctaaaaacacaagaattagacaagaaggaaaaggaaagtgaattagaagccctaaataggccaagtgcagtggctcacgtctgtaatctcagcactttgggaggataatgcggacgggtgacttgaggtcaggagttctagatcaacctgggtgacatagcaagaccacttctctacaaaaaagaatttttttttttaattagcccagtgtggtggtgagtgcctgtagtcctagtcaggagaatgaggtaggggttgatcccaggaggtggaggctgcagcgagctgtgatggtatcactgcattctaacctgggtgacgatgagatcccccatctctatt

SEQ ID NO: 17516 - DNA, 390 bp, Homo sapiens
gtatttgatctgttctgcatggtgtttggccctcctctttgcaagttttgcaatttcactgtccaacaagcagtatctggtaggagttttaataagactcttcacccttctttgtgctcaagaaaatattgtcagcactcttccattccctcagaaacaggatcccacccactctgacatagctgttccacacaagaaaccaaacatgtaaaccctaaacaaagagagtttgatgccaagggttactttttctctttattctgtaatatatttatacacttttgctcaatatcaaactatttgaagtcattataaataaatccagaaatatgtgctttatagcctcaatatgagcaaataccaggccagaactgaccaaatgcacaaaca

SEQ ID NO: 17517 - DNA, 359 bp, Homo sapiens
ttcagcactacagtagcagagttgagtagctgtggcagacactgtatggcctgaaaggcttaaaatatttactgtcttgccctttacaggaaaagtttactgacccctgaattgaatgagccacattcttcactttaaaaactgtgaaagattttacagctggatattactcttcccaagcctttctggttaggatttgtctttcaaagtgatcaaagaatgttggagatacaaataatctgagaagattcatctagtctggaatgtcttccattccacagataaaagccccagagacggatcacgaggtcaggagatcgagaccatcccggctaaaacggtgaaaccccgtctctact

SEQ ID NO: 17518 - DNA, 390 bp, Homo sapiens
agaacaatagaaactactcagtctgaacaacggagaaaatagagtgagaaaatgaatagagccccagggacctgagagatggtaacaagagatctaacattcctgtcactggagtcccagaagaagaaaaaaagaaggcagggctgaaaaagtacaccaagaaataatgactgagaacttcccaagtttgtcaagagacaaaacatagtgattcataaacatagtgattcaaaaagatgaggaaggccgggtacagtggttcacgcctgtaatctcagcactttgggagacagaggaaggcagactgcttgaggccaggagttcaagaccagaccgggaaatatggtaaaaccccatctctaaaaaaaaccaaaccaaaaaaacaaaaac

SEQ ID NO: 17519 - DNA, 357 bp, Homo sapiens
tgggatattaggggtttaatcacaattaaagatgaaaaatgttaggagggaagtaaagcagaaagcccaaatcagacagtgaatcagggattaagtgggcccaggagaaaggaggaagggaaggagctggaggggcgggagaacaggagacagaacaggacagagacagctgcccgggaggatgggagaacagaaagagggaggaaacgccgagcactgacctgggggaggggagtaaagagaagtgaagggggattggaagggaactggagaatgagagaagcacccgcgaggtagaggcacccgggaggtagagggcggggaggcacccgcgaggtagaggcacccgcgaggtag

SEQ ID NO: 17520 - DNA, 449 bp, Homo sapiens
tgggatattaggggtttaatcacaattaaagatgaaaaatgttaggagggaagtaaagcagaaagcccaaatcagacagtgaatcagggattaagtgggcccaggagaaaggaggaagggaaggagctggaggggcgggagaacaggagacagaacaggacagagacagctgcccgggaggatgggagaacagaaagagggaggaaacgccgagcactgacctgggggaggggagtaaagagaagtgaagggggattggaagggaactggagaatgagagaagcaacaggcggggtgcgtgtaggagggcgggagagccaatgacaagacagaaaaggcagagaaagcaaagcaagaccagactcctcatccggtaacactgtgtcaggtcattgccctcccaccccgcccccaaccccataactgaaaacaagtaggaacctggataa

SEQ ID NO: 17521 - DNA, 180 bp, Homo sapiens
gggagatgcagttgggtagagaggttgaagggaaaatgagaccaggtgcaggtcagctgatccattctgctgggtgactcagttccagcgcggtcctagtgagggcctgggtggcatttggagtctcactgacctggtcttctgtctactatttctttgcaaacctgtaaggactaaaga

SEQ ID NO: 17522 - DNA, 2316 bp, Homo sapiens
  misc_feature (96)..(96): n is a, c, g, or t
  misc_feature (99)..(99): n is a, c, g, or t
  misc_feature (127)..(127): n is a, c, g, or t
  misc_feature (149)..(149): n is a, c, g, or t
  misc_feature (151)..(151): n is a, c, g, or t
  misc_feature (208)..(208): n is a, c, g, or t
  misc_feature (549)..(549): n is a, c, g, or t
  misc_feature (573)..(573): n is a, c, g, or t
  misc_feature (578)..(578): n is a, c, g, or t
  misc_feature (638)..(638): n is a, c, g, or t
  misc_feature (691)..(691): n is a, c, g, or t
  misc_feature (1254)..(1254): n is a, c, g, or t
attttattttattattattactttttttgagattgagtcttgctgtgtagcccaggctggagtgcagtggcacgacttggctcactgcaatctccnccncctgggttcaagcgattctcctacctcngcctcctgagtagctgggatcncnggcgtgtgccaccacacccagctattttttttttttttgtagtgttagtagagacangatttcaccatgttggccaggctggtcttgaactcctgacctcaggtgatccacctgcctcggcctcccagagagctgggatttagaagcgtgagccaccactcccggccaatatatttgtatttgtaagttcacatcattcaaaaatctttatatctggtttctacctatttgagacaatatcctatgaattggtttttaaattaaaagaacatcatattggggagaagattgctctgtaatgtttgttcaagaaagcagcaaactaggctgagtgcggcagctcacccttgcaatctcagcactctgggaggctgaggctggcggatcacttaaggccnggaattcgagaccaacctggccancatgntgaaaccctgtccctactaaaaatacaaagattagccggatgtggtggcatgcacctgtngtcccagatagtcaggaggctgaggtgggagaattgctggaacctgggaggcngaggttgcagtgagccgagattgcactactgcactccagcaagtgcaatgagaccctgcctcaaaaataaataaataaagcagcaaactgattttttaagcaaaaaaaaagaaagaaagaaagaaagaaaaaggctgccagtatcatgtgaaatttagagccctacttctaaaataccgttgctgcataagatttttaggaattcagatgcatcactaaatattttttttttaagtggtgcaagtatgaaaggaaagggctctgagccaggcgcagtggctcacacctgtaatccaagcacttagggaggctggggtggacagatcacttgaggtcaggagttcaagaccagcctggccaatgtggtgaaatcccatctctactaaaaatacaaaaattagccaggcgtggtggtgcacacctgtaatcccagctacacaggaagctgaggcaggagaatagcttaaacctgggaggcagaggttgcagtgagccgagatcccgccactgcactcctgagtggcagagtaagactccgtctaaaaaaaaaaaagggctgtagnctggcctggtggctcatgcctgtaatcccagcagtttgggaggccgaagcggggcagatcgagaccagcctggccaacatggcgaaacctcatgcctaccaaaaatacaaaaaattagccagacgtggtggtgggcgcctgtaatcccagctactcgggaggttgaggcaggaaaatcgcttgaacccagaaggtggaggttgcagtgagccaagatcgtaccattgcattccagcctgggcaacagcgagactccatctaaaaaaaaaaaaaaaaaagccgagcgtgatgtcatgtgcccataaccccaactactcaggaggctgagacacgagaataacttgaacccaggagatggagattgcagtaagctgagatcacgccgctgcactccagcctgggagacagaggaagactgtttcaaaaaaaattaaagagctgataccttttgcagtgggaaattcttaaagttttaagccaagtgcctatttttaactgatcatagtgtgatgtccacagaggcacaatgtatattagtactttcttccatatttggtacataatgaatgcctttggtactcattttctgaatggtttgctctagtaggaaagaaaaaaaaaaaaagcaagaggcagctttgcctgcactactgaggctgtaccaccagaaagcttcattcccatggttcctctgtatggcatccaagaagttgcagagtcccttgtgtagttcagagagcaggggtgtttctcaggatttcagagtcatcagctgctttgaaggtgtgcttccttcacctgtgttttaacgccctgccccaggggtggtccctgtctcccttgggtacagtgccctgtggcaccttgggtgctctagttccaggtttgcctcgcttcccctctgagggtgttctggagaagcagtgctttttaaattgacgggtcccatcctctgccagttctagactttatttcaagaatcaccagtgcaactatatatacatcttcaggttgctgtttttatttttaataattattaaatacattttctcaaaaaaatta

SEQ ID NO: 17523 - DNA, 1593 bp, Homo sapiens
  misc_feature (531)..(531): n is a, c, g, or t
cagtgtggtatggatttactgggtaatgcatggtgtgtcatctcctgatagaccttaaccatgtgtcttctggtgacctccctatgtcatttgaagccccttccttttcacctttgattctagaagactgcttttgaaaaaatgggcacattttaaaacatttttaggaattcagatgcatcactaaatattttttttttaagtggtgcaagtatgaaaggaaagggctctgagccaggcgcagtggctcacacctgtaatccaagcacttagggaggctggggtggacagatcacttgaggtcaggagttcaagaccagcctggccaatgtggtgaaatcccatctctactaaaaatacaaaaattagccaggcgtggtggtgcacacctgtaatcccagctacacaggaagctgaggcaggagaatagcttaaacctgggaggcagaggttgcagtgagccgagatcccgccactgcactcctgagtggcagagtaagactccgtctaaaaaaaaaaaagggctgtagnctggcctggtggctcatgcctgtaatcccagcagtttgggaggccgaagcggggcagatcgagaccagcctggccaacatggcgaaacctcatgcctaccaaaaatacaaaaaattagccagacgtggtggtgggcgcctgtaatcccagctactcgggaggttgaggcaggaaaatcgcttgaacccagaaggtggaggttgcagtgagccaagatcgtaccattgcattccagcctgggcaacagcgagactccatctaaaaaaaaaaaaaaaaaagccgagcgtgatgtcatgtgcccataaccccaactactcaggaggctgagacacgagaataacttgaacccaggagatggagattgcagtaagctgagatcacgccgctgcactccagcctgggagacagaggaagactgtttcaaaaaaaattaaagagctgataccttttgcagtgggaaattcttaaagttttaagccaagtgcctatttttaactgatcatagtgtgatgtccacagaggcacaatgtatattagtactttcttccatatttggtacataatgaatgcctttggtactcattttctgaatggtttgctctagtaggaaagaaaaaaaaaaaaagcaagaggcagctttgcctgcactactgaggctgtaccaccagaaagcttcattcccatggttcctctgtatggcatccaagaagttgcagagtcccttgtgtagttcagagagcaggggtgtttctcaggatttcagagtcatcagctgctttgaaggtgtgcttccttcacctgtgttttaacgccctgccccaggggtggtccctgtctcccttgggtacagtgccctgtggcaccttgggtgctctagttccaggtttgcctcgcttcccctctgagggtgttctggagaagcagtgctttttaaattgacgggtcccatcctctgccagttctagactttatttcaagaatcaccagtgcaactatatatacatcttcaggttgctgtttttatttttaataattattaaatacattttctcaaaaaaatta

SEQ ID NO: 17524 - DNA, 358 bp, Homo sapiens
gttttcaacagtagtgtatgagaacttagattgtccacatccttgtcaatacttcttgactgactttgattatagccatcctgctggatatgaaggggtttgatttgcatttccctgatgactaatgatatcaggcatatgtatttattattcatttgtatgtcttcacttgatcttagccaaaaagcagagaagcaatacatttgtatatcttctttggagaaatgtctactcagatcccttgcccattttaaaattgggttatcattttattatgagttgcgaaagttcttcatatggtatagttcttcatatacaaggtatccaaactatacaaaggtatatgattaggaaatag

SEQ ID NO: 17525 - DNA, 399 bp, Homo sapiens
ttcagttgggcctactttatctgtagtctggacattaatttaatttaattgtattaaagattagagggcaatagtcatttttattagagctgttttagttaaggtcatgttttgtagagagaaatccaaatgtagataatgttttactctgaacattaatattgttaaaggctctccagtgaattctcctagaatcgttgttcagagggaaatagacctgctgtattttatgtggtgccatattgacctttaggttctaatcaatagctagctataattagagagagagaaaaaatgattaatttggtatctgaaatctcatgtagcaggcttggaagacacttggaagtaacaaaagtcacactgtaaattagtataacttttttcataagacttcat

SEQ ID NO: 17526 - DNA, 621 bp, Homo sapiens
cttagatgctgggaaataaaatatgaataagacatggtctttgcccccagtaaatagctcactatacaaaggtttccttgtcatttaatttataaattaggagagccactctttatgtatttattttgcttctgtgtaatttgagttttgttttctcaggattgcctcactgaagcaagtcctaaatcaaatacagtctttgtcatgggagtcaaagtttcacaaacaaacacgcatagtttgctagattaaaagtcccaataacgctattctagggctttacccatcaactgaatgtgggtccccacaggcataggatccatgcctgtttcagtctgccaacagcgtggctccaggaaggaagcctgactgctgcagaacaagaaatgcattatgactttatcttttttctaaaccattagctgaaattactaaattattaacccagccatataaatgaattataaacatagcatatgtgcatttgattaatctgtttttcatgtcaagtgttatacagacctggggtacaaactcatggggatacttaagtaacacacagatgaagtataaagggtgtaaaccaagggagaggcaggaagtgtggcaaaatggtgattg

SEQ ID NO: 17527 - DNA, 320 bp, Homo sapiens
agaaagggaagtctgctctcactggacactggaactgtttgtctctgtctctgctgtactttccctgcctctacctcacttagtaaagaaatcatctttgcttgataactaaaacaaccaataaggctgagaaaggggaaaacccacatctggatttaaatacaaggtaagaaatatttttctctttagaatatcccactcactttgggaaagtgatttcatgtgatgtattattcaagactctcatcagcaaatattttctgaatgtatactatgttctaggtattgggccagctgctggggattaaactttgaacaaa

SEQ ID NO: 17528 - DNA, 415 bp, Homo sapiens
atataaataacagctcgtaatacacactgttccacatctcgctttttcatctagcaatgatctagctttttcatctaaaatgatcttcaagatcattttatttcagttcatacagaacattctaattctttttataattgtatacaattccattcattgcatatagcataatatgactgctatggtctgaatgttaatgttcccaccaaaaattcatatgttgaaacataattaccaatgtgatgacattaggaggtagattagatcatcagagtgaagtcctcatgaatgggattaatgaccttaaagaggctcaagagctgccttgcttcttccaccatgtgaggacacagcaagaagacgcagtataagtacaagggccttttacctgccagcactttgatcttggacttcc

SEQ ID NO: 17529 - DNA, 526 bp, Homo sapiens
ggcatggatggtgatccttctgtccagtctacgctggccatgctggccctgaggcctggaactggggagcacgagcaggatgacatctccagtgtctgtctgggtcacctgttagcggatgagaagtccagccttactgcctgttctccacctgcatttaggcttcatccctggaatgtcaccttctgtcttctggaaaacgtctaggctctgctgccatacagaacccttctgcttccttaaggagacggtccactgtccccttgtcttctctcctctaagcaagaggggcccctgcccgttgccctttcctggatggagcatgagttttgatgtcaggcaggtctgggtttgaagcctcgtttgtcttgccttcagaataacctctctaagcctcagttttatagcccgaaaatgggggtgattataactcctgaagggaagttttgggattggctgatacataagatacttagcacagtgcctggcacacagtaagcgatcaataaatggtagcatttatagc

SEQ ID NO: 17530 - DNA, 361 bp, Homo sapiens
cgcgacccgcagcccacccctgcaccagtggacactgcgggatggcctggcctcggctctgcattttcacttctcttagctctcatctcctccaccacagagacagctctgtctgagtatctttctgatactgttctttatcccccaggactggcccagcccagggcggtgcgtacagcagacacttaatgtaacacagtagcagcttttaatttctcaggccaatgagatacagacagtcactggtatggtagtttttcagtcaagcatcaagggaagaacttattagtttgaattacaaacaacagaagtagaaaactccacaaggaaaaatctcagctggtgaagaagctcaggagct

SEQ ID NO: 17531 - DNA, 511 bp, Homo sapiens
agaatctcagaccccaccccagaccaactgaaggagaatctgcattttaacaggctttccagactccaggtgagagcacattacaggtggagaggcacaaggtggaaccttgccgattgagagagaattaagtgttctttcccctccttcctctgagccagatcacaatgacttggatatggaaaaaaaaaattagggtgataatttttccctttgaccctgctcccccaagcccccaactgaaaaatgggtgtggtccattcatcttggaagcattatgattgccattattatttagttatttttcttttacattactagtgtgtcactatgtaatacatgacctgtaatcatggttataatcacagttaattatacatcatgaggccgggcgcaatgactcatgcctgaaatcccagcactttgggaggccaaggcaggtggattgcttgaggtcaggagttggagaccagcctgggcaacatggtgaaactctgtctctactaaaaat

SEQ ID NO: 17532 - DNA, 4061 bp, Homo sapiens
aagaaagaggggcagaggagggaaggcgactgcagtccgaaaggagcttttggaagctaggaccctaagcgtcaggacgtggcattggtcgagagaaagcctgggctggcaagagctgccgccggtgctgggagagcatttatttgggagaaaaagaggggagagagcagagggagggggaggaagagagttcaaaccgaagtggatggaaggggactggggtttctgccgcgcagggagccgtgagccagggcgatggcgctaagggcggcgcggagcagctgcgctcccgagaacgcgtctcctcgcagaggactagcagacatcgggaaggtctgcgccaacgggaaccaacttgtggctccaaaatgtacccaacgcagctggaaatgagatcaaagctgcagttgcatttgagaaggatgagaagagccagcgattagggaattttttttttacccgttttcttcctttttctttttttcttctttttctttttttctttcttttttcgtgtgtgttttttttaatttgcctaccaccctgtctgtcccctcacttcgccctccccatttgaaataaaagccccagtctcaacttccatcacctcggcgctcccggagccactaccggctgatggaggagaaggggacccgggggctggcaggggccaccggcgagggaccgcatcctgcgtctcccccgtgatcccggccccgaccgcggagttctgcaacacctggaggatctggaccgggtgctgggggtgggggcggggacagaggaaggaaaggcaccccgagccttaaaaagaaaaaaaaaaagtagcggggggaggaatgggtttcttcttgacagctgacggagccttgaaattttcctccactacctccgcccccgcccccgcccccgccccccgcactccatttaacgtgagattatgaaattgcagaggcggtggagggaaggagacaggatataaccggagtttggaggggagaggggaaggtggctggccgggtggctgaaatcaaaaattcaattgcgcactgggttgtgatgagaaatctaatcagatctttggcgaaggggccggccggaaggatggagagtgggggggaagttgctccccaaattcttcgaaggggaggctggggagaggaattgaccatgtaaaaggagacttttttttttggtggtggtggctgttgggtgccttgcaaaaatgaaggatgcaggacgcagctttctcctggaaccgaacgcaatggataaactgattgtgcaagagagaaggaagaacgaagctttttcttgtgagccctggatcttaacacaaatgtgtatatgtgcacacagggagcattcaagaatgaaataaaccagagttagacccgcgggggttggtgtgttctgacataaataaataatcttaaagcagctgttcccctccccccccccaaaaaaaaggatgattggaaatgaagaaccgaggattcacaaagaaaaaagtatgttcatttttctctataaaggagaaagtgagccaaggagatatttttggaatgaaaagtttggggcttttttagtaaagtaaagaactggtgtggtggtgttttcttttctttttgaatttcccacaagaggagaggaaattaataatacatctgcaaagaaatttcagagaagaaaagttgaccgcggcagattgaggcattgattgggggagagaaaccagcagagcacagttggatttgtgcctatgttgactaaaattgacggataattgcagttggatttttcttcatcaacctccttttttttaaatttttattccttttggtatcaagatcatgcgtttctcttgttcttaaccacctgatttccatctggatgttgctgtgatcagtctgaaatacaactgtttgaattccagaaggaccaacaccagataaattatgaatgttgaacaagatgaccttacatccacagcagataatgataggtcctaggtttaacagggccctatttgaccccctgcttgtggtgctgctggctcttcaacttcttgtggtggctggtctggtgcgggctcagacctgcccttctgtgtgctcctgcagcaaccagttcagcaaggtgatttgtgttcggaaaaacctgcgtgaggttccggatggcatctccaccaacacacggctgctgaacctccatgagaaccaaatccagatcatcaaagtgaacagcttcaagcacttgagacacttggaaatcctacagttgagtaggaaccatatcagaaccattgaaattggggctttcaatggtctggcgaacctcaacactctggaactctttgacaatcgtcttactaccatcccgaatggagcttttgtatacttgtctaaactgaaggagctctggttgcgaaacaaccccattgaaagcatcccttcttatgcttttaacagaattccttctttgcgccgactagacttaggggaattgaaaagactttcatacatctcagaaggtgcctttgaaggtctgtccaacttgaggtatttgaaccttgccatgtgcaaccttcgggaaatccctaacctcacaccgctcataaaactagatgagctggatctttctgggaatcatttatctgccatcaggcctggctctttccagggtttgatgcaccttcaaaaactgtggatgatacagtcccagattcaagtgattgaacggaatgcctttgacaaccttcagtcactagtggagatcaacctggcacacaataatctaacattactgcctcatgacctcttcactcccttgcatcatctagagcggatacatttacatcacaacccttggaactgtaactgtgacatactgtggctcagctggtggataaaagacatggccccctcgaacacagcttgttgtgcccggtgtaacactcctcccaatctaaaggggaggtacattggagagctcgaccagaattacttcacatgctatgctccggtgattgtggagccccctgcagacctcaatgtcactgaaggcatggcagctgagctgaaatgtcgggcctccacatccctgacatctgtatcttggattactccaaatggaacagtcatgacacatggggcgtacaaagtgcggatagctgtgctcagtgatggtacgttaaatttcacaaatgtaactgtgcaagatacaggcatgtacacatgtatggtgagtaattccgttgggaatactactgcttcagccaccctgaatgttactgcagcaaccactactcctttctcttacttttcaaccgtcacagtagagactatggaaccgtctcaggatgaggcacggaccacagataacaatgtgggtcccactccagtggtcgactgggagaccaccaatgtgaccacctctctcacaccacagagcacaaggtcgacagagaaaaccttcaccatcccagtgactgatataaacagtgggatcccaggaattgatgaggtcatgaagactaccaaaatcatcattgggtgttttgtggccatcacactcatggctgcagtgatgctggtcattttctacaagatgaggaagcagcaccatcggcaaaaccatcacgccccaacaaggactgttgaaattattaatgtggatgatgagattacgggagacacacccatggaaagccacctgcccatgcctgctatcgagcatgagcacctaaatcactataactcatacaaatctcccttcaaccacacaacaacagttaacacaataaattcaatacacagttcagtgcatgaaccgttattgatccgaatgaactctaaagacaatgtacaagagactcaaatctaaaacatttacagagttacaaaaaacaaacaatcaaaaaaaaagacagtttattaaaaatgacacaaatgactgggctaaatctactgtttcaaaaaagtgtctttacaaaaaaacaaaaaagaaaagaaatttatttattaaaaattctattgtgatctaaagcagacaaaattatg

SEQ ID NO: 17533 - DNA, 769 bp, Homo sapiens
agcgggtcaccacctcccgcaagtgccagagccgagcggactgcgcggaggctgcggagccggcggccgcgggagctgaccctgcggggtcccggggggggagggggagccgcgaagcccccactgaggccgccgctgccgggcctcccctcccccccgggcgggcgccatgcgggggagcccgggcgacgcggagcggcggcagcgctggggtcgcctgttcgaggagctggacagtaacaaggatggccgcgtggacgtgcacgagttgcgccaggggctggccaggctgggcgggggcaacccagaccccggcgcccaacagggtatctcctctgagggtgatgctgacccagatggcgggctcgacctggaggaattttcccgctatctgcaggagcgggaacagcgtctgctgctcatgtttcacagtcttgaccggaaccaggatggtcacattgatgtctctgagatccaacagagtttccgagctctgggcatttccatctcgctggagcaggctgagaaaattttgcacagcatggaccgagacggcacaatgaccattgactggcaagaatggcgcgaccacttcctgttgcattcgctggaaaatgtggaggacgtgctgtatttctggaagcattccacggtgaggtgggggtggctttccccagctgaaggctgtgccctcttccccaggggggccttgctccgatctccccagggcttggatgggctggaccaggactttccagaaggagaaggc

SEQ ID NO: 17534 - DNA, 3233 bp, Homo sapiens
agcgggtcaccacctcccgcaagtgccagagccgagcggactgcgcggaggctgcggagccggcggccgcgggagctgaccctgcggggtcccggggggggagggggagccgcgaagcccccactgaggccgccgctgccgggcctcccctcccccccgggcgggcgccatgcgggggagcccgggcgacgcggagcggcggcagcgctggggtcgcctgttcgaggagctggacagtaacaaggatggccgcgtggacgtgcacgagttgcgccaggggctggccaggctgggcgggggcaacccagaccccggcgcccaacagggtatctcctctgagggtgatgctgacccagatggcgggctcgacctggaggaattttcccgctatctgcaggagcgggaacagcgtctgctgctcatgtttcacagtcttgaccggaaccaggatggtcacattgatgtctctgagatccaacagagtttccgagctctgggcatttccatctcgctggagcaggctgagaaaattttgcacagcatggaccgagacggcacaatgaccattgactggcaagaatggcgcgaccacttcctgttgcattcgctggaaaatgtggaggacgtgctgtatttctggaagcattccacggtcctggacattggcgagtgcctgacagtgccggacgagttctcaaagcaagagaagctgacgggcatgtggtggaaacagctggtggccggcgcagtggcaggtgccgtgtcacggacaggcacggcccctctggaccgcctcaaggtcttcatgcaggtccatgcctcaaagaccaaccggctgaacatccttggggggcttcgaagcatggtccttgagggaggcatccgctccctgtggcgcggcaatggtattaatgtactcaagattgcccccgagtcagctatcaagttcatggcctatgaacagatcaagagggccatcctggggcagcaggagacactgcatgtgcaggagcgcttcgtggctggctccctggctggtgccacagcccaaaccatcatttaccctatggaggtgctgaagacgcggctgaccttgcgccggacgggccagtataaggggctgctggactgcgccaggcgtatcctggagagggaggggccccgtgccttctaccgcggctacctccccaacgtgctgggcatcatcccctatgcgggcatcgacctggccgtctacgagactctgaagaactggtggcttcagcagtacagccacgactcggcagacccaggcatcctcgtgctcctggcctgcggtaccatatccagcacctgcggccagatagccagttacccgctggccctggtccggacccgcatgcaggcacaagcctccatcgagggtggcccccagctgtccatgctgggtctgctacgtcacatcctgtcccaggagggcatgcggggcctctaccgggggatcgcccccaacttcatgaaggttattccagctgtgagcatctcctatgtggtctacgagaacatgaagcaggccttgggggtcacgtccaggtgagggacccggagcccgtccccccaatccctcaccccccacacctcagccactggagactgatgatccaaccacaggatccctactctttggccacgagatcccagtacccagatcctggatcctagactcctatgccccaaccattgggtcatgggatcccagcatccagatcctggatcctagactcctatgccccaaccactgggtcatgcgatccccacccttcagccactagatcccagatccccctgtaaccataactgtggatcccttacttcagcaactcaagtctgctaccctaaccacaagattcaagattatccacaccccagcccttaatccccatcccccaaatcactggatcctgcagccccacatcctaaggtggatcccacgcttccctgtgccccctactggatcctggacctctacgtcttaaccactggatcccacacaaatcagtgaatggatcccaacaccccaaccacaggagcacggattccctgtacctcaacacccagaccctgcctccctcaggcaccagatccagtgtcctagtgaaacgctggatcctagatccccaaccccagatccccatgcctcgagccctggatctccaagctcagctgctggattctggatgtcaacaaacctcaccactggatcctgacaaccacaatgcctggatcctggggcccccatcactggatcccagatcccctcactccacccactggattcctgcattggtttttggttttttgtttttttttaacctcgacactgggtctcagatccttctgctgactgccagatccctgcatttcaagcactacgccttccacccccgggtcccaaatgttcaggccccaagtctagatcctggcagcccagtcacagagtatcccacacacactggtgcccagagccggcttctcatgacatgaaattgcatggtcgagggagtctgtggggaaggaagcccaggtcctggctgcaacctgcacggatgctggattccccctcaccccacctctgcatggccaccccctcccagccctgtggggaaactgttccctggaaccactccactccctgcatccccacacttcacagcatcttccatccccctcccaccttctaggcgaatagtccccagagctgtgttcctccaaggggtccgaggaatcactcactcctggaggctggcaaggagacagtctgaggccagggacacatgaagggatgtccccaccccagcactatcagggcctccccaggcttccagagttgaaagccaggagaaaatcggcaaagaccacccttccctaaacccaagcacccaatgatgcaaaaaacaaaaacaaaaaaaaaccaccaaatccccaaattcattccagatctatttttctaccagagagaggagcaaagtcctcctcccctgcgcccttacattctgcacttcatagttggattctgagcttaggatcatctggagaccccatggagggacttggaaaggggaactgggatttggggaggggctggaggacttccgcacgcttccacctccttcgacctccactgcgccccacctccctgcctgtgtgtgttatttcaaaggaaaagaacaaaaggaataaattttctaagctct

SEQ ID NO: 17535 - DNA, 3438 bp, Homo sapiens
agcgggtcaccacctcccgcaagtgccagagccgagcggactgcgcggaggctgcggagccggcggccgcgggagctgaccctgcggggtcccggggggggagggggagccgcgaagcccccactgaggccgccgctgccgggcctcccctcccccccgggcgggcgccatgcgggggagcccgggcgacgcggagcggcggcagcgctggggtcgcctgttcgaggagctggacagtaacaaggatggccgcgtggacgtgcacgagttgcgccaggggctggccaggctgggcgggggcaacccagaccccggcgcccaacagggtatctcctctgagggtgatgctgacccagatggcgggctcgacctggaggaattttcccgctatctgcaggagcgggaacagcgtctgctgctcatgtttcacagtcttgaccggaaccaggatggtcacattgatgtctctgagatccaacagagtttccgagctctgggcatttccatctcgctggagcaggctgagaaaattttgcacagcatggaccgagacggcacaatgaccattgactggcaagaatggcgcgaccacttcctgttgcattcgctggaaaatgtggaggacgtgctgtatttctggaagcattccacggtcctggacattggcgagtgcctgacagtgccggacgagttctcaaagcaagagaagctgacgggcatgtggtggaaacagctggtggccggcgcagtggcaggtgccgtgtcacggacaggcacggcccctctggaccgcctcaaggtcttcatgcaggtccatgcctcaaagaccaaccggctgaacatccttggggggcttcgaagcatggtccttgagggaggcatccgctccctgtggcgcggcaatggtattaatgtactcaagattgcccccgagtcagctatcaagttcatggcctatgaacagatcaagagggccatcctggggcagcaggagacactgcatgtgcaggagcgcttcgtggctggctccctggctggtgccacagcccaaaccatcatttaccctatggaggtgctgaagacgcggctgaccttgcgccggacgggccagtataaggggctgctggactgcgccaggcgtatcctggagagggaggggccccgtgccttctaccgcggctacctccccaacgtgctgggcatcatcccctatgcgggcatcgacctggccgtctacgagactctgaagaactggtggcttcagcagtacagccacgactcggcagacccaggcatcctcgtgctcctggcctgcggtaccatatccagcacctgcggccagatagccagttacccgctggccctggtccggacccgcatgcaggcacaagcctccatcgagggtggcccccagctgtccatgctgggtctgctacgtcacatcctgtcccaggagggcatgcggggcctctaccgggggatcgcccccaacttcatgaaggttattccagctgtgagcatctcctatgtggtctacgagaacatgaagcaggccttgggggtcacgtccaggtgagggacccggagcccgtccccccaatccctcaccccccacacctcagccactggagactgatgatccaaccacaggatccctactctttggccacgagatcccagtacccagatcctggatcctagactcctatgccccaaccattgggtcatgggatcccagcatccagatcctggatcctagactcctatgccccaaccactgggtcatgcgatccccacccttcagccactagatcccagatccccctgtaaccataactgtggatcccttacttcagcaactcaagtctgctaccctaaccacaagattcaagattatccacaccccagcccttaatccccatcccccaaatcactggatcctgcagccccacatcctaaggtggatcccacgcttccctgtgccccctactggatcctggacctctacgtcttaaccactggatcccacacaaatcagtgaatggatcccaacaccccaaccacaggagcacggattccctgtacctcaacacccagaccctgcctccctcaggcaccagatccagtgtcctagtgaaacgctggatcctagatccccaaccccagatccccatgcctcgagccctggatctccaagctcagctgctggattctggatgtcaacaaacctcaccactggatcctgacaaccacaatgcctggatcctggggcccccatcactggatcccagatcccctcactccacccactggattcctgcattggtttttggttttttgtttttttttaacctcgacactgggtctcagatccttctgctgactgccagatccctgcatttcaagcactacgccttccacccccaggcactggatcccagattcccaagccttcacccaccagattctggctcctaaaacaagtgcgggggccccagtggcacagcaagtggatcctggcaactgcagctgctggattccagattctgggtccccaatccctctgcccagtccctcaatgttgaaacctcatctcttgaaggcagatcctgatattccaaggcactgaatcccaagccctgaatccccggtttctgatctgaatcttccaggcgccgggtcccaaatgttcaggccccaagtctagatcctggcagcccagtcacagagtatcccacacacactggtgcccagagccggcttctcatgacatgaaattgcatggtcgagggagtctgtggggaaggaagcccaggtcctggctgcaacctgcacggatgctggattccccctcaccccacctctgcatggccaccccctcccagccctgtggggaaactgttccctggaaccactccactccctgcatccccacacttcacagcatttcctccaaggggtccgaggaatcactcactcctggaggctggcaaggagacagtctgaggccagggacacatgaagggatgtccccaccccagcactatcagggcctccccaggcttccagagttgaaagccaggagaaaatcggcaaagaccacccttccctaaacccaagcacccaatgatgcaaaaaacaaaaacaaaaaaaaaccaccaaatccccaaattcattccagatctatttttctaccagagagaggagcaaagtcctcctcccctgcgcccttacattctgcacttcatagttggattctgagcttaggatcatctggagaccccatggagggacttggaaaggggaactgggatttggggaggggctggaggacttccgcacgcttccacctccttcgacctccactgcgccccacctccctgcctgtgtgtgttatttcaaaggaaaagaacaaaaggaataaattttctaagctct

SEQ ID NO: 17536 - DNA, 3616 bp, Homo sapiens
agcgggtcaccacctcccgcaagtgccagagccgagcggactgcgcggaggctgcggagccggcggccgcgggagctgaccctgcggggtcccggggggggagggggagccgcgaagcccccactgaggccgccgctgccgggcctcccctcccccccgggcgggcgccatgcgggggagcccgggcgacgcggagcggcggcagcgctggggtcgcctgttcgaggagctggacagtaacaaggatggccgcgtggacgtgcacgagttgcgccaggggctggccaggctgggcgggggcaacccagaccccggcgcccaacagggtatctcctctgagggtgatgctgacccagatggcgggctcgacctggaggaattttcccgctatctgcaggagcgggaacagcgtctgctgctcatgtttcacagtcttgaccggaaccaggatggtcacattgatgtctctgagatccaacagagtttccgagctctgggcatttccatctcgctggagcaggctgagaaaattttgcacagcatggaccgagacggcacaatgaccattgactggcaagaatggcgcgaccacttcctgttgcattcgctggaaaatgtggaggacgtgctgtatttctggaagcattccacggtcctggacattggcgagtgcctgacagtgccggacgagttctcaaagcaagagaagctgacgggcatgtggtggaaacagctggtggccggcgcagtggcaggtgccgtgtcacggacaggcacggcccctctggaccgcctcaaggtcttcatgcaggtccatgcctcaaagaccaaccggctgaacatccttggggggcttcgaagcatggtccttgagggaggcatccgctccctgtggcgcggcaatggtattaatgtactcaagattgcccccgagtcagctatcaagttcatggcctatgaacagatcaagagggccatcctggggcagcaggagacactgcatgtgcaggagcgcttcgtggctggctccctggctggtgccacagcccaaaccatcatttaccctatggaggtgctgaagacgcggctgaccttgcgccggacgggccagtataaggggctgctggactgcgccaggcgtatcctggagagggaggggccccgtgccttctaccgcggctacctccccaacgtgctgggcatcatcccctatgcgggcatcgacctggccgtctacgagactctgaagaactggtggcttcagcagtacagccacgactcggcagacccaggcatcctcgtgctcctggcctgcggtaccatatccagcacctgcggccagatagccagttacccgctggccctggtccggacccgcatgcaggcacaagcctccatcgagggtggcccccagctgtccatgctgggtctgctacgtcacatcctgtcccaggagggcatgcggggcctctaccgggggatcgcccccaacttcatgaaggttattccagctgtgagcatctcctatgtggtctacgagaacatgaagcaggccttgggggtcacgtccaggtgagggacccggagcccgtccccccaatccctcaccccccacacctcagccactggagactgatgatccaaccacaggatccctactctttggccacgagatcccagtacccagatcctggatcctagactcctatgccccaaccattgggtcatgggatcccagcatccagatcctggatcctagactcctatgccccaaccactgggtcatgcgatccccacccttcagccactagatcccagatccccctgtaaccataactgtggatcccttacttcagcaactcaagtctgctaccctaaccacaagattcaagattatccacaccccagcccttaatccccatcccccaaatcactggatcctgcagccccacatcctaaggtggatcccacgcttccctgtgccccctactggatcctggacctctacgtcttaaccactggatcccacacaaatcagtgaatggatcccaacaccccaaccacaggagcacggattccctgtacctcaacacccagaccctgcctccctcaggcaccagatccagtgtcctagtgaaacgctggatcctagatccccaaccccagatccccatgcctcgagccctggatctccaagctcagctgctggattctggatgtcaacaaacctcaccactggatcctgacaaccacaatgcctggatcctggggcccccatcactggatcccagatcccctcactccacccactggattcctgcattggtttttggttttttgtttttttttaacctcgacactgggtctcagatccttctgctgactgccagatccctgcatttcaagcactacgccttccacccccaggcactggatcccagattcccaagccttcacccaccagattctggctcctaaaacaagtgcgggggccccagtggcacagcaagtggatcctggcaactgcagctgctggattccagattctgggtccccaatccctctgcccagtccctcaatgttgaaacctcatctcttgaaggcagatcctgatattccaaggcactgaatcccaagccctgaatccccggtttctgatctgaatcttccaggcgccgggtcccaaatgttcaggccccaagtctagatcctggcagcccagtcacagagtatcccacacacactggtgcccagagccggcttctcatgacatgaaattgcatggtcgagggagtctgtggggaaggaagcccaggtcctggctgcaacctgcacggatgctggattccccctcaccccacctctgcatggccaccccctcccagccctgtggggaaactgttccctggaaccactccactccctgcatccccacacttcacagcatcttccatccccctcccaccttctaggcgaatagtccccagagctgtgttcctccaaggggtccgaggaatcactcactcctggaggctggcaaggagacagtctgaggccagggacacatgaagggatgtccccaccccagcactatcagggcctccccaggcttccagagtgagtgattcctccaaggggtccgaggaatcactcactcctggaggctggcaaggagacagtctgaggccagggacacatgaagggatgtccccaccccagcactatcagggcctccccaggcttccagagttgaaagccaggagaaaatcggcaaagaccacccttccctaaacccaagcacccaatgatgcaaaaaacaaaaacaaaaaaaaaccaccaaatccccaaattcattccagatctatttttctaccagagagaggagcaaagtcctcctcccctgcgcccttacattctgcacttcatagttggattctgagcttaggatcatctggagaccccatggagggacttggaaaggggaactgggatttggggaggggctggaggacttccgcacgcttccacctccttcgacctccactgcgccccacctccctgcctgtgtgtgttatttcaaaggaaaagaacaaaaggaataaattttctaagctct

SEQ ID NO: 17537 - DNA, 2145 bp, Homo sapiens
agcgggtcaccacctcccgcaagtgccagagccgagcggactgcgcggaggctgcggagccggcggccgcgggagctgaccctgcggggtcccggggggggagggggagccgcgaagcccccactgaggccgccgctgccgggcctcccctcccccccgggcgggcgccatgcgggggagcccgggcgacgcggagcggcggcagcgctggggtcgcctgttcgaggagctggacagtaacaaggatggccgcgtggacgtgcacgagttgcgccaggggctggccaggctgggcgggggcaacccagaccccggcgcccaacagggtatctcctctgagggtgatgctgacccagatggcgggctcgacctggaggaattttcccgctatctgcaggagcgggaacagcgtctgctgctcatgtttcacagtcttgaccggaaccaggatggtcacattgatgtctctgagatccaacagagtttccgagctctgggcatttccatctcgctggagcaggctgagaaaattttgcacagcatggaccgagacggcacaatgaccattgactggcaagaatggcgcgaccacttcctgttgcattcgctggaaaatgtggaggacgtgctgtatttctggaagcattccacggtcctggacattggcgagtgcctgacagtgccggacgagttctcaaagcaagagaagctgacgggcatgtggtggaaacagctggtggccggcgcagtggcaggtgccgtgtcacggacaggcacggcccctctggaccgcctcaaggtcttcatgcaggtccatgcctcaaagaccaaccggctgaacatccttggggggcttcgaagcatggtccttgagggaggcatccgctccctgtggcgcggcaatggtattaatgtactcaagattgcccccgagtcagctatcaagttcatggcctatgaacagatcaagagggccatcctggggcagcaggagacactgcatgtgcaggagcgcttcgtggctggctccctggctggtgccacagcccaaaccatcatttaccctatggaggtgctgaagacgcggctgaccttgcgccggacgggccagtataaggggctgctggactgcgccaggcgtatcctggagagggaggggccccgtgccttctaccgcggctacctccccaacgtgctgggcatcatcccctatgcgggcatcgacctggccgtctacgagactctgaagaactggtggcttcagcagtacagccacgactcggcagacccaggcatcctcgtgctcctggcctgcggtaccatatccagcacctgcggccagatagccagttacccgctggccctggtccggacccgcatgcaggcacaagcctccatcgagggtggcccccagctgtccatgctgggtctgctacgtcacatcctgtcccaggagggcatgcggggcctctaccgggggatcgcccccaacttcatgaaggttattccagctgtgagcatctcctatgtggtctacgagaacatgaagcaggccttgggggtcacgtccaggctggagtacagtggctcgatttcagatcactgcaacctctgccttccaggttcaagcgattctcctgcctcagcctccagagtagctggtattacaggatttcatcatgttgcccaggctcatctcgaactcgtggggtcaaggaattcgccagccttcagcctcccaacgtgctgggattacagccggtggtcatgccatgagcagccttatggagaggaccatgtggtaaggaactcagccaatagccatgtaactgagcttggaagaggatcttgctgtcctggccaacatctcactgcaattctatcagttgaattccctggatagtccaagctttgtggatccctccaccagaacaactggatcccagtacctgaatcctgaatcttagactcttatacttcaaacactgatcacgggaacagccggctcagcagctcctgagttcctaatgctcagaacatggatgagatgataaatgtttgttgtgttaagctgccaacctttggcgggggggtaattcgtcacatggcaacagctggctaatacatatatacctacatgtaaat

SEQ ID NO: 17538 - DNA, 1934 bp, Homo sapiens
agcgggtcaccacctcccgcaagtgccagagccgagcggactgcgcggaggctgcggagccggcggccgcgggagctgaccctgcggggtcccggggggggagggggagccgcgaagcccccactgaggccgccgctgccgggcctcccctcccccccgggcgggcgccatgcgggggagcccgggcgacgcggagcggcggcagcgctggggtcgcctgttcgaggagctggacagtaacaaggatggccgcgtggacgtgcacgagttgcgccaggggctggccaggctgggcgggggcaacccagaccccggcgcccaacagggtatctcctctgagggtgatgctgacccagatggcgggctcgacctggaggaattttcccgctatctgcaggagcgggaacagcgtctgctgctcatgtttcacagtcttgaccggaaccaggatggtcacattgatgtctctgagatccaacagagtttccgagctctgggcatttccatctcgctggagcaggctgagaaaattttgcacagcatggaccgagacggcacaatgaccattgactggcaagaatggcgcgaccacttcctgttgcattcgctggaaaatgtggaggacgtgctgtatttctggaagcattccacggtcctggacattggcgagtgcctgacagtgccggacgagttctcaaagcaagagaagctgacgggcatgtggtggaaacagctggtggccggcgcagtggcaggtgccgtgtcacggacaggcacggcccctctggaccgcctcaaggtcttcatgcaggtccatgcctcaaagaccaaccggctgaacatccttggggggcttcgaagcatggtccttgagggaggcatccgctccctgtggcgcggcaatggtattaatgtactcaagattgcccccgagtcagctatcaagttcatggcctatgaacagatcaagagggccatcctggggcagcaggagacactgcatgtgcaggagcgcttcgtggctggctccctggctggtgccacagcccaaaccatcatttaccctatggaggtgctgaagacgcggctgaccttgcgccggacgggccagtataaggggctgctggactgcgccaggcgtatcctggagagggaggggccccgtgccttctaccgcggctacctccccaacgtgctgggcatcatcccctatgcgggcatcgacctggccgtctacgagactctgaagaactggtggcttcagcagtacagccacgactcggcagacccaggcatcctcgtgctcctggcctgcggtaccatatccagcacctgcggccagatagccagttacccgctggccctggtccggacccgcatgcaggcacaagcctccatcgagggtggcccccagctgtccatgctgggtctgctacgtcacatcctgtcccaggagggcatgcggggcctctaccgggggatcgcccccaacttcatgaaggttattccagctgtgagcatctcctatgtggtctacgagaacatgaagcaggccttgggggtcacgtccaggctggagtacagtggctcgatttcagatcactgcaacctctgccttccaggttcaagcgattctcctgcctcagcctccagagtagctggtattacaggatttcatcatgttgcccaggctcatctcgaactcgtggggtcaaggaattcgccagccttcagccagtagatcccagatcccccgtgtaaccataactgtgagcccgtacttcagcaactcaagtctgctaccctaaccacaagattcaagattatccacaccacagcccataatccccatctacccagatcactggattacacagacacacattactaagatgatacacagcttcctctgctcctactgatccagaccttaa

SEQ ID NO: 17539 - DNA, 1900 bp, Homo sapiens
agcgggtcaccacctcccgcaagtgccagagccgagcggactgcgcggaggctgcggagccggcggccgcgggagctgaccctgcggggtcccggggggggagggggagccgcgaagcccccactgaggccgccgctgccgggcctcccctcccccccgggcgggcgccatgcgggggagcccgggcgacgcggagcggcggcagcgctggggtcgcctgttcgaggagctggacagtaacaaggatggccgcgtggacgtgcacgagttgcgccaggggctggccaggctgggcgggggcaacccagaccccggcgcccaacagggtatctcctctgagggtgatgctgacccagatggcgggctcgacctggaggaattttcccgctatctgcaggagcgggaacagcgtctgctgctcatgtttcacagtcttgaccggaaccaggatggtcacattgatgtctctgagatccaacagagtttccgagctctgggcatttccatctcgctggagcaggctgagaaaattttgcacagcatggaccgagacggcacaatgaccattgactggcaagaatggcgcgaccacttcctgttgcattcgctggaaaatgtggaggacgtgctgtatttctggaagcattccacggtcctggacattggcgagtgcctgacagtgccggacgagttctcaaagcaagagaagctgacgggcatgtggtggaaacagctggtggccggcgcagtggcaggtgccgtgtcacggacaggcacggcccctctggaccgcctcaaggtcttcatgcaggtccatgcctcaaagaccaaccggctgaacatccttggggggcttcgaagcatggtccttgagggaggcatccgctccctgtggcgcggcaatggtattaatgtactcaagattgcccccgagtcagctatcaagttcatggcctatgaacagatcaagagggccatcctggggcagcaggagacactgcatgtgcaggagcgcttcgtggctggctccctggctggtgccacagcccaaaccatcatttaccctatggaggtgctgaagacgcggctgaccttgcgccggacgggccagtataaggggctgctggactgcgccaggcgtatcctggagagggaggggccccgtgccttctaccgcggctacctccccaacgtgctgggcatcatcccctatgcgggcatcgacctggccgtctacgagactctgaagaactggtggcttcagcagtacagccacgactcggcagacccaggcatcctcgtgctcctggcctgcggtaccatatccagcacctgcggccagatagccagttacccgctggccctggtccggacccgcatgcaggcacaagatgcagtttcgctctgtttcccaggctggagtgcaatgacgtgatctcagctcactgcaacctccgcttcccgggttcaagtgatcctcctgcctcagcctccagaatagctgggattacagccggtggtcatgccatgagcagccttatggagaggaccatgtggtaaggaactcagccaatagccatgtaactgagcttggaagaggatcttgctgtcctggccaacatctcactgcaattctatcagttgaattccctggatagtccaagctttgtggatccctccaccagaacaactggatcccagtacctgaatcctgaatcttagactcttatacttcaaacactgatcacgggaacagccggctcagcagctcctgagttcctaatgctcagaacatggatgagatgataaatgtttgttgtgttaagctgccaacctttggcgggggggtaattcgtcacatggcaacagctggctaatacatatatacctacatgtaaat

SEQ ID NO: 17540 - DNA, 1420 bp, Homo sapiens
agcgggtcaccacctcccgcaagtgccagagccgagcggactgcgcggaggctgcggagccggcggccgcgggagctgaccctgcggggtcccggggggggagggggagccgcgaagcccccactgaggccgccgctgccgggcctcccctcccccccgggcgggcgccatgcgggggagcccgggcgacgcggagcggcggcagcgctggggtcgcctgttcgaggagctggacagtaacaaggatggccgcgtggacgtgcacgagttgcgccaggggctggccaggctgggcgggggcaacccagaccccggcgcccaacagggtatctcctctgagggtgatgctgacccagatggcgggctcgacctggaggaattttcccgctatctgcaggagcgggaacagcgtctgctgctcatgtttcacagtcttgaccggaaccaggatggtcacattgatgtctctgagatccaacagagtttccgagctctgggcatttccatctcgctggagcaggctgagaaaattttgcacagcatggaccgagacggcacaatgaccattgactggcaagaatggcgcgaccacttcctgttgcattcgctggaaaatgtggaggacgtgctgtatttctggaagcattccacggtcctggacattggcgagtgcctgacagtgccggacgagttctcaaagcaagagaagctgacgggcatgtggtggaaacagctggtggccggcgcagtggcaggtgccgtgtcacggacaggcacggcccctctggaccgcctcaaggtcttcatgcaggtccatgcctcaaagaccaaccggctgaacatccttggggggcttcgaagcatggtccttgagggaggcatccgctccctgtggcgcggcaatggtattaatgtactcaagattgcccccgagtcagctatcaagttcatggcctatgaacagatcaagagggccatcctggggcagcaggagacactgcatgtgcaggagcgcttcgtggctggctccctggctggtgccacagcccaaaccatcatttaccctatggaggtgctgaagacgcggctgaccttgcgccggacgggccagtataaggggctgctggactgcgccaggcgtatcctggagagggaggggccccgtgccttctaccgcggctacctccccaacgtgctgggcatcatcccctatgcgggcatcgacctggccgtctacgagactctgaagaactggtggcttcagcagtacagccacgactcggcagacccaggcatcctcgtgctcctggcctgcggtaccatatccagcacctgcggccagatagccagttacccgctggtattgatacggaaatgcatgcatgcagggggtggcgagcgcgaacgcgtccgcatggac

SEQ ID NO: 17541 - DNA, 963 bp, Homo sapiens
agcgggtcaccacctcccgcaagtgccagagccgagcggactgcgcggaggctgcggagccggcggccgcgggagctgaccctgcggggtcccggggggggagggggagccgcgaagcccccactgaggccgccgctgccgggcctcccctcccccccgggcgggcgccatgcgggggagcccgggcgacgcggagcggcggcagcgctggggtcgcctgttcgaggagctggacagtaacaaggatggccgcgtggacgtgcacgagttgcgccaggggctggccaggctgggcgggggcaacccagaccccggcgcccaacagggtatctcctctgagggtgatgctgacccagatggcgggctcgacctggaggaattttcccgctatctgcaggagcgggaacagcgtctgctgctcatgtttcacagtcttgaccggaaccaggatggtcacattgatgtctctgagatccaacagagtttccgagctctgggcatttccatctcgctggagcaggctgagaaaattttgcacagcatggaccgagacggcacaatgaccattgactggcaagaatggcgcgaccacttcctgttgcattcgctggaaaatgtggtaaggaactcagccaatagccatgtaactgagcttggaagaggatcttgctgtcctggccaacatctcactgcaattctatcagttgaattccctggatagtccaagctttgtggatccctccaccagaacaactggatcccagtacctgaatcctgaatcttagactcttatacttcaaacactgatcacgggaacagccggctcagcagctcctgagttcctaatgctcagaacatggatgagatgataaatgtttgttgtgttaagctgccaacctttggcgggggggtaattcgtcacatggcaacagctggctaatacatatatacctacatgtaaat

SEQ ID NO: 17542 - DNA, 221 bp, Homo sapiens
gtatttttcttttatgaattatttccccccgtcccctccaccactaccctcccattctccctgaatctgttttgagaattttcttgagaattttagtgtttgtgttttgtgatttttactggagatgtgtcagtgtacaagacggacacggtccccaccctcatagagctcacaggccggagaggaaggaagatgctaaataaatcattctggaattaaaa

SEQ ID NO: 17543 - DNA, 2105 bp, Homo sapiens
agcgggtcaccacctcccgcaagtgccagagccgagcggactgcgcggaggctgcggagccggcggccgcgggagctgaccctgcggggtcccggggggggagggggagccgcgaagcccccactgaggccgccgctgccgggcctcccctcccccccgggcgggcgccatgcgggggagcccgggcgacgcggagcggcggcagcgctggggtcgcctgttcgaggagctggacagtaacaaggatggccgcgtggacgtgcacgagttgcgccaggggctggccaggctgggcgggggcaacccagaccccggcgcccaacagggtatctcctctgagggtgatgctgacccagatggcgggctcgacctggaggaattttcccgctatctgcaggagcgggaacagcgtctgctgctcatgtttcacagtcttgaccggaaccaggatggtcacattgatgtctctgagatccaacagagtttccgagctctgggcatttccatctcgctggagcaggctgagaaaattttgcacagcatggaccgagacggcacaatgaccattgactggcaagaatggcgcgaccacttcctgttgcattcgctggaaaatgtggaggacgtgctgtatttctggaagcattccacgctctcttctgctgggttctctgcctggataaaagattctacggctgaacagaatcgttcaaaaaccacggtcttggccaggcgcagtggctcacacctgaaatcccagcactttgggaggccgaagtgggcggatcacgaggtcctggacattggcgagtgcctgacagtgccggacgagttctcaaagcaagagaagctgacgggcatgtggtggaaacagctggtggccggcgcagtggcaggtgccgtgtcacggacaggcacggcccctctggaccgcctcaaggtcttcatgcaggtccatgcctcaaagaccaaccggctgaacatccttggggggcttcgaagcatggtccttgagggaggcatccgctccctgtggcgcggcaatggtattaatgtactcaagattgcccccgagtcagctatcaagttcatggcctatgaacagatcaagagggccatcctggggcagcaggagacactgcatgtgcaggagcgcttcgtggctggctccctggctggtgccacagcccaaaccatcatttaccctatggaggtgctgaagacgcggctgaccttgcgccggacgggccagtataaggggctgctggactgcgccaggcgtatcctggagagggaggggccccgtgccttctaccgcggctacctccccaacgtgctgggcatcatcccctatgcgggcatcgacctggccgtctacgagactctgaagaactggtggcttcagcagtacagccacgactcggcagacccaggcatcctcgtgctcctggcctgcggtaccatatccagcacctgcggccagatagccagttacccgctggccctggtccggacccgcatgcaggcacaaggctggagtacagtggctcgatttcagatcactgcaacctctgccttccaggttcaagcgattctcctgcctcagcctccagagtagctggtattacaggatttcatcatgttgcccaggctcatctcgaactcgtggggtcaaggaattcgccagccttcagcctcccaacgtgctgggattacagccggtggtcatgccatgagcagccttatggagaggaccatgtggtaaggaactcagccaatagccatgtaactgagcttggaagaggatcttgctgtcctggccaacatctcactgcaattctatcagttgaattccctggatagtccaagctttgtggatccctccaccagaacaactggatcccagtacctgaatcctgaatcttagactcttatacttcaaacactgatcacgggaacagccggctcagcagctcctgagttcctaatgctcagaacatggatgagatgataaatgtttgttgtgttaagctgccaacctttggcgggggggtaattcgtcacatggcaacagctggctaatacatatatacctacatgtaaat

SEQ ID NO: 17544 - DNA, 3658 bp, Homo sapiens
  misc_feature (3551)..(3551): n is a, c, g, or t
  misc_feature (3566)..(3566): n is a, c, g, or t
  misc_feature (3568)..(3568): n is a, c, g, or t
agcgggtcaccacctcccgcaagtgccagagccgagcggactgcgcggaggctgcggagccggcggccgcgggagctgaccctgcggggtcccggggggggagggggagccgcgaagcccccactgaggccgccgctgccgggcctcccctcccccccgggcgggcgccatgcgggggagcccgggcgacgcggagcggcggcagcgctggggtcgcctgttcgaggagctggacagtaacaaggatggccgcgtggacgtgcacgagttgcgccaggggctggccaggctgggcgggggcaacccagaccccggcgcccaacagggtatctcctctgagggtgatgctgacccagatggcgggctcgacctggaggaattttcccgctatctgcaggagcgggaacagcgtctgctgctcatgtttcacagtcttgaccggaaccaggatggtcacattgatgtctctgagatccaacagagtttccgagctctgggcatttccatctcgctggagcaggctgagaaaattttgcacagcatggaccgagacggcacaatgaccattgactggcaagaatggcgcgaccacttcctgttgcattcgctggaaaatgtggaggacgtgctgtatttctggaagcattccacggtcctggacattggcgagtgcctgacagtgccggacgagttctcaaagcaagagaagctgacgggcatgtggtggaaacagctggtggccggcgcagtggcaggtgccgtgtcacggacaggcacggcccctctggaccgcctcaaggtcttcatgcaggtccatgcctcaaagaccaaccggctgaacatccttggggggcttcgaagcatggtccttgagggaggcatccgctccctgtggcgcggcaatggtattaatgtactcaagattgcccccgagtcagctatcaagttcatggcctatgaacagatcaagagggccatcctggggcagcaggagacactgcatgtgcaggagcgcttcgtggctggctccctggctggtgccacagcccaaaccatcatttaccctatggaggtgctgaagacgcggctgaccttgcgccggacgggccagtataaggggctgctggactgcgccaggcgtatcctggagagggaggggccccgtgccttctaccgcggctacctccccaacgtgctgggcatcatcccctatgcgggcatcgacctggccgtctacgagactctgaagaactggtggcttcagcagtacagccacgactcggcagacccaggcatcctcgtgctcctggcctgcggtaccatatccagcacctgcggccagatagccagttacccgctggccctggtccggacccgcatgcaggcacaagcctccatcgagggtggcccccagctgtccatgctgggtctgctacgtcacatcctgtcccaggagggcatgcggggcctctaccgggggatcgcccccaacttcatgaaggttattccagctgtgagcatctcctatgtggtctacgagaacatgaagcaggccttgggggtcacgtccaggtgagggacccggagcccgtccccccaatccctcaccccccacacctcagccactggagactgatgatccaaccacaggatccctactctttggccacgagatcccagtacccagatcctggatcctagactcctatgccccaaccattgggtcatgggatcccagcatccagatcctggatcctagactcctatgccccaaccactgggtcatgcgatccccacccttcagccactagatcccagatccccctgtaaccataactgtggatcccttacttcagcaactcaagtctgctaccctaaccacaagattcaagattatccacaccccagcccttaatccccatcccccaaatcactggatcctgcagccccacatcctaaggtggatcccacgcttccctgtgccccctactggatcctggacctctacgtcttaaccactggatcccacacaaatcagtgaatggatcccaacaccccaaccacaggagcacggattccctgtacctcaacacccagaccctgcctccctcaggcaccagatccagtgtcctagtgaaacgctggatcctagatccccaaccccagatccccatgcctcgagccctggatctccaagctcagctgctggattctggatgtcaacaaacctcaccactggatcctgacaaccacaatgcctggatcctggggcccccatcactggatcccagatcccctcactccacccactggattcctgcattggtttttggttttttgtttttttttaacctcgacactgggtctcagatccttctgctgactgccagatccctgcatttcaagcactacgccttccacccccaggcactggatcccagattcccaagccttcacccaccagattctggctcctaaaacaagtgcgggggccccagtggcacagcaagtggatcctggcaactgcagctgctggattccagattctgggtccccaatccctctgcccagtccctcaatgttgaaacctcatctcttgaaggcagatcctgatattccaaggcactgaatcccaagccctgaatccccggtttctgatctgaatcttccaggcgccgggtcccaaatgttcaggccccaagtctagatcctggcagcccagtcacagagtatcccacacacactggtgcccagagccggcttctcatgacatgaaattgcatggtcgagggagtctgtggggaaggaagcccaggtcctggctgcaacctgcacggatgctggattccccctcaccccacctctgcatggccaccccctcccagccctgtggggaaactgttccctggaaccactccactccctgcatccccacacttcacagcatcttccatccccctcccaccttctaggcgaatagtccccagagctgtgttcctccaaggggtccgaggaatcactcactcctggaggctggcaaggagacagtctgaggccagggacacatgaagggatgtccccaccccagcactatcagggcctccccaggcttccagagttgaaagccaggagaaaatcggcaaagaccacccttccctaaacccaagcacccaatgatgcaaaaaacaaaaacaaaaaaaaaccaccaaatccccaaattcattccagatctatttttctaccagagagaggagcaaagtcctcctcccctgcgcccttacattctgcacttcatagttggattctgagcttaggatcatctggagaccccatggagggacttggaaaggggaactgggatttggggaggggctggaggacttccgcacgcttccacctccttcgacctccactgcgccccacctccctgcctgtgtgtgttatttcaaaggaaaagaacaaaaggaataaattttctaagctctaaaaaaaaagtccaagttcattcagcaaggcaatgctccatcttcagtggccttacaaatattatnataaccactctggtngnatatccttcattatgatattgatggaccaatgaactgcacttcagatatggagatcaaccctttgagaattaagatctcatctttgcaaa

SEQ ID NO: 17545 - DNA, 3485 bp, Homo sapiens
agcgggtcaccacctcccgcaagtgccagagccgagcggactgcgcggaggctgcggagccggcggccgcgggagctgaccctgcggggtcccggggggggagggggagccgcgaagcccccactgaggccgccgctgccgggcctcccctcccccccgggcgggcgccatgcgggggagcccgggcgacgcggagcggcggcagcgctggggtcgcctgttcgaggagctggacagtaacaaggatggccgcgtggacgtgcacgagttgcgccaggggctggccaggctgggcgggggcaacccagaccccggcgcccaacagggtatctcctctgagggtgatgctgacccagatggcgggctcgacctggaggaattttcccgctatctgcaggagcgggaacagcgtctgctgctcatgtttcacagtcttgaccggaaccaggatggtcacattgatgtctctgagatccaacagagtttccgagctctgggcatttccatctcgctggagcaggctgagaaaattttgcacagcatggaccgagacggcacaatgaccattgactggcaagaatggcgcgaccacttcctgttgcattcgctggaaaatgtggaggacgtgctgtatttctggaagcattccacggtcctggacattggcgagtgcctgacagtgccggacgagttctcaaagcaagagaagctgacgggcatgtggtggaaacagctggtggccggcgcagtggcaggtgccgtgtcacggacaggcacggcccctctggaccgcctcaaggtcttcatgcaggtccatgcctcaaagaccaaccggctgaacatccttggggggcttcgaagcatggtccttgagggaggcatccgctccctgtggcgcggcaatggtattaatgtactcaagattgcccccgagtcagctatcaagttcatggcctatgaacagatcaagagggccatcctggggcagcaggagacactgcatgtgcaggagcgcttcgtggctggctccctggctggtgccacagcccaaaccatcatttaccctatggaggtgctgaagacgcggctgaccttgcgccggacgggccagtataaggggctgctggactgcgccaggcgtatcctggagagggaggggccccgtgccttctaccgcggctacctccccaacgtgctgggcatcatcccctatgcgggcatcgacctggccgtctacgagactctgaagaactggtggcttcagcagtacagccacgactcggcagacccaggcatcctcgtgctcctggcctgcggtaccatatccagcacctgcggccagatagccagttacccgctggccctggtccggacccgcatgcaggcacaagcctccatcgagggtggcccccagctgtccatgctgggtctgctacgtcacatcctgtcccaggagggcatgcggggcctctaccgggggatcgcccccaacttcatgaaggttattccagctgtgagcatctcctatgtggtctacgagaacatgaagcaggccttgggggtcacgtccaggtgagggacccggagcccgtccccccaatccctcaccccccacacctcagccactggagactgatgatccaaccacaggatccctactctttggccacgagatcccagtacccagatcctggatcctagactcctatgccccaaccattgggtcatgggatcccagcatccagatcctggatcctagactcctatgccccaaccactgggtcatgcgatccccacccttcagccactagatcccagatccccctgtaaccataactgtggatcccttacttcagcaactcaagtctgctaccctaaccacaagattcaagattatccacaccccagcccttaatccccatcccccaaatcactggatcctgcagccccacatcctaaggtggatcccacgcttccctgtgccccctactggatcctggacctctacgtcttaaccactggatcccacacaaatcagtgaatggatcccaacaccccaaccacaggagcacggattccctgtacctcaacacccagaccctgcctccctcaggcaccagatccagtgtcctagtgaaacgctggatcctagatccccaaccccagatccccatgcctcgagccctggatctccaagctcagctgctggattctggatgtcaacaaacctcaccactggatcctgacaaccacaatgcctggatcctggggcccccatcactggatcccagatcccctcactccacccactggattcctgcattggtttttggttttttgtttttttttaacctcgacactgggtctcagatccttctgctgactgccagatccctgcatttcaagcactacgccttccacccccaggcactggatcccagattcccaagccttcacccaccagattctggctcctaaaacaagtgcgggggccccagtggcacagcaagtggatcctggcaactgcagctgctggattccagattctgggtccccaatccctctgcccagtccctcaatgttgaaacctcatctcttgaaggcagatcctgatattccaaggcactgaatcccaagccctgaatccccggtttctgatctgaatcttccaggcgccgggtcccaaatgttcaggccccaagtctagatcctggcagcccagtcacagagtatcccacacacactggtgcccagagccggcttctcatgacatgaaattgcatggtcgagggagtctgtggggaaggaagcccaggtcctggctgcaacctgcacggatgctggattccccctcaccccacctctgcatggccaccccctcccagccctgtggggaaactgttccctggaaccactccactccctgcatccccacacttcacagcatcttccatccccctcccaccttctaggcgaatagtccccagagctgtgttcctccaaggggtccgaggaatcactcactcctggaggctggcaaggagacagtctgaggccagggacacatgaagggatgtccccaccccagcactatcagggcctccccaggcttccagagttgaaagccaggagaaaatcggcaaagaccacccttccctaaacccaagcacccaatgatgcaaaaaacaaaaacaaaaaaaaaccaccaaatccccaaattcattccagatctatttttctaccagagagaggagcaaagtcctcctcccctgcgcccttacattctgcacttcatagttggattctgagcttaggatcatctggagaccccatggagggacttggaaaggggaactgggatttggggaggggctggaggacttccgcacgcttccacctccttcgacctccactgcgccccacctccctgcctgtgtgtgttatttcaaaggaaaagaacaaaaggaataaattttctaagctct

SEQ ID NO: 17546 - DNA, 3427 bp, Homo sapiens
agcgggtcaccacctcccgcaagtgccagagccgagcggactgcgcggaggctgcggagccggcggccgcgggagctgaccctgcggggtcccggggggggagggggagccgcgaagcccccactgaggccgccgctgccgggcctcccctcccccccgggcgggcgccatgcgggggagcccgggcgacgcggagcggcggcagcgctggggtcgcctgttcgaggagctggacagtaacaaggatggccgcgtggacgtgcacgagttgcgccaggggctggccaggctgggcgggggcaacccagaccccggcgcccaacagggtatctcctctgagggtgatgctgacccagatggcgggctcgacctggaggaattttcccgctatctgcaggagcgggaacagcgtctgctgctcatgtttcacagtcttgaccggaaccaggatggtcacattgatgtctctgagatccaacagagtttccgagctctgggcatttccatctcgctggagcaggctgagaaaattttgcacagcatggaccgagacggcacaatgaccattgactggcaagaatggcgcgaccacttcctgttgcattcgctggaaaatgtggaggacgtgctgtatttctggaagcattccacggtcctggacattggcgagtgcctgacagtgccggacgagttctcaaagcaagagaagctgacgggcatgtggtggaaacagctggtggccggcgcagtggcaggtgccgtgtcacggacaggcacggcccctctggaccgcctcaaggtcttcatgcaggtccatgcctcaaagaccaaccggctgaacatccttggggggcttcgaagcatggtccttgagggaggcatccgctccctgtggcgcggcaatggtattaatgtactcaagattgcccccgagtcagctatcaagttcatggcctatgaacagatcaagagggccatcctggggcagcaggagacactgcatgtgcaggagcgcttcgtggctggctccctggctggtgccacagcccaaaccatcatttaccctatggaggtgctgaagacgcggctgaccttgcgccggacgggccagtataaggggctgctggactgcgccaggcgtatcctggagagggaggggccccgtgccttctaccgcggctacctccccaacgtgctgggcatcatcccctatgcgggcatcgacctggccgtctacgagactctgaagaactggtggcttcagcagtacagccacgactcggcagacccaggcatcctcgtgctcctggcctgcggtaccatatccagcacctgcggccagatagccagttacccgctggccctggtccggacccgcatgcaggcacaagcctccatcgagggtggcccccagctgtccatgctgggtctgctacgtcacatcctgtcccaggagggcatgcggggcctctaccgggggatcgcccccaacttcatgaaggttattccagctgtgagcatctcctatgtggtctacgagaacatgaagcaggccttgggggtcacgtccaggtgagggacccggagcccgtccccccaatccctcaccccccacacctcagccactggagactgatgatccaaccacaggatccctactctttggccacgagatcccagtacccagatcctggatcctagactcctatgccccaaccactgggtcatgcgatccccacccttcagccactagatcccagatccccctgtaaccataactgtggatcccttacttcagcaactcaagtctgctaccctaaccacaagattcaagattatccacaccccagcccttaatccccatcccccaaatcactggatcctgcagccccacatcctaaggtggatcccacgcttccctgtgccccctactggatcctggacctctacgtcttaaccactggatcccacacaaatcagtgaatggatcccaacaccccaaccacaggagcacggattccctgtacctcaacacccagaccctgcctccctcaggcaccagatccagtgtcctagtgaaacgctggatcctagatccccaaccccagatccccatgcctcgagccctggatctccaagctcagctgctggattctggatgtcaacaaacctcaccactggatcctgacaaccacaatgcctggatcctggggcccccatcactggatcccagatcccctcactccacccactggattcctgcattggtttttggttttttgtttttttttaacctcgacactgggtctcagatccttctgctgactgccagatccctgcatttcaagcactacgccttccacccccaggcactggatcccagattcccaagccttcacccaccagattctggctcctaaaacaagtgcgggggccccagtggcacagcaagtggatcctggcaactgcagctgctggattccagattctgggtccccaatccctctgcccagtccctcaatgttgaaacctcatctcttgaaggcagatcctgatattccaaggcactgaatcccaagccctgaatccccggtttctgatctgaatcttccaggcgccgggtcccaaatgttcaggccccaagtctagatcctggcagcccagtcacagagtatcccacacacactggtgcccagagccggcttctcatgacatgaaattgcatggtcgagggagtctgtggggaaggaagcccaggtcctggctgcaacctgcacggatgctggattccccctcaccccacctctgcatggccaccccctcccagccctgtggggaaactgttccctggaaccactccactccctgcatccccacacttcacagcatcttccatccccctcccaccttctaggcgaatagtccccagagctgtgttcctccaaggggtccgaggaatcactcactcctggaggctggcaaggagacagtctgaggccagggacacatgaagggatgtccccaccccagcactatcagggcctccccaggcttccagagttgaaagccaggagaaaatcggcaaagaccacccttccctaaacccaagcacccaatgatgcaaaaaacaaaaacaaaaaaaaaccaccaaatccccaaattcattccagatctatttttctaccagagagaggagcaaagtcctcctcccctgcgcccttacattctgcacttcatagttggattctgagcttaggatcatctggagaccccatggagggacttggaaaggggaactgggatttggggaggggctggaggacttccgcacgcttccacctccttcgacctccactgcgccccacctccctgcctgtgtgtgttatttcaaaggaaaagaacaaaaggaataaattttctaagctct

SEQ ID NO: 17547 - DNA, 3381 bp, Homo sapiens
  misc_feature (3274)..(3274): n is a, c, g, or t
  misc_feature (3289)..(3289): n is a, c, g, or t
  misc_feature (3291)..(3291): n is a, c, g, or t
ttcctctcctcccacctcgggggcaacccagaccccggcgcccaacagggtatctcctctgagggtgatgctgacccagatggcgggctcgacctggaggaattttcccgctatctgcaggagcgggaacagcgtctgctgctcatgtttcacagtcttgaccggaaccaggatggtcacattgatgtctctgagatccaacagagtttccgagctctgggcatttccatctcgctggagcaggctgagaaaattttgcacagcatggaccgagacggcacaatgaccattgactggcaagaatggcgcgaccacttcctgttgcattcgctggaaaatgtggaggacgtgctgtatttctggaagcattccacggtcctggacattggcgagtgcctgacagtgccggacgagttctcaaagcaagagaagctgacgggcatgtggtggaaacagctggtggccggcgcagtggcaggtgccgtgtcacggacaggcacggcccctctggaccgcctcaaggtcttcatgcaggtccatgcctcaaagaccaaccggctgaacatccttggggggcttcgaagcatggtccttgagggaggcatccgctccctgtggcgcggcaatggtattaatgtactcaagattgcccccgagtcagctatcaagttcatggcctatgaacagatcaagagggccatcctggggcagcaggagacactgcatgtgcaggagcgcttcgtggctggctccctggctggtgccacagcccaaaccatcatttaccctatggaggtgctgaagacgcggctgaccttgcgccggacgggccagtataaggggctgctggactgcgccaggcgtatcctggagagggaggggccccgtgccttctaccgcggctacctccccaacgtgctgggcatcatcccctatgcgggcatcgacctggccgtctacgagactctgaagaactggtggcttcagcagtacagccacgactcggcagacccaggcatcctcgtgctcctggcctgcggtaccatatccagcacctgcggccagatagccagttacccgctggccctggtccggacccgcatgcaggcacaagcctccatcgagggtggcccccagctgtccatgctgggtctgctacgtcacatcctgtcccaggagggcatgcggggcctctaccgggggatcgcccccaacttcatgaaggttattccagctgtgagcatctcctatgtggtctacgagaacatgaagcaggccttgggggtcacgtccaggtgagggacccggagcccgtccccccaatccctcaccccccacacctcagccactggagactgatgatccaaccacaggatccctactctttggccacgagatcccagtacccagatcctggatcctagactcctatgccccaaccattgggtcatgggatcccagcatccagatcctggatcctagactcctatgccccaaccactgggtcatgcgatccccacccttcagccactagatcccagatccccctgtaaccataactgtggatcccttacttcagcaactcaagtctgctaccctaaccacaagattcaagattatccacaccccagcccttaatccccatcccccaaatcactggatcctgcagccccacatcctaaggtggatcccacgcttccctgtgccccctactggatcctggacctctacgtcttaaccactggatcccacacaaatcagtgaatggatcccaacaccccaaccacaggagcacggattccctgtacctcaacacccagaccctgcctccctcaggcaccagatccagtgtcctagtgaaacgctggatcctagatccccaaccccagatccccatgcctcgagccctggatctccaagctcagctgctggattctggatgtcaacaaacctcaccactggatcctgacaaccacaatgcctggatcctggggcccccatcactggatcccagatcccctcactccacccactggattcctgcattggtttttggttttttgtttttttttaacctcgacactgggtctcagatccttctgctgactgccagatccctgcatttcaagcactacgccttccacccccaggcactggatcccagattcccaagccttcacccaccagattctggctcctaaaacaagtgcgggggccccagtggcacagcaagtggatcctggcaactgcagctgctggattccagattctgggtccccaatccctctgcccagtccctcaatgttgaaacctcatctcttgaaggcagatcctgatattccaaggcactgaatcccaagccctgaatccccggtttctgatctgaatcttccaggcgccgggtcccaaatgttcaggccccaagtctagatcctggcagcccagtcacagagtatcccacacacactggtgcccagagccggcttctcatgacatgaaattgcatggtcgagggagtctgtggggaaggaagcccaggtcctggctgcaacctgcacggatgctggattccccctcaccccacctctgcatggccaccccctcccagccctgtggggaaactgttccctggaaccactccactccctgcatccccacacttcacagcatcttccatccccctcccaccttctaggcgaatagtccccagagctgtgttcctccaaggggtccgaggaatcactcactcctggaggctggcaaggagacagtctgaggccagggacacatgaagggatgtccccaccccagcactatcagggcctccccaggcttccagagttgaaagccaggagaaaatcggcaaagaccacccttccctaaacccaagcacccaatgatgcaaaaaacaaaaacaaaaaaaaaccaccaaatccccaaattcattccagatctatttttctaccagagagaggagcaaagtcctcctcccctgcgcccttacattctgcacttcatagttggattctgagcttaggatcatctggagaccccatggagggacttggaaaggggaactgggatttggggaggggctggaggacttccgcacgcttccacctccttcgacctccactgcgccccacctccctgcctgtgtgtgttatttcaaaggaaaagaacaaaaggaataaattttctaagctctaaaaaaaaagtccaagttcattcagcaaggcaatgctccatcttcagtggccttacaaatattatnataaccactctggtngnatatccttcattatgatattgatggaccaatgaactgcacttcagatatggagatcaaccctttgagaattaagatctcatctttgcaaa

SEQ ID NO: 17548 - DNA, 3799 bp, Homo sapiens
  misc_feature (3692)..(3692): n is a, c, g, or t
  misc_feature (3707)..(3707): n is a, c, g, or t
  misc_feature (3709)..(3709): n is a, c, g, or t
agcgggtcaccacctcccgcaagtgccagagccgagcggactgcgcggaggctgcggagccggcggccgcgggagctgaccctgcggggtcccggggggggagggggagccgcgaagcccccactgaggccgccgctgccgggcctcccctcccccccgggcgggcgccatgcgggggagcccgggcgacgcggagcggcggcagcgctggggtcgcctgttcgaggagctggacagtaacaaggatggccgcgtggacgtgcacgagttgcgccaggggctggccaggctgggcgggggcaacccagaccccggcgcccaacagggtatctcctctgagggtgatgctgacccagatggcgggctcgacctggaggaattttcccgctatctgcaggagcgggaacagcgtctgctgctcatgtttcacagtcttgaccggaaccaggatggtcacattgatgtctctgagatccaacagagtttccgagctctgggcatttccatctcgctggagcaggctgagaaaattttgcacagcatggaccgagacggcacaatgaccattgactggcaagaatggcgcgaccacttcctgttgcattcgctggaaaatgtggaggacgtgctgtatttctggaagcattccacgctctcttctgctgggttctctgcctggataaaagattctacggctgaacagaatcgttcaaaaaccacggtcttggccaggcgcagtggctcacacctgaaatcccagcactttgggaggccgaagtgggcggatcacgaggtcctggacattggcgagtgcctgacagtgccggacgagttctcaaagcaagagaagctgacgggcatgtggtggaaacagctggtggccggcgcagtggcaggtgccgtgtcacggacaggcacggcccctctggaccgcctcaaggtcttcatgcaggtccatgcctcaaagaccaaccggctgaacatccttggggggcttcgaagcatggtccttgagggaggcatccgctccctgtggcgcggcaatggtattaatgtactcaagattgcccccgagtcagctatcaagttcatggcctatgaacagatcaagagggccatcctggggcagcaggagacactgcatgtgcaggagcgcttcgtggctggctccctggctggtgccacagcccaaaccatcatttaccctatggaggtgctgaagacgcggctgaccttgcgccggacgggccagtataaggggctgctggactgcgccaggcgtatcctggagagggaggggccccgtgccttctaccgcggctacctccccaacgtgctgggcatcatcccctatgcgggcatcgacctggccgtctacgagactctgaagaactggtggcttcagcagtacagccacgactcggcagacccaggcatcctcgtgctcctggcctgcggtaccatatccagcacctgcggccagatagccagttacccgctggccctggtccggacccgcatgcaggcacaagcctccatcgagggtggcccccagctgtccatgctgggtctgctacgtcacatcctgtcccaggagggcatgcggggcctctaccgggggatcgcccccaacttcatgaaggttattccagctgtgagcatctcctatgtggtctacgagaacatgaagcaggccttgggggtcacgtccaggtgagggacccggagcccgtccccccaatccctcaccccccacacctcagccactggagactgatgatccaaccacaggatccctactctttggccacgagatcccagtacccagatcctggatcctagactcctatgccccaaccattgggtcatgggatcccagcatccagatcctggatcctagactcctatgccccaaccactgggtcatgcgatccccacccttcagccactagatcccagatccccctgtaaccataactgtggatcccttacttcagcaactcaagtctgctaccctaaccacaagattcaagattatccacaccccagcccttaatccccatcccccaaatcactggatcctgcagccccacatcctaaggtggatcccacgcttccctgtgccccctactggatcctggacctctacgtcttaaccactggatcccacacaaatcagtgaatggatcccaacaccccaaccacaggagcacggattccctgtacctcaacacccagaccctgcctccctcaggcaccagatccagtgtcctagtgaaacgctggatcctagatccccaaccccagatccccatgcctcgagccctggatctccaagctcagctgctggattctggatgtcaacaaacctcaccactggatcctgacaaccacaatgcctggatcctggggcccccatcactggatcccagatcccctcactccacccactggattcctgcattggtttttggttttttgtttttttttaacctcgacactgggtctcagatccttctgctgactgccagatccctgcatttcaagcactacgccttccacccccaggcactggatcccagattcccaagccttcacccaccagattctggctcctaaaacaagtgcgggggccccagtggcacagcaagtggatcctggcaactgcagctgctggattccagattctgggtccccaatccctctgcccagtccctcaatgttgaaacctcatctcttgaaggcagatcctgatattccaaggcactgaatcccaagccctgaatccccggtttctgatctgaatcttccaggcgccgggtcccaaatgttcaggccccaagtctagatcctggcagcccagtcacagagtatcccacacacactggtgcccagagccggcttctcatgacatgaaattgcatggtcgagggagtctgtggggaaggaagcccaggtcctggctgcaacctgcacggatgctggattccccctcaccccacctctgcatggccaccccctcccagccctgtggggaaactgttccctggaaccactccactccctgcatccccacacttcacagcatcttccatccccctcccaccttctaggcgaatagtccccagagctgtgttcctccaaggggtccgaggaatcactcactcctggaggctggcaaggagacagtctgaggccagggacacatgaagggatgtccccaccccagcactatcagggcctccccaggcttccagagttgaaagccaggagaaaatcggcaaagaccacccttccctaaacccaagcacccaatgatgcaaaaaacaaaaacaaaaaaaaaccaccaaatccccaaattcattccagatctatttttctaccagagagaggagcaaagtcctcctcccctgcgcccttacattctgcacttcatagttggattctgagcttaggatcatctggagaccccatggagggacttggaaaggggaactgggatttggggaggggctggaggacttccgcacgcttccacctccttcgacctccactgcgccccacctccctgcctgtgtgtgttatttcaaaggaaaagaacaaaaggaataaattttctaagctctaaaaaaaaagtccaagttcattcagcaaggcaatgctccatcttcagtggccttacaaatattatnataaccactctggtngnatatccttcattatgatattgatggaccaatgaactgcacttcagatatggagatcaaccctttgagaattaagatctcatctttgcaaa

SEQ ID NO: 17549 - DNA, 3111 bp, Homo sapiens
  misc_feature (3004)..(3004): n is a, c, g, or t
  misc_feature (3019)..(3019): n is a, c, g, or t
  misc_feature (3021)..(3021): n is a, c, g, or t
ccgaggtgatctagaggatcccgaagcgcacaatggcgcgaccacttcctgttgcattcgctggaaaatgtggaggacgtgctgtatttctggaagcattccacggtcctggacattggcgagtgcctgacagtgccggacgagttctcaaagcaagagaagctgacgggcatgtggtggaaacagctggtggccggcgcagtggcaggtgccgtgtcacggacaggcacggcccctctggaccgcctcaaggtcttcatgcaggtccatgcctcaaagaccaaccggctgaacatccttggggggcttcgaagcatggtccttgagggaggcatccgctccctgtggcgcggcaatggtattaatgtactcaagattgcccccgagtcagctatcaagttcatggcctatgaacagatcaagagggccatcctggggcagcaggagacactgcatgtgcaggagcgcttcgtggctggctccctggctggtgccacagcccaaaccatcatttaccctatggaggtgctgaagacgcggctgaccttgcgccggacgggccagtataaggggctgctggactgcgccaggcgtatcctggagagggaggggccccgtgccttctaccgcggctacctccccaacgtgctgggcatcatcccctatgcgggcatcgacctggccgtctacgagactctgaagaactggtggcttcagcagtacagccacgactcggcagacccaggcatcctcgtgctcctggcctgcggtaccatatccagcacctgcggccagatagccagttacccgctggccctggtccggacccgcatgcaggcacaagcctccatcgagggtggcccccagctgtccatgctgggtctgctacgtcacatcctgtcccaggagggcatgcggggcctctaccgggggatcgcccccaacttcatgaaggttattccagctgtgagcatctcctatgtggtctacgagaacatgaagcaggccttgggggtcacgtccaggtgagggacccggagcccgtccccccaatccctcaccccccacacctcagccactggagactgatgatccaaccacaggatccctactctttggccacgagatcccagtacccagatcctggatcctagactcctatgccccaaccattgggtcatgggatcccagcatccagatcctggatcctagactcctatgccccaaccactgggtcatgcgatccccacccttcagccactagatcccagatccccctgtaaccataactgtggatcccttacttcagcaactcaagtctgctaccctaaccacaagattcaagattatccacaccccagcccttaatccccatcccccaaatcactggatcctgcagccccacatcctaaggtggatcccacgcttccctgtgccccctactggatcctggacctctacgtcttaaccactggatcccacacaaatcagtgaatggatcccaacaccccaaccacaggagcacggattccctgtacctcaacacccagaccctgcctccctcaggcaccagatccagtgtcctagtgaaacgctggatcctagatccccaaccccagatccccatgcctcgagccctggatctccaagctcagctgctggattctggatgtcaacaaacctcaccactggatcctgacaaccacaatgcctggatcctggggcccccatcactggatcccagatcccctcactccacccactggattcctgcattggtttttggttttttgtttttttttaacctcgacactgggtctcagatccttctgctgactgccagatccctgcatttcaagcactacgccttccacccccaggcactggatcccagattcccaagccttcacccaccagattctggctcctaaaacaagtgcgggggccccagtggcacagcaagtggatcctggcaactgcagctgctggattccagattctgggtccccaatccctctgcccagtccctcaatgttgaaacctcatctcttgaaggcagatcctgatattccaaggcactgaatcccaagccctgaatccccggtttctgatctgaatcttccaggcgccgggtcccaaatgttcaggccccaagtctagatcctggcagcccagtcacagagtatcccacacacactggtgcccagagccggcttctcatgacatgaaattgcatggtcgagggagtctgtggggaaggaagcccaggtcctggctgcaacctgcacggatgctggattccccctcaccccacctctgcatggccaccccctcccagccctgtggggaaactgttccctggaaccactccactccctgcatccccacacttcacagcatcttccatccccctcccaccttctaggcgaatagtccccagagctgtgttcctccaaggggtccgaggaatcactcactcctggaggctggcaaggagacagtctgaggccagggacacatgaagggatgtccccaccccagcactatcagggcctccccaggcttccagagttgaaagccaggagaaaatcggcaaagaccacccttccctaaacccaagcacccaatgatgcaaaaaacaaaaacaaaaaaaaaccaccaaatccccaaattcattccagatctatttttctaccagagagaggagcaaagtcctcctcccctgcgcccttacattctgcacttcatagttggattctgagcttaggatcatctggagaccccatggagggacttggaaaggggaactgggatttggggaggggctggaggacttccgcacgcttccacctccttcgacctccactgcgccccacctccctgcctgtgtgtgttatttcaaaggaaaagaacaaaaggaataaattttctaagctctaaaaaaaaagtccaagttcattcagcaaggcaatgctccatcttcagtggccttacaaatattatnataaccactctggtngnatatccttcattatgatattgatggaccaatgaactgcacttcagatatggagatcaaccctttgagaattaagatctcatctttgcaaa

SEQ ID NO: 17550 - DNA, 3156 bp, Homo sapiens
agcgggtcaccacctcccgcaagtgccagagccgagcggactgcgcggaggctgcggagccggcggccgcgggagctgaccctgcggggtcccggggggggagggggagccgcgaagcccccactgaggccgccgctgccgggcctcccctcccccccgggcgggcgccatgcgggggagcccgggcgacgcggagcggcggcagcgctggggtcgcctgttcgaggagctggacagtaacaaggatggccgcgtggacgtgcacgagttgcgccaggggctggccaggctgggcgggggcaacccagaccccggcgcccaacagggtatctcctctgagggtgatgctgacccagatggcgggctcgacctggaggaattttcccgctatctgcaggagcgggaacagcgtctgctgctcatgtttcacagtcttgaccggaaccaggatggtcacattgatgtctctgagatccaacagagtttccgagctctgggcatttccatctcgctggagcaggctgagaaaattttgcacagcatggaccgagacggcacaatgaccattgactggcaagaatggcgcgaccacttcctgttgcattcgctggaaaatgtggaggacgtgctgtatttctggaagcattccacggtcctggacattggcgagtgcctgacagtgccggacgagttctcaaagcaagagaagctgacgggcatgtggtggaaacagctggtggccggcgcagtggcaggtgccgtgtcacggacaggcacggcccctctggaccgcctcaaggtcttcatgcaggtccatgcctcaaagaccaaccggctgaacatccttggggggcttcgaagcatggtccttgagggaggcatccgctccctgtggcgcggcaatggtattaatgtactcaagattgcccccgagtcagctatcaagttcatggcctatgaacagatcaagagggccatcctggggcagcaggagacactgcatgtgcaggagcgcttcgtggctggctccctggctggtgccacagcccaaaccatcatttaccctatggaggtgctgaagacgcggctgaccttgcgccggacgggccagtataaggggctgctggactgcgccaggcgtatcctggagagggaggggccccgtgccttctaccgcggctacctccccaacgtgctgggcatcatcccctatgcgggcatcgacctggccgtctacgagactctgaagaactggtggcttcagcagtacagccacgactcggcagacccaggcatcctcgtgctcctggcctgcggtaccatatccagcacctgcggccagatagccagttacccgctggccctggtccggacccgcatgcaggcacaagcctccatcgagggtggcccccagctgtccatgctgggtctgctacgtcacatcctgtcccaggagggcatgcggggcctctaccgggggatcgcccccaacttcatgaaggttattccagctgtgagcatctcctatgtggtctacgagaacatgaagcaggccttgggggtcacgtccaggtgagggacccggagcccgtccccccaatccctcaccccccacacctcagccactggagactgatgatccaaccacaggatccctactctttggccacgagatcccagtacccagatcctggatcctagactcctatgccccaaccattgggtcatgggatcccagcatccagatcctggatcctagactcctatgccccaaccactgggtcatgcgatccccacccttcagccactagatcccagatccccctgtaaccataactgtggatcccttacttcagcaactcaagtctgctaccctaaccacaagattcaagattatccacaccccagcccttaatccccatcccccaaatcactggatcctgcagccccacatcctaaggtggatcccacgcttccctgtgccccctactggatcctggacctctacgtcttaaccactggatcccacacaaatcagtgaatggatcccaacaccccaaccacaggagcacggattccctgtacctcaacacccagaccctgcctccctcaggcaccagatccagtgtcctagtgaaacgctggatcctagatccccaaccccagatccccatgcctcgagccctggatctccaagctcagctgctggattctggatgtcaacaaacctcaccactggatcctgacaaccacaatgcctggatcctggggcccccatcactggatcccagatcccctcactccacccactggattcctgcattggtttttggttttttgtttttttttaacctcgacactgggtctcagatccttctgctgactgccagatccctgcatttcaagcactacgccttccacccccaggcactggatcccagattcccaagccttcacccaccagattctggctcctaaaacaagtgcgggggccccagtggcacagcaagtggatcctggcaactgcagctgctggattccagattctgggtccccaatccctctgcccagtccctcaatgttgaaacctcatctcttgaaggcagatcctgatattccaaggcactgaatcccaacttctaggcgaatagtccccagagctgtgttcctccaaggggtccgaggaatcactcactcctggaggctggcaaggagacagtctgaggccagggacacatgaagggatgtccccaccccagcactatcagggcctccccaggcttccagagttgaaagccaggagaaaatcggcaaagaccacccttccctaaacccaagcacccaatgatgcaaaaaacaaaaacaaaaaaaaaccaccaaatccccaaattcattccagatctatttttctaccagagagaggagcaaagtcctcctcccctgcgcccttacattctgcacttcatagttggattctgagcttaggatcatctggagaccccatggagggacttggaaaggggaactgggatttggggaggggctggaggacttccgcacgcttccacctccttcgacctccactgcgccccacctccctgcctgtgtgtgttatttcaaaggaaaagaacaaaaggaataaattttctaagctct

SEQ ID NO: 17551 - DNA, 1213 bp, Homo sapiens
agcgggtcaccacctcccgcaagtgccagagccgagcggactgcgcggaggctgcggagccggcggccgcgggagctgaccctgcggggtcccggggggggagggggagccgcgaagcccccactgaggccgccgctgccgggcctcccctcccccccgggcgggcgccatgcgggggagcccgggcgacgcggagcggcggcagcgctggggtcgcctgttcgaggagctggacagtaacaaggatggccgcgtggacgtgcacgagttgcgccaggggctggccaggctgggcgggggcaacccagaccccggcgcccaacagggtatctcctctgagggtgatgctgacccagatggcgggctcgacctggaggaattttcccgctatctgcaggagcgggaacagcgtctgctgctcatgtttcacagtcttgaccggaaccaggatggtcacattgatgtctctgagatccaacagaagccggcttctcatgacatgaaattgcatggtcgagggagtctgtggggaaggaagcccaggtcctggctgcaacctgcacggatgctggattccccctcaccccacctctgcatggccaccccctcccagccctgtggggaaactgttccctggaaccactccactccctgcatccccacacttcacagcatcttccatccccctcccaccttctaggcgaatagtccccagagctgtgttcctccaaggggtccgaggaatcactcactcctggaggctggcaaggagacagtctgaggccagggacacatgaagggatgtccccaccccagcactatcagggcctccccaggcttccagagttgaaagccaggagaaaatcggcaaagaccacccttccctaaacccaagcacccaatgatgcaaaaaacaaaaacaaaaaaaaaccaccaaatccccaaattcattccagatctatttttctaccagagagaggagcaaagtcctcctcccctgcgcccttacattctgcacttcatagttggattctgagcttaggatcatctggagaccccatggagggacttggaaaggggaactgggatttggggaggggctggaggacttccgcacgcttccacctccttcgacctccactgcgccccacctccctgcctgtgtgtgttatttcaaaggaaaagaacaaaaggaataaattttctaagctct

SEQ ID NO: 17552 - DNA, 1778 bp, Homo sapiens
agcgggtcaccacctcccgcaagtgccagagccgagcggactgcgcggaggctgcggagccggcggccgcgggagctgaccctgcggggtcccggggggggagggggagccgcgaagcccccactgaggccgccgctgccgggcctcccctcccccccgggcgggcgccatgcgggggagcccgggcgacgcggagcggcggcagcgctggggtcgcctgttcgaggagctggacagtaacaaggatggccgcgtggacgtgcacgagttgcgccaggggctggccaggctgggcgggggcaacccagaccccggcgcccaacagggtatctcctctgagggtgatgctgacccagatggcgggctcgacctggaggaattttcccgctatctgcaggagcgggaacagcgtctgctgctcatgtttcacagtcttgaccggaaccaggatggtcacattgatgtctctgagatccaacagagtttccgagctctgggcatttccatctcgctggagcaggctgagaaaattttgcacagcatggaccgagacggcacaatgaccattgactggcaagaatggcgcgaccacttcctgttgcattcgctggaaaatgtggaggacgtgctgtatttctggaagcattccacggtcctggacattggcgagtgcctgacagtgccggacgagttctcaaagcaagagaagctgacgggcatgtggtggaaacagctggtggccggcgcagtggcaggtgccgtgtcacggacaggcacggcccctctggaccgcctcaaggtcttcatgcaggtccatgcctcaaagaccaaccggctgaacatccttggggggcttcgaagcatggtccttgagggaggcatccgctccctgtggcgcggcaatggtattaatgtactcaagattgcccccgagtcagctatcaagttcatggcctatgaacagatcaagagggccatcctggggcagcaggagacactgcatgtgcaggagcgcttcgtggctggctccctggctggtgccacagcccaaaccatcatttaccctatggaggtgctgaagacgcggctgaccttgcgccggacgggccagtataaggggctgctggactgcgccaggcgtatcctggagagggaggggccccgtgccttctaccgcggctacctccccaacgtgctgggcatcatcccctatgcgggcatcgacctggccgtctacgagactctgaagaactggtggcttcagcagtacagccacgactcggcagacccaggcatcctcgtgctcctggcctgcggtaccatatccagcacctgcggccagatagccagttacccgctggccctggtccggacccgcatgcaggcacaagccggtggtcatgccatgagcagccttatggagaggaccatgtggtaaggaactcagccaatagccatgtaactgagcttggaagaggatcttgctgtcctggccaacatctcactgcaattctatcagttgaattccctggatagtccaagctttgtggatccctccaccagaacaactggatcccagtacctgaatcctgaatcttagactcttatacttcaaacactgatcacgggaacagccggctcagcagctcctgagttcctaatgctcagaacatggatgagatgataaatgtttgttgtgttaagctgccaacctttggcgggggggtaattcgtcacatggcaacagctggctaatacatatatacctacatgtaaat

SEQ ID NO: 17553 - DNA, 1489 bp, Homo sapiens
agcgggtcaccacctcccgcaagtgccagagccgagcggactgcgcggaggctgcggagccggcggccgcgggagctgaccctgcggggtcccggggggggagggggagccgcgaagcccccactgaggccgccgctgccgggcctcccctcccccccgggcgggcgccatgcgggggagcccgggcgacgcggagcggcggcagcgctggggtcgcctgttcgaggagctggacagtaacaaggatggccgcgtggacgtgcacgagttgcgccaggggctggccaggctgggcgggggcaacccagaccccggcgcccaacagggtatctcctctgagggtgatgctgacccagatggcgggctcgacctggaggaattttcccgctatctgcaggagcgggaacagcgtctgctgctcatgtttcacagtcttgaccggaaccaggatggtcacattgatgtctctgagatccaacagagtttccgagctctgggcatttccatctcgctggagcaggctgagaaaattttgcacagcatggaccgagacggcacaatgaccattgactggcaagaatggcgcgaccacttcctgttgcattcgctggaaaatgtggaggacgtgctgtatttctggaagcattccacggtcctggacattggcgagtgcctgacagtgccggacgagttctcaaagcaagagaagctgacgggcatgtggtggaaacagctggtggccggcgcagtggcaggtgccgtgtcacggacaggcacggcccctctggaccgcctcaaggtcttcatgcaggtccatgcctcaaagaccaaccggctgaacatccttggggggcttcgaagcatggtccttgagggaggcatccgctccctgtggcgcggcaatggtattaatgtactcaagattgcccccgagtcagctatcaagttcatggcctatgaacagatcaagagggccatcctggggcagcaggagacactgcatgtgcaggagcgcttcgtggctggctccctggctggtgccacagcccaaaccatcatttaccctatggaggtgctgaagacgcggctgaccttgcgccggacgggccagtataaggggctgctggactgcgccaggcgtatcctggagagggaggggccccgtgccttctaccgcggctacctccccaacgtgctgggcatcatcccctatgcgggcatcgacctggccgtctacgagactctgaagaactggtggcttcagcagtacagccacgactcggcagacccaggcatcctcgtgctcctggcctgcggtaccatatccagcacctgcggccagatagccagttacccgctggccctggtccggacccgcatgcaggcacaagatgtgtcagtgtacaagacggacacggtccccaccctcatagagctcacaggccggagaggaaggaagatgctaaataaatcattctggaattaaaaa

SEQ ID NO: 17554 - DNA, 2232 bp, Homo sapiens
gcgcccgggccgccggccgggcccgggcctgggggcggggcgggaagacggcggccgggagtgttttcagttccgcctccaatcgcccattcccctcttcccctcccagccccctccatcccatcggaagaggaaggaacaaaaggtcccggaccccccggatctgacggggcgggacctggcgccaccttgcaggttcgatacaagaggctgttttcctagcgtggcttgctgcctttggtaagaacatgtcgtccatcttgccattcacgccgccagttgtgaagagactgctgggatggaagaagtcagctggtgggtctggaggagcaggcggaggagagcagaatgggcaggaagaaaagtggtgtgagaaagcagtgaaaagtctggtgaagaagctaaagaaaacaggacgattagatgagcttgagaaagccatcaccactcaaaactgtaatactaaatgtgttaccataccaagcacttgctctgaaatttggggactgagtacaccaaatacgatagatcagtgggatacaacaggcctttacagcttctctgaacaaaccaggtctcttgatggtcgtctccaggtatcccatcgaaaaggattgccacatgttatatattgccgattatggcgctggcctgatcttcacagtcatcatgaactcaaggcaattgaaaactgcgaatatgcttttaatcttaaaaaggatgaagtatgtgtaaacccttaccactatcagagagttgagacaccagttttgcctccagtattagtgccccgacacaccgagatcctaacagaacttccgcctctggatgactatactcactccattccagaaaacactaacttcccagcaggaattgagccacagagtaattatattccagaaacgccacctcctggatatatcagtgaagatggagaaacaagtgaccaacagttgaatcaaagtatggacacaggctctccagcagaactatctcctactactctttcccctgttaatcatagcttggatttacagccagttacttactcagaacctgcattttggtgttcgatagcatattatgaattaaatcagagggttggagaaaccttccatgcatcacagccctcactcactgtagatggctttacagacccatcaaattcagagaggttctgcttaggtttactctccaatgttaaccgaaatgccacggtagaaatgacaagaaggcatataggaagaggagtgcgcttatactacataggtggggaagtttttgctgagtgcctaagtgatagtgcaatctttgtgcagagccccaattgtaatcagagatatggctggcaccctgcaacagtgtgtaaaattccaccaggctgtaatctgaagatcttcaacaaccaggaatttgctgctcttctggctcagtctgttaatcagggttttgaagccgtctatcagctaactagaatgtgcaccataagaatgagttttgtgaaagggtggggagcagaataccgaaggcagacggtaacaagtactccttgctggattgaacttcatctgaatggacctctacagtggttggacaaagtattaactcagatgggatccccttcagtgcgttgctcaagcatgtcataaagcttcaccaatcaagtcccatgaaaagacttaatgtaacaactcttctgtcatagcattgtgtgtggtccctatggactgtttactatccaaaagttcaagagagaaaacagcacttgaggtctcatcaattaaagcaccttgtggaatctgtttcctatatttgaatattagatgggaaaattagtgtctagaaatactctcccattaaagaggaagagaagattttaaagacttaatgatgtcttattgggcataaaactgagtgtcccaaaggtttattaataacagtagtagttatgtgtacaggtaatgtatcatgatccagtatcacagtattgtgctgtttatatacatttttagtttgcatagatgaggtgtgtgtgtgcgctgcttcttgatctaggcaaacctttataaagttgcagtacctaatctgttattcccacttctctgttatttttgtgtgtcttttttaatatataatatatatcaagattttcaaattatttagaagcagattttcctgtagaaaaactaatttttctgccttttaccaaaaataaactcttgggggaag

SEQ ID NO: 17555 - DNA, 584 bp, Homo sapiens
gcatataatcatgatactggttaaattagccagtgatgctttattttcaaagaaatgttacaactacagttttcttctattatcatcatcgttttccttgaagcgcacttgctctgaaatttggggactgagtacaccaaatacgatagatcagtgggatacaacaggcctttacagcttctctgaacaaaccaggtctcttgatggtcgtctccaggtatcccatcgaaaaggattgccacatgttatatattgccgattatggcgctggcctgatcttcacagtcatcatgaactcaaggcaattgaaaactgcgaatatgcttttaatcttaaaaaggatgaagtatgtgtaaacccttaccactatcagagagttgagacaccagttttgcctccagtattagtgccccgacacaccgagatcctaacagaacttccgcctctggatgactatactcactccattccagaaaacactaacttcccagcaggaattgagccacagagtaattatattccaggtatttttgccttctgaatctcctaaaacttggatagatacaaattttgttcataagcat

SEQ ID NO: 17556 - DNA, 3389 bp, Homo sapiens
  misc_feature (263)..(263): n is a, c, g, or t
  misc_feature (266)..(268): n is a, c, g, or t
agcggcgggaggcggggcgggccgtagacaaagggaggtggggaggcggtggccggcgactccccgcgccccgctcgccccccggcccttcccgcggtgctcggcctcgttcctttcctcctccgctccctccgtcttccatacccgccccgcgcggctttcggccggcgtgcctcgcgccctaacgggcggctggaggcgccaatcagcgggcggcagggtgccagccccggggctgcgccggcgaatcggcggggcccgcngcnnngggtggcaggcgggtctacccgcgcggccgcggcggcggagaagcagctcgccagccagcagcccgccagccgccgggaggttcgatacaagaggctgttttcctagcgtggcttgctgcctttggtaagaacatgtcgtccatcttgccattcacgccgccagttgtgaagagactgctgggatggaagaagtcagctggtgggtctggaggagcaggcggaggagagcagaatgggcaggaagaaaagtggtgtgagaaagcagtgaaaagtctggtgaagaagctaaagaaaacaggacgattagatgagcttgagaaagccatcaccactcaaaactgtaatactaaatgtgttaccataccaagcacttgctctgaaatttggggactgagtacaccaaatacgatagatcagtgggatacaacaggcctttacagcttctctgaacaaaccaggtctcttgatggtcgtctccaggtatcccatcgaaaaggattgccacatgttatatattgccgattatggcgctggcctgatcttcacagtcatcatgaactcaaggcaattgaaaactgcgaatatgcttttaatcttaaaaaggatgaagtatgtgtaaacccttaccactatcagagagttgagacaccagttttgcctccagtattagtgccccgacacaccgagatcctaacagaacttccgcctctggatgactatactcactccattccagaaaacactaacttcccagcaggaattgagccacagagtaattatattccagaaacgccacctcctggatatatcagtgaagatggagaaacaagtgaccaacagttgaatcaaagtatggacacaggctctccagcagaactatctcctactactctttcccctgttaatcatagcttggatttacagccagttacttactcagaacctgcattttggtgttcgatagcatattatgaattaaatcagagggttggagaaaccttccatgcatcacagccctcactcactgtagatggctttacagacccatcaaattcagagaggttctgcttaggtttactctccaatgttaaccgaaatgccacggtagaaatgacaagaaggcatataggaagaggagtgcgcttatactacataggtggggaagtttttgctgagtgcctaagtgatagtgcaatctttgtgcagagccccaattgtaatcagagatatggctggcaccctgcaacagtgtgtaaaattccaccaggctgtaatctgaagatcttcaacaaccaggaatttgctgctcttctggctcagtctgttaatcagggttttgaagccgtctatcagctaactagaatgtgcaccataagaatgagttttgtgaaagggtggggagcagaataccgaaggcagacggtaacaagtactccttgctggattgaacttcatctgaatggacctctacagtggttggacaaagtattaactcagatgggatccccttcagtgcgttgctcaagcatgtcataaagcttcaccaatcaagtcccatgaaaagacttaatgtaacaactcttctgtcatagcattgtgtgtggtccctatggactgtttactatccaaaagttcaagagagaaaacagcacttgaggtctcatcaattaaagcaccttgtggaatctgtttcctatatttgaatattagatgggaaaattagtgtctagaaatactctcccattaaagaggaagagaagattttaaagacttaatgatgtcttattgggcataaaactgagtgtcccaaaggtttattaataacagtagtagttatgtgtacaggtaatgtatcatgatccagtatcacagtattgtgctgtttatatacatttttagtttgcatagatgaggtgtgtgtgtgcgctgcttcttgatctaggcaaacctttataaagttgcagtacctaatctgttattcccacttctctgttatttttgtgtgtcttttttaatatataatatatatcaagattttcaaattatttagaagcagattttcctgtagaaaaactaatttttctgccttttaccaaaaataaactcttgggggaagaaaagtggattaacttttgaaatccttgaccttaatgtgttcagtggggcttaaacagtcattctttttgtggtttttgtttttttgtttttttttttaactgctaaatcttattataaggaaaccataccgaaaacctttccaagcctcttttttccattcccatttttgtcctcataatcaaaacagcataacatgacatcatcaccagtaatagttgcattgatactgctggcaccagttaattctgggatacagtaagaattcatatggagaaagtccctttgtcttatgcccaaatttcaacaggaataattggcttgtataatctagcagtctgttgatttatccttccacctcataaaaaatgcataggtggcagtataattattttcagggatatgctagaattacttccacatatttatccctttttaaaaaagctaatctataaataccgtttttccaaaggtattttacaatatttcaacagcagaccttctgctcttcgagtagtttgatttggtttagtaaccagattgcattatgaaatgggccttttgtaaatgtaattgtttctgcaaaatacctagaaaagtgatgctgaggtaggatcagcagatatgggccatctgtttttaaagtatgttgtattcagtttataaattgattgttattctacacataattatgaattcagaattttaaaaattgggggaaaagccatttatttagcaagttttttagcttataagttacctgcagtctgagctgttcttaactgatcctggttttgtgattgacaatatttcatgctctgtagtgagaggagatttccgaaactctgttgctagttcattctgcagcaaataattattatgtctgatgttgactcattgcagtttaaacatttcttcttgtttgcatcttagtagaaatggaaaataaccactcctggtcgtcttttcataaattttcatatttttgaagctgtctttggtact

SEQ ID NO: 17557 - DNA, 3127 bp, Homo sapiens
aagccaggctggtacggtcggagtcgtttggatccgcggcggcggagaagcagctcgccagccagcagcccgccagccgccgggaggttcgatacaagaggctgttttcctagcgtggcttgctgcctttggtaagaacatgtcgtccatcttgccattcacgccgccagttgtgaagagactgctgggatggaagaagtcagctggtgggtctggaggagcaggcggaggagagcagaatgggcaggaagaaaagtggtgtgagaaagcagtgaaaagtctggtgaagaagctaaagaaaacaggacgattagatgagcttgagaaagccatcaccactcaaaactgtaatactaaatgtgttaccataccaagcacttgctctgaaatttggggactgagtacaccaaatacgatagatcagtgggatacaacaggcctttacagcttctctgaacaaaccaggtctcttgatggtcgtctccaggtatcccatcgaaaaggattgccacatgttatatattgccgattatggcgctggcctgatcttcacagtcatcatgaactcaaggcaattgaaaactgcgaatatgcttttaatcttaaaaaggatgaagtatgtgtaaacccttaccactatcagagagttgagacaccagttttgcctccagtattagtgccccgacacaccgagatcctaacagaacttccgcctctggatgactatactcactccattccagaaaacactaacttcccagcaggaattgagccacagagtaattatattccagaaacgccacctcctggatatatcagtgaagatggagaaacaagtgaccaacagttgaatcaaagtatggacacaggctctccagcagaactatctcctactactctttcccctgttaatcatagcttggatttacagccagttacttactcagaacctgcattttggtgttcgatagcatattatgaattaaatcagagggttggagaaaccttccatgcatcacagccctcactcactgtagatggctttacagacccatcaaattcagagaggttctgcttaggtttactctccaatgttaaccgaaatgccacggtagaaatgacaagaaggcatataggaagaggagtgcgcttatactacataggtggggaagtttttgctgagtgcctaagtgatagtgcaatctttgtgcagagccccaattgtaatcagagatatggctggcaccctgcaacagtgtgtaaaattccaccaggctgtaatctgaagatcttcaacaaccaggaatttgctgctcttctggctcagtctgttaatcagggttttgaagccgtctatcagctaactagaatgtgcaccataagaatgagttttgtgaaagggtggggagcagaataccgaaggcagacggtaacaagtactccttgctggattgaacttcatctgaatggacctctacagtggttggacaaagtattaactcagatgggatccccttcagtgcgttgctcaagcatgtcataaagcttcaccaatcaagtcccatgaaaagacttaatgtaacaactcttctgtcatagcattgtgtgtggtccctatggactgtttactatccaaaagttcaagagagaaaacagcacttgaggtctcatcaattaaagcaccttgtggaatctgtttcctatatttgaatattagatgggaaaattagtgtctagaaatactctcccattaaagaggaagagaagattttaaagacttaatgatgtcttattgggcataaaactgagtgtcccaaaggtttattaataacagtagtagttatgtgtacaggtaatgtatcatgatccagtatcacagtattgtgctgtttatatacatttttagtttgcatagatgaggtgtgtgtgtgcgctgcttcttgatctaggcaaacctttataaagttgcagtacctaatctgttattcccacttctctgttatttttgtgtgtcttttttaatatataatatatatcaagattttcaaattatttagaagcagattttcctgtagaaaaactaatttttctgccttttaccaaaaataaactcttgggggaagaaaagtggattaacttttgaaatccttgaccttaatgtgttcagtggggcttaaacagtcattctttttgtggtttttgtttttttgtttttttttttaactgctaaatcttattataaggaaaccataccgaaaacctttccaagcctcttttttccattcccatttttgtcctcataatcaaaacagcataacatgacatcatcaccagtaatagttgcattgatactgctggcaccagttaattctgggatacagtaagaattcatatggagaaagtccctttgtcttatgcccaaatttcaacaggaataattggcttgtataatctagcagtctgttgatttatccttccacctcataaaaaatgcataggtggcagtataattattttcagggatatgctagaattacttccacatatttatccctttttaaaaaagctaatctataaataccgtttttccaaaggtattttacaatatttcaacagcagaccttctgctcttcgagtagtttgatttggtttagtaaccagattgcattatgaaatgggccttttgtaaatgtaattgtttctgcaaaatacctagaaaagtgatgctgaggtaggatcagcagatatgggccatctgtttttaaagtatgttgtattcagtttataaattgattgttattctacacataattatgaattcagaattttaaaaattgggggaaaagccatttatttagcaagttttttagcttataagttacctgcagtctgagctgttcttaactgatcctggttttgtgattgacaatatttcatgctctgtagtgagaggagatttccgaaactctgttgctagttcattctgcagcaaataattattatgtctgatgttgactcattgcagtttaaacatttcttcttgtttgcatcttagtagaaatggaaaataaccactcctggtcgtcttttcataaattttcatatttttgaagctgtctttggtact

SEQ ID NO: 17558 - DNA, 2480 bp, Homo sapiens
  misc_feature (263)..(263): n is a, c, g, or t
  misc_feature (266)..(268): n is a, c, g, or t
agcggcgggaggcggggcgggccgtagacaaagggaggtggggaggcggtggccggcgactccccgcgccccgctcgccccccggcccttcccgcggtgctcggcctcgttcctttcctcctccgctccctccgtcttccatacccgccccgcgcggctttcggccggcgtgcctcgcgccctaacgggcggctggaggcgccaatcagcgggcggcagggtgccagccccggggctgcgccggcgaatcggcggggcccgcngcnnngggtggcaggcgggtctacccgcgcggccgcggcggcggagaagcagctcgccagccagcagcccgccagccgccgggagccctcccagccccctccatcccatcggaagaggaaggaacaaaaggtcccggaccccccggatctgacggggcgggacctggcgccaccttgcaggttcgatacaagaggctgttttcctagcgtggcttgctgcctttggtaagaacatgtcgtccatcttgccattcacgccgccagttgtgaagagactgctgggatggaagaagtcagctggtgggtctggaggagcaggcggaggagagcagaatgggcaggaagaaaagtggtgtgagaaagcagtgaaaagtctggtgaagaagctaaagaaaacaggacgattagatgagcttgagaaagccatcaccactcaaaactgtaatactaaatgtgttaccataccaagcacttgctctgaaatttggggactgagtacaccaaatacgatagatcagtgggatacaacaggcctttacagcttctctgaacaaaccaggtctcttgatggtcgtctccaggtatcccatcgaaaaggattgccacatgttatatattgccgattatggcgctggcctgatcttcacagtcatcatgaactcaaggcaattgaaaactgcgaatatgcttttaatcttaaaaaggatgaagtatgtgtaaacccttaccactatcagagagttgagacaccagttttgcctccagtattagtgccccgacacaccgagatcctaacagaacttccgcctctggatgactatactcactccattccagaaaacactaacttcccagcaggaattgagccacagagtaattatattccagaaacgccacctcctggatatatcagtgaagatggagaaacaagtgaccaacagttgaatcaaagtatggacacaggctctccagcagaactatctcctactactctttcccctgttaatcatagcttggatttacagccagttacttactcagaacctgcattttggtgttcgatagcatattatgaattaaatcagagggttggagaaaccttccatgcatcacagccctcactcactgtagatggctttacagacccatcaaattcagagaggttctgcttaggtttactctccaatgttaaccgaaatgccacggtagaaatgacaagaaggcatataggaagaggagtgcgcttatactacataggtggggaagtttttgctgagtgcctaagtgatagtgcaatctttgtgcagagccccaattgtaatcagagatatggctggcaccctgcaacagtgtgtaaaattccaccaggctgtaatctgaagatcttcaacaaccaggaatttgctgctcttctggctcagtctgttaatcagggttttgaagccgtctatcagctaactagaatgtgcaccataagaatgagttttgtgaaagggtggggagcagaataccgaaggcagacggtaacaagtactccttgctggattgaacttcatctgaatggacctctacagtggttggacaaagtattaactcagatgggatccccttcagtgcgttgctcaagcatgtcataaagcttcaccaatcaagtcccatgaaaagacttaatgtaacaactcttctgtcatagcattgtgtgtggtccctatggactgtttactatccaaaagttcaagagagaaaacagcacttgaggtctcatcaattaaagcaccttgtggaatctgtttcctatatttgaatattagatgggaaaattagtgtctagaaatactctcccattaaagaggaagagaagattttaaagacttaatgatgtcttattgggcataaaactgagtgtcccaaaggtttattaataacagtagtagttatgtgtacaggtaatgtatcatgatccagtatcacagtattgtgctgtttatatacatttttagtttgcatagatgaggtgtgtgtgtgcgctgcttcttgatctaggcaaacctttataaagttgcagtacctaatctgttattcccacttctctgttatttttgtgtgtcttttttaatatataatatatatcaagattttcaaattatttagaagcagattttcctgtagaaaaactaatttttctgccttttaccaaaaataaactcttgggggaag

SEQ ID NO: 17559 - DNA, 2237 bp, Homo sapiens
  misc_feature (263)..(263): n is a, c, g, or t
  misc_feature (266)..(268): n is a, c, g, or t
agcggcgggaggcggggcgggccgtagacaaagggaggtggggaggcggtggccggcgactccccgcgccccgctcgccccccggcccttcccgcggtgctcggcctcgttcctttcctcctccgctccctccgtcttccatacccgccccgcgcggctttcggccggcgtgcctcgcgccctaacgggcggctggaggcgccaatcagcgggcggcagggtgccagccccggggctgcgccggcgaatcggcggggcccgcngcnnngggtggcaggcgggtctacccgcgcggccgcggcggcggagaagcagctcgccagccagcagcccgccagccgccgggaggttcgatacaagaggctgttttcctagcgtggcttgctgcctttggtaagaacatgtcgtccatcttgccattcacgccgccagttgtgaagagactgctgggatggaagaagtcagctggtgggtctggaggagcaggcggaggagagcagaatgggcaggaagaaaagtggtgtgagaaagcagtgaaaagtctggtgaagaagctaaagaaaacaggacgattagatgagcttgagaaagccatcaccactcaaaactgtaatactaaatgtgttaccataccaagcacttgctctgaaatttggggactgagtacaccaaatacgatagatcagtgggatacaacaggcctttacagcttctctgaacaaaccaggtctcttgatggtcgtctccaggtatcccatcgaaaaggattgccacatgttatatattgccgattatggcgctggcctgatcttcacagtcatcatgaactcaaggcaattgaaaactgcgaatatgcttttaatcttaaaaaggatgaagtatgtgtaaacccttaccactatcagagagttgagacaccagttttgcctccagtattagtgccccgacacaccgagatcctaacagaacttccgcctctggatgactatactcactccattccagaaaacactaacttcccagcaggaattgagccacagagtaattatattccagaaacgccacctcctggatatatcagtgaagatggagaaacaagtgaccaacagttgaatcaaagtatggacacaggctctccagcagaactatctcctactactctttcccctgttaatcatagcttggatttacagccagttacttactcagaacctgcattttggtgttcgatagcatattatgaattaaatcagagggttggagaaaccttccatgcatcacagccctcactcactgtagatggctttacagacccatcaaattcagagaggttctgcttaggtttactctccaatgttaaccgaaatgccacggtagaaatgacaagaaggcatataggaagaggagtgcgcttatactacataggtggggaagtttttgctgagtgcctaagtgatagtgcaatctttgtgcagagccccaattgtaatcagagatatggctggcaccctgcaacagtgtgtaaaattccaccaggctgtaatctgaagatcttcaacaaccaggaatttgctgctcttctggctcagtctgttaatcagggttttgaagccgtctatcagctaactagaatgtgcaccataagaatgagttttgtgaaagggtggggagcagaataccgaaggcagacggtaacaagtactccttgctggattgaacttcatctgaatggacctctacagtggttggacaaagtattaactcagatgggatccccttcagtgcgttgctcaagcatgtcataaagcttcaccaatcaagtcccatgaaaagacttaatgtaacaactcttctgtcatagcattgtgtgtggtccctatggactgtttactatccaaaagttcaagagagaaaacagcacttgaggtctcatcaattaaagcaccttgtggaatctgtttcctatatttgaatattagatgggaaaattagtgtctagaaatactctcccattaaagaggaagagaagattttaaagacttaatgatgtcttattgggcataaaactgagtgtcccaaaggtttattaataacagtagtagttatgtgtacaggtaatgtatcatgatccagtatcacagtattgtgctgtttatatacatttttagtttgcatagatgaggtgtgtgtgtgcgctgcttcttgatctaggcaaacctttataaagttgcagtacc

SEQ ID NO: 17560 - DNA, 3100 bp, Homo sapiens
  misc_feature (263)..(263): n is a, c, g, or t
  misc_feature (266)..(268): n is a, c, g, or t
agcggcgggaggcggggcgggccgtagacaaagggaggtggggaggcggtggccggcgactccccgcgccccgctcgccccccggcccttcccgcggtgctcggcctcgttcctttcctcctccgctccctccgtcttccatacccgccccgcgcggctttcggccggcgtgcctcgcgccctaacgggcggctggaggcgccaatcagcgggcggcagggtgccagccccggggctgcgccggcgaatcggcggggcccgcngcnnngggtggcaggcgggtctacccgcgcggccgcggcggcggagaagcagctcgccagccagcagcccgccagccgccgggagcacttgctctgaaatttggggactgagtacaccaaatacgatagatcagtgggatacaacaggcctttacagcttctctgaacaaaccaggtctcttgatggtcgtctccaggtatcccatcgaaaaggattgccacatgttatatattgccgattatggcgctggcctgatcttcacagtcatcatgaactcaaggcaattgaaaactgcgaatatgcttttaatcttaaaaaggatgaagtatgtgtaaacccttaccactatcagagagttgagacaccagttttgcctccagtattagtgccccgacacaccgagatcctaacagaacttccgcctctggatgactatactcactccattccagaaaacactaacttcccagcaggaattgagccacagagtaattatattccagaaacgccacctcctggatatatcagtgaagatggagaaacaagtgaccaacagttgaatcaaagtatggacacaggctctccagcagaactatctcctactactctttcccctgttaatcatagcttggatttacagccagttacttactcagaacctgcattttggtgttcgatagcatattatgaattaaatcagagggttggagaaaccttccatgcatcacagccctcactcactgtagatggctttacagacccatcaaattcagagaggttctgcttaggtttactctccaatgttaaccgaaatgccacggtagaaatgacaagaaggcatataggaagaggagtgcgcttatactacataggtggggaagtttttgctgagtgcctaagtgatagtgcaatctttgtgcagagccccaattgtaatcagagatatggctggcaccctgcaacagtgtgtaaaattccaccaggctgtaatctgaagatcttcaacaaccaggaatttgctgctcttctggctcagtctgttaatcagggttttgaagccgtctatcagctaactagaatgtgcaccataagaatgagttttgtgaaagggtggggagcagaataccgaaggcagacggtaacaagtactccttgctggattgaacttcatctgaatggacctctacagtggttggacaaagtattaactcagatgggatccccttcagtgcgttgctcaagcatgtcataaagcttcaccaatcaagtcccatgaaaagacttaatgtaacaactcttctgtcatagcattgtgtgtggtccctatggactgtttactatccaaaagttcaagagagaaaacagcacttgaggtctcatcaattaaagcaccttgtggaatctgtttcctatatttgaatattagatgggaaaattagtgtctagaaatactctcccattaaagaggaagagaagattttaaagacttaatgatgtcttattgggcataaaactgagtgtcccaaaggtttattaataacagtagtagttatgtgtacaggtaatgtatcatgatccagtatcacagtattgtgctgtttatatacatttttagtttgcatagatgaggtgtgtgtgtgcgctgcttcttgatctaggcaaacctttataaagttgcagtacctaatctgttattcccacttctctgttatttttgtgtgtcttttttaatatataatatatatcaagattttcaaattatttagaagcagattttcctgtagaaaaactaatttttctgccttttaccaaaaataaactcttgggggaagaaaagtggattaacttttgaaatccttgaccttaatgtgttcagtggggcttaaacagtcattctttttgtggtttttgtttttttgtttttttttttaactgctaaatcttattataaggaaaccataccgaaaacctttccaagcctcttttttccattcccatttttgtcctcataatcaaaacagcataacatgacatcatcaccagtaatagttgcattgatactgctggcaccagttaattctgggatacagtaagaattcatatggagaaagtccctttgtcttatgcccaaatttcaacaggaataattggcttgtataatctagcagtctgttgatttatccttccacctcataaaaaatgcataggtggcagtataattattttcagggatatgctagaattacttccacatatttatccctttttaaaaaagctaatctataaataccgtttttccaaaggtattttacaatatttcaacagcagaccttctgctcttcgagtagtttgatttggtttagtaaccagattgcattatgaaatgggccttttgtaaatgtaattgtttctgcaaaatacctagaaaagtgatgctgaggtaggatcagcagatatgggccatctgtttttaaagtatgttgtattcagtttataaattgattgttattctacacataattatgaattcagaattttaaaaattgggggaaaagccatttatttagcaagttttttagcttataagttacctgcagtctgagctgttcttaactgatcctggttttgtgattgacaatatttcatgctctgtagtgagaggagatttccgaaactctgttgctagttcattctgcagcaaataattattatgtctgatgttgactcattgcagtttaaacatttcttcttgtttgcatcttagtagaaatggaaaataaccactcctggtcgtcttttcataaattttcatatttttgaagctgtctttggtact

SEQ ID NO: 17561 - DNA, 2552 bp, Homo sapiens
taatcattagggaggtgatggctttctaattcatcgtcaagtctgtgattctactttatggatatccctgacatctacacccaaagcttttgtctgaattggttttctaatgtatattttaatcatttctttcccagaatatggcagcagcctgttagttgactgtcctgcctcctgtttgccctcttatctgtcctccacagagtaattatattccagaaacgccacctcctggatatatcagtgaagatggagaaacaagtgaccaacagttgaatcaaagtatggacacaggctctccagcagaactatctcctactactctttcccctgttaatcatagcttggatttacagccagttacttactcagaacctgcattttggtgttcgatagcatattatgaattaaatcagagggttggagaaaccttccatgcatcacagccctcactcactgtagatggctttacagacccatcaaattcagagaggttctgcttaggtttactctccaatgttaaccgaaatgccacggtagaaatgacaagaaggcatataggaagaggagtgcgcttatactacataggtggggaagtttttgctgagtgcctaagtgatagtgcaatctttgtgcagagccccaattgtaatcagagatatggctggcaccctgcaacagtgtgtaaaattccaccaggctgtaatctgaagatcttcaacaaccaggaatttgctgctcttctggctcagtctgttaatcagggttttgaagccgtctatcagctaactagaatgtgcaccataagaatgagttttgtgaaagggtggggagcagaataccgaaggcagacggtaacaagtactccttgctggattgaacttcatctgaatggacctctacagtggttggacaaagtattaactcagatgggatccccttcagtgcgttgctcaagcatgtcataaagcttcaccaatcaagtcccatgaaaagacttaatgtaacaactcttctgtcatagcattgtgtgtggtccctatggactgtttactatccaaaagttcaagagagaaaacagcacttgaggtctcatcaattaaagcaccttgtggaatctgtttcctatatttgaatattagatgggaaaattagtgtctagaaatactctcccattaaagaggaagagaagattttaaagacttaatgatgtcttattgggcataaaactgagtgtcccaaaggtttattaataacagtagtagttatgtgtacaggtaatgtatcatgatccagtatcacagtattgtgctgtttatatacatttttagtttgcatagatgaggtgtgtgtgtgcgctgcttcttgatctaggcaaacctttataaagttgcagtacctaatctgttattcccacttctctgttatttttgtgtgtcttttttaatatataatatatatcaagattttcaaattatttagaagcagattttcctgtagaaaaactaatttttctgccttttaccaaaaataaactcttgggggaagaaaagtggattaacttttgaaatccttgaccttaatgtgttcagtggggcttaaacagtcattctttttgtggtttttgtttttttgtttttttttttaactgctaaatcttattataaggaaaccataccgaaaacctttccaagcctcttttttccattcccatttttgtcctcataatcaaaacagcataacatgacatcatcaccagtaatagttgcattgatactgctggcaccagttaattctgggatacagtaagaattcatatggagaaagtccctttgtcttatgcccaaatttcaacaggaataattggcttgtataatctagcagtctgttgatttatccttccacctcataaaaaatgcataggtggcagtataattattttcagggatatgctagaattacttccacatatttatccctttttaaaaaagctaatctataaataccgtttttccaaaggtattttacaatatttcaacagcagaccttctgctcttcgagtagtttgatttggtttagtaaccagattgcattatgaaatgggccttttgtaaatgtaattgtttctgcaaaatacctagaaaagtgatgctgaggtaggatcagcagatatgggccatctgtttttaaagtatgttgtattcagtttataaattgattgttattctacacataattatgaattcagaattttaaaaattgggggaaaagccatttatttagcaagttttttagcttataagttacctgcagtctgagctgttcttaactgatcctggttttgtgattgacaatatttcatgctctgtagtgagaggagatttccgaaactctgttgctagttcattctgcagcaaataattattatgtctgatgttgactcattgcagtttaaacatttcttcttgtttgcatcttagtagaaatggaaaataaccactcctggtcgtcttttcataaattttcatatttttgaagctgtctttggtact

SEQ ID NO: 17562 - DNA, 1802 bp, Homo sapiens
tctgtaaatttttaatgcagtgtacctaaacatagccattttccctgcctgtggacttgaatttcataatcattttcctgtatcttttaaacagaaggcagacggtaacaagtactccttgctggattgaacttcatctgaatggacctctacagtggttggacaaagtattaactcagatgggatccccttcagtgcgttgctcaagcatgtcataaagcttcaccaatcaagtcccatgaaaagacttaatgtaacaactcttctgtcatagcattgtgtgtggtccctatggactgtttactatccaaaagttcaagagagaaaacagcacttgaggtctcatcaattaaagcaccttgtggaatctgtttcctatatttgaatattagatgggaaaattagtgtctagaaatactctcccattaaagaggaagagaagattttaaagacttaatgatgtcttattgggcataaaactgagtgtcccaaaggtttattaataacagtagtagttatgtgtacaggtaatgtatcatgatccagtatcacagtattgtgctgtttatatacatttttagtttgcatagatgaggtgtgtgtgtgcgctgcttcttgatctaggcaaacctttataaagttgcagtacctaatctgttattcccacttctctgttatttttgtgtgtcttttttaatatataatatatatcaagattttcaaattatttagaagcagattttcctgtagaaaaactaatttttctgccttttaccaaaaataaactcttgggggaagaaaagtggattaacttttgaaatccttgaccttaatgtgttcagtggggcttaaacagtcattctttttgtggtttttgtttttttgtttttttttttaactgctaaatcttattataaggaaaccataccgaaaacctttccaagcctcttttttccattcccatttttgtcctcataatcaaaacagcataacatgacatcatcaccagtaatagttgcattgatactgctggcaccagttaattctgggatacagtaagaattcatatggagaaagtccctttgtcttatgcccaaatttcaacaggaataattggcttgtataatctagcagtctgttgatttatccttccacctcataaaaaatgcataggtggcagtataattattttcagggatatgctagaattacttccacatatttatccctttttaaaaaagctaatctataaataccgtttttccaaaggtattttacaatatttcaacagcagaccttctgctcttcgagtagtttgatttggtttagtaaccagattgcattatgaaatgggccttttgtaaatgtaattgtttctgcaaaatacctagaaaagtgatgctgaggtaggatcagcagatatgggccatctgtttttaaagtatgttgtattcagtttataaattgattgttattctacacataattatgaattcagaattttaaaaattgggggaaaagccatttatttagcaagttttttagcttataagttacctgcagtctgagctgttcttaactgatcctggttttgtgattgacaatatttcatgctctgtagtgagaggagatttccgaaactctgttgctagttcattctgcagcaaataattattatgtctgatgttgactcattgcagtttaaacatttcttcttgtttgcatcttagtagaaatggaaaataaccactcctggtcgtcttttcataaattttcatatttttgaagctgtctttggtact

SEQ ID NO: 17563 - DNA, 1834 bp, Homo sapiens
  misc_feature (263)..(263): n is a, c, g, or t
  misc_feature (266)..(268): n is a, c, g, or t
agcggcgggaggcggggcgggccgtagacaaagggaggtggggaggcggtggccggcgactccccgcgccccgctcgccccccggcccttcccgcggtgctcggcctcgttcctttcctcctccgctccctccgtcttccatacccgccccgcgcggctttcggccggcgtgcctcgcgccctaacgggcggctggaggcgccaatcagcgggcggcagggtgccagccccggggctgcgccggcgaatcggcggggcccgcngcnnngggtggcaggcgggtctacccgcgcggccgcggcggcggagaagcagctcgccagccagcagcccgccagccgccgggaggttcgatacaagaggctgttttcctagcgtggcttgctgcctttggtaagaacatgtcgtccatcttgccattcacgccgccagttgtgaagagactgctgggatggaagaagtcagctggtgggtctggaggagcaggcggaggagagcagaatgggcaggaagaaaagtggtgtgagaaagcagtgaaaagtctggtgaagaagctaaagaaaacaggacgattagatgagcttgagaaagccatcaccactcaaaactgtaatactaaatgtgttaccataccaagcacttgctctgaaatttggggactgagtacaccaaatacgatagatcagtgggatacaacaggcctttacagcttctctgaacaaaccaggtctcttgatggtcgtctccaggtatcccatcgaaaaggattgccacatgttatatattgccgattatggcgctggcctgatcttcacagtcatcatgaactcaaggcaattgaaaactgcgaatatgcttttaatcttaaaaaggatgaagtatgtgtaaacccttaccactatcagagagttgagacaccagttttgcctccagtattagtgccccgacacaccgagatcctaacagaacttccgcctctggatgactatactcactccattccagaaaacactaacttcccagcaggaattgagccacagagtaattatattccagaaacgccacctcctggatatatcagtgaagatggagaaacaagtgaccaacagttgaatcaaagtatggacacaggctctccagcagaactatctcctactactctttcccctgttaatcatagcttggatttacagccagttacttactcagaacctgcattttggtgttcgatagcatattatgaattaaatcagagggttggagaaaccttccatgcatcacagccctcactcactgtagatggctttacagacccatcaaattcagagaggttctgcttaggtttactctccaatgttaaccgaaatgccacggtagaaatgacaagaaggcatataggaagaggagtgcgcttatactacataggtggggaagtttttgctgagtgcctaagtgatagtgcaatctttgtgcagagccccaattgtaatcagagatatggctggcaccctgcaacagtgtgtaaaattccaccaggctgtaatctgaagatcttcaacaaccaggaatttgctgctcttctggctcagtctgttaatcagggttttgaagccgtctatcagctaactagaatgtgcaccataagaatgagttttgtgaaagggtggggagcagaataccggtatgaaatacatatttggttcttaaatttccacagtgtaattatgtttcattgcattcttgcatattctggagttcatttgtatctattttcaatgaggttatagagtcagctgatctttatgtaaaataaagttggaggcctccaaattca

SEQ ID NO: 17564 - DNA, 2748 bp, Homo sapiens
  misc_feature (263)..(263): n is a, c, g, or t
  misc_feature (266)..(268): n is a, c, g, or t
agcggcgggaggcggggcgggccgtagacaaagggaggtggggaggcggtggccggcgactccccgcgccccgctcgccccccggcccttcccgcggtgctcggcctcgttcctttcctcctccgctccctccgtcttccatacccgccccgcgcggctttcggccggcgtgcctcgcgccctaacgggcggctggaggcgccaatcagcgggcggcagggtgccagccccggggctgcgccggcgaatcggcggggcccgcngcnnngggtggcaggcgggtctacccgcgcggccgcggcggcggagaagcagctcgccagccagcagcccgccagccgccgggaggttcgatacaagaggctgttttcctagcgtggcttgctgcctttggtaagaacatgtcgtccatcttgccattcacgccgccagttgtgaagagactgctgggatggaagaagtcagctggtgggtctggaggagcaggcggaggagagcagaatgggcaggaagaaaagtggtgtgagaaagcagtgaaaagtctggtgaagaagctaaagaaaacaggacgattagatgagcttgagaaagccatcaccactcaaaactgtaatactaaatgtgttaccataccaagcacttgctctgaaatttggggactgagtacaccaaatacgatagatcagtgggatacaacaggcctttacagcttctctgaacaaaccaggtctcttgatggtcgtctccaggtatcccatcgaaaaggattgccacatgttatatattgccgattatggcgctggcctgatcttcacagtcatcatgaactcaaggcaattgaaaactgcgaatatgcttttaatcttaaaaaggatgaagtatgtgtaaacccttaccactatcagagagttgagacaccagttttgcctccagtattagtgccccgacacaccgagatcctaacagaacttccgcctctggatgactatactcactccattccagaaaacactaacttcccagcaggaattgagccacagagtaattatattccagaaacgccacctcctggatatatcagtgaagatggagaaacaagtgaccaacagttgaatcaaagtatggacacaggctctccagcagaactatctcctactactctttcccctgttaatcatagcttggatttacagccagttacttactcagaacctgcattttggtgttcgatagcatattatgaattaaatcagagggttggagaaaccttccatgcatcacagccctcactcactgtagatggctttacagacccatcaaattcagagaggttctgcttaggtttactctccaatgttaaccgaaatgccacggtagaaatgacaagaaggcatataggaagaggagtgcgcttatactacataggtggggaagtttttgctgagtgcctaagtgatagtgcaatctttgtgcagagccccaattgtaatcagagatatggctggcaccctgcaacagtgtgtaaaattccaccaggctgtaatctgaagatcttcaacaaccaggaatttgctgctcttctggctcagtctgttaatcagggttttgaagccgtctatcagctaactagaatgtgcaccataagaatgagttttgtgaaagggtggggagcagaataccgaaggcagacggtaacaagtactccttgctggattgaacttcatctgaatggacctctacagtggttggacaaagtattaactcagatgggatccccttcagtgcgttgctcaagcatgtcataaagcttcaccaatcaagtcccatgaaaagacttaatgtaacaactcttctgtcatagcattgtgtgtggtccctatggactgtttactatccaaaagttcaagagagaaaacagcacttgaggtctcatcaattaaagcaccttgtggaatctgtttcctatatttgaatattagatgggaaaattagtgtctagaaatactctcccattaaagaggaagagaagattttaaagacttaatgatgtcttattgggcataaaactgagtgtcccaaaggtttattaataacagtagtagttatgtgtacaggtaatgtatcatgatccagtatcacagtattgtgctgtttatatacatttttagtttgcatagatgaggtgtgtgtgtgcgctgcttcttgatctaggcaaacctttataaagttgcagtaccctaaaaaaaaaaaaaaaaaaaaaaaaaaaaaaaacaaaaaaaaactaaaacaacaaaacaaaaaaaaaaaagaagggggggggcgcgaaaaaaaatttcccccggggggggcccccagatttagccagcaccccccaggttttttgtgtaaaaaaggggggcccaaaaaggaggcgggtaaaaaaaaagggagggggcggggaaaccccggcggcgacgggggacacacccgaagggggactggggaagacgccccatccttcgggcgggggcgtaattcggcgacccaaccccaaagaaattagagccggggaatcaaccctcgcggtcaaggcggaaccacaggaatagtcggggagagaattcgtccagaatatctagaatacgggggcatcaatataccgactgcgctaacaactacaacagacaacaaacacgcgctcgcgaacatacagcaacatataacacacaaacgctgaacaacacagaccaccacacatcaacaacagaa

SEQ ID NO: 17565 - DNA, 3132 bp, Homo sapiens
aagccaggctggtacggtcggagtcgtttggatccgcggcggcggagaagcagctcgccagccagcagcccgccagccgccgggagccctcccagccccctccatcccatcggaagaggaaggaacaaaaggtcccggaccccccggatctgacggggcgggacctggcgccaccttgcaggttcgatacaagaggctgttttcctagcgtggcttgctgcctttggtaagaacatgtcgtccatcttgccattcacgccgccagttgtgaagagactgctgggatggaagaagtcagctggtgggtctggaggagcaggcggaggagagcagaatgggcaggaagaaaagtggtgtgagaaagcagtgaaaagtctggtgaagaagctaaagaaaacaggacgattagatgagcttgagaaagccatcaccactcaaaactgtaatactaaatgtgttaccataccaaggtctcttgatggtcgtctccaggtatcccatcgaaaaggattgccacatgttatatattgccgattatggcgctggcctgatcttcacagtcatcatgaactcaaggcaattgaaaactgcgaatatgcttttaatcttaaaaaggatgaagtatgtgtaaacccttaccactatcagagagttgagacaccagttttgcctccagtattagtgccccgacacaccgagatcctaacagaacttccgcctctggatgactatactcactccattccagaaaacactaacttcccagcaggaattgagccacagagtaattatattccagaaacgccacctcctggatatatcagtgaagatggagaaacaagtgaccaacagttgaatcaaagtatggacacaggctctccagcagaactatctcctactactctttcccctgttaatcatagcttggatttacagccagttacttactcagaacctgcattttggtgttcgatagcatattatgaattaaatcagagggttggagaaaccttccatgcatcacagccctcactcactgtagatggctttacagacccatcaaattcagagaggttctgcttaggtttactctccaatgttaaccgaaatgccacggtagaaatgacaagaaggcatataggaagaggagtgcgcttatactacataggtggggaagtttttgctgagtgcctaagtgatagtgcaatctttgtgcagagccccaattgtaatcagagatatggctggcaccctgcaacagtgtgtaaaattccaccaggctgtaatctgaagatcttcaacaaccaggaatttgctgctcttctggctcagtctgttaatcagggttttgaagccgtctatcagctaactagaatgtgcaccataagaatgagttttgtgaaagggtggggagcagaataccgaaggcagacggtaacaagtactccttgctggattgaacttcatctgaatggacctctacagtggttggacaaagtattaactcagatgggatccccttcagtgcgttgctcaagcatgtcataaagcttcaccaatcaagtcccatgaaaagacttaatgtaacaactcttctgtcatagcattgtgtgtggtccctatggactgtttactatccaaaagttcaagagagaaaacagcacttgaggtctcatcaattaaagcaccttgtggaatctgtttcctatatttgaatattagatgggaaaattagtgtctagaaatactctcccattaaagaggaagagaagattttaaagacttaatgatgtcttattgggcataaaactgagtgtcccaaaggtttattaataacagtagtagttatgtgtacaggtaatgtatcatgatccagtatcacagtattgtgctgtttatatacatttttagtttgcatagatgaggtgtgtgtgtgcgctgcttcttgatctaggcaaacctttataaagttgcagtacctaatctgttattcccacttctctgttatttttgtgtgtcttttttaatatataatatatatcaagattttcaaattatttagaagcagattttcctgtagaaaaactaatttttctgccttttaccaaaaataaactcttgggggaagaaaagtggattaacttttgaaatccttgaccttaatgtgttcagtggggcttaaacagtcattctttttgtggtttttgtttttttgtttttttttttaactgctaaatcttattataaggaaaccataccgaaaacctttccaagcctcttttttccattcccatttttgtcctcataatcaaaacagcataacatgacatcatcaccagtaatagttgcattgatactgctggcaccagttaattctgggatacagtaagaattcatatggagaaagtccctttgtcttatgcccaaatttcaacaggaataattggcttgtataatctagcagtctgttgatttatccttccacctcataaaaaatgcataggtggcagtataattattttcagggatatgctagaattacttccacatatttatccctttttaaaaaagctaatctataaataccgtttttccaaaggtattttacaatatttcaacagcagaccttctgctcttcgagtagtttgatttggtttagtaaccagattgcattatgaaatgggccttttgtaaatgtaattgtttctgcaaaatacctagaaaagtgatgctgaggtaggatcagcagatatgggccatctgtttttaaagtatgttgtattcagtttataaattgattgttattctacacataattatgaattcagaattttaaaaattgggggaaaagccatttatttagcaagttttttagcttataagttacctgcagtctgagctgttcttaactgatcctggttttgtgattgacaatatttcatgctctgtagtgagaggagatttccgaaactctgttgctagttcattctgcagcaaataattattatgtctgatgttgactcattgcagtttaaacatttcttcttgtttgcatcttagtagaaatggaaaataaccactcctggtcgtcttttcataaattttcatatttttgaagctgtctttggtact

SEQ ID NO: 17566 - DNA, 746 bp, Homo sapiens
aagccaggctggtacggtcggagtcgtttggatccgcggcggcggagaagcagctcgccagccagcagcccgccagccgccgggagccctcccagccccctccatcccatcggaagaggaaggaacaaaaggtcccggaccccccggatctgacggggcgggacctggcgccaccttgcaggttcgatacaagaggctgttttcctagcgtggcttgctgcctttggtaagaacatgtcgtccatcttgccattcacgccgccagttgtgaagagactgctgggatggaagaagtcagctggtgggtctggaggagcaggcggaggagagcagaatgggcaggaagaaaagtggtgtgagaaagcagtgaaaagtctggtgaagaagctaaagaaaacaggacgattagatgagcttgagaaagccatcaccactcaaaactgtaatagctgtaatctgaagatcttcaacaaccaggaatttgctgctcttctggctcagtctgttaatcagggttttgaagccgtctatcagctaactagaatgtgcaccataagaatgagttttgtgaaagggtggggagcagaataccggtatgaaatacatatttggttcttaaatttccacagtgtaattatgtttcattgcattcttgcatattctggagttcatttgtatctattttcaatgaggttatagagtcagctgatctttatgtaaaataaagttggaggcctccaaattca

SEQ ID NO: 17567 - DNA, 317 bp, Homo sapiens
cccttccatgctcacacctctccgtgcccacatcggggaaaggatccccactttaaaggctcgtgtgattagattgggctcacctggatagtccagaagaattttcccatctcaaccttgatcacatctgcaaagtcccttttgccatggaaagtaacatattcatgggttccagggattaggagatggccctattttgtcatattttgctggaggcggggaggatattattctgcctaccataaacatatgtacacacaaatagtaacaataagtgtaaatttatgtttgtatatgtataaacaattactataata

SEQ ID NO: 17568 - DNA, 396 bp, Homo sapiens
tccagcatatgattgaccttggacactgttccatgtgcacttgaggagaacgtgacttcggctcttgccaggtggagtgttctagagatgtcagttggtgtccagtgatgtcaagtcatttgtatctactgattttctttctaatttttctatccattattgagagtggggtaggattttggtgtccaattattgtttttttgttgtttttgttttgttttgttttgtttttttgaggtggagtctcactttgtcacccaggctggagtgcagtggtatgatcacagctcactgcagcccccacctcccaaggctgaggtgagaggatgacttgagcccagtaggcagagattgcagtgcattccagcctgggctacacagcaagaccctgacaaa

SEQ ID NO: 17569 - DNA, 403 bp, Homo sapiens
ctcctgggatggaaggtgtccttgtgctagtcatgaacccaacagaaagcaagtgccattttctcttctcttcccctctttatctctgagatcttaacttggctgcttcttttcagaagacagtgatgcactgtattcaagtgatagccccagcagtaacattgatgcagagaaaatggaatactttttacaagagaccagaagacacatgaagctagaaaaaggagcccagaaaactgccacattttgcccatatagaaaagcatatcccgaccgggcacagtggctcacgcctgtaatcccaggactttggaagcccaagatgggtggatcacaaggtcaggagttcgagaccagcctggccaatatggtgataccctatctctactaaaaatgaaaaaat

SEQ ID NO: 17570 - DNA, 333 bp, Homo sapiens
gtagctctaaacaaaaaggtgttgaaatggtagtattttctagagatcattgacctaagacatgttccatttcactttatttgaaaatcctgtcctggtgtgcatgttgcacacatttcccacctacttcctttaggacctcaccagcctgttgacaaagtctctggaaacaacaaccctttaaatttttagggcccaataagagtttttaaaggctggacctgaggctcattcctgtaatcccagcactttgggatgctgaggagggaggatcacttgaagccaggagagaccagcctgggtaacatattgagaccctgtctctaccaaaaa

SEQ ID NO: 17571 - DNA, 425 bp, Homo sapiens
ggtgccagatgacatcctgaggccattcatgggaagcctagatgtggcaaagctgcagggacagagagcagatgagaagctgctggaggcccagtcggggtgtggttgactgcagtggggatgggagagttttggggtgctagaaaggcccagtactatgatgtggtggcttcatagcttgccacagttgtcagaactcagttgagtctttaaaattgtgaatattattgcttgtaagttatgtattaagtcttttaaaaatagatgcaacacatacacacatgcacttacttttcctattaaaaaagctaattgggctgggattctgtgagaaattgtcaggcttgtcaggaggtaagagtggacgttaggtggaaagtaagtgactccattttgatcatgctaagtttgaagttacatcatgt

SEQ ID NO: 17572 - DNA, 397 bp, Homo sapiens
gtggtgaacacaatggattatggagctgtaaccggagctgggcccaaccctgagcaaatggtgcagccagcgaagtgtgtctttgatgccctctcctttctgtgggctccacctgcaccctgatctgggctccctcacaggcatctccatgaacttcaaagctggaactccacccacagctgagctgcacccagacagagatgcgggcagagctttctaaggaacccaaattagcagctcatggacgcagcgttaatttgctcttgctgctggctgactttgaacttagtatctcagttttctctctgtgtcaccggctttgaacttcaatgctttggtgcctgcattctctttataacccactgtgccccgggacctcagagggccccacgaaccc

SEQ ID NO: 17573 - DNA, 371 bp, Homo sapiens
acggcttcaacggaactttctgtgtaggttttgggcgggagatgaccgccttggcaggccagaccgctcataacgccatggcttgggttttccttccccagatctgcctccgctttcacagtcctccagatttttccaagagcagcagaaaatgaataaatccctggtgagtgtttctgttcatgtatttattctctactctgatttacaatacaccttaggaggagattaagggttcaaagtttaaaatgggaaagtagaaatagatacaagatttggtcagacagaacagtagccatcagcaccaagcctttttatcatattcatatgcgcagatagcgtgatccttaaaaagttccgttgaagtcaga

SEQ ID NO: 17574 - DNA, 801 bp, Homo sapiens
gtgttcgcgcatgcgcgccgcggccgcagtgccctcgcttcctgtgcgtccccaggtcaccgctcgccctagttcccaggctttggcctccggtgggcgagaatcgcggagcctgcggggctgggcgccgaagagccgggccggcacccaagcgggcgcggggctgtgcgggccaggcggaggctcaagcggggatccccgagcacgacccccggagccgacggcgctggggcccaaggggccggccgggcggtgacgacggcggaggcgaaggggcggcgggacccgggcccggcccgtgtgcgtcctcgacggcccggccccggctccgcaggacggtgagccccagggagacggatctgggctccgggagggacgccccgtctggatttgtcccgtaggcccggcccgggcccctctggagcagaacggccttggtgaggtggacaggaagggacctcgcgagcagacgcgcgcccgcgacagcaatcccgccccggcctgtcgggagcggtggggcagaggctgcggagccccaggaggatctgcctccgctttcacagtcctccagatttttccaagagcagcagaaaatgaataaatccctgatggagtctcactctgttgcccaggctggagtgcagtggcgctatccctgattcaagcgattctcctgccttagcctcccgagtagctgcgattacaggcacctgccaccacacccagctcatttttgtatttttttagtagagacggggtttcagaagcacttgggccaagctggtctcgaactcctgacct

SEQ ID NO: 17575 - DNA, 4524 bp, Homo sapiens
gtgttcgcgcatgcgcgccgcggccgcagtgccctcgcttcctgtgcgtccccaggtcaccgctcgccctagttcccaggctttggcctccggtgggcgagaatcgcggagcctgcggggctgggcgccgaagagccgggccggcacccaagcgggcgcggggctgtgcgggccaggcggaggctcaagcggggatccccgagcacgacccccggagccgacggcgctggggcccaaggggccggccgggcggtgacgacggcggaggcgaaggggcggcgggacccgggcccggcccgtgtgcgtcctcgacggcccggccccggctccgcaggacggtgagccccagggagacggatctgggctccgggagggacgccccgtctggatttgtcccgtaggcccggcccgggcccctctggagcagaacggccttggtgaggtggacaggaagggacctcgcgagcagacgcgcgcccgcgacagcaatcccgccccggcctgtcgggagcggtggggcagaggctgcggagccccaggaggatctgcctccgctttcacagtcctccagatttttccaagagcagcagaaaatgaataaatccctggggccagtgtcattcaaggacgtggctgtggacttcacccaggaggaatggcagcagctggatcctgagcagaagataacttacagggatgtgatgctggagaactacagcaatctagtttctgtggggtatcacattatcaaaccggatgttatcagcaagttggagcaaggagaagagccatggatagtagaaggagaattcctacttcagagctatccagatgaagtctggcaaactgatgacctaatagagagaatccaggaagaggaaaataaaccttcaaggcaaactgtgttcattgagaccctgattgaagagagaggtaatgttcctggtaaaacttttgatgtagaaacgaaccctgttccttcaagaaaaatagcctataaaaatagcctctgtgactcatgtgaaaagtgtttaacgtctgtttcagaatatattagtagtgatggaagctatgcaagaatgaaagctgatgaatgtagtggatgtgggaaatcactcctccatattaagcttgagaaaactcatccaggagatcaagcttatgaatttaatcaaaatggggaaccttatactctaaatgaagaaagtctttatcagaaaattcgtattttggagaaaccttttgaatatattgaatgccagaaagccttccaaaaggacactgtttttgttaatcacatggaagaaaagccctataagtggaatggatctgaaatagcctttctccagatgtcggacctcactgtacatcagacatctcatatggaaatgaagccctatgaatgcagtgaatgtgggaaatccttctgtaaaaagtcaaaatttattatacatcagaggactcacacaggagagaaaccttacgaatgtaatcagtgtgggaaatccttctgccagaagggaacccttactgtgcatcagagaacacacacaggggagaagccctatgaatgtaatgaatgtgggaagaacttttaccagaagttacacctcattcagcatcagagaactcactcaggagagaagccctatgaatgtagttattgtggaaaatccttttgccagaagacacacctcacacaacatcagagaacacattcaggagagagaccttatgtttgtcatgactgtgggaaaaccttctcgcagaagtcagcacttaatgaccatcagaaaattcacacaggtgtgaaactctacaagtgtagtgaatgtgggaaatgcttctgccgcaagtctactctcacgacccacctgaggacccacacaggagagaaaccgtatgaatgtaatgagtgtggaaaattcttctctcggttgtcatatctcactgtacattatagaactcattcaggagagaaaccctatgagtgtactgaatgtggaaaaaaattctaccacaaatcagcattcaacagccatcagagaattcataggagaggcaatatgaatgtaatagatgtgggaaggcttctctgaagtcagacctcattttatatcagagaaccctttcagtatagtgaatcagaaactcctgcctgaagtcaaacaccttgtacatcagagagttcacacaggttagtgtggacatccccttgtgtgttggactcataatctgaagactcacagaatggaaaccatgattataacaagaccacatggtataacaatactagactatagacaagtaaaaatttataaatattaagaatgtatatacatgtcaccatggattggaactgttttgcatatcagggaaatcatagccaaggggaaatctatcagtataaggaatgtggaagacataatcctttggaaactgttaatactaaaagatatgtttctgatacaatagcaaacttgaaaaaaaaaaaagaaatagaagattcctgctgtgaataaacatacttcttgtgtaaatagaaactgtaaagtcatcaggatagctagttaagtcggtaaccttaaactcatgtaagcagttcccaaagaacataggacttatgtttggggagagggttgtttttattacagtacattacaggaattgtatgttcacttcgaatcatgtttgaaaaaacgttgtatccttattttgtaattcatatagtaagagtattctaaacagcactacattaatatcatttgataggtataaagtatactttttcttgcactcttctctaggatttaatgcattgatcattcttaatgaacaatatcagctctaaaggaccaatgcttttataatgttttcaactgtatctgagtcagccagagagataaatatccatgtataaaatagatagaaaactttgcttggtaatttaaaattaataatgccagttttccaagagtgagaaaatcattgcactctatacagttttaagatatacttaaaatattcccatttgtatctatttttttttctactgttttttatttggacacttacataacagtgcagagcacaatgctgtgtaacataggaattcactgtgttttcatttgatgtcgtactggttttaaaccttgtgctctactccttcctgttaatgaattaagaacacattctaacaagggtctgtggcagacattgccgagtgactttctaacataggaattcactgtgttttcatttgatgtcgtactggttttaaaccttgtgctctactccttcctgttaatgaattaagaacacattctaacaagggtctgtggcagacattgccgagtgactttcttagtcactcccttactctgctggcggagtttggttatccatttatcctcaaaaggaagtgagataaatcctgattagttttaaccagtgacactccccttctcgttgccagcagttgatttacagtggtcacagggcccaattctagacataaaacaaaggatatacctgacagactacttctggaaaaggttttctcaaaggcccaaggattcaagcaaagggaagtggaatcttgtggtgaacagtaccttgtctggatgtggtgcctggtaaccatctttcagcaatggattatagtttaatcatggcctgagcagaaatactgaaagaccctgagacctggatgatgtctttgagccaccaaaccaagcagccttgtagccactcctcctttggactgtttcttttgtgagagactaaacttatttttaagccagttgatttaggatgctctattactaataactgaagacattctaattggtacagactgaaacctttataggagttatgcagttcagaagtggactttaggtaagtcatttattttaagctgttgatatagagatttattttctgtaaattttgacgtaaatagtttgagcattagaaatcaacttgaaacaataaaatgtatgcttccttgaactgtcatatcgttgacctgcaaaattcacctttggaacgtgacacaatgttaggcatacctccttttttctaatacatggaatacattttgttggaggtaatttatgtgattcatataccactgctacagtgttagctgacaacatatagtatgaggtaaggatctaattctgtttcctctcacatgattacttgatagctaagcatctgattggtttactgctttaccactgagctgaaatgccgtgttttccatttattaaaatcacacatggctcctgtttttgtcactcagcactttttctccatattcttcaagacgattgtgagtatggtacgtaacaggaattacatctggtaagttgtatagttttgtgtaggaactctatattcatagcatatttgtggaaatgatacctatggaggtttctcacactggtgtgtcattatacattaattgtacaatatgcattttcagtaaaatatttgaaaactgtaaaaaaaaaaaaa

SEQ ID NO: 17576 - DNA, 5112 bp, Homo sapiens
gtgttcgcgcatgcgcgccgcggccgcagtgccctcgcttcctgtgcgtccccaggtcaccgctcgccctagttcccaggctttggcctccggtgggcgagaatcgcggagcctgcggggctgggcgccgaagagccgggccggcacccaagcgggcgcggggctgtgcgggccaggcggaggctcaagcggggatccccgagcacgacccccggagccgacggcgctggggcccaaggggccggccgggcggtgacgacggcggaggcgaaggggcggcgggacccgggcccggcccgtgtgcgtcctcgacggcccggccccggctccgcaggacggtgagccccagggagacggatctgggctccgggagggacgccccgtctggatttgtcccgtaggcccggcccgggcccctctggagcagaacggccttggtgaggtggacaggaagggacctcgcgagcagacgcgcgcccgcgacagcaatcccgccccggcctgtcgggagcggtggggcagaggctgcggagccccaggaggatctgcctccgctttcacagtcctccagatttttccaagagcagcagaaaatgaataaatccctggggccagtgtcattcaaggacgtggctgtggacttcacccaggaggaatggcagcagctggatcctgagcagaagataacttacagggatgtgatgctggagaactacagcaatctagtttctgtggggtatcacattatcaaaccggatgttatcagcaagttggagcaaggagaagagccatggatagtagaaggagaattcctacttcagagctatccagatgaagtctggcaaactgatgacctaatagagagaatccaggaagaggaaaataaaccttcaaggcaaactgtgttcattgagaccctgattgaagagagaggtaatgttcctggtaaaacttttgatgtagaaacgaaccctgttccttcaagaaaaatagcctataaaaatagcctctgtgactcatgtgaaaagtgtttaacgtctgtttcagaatatattagtagtgatggaagctatgcaagaatgaaagctgatgaatgtagtggatgtgggaaatcactcctccatattaagcttgagaaaactcatccaggagatcaagcttatgaatttaatcaaaatggggaaccttatactctaaatgaagaaagtctttatcagaaaattcgtattttggagaaaccttttgaatatattgaatgccagaaagccttccaaaaggacactgtttttgttaatcacatggaagaaaagccctataagtggaatggatctgaaatagcctttctccagatgtcggacctcactgtacatcagacatctcatatggaaatgaagccctatgaatgcagtgaatgtgggaaatccttctgtaaaaagtcaaaatttattatacatcagaggactcacacaggagagaaaccttacgaatgtaatcagtgtgggaaatccttctgccagaagggaacccttactgtgcatcagagaacacacacaggggagaagccctatgaatgtaatgaatgtgggaagaacttttaccagaagttacacctcattcagcatcagagaactcactcaggagagaagccctatgaatgtagttattgtggaaaatccttttgccagaagacacacctcacacaacatcagagaacacattcaggagagagaccttatgtttgtcatgactgtgggaaaaccttctcgcagaagtcagcacttaatgaccatcagaaaattcacacaggtgtgaaactctacaagtgtagtgaatgtgggaaatgcttctgccgcaagtctactctcacgacccacctgaggacccacacaggagagaaaccgtatgaatgtaatgagtgtggaaaattcttctctcggttgtcatatctcactgtacattatagaactcattcaggagagaaaccctatgaatgtaatgaatgtggaaaaaccttctacctgaattcagccctcatgagacatcagagagtgcacacaggagagaaaccttacgaatgtaatgaatgtggaaagttattctcccagttgtcatacctcactatccatcatagaactcattcaggagtaaaaccctatgaatgtagtgaatgtgggaaaaccttctaccagaactcagccctttgtagacatcggagaatacacaaaggagagaagccctatgaatgctatatatgtggaaaattcttctctcagatgtcatacctcactatacatcatagaattcattcaggagagaagccctatgaatgtagtgaatgtgggaaaaccttctgccagaattcagcccttaatcgacatcagagaacacacacaggagagaaagcctacgaatgttatgaatgtgggaagtgcttctctcagatgtcctatctcactatacatcatcgaattcattcaggagagaaaccctttgaatgtaatgagtgtggaaaagccttctctcggatgtcatacctcactgtacattatagaactcattcaggagagaaaccctatgagtgtactgaatgtggaaaaaaattctaccacaaatcagcattcaacagccatcagagaattcataggagaggcaatatgaatgtaatagatgtgggaaggcttctctgaagtcagacctcattttatatcagagaaccctttcagtatagtgaatcagaaactcctgcctgaagtcaaacaccttgtacatcagagagttcacacaggttagtgtggacatccccttgtgtgttggactcataatctgaagactcacagaatggaaaccatgattataacaagaccacatggtataacaatactagactatagacaagtaaaaatttataaatattaagaatgtatatacatgtcaccatggattggaactgttttgcatatcagggaaatcatagccaaggggaaatctatcagtataaggaatgtggaagacataatcctttggaaactgttaatactaaaagatatgtttctgatacaatagcaaacttgaaaaaaaaaaaagaaatagaagattcctgctgtgaataaacatacttcttgtgtaaatagaaactgtaaagtcatcaggatagctagttaagtcggtaaccttaaactcatgtaagcagttcccaaagaacataggacttatgtttggggagagggttgtttttattacagtacattacaggaattgtatgttcacttcgaatcatgtttgaaaaaacgttgtatccttattttgtaattcatatagtaagagtattctaaacagcactacattaatatcatttgataggtataaagtatactttttcttgcactcttctctaggatttaatgcattgatcattcttaatgaacaatatcagctctaaaggaccaatgcttttataatgttttcaactgtatctgagtcagccagagagataaatatccatgtataaaatagatagaaaactttgcttggtaatttaaaattaataatgccagttttccaagagtgagaaaatcattgcactctatacagttttaagatatacttaaaatattcccatttgtatctatttttttttctactgttttttatttggacacttacataacagtgcagagcacaatgctgtgtaacataggaattcactgtgttttcatttgatgtcgtactggttttaaaccttgtgctctactccttcctgttaatgaattaagaacacattctaacaagggtctgtggcagacattgccgagtgactttctaacataggaattcactgtgttttcatttgatgtcgtactggttttaaaccttgtgctctactccttcctgttaatgaattaagaacacattctaacaagggtctgtggcagacattgccgagtgactttcttagtcactcccttactctgctggcggagtttggttatccatttatcctcaaaaggaagtgagataaatcctgattagttttaaccagtgacactccccttctcgttgccagcagttgatttacagtggtcacagggcccaattctagacataaaacaaaggatatacctgacagactacttctggaaaaggttttctcaaaggcccaaggattcaagcaaagggaagtggaatcttgtggtgaacagtaccttgtctggatgtggtgcctggtaaccatctttcagcaatggattatagtttaatcatggcctgagcagaaatactgaaagaccctgagacctggatgatgtctttgagccaccaaaccaagcagccttgtagccactcctcctttggactgtttcttttgtgagagactaaacttatttttaagccagttgatttaggatgctctattactaataactgaagacattctaattggtacagactgaaacctttataggagttatgcagttcagaagtggactttaggtaagtcatttattttaagctgttgatatagagatttattttctgtaaattttgacgtaaatagtttgagcattagaaatcaacttgaaacaataaaatgtatgcttccttgaactgtcatatcgttgacctgcaaaattcacctttggaacgtgacacaatgttaggcatacctccttttttctaatacatggaatacattttgttggaggtaatttatgtgattcatataccactgctacagtgttagctgacaacatatagtatgaggtaaggatctaattctgtttcctctcacatgattacttgatagctaagcatctgattggtttactgctttaccactgagctgaaatgccgtgttttccatttattaaaatcacacatggctcctgtttttgtcactcagcactttttctccatattcttcaagacgattgtgagtatggtacgtaacaggaattacatctggtaagttgtatagttttgtgtaggaactctatattcatagcatatttgtggaaatgatacctatggaggtttctcacactggtgtgtcattatacattaattgtacaatatgcattttcagtaaaatatttgaaaactgtaaaaaaaaaaaaa

SEQ ID NO: 17577 - DNA, 4067 bp, Homo sapiens
  misc_feature (33)..(33): n is a, c, g, or t
ttagaggatcgtcacactgggttcgagtccaanaatgaaagctgatgaatgtagtggatgtgggaaatcactcctccatattaagcttgagaaaactcatccaggagatcaagcttatgaatttaatcaaaatggggaaccttatactctaaatgaagaaagtctttatcagaaaattcgtattttggagaaaccttttgaatatattgaatgccagaaagccttccaaaaggacactgtttttgttaatcacatggaagaaaagccctataagtggaatggatctgaaatagcctttctccagatgtcggacctcactgtacatcagacatctcatatggaaatgaagccctatgaatgcagtgaatgtgggaaatccttctgtaaaaagtcaaaatttattatacatcagaggactcacacaggagagaaaccttacgaatgtaatcagtgtgggaaatccttctgccagaagggaacccttactgtgcatcagagaacacacacaggggagaagccctatgaatgtaatgaatgtgggaagaacttttaccagaagttacacctcattcagcatcagagaactcactcaggagagaagccctatgaatgtagttattgtggaaaatccttttgccagaagacacacctcacacaacatcagagaacacattcaggagagagaccttatgtttgtcatgactgtgggaaaaccttctcgcagaagtcagcacttaatgaccatcagaaaattcacacaggtgtgaaactctacaagtgtagtgaatgtgggaaatgcttctgccgcaagtctactctcacgacccacctgaggacccacacaggagagaaaccgtatgaatgtaatgagtgtggaaaattcttctctcggttgtcatatctcactgtacattatagaactcattcaggagagaaaccctatgaatgtaatgaatgtggaaaaaccttctacctgaattcagccctcatgagacatcagagagtgcacacaggagagaaaccttacgaatgtaatgaatgtggaaagttattctcccagttgtcatacctcactatccatcatagaactcattcaggagtaaaaccctatgaatgtagtgaatgtgggaaaaccttctaccagaactcagccctttgtagacatcggagaatacacaaaggagagaagccctatgaatgctatatatgtggaaaattcttctctcagatgtcatacctcactatacatcatagaattcattcaggagagaagccctatgaatgtagtgaatgtgggaaaaccttctgccagaattcagcccttaatcgacatcagagaacacacacaggagagaaagcctacgaatgttatgaatgtgggaagtgcttctctcagatgtcctatctcactatacatcatcgaattcattcaggagagaaaccctttgaatgtaatgagtgtggaaaagccttctctcggatgtcatacctcactgtacattatagaactcattcaggagagaaaccctatgagtgtactgaatgtggaaaaaaattctaccacaaatcagcattcaacagccatcagagaattcataggagaggcaatatgaatgtaatagatgtgggaaggcttctctgaagtcagacctcattttatatcagagaaccctttcagtatagtgaatcagaaactcctgcctgaagtcaaacaccttgtacatcagagagttcacacaggttagtgtggacatccccttgtgtgttggactcataatctgaagactcacagaatggaaaccatgattataacaagaccacatggtataacaatactagactatagacaagtaaaaatttataaatattaagaatgtatatacatgtcaccatggattggaactgttttgcatatcagggaaatcatagccaaggggaaatctatcagtataaggaatgtggaagacataatcctttggaaactgttaatactaaaagatatgtttctgatacaatagcaaacttgaaaaaaaaaaaagaaatagaagattcctgctgtgaataaacatacttcttgtgtaaatagaaactgtaaagtcatcaggatagctagttaagtcggtaaccttaaactcatgtaagcagttcccaaagaacataggacttatgtttggggagagggttgtttttattacagtacattacaggaattgtatgttcacttcgaatcatgtttgaaaaaacgttgtatccttattttgtaattcatatagtaagagtattctaaacagcactacattaatatcatttgataggtataaagtatactttttcttgcactcttctctaggatttaatgcattgatcattcttaatgaacaatatcagctctaaaggaccaatgcttttataatgttttcaactgtatctgagtcagccagagagataaatatccatgtataaaatagatagaaaactttgcttggtaatttaaaattaataatgccagttttccaagagtgagaaaatcattgcactctatacagttttaagatatacttaaaatattcccatttgtatctatttttttttctactgttttttatttggacacttacataacagtgcagagcacaatgctgtgtaacataggaattcactgtgttttcatttgatgtcgtactggttttaaaccttgtgctctactccttcctgttaatgaattaagaacacattctaacaagggtctgtggcagacattgccgagtgactttctaacataggaattcactgtgttttcatttgatgtcgtactggttttaaaccttgtgctctactccttcctgttaatgaattaagaacacattctaacaagggtctgtggcagacattgccgagtgactttcttagtcactcccttactctgctggcggagtttggttatccatttatcctcaaaaggaagtgagataaatcctgattagttttaaccagtgacactccccttctcgttgccagcagttgatttacagtggtcacagggcccaattctagacataaaacaaaggatatacctgacagactacttctggaaaaggttttctcaaaggcccaaggattcaagcaaagggaagtggaatcttgtggtgaacagtaccttgtctggatgtggtgcctggtaaccatctttcagcaatggattatagtttaatcatggcctgagcagaaatactgaaagaccctgagacctggatgatgtctttgagccaccaaaccaagcagccttgtagccactcctcctttggactgtttcttttgtgagagactaaacttatttttaagccagttgatttaggatgctctattactaataactgaagacattctaattggtacagactgaaacctttataggagttatgcagttcagaagtggactttaggtaagtcatttattttaagctgttgatatagagatttattttctgtaaattttgacgtaaatagtttgagcattagaaatcaacttgaaacaataaaatgtatgcttccttgaactgtcatatcgttgacctgcaaaattcacctttggaacgtgacacaatgttaggcatacctccttttttctaatacatggaatacattttgttggaggtaatttatgtgattcatataccactgctacagtgttagctgacaacatatagtatgaggtaaggatctaattctgtttcctctcacatgattacttgatagctaagcatctgattggtttactgctttaccactgagctgaaatgccgtgttttccatttattaaaatcacacatggctcctgtttttgtcactcagcactttttctccatattcttcaagacgattgtgagtatggtacgtaacaggaattacatctggtaagttgtatagttttgtgtaggaactctatattcatagcatatttgtggaaatgatacctatggaggtttctcacactggtgtgtcattatacattaattgtacaatatgcattttcagtaaaatatttgaaaactgtaaaaaaaaaaaaa

SEQ ID NO: 17578 - DNA, 1705 bp, Homo sapiens
gtgttcgcgcatgcgcgccgcggccgcagtgccctcgcttcctgtgcgtccccaggtcaccgctcgccctagttcccaggctttggcctccggtgggcgagaatcgcggagcctgcggggctgggcgccgaagagccgggccggcacccaagcgggcgcggggctgtgcgggccaggcggaggctcaagcggggatccccgagcacgacccccggagccgacggcgctggggcccaaggggccggccgggcggtgacgacggcggaggcgaaggggcggcgggacccgggcccggcccgtgtgcgtcctcgacggcccggccccggctccgcaggacggtgagccccagggagacggatctgggctccgggagggacgccccgtctggatttgtcccgtaggcccggcccgggcccctctggagcagaacggccttggtgaggtggacaggaagggacctcgcgagcagacgcgcgcccgcgacagcaatcccgccccggcctgtcgggagcggtggggcagaggctgcggagccccaggaggatctgcctccgctttcacagtcctccagatttttccaagagcagcagaaaatgaataaatccctggggccagtgtcattcaaggacgtggctgtggacttcacccaggaggaatggcagcagctggatcctgagcagaagataacttacagggatgtgatgctggagaactacagcaatctagtttctgtggggtatcacattatcaaaccggatgttatcagcaagttggagcaaggagaagagccatggatagtagaaggagaattcctacttcagagctatccaggtgtgttagtggaggcagtgaggagatcggtaacttgggagtgtttttcccagggattttttaatggtcccgaacctttagaagtgactagaaatagttgcttatatgctctatgaacctgaatctcactcccaaagacttcttccttccccgtaagaacttatgtttatggagcttttctgtgcttgccactcccaagaatcgaattccagtcacttctgttgttctcttaaactttgggtctttgcttgctcttctagcattttcagaaaccattatcatggattttttaggtgttataagtctgacatttaaaaataacttatgtgattcttgtgttcttcgtgtaacttctggttttttttttttaatctttaccgtgcagtgcctgagactgtttctggaccctgttctactttgtacttttctttctttgaggttagactccaaagttcccatcctgtgcctaagccagtggatcctgctacttgtcatgtgcacctgtgcttcattggacagtgctgctcattcctgagacccagccctcctgaaatttggtgactgcagtacctgggtctccctctttaaccaaatgctcgttttcatcttgtttcttattttctgttctgttcccaatgccttgaatgataccctgtcatggcaggtgcttagtaagtatcatatacgcaaatgaagtctggtttatgcttccaccacctccagaaatgtctttaaagggtctgtttctacctactgtgatttcctcgcattatgagtttctcaaagggtgcctccagtgccaagtctttaggctttgttttttattttatgttgctcgcacccaggatgacatctctaccaccattgagcctgg

SEQ ID NO: 17579 - DNA, 415 bp, Homo sapiens
ccccgtgccatccgaaggccagtcccagcgtgacggtgttggcatggcttgtcaggacttacacagcaagagtggtttcctcatgacctcgctatttttacacagagaatttcgtaactccccataatgctgctaaagctgaacaccatgcctgtcataaacatgtggatacattcacaaggaatttcaaatgctaatctaactgacacgtggatgagctactctttgatctgcctttttttccccgcttcaacaaaatgctttgttttggtttagacagctgatattgtagcaagctaggaactctggggccagtaatttgctgcttgattctgataatggctttctctccaaagtcagctgatcctgtaagcagtaacttcaagggaccacagtcagattttcaataaactcc

SEQ ID NO: 17580 - DNA, 313 bp, Homo sapiens
gtgaggaaaatggaatttactgcgtgaaaagggaaaagaaaaaataactctcagcaaagcaagagagagtcctgttaggtttcctgcctcacaggttgaatcccagttcacagcacaggaacaggaggggccaggctcctctccactcccctcccccgcaaaacggtgcaaacttcctgaactctaccccctcctcctagtgtacaggtgggcattattcagaaagaatcaattgggaaagggcgggtttcatttgcgaccagcagtctggtttttcagccttcagactgttttaggcttgaaggcagggttt

SEQ ID NO: 17581 - DNA, 356 bp, Homo sapiens
gttatatatacgtataaatgtgtggtggatgcgactatataatgaagattgtactccctgagttataaagcagatagaattgttgacagtgtttaaattgttaaaggcttccctctcaaatacgtgttttattgaatctacatgtgttacttctccaccgtaagtccttttaggcctccagactcctgtagattcctccattctctgtagagtcccgactcccatcctgtttaatatgctctttacataaattgtaaacaccaattgtattcatttgtttattcagcagatacttatgagcactgttcagggaagtgggcttgctgctaggagcgagactgacaaagtctctttcc

SEQ ID NO: 17582 - DNA, 830 bp, Homo sapiens
gtggaccctttgaacgcatcgcccgaaaaccgcaacaaccagggcactgtaaattggtctgttgatgacattgtcaaaggcataaatagcagcaatgtggaaaatcagctccaagctactcaagctgccaggaaactactttccagagaaaaacagccccccatagacaacataatccgggctggtttgattccgaaatttgtgtccttcttgggcagaactgattgtagtcccattcagtttgaatctgcttgggcactcactaacattgcttctgggacatcagaacaaaccaaggctgtggtagatggaggtgccatcccagcattcatttctctgttggcatctccccatgctcacatcagtgaacaagctgtctgggctctaggaaacattgcaggtgatggctcagtgttccgagacttggttattaagtacggtgcagttgacccactgttggctctccttgcagttcctgatatgtcatctttagcatgtggctacttacgtaatcttacctggacactttctaatctttgccgcaacaagaatcctgcacccccgatagatgctgttgagcaaattcttcctaccttagttcggctcctgcatcatgatgatccagaagtgttagcagatacctgctgggctatttcctaccttactgatggtccaaatgaacgaattggcatggtgggtgaaaacaggaattgtgccccaacttgtgaagcttctaggagcttctgaattgccaatgtgactcctgccctaagagccttagggaatattgtcactggtacagatgaacagactcaggttgtgattgatgc

SEQ ID NO: 17583 - DNA, 494 bp, Homo sapiens
gccgtcatagcccccctttgtgcccccgtcgtaccgccacacatccctcgagcgggacactagaagttcgttctgaatggaacagccggaaggacagcacccctgggtccacagcaccttcaacggcgagccccagagcctgtcttcatcagtcaggagacatccgaggcatctgaacaggggagaggcaccatcagatgtggatttagaaaagctctggtaatcgtttgctccaataatgatggatggagtgtggaggttctaaaagcagaacactcgcagtaggataacaggagccgtatcactgcccgcatgctttagccagcggccaactaaagaggactaaagtattttgcccagaattatcaccagctcaacctacttggaattgcaggactcccagcactggttcagctccgtgcctctcagagtatgcctgcctttcattatgtgtgaaattcaatggaataaaagtggctgcaagcatagcaaag

SEQ ID NO: 17584 - DNA, 391 bp, Homo sapiens
gccgtcatagcccccctttgtgcccccgtcgtaccgccacacatccctcgagcgggacactagaagttcgttctgaatggaacagccggaaggacagcacccctgggtccacagcaccttcaacggcgagccccagagcctgtcttcatcagtcagttctaaaagcagaacactcgcagtaggataacaggagccgtatcactgcccgcatgctttagccagcggccaactaaagaggactaaagtattttgcccagaattatcaccagctcaacctacttggaattgcaggactcccagcactggttcagctccgtgcctctcagagtatgcctgcctttcattatgtgtgaaattcaatggaataaaagtggctgcaagcatagcaaag

SEQ ID NO: 17585 - DNA, 237 bp, Homo sapiens
ctctggtaatcgtttgctccaataatgatggatggagtgtggagggtaagcatctggaaggtgggagcccagctgggaggtctgattcagtagaaacactacaaggggcagaaggagagcactgtcagcctgagtggaaaggagacgaggaggtgtggtctgtgccttatgcagccaagggatgacaaatgtccgcagctggaacaaaccaccagcacaggcctcgggccgctggcc

SEQ ID NO: 17586 - DNA, 446 bp, Homo sapiens
aacaggcaggagatgaatgttgcaatgaatggaacagccggaaggacagcacccctgggtccacagcaccttcaacggcgagccccagagcctgtcttcatcagtcaggagacatccgaggcatctgaacaggggagaggcaccatcagatgtggatttagaaaagctctggtaatcgtttgctccaataatgatggatggagtgtggaggttctaaaagcagaacactcgcagtaggataacaggagccgtatcactgcccgcatgctttagccagcggccaactaaagaggactaaagtattttgcccagaattatcaccagctcaacctacttggaattgcaggactcccagcactggttcagctccgtgcctctcagagtatgcctgcctttcattatgtgtgaaattcaatggaataaaagtggctgcaagcatagcaaag

SEQ ID NO: 17587 - DNA, 353 bp, Homo sapiens
ttttttttttagtattactatgttcttacgtgaaatgatggtgagaaatagagggtaatgtttttatttctgttttggctaaagatatttacaaggcaaccctatagttaacttcgtatttttgttttaagtttacaggtctgggacataggagggtctggcaaatgctgacctggagtaaatgcatttgctagcactaacccaattgtcatgcctggttctccacggctgatcaagcttgccaacgagcacaggagtgcccgtctcagcaatccgcctccctgttcaagggacaccactgtctgccacctccctgccttcctttacactctcagagtgtagcatcttagagt

SEQ ID NO: 17588 - DNA, 2065 bp, Homo sapiens
tttcaagacggagtgttgctgttgtcgcccgggctggagtgctgtggtgcgatcttggctaattgcaacctccgcctcccagattcaagcgattgtcctgcctcagcctcccgagtagctgagattacaggcacgcaccaccgtgcctggctaatttttgtgtttttagtagaaacaggatttcaccatgttggccaggctggtctcaaactcctgaccttgtgatccacctgcctcggcctcccaaagtgctgggtttacaggcgtgaaccactgcacccggcctgaatcatggttttttgaaaccattggcatctgaacctgtagctctctctggtagtgttgtgtggttttaaatgtcatgtgagctgagttactgacctcaacctactgccagatgaaggtgtgatcctgtgataccaatcttgagggtcccttctagttttagcagtcagtgacttctcttgtttatttttgtttgaaaaagtaaaaggctctctttttggctatagagttgcatcttgaaatttttgacaaattacatagagctgaagaaggatacaagttttgatatcttaaaatcacagggttgaagcttgaaaggacagtattggcattgcagctaagtgggagtgtgaggaagcgccttctctagggcaggtaattgcatctgttaatgtggtccttgggcccctgagttgctgccttccaatcagaattcccttagcattagccagtgacgcctgaattaatctcaggtaggacttctaacttttttccaaaattatttttgtgcagaggtttatctagatttttcttctaaatgtcctcctccccacttgttttattattactgtttttttctctctttaattttttttttttttttatagagacatggtctcactatgttgcctgggctgatctcagactcctgggctcaagtgatcctcctgcctcagcttcccaaagtgctgggattataggcgtgagccattgcgcctggctctgttactgtttttctaacctgagttacttaggatcatattttcattcttttttaaaaagatgggagttttctgaacttttccttaactaaaaagtggaatgcatcttaatattttcctttttttacttgtgtttctccccagggagggaaaaacatatttattgtgacagaatttagcatattttaggccacattaaaatactgataaatgtattaatcagtgaaaataggttatagtgaaaaatatataccatttgattaataaaaatgttattggaaaaatgcaagaactgctgtaagaattgctaacattgtgttggaaaataaatatactaagctaagaaacaatgggaaactgtcatatgtagggccaacagcctttttttttttaaacccttccaatttattaatatctagtctaataaaccctgatttataggacctctgcaccttttttgactttttattcatccattcttaatattctacactatgacaaaatccttaaaactccattattgatgaaatgggaacagacttttgtttttgtatgttggtgttctctgagtggtgaaggcccagggagaatgttttgtttggtggtcacttagcatttgaaaacatccacttccttgtgacttagctgggtatcttttaacatctggaagccacgtccctgattgaaatctctggagacaacttacctttcaccaacttgtctgccaaattgcaccatggaccaagattgcagtggctgcatcaagtctaggcctgccctgaagtctggatttgtaagtcccccatttcaaatggggcagaaggcagaggagcagaggagccactgtgcctttcgctgtcctggagccagttggccttctggttttggtgaaccctgcttttataagaggactccctggcatcttccagtttcccgctacttgttttatgtattattttatgtctgtgtttgtcctggagtgctgtaactcctttcactgtctgctgtaagttcaacttcttcaataaaagaaatgtttcaaattgaaagaaaaatgg

SEQ ID NO: 17589 - DNA, 1830 bp, Homo sapiens
acagtattggcattgcagctaagtgggagcgtgaaccactgcacccggcctgaatcatggttttttgaaaccattggcatctgaacctgtagctctctctggtagtgttgtgtggttttaaatgtcatgtgagctgagttactgacctcaacctactgccagatgaaggtgtgatcctgtgataccaatcttgagggtcccttctagttttagcagtcagtgacttctcttgtttatttttgtttgaaaaagtaaaaggctctctttttggctatagagttgcatcttgaaatttttgacaaattacatagagctgaagaaggatacaagttttgatatcttaaaatcacagggttgaagcttgaaaggacagtattggcattgcagctaagtgggagtgtgaggaagcgccttctctagggcaggtaattgcatctgttaatgtggtccttgggcccctgagttgctgccttccaatcagaattcccttagcattagccagtgacgcctgaattaatctcaggtaggacttctaacttttttccaaaattatttttgtgcagaggtttatctagatttttcttctaaatgtcctcctccccacttgttttattattactgtttttttctctctttaattttttttttttttttatagagacatggtctcactatgttgcctgggctgatctcagactcctgggctcaagtgatcctcctgcctcagcttcccaaagtgctgggattataggcgtgagccattgcgcctggctctgttactgtttttctaacctgagttacttaggatcatattttcattcttttttaaaaagatgggagttttctgaacttttccttaactaaaaagtggaatgcatcttaatattttcctttttttacttgtgtttctccccagggagggaaaaacatatttattgtgacagaatttagcatattttaggccacattaaaatactgataaatgtattaatcagtgaaaataggttatagtgaaaaatatataccatttgattaataaaaatgttattggaaaaatgcaagaactgctgtaagaattgctaacattgtgttggaaaataaatatactaagctaagaaacaatgggaaactgtcatatgtagggccaacagcctttttttttttaaacccttccaatttattaatatctagtctaataaaccctgatttataggacctctgcaccttttttgactttttattcatccattcttaatattctacactatgacaaaatccttaaaactccattattgatgaaatgggaacagacttttgtttttgtatgttggtgttctctgagtggtgaaggcccagggagaatgttttgtttggtggtcacttagcatttgaaaacatccacttccttgtgacttagctgggtatcttttaacatctggaagccacgtccctgattgaaatctctggagacaacttacctttcaccaacttgtctgccaaattgcaccatggaccaagattgcagtggctgcatcaagtctaggcctgccctgaagtctggatttgtaagtcccccatttcaaatggggcagaaggcagaggagcagaggagccactgtgcctttcgctgtcctggagccagttggccttctggttttggtgaaccctgcttttataagaggactccctggcatcttccagtttcccgctacttgttttatgtattattttatgtctgtgtttgtcctggagtgctgtaactcctttcactgtctgctgtaagttcaacttcttcaataaaagaaatgtttcaaattgaaagaaaaatgg

SEQ ID NO: 17590 - DNA, 255 bp, Homo sapiens
tttgggaggccgaagcgggaggatcgcttgaacctacaagttcgagaccaggctgggcaacatagtggaaccccctctgtacaaaaaaaaaataacaaaaattagctggtgtagtggcatgtgcctatagtcccaactactcgggaggctgaagcagcggaagggttgcttgagcctgggagatcaaggctacagtgagccatggtcataccactgcactccatccagagtgacacagtgagatcctctctcaga

SEQ ID NO: 17591 - DNA, 473 bp, Homo sapiens
atgttttttgaggattttgcatatttcttgttgccataatgctgtgctattttaccctgattttcagtgatacaatatgggtgacaatactggcccctccataaatctgaagagtaagaagtagtgaaaataaggcttaggatatgaaatggcgttgtcacttgaatcaaggccactttttgtcctacttgagcatctcaagttgggatgcatcttctgatggcacttccggaactggctgtggtttttttgggtgtaccgagagtgccagtgactgtgcttcttacaattcctggcatcttgagtaggtgaaacactgtatcagactgggtgatgggcacattgtcatttcaccaagttcctggaactgttagaattgcttgtgtatggggatcctatgttagttcccctggatacattgttttatcagtcggaattcttaaataaagacatacttcccttcatgtagtggt

SEQ ID NO: 17592 - DNA, 1619 bp, Homo sapiens
agctgacttacgtactttccccatcttcccaggcatcttgtacgtcgttacatttatcatattggaaggtaataaatgatcttgttttcctcttttcctgggctccttattaagagcagggaacctaatttatatcctcagggcagaacaggtattcagaaaagaataatgcaagaggaaaaaagtttaatataaactagggagatcgtaacattggctaatcacgagcaaatatttatagaagacccactgtgtgctaaatggctcctaatatatacttaagatattctcccagcttggaaattctgctcacttcttgctcttgcttgcttctctggtgggcttccatccaaatttggccatgacatcagatcatatggttaatattaacaaatattgtataaattgttttcatacttaatatccaacaggttgtcaatttacgtactactggtgccttatctgtttttactgtcccatacactgcccatctggaataagcttagtgtttaaaaaaaaaaaaagatctttgcatacacacagtaaatcctagattcagttttgtgataaacactggaatcctgaatgggacttttggtaggagataactgctgtttttaaaggtcataaaggtggtttaatccattggaaattaaaaaaaaaaacttaaaagaggatcaacattgacctatttaactggcccatcagtaagtagcaaaacaatactgtagttgttgaaatgaagatagttataagcctcaaaccgagcacagtcagaggtgggaggccaaaaaaacaaaaattgctcatgaaacagtagtacctatcagagcccatcaaaaagctaattaaattaatagaagtaaaagaatttgtcagtgatcattccagcacaacccagggaggattattttattataagaattagcaaacctaaagtaaaaatgggagttaccaagctggcataccttgatagaactagcccctaaaaactgtcctctgccacattcttgtcctttaagaaactttaaaatgtgaaatttggtacatacaggtaaattcacattcaggtaaattcttaattcacccattcaaaaaatatttagagtacctactgagtattagacactgaacgaggtactagactgatcaagacaggaaaaatccctttaaggagctgacattctactggaggaatcaataagcaagacttctactgagccagtcatgcaaagatccaggagaaaggcagcatgtgttcgttcggtaataaccatctcggcttgttagaatggcaaggccactgtacctggactagtggacaagagtaggatatgaaagagcatgggatcatgtagggcctttggagcaatggtaaggattctgagcataatcggaggctacagaggacttattatagtcatctgatacacatttttatgagtagaatcaagatctgaaaggtactactgtttcatgagcaatttttgtttttttggcctcccacctctgactgtgctcggtttgaggcttataactatcttcatttcaacaactacagtattgttttgctacttactgatgggccagttaaataggtcaatgttgatcctctttta

SEQ ID NO: 17593 - DNA, 326 bp, Homo sapiens
catcaaaaagctaattaaattaatagaagctatgatgaattaacagcccaaggtgctgtcagaaaggaagcctgcggttattttttttaaaagaatttgtcagtgatcattccagcacaacccagggaggattattttattataagaattagcaaacctaaagtaaaaatgggagttaccaagctggcataccttgatagaactagcccctaaaaactgtcctctgccacattcttgtcctttaagaaactttaaaatgtgaaatttggtacatacaggtaaattcacattcaggtaaattcttaattcacccattcaaaaaatat

SEQ ID NO: 17594 - DNA, 491 bp, Homo sapiens
gagaatccaggtttggcttagctaagtccctctggttcaaggcttctgtgaggttgcaatcaagatgtcacttaaggctgtgatctcatctgaaggctctaccagtggggatccattcacatggtaattggcttgcttgggtttctcatcacctaggtctttccataaaggctgctttatgacctgacagctattttcccaccaaacagaccaagagagctaaagagaaaacaagcaagtccaagatggaagccatggtctttttataatctcatcttggaagtgacattccattccttctgccatatgctattcattagaagcagattagtaagtctagcccatcctaaaggggaggaaattacatgagaatgtaataccagcaggtagggatcactggacattgaccacaatgatgtttttctttcttcttgctttcctattttctaacatgtcaattttggacatgtgttacttgtgtaaaaaggaaa

SEQ ID NO: 17595 - DNA, 377 bp, Homo sapiens
gccaactctcagctcaaaagtgcatgtttgtctctaccagtggactaaggaccagctcctaggatgggagcagtttcttactcatgtttataaagtgctatgcagaaaatagcagggctatgggaaagaaagagaccaggttagaaaagtcatttgaatcggatctgcatgaaaaaaggcactttagataagacctgatagcaaagggctgtaagaggagaaaagggcaaatcaaaggtaccgacagaacatattaagcatggcctaggctgagcaaagccaaatttaaacataattttgtatgttgaagcacattattttccaatatgttaatgtgtagccattctcacatacataataaagctaatggattattt

SEQ ID NO: 17596 - DNA, 1923 bp, Homo sapiens
tgtatttttagtagagatagagtttcaccatgttagccaggatggtctcgatctcctcaccttgtgatcctcccgcctcagcctcccaaagtgcttggattacaggcgtgagccactgcacccggcccaaaaagtattttaaaatgaaacatctgtagtttttaccccaacctgcgtccattgatcttgctggttgaatttcatgttaaaattgaataataagttagcaattaagtatatttttggggatcaaattattttgtctccaaacatcttaacaatcttgtgattcagtgaacaaaattaaaaacttacagaatctgataaatgcatccaaactagcacacgtctgtgtgtatctcctacttaatggaaaaaataaaacaagatattggataacatctactgtaaggattcacccccagatatactgaaggataatcaatcatttgattacataggtaaggggaggtatgtggttttgttgatacagtcattggggaaaaacttaccatttgctaccggctgtgtacccaacagtaaaagtagaagtctgggttttctctccctggtgaataaattatgtatgtttaaatctgttttgatcttaccctttttatgcagtaacgcacttggtagatgataatcacatgtatgaaatacctctactgtcaggagagaatactaagatttcaagcagtgttactgcacattaatgtaatgtcataacttcatgctagccttacatccatttctttctcactgacctacaacttacctagatgttgaggcaaacaacagggacaaagtactagagattaaaaaaagagagaagttaaaacacacatacacagaggctgctctgcaactttagttactttgcttatttttctcccacgttttgtaattttggtgaattgtaatatgtagtatgtaaggacatcattttgcagatgaggatacaaggccaaagatgtcttgctcaaagttatgaagctatttgatagcagaactgagagaactttgagtgatgaaaatgtgtgattatttttgtactctccccacaccacacacacacactctgtctctctctctctctcattctctctccctctctctctctctgtctctccactatgctccttgcttagttatagcaacagatctcatgatgcttgtattagagaattttcatgataaatttatggttatacgaataatccagtcatttgtagatatgcctctaatatgatattggttttctctctcatgcccatgtaatttgtaaagcaatgtttgacttttgtcacagatattttgctatgtctttaatttactggtttgtggcagtgaacaacaaaaagatttctacgatacttgttaaggcaggcaggatgattcttccccccattcccagcttttctgagattaatggataaaaattgtacatatttaagatatgaaatatgttttgatatgacatgagtaccacaataaggctaattattatatccatcacctcatgtggtaatcagtttggggtttttttggtggtgaaaacacttaagatttactctcagcaaatttcaagtatataatacagtattattaactgtagtccccatgctgtatattaggttcctggaacttatttatcttataactgaaagtttgtactctttgatcaacaactccccattttcctctccctgcagtcttgccaaccactcttctactctctgcctctctgagtttgcagcattattcacagtagccaagatatggaaacaacctaagtgttggtcagtggatgaatggatgaagaaaatgtgcaatacagacacatacacacaggaacacacacacaaacacacacacacacacacacacacacacacacacagaggaatattattcagtctt

SEQ ID NO: 17597 - DNA, 408 bp, Homo sapiens
taaagccctgccatggcagtgctgccagctcactctccttgggctcccttcccacctcccacatccccatgtccccatggactcctggtgccacggcacagctgcatgggggtgattcatgctggacacctgagacacaaggagaggaggcagggagctgccgaaagaggttcagttaaaaacttccaacaatgagggaagatgggatttcctcattttggccaggccggtcttgagctcctgacttcaagtattctgctcacctcggcctcagaaagtactggaattacaggcttgagccatcacgcccggcttcgctcctgcttttgccatgtgacgtgcctgctcccactttgcattctgccatgatgtctcaaaaataaaaataaaagtttaaaaaaattggaa

SEQ ID NO: 17598 - DNA, 313 bp, Homo sapiens
catccacccactgtggggtctctgagcccagggctgggtcatttctcctgggccgagtgtggcactaagcatgctgagtgctagcctgcacagaggccaggcccgggtgggccccaggacacagctgtcagtggctgtcttgccatggagtgagtggatgaatcagcagggctgggatcctctcccattttacagtaggaggctggggagaggagctggccagcccgtccacctctgcagcctggcatctgaggccctcatggcatccctgctggtctgccttcccctgcagcccttccaccctctgtggagc

SEQ ID NO: 17599 - DNA, 522 bp, Homo sapiens
ctgagtagctgggattacagacttgtgccaccatgcctggctaatttttgtatttttagtagagacggggtttcaccatgttggtcagactggtcttgaacttctgacctcgcagtctgccccctcggcctcccaaagtgctgggattataggtatgagccaccctgcctggccaagaacagtttttaactctaagaatatcagtgctgttgagaatataagccagatgcaaaagaatacatactgtatgattctatttgtatgaagttcaaaaagagacaggactgatctttgatgacagaaatcagaataatggttactttttgggcttgagagggtggtattgactgggaaagggcacgtgaaagcgttcttgggtttttaaaatgatccatgtcttaatctgagtggtgattactgggtgcatgtatgtgtaaaaattgttcaagctgaacacttgacatttgtgcactttactgtattttacctcaataaaaatgagtttaaaaaaaaaaaagaaca

SEQ ID NO: 17600 - DNA, 218 bp, Homo sapiens
cctggcctggcctgaggctggcatccagctgggcagagtgccaagccctgcatggaagccaagccaagcttcctgcccccagggcccgaggaagtgggtgtaggggtcaggggatggcccgttctgtgtctgttccccctgcccctgagagtgggtgcccagtgggcacagcccagcctcctgctccactgaccccacactgccagtgagatgaagtt

SEQ ID NO: 17601 - DNA, 209 bp, Homo sapiens
cttcttgccctctggtgatcaggtgaccaccaggtcccctcgtctgctggttgtttcgtgagttttcatcctttctgtttcaagtgtgcaatttccgaatggccacccgcatcatccctgcagcctgtggactctcaaaacccagtccctcctgctgggaagtaagggaccagctgttctgatggctcaaaaaccttcagccgtttgca

SEQ ID NO: 17602 - DNA, 949 bp, Homo sapiens
tatcacaaatttagtgacttaaagtaacataaattaattattttgcagttctggaggtcagaattccttagcattctttctggaggctgttggggagaactcactgccttgccttttccagcttctagaggccacctgccttctttggctcatggcctcttcctccgtcttcaaagccagcaacgtgacatttcagatctccctctctctgtctgtctcaccgcatcttcactaccctcttcctctcattctggcccttctgcatgtcttttataaagacctttgtgatttcactgggcccactcatataagccaggaaaatctctgtgtctcagatccttaatttaattacacctgcaaagtccgttttctcgtgtaaagtaacatattcacaggtttctggaattgggacgtggacatcttcgggggaccattactctgtctgtcatactccctgagtgtgtaagggccatctcttcagagcctaatgtgtcatcctacacagagcaggtgtttccttataaattaagttgaattaaattacccctatgaagccacataatcaataattcagctataataaacattgccgaataaattaacaaagggaggataatgactccttatgatgatggatagaaacactgaagaaaaccattttcagaggatttactgaatcttcctctccaaggagcttgtaatagaagggtaaacctctagtttcttgtccagcagaggaataggctcatgtcttttgttttattttatttttttggtgagtcagtatggttgggttaatcatattcacattagattccatgttgaagaacaactaatcaaagaagaaaatcatcaggaatcagggtgagattaacagaccaaggtcagaaacatggagttacaattttccaaaaaagcacgacagcccaaacggtaccggctcgatctt

SEQ ID NO: 17603 - DNA, 420 bp, Homo sapiens
agaaaaccattttcagaggatttactgaatcttcctctccaaggagcttgtaatagaagggtaaacctctagtttcttgtccagcagaggaataggctcatgtcttttgttttattttatttttttggtgagtcagtatggttgggttaatcatattcacattagattccatgttgaagaacaactaatcaaagaagaaaatcatcaggaatcagggtgagattaacagaccaaggtcagaaacatggagttacaattttccaaaaaagcacgaagtgagattaaaaccacagtaagtcttagtctgactgacaggctttatacaggccctcggtaagcagttgggagaacccatgcccaccactgctctgtacggtatctggctgctcagagctctctgattcacaaaagagatcatca

SEQ ID NO: 17604 - DNA, 694 bp, Homo sapiens
  misc_feature (637)..(637): n is a, c, g, or t
  misc_feature (675)..(675): n is a, c, g, or t
  misc_feature (682)..(682): n is a, c, g, or t
aagtttatagaaaatgcttgttttatagttggttgttattgagatgagagtccctcaaggaactccctatgctttagggagctttttgttttaaacctactggttagacttgtgggttttaatgttttcagctgtggttgtaagaaacacattttaaattgcacctagtatagacatacatgtaaaacaaacaaaatttttacgaagtagtacttgtattaagagtgatgtactctgctatcttctatttcatttttttaaagttgatattgctgccttaaattgattttttcaaccactaatgagtcaggacccactatttaaaaaatactggtgtgttctcttgctgttacgaattaacccaaaacttagtggtttaaagcaataaacttgtgtttatctcatgtaggttctgtgggtcaggaatctgggagtagcttacttaggtggttctgggtcagggtttttcatgaggttccgcgctctgctccagccaaacttctgcagaccatgtgcagccgaggcgaggaaacttctctccacctattggggctggaggcctgagtcacaagccccttgtttacataaagtgtttaaggtagcacaagtccttgagatgctcggggtagagatgganaaccactgcttcgtatccttctgccgcttctgcttganatctctngccttacccttg

SEQ ID NO: 17605 - DNA, 2163 bp, Homo sapiens
agtgatacttagcttacaagagaaattagattcatgtctgacaactgtagggagtttacaagctaaattccacaacatggcaatatgtgattaagggctgaaatgaaacattcaggcagtaaattcagtgggtcagagaataggggaagtgtgtgtaggtagaaatatcagggcagatggagcctgagagagtcttcttgtggcaagggactccacagggtccttttagagatgcttggggaaaacagtaagtagccttaagatcagagtggcccatttcacaaaacaatctgtgtgaaataacattgcctgatgagaacccatttaaaactgagttcccgttgccttgaagaatatgtcccacttagccttctcttagcttgcctttattttaattatttgaaggagtagaagaaaagacacttgttttccccaattttttttcttgatttttatggactttttacctgtttaaaactaaaacttttacaaactctgactgagggtgtggtgtttattttaagggtgaggcaatagagagcagggcactgtaaaaccactaaccagggatgtgcttctctctcaggccagctaggccttctttgctcctggtctctgactggtctcctgctcccagtgaccattcgcaggtcctttcctgtttggccagttgagagaacaggggctgggcatggtggctcacatctgtaatcccaatactttgagaggctgaggtgggaggatcactccagcccaggagttcaagaccagcctgggtaacacagtgagatttttatttattatttaattgttacaaaaaataaaaaagaatcaaccaggcctggtgatgcacctgtagtcccagctactcggagggctgaggtgggaggattatttgagtccaggaatgatcgtgccactgaactccagcctaggctacagagttagaccctgtctcaaaaaaagaaaaaagaaattggccaggcacagtggatcacacctataatcccagcactttgggaggccagggcagggggatcacttgagcccaggagtttgagaccagcctgagcaataatagcgaaaccctgtctctttaaaaataaaaataaatttaaaaagaacaggaagcttggtaatgtgctcttcttcactagtcagtagacctgctccactgatagggctttattcatccatttacctgtcatttattaattcctattatgtttcagggtctgtgctaattctgagcatttgaaaatgggccttcaggtaacaacttttggcctaatgggagcaaaagtcaaacaaacagatatttacaatgccttttggcaagagttaagagcaagttaggcactagtttctttggaagagaataaggagagtaatgtaacttagcctaaagggaggagggagcttcagggaagatttttctggaggaactactatttgacacttgaaatacaagtaggagttggccagagaaagaagagaaaggtgttccaggcaagagacacaacataaagaggcatgggagagcataatgacttcggagaacttgccaggacataaaggaagaaggtgtataggtgaggaaaaagggaagtgaagcgagattaatcacttcacttttaaaagcaatggtagttcccgccatgtgtgcacatgccctagctctaaaaaaaaaaatacatatttttaactcctttagcagccttttgaggtatggatttactggtgttttatgatctagaaagttaagatataccttcccacattttcattggtaaattctcaggactgggtgaagctatattacctcataccaaagtatcaactcctattccttatagttgtaacatctttacatttgtcaagttcaaagacattgtatatcagtgactgttttagcaggcatattcttgatctgttggtttgattgatagccagtcttagtagttgtattgctaacacttcataggtgattagatggatttgtaaaaagacatggttgctcctttgtatctcaagctctacttggatattaactcatttgaaatacttgcacaggcatatggtgtaagcctgtagtcccagttactctggaacgcaggagttcaggaccagcctgagcaacttagtaccattccatctctttta

SEQ ID NO: 17606 - DNA, 462 bp, Homo sapiens
cccagatgtgaatactgtaacttcggaaagaattcttaccccccactcttgtgaattatcaaactttctcatcattctccatctgttgctcaaaatgcaggtaaagaatagcagaaaaagagagaggaactctcgcaaacccatcctgctcctgctcactgggtcattagaaacaaaacagatctggtgaagggtctgctgtaaagcagcttgtcttgtgtctgcagattttcacggactgctccctcctgccagcagaggacctgtaacactgccccgattgaagtcagggaacaattcacagatcggaggaacatttctgaatgacgctcagatgacagagaaacgaagtttgcataatttcagcagtaatgcaagaaaagatgagtgtgcgtgttgtaagggagggagggatgcagaaagggttgaaatctgtaataaactgcctccaagaaaacagga

SEQ ID NO: 17607 - DNA, 306 bp, Homo sapiens
cccagatgtgaatactgtaacttcggaaagaattcttaccccccactcttgtgaattatcaaactttctcatcattctccatctgttgctcaaaatgcaggtaaagaatagcagaaaaagagagaggaactctcgcaaacccatcctgctcctgctcactgggtcattagaaacaaaacagatctggtgaagggtctgctgtaaagcagcttggtgagtcacggtctgagatccctgggatatgccagaaatagaacaagccaaaaaaaaaaagaaggaataaagttgagactcaaaacactgaaa

SEQ ID NO: 17608 - DNA, 1097 bp, Homo sapiens
gtttgaatgatcatgtggtactccaccaacaaccagtcattaacgatgtgtccaagattgctgaaatacttctcacaacttctgtctagcattgtggtcaaactacctgaattcatttttgagctctaccatttactactggaatgaccatggataagttacttaacatctgtaaattgggagtaataattacacctacatcatagagtttttgtgagaattaagagagttaatgtgttgcaaggtacatttattgggagcttacatgggaagcccccaataaattgtagtagtgttatttcggtaatttttcatttgtccccccgttgtctttgtgactgtatctcacagcaaacagaaagaagaggcaggggggtaaattgtggttttaaaggcttttctgatgtctactgatatgtacagcatgcatgataaatcatttgagttccaaatcttctagttacctagatcttgtaaaaacttataaactaatgtcctaaatcctaagtctttataatgtctagtatttgtacatcaaaagccctagttaggggactttaattacttttacttttctcatggattctgctgtcagtgggtcctaaatgagaataccttaaagcagtgattctcaaagtgtgggccacagaatgctggggtgggggtgatggtagtgaccgtgtcactgagacccttttagaggtgcacaagtttaaaactattttcataattacactaatttgatattctccttattcactgcgctgacatttatattaatggtgcaaaagcaatgatggataaaactgccatcacctctgcgtgaattaagatggtgagtgactccatttgggaggccgaggtgggtggattgcttgagtccaggagtaggggactagtctaggtaacatgatgaaaccctgtgtctacaaaaaatacaaaaaaattaaataggcatggtagtgcgtgtctgtagtcgcagctactcaggagactgaagtgggagaattgcctgaggcacggagtgtcgaggctgcagtgagccatgattgtgccattgtactccagccttggcaatggcgtgagaccctgtcttt

SEQ ID NO: 17609 - DNA, 486 bp, Homo sapiens
ttgggagcccaagatcacctgagcacaggagtttgaggccatcttgggcaacacagggaaacctcatgtcttaaaaacaaacaaacaaaaccgccaggtttagtagcacatgcctgtggtcccacccagctacttgggaggttgaggtgagaggacggcttggatccagaaggccatggctgcaataagccgtgactgcacgatggcactccagcctgaaccataccacagagagagactgtttcaagaaaaaaaaaaaaccaatttattactattactttgagccagatggaagaatagagggcctgggcagttgttaaaaaattctacctttaaaaaacaccataccattcaaattcattgacctctaactttgtaaagtgattggccttaagggtgctcaagttgagacaaataaattaggcagaatttaaactattgacagcaaatcatacaagctagtttaggagccattctgaaataagg

SEQ ID NO: 17610 - DNA, 510 bp, Homo sapiens
ggaccaccattcccgaaaacgaggagcctcatctaaccacctcgattagaccccacaattcctgggtttgagctgccacatggaccaggcgcccactagccgaggacaatgctcccttgttcgttgtttcagcgctatgtgggtgacacccacagctagaagaacccggagtgaggggaagaacacgctttgatttatatatgtgtatatatatatatacagttttagggaacccaagcacaggaatcaactgccgagcactcaagactgaagaaagaagaagagcaaatgataaaggaagggaacagagcacaaaagttcttgactcttgtggggagtagggtggagaggagtaaaagggacaggctagagcaactcctatttctacaaaaaaaataattatattaatattcagatcttatgtatatttagcatccctgcacttcaggatttaaatagcacaaattcacttatttctgcatcagatgaataatactactttgcatttct

SEQ ID NO: 17611 - DNA, 255 bp, Homo sapiens
tcaaatttcacatagatgacgtcatatggcatgtattcttttgtatctggtttatctctcttaacattcttaggttgttgagatgcatccctgttcttgaatgtagcactaggtctttcgttcaagtttcaatgtagccttccgttctgtaaatatgcaacaatttctttacccatccttttgttgataaacatttcatttgtttctacctatttactattacaaatgtgctgtcatgtcttgtacctgagttta

SEQ ID NO: 17612 - DNA, 446 bp, Homo sapiens
gcaagttacttcagttctctgcatactcatgccctcggctggaaaacggtgtaatagctgcccatggggtgttgtgcaggttacagagctcgactgcagagtgcctggatccctgccctgcaccgagcgaacgctcggagtgtccactaggatgagccgtttctgtctgatctggggcaagggcctgagccggacctctctgagcctcggtctcctctgcacgatagtgtggatacccctcagctcctcggtacgcgtggtgaagactaaataagatgatgcatggcagaacctggcacaaggggacatccagtagatggttgcttggcctggcatggtggctcacgcctgtaatcccagcactttggaaggccaaggcaggtagatcacatgaggtcaggagtttgagaccagcctggccaacatggtgaaaccccgtcgctact

SEQ ID NO: 17613 - DNA, 288 bp, Homo sapiens
gaataatgcttgtgtgttgttttcacagtattatctaaacatagaagggtaaaaatccaagtatcagccactgttttgctctatcacatttaatatctgtgcaccaacaatagtttgtaggattatggaatcattaaacatagatgcatattattccaaggcttattatggatgtttgtcatcactgactttccttcaatattaaaaaagtgctaaattttgattggattatgattataatttcttctataattgacagattctgtaatacaaatggtcatgtcttcg

SEQ ID NO: 17614 - DNA, 413 bp, Homo sapiens
cgattctccaaacatttatttttaaagttaatattaaatctcatctggtggaaaacctgacaggaactgaagcatatattttctagtctaaactctcattgttaaaatgaagacaacatgagacagttatagcgccgtaatcaagttatttgaaaaaaatgttttaaaaattaccactttttggtagtcaacatacacacatatgccaacagatggcattaaaaaatggcaagaacatgagacaattatagggtcataataaatttatttgaaaaaaatgtttaaaaaattaccactttttgatagtcagcatacacacatatgccaacagatgacattaaaatagctgtaaagtcaagaagcagggaggatgacaaagtgaaaaatagaagaaatcaaaggaagttaagtca

SEQ ID NO: 17615 - DNA, 478 bp, Homo sapiens
gcttcggaggtagaagaccccaagacaggcgggcgatgcgaactgcaagactttccgagctccgcaatcctgcggtccgcggtacccgcatgttgctatggcgacgggaggcagcggccgtctctctccatggcaacgggagggaaaagtttctggcgaacaggaatggggggtcatttcaagagggcgcagggcgctcagttccgccgacccacctccttgcttcggtgaaacagcaccagagatcatgtatctttctgctaagcataacaagaaagacagaaagctcaacgggaggattgaggctagacttaaagtagagatcccctcagaaactgtggagtgaggcccagggaacagattcggctgagaggcttcgagctgcctcactcagcgctggaagtctgtgagccatggtcagggaggccgggggaccagcgccctgcaggggcctatctcgggagtctcttgatctaca

SEQ ID NO: 17616 - DNA, 259 bp, Homo sapiens
acaaatgtgtgtaccttaatcatacccatatgtaaaactagagcggtggcatgaatcccaagaagtgggcggttgcccacagctgtacttctgtctcagatggataactgcaatcactaaccttttttgaagaatttgatatgatactgagaaaatagtgattaatcaaagccccttttaaaatggaagactttcatctataggcattaactttttatgatcagagaaaaaagcagtaaagaataggtgaaacatttat

SEQ ID NO: 17617 - DNA, 553 bp, Homo sapiens
tctcctgactcagcttgaattggtcatggaaggcttttctgagggagagaagtctacactgagatctaaaggcaagtgagttaacgagtatggggagacaaggtggcatagtcaggtgaagaaggcagtgccttgggccagacacgctggtttgaatcctagttctgccagtagtgtgtaattttaagcaagtttctcgaactctacgtccctcagttcttcatatctgtaaaattgggatgataacgtacataccatatagggttgtggtgaagatgaaatgttgctgttatcatcatcgttgttaaaatgtggcacttgccagtggcaggtacagcccgctgttgcggggagtctggagggaggagaggaagagagtatggtgtctgctctgctcatctcagcacttcctttcctgggaacttcccatgtcactgttgaaactttggatgtccaatatactgtattccctaaactaatttgtttcttgccctgtgaatgaagaagtgttctctttcactctggtggagtatgttcagtagctgtagtttca

SEQ ID NO: 17618 - DNA, 662 bp, Homo sapiens
atccttaattaaattaatctcccccccccgtttcaccatgttggtcagggtagtcttgaactcctgacctcatgctctgcccagcttggcttcccaaagtgctgtgattacaggcttaagccacagcgcccgacccaaagtgttcttttttccttgaaaagaagtacagattttttaaaaagctaatattgctgtgattcaactctcaagttacttgatgctatttcttcatttctattgtattcacatgtgaaagcatgtgatcagttgtcacggcatcaaagataggagagtttctttttttttaggtgggcattatttatgaccttttctttggaagagtaaggatattaaaatgtaacatgcatgatgaaaatctaagtggagatgatatttgtggttaattatgatattgagtggtgcatgaggtaggtgtttagagtaatattcttttgcattatagtaagaacatttaagttttgttaaaattaaaaaattagtagtacgttattttactatttgtacttttatgtaataaaatgcagtacatttttaaattttcagatgatgtgtgaacttgtttcattatacatttttaacatgttaatactattgtgcattcaatgaagcattattatgccactaactgaaacctatcccat

SEQ ID NO: 17619 - DNA, 734 bp, Homo sapiens
agcggttcaagcaattctcctgcctcggcctactgagtagctgagattacaggtgcacaccaccacgtccggctgacttttgtgtttttagtggggacggggtttcaccatgttggtcagggtagtcttgaactcctgacctcatgctctgcccagcttggcttcccaaagtgctgtgattacaggcttaagccacagcgcccgacccaaagtgttcttttttccttgaaaagaagtacagattttttaaaaagctaatattgctgtgattcaactctcaagttacttgatgctatttcttcatttctattgtattcacatgtgaaagcatgtgatcagttgtcacggcatcaaagataggagagtttctttttttttaggtgggcattatttatgaccttttctttggaagagtaaggatattaaaatgtaacatgcatgatgaaaatctaagtggagatgatatttgtggttaattatgatattgagtggtgcatgaggtaggtgtttagagtaatattcttttgcattatagtaagaacatttaagttttgttaaaattaaaaaattagtagtacgttattttactatttgtacttttatgtaataaaatgcagtacatttttaaattttcagatgatgtgtgaacttgtttcattatacatttttaacatgttaatactattgtgcattcaatgaagcattattatgccactaactgaaacctatcccat

SEQ ID NO: 17620 - DNA, 305 bp, Homo sapiens
  misc_feature (271)..(271): n is a, c, g, or t
cagtacgaataaattttaaaaatggattttaaaggtccaatgcaaattgcagaatgatgcataacacatgatgctacagtacttataaagtgtgaaaatatacttaaggttatttaacatcatggtttttatattggatactttctgaaaagataggagaaaaaggataggaccacaaagggtttatatgatatataggtatacctcagagatattgtgggtttggttcagtgagtcaaacaactttttggcttcctagtacatataaaangttatatttaccctatagtgtattgtgtgtgcaa

SEQ ID NO: 17621 - DNA, 468 bp, Homo sapiens
tgttactctcctgttaagttttcaagatatgaagtactttgttgaagagggcagggggtctgtccagattagttgacacgtagatcctcctttaaaatgtaaagtatgtgcagaataataaaagacatgaagggtataaaataaatgagatcaaagacaataggatttttggctatattttaagcataccctttcctctgctgatgtatgaccactgtctttatcttactgcaaattcacttcaaagtagtagtgatgtaataataaattaatgaggtaatagcagaatttttattacaactacttcatggcttttctggctaaaagctgtagttttcagtctttgggacatggttacttattcccatcagagaagactgtaagaaccaaagattgattctgcacattttttaaaaatctgccacagacatggcattaaatggagtatagaaatgatgcatactttgg

SEQ ID NO: 17622 - DNA, 1620 bp, Homo sapiens
gttgcttcaccaacaaagcccaagccaagaactgcagcgttgagggttgtccctcggagtggagtagcccaaggaatctcaggtccaccaagagcattggtaccatccgggccacgggtggatgcctttgttctggcacagttctccacttcccgattcctggctcagccagccaggcctccctctaatggcatttagtaaccaggaaacaaaacacatgccacctgagcaaaactgcctgcacttcatctctggaggttcgctgcacagaggccacctgccgcatcaccagtgaggaagctttgccaccatcctgcttggcagcttcacacttgacatctgaggattggtttttggctggaaaaagggtaccagggtttcctggcaaggacaggagagcagtgcagtgacacagatgagaagctgtgagtctccaggattcaaggaagccaccaggtgtgcaggctgggaagagacatctctttcagtttgaccctttatctcctgcacttttaaagaaacaccagagaaaaaatctacaaggcgtgtttccactgaagctgaacctctgcctttaggagtcccctatatttgagcaaggccacctgcttcccctggacttgagctggactccttgaagagtgggcttctggagagatgttaggaatatagcacatgctctctgggggccacagggtcattgggaaggtttgaaatgaagatgggatgtggctggaacagcctgtgagatggctccattggggacactcccctcatcttgtcatcacgatggatatgctggaagaggaggtgtcccagtgagccgcccgaagttcatagctttgccctcgccttggcaacagcggcaatgcctctatctctgggatgcatcttaaggagggctcctaacaaggccgatgatttagacagaacaagagactaagtaaggtccagctatcccgtggagccagtagtaggtgggagctcctgtccccgccagccctgctccagcccccgtgtccagctgggccagtggaagaactgggaaggaggaagcccctccctttcactgtggctaatgtttgctaggccagttatggtgaaccaatgatacagtgttttccctcttaacgttcccctcctggttttgccttttcagggttttctgggggattttgttgtagtagttgcttttcttcctctctcatttgggtttgaggattgtggtcgggggagccctggctttcaccaaaggagcccagtggtttctgtggaagaggcgcccactcccactttaatgagggtgaagattgtcaggtcactgtttgacatattcatgccccgtcccttccccccccacccccccgcccacccaccacgggtgtcgctttaaagagtcaattcttgtacagagaaggatttgctaggtttgcatttgggtgttagcatcacgacccacgagggccctgccaaaccgtgcgtcccatggggcaccttgactcttcaaaccaaaattccttaaaggggcacagccagccttgtccgcaacctcaggggcctgggattcctgtggcgcttcctgaattccaggttggcacagatgatgaggtctgagaccag

SEQ ID NO: 17623 - DNA, 332 bp, Homo sapiens
caaaggttacaaattcaggcacttcccctctctggagcctcagtcttctcacccgtaaaatatgcatgtgggatgtctgtacctcttagtgttgtgatgacccacttagaacagtgcctgacttcaagataaatgatggctgctgtgattataacaaaagaaactgtggtggagattcagggaaggcagaagaaggagtccagagtaggtatcaggaggtctgagttcaggaccagttcttctctaccacactgtgtggccctgggcagaatgttctgcctgtcccttggtttttgtttttggatgtattggccaagtaatacacaaattct

SEQ ID NO: 17624 - DNA, 1495 bp, Homo sapiens
gcggccgcgtcgacgtgacagccggtacggccccgggtttgggcaacctcgattacgggcggcctccagccccgccagcagcgccccgcgccgcccgcccgcgcccctgccgccccccggttccggccgcggaccccactctctgccgttccggctgcggctccgctgccggtagcgccgtcccccgggaccacccttcggctggcgccctcccatgctctcggccacccggagggcttgccagctcctcctcctccacagcctctttcccgtcccgaggatgggcaactcggcctcgaacatcgtcagcccccaggaggccttgccgggccggaaggaacagacccctgtagcggccaaacatcatgtcaatggcaacagaacagtcgaacctttcccagagggaacacagatggctgtatttggaatgggatgtttctggggagctgaaaggaaattctgggtcttgaaaggagtgtattcaactcaagttggttttgcaggaggctatacttcaaatcctacttataaagaagtctgctcagaaaaaactggccatgcagaagtcgtccgagtggtgtaccagccagaacacatgagttttgaggaactgctcaaggtcttctgggagaatcacgacccgacccaaggtatgcgccaggggaacgaccatggcactcagtaccgctcggccatctacccgacctctgccaagcaaatggaggcagccctgagctccaaagagaactaccaaaaggttctttcagagcacggcttcggccccatcactaccgacatccgggagggacagactttctactatgcggaagactaccaccagcagtacctgagcaagaaccccaatggctactgcggccttgggggcaccggcgtgtcctgcccagtgggtattaaaaaataattgctccccacatggtgggcctttgaggttccagtaaaaatgctttcaacaaattgggcaatgcttgtgtgattcacaatcgtggcatttaaagtgcacaaagtacaaaggaatttatacagattgggtttaccgaagtataatctataggaggcgcgatggcaagttgataaaatgtgacttatctcctaataagttatggtgggagtggagctgtgcggtttcctgtgtcttctggggtctgagtgaagatagcagggatgctgtgttcacccttcttggtagaagctaaggtgtgagctgggaggttgctggacaggatgggggaccccagaagtcctttatctgtgctctctgcccgccagtgccttacaatttgcaaacgtgtatagcctcagtgactcattcgctgaaatccttcgctttaccaaatctagacatacataagggactttctctcccttttcagccctctctgtgcagagaaaagatgtgagtccgcttgatgaattctaatgctttgcttagagctatgagaaatgtttgttttaataaaaacctacagtccaataa

SEQ ID NO: 17625 - DNA, 1527 bp, Homo sapiens
gcggccgcgtcgacgtgacagccggtacggccccgggtttgggcaacctcgattacgggcggcctccagccccgccagcagcgccccgcgccgcccgcccgcgcccctgccgccccccggttccggccgcggaccccactctctgccgttccggctgcggctccgctgccggtagcgccgtcccccgggaccacccttcggctggcgccctcccatgctctcggccacccggagggcttgccagctcctcctcctccacagcctctttcccgtcccgaggatgggcaactcggcctcgaacatcgtcagcccccaggaggccttgccgggccggaaggaacagacccctgtagcggccaaacatcatgtcaatggcaacagaacagtcgaacctttcccagagggaacacagatggctgtatttggaatgggatgtttctggggagctgaaaggaaattctgggtcttgaaaggagtgtattcaactcaagttggttttgcaggaggctatacttcaaatcctacttataaagaagtctgctcagaaaaaactggccatgcagaagtcgtccgagtggtgtaccagccagaacacatgagttttgaggaactgctcaaggtcttctgggagaatcacgacccgacccaaggtatgcgccaggggaacgaccatggcactcagtaccgctcggccatctacccgacctctgccaagcaaatggaggcagccctgagctccaaagagaactaccaaaaggttctttcagagcacggcttcggccccatcactaccgacatccgggagggacagactttctactatgcggaagactaccaccagcagtacctgagcaagaaccccaatggctactgcggccttgggggcaccggcgtgtcctgcccagtgggtattaaaaaataattgctccccacatggtgggcctttgaggttccagtaaaaatgctttcaacaaattgggcaatgcttgtgtgattcacaatcgtggcatttaaagtgcacaaagtacaaaggaatttatacagattgggtttaccgaagtataatctataggaggcgcgatggcaagttgataaaatgtgacttatctcctaataagttatggtgggagtggagctgtgcggtttcctgtgtcttctggggtctgagtgaagatagcagggatgctgtgttcacccttcttggtagaagctaaggtgtgagctgggaggttgctggacaggatgggggaccccagaagtcctttatctgtgctctctgcccgccagtgccttacaatttgcaaacgtgtatagcctcagtgactcattcgctgaaatccttcgctttaccaaatctagacatacataagggactttctctcccttttcagccctctctgtgcagagaaaagatgtgagtccgcttgatgaattctaatgctttgcttagagctatgagaaatgtttgttttaataaaaacctacagtccaataaaaaaaaaattattaaacagcacgcaagctaca

SEQ ID NO: 17626 - DNA, 287 bp, Homo sapiens
  misc_feature (8)..(8): n is a, c, g, or t
  misc_feature (13)..(13): n is a, c, g, or t
  misc_feature (66)..(66): n is a, c, g, or t
aggagagnaaagnaagagagaaaaaaaaaagaggagaggaagagaagagaaaagaaagaagaaaancccgttctttcagagcacggcttcggccccatcactaccgacatccgggagggacagactttctactatgcggaagactaccaccagcagtacctgagcaagaaccccaatggctactgcggccttgggggcaccggcgtgtcctgcccagtgggtattaaaaaataattgctccccacatggtgggcctttgaggttccagtaaaaatgctttcaacaaa

SEQ ID NO: 17627 - DNA, 264 bp, Homo sapiens
ataaaacaatcaatcataacatatcaaaagaaaagaaaaaagttgagttctttcagagcacggcttcggccccatcactaccgacatccgggagggacagactttctactatgcggaagactaccaccagcagtacctgagcaagaaccccaatggctactgcggccttgggggcaccggcgtgtcctgcccagtgggtattaaaaaataattgctccccacatggtgggcctttgaggttccagtaaaaatgctttcaacaaa

SEQ ID NO: 17628 - DNA, 266 bp, Homo sapiens
agtataaggagaatagaaaatttattatatttagtggatatgagactagttctttcagagcacggcttcggccccatcactaccgacatccgggagggacagactttctactatgcggaagactaccaccagcagtacctgagcaagaaccccaatggctactgcggccttgggggcaccggcgtgtcctgcccagtgggtattaaaaaataattgctccccacatggtgggcctttgaggttccagtaaaaatgctttcaacaaa

SEQ ID NO: 17629 - DNA, 262 bp, Homo sapiens
tacataattatacaatttaaccaacacaaataaatcattcctcagttctttcagagcacggcttcggccccatcactaccgacatccgggagggacagactttctactatgcggaagactaccaccagcagtacctgagcaagaaccccaatggctactgcggccttgggggcaccggcgtgtcctgcccagtgggtattaaaaaataattgctccccacatggtgggcctttgaggttccagtaaaaatgctttcaacaaa

SEQ ID NO: 17630 - DNA, 382 bp, Homo sapiens
aattcggcacaaggggagatgtgccagcttcctcttctgccatgattattattattttacattgtaggtacagccagtgtgatcagacaaagcaattcgagaactacaaaagaggaaaaaagatcagaagttcttaaatacataagggaatgcagcatttgataaagccaaacatcatgtcaatggcaacagaacagtcgaacctttcccagagggaacacagatggctgtatttggaatgggatgtttctggggagctgaaaggaaattctgggtcttgaaaggagtgtattcaactcaagttggttttgcaggaggctatacttcaaatcctacttataaagaagtctgctcaggtaggaagaatttgctttattgtatt

SEQ ID NO: 17631 - DNA, 1707 bp, Homo sapiens
agagtgagagagagaaagagggagagagagaggcagagggagagctgaggaaagaaaaaaaggcaagacttggcacagctcagtcaaatcagcttcttttgtctgctttctcggcttgagcttcaggaaagaaaaccgtcctggggtacagaaaaactcagaactttttggttttcaaacttagaaggctttttaagtctcttgggctatttgaaagtgttggtacatacaatgacgtttagtcaccagtattaagggaaataaaagcctttttcaaaacgaagcttccatagtgtccatgcatttgggaaatactatatttgattttttgcatgtatgattataccatgagagacaggattaatatagaagatggcaaggcaaatttctaattagagggaatattaattttctacaaaataaagtttgttcatcaatacaaacctgctttcaaatcaaatcagaaagacatccttcggaatgtgttcagaaccaattagtgacaacactgaagaccagaaaggcaagctgaagacaccagacttcgcttgaagggcaaacaagaaatccaaacatcatgtcaatggcaacagaacagtcgaacctttcccagagggaacacagatggctgtatttggaatgggatgtttctggggagctgaaaggaaattctgggtcttgaaaggagtgtattcaactcaagttggttttgcaggaggctatacttcaaatcctacttataaagaagtctgctcagaaaaaactggccatgcagaagtcgtccgagtggtgtaccagccagaacacatgagttttgaggaactgctcaaggtcttctgggagaatcacgacccgacccaaggtatgcgccaggggaacgaccatggcactcagtaccgctcggccatctacccgacctctgccaagcaaatggaggcagccctgagctccaaagagaactaccaaaaggttctttcagagcacggcttcggccccatcactaccgacatccgggagggacagactttctactatgcggaagactaccaccagcagtacctgagcaagaaccccaatggctactgcggccttgggggcaccggcgtgtcctgcccagtgggtattaaaaaataattgctccccacatggtgggcctttgaggttccagtaaaaatgctttcaacaaattgggcaatgcttgtgtgattcacaatcgtggcatttaaagtgcacaaagtacaaaggaatttatacagattgggtttaccgaagtataatctataggaggcgcgatggcaagttgataaaatgtgacttatctcctaataagttatggtgggagtggagctgtgcggtttcctgtgtcttctggggtctgagtgaagatagcagggatgctgtgttcacccttcttggtagaagctaaggtgtgagctgggaggttgctggacaggatgggggaccccagaagtcctttatctgtgctctctgcccgccagtgccttacaatttgcaaacgtgtatagcctcagtgactcattcgctgaaatccttcgctttaccaaatctagacatacataagggactttctctcccttttcagccctctctgtgcagagaaaagatgtgagtccgcttgatgaattctaatgctttgcttagagctatgagaaatgtttgttttaataaaaacctacagtccaataa

SEQ ID NO: 17632 - DNA, 1632 bp, Homo sapiens
agagtgagagagagaaagagggagagagagaggcagagggagagctgaggaaagaaaaaaaggcaagacttggcacagctcagtcaaatcagcttcttttgtctgctttctcggcttgagcttcaggaaagaaaaccgtcctggggtacagaaaaactcagaactttttggttttcaaacttagaaggctttttaagtctcttgggctatttgaaagtgttggtacatacaatgacgtttagtcaccagtattaagggaaataaaagcctttttcaaaacgaagcttccatagtgtccatgcatttgggaaatactatatttgattttttgcatgtatgattataccatgagagacaggattaatatagaagatggcaaggcaaatttctaattagagggaatattaattttctacaaaataaagtttgttcatcaatacaaacctgctttcaaatcaaatcagaaagacatccttcggaatgtgttcagaacccaaacatcatgtcaatggcaacagaacagtcgaacctttcccagagggaacacagatggctgtatttggaatgggatgtttctggggagctgaaaggaaattctgggtcttgaaaggagtgtattcaactcaagttggttttgcaggaggctatacttcaaatcctacttataaagaagtctgctcagaaaaaactggccatgcagaagtcgtccgagtggtgtaccagccagaacacatgagttttgaggaactgctcaaggtcttctgggagaatcacgacccgacccaaggtatgcgccaggggaacgaccatggcactcagtaccgctcggccatctacccgacctctgccaagcaaatggaggcagccctgagctccaaagagaactaccaaaaggttctttcagagcacggcttcggccccatcactaccgacatccgggagggacagactttctactatgcggaagactaccaccagcagtacctgagcaagaaccccaatggctactgcggccttgggggcaccggcgtgtcctgcccagtgggtattaaaaaataattgctccccacatggtgggcctttgaggttccagtaaaaatgctttcaacaaattgggcaatgcttgtgtgattcacaatcgtggcatttaaagtgcacaaagtacaaaggaatttatacagattgggtttaccgaagtataatctataggaggcgcgatggcaagttgataaaatgtgacttatctcctaataagttatggtgggagtggagctgtgcggtttcctgtgtcttctggggtctgagtgaagatagcagggatgctgtgttcacccttcttggtagaagctaaggtgtgagctgggaggttgctggacaggatgggggaccccagaagtcctttatctgtgctctctgcccgccagtgccttacaatttgcaaacgtgtatagcctcagtgactcattcgctgaaatccttcgctttaccaaatctagacatacataagggactttctctcccttttcagccctctctgtgcagagaaaagatgtgagtccgcttgatgaattctaatgctttgcttagagctatgagaaatgtttgttttaataaaaacctacagtccaataa

SEQ ID NO: 17633 - DNA, 1628 bp, Homo sapiens
gtgatgaaattgatggcccctaagatagaggagacacctgctaggtgtaaggagaagatggttaggtctacggaggctccagggtgggagtagttccctgctaagggagggtagactgttcaacctgttcctgctccggcctccactatagcagatgcgagcaggagtaggagagagggaggtaagagtcagaagcttatgttgtttatgcggggaaacgccatatcgggggcaccgattattaggggaactagtcagttgccaaagcctccgattatgatgggtattactatgaagaagattattacaaatgcatgggctgtgacgataacgttgtagatgtggtcgttacctagaaggttgcctggctggcccagctcggctcgaataaggaggcttagagctgtgcctaggactccagctcatgcgccgaataataggtatagtgttccaatgtctttgtggtttgtagagaatagtcaacggtcgccaaacatcatgtcaatggcaacagaacagtcgaacctttcccagagggaacacagatggctgtatttggaatgggatgtttctggggagctgaaaggaaattctgggtcttgaaaggagtgtattcaactcaagttggttttgcaggaggctatacttcaaatcctacttataaagaagtctgctcagaaaaaactggccatgcagaagtcgtccgagtggtgtaccagccagaacacatgagttttgaggaactgctcaaggtcttctgggagaatcacgacccgacccaaggtatgcgccaggggaacgaccatggcactcagtaccgctcggccatctacccgacctctgccaagcaaatggaggcagccctgagctccaaagagaactaccaaaaggttctttcagagcacggcttcggccccatcactaccgacatccgggagggacagactttctactatgcggaagactaccaccagcagtacctgagcaagaaccccaatggctactgcggccttgggggcaccggcgtgtcctgcccagtgggtattaaaaaataattgctccccacatggtgggcctttgaggttccagtaaaaatgctttcaacaaattgggcaatgcttgtgtgattcacaatcgtggcatttaaagtgcacaaagtacaaaggaatttatacagattgggtttaccgaagtataatctataggaggcgcgatggcaagttgataaaatgtgacttatctcctaataagttatggtgggagtggagctgtgcggtttcctgtgtcttctggggtctgagtgaagatagcagggatgctgtgttcacccttcttggtagaagctaaggtgtgagctgggaggttgctggacaggatgggggaccccagaagtcctttatctgtgctctctgcccgccagtgccttacaatttgcaaacgtgtatagcctcagtgactcattcgctgaaatccttcgctttaccaaatctagacatacataagggactttctctcccttttcagccctctctgtgcagagaaaagatgtgagtccgcttgatgaattctaatgctttgcttagagctatgagaaatgtttgttttaataaaaacctacagtccaataa

SEQ ID NO: 17634 - DNA, 1612 bp, Homo sapiens
gcggccgcgtcgacgtgacagccggtacggccccgggtttgggcaacctcgattacgggcggcctccagccccgccagcagcgccccgcgccgcccgcccgcgcccctgccgccccccggttccggccgcggaccccactctctgccgttccggctgcggctccgctgccggtagcgccgtcccccgggaccacccttcggctggcgccctcccatgctctcggccacccggagggcttgccagctcctcctcctccacagcctctttcccgtcccgaggatgggcaactcggcctcgaacatcgtcagcccccaggaggccttgccgggccggaaggaacagacccctgtagcggtcttgctctgtcggccaggctggagtgcagtggcatgatctcggctcactgcaccctccgtctcccggattcaagcgattctccatacctcagcctcttgagtagctgggattacagccaaacatcatgtcaatggcaacagaacagtcgaacctttcccagagggaacacagatggctgtatttggaatgggatgtttctggggagctgaaaggaaattctgggtcttgaaaggagtgtattcaactcaagttggttttgcaggaggctatacttcaaatcctacttataaagaagtctgctcagaaaaaactggccatgcagaagtcgtccgagtggtgtaccagccagaacacatgagttttgaggaactgctcaaggtcttctgggagaatcacgacccgacccaaggtatgcgccaggggaacgaccatggcactcagtaccgctcggccatctacccgacctctgccaagcaaatggaggcagccctgagctccaaagagaactaccaaaaggttctttcagagcacggcttcggccccatcactaccgacatccgggagggacagactttctactatgcggaagactaccaccagcagtacctgagcaagaaccccaatggctactgcggccttgggggcaccggcgtgtcctgcccagtgggtattaaaaaataattgctccccacatggtgggcctttgaggttccagtaaaaatgctttcaacaaattgggcaatgcttgtgtgattcacaatcgtggcatttaaagtgcacaaagtacaaaggaatttatacagattgggtttaccgaagtataatctataggaggcgcgatggcaagttgataaaatgtgacttatctcctaataagttatggtgggagtggagctgtgcggtttcctgtgtcttctggggtctgagtgaagatagcagggatgctgtgttcacccttcttggtagaagctaaggtgtgagctgggaggttgctggacaggatgggggaccccagaagtcctttatctgtgctctctgcccgccagtgccttacaatttgcaaacgtgtatagcctcagtgactcattcgctgaaatccttcgctttaccaaatctagacatacataagggactttctctcccttttcagccctctctgtgcagagaaaagatgtgagtccgcttgatgaattctaatgctttgcttagagctatgagaaatgtttgttttaataaaaacctacagtccaataa

SEQ ID NO: 17635 - DNA, 1292 bp, Homo sapiens
tgctggcagcagaatctggggaatgcagtctgcgagctttccgcctgtgcggtacgagggtgagctgagaatgtcagggaccaaggcacagtatctgatacacacttttaaatatgggtgataataataggacttccttcccgtggctgttgtgaggctaaaattaacatgtgtgaagtctttgcacagatcatggcatatggtagaccctcaataattgctagtttacaaaaaattgtcaaaactgacattagaatggctcctcattctcattcctaacccctgcaagaaaactggctgcctctgagctggctggtctaacccacccgtcttggcggggaccctgccccttgtcgttccggacctgctgggcctcaagatcctcgatcggccttctgctggctcagacggcgaaacagagatgcaggaaataagtgacgttgctcaagaaaaacctgacgcagtgaatcatgctgaatattaatattggatgcactgtgcttggcagacttgaagacttcatctcacatggaccagtggacagtcagagtgtggttctttcagagcacggcttcggccccatcactaccgacatccgggagggacagactttctactatgcggaagactaccaccagcagtacctgagcaagaaccccaatggctactgcggccttgggggcaccggcgtgtcctgcccagtgggtattaaaaaataattgctccccacatggtgggcctttgaggttccagtaaaaatgctttcaacaaattgggcaatgcttgtgtgattcacaatcgtggcatttaaagtgcacaaagtacaaaggaatttatacagattgggtttaccgaagtataatctataggaggcgcgatggcaagttgataaaatgtgacttatctcctaataagttatggtgggagtggagctgtgcggtttcctgtgtcttctggggtctgagtgaagatagcagggatgctgtgttcacccttcttggtagaagctaaggtgtgagctgggaggttgctggacaggatgggggaccccagaagtcctttatctgtgctctctgcccgccagtgccttacaatttgcaaacgtgtatagcctcagtgactcattcgctgaaatccttcgctttaccaaatctagacatacataagggactttctctcccttttcagccctctctgtgcagagaaaagatgtgagtccgcttgatgaattctaatgctttgcttagagctatgagaaatgtttgttttaataaaaacctacagtccaataa

SEQ ID NO: 17636 - DNA, 1187 bp, Homo sapiens
agagtgagagagagaaagagggagagagagaggcagagggagagctgaggaaagaaaaaaaggcaagacttggcacagctcagtcaaatcagcttcttttgtctgctttctcggcttgagcttcaggaaagaaaaccgtcctggggtacagaaaaactcagaactttttggttttcaaacttagaaggctttttaagtctcttgggctatttgaaagtgttggtacatacaatgacgtttagtcaccagtattaagggaaataaaagcctttttcaaaacgaagcttccatagtgtccatgcatttgggaaatactatatttgattttttgcatgtatgattataccatgagagacaggattaatatagaagatggcaaggcaaatttctaattagagggaatattaattttctacaaaataaagtttgttcatcaatacaaacctgctttcaaatcaaatcagaaagacatccttcggaatgtgttcagaaccaattagtgacaacactgaagaccagaaaggcaagctgaagacaccagacttcgcttgaagggcaaacaagaaatccaaacatcatgtcaatggcaacagaacagtcgaacctttcccagagggaacacagatggctgtatttggaatgggatgtttctggggagctgaaaggaaattctgggtcttgaaaggagtgtattcaactcaagttggttttgcaggaggctatacttcaaatcctacttataaagaagtctgctcagaaaaaactggccatgcagaagtcgtccgagtggtgtaccagccagaacacatgagttttgaggaactgctcaaggtcttctgggagaatcacgacccgacccaaggtatgcgccaggggaacgaccatggcactcagtaccgctcggccatctacccgacctctgccaagcaaatggaggcagccctgagctccaaagagaactaccaaaaggttctttcagagcacggcttcggccccatcactaccgacatccgggagggacagactttctactatgcggaagactaccaccagcagtacctgagcaagaaccccaatggctactgcggccttgggggcaccggcgtgtcctgcccagtgggtattaaaaaataattgctccccacatggtgggcctttgaggttccagtaaaaatgctttcaacaaa

SEQ ID NO: 17637 - DNA, 539 bp, Homo sapiens
ccagtttcaaacagacccacagcgtccaaaccagggcccccaacatgcacttgggatggcaggggtgtgggggtagagtgtaagttactgatttaaaaatctgatataaacctgatttcagttcccagtcaactgaggcacagcaaggtaagtccctgcccagcgtcactccacttggaatgcggagagcccggcctaaaggggacccactgcacatcccaagccacgcgtctgctcactgcagccctggcccctcagtgccacccctcgcaggtgctgtctctctagcatgggagctgatggcgcctttctgtgtccccacagttctttcagagcacggcttcggccccatcactaccgacatccgggagggacagactttctactatgcggaagactaccaccagcagtacctgagcaagaaccccaatggctactgcggccttgggggcaccggcgtgtcctgcccagtgggtattaaaaaataattgctccccacatggtgggcctttgaggttccagtaaaaatgctttcaaca

SEQ ID NO: 17638 - DNA, 484 bp, Homo sapiens
gcggactccctggcctgctaaactacccttgaaatacagtagcctccaaattttcagggaaattgatttaagtaatggtcaggcctctgagcccaagccaagccatcgcatcccctgtgacttgcacgtatatgcccagatggcctgaagtaactgaagaatcacaaaagaagtgaatatgccctgccccaccttaactgatgacattccaccacaaaagaagtgtaaatggctggtccttgccttaagtgatgacattactttgtgaaagtccttttcctggctcatcctggctcaaaaagctcccccactgagcatcttgcgacccccactcctgcccgccagagaacaaaccccctttgtctgtaattttcctttacctacgcaaatcctataaaacggtcccacccttatctcccttcgctgactctcttttcggactcagcccgcctgcacccaggtgaaataaacagccattttgctc

SEQ ID NO: 17639 - DNA, 284 bp, Homo sapiens
tggcaagtttcttaccctctctgagccttgagtacaacactgaagaatgttggatgatcacttacatggtgcagttgtgaataagatatcacctttagcacattatcagcgtccaatgattaatagtagtagttatttgttccctttgtctttccaggtacttcttggatgtttcagaaaacaactacaagaatcttttcattttgaggactgtcctctgaatctctgatgaaagcaaataggagatacatacccatggaacaatacaaataaatagataacat

SEQ ID NO: 17640 - DNA, 445 bp, Homo sapiens
ctacctgtagagtctgaaatgccaaaaatggcaagttatttttacatgtagttcaaaggcaagccttagaaatgctgtaacttcatcaatataatgtcacaaatctcttgtgtgtttatttatatcaaatcagtacaaatgatttcaatcagtagtcaagaagacctttttttagggtgggtgtgttggcttatgcctgtaatcctagtactttgggatgctgaggtgagaggattccttgaggccaggagttcaagaccagcctgggctattaatatagtaagacccatctctacaaaaaattagctgggtttggtggtgtatgcctgtattcccagctactctggaggcttgaggtgggtggattgcttgagcccaggaatttgaggctactgtgagccatgatcatgccactgcaatcagcgagatcctatctctgaaagga

SEQ ID NO: 17641 - DNA, 148 bp, Homo sapiens
cacacctgcccctgatgtcattgtagccccacgattgtagtgcccgtatccactctattgggaagatggcaaccatggggtgaaggtccttcacaggggagccaggggcagcctgagtctccctgagccaagaggctgggtgggggct

SEQ ID NO: 17642 - DNA, 182 bp, Homo sapiens
gacggagggcaccgtactctgggcactagcttcactgcctactaccccgaggtgccttagctcgtaagcgtctgtggctcaggccctgtgcgcctcgcagggacccgctgctcgggacccccgtctcagcggctcttctgtagctgggcctagacggtccgctgcctccttgggcctgaagg

SEQ ID NO: 17643 - DNA, 627 bp, Homo sapiens
caagtagctattaccaatgcacagctctgaatgactaaatatctcaatcaagaatatcgacaataaatccaggagctgtggctcaagctctgaatgactaaatatctcaatcaagaatatcgacaataaatccaggagctgtggctcaagcctgaaatctcaatgcctagggaagctgaggtgggaggatcatttgaagttaggagttcaagaccagcctggccaacagtgataccctatctctacaaaaaacaaaaataataaccagagatggttgtgcacatttgtagtcccagctattcagggaagctaaagcaggaggattgcgttgagcccaggggaggacgcagtgagctataatcctgccattgcactgtagcctgggtgacagactaagatgctgtctcaaaaaaaaaaaggaaagaaaaaaaagaaaaaaaacccaacataacaacagaataccgaatacccataataagaaatgtaagattctccatgaactccacatttttgggcttagtaacttgactcttaccacctaaattcaactcatttaaaactataggccaggagcagtggccacacctggctaatttttgtacttttagtagaaacagggttttgcca

SEQ ID NO: 17644 - DNA, 451 bp, Homo sapiens
gtaagatggaatcaactatgtccgatttctctgtcataattttgcaaaggcagtttcacaattagaaaaatgtagaatttgctgcattctttaaaacagctggtggaagtctttaaaaatcattgttgccttggcaaagctgctgggattataaaagaaaaaaaccaaaaagttaaacaaacaaaaatcattgccatggaaaagaagggaggatgttctagattttaaaagattaaggagatagtagccacaggcaatttgtatatattgattaggtactgaattgggggaaaaatggctttaaaaatatgtctggggactgggcagtagctcatgtttgtaatcccagcattttggaaagctctggcgggtagatcgcttgagtccaggtggattccttgagcccaggagttcgagatcagcctggccaatggggtgaaatcccgtctct

SEQ ID NO: 17645 - DNA, 284 bp, Homo sapiens
tgtgactattttctctcattctgtagggttgtctgtttactctgttgtttcttttgttgtacagaagctctgtagtttaattaggtctcacttttcaatttttgttgtcaactttgtcaaccatcaggtggtcgtaggtgtgtggctttatttctgagttctctgtcctgttccattggtctatgtgtctgtttttgtaccagtaccattctgttttggttactgtagtgtgtctgtggtttctgcatccatggattgaaccaattgtggattgaaaatatttg

SEQ ID NO: 17646 - DNA, 180 bp, Homo sapiens
ttgagaacagattcttaaaaataccctatctctgtagtgtgtccttgttcttatatatggccctgagttttgtgatcacctgaataattctaacatacgtttggctggctgactgtggagatacatttgagttacatgtttatttttaatttaaggtcatcattgttttaaaggagctgt

SEQ ID NO: 17647 - DNA, 448 bp, Homo sapiens
ggagctgcacttcagagagtcccactgtaatctgttaatagaatctgctttaaatgagtcactccttagactggcaatgacacccagcttagtctgtaaaatcaggaatctttgtgttggctgaaggaacttagtaatcttagttgaattcctcttccccatgtctttcaaaaccagagcactgggtcgaacctaacccacaaaataattcgtccaaattaaattgacttttttacataacatcagcaccaccccttacacttttaaagttaaagaccctgttgatcaggttacctggaaatttcaagtgcatctgaccagggattatcaagctccttgtgacatctgtttctgatgctgtgaatgtgatgtcaccacaaatagaggattctgaattttgctggtactaatgctgagtggtgacttattggggccttgctcatgttac

SEQ ID NO: 17648 - DNA, 655 bp, Homo sapiens
aaagtggaactgtgtagaagagaggatatgtcacctccaacgtgaaaatgcgtggcttgtacagcaactagatgacgttcatcagaaagaggatcataaagagatagtaactaatatccaaagaggctttattgagagtggaaagaaagacctcgtgctagaagagaaaagtaagaagctaatgaatgaatgtgatcatttaaaagaaagtctctttcagtatgagagagagaaaacagaaggagtagtggttgtgagacaacttcaacaagaagtggctgacagcgtaaaaaaattaacgacgttagagtctccactggaaggtatatcacgttgtcatattaatttggatgagacacaggcctcaaataagaaattatttcaagtgaaaagtcaaatatgtatggaatttaacatgtcaacagttattctgtagctagttgaattatataacgtgttttaggatactaattttggcagaagcttgattttttattttcattataatgaatgatttccattttactatctttataatgtactatttttttatattgtgactttcattataccattttgaaaaaccattgcataccttttctcttacaatatgtacccttggaaaagttgagaattatacatcattcctcataga

SEQ ID NO: 17649 - DNA, 466 bp, Homo sapiens
acagatgaatattaaatgtggcttcactaaactctacatgcttagctcatttgatctcacattaggtcatctagaatttgtcagcctattttggtgtgcatgtttatgtttaattttaattcagcaggcaagttatatggtatataggtatctcagtagacatgttttggccaagattctcttccccatcctgaagctcgtggaacatctaaaaataggactggcctggtcccatgatactactaaatcacatgtcaggttagcctgtgttttcctctgccctcctttgcttctttgtgcctttgctaccatctaaaatatagctgctgagtatttttccagaattaggttctcctttgggtatattcacttgtattttttaatatactttactttgttctgtttttctgaacataaaaatatatggggcttcccaattaaatggcagaaagttaccaactcttga

SEQ ID NO: 17650 - DNA, 460 bp, Homo sapiens
gaatacagatatcttttccatatactgatttcctttgttttggatatatacccagcagtgggcttgctggatcatatggcagctctgattttaggtttttaaggatgggttttttttttgcaatgagaataaaaattttccatgtataagatcagtgtctttgaactttgtttatatcctttgcccatttttctattgagttcttttttctttttgagacagggtttattgcccaggctagagtgcagtggcatgatcacagctcactgcagctttgatctcccgggctcaagtggtcctcccatgtcagcctcttcagtagctgggactagaggcacatgacatcatgcctggctaatttcttgtatattttgtggagatggagtcttcctattttgcccaggctggtctccaggtcctgggcataaatggtctttctgccttgacttcccaaagtgta

SEQ ID NO: 17651 - DNA, 382 bp, Homo sapiens
tgtgagttctgccaacctattatcctgacaagaacgacaacaggatcattggtggcaattttaatggtgctttgtagttttcagagtttttaaagtgtatgttggtttattcttagagtcattctcacaggattatttgggagaggaatttagcagatgatgttgtgaaaatccacttgtaagagaatggaaaggaattggtggtgatgggtgtaggtagatcacatatgagagtgacagaaagtagctgagcacaggaaagtgcatgattttagttctagctactcagaaggctgaggcaggaggataacttgaggccaggagttcaaggccagcctaggcaacgtagtgagaccctcatctctttaaaacaaatcaaaac

SEQ ID NO: 17652 - DNA, 174 bp, Homo sapiens
ctgagaagtaaaatcattcaaagtggctttaaaaactaggtaaaacactgactatgaaaatgttcttttactttgtaagaaaaagaaaaaaaatacctccatttttcacttgtacttcacatttggagccctaaaaacatataatttatttatcaaagaaacagtatactaccc

SEQ ID NO: 17653 - DNA, 462 bp, Homo sapiens
gtctccaatttactttcaaatgattaagaaaaaataatttgcaagtacatagagaaaaagtgtgaaaaatgtaaacaattggtgagtctgaatataggttacatgggtattcctagttccttgggctattcttgaaccttttctgtaactttgaaagtatatcaaaataggccaggcatggtggctcatgcctgtaattccagcactttgggagcccaaggcgggcagatcacgaggttaggaggttgagaccagcctgaccaacatggtgaaagcctgtctctactaaaaatacaacaacaaaaaaagaaaattagccgggcatggtggcgcatgcctgtaatcccagctactcaggaggctgaggcaggagaatcgcttgaatccgggaggtggaggttgcagtgattcgagatcgcaccactgcactccagcctgggggacagcgccaggctccatctc

SEQ ID NO: 17654 - DNA, 440 bp, Homo sapiens
ggcatactcagccctcgaacacaggcagtcagcctccagagcccgtgctcttactgagctatgctgaactggaccaagtggtaatgatttcatggtagatctagaacaagaccagatatcttcaacaaaacaaaaatgtatttgctttgctattgcctagatttacttaaatccttttctgtttcaagatctgtctttactttgtcattaaagattatttcagtggcggtattggacagtgattttttttttgagcacaggatgacactgttctcggctgaattgctcttttaaagaaaggtgcaagaggttgggaaggctgattgtggtgttgtagcacttagttccttctctcaggaatgccttccagtcttgggctcagccatcctttggcggccagagggacactgttcttccctgttactctctctactcaagtc

SEQ ID NO: 17655 - DNA, 748 bp, Homo sapiens
gcataaaacggcaatgagctcagtaaacaacccccttcccgtgatcttcgtggcttcccgcccagacgtgtgaccaagatagcaaggagcagtctttaaggcgacacggcagagaggcagaaaaagatgggccttaccggttagttaagaaaaaaagaggacctgttgcctgtccctctagctttgaactacaaagtggaggggaagtttgtctggattttcctgtagaactgagggcaggacatgaggctctgcctgcagtcagcaacttggaatattcagacttcagaccagcatcacagattataaccctccgtaaatcatctgcatcccagctcccatcaaaagccagcctgaaggacccatggacacgtgactccagtgttctcaacaacatcttaagatcaagttggtttgcacaacatttgcatctacttgggacaaagcaagaacaataagggcaaaaaaaaaaaaaaaaaaaaaaaaaaaaaatttggggggggacaggggaccattcaagaggctttgagagaacaactggtggggaccgcaggcccagaaggataagagcaacacgtggccacagagggaccacgggaaaacacgggcacagacacagggcggggatatcaacacaataaaaaagccgggcggaaaacgagccttgtgaaaactcaaagggggatcagagaggaaaaggggaatataacagggggatccaaggaagcgaataaaattgcccggcggg

SEQ ID NO: 17656 - DNA, 760 bp, Homo sapiens
ctgggagcggggagccagcggggtgcggcgccggagtgcggggagaaccaccaggcgccggaattggggagcacgtggagggggcagcggctccagccccagaccgccgcgctctgtcactttgcattaagaaagcttccggggaatgcacacggcctggccgccgccttcgtgcagcccgccctgcaggtgcaggaagaaaagaataatcgcacccgtttctcaggtgcttacttcaccatgtccgatccggacatgaggctctgcctgcagtcagcaacttggaatattcagacttcagaccagcatcacagattataaccctccgtaaatcatctgcatcccagctcccatcaaaagccagcctgaaggacccatggacacgtgactccagtgttctcaacaacatcttaagatcaagttggtttgcacaacatttgcatctacttgggacaaagcaagaacaataagggcaaaaaaaaaaaaaaaaaaaaaaaaaaaaaatttggggggggacaggggaccattcaagaggctttgagagaacaactggtggggaccgcaggcccagaaggataagagcaacacgtggccacagagggaccacgggaaaacacgggcacagacacagggcggggatatcaacacaataaaaaagccgggcggaaaacgagccttgtgaaaactcaaagggggatcagagaggaaaaggggaatataacagggggatccaaggaagcgaataaaattgcccggcggg

SEQ ID NO: 17657 - DNA, 724 bp, Homo sapiens
tctctccctcacaggattggcatcttcttctgccccctgctgccctttatccaaatgattatgcttttcatcatgttctactcaattctcagaagaaagcgatcggccccgaggcaggaaggccggctccggtgcagggagcgccgcctgcgggctgcttcgggccagggtcgacccgagggccagcgcaagcagcggcaacaggagcgccaggaggacatgaggctctgcctgcagtcagcaacttggaatattcagacttcagaccagcatcacagattataaccctccgtaaatcatctgcatcccagctcccatcaaaagccagcctgaaggacccatggacacgtgactccagtgttctcaacaacatcttaagatcaagttggtttgcacaacatttgcatctacttgggacaaagcaagaacaataagggcaaaaaaaaaaaaaaaaaaaaaaaaaaaaaatttggggggggacaggggaccattcaagaggctttgagagaacaactggtggggaccgcaggcccagaaggataagagcaacacgtggccacagagggaccacgggaaaacacgggcacagacacagggcggggatatcaacacaataaaaaagccgggcggaaaacgagccttgtgaaaactcaaagggggatcagagaggaaaaggggaatataacagggggatccaaggaagcgaataaaattgcccggcggg

SEQ ID NO: 17658 - DNA, 783 bp, Homo sapiens
ccttgtatgtacgggggtagtggctcatgccgtgtgatccagcactttgggaggccaatgacgggcggatcacttgaggtcgggagttcgggaccagcctggccagcatggtgaaaccccatctctactaaaaatacaaaaaaattagcccggtacatgcaagggccccgaggcaggaaggccggctccggtgcagggagcgccgcctgcgggctgcttcgggccagggtcgacccgagggccagcgcaagcagcggcaacaggagcgccaggaggacatgaggctctgcctgcagtcagcaacttggaatattcagacttcagaccagcatcacagattataaccctccgtaaatcatctgcatcccagctcccatcaaaagccagcctgaaggacccatggacacgtgactccagtgttctcaacaacatcttaagatcaagttggtttgcacaacatttgcatctacttgggacaaagcaagaacaataagggcaaaaaaaaaaaaaaaaaaaaaaaaaaaaaatttggggggggacaggggaccattcaagaggctttgagagaacaactggtggggaccgcaggcccagaaggataagagcaacacgtggccacagagggaccacgggaaaacacgggcacagacacagggcggggatatcaacacaataaaaaagccgggcggaaaacgagccttgtgaaaactcaaagggggatcagagaggaaaaggggaatataacagggggatccaaggaagcgaataaaattgcccggcggg

SEQ ID NO: 17659 - DNA, 443 bp, Homo sapiens
ttatgattactgcaattcaaaagtcataataaattttaaaacaaatcctcctgtacctgttgtggtgcatgcagaaacttttcctgttcaacacacttatatggcactatatagggatataccaaatagctcaggtacatagtgaatacaactttaacacttatattgaaatgctaatcttacttgccaatattagtggcacattagcataatttaacttttataaaattatggaaaacagtttaaaattattctccctaatattagcaaattgcattaatggcatgtaccgtgtgccagtttgtttccaaataaacaaaatgtaccttgatatgccacttcagagccagcagagggagctcatacttttttattgttttcaacttactgaagaaaatttgcttttaaaagctactgtgttataaccaatgagaaccaagaaa

SEQ ID NO: 17660 - DNA, 946 bp, Homo sapiens
tgagactccgtttcaaaacaacagcaacaaccacaacaaaaaagaaaaaaacaaaaacaacaacaaaaaaacaaaaacgagataagattccttccctgtgtctgcccgcgagctgtctggaaccatgcaccagtcaggaaatggcaacttgtggcagcccatcttggggaagaacaaactggatggttagaagggacagaaaagatgcagacaggtttcagggaaagatggtgtccacacaaaggcccatgtgttaaagaggccaaatactagctcagaatcagcagctaagaaaaggcactttctggaagcctcaataaatcaggcaaaccaaatggcagcaagagaagtaggcataggtgaagcaggacttccaggggcctggagcctaagactttgaagagacaggagaaaactgcagagtcagtacaggatggaggagagttttttcatttcaaccacaaaagtctcatttgtctccttttcgtgctcacaccttatcctgagatctccaccagccaggaagtttgcctgagctttattgctcttgttttacaaaaaaatgcattttcactttgaacgtacaaaaattaaaatggtaacttaaaaatatattggagaaaatatctaagggagcatccttagtccccataatatcttatttgatcttcacagaccttggttgggggatagagagggaatattcctagaaagaataaataataacttttatattatattatatatatataaatgggccaggtgtggtggctcatgcctttaataccagggctttgggaggctgaggcaggacgatcacttgaggccaggtgtttaagaccagcctgggcaacatagggaggctgggtgtggtggctcacgcctgtaatcccagcactttgggaggccaaggcaggtggatcccttgagaccaggagttcgagac

SEQ ID NO: 17661 - DNA, 288 bp, Homo sapiens
caaaggcctctctcttccccgattcggaagattggcaaacccaagcctggatgtgccaccaggtgggaccccctccagctccccagtgctgagtgcgtcgtccctgtcactccatgggcagctcagctgagcaaaccctttctccataggcaagagaaaggagcaggtgctgcagccagggccccccagggtaggggcagctgaggaaaggaaaaaacgaatcctctggggaaagacgaagcgcttcagctcctagaggacacagtctctctgaagcaaggacctcag

SEQ ID NO: 17662 - DNA, 377 bp, Homo sapiens
ctacgtggaactgtaagtccaattaaactgctttcttttgtaaattgcccattctcaggtatgtctttatcggcagtgtaaaaatggactaatacagccctacatccagtagcttgtgacagcttgtttctaagtcctgggggcagccctgctgccactgggctccaggacagctcacagtctgtaggggagggagttctaaagtggtgccttgccatagctacttaagtgtcagggaacatgaaggacccaggggaagtgttctctcttgggcagtgcatggtacaatctcccggcagctccttgtgttagtttcagggctcacgagggttcaggagctcttcagtggcctggtatcgtagggatccatggtgata

SEQ ID NO: 17663 - DNA, 354 bp, Homo sapiens
atagaagtaattctgattttccaaatatcaaaaatctcgtaatgtccaattcaataatattgtaaacatttgtttttattaagaaaaatgtggctggacacagtggctcacacctgtaatcccagcaatttgggaggccaaggcaggagcatcacttgagcctgggagtttgagaccagctttcacagcatagggggacctctctataaataattaaaaaaaaatagccaggcatggtggcatacacctgtgtattccagctactcaggaggctgaggcaggaggatcacctgagcccaggaggtcaaggcttcagtcagctgtgatcacaccactgcactccagcttgggtga

SEQ ID NO: 17664 - DNA, 464 bp, Homo sapiens
acaaaggcctctcctcatcataccaatagggaaggaagaactgggctcctgtgagtggtggtggtctcctttccctccacgatgacagtggaaagagcagtgccactgcctttatttctcaaatcttgaaggtacaagttaaaaaacaaaaaaaaagttcacactaagagaccagtttatgccttgtatgttgtagactcagtcatgttgaaaatgatgctttattgaatgtttgccatgagaagagttcatggccctgtctcaacaatggcgccccctttggtcaggtgttgatatatacactgagaacaaggcatttaacccggtaactcatttaggtagagaatagctggaaataaaagaatgttttggaattttgtctcttggtcgggggagggagtcttttcctcttaaataattaaaataaaaaacataaacaaaatgtttcatttcctctcaaacac

SEQ ID NO: 17665 - DNA, 410 bp, Homo sapiens
ggctagggattgcttttgtcgccatctgctggtttccaccggtttcttcacttcatcctgtgtggaccatcttttggtcagcaggactgtgaccagaagacaagtcctgccagtctcctacctcatttccaagagacaaaaagataggatgtgcagcggaatagaaaaaagacttagaaaacatattttaaacatctaatgaacatgttgtcagacacccagaaggaggagtgagagaatgggcagtgacaaaattgaagatggagtggctggaaagaggaccttcacagcaccacccacgagtaaggggctgctgtaaagagacagaggtggtcgccatgctcctgcagcccagtgggttcctttttggaatcagagaatcaaaataaaagggccgaattccacctcca

SEQ ID NO: 17666 - DNA, 291 bp, Homo sapiens
tcagatattctacatggtccatggaagactctgtgggccgcagaagcccatagctgcatacccttctattttcctcttccccatttcactcttttaagctccctactcctattccctatgatcactttccaaaataaacggcaggtgtgctagctgttgtcttagactctgctttctggaaactatttttcccctccacaagaaattatcactgtgaatattacaggaggagaaataaaataagaataaatcagtggtttattttcaggttcgaataaactctttctaatg

SEQ ID NO: 17667 - DNA, 380 bp, Homo sapiens
gcaaaacacaaataatacattgtttgttgtatatttttatgactacgtataggtactaaaagtataaaaagatgtgcggaagtcataaatagtgaaattagggtattgattatcaaatgaatgggccaggaaaggatccacagggagcttcaagtgtatcttgactgttttatttcttaagctaagagataggatttgcaatattatctatacttttttaaactcctgggaattagctgggcatgatgactcatgcctgtagtcctagctgcttgggaggctacggtgggaggattgcttgatcccaggagtttggtgaactatgatcacaccactgtatcccagcctgcatgacagagtgagaccctgtctcttaaaaa

SEQ ID NO: 17668 - DNA, 304 bp, Homo sapiens
ataagggcatctgctcttacaagaacttgaaacaaagtctgcacctatgcatgatgcaaacaactcaaaaagcacaaatccagagcaaagggggtttatgtggaaggtgcaattagagcaaaaaaaatccaaatttatttctgctcttagctatctcaaatcatactttcgttgtggtctcatcagttgtaaaccaaataattatttctttgtgatgtataaaggtgagttccttcaagcttcattggtaataatagtaattatgatgatgataataataaaaattatcttccttattctttcg

SEQ ID NO: 17669 - DNA, 271 bp, Homo sapiens
acggtttgaacgcaggagatggaggttgcagtgagccgagatcgcaccactgcactccagcctgggcgacacagtgagactttatttcaaaaaaacaaaaaacagattgttaaatcatgtaacttcatctcagttgtgtttggaatttttcagcttaacattttataatagtagcccctcctcttgaattgaagatgagtcattaaagcttcattcatttcttgagactgttactctaccaatgctaaaatcactgcactttcaataaggc

SEQ ID NO: 17670 - DNA, 1026 bp, Homo sapiens
agcaacatcctcagcagatgccagggaggtacaggacttagatttcagtggcttcctggcccttccacctgcctccaatccagcattttataggtcacattcatgacattcctcagggtcaggaagtaaaatatttttatacattaacttactaaatcctcatagtaatgctatgagatagatactataactcccatttccctgataaggcaaatgaggcctgaagaaggcaagtggctggctgggagttaaattaggctacttagtgatgggctgcaatttgagatttcatactagatccttcctcttagccgcttgtttcttctgcttcctttccattgttgtgttcacaaaaatgccacttcacaggtttgaaattattctctttttagcctgaaatgttctttacatttcttgataggaggattttattttatgtctaaatacattttcttgttcacttttgtcttgatgaattacaagtaacagtttttaaattccatgtcttaatgtttaggatatttgcatttttatgttttattattaagggaactgtcaatattatgttaaacagacatgagcatcgaacgtgttgtagagcaaatttcagagaaatcacttcttaaattatttttgtcaggacaaatcaaagaattgtataagataggtaattgatctataaactggtgaaggggtcattttaaaatccaggctaatttaagttagattcttacttgacttacagtattgtgttggctttggttcatttttttcaccttctcctggtacataaaaagaagaaagattcttggcttaaacaaatcgctaaagttaatcttgtatgaagaagaaaaaatgaggacatcatttttcaatttgctaaagagttagcctcaatttttaaaactttttatcttggtatatagatatatattttttaaatgctcacttgcatatcttagaaccaaaggcctaataacaaaaaataaacacttggttctttcagaagaaaaatcacagatggca

SEQ ID NO: 17671 - DNA, 354 bp, Homo sapiens
tgaggtcattcagcttttggtagtaagttcagcttctgactcagagattatagctcttgccaccaggccttgctatgtttcttagccatcttcagatttttcataatattgcaagtctgaaagtttgaacgctatagattgtttaaaaggaattctgaatatatgttttaatatttgctatatagtcaacattaagttaaaatgaaatttaggaaagcaaagacaaatagcattgctaaaagacatgaagaatttgtttaatttgggaaaatgctttttttctagattcagtgcttttacctaatattaatatttgattagcttaaaataaacattaattgtccagcccattca

SEQ ID NO: 17672 - DNA, 489 bp, Homo sapiens
aatctgttgatatctgccacattcttatttaatctttattttcagtatcaaatcctaagatttttagtttttccatacaagagtactcaactctttgatcatgtagtgccttcttggcatcttctttaggtgcattttatctttcttaagaaagtatcccagttattgtcacaccaggcaagattttatacagacaaaaggcatagtttgttttgttttggtattgatcctctgctttaaaatactcgacatcttggggattcttaaggtcttccctgtcaatttcatgggtcaaaattctcagttcttttacaggctccttttcttttacccaagtgtaaaatggtggaattccttgaagctctgccctaggctcttttcctttctctctatgcttctgttatagtttttgtttttgttttcaaatttacagctcaatttgagttttttccctgagttttagacacattattgaactgactatgtgac

SEQ ID NO: 17673 - DNA, 433 bp, Homo sapiens
cctggctcagggaacttctttaccctctcaggcagtgccagcagagaccaatgggagctcaaaggcactagataaacaaagcaggctaaataacactgcaaaggctctgtaaattagtctgctattggaacgatagcctagaaaagtagaccaagatactcgtgctaaaactaaacagggtggctaactgttaaaagatttaatagaagcctatgttagagacttctaacataatagacaaaatgttcatgatataatagcaaatcacttgtcataccatcaacaaaggaaaccacaaattgaatcagaaaagacaatcaacagtcaccaatacaagatgaatcagatgttggaattttctgacaaggattttaaagcatccatcataaaaatgcttcaaaatcaattaaaattatcctgaaacaaaagatat

SEQ ID NO: 17674 - DNA, 494 bp, Homo sapiens
aaagattttaccaatttaatttaatgaaaacttgaaaaaaaaagcctcattttaaaacaagctctcttaccattctcacattttagtttagaggttaaaaaatagaccagaattctggaaatagtatatcagaataaaattgagatatttctgatttatttgaggatcatcttgagaagggttagatttttaactcattcagagggcctaatatttaaagcaggatgattttatgcttagacaggggacatggtgaaatggcatagcaattgctcttcggtttctgttctttttctttatgagacaggtatgtttggctcaggcagcggctgtttgtttttcctctgcttatcactgtacatttttctatcaaatgctttggttgcttgttttattgagatccttttttggttttcttagcaataggaatggaaaacctcagaacgctggggtaaatttaaatgcaggtatttttaatcttttgataatgaaga

SEQ ID NO: 17675 - DNA, 716 bp, Homo sapiens
acttccccaaaagaagctatgctcgggccttcccatcgtcccactcaagagctttcttcatattggtcccttggttgaattctgtgttctgaagaggcaagaattgaggttgctgcagacctgtatggattcgccaccagtaacaagatctcagaacactggaaaaatcgatgcacaaaaaaaaaaggtttctgttgctctattaggatgatgtctgaatttgaacccaccacacgaggggaaaagaagtcgacagagacttgagctgtgccgaaacaactgtgtcctgatttccccaggccctacacagctcatggtatacggaatgcaagggaagaactgcttgcaggccacagggtggacaaggccctggagctctgcgaaaccaggaaggcaccatggatggctctggcttccagaagtttaataggaaaaaaaaggcaaacaaacattaagacagaaaatgcatgcagcatatagcgcccacagctcctttttcttggcgtgcccctggtccctgcagccacttggccaagtgcagtgtctgtcttccttcaggtcctctattggtgtgcacttctcgagcctagggccacgtctttccatctttggacaaatgccagtgccttttctgacacattgtaagtgctgaatagatagtaaatggctgactgaacaaatgcaacttacaactatataatggaagatgtggaagt

SEQ ID NO: 17676 - DNA, 1674 bp, Homo sapiens
aatctctattttataaatgaaaaaactaaggccataaatttaagaaatttgtcagtgtctcaaagctaggaaatggccatctaatcccagagcctatgctttaggtcactatgatatatactactcctgtatcctcaagtaatgtatcatttagtaacactaagcaccctgcttagttttcatggatactgccaaattgccctatctcaagctttatacttgcaccatttaaagttttccacactgttggcaatatcagaagtgataaggctttgaaatgttcgccactttgataaagaggaaatgattgtttgttactgttatatacatgtatttttatcagagatgggttatgtacttttccacgtttgatagttggttgtatttctttagtgaattgatttttcttttcctttgcccatttttctgtttggatgtttgactttcttcttaatttgtaagagtatcctatgtagtaacaaaatccttttttaaaaatttttaaagaaaaagtatacacacaggacttttttttttctaattcaaaaaatacaaaggcatgcaatgaaaattaagtctgttccactaccacattttccagttttttgtgtatctttctaatgatagataccatatgagtattcaaatatacatacacatacacttaaaaaaaaaagatggcatatactaactgttctgtttggggctttttggtggtggtgtttgtttgacagggtctcactctgcctcccaggttggagtgcaccttgaactcctggactcaagtgatccttcacctcctccttccaagtatctgacactacaggcttgcatcactatgcccagcttatactcaccatagtggttctgtactcccttaaaatattctggaggccaggcatgctggctcacacctgtaatcccagcaccttgggaggccaaggtgggtggatcacctgaggtcaggagttcaagaccagcctgatcaacatggtgaaaccccatctctactaaaaatacaaaagtatccaggcgtggtagcacatacctgtaatcccagctacttgggaggctgaggtaggaaaattgtttgaacccggcagacagaggttgcagtgagccgacatcgtgccattgcactccaagcctgggcaacaagagtgaaaccgtctcacacacacacaaaaaaaaatattttggagctccttctatatgagtctctctctcttatctctctcaggatgtgtgtatgtgtttgtttctctggaaaaccctgactaatacagattagctatgtattaggtaatacataatgcctaatacataactaatatatggacaggaagttaatagactgactgtgccaccttaaaactcgtatgttgaagccctaacctccaacgtggtggtattgggagatgggccttttggaaggtaagtgtgtttgaatgaggtgaagaggttggggacttcgtgatgggattattgtccttacaagaaaagacaccagagagcttgttctgtctctttgggccatgtgaagacatggtgagaaagcagccagctgtaagccagagagtcctcaccagaacctaaccatgctggtgatatcctcatctcagacttctaacctccagaactgtgagaaaataaacttctttgtttaaaaaaaaa

SEQ ID NO: 17677 - DNA, 399 bp, Homo sapiens
tcaagaccaggctgggcagcatagtgagaccctgtctgtggtagtccgttttcatgctgctgataaagacatacccaagactgggcaatttataaaaaagagaggtttaatggacttacagttccatgtggctgcagacgcctcacaatcatggcagaaggcaaggaggagcaagtcacgtcttacatggatggcagtaggcaaaatgagagagagcttgtgcagggaaactccaccttataaagccatcagatctcatgagacttattcacatgagaacagcacaggaaagaccatgattatattacctcccactgggtccctcccacaatatgtgggaattcaagaggagacttgggtggggacacagccaaaccatgtcactgtctctaaaaaaaa

SEQ ID NO: 17678 - DNA, 429 bp, Homo sapiens
tcattgattcttacgggagtaggttattaccagacagacaagtgaaattcagtaggcagaatgataataaatgtcatttattaaatattaaaaagacaaataccttccctattttagaaataaggtaggcaaaggaactgaggagtggaagttgaaggccagctctgggtgctttgtgaacagagcccagttgacagtgggaagatttgtgctctatgctaaggacacgctctgtaatgacaatccactcggttgcactaagaatttaagagcatttatatgaatatatacaatttaaggaaagataaagagaaaaatttgctatcaactctgtgtagatttggaaaatggtgtcaaaggaacagtttcacctgcatttctttgtctagaaagttttattttattaaaaaatgtagtctacaaacgagc

SEQ ID NO: 17679 - DNA, 260 bp, Homo sapiens
actgtggggttattagtacatatatcaaattcatgaggctcctattcctgtatattgttacagagctgttcttgtatattgatgtttaatgatatggggccgaattgttattcaaataattacagcccattcctgattatttagatgctgattaactagtcaatgacttattccctttgacaaaatttcccaccctctggctttcctttgatgttaatgaggaagaggatccagttttcatcccatttggcaaggttggt

SEQ ID NO: 17680 - DNA, 174 bp, Homo sapiens
caaaacaacttgaaccaactgttcagtcactagagatgaaatcaaagactgcaagaaatactccaaattgggtaaatcaatctttggattttcataatcatgaagaaatgaaaggtctgatggatgaaaattgcattttgaaggcagatattgctatactcagacaggaaatat

SEQ ID NO: 17681 - DNA, 455 bp, Homo sapiens
tccctaagtgaaataggatagtaggtaaacatagttactattttgagatatgtaaactatttctatttttatttaatgggttgatatcctattttgttttgagcaaagcaaattttatttatgaaagctttcttaggtttatttctgacctctttttcacaccttttgttattgagatcttaagttcttttttttttttttagatcttaagttcttaaccattaatttttcttattacaaaggttgcaggaaccctaccttcaaaactggggactaacaattctaaggaatgtgttaataaattcgataaaacaaaaaggttggccaggtgccatagctcatgcctgtaatcccagcactttgggaggctgaggctggtggatcacgaggtcaggagatcgagaccatcctggccaacgtagtgaaaccccgtctctactaaaaatacaaaaatt

SEQ ID NO: 17682 - DNA, 444 bp, Homo sapiens
tttctatttttttttttttacattaaaaaatagaagaaagaaaaatcggccaggcacagtggctcatgtatgtaatcccagcactttgggaggctgagtcaggcagatcacctgaggttaggagcttgagactagcctggccaacatggtgaaaccctatctctactaaaaatacaaaaattatccaggcatggtggtgggcacctctaatcccagctactcatgaggctgaagccagagaattgcttgaacccaggaggtggaggttgcagtgagccaaaatcatgccactacactccagtcttggtgacagagcaagacaggaaagaaagaaagggaagggaagggaaggggaagagaagagaaagaaagagagggagagcaggggagggagggagggaaggaaggaaggtctaaacaacaaagagaaaatagacccccctc

SEQ ID NO: 17683 - DNA, 178 bp, Homo sapiens
ccaactatcaagagaaatttcaacatagaaatttatttagtaagttttacttgacacaggagccttcataaaacatacctgtgtatgttttctgttagttatgatatggaagaggatagtaatggagaagcataattagataaaacagtatgatctaataataaactgggaagaactt

SEQ ID NO: 17684 - DNA, 1112 bp, Homo sapiens
gagcttgcctgccagaagctcctctcccagcctgcgagcatttccaggctcttgtttcccatcagcctctgggtccaaactaaccacaggtctctgggtccttttccggtgtccttaaggttcttggactctgcatgtgctgccaggttgccagatttctaagaaggagtttgaagaggagaaaaggatttttgcatgtttagaaatcaaggttcaggagaatcttgacagtgaatgtgtctcattacattgaataacagctacaggatgttcgagagctgttctggcttttctggattctgtgcttcaccaatagaggaatcccatggagcattaattagttcttgcaattccagaaccatgactgatgggttggtgacattcagggatgtggccatcgacttctctcaggaggagtgggaatgcctggaccctgctcagagggacttgtacgtggatgtaatgttggagaactatagtaacttggtgtcactgggtaaggtcatctgcctgaaataatttagagtctcctctttgcatcatcagttttctgcactggaaattacagggctatctttgaagaaaccaggtgaatttcttctcccccttcccaagggcatgcttttatacttgctgggttagaaatgggtttgttaaacacgttgatcttccccatccctcagtgagctttacaccattctcgggccctccctgcaatcacctctctcctttaatggccaaggggctggatttgcattatagaacatttatttcataactatggcaaagaaaccagatttcataaattctgcaaatattatattgaatatctactcctggccagccttgtgctgagcactgtcaattgaatcatgaacaagctttgataacttgcccattttcgtgcagtttactttgtagtaaagcagaaacatcaaataagtaaatttataaatagataaatagtatgtaatgaagcaaattctttggaaaaggtaaacagcataagggaatagaaaatgatgaggactgacagggctaatttaggtaagacagtcggggaacgctttcttgaacagagatgtggagcctgggatctctatgtgaatatc

SEQ ID NO: 17685 - DNA, 1277 bp, Homo sapiens
gagcttgcctgccagaagctcctctcccagcctgcgagcatttccaggctcttgtttcccatcagcctctgggtccaaactaaccacaggtctctgggtccttttccggtgtccttaaggttcttggactctgcatggttccctttagcctgtcttcgggcctgccacaattaaatgaccgcaagaaagaagtctatgctaagccccataatgaacgtttcaagcaagaaggatgagaattttagatctggaagtgtccgcgggacaggatcttgtcaagacctgatggggaagttctagagtgctgccaggttgccagatttctaagaaggagtttgaagaggagaaaaggatttttgcatgtttagaaatcaaggttcaggagaatcttgacagtgaatgtgtctcattacattgaataacagctacaggatgttcgagagctgttctggcttttctggattctgtgcttcaccaatagaggaatcccatggagcattaattagttcttgcaattccagaaccatgactgatgggttggtgacattcagggatgtggccatcgacttctctcaggaggagtgggaatgcctggaccctgctcagagggacttgtacgtggatgtaatgttggagaactatagtaacttggtgtcactgggtaaggtcatctgcctgaaataatttagagtctcctctttgcatcatcagttttctgcactggaaattacagggctatctttgaagaaaccaggtgaatttcttctcccccttcccaagggcatgcttttatacttgctgggttagaaatgggtttgttaaacacgttgatcttccccatccctcagtgagctttacaccattctcgggccctccctgcaatcacctctctcctttaatggccaaggggctggatttgcattatagaacatttatttcataactatggcaaagaaaccagatttcataaattctgcaaatattatattgaatatctactcctggccagccttgtgctgagcactgtcaattgaatcatgaacaagctttgataacttgcccattttcgtgcagtttactttgtagtaaagcagaaacatcaaataagtaaatttataaatagataaatagtatgtaatgaagcaaattctttggaaaaggtaaacagcataagggaatagaaaatgatgaggactgacagggctaatttaggtaagacagtcggggaacgctttcttgaacagagatgtggagcctgggatctctatgtgaatatc

SEQ ID NO: 17686 - DNA, 301 bp, Homo sapiens
gagcttgcctgccagaagctcctctcccagcctgcgagcatttccaggctcttgtttcccatcagcctctgggtccaaactaaccacaggtctctgggtccttttccggtgtccttaaggttcttggactctgcatgtgctgccaggttgccagatttctaagaaggagtttgaagaggagaaaaggatttttgcatgtttagaaatcaaggttcaggagaatcttgacagtgaatgtgtctcattacattgaataacagctacaggatgttcgagagctggtaggtgtaaattgtttcag

SEQ ID NO: 17687 - DNA, 1048 bp, Homo sapiens
gagcttgcctgccagaagctcctctcccagcctgcgagcatttccaggctcttgtttcccatcagcctctgggtccaaactaaccacaggtctctgggtccttttccggtgtccttaaggttcttggactctgcatgtgctgccaggttgccagatttctaagaaggagtttgaagaggagaaaaggatttttgcatgtttagaaatcaaggttcagttctggcttttctggattctgtgcttcaccaatagaggaatcccatggagcattaattagttcttgcaattccagaaccatgactgatgggttggtgacattcagggatgtggccatcgacttctctcaggaggagtgggaatgcctggaccctgctcagagggacttgtacgtggatgtaatgttggagaactatagtaacttggtgtcactgggtaaggtcatctgcctgaaataatttagagtctcctctttgcatcatcagttttctgcactggaaattacagggctatctttgaagaaaccaggtgaatttcttctcccccttcccaagggcatgcttttatacttgctgggttagaaatgggtttgttaaacacgttgatcttccccatccctcagtgagctttacaccattctcgggccctccctgcaatcacctctctcctttaatggccaaggggctggatttgcattatagaacatttatttcataactatggcaaagaaaccagatttcataaattctgcaaatattatattgaatatctactcctggccagccttgtgctgagcactgtcaattgaatcatgaacaagctttgataacttgcccattttcgtgcagtttactttgtagtaaagcagaaacatcaaataagtaaatttataaatagataaatagtatgtaatgaagcaaattctttggaaaaggtaaacagcataagggaatagaaaatgatgaggactgacagggctaatttaggtaagacagtcggggaacgctttcttgaacagagatgtggagcctgggatctctatgtgaatatc

SEQ ID NO: 17688 - DNA, 353 bp, Homo sapiens
aagttcaatcatgctaatatacataaaagacaaacacggagccttctttggtcaactgggaaaggagatgaggagagaggtatattgttaagaggccttcagaagcaatgccttccaatcattcctgatttttttctgttttctttaatgcacatgtattctataattaggggagaaaatgttcaaaagcaagtccacaggtctagtttgaagggcaaataagctgggtgcagtggctcatgcctataatcccagcagtttgggaggctgaggcaggaggatcacttgagatcaggagtttgagaccagcctggccaacatgcagaaaccctgtctgtactaaaaatacaaaa

SEQ ID NO: 17689 - DNA, 1041 bp, Homo sapiens
cgtgagggccactaccccgaacccgctcacctgtctgccaatgcgcgccgcctcatcgtgcacctcctagcacccaacccggccgagcggcccagcctggaccacctgctgcaggacgacttcttcacacagggtttcactccagaccggctgccggcccactcctgccacagtccccccatcttcgccatacccccgcctctgggcaggatcttccggaaggtgggccagcggctgctcacccagtgccggccaccctgccccttcacgcctaaagaggcctcgggtccaggagaaggtgggccagaccctgactccatggagtgggacggcgagagctccctgtctgcgaaagaggttccctgcctggaaggccccatccacctggtcgcacaagggaccctgcagagtgacctggccgggcccgaggggagccggcggccagaggtggaggcggccctcagacacctgcagctgtgcctggatgtaggccccccggccacacaggaccccctgggagagcagcagcccatcctctgggcccccaaatgggtggattattccagcaaatacggctttggctaccagctcttggacggggggcgcacgggacggcacccacatggccctgcgaccccccggagggtgagcttcagtggagtcccggcccaactggtgctgagtggcgagggtgagggtttgcagctcaccctctgggagcaggggtcccctggcacctcctactccctggacgtcccgcggagccacgggcgcccccaccaccggacagcaccttcaccacgccctccgcatgctgcagagtatctagtgcccctgagggtcagagtggacccctgcatggtagtgccagggacccaggctccatttccattcctgtggctcccccagaggggctgtcctgggggagggctggggggcacacgggaggtgggttcttgccttgtggcatgactgttcaacccagactttgctgggatctcttcctttttcattaaagacaatttgaaatgctgtaggcca

SEQ ID NO: 17690 - DNA, 1208 bp, Homo sapiens
cgtgagggccactaccccgaacccgctcacctgtctgccaatgcgcgccgcctcatcgtgcacctcctagcacccaacccggccgagcggcccagcctggaccacctgctgcaggacgacttcttcacacaggtgggcggcggtcctcggcgtggggtccctggcgtggggtccctggcaggtgatgagccagagcctgccctgctcagccgagggaggccccgccctgtcccaggtaacccaggtgctcaggggctgggtgacctaagccggggataaccccaaatccccatccaaagggtttcactccagaccggctgccggcccactcctgccacagtccccccatcttcgccatacccccgcctctgggcaggatcttccggaaggtgggccagcggctgctcacccagtgccggccaccctgccccttcacgcctaaagaggcctcgggtccaggagaaggtgggccagaccctgactccatggagtgggacggcgagagctccctgtctgcgaaagaggttccctgcctggaaggccccatccacctggtcgcacaagggaccctgcagagtgacctggccgggcccgaggggagccggcggccagaggtggaggcggccctcagacacctgcagctgtgcctggatgtaggccccccggccacacaggaccccctgggagagcagcagcccatcctctgggcccccaaatgggtggattattccagcaaatacggctttggctaccagctcttggacggggggcgcacgggacggcacccacatggccctgcgaccccccggagggtgagcttcagtggagtcccggcccaactggtgctgagtggcgagggtgagggtttgcagctcaccctctgggagcaggggtcccctggcacctcctactccctggacgtcccgcggagccacgggcgcccccaccaccggacagcaccttcaccacgccctccgcatgctgcagagtatctagtgcccctgagggtcagagtggacccctgcatggtagtgccagggacccaggctccatttccattcctgtggctcccccagaggggctgtcctgggggagggctggggggcacacgggaggtgggttcttgccttgtggcatgactgttcaacccagactttgctgggatctcttcctttttcattaaagacaatttgaaatgctgtaggcca

SEQ ID NO: 17691 - DNA, 577 bp, Homo sapiens
cgtgagggccactaccccgaacccgctcacctgtctgccaatgcgcgccgcctcatcgtgcacctcctagcacccaacccggccgagcggcccagcctggaccacctgctgcaggacgacttcttcacacaggtgggcggcggtcctcggcgtggggtccctggcgtggggtccctggcaggtgatgagccagagcctgccctgctcagccgagggaggccccgccctgtcccaggtaacccaggtgctcaggggctgggtgacctaagccggggataaccccaaatccccatccaaagggtttcactccagaccggctgccggcccactcctgccacagtccccccatcttcgccatacccccgcctctgggcaggatcttccggaaggtgggccagcggctgctcacccagtgccggccaccctgccccttcacgcctaaagaggcctcgggtccaggagaaggtgggccagaccctgactccatggagtgggacggcgaggtgagacatcggggtgggggacacggggagacacaggtggagggcatgctggcccctgctaaaaccccctcccc

SEQ ID NO: 17692 - DNA, 516 bp, Homo sapiens
  misc_feature (510)..(510): n is a, c, g, or t
gcctgtcttttctgtgggatacacaggacagtgccatgattctagtagatggtagatgtgagccagcccgaaggaacatcaaggagagttccaggaatgaaccgtgaaatccctaaggatccaaaaggatatgcagaaagaagagcagcacgtcatacccaagaccaacatctctcagtgtttcacgctaacccaaggagagacactagcagtcttctctgcaggaccccttgaatttacattgaattccatccccagccgagcaggtgcttaaagtcaacaggggacactccattttcttggaatttcattctggcaaagagggtgtgagcagcaataaggtgcttcacatcatgaagggatatttttccatcatcttgggatttcattctgggacatagagtatgagccacaataaggtcagagaggagtgaggatacaatcttgtgaggggtgaactgggtccagcaactttgcctgcaaaaataaataaattaattaattaattantaaatg

SEQ ID NO: 17693 - DNA, 533 bp, Homo sapiens
gcctgtcttttctgtgggatacacaggacagtgccatgattctagtagatggtagatgtgagccagcccgaaggaacatcaaggagagttccaggaatgaaccgtgaaatccctaaggatccaaaaggatatgcagaaagaagagcagcacgtcatacccaagaccaacatctctcagtgtttcacgctaacccaaggagagacactagcagtcttctctgcaggaccccttgaatttacattgaattccatccccagccgagcaggtgcttaaagtcaacaggggacactccattttcttggaatttcattctggcaaagagggtgtgagcagcaataaggtgggtcttcctgaagaaccaaccaaactcaggagctaccaggctgcttgtttctgtgaaaatgttgtgagtgttggatgtctgcatgtgtgtgtgccattgtgtgcttaggggtgtgtgtgtgtgtgtgtgtgagtgtgtgtgtgtttgcctttaactggagtctgcttaaaggactgtggataatgcact

SEQ ID NO: 17694 - DNA, 385 bp, Homo sapiens
gatggaaaaagcccacttcaccctactattgtcactaatttcaactaaaatttacgaagaaaatgcatgcagtccgtatttcagtactctaagaagtaagagacagtaggcatgttggacagcgtctcactctgtcacccaggctggagtgaactgcacaatgggctcagtacgatatccgtggctcaagcaatcctcccacctcagcctctcaagtagctgggactacgcctggccaatttgtatatgttttgtaaagatgagcttttgccatcttgctcagttggtctcaaactcctgagctcaagtgatcgcctgcttcggcctcccaaaatgctgggattacagatgagagccacaacacctagcctctatttggtttcca

SEQ ID NO: 17695 - DNA, 388 bp, Homo sapiens
tttaaaatatgaaatgaacaaatgtttactcataatatcttaaaatgtcatttttttattagtaaaaatctttacttcatttcttattatatgcaattaggctatattagtttttaactatttgtaacttttaaatttgatatgttcaccctttcttttaatctattttttcaaacctaataaatattattagctgattgaaattaacaactcatttaaaagaaacagaattttataatatcctgtttcttcctcagagtagtttgatagtattaacgtaataactattctcactttattcaataagatcaaagtaaagatttgggggaagcatagaaacaacatttatttgccttaactggatctttaatacagcacctctacttaa

SEQ ID NO: 17696 - DNA, 444 bp, Homo sapiens
actgttggaatttagctgtgtatgacatagaagtattcatctaagaatgactttagagggtaactttctgtgatgctgcagcttaaatggaaaaccacctccttcccaagtccactgatttgctgatggactacgttgtcttggcaagtgaagtctctgccatctctggcagctctttctgattagggatctgacaagcacctaagtaattcatgcaatgactttatgcaagaaatttcattatttctaataacttacagtgttttaatattttaatgtatttatgcttaattatatattgtaatatgcattagcagagcttcgtctctggatctaagtaaaatacaactaatgcaaaattttcttccagtttttttttttaaacagggaattaagtcctgaaatgaaactacatgcaaagacagcaagcaatctcttgccaga

SEQ ID NO: 17697 - DNA, 2054 bp, Homo sapiens
gggacaagctgcttctgataggagccaggctggcagtggcagggctggagggtcctggcctgggatggggaggggactgcccaaggttggggtgggtcaaggctgctggcctgggagactggtgatttcctggtaactggacccctggcaacctcccagtgattcaggctgggcctttttggattctaatcagcctctctctctctttccctttctgtgtaactggaggccacttggctgctggttttcattgggcatttctggactttagatctcagctcttgtttacccatctcagagccttccctgatctgcctccagcactgcccatccttgcccctttccactgtccttggagcttcctgggcccttccctgggcctcaggatcccaccctccatcccgtctgccctgcaggatgccgcagctgagcctgtcctggctgggcctcgggcccgtggcagcatccccgtggctgcttctgctgctggttgggggctcctggctcctggcccgcgtcctggcctggacctacaccttctatgacaactgccgccgcctccagtgttttcctcaacccccgaaacagaactggttttggggacaccagggcctggtcactcccacggaagagggcatgaagacattgacccagctggtgaccacatatccccagggctttaagttgtggctgggtcctaccttccccctcctcattttatgccaccctgacatcatccggcctatcaccagtgcctcagctgctgtcgcacccaaggatatgattttctatggcttcctgaagccctggctgggggatgggctcctgctgagtggtggtgacaagtggagccgccaccgtcggatgttgacgcctgccttccatttcaacatcttgaagccttatatgaagattttcaacaagagtgtgaacatcatgcacgacaagtggcagcgcctggcctcagagggcagcgccagactggacatgtttgaacacatcagcctcatgaccttggacagtctgcagaaatgtgtcttcagctttgaaagcaattgtcaggagaagcccagtgaatatattgccgccatcttggagctcagtgcctttgtagaaaagagaaaccagcagattctcttgcacacggacttcctgtattatctcactcctgatgggcagcgcttccgcagggcctgccacctggtgcacgacttcacagatgccgtcatccaggagcggcgccgcaccctccccactcagggtattgatgatttcctcaagaacaaggcaaagtccaagactttagacttcattgatgtgcttctgctgagcaaggatgaagatgggaaggaattgtctgatgaggacataagagcagaagctgacaccttcatgtttgagggccatgacactacagccagtggtctctcctgggtcctataccaccttgcaaagcacccagaataccaggaacagtgccggcaagaagtgcaagagcttctgaaggaccgtgaacctatagagattgaatgggacgacctggcccagctgcccttcctgaccatgtgcattaaggagagcctgcggttgcatcccccagtcccggtcatctcccgatgttgcacgcaggactttgtgctcccagacggccgcgtcatccccaaaggcattgtctgcctcatcaatattatcgggatccattacaacccaactgtgtggccagaccctgaggtctacgaccccttccgtttcgaccaagagaacatcaaggagaggtcacctctggcttttattcccttctcggcagggcccagaaactgcatcgggcaggcgttcgccatggctgagatgaaggtggtcctggcgctcacgctgctgcacttccgcatcctgccgacccacactgaaccccgcaggaaacccgagctgatattgcgcgcagagggtggactttggctgcgggtggagcccctgggtgcgaactcacagtgactgccctacccacccacccacctctgtagagtcccagaaacaaaactatgctgacacctctg

SEQ ID NO: 17698 - DNA, 1729 bp, Homo sapiens
gggacaagctgcttctgataggagccaggctggcagtggcagggctggagggtcctggcctgggatggggaggggactgcccaaggttggggtgggtcaaggctgctggcctgggagactggtgatttcctggtaactggacccctggcaacctcccagtgattcaggctgggcctttttggattctaatcagcctctctctctctttccctttctgtgtaactggaggccacttggctgctggttttcattgggcatttctggactttagatctcagctcttgtttacccatctcagagccttccctgatctgcctccagcactgcccatccttgcccctttccactgtccttggagcttcctgggcccttccctgggcctcaggatcccaccctccatcccgtctgccctgcaggatgccgcagctgagcctgtcctggctgggcctcgggcccgtggcagcatccccgtggctgcttctgctgctggttgggggctcctggctcctggcccgcgtcctggcctggacctacaccttctatgacaactgccgccgcctccagtgttttcctcaacccccgaaacagaactggttttggggacaccagggcctggtcactcccacggaagagggcatgaagacattgacccagctggtgaccacatatccccagggctttaagttgtggctgggtcctaccttccccctcctcattttatgccaccctgacatcatccggcctatcaccagtgcctcagctgctgtcgcacccaaggatatgattttctatggcttcctgaagccctggctgggggatgggctcctgctgagtggtggtgacaagtggagccgccaccgtcggatgttgacgcctgccttccatttcaacatcttgaagccttatatgaagattttcaacaagagtgtgaacatcatgcacgacaagtggcagcgcctggcctcagagggcagcgccagactggacatgtttgaacacatcagcctcatgaccttggacagtctgcagaaatgtgtcttcagctttgaaagcaattgtcaggagaagcccagtgaatatattgccgccatcttggagctcagtgcctttgtagaaaagagaaaccagcagattctcttgcacacggacttcctgtattatctcactcctgatgggcagcgcttccgcagggcctgccacctggtgcacgacttcacagatgccgtcatccaggagcggcgccgcaccctccccactcagggtattgatgatttcctcaagaacaaggcaaagtccaagactttagacttcattgatgtgcttctgctgagcaaggatgaagatgggaaggaattgtctgatgaggacataagagcagaagctgacaccttcatgtttgagggccatgacactacagccagtggtctctcctgggtcctataccaccttgcaaagcacccagaataccaggaacagtgccggcaagaagtgcaagagcttctgaaggaccgtgaacctatagagattgaatgggacgacctggcccagctgcccttcctggtccacctctgttcctctccctcctgaccgcagggctttgtctccaacactctccccgaccttcctctgagtcagtcccttccctctgttcactccatctccacctccggcttcgcctctgttggagcacagggatcaggcattacttctgacgtcttgcccaccagct

SEQ ID NO: 17699 - DNA, 1262 bp, Homo sapiens
gggacaagctgcttctgataggagccaggctggcagtggcagggctggagggtcctggcctgggatggggaggggactgcccaaggttggggtgggtcaaggctgctggcctgggagactggtgatttcctggtaactggacccctggcaacctcccagtgattcaggctgggcctttttggattctaatcagcctctctctctctttccctttctgtgtaactggaggccacttggctgctggttttcattgggcatttctggactttagatctcagctcttgtttacccatctcagagccttccctgatctgcctccagcactgcccatccttgcccctttccactgtccttggagcttcctgggcccttccctgggcctcaggatcccaccctccatcccgtctgccctgcaggatgccgcagctgagcctgtcctggctgggcctcgggcccgtggcagcatccccgtggctgcttctgctgctggttgggggctcctggctcctggcccgcgtcctggcctggacctacaccttctatgacaactgccgccgcctccagtgttttcctcaacccccgaaacagaactggttttggggacaccagggcctggtcactcccacggaagagggcatgaagacattgacccagctggtgaccacatatccccagggctttaagttgtggctgggtcctaccttccccctcctcattttatgccaccctgacatcatccggcctatcaccagtgcctcaggtacccgtgcagagcttgtggtagtgggggctgggaaacatcaaaggccttctagcctctcccctccccaagcttctgtgtggcccctgcagggcccaggcccctcttcctgcttctctctcagccatgttcctctttccttcatgtattcacgaaccccccatgtcagcgtctcctccctccactgccatctctctctgcctttgtgttctgggcaccactggggctccaaaaagcctcaatttagggccctgtcctcgagaaagccccgtgcttgaggaaatggatctggacagagacatctcaaacttcgtggagtcaggaattggcaagaaggagatgggtgtgacaactgggagaacaaggtctttcctgggggcagattggaaggcttcctggaggaggagttgctggaaaaatgagtaaaaagattttaaagcaaggggaagggtgatgcagtggacatcattagtatacaggtaccgctgccaggcctggcatc

SEQ ID NO: 17700 - DNA, 712 bp, Homo sapiens
aaaggatggctgaccggggtaaccagaagtgcctttctgaaggcactttctgtgtgtcatagctgggctttgaaggatggggagggggaaagagacagtagacatgaggttgtggaagtagacaggggatagatttcaggacattgaaaatcaggaaaagtggcatgaactttatcaggaggttcccaggaatcttttgaagagggttgggccgatgacagatgtggtcacagctgagctctgtggaggtctgcctgtcatgtagacgctacatggagcagacattgaatgcaagtctgttatggtgggggctgggtcagaaagagctggaagacagtgaggtctgagttttgtgaacagtttttggaaggaaaagagtgcaggctggatactgggtgggagagacgggagagaagcatggtgtccaagctatgctctgggtaccttggtgcatggaggcagctctcagagatggaatgcctcagagaagagagtttggagagtcaagtctcctggctgtttctggatactcaatttcctgatgggcagtagcttctagctgctggtgagaggtgctcctgggactttgcatatgttaagttgttacctccttcatgcaggaagcccagtgaatatattgccgccatcttggagctcagtgcctttgtagaaaagagaaaccagcagattctcttgcacacggacttcctgt

SEQ ID NO: 17701 - DNA, 299 bp, Homo sapiens
gtgtagacttcataagtatgcaaaacaaaaacagctggtatcaagcaccacttgatcacctttaaattcagaaaacacacttgacaaaatgcgacaccccttcaggatgaaaacactcattaaataaggaatagaaagtacttccttgacctgataaagggcatctatgaaaaatccagagctaacatacacaaatgggccataaggacaaatggccaaaagatgtcaacatcattagccatcaggggaaatgtaaatcaaagccacagtgagataccacttcacacccgctaggatgg

SEQ ID NO: 17702 - DNA, 431 bp, Homo sapiens
aatgctgggatttaaacgagggtaagctgactccagaggcatcattcttaactgctgtgcaacactctctgctaagagctaacataggattgaaattttagtaggtgggagatttttcttaatcctcacagcaacctggatgtagtattaccctgttttcacaggtgcagaaactgagtttcaagtagatccagcaacttgcccgagtcgtaaaaccagaaagagtggagccgagaatcaaagcttggatgcctgaccagagtggacctttgaaacactcctctgtatattgtcttcaggctgcctgtatttacaaactctgatattgacctcattacttctccccgttctgcaggcagaagactgctatgagagcacttaggacccaagcgacatcagccttggaacaggcaaataaaaatggaaagcta

SEQ ID NO: 17703 - DNA, 1900 bp, Homo sapiens
ggcgacggcgctgccgccattttgtggggtgtttgtcgcagcggccgaggagggaagacggcagtttggcgacatttctcggccgaagggccatttgcttttgcggagatgcggcattccaaaagaactcactgtcctgattgggatagcagagaaagctggggacatgaaagctatcgtggaagtcacaagcggaagaggagatctcatagtagcacacaagagaacaggcattgtaaaccacatcaccagtttaaagaatctgattgtcattatttagaagcaaggtccttgaatgagcgagattatcgggaccggagatacgttgacgaatacaggaatgactactgtgaaggatatgttcctagacattatcacagagacattgaaagcgggtatcgaatccactgcagtaaatcttcagtccgcagcaggagaagcagtcctaaaaggaagcgcaatagacactgttcaagtcatcagtcacgttcgaagagccaccgaaggaaaagatccaggagtatagaggatgatgaggagggtcacctgatctgtcaaagtggagacgttctaagagcaagatatgaaatcgtggacactttgggtgaaggagcctttggcaaagttgtagagtgcattgatcatggcatggatggcatgcatgtagcagtgaaaatcgtaaaaaatgtaggccgttaccgtgaagcagctcgttcagaaatccaagtattagagcacttaaatagtactgatcccaatagtgtcttccgatgtgtccagatgctagaatggtttgatcatcatggtcatgtttgtattgtgtttgaactactgggacttagtacttacgatttcattaaagaaaacagctttctgccatttcaaattgaccacatcaggcagatggcgtatcagatctgccagtcaataaattttttacatcataataaattaacccatacagatctgaagcctgaaaatattttgtttgtgaagtctgactatgtagtcaaatataattctaaaatgaaacgtgatgaacgcacactgaaaaacacagatatcaaagttgttgactttggaagtgcaacgtatgatgatgaacatcacagtactttggtgtctacccggcactacagagctcccgaggtcattttggctttaggttggtctcagccttgtgatgtttggagcataggttgcattcttattgaatattaccttggtttcacagtctttcagactcatgatagtaaagagcacctggcaatgatggaacgaatattaggacccataccacaacacatgattcagaaaacaagaaaacgcaagtattttcaccataaccagctagattgggatgaacacagttctgctggtagatatgttaggagacgctgcaaaccgttgaaggaatttatgctttgtcatgatgaagaacatgagaaactgtttgacctggttcgaagaatgttagaatatgatccaactcaaagaattaccttggatgaagcattgcagcatcctttctttgacttattaaaaaagaaatgaaatgggaatcagtggtcttactatatacttctctagaagagattacttaagactgtgtcagtcaactaaacattctaatatttttgtaaacattaaattattttgtacagttaagtgtaaatattgtatgttttgtatcaatagcataattaacttgttaagcaagtatggtcttgataatgcattagaaaaattaaaattaatttttctttttgaaattaccatttttaaatacctttgaaatatcctttgtgtccagtgataaatgtgattgatcttgccttttgtacatggaggtcacctctgaagtgattttttttgagtaaaaggaaatcttgactacttt

SEQ ID NO: 17704 - DNA, 2476 bp, Homo sapiens
atttttagataatcattaaagaccacagaaaatgtaacagatcctactcttcaaaataattgctattcagtattaaaacgcagtcagctgcgtgattcccgtgattgcgttacaagctttgtctccttcgacttggagtctttgtccaggacgatgagacactcaaagagaacttactgtcctgattgggatgacaaggattgggattatggaaaatggaggagcagcagcagtcataaaagaaggaagagatcacatagcagtgcccaggagaacaagcgctgcaaatacaatcactctaaaatgtgtgatagccattatttggaaagcaggtctataaatgagaaagattatcatagtcgacgctacattgatgagtacagaaatgactacactcaaggatgtgaacctggacatcgccaaagagaccatgaaagccggtatcagaaccatagtagcaagtcttctggtagaagtggaagaagtagttataaaagcaaacacaggattcaccacagtacttcacatcgtcggtcacatggggatgaaattgttgatactttaggtgaaggagcttttggaaaagttgtggagtgcatcgatcataaagcgggaggtagacatgtagcagtaaaaatagttaaaaatgtggatagatactgtgaagctgctcgctcagaaatacaagttctggaacatctgaatacaacagaccccaacagtactttccgatgtgtccagatgctagaatggtttgatcatcatggtcatgtttgtattgtgtttgaactactgggacttagtacttacgatttcattaaagaaaacagctttctgccatttcaaattgaccacatcaggcagatggcgtatcagatctgccagtcaataaatttgtgaattttttgcacagtaataagttgactcacacagacttaaagcctgaaaacatcttatttgtgcagtctgactacacagaggcgtataatcccaaaataaaacgtgatgaacgcacactgaaaaacacagatatcaaagttgttgactttggaagtgcaacgtatgatgatgaacatcacagtactttggtgtctacccggcactacagagctcccgaggtcattttggctttaggttggtctcagccttgtgatgtttggagcataggttgcattcttattgaatattaccttggtttcacagtctttcagactcatgatagtaaagagcacctggcaatgatggaacgaatattaggacccataccacaacacatgattcagaaaacaagaaaacgcaagtattttcaccataaccagctagattgggatgaacacagttctgctggtagatatgttaggagacgctgcaaaccgttgaaggaatttatgctttgtcatgatgaagaacatgagaaactgtttgacctggttcgaagaatgttagaatatgatccaactcaaagaattaccttggatgaagcattgcagcatcctttctttgacttattaaaaaagaaatgaaatgggaatcagtggtcttactatatacttctctagaagagattacttaagactgtgtcagtcaactaaacattctaatatttttgtaaacattaaattattttgtacagttaagtgtaaatattgtatgttttgtatcaatagcataattaacttgttaagcaagtatggtcttgataatgcattagaaaaattaaaattaatttttctttttgaaattaccatttttaaatacctttgaaatatcctttgtgtccagtgataaatgtgattgatcttgccttttgtacatggaggtcacctctgaagtgattttttttgagtaaaaggaaatcttgactactttatattcttaaaggaatattctttatatacttcaaatttagaacttaactttaaaagtttttcttctgtaattgttgaacgggtgattattattaactctagataagcaggtactagaaaccaaaactcagaaaatgtttactgttagaattctattaaattttaagtgttgtattctttttcattgggtgatgtcagggtgataaccagacattcatggaaaggcatgcagtttgtccattgtgacagtttgtttaataaaaccacatacacactttatttaagattaaaatctaactggaaagtcagcttggaaaatggacatttccaagtatgtttggtgagtcacagatataaaaatagaaattctgatgagaggtttcagtttttaataccaagtccttaggagtcttaacattggccagcatctgtttatcaaatgacataaatacgtaaacctataagaattaagtttattaattaggcaatttatgtctgtgataattcttacgggagaaagaggatttgattggaaagcagtttgggaagaaagtgctgctgaaatttccagaatttaattgattggttacataaactttttgacttca

SEQ ID NO: 17705 - DNA, 2097 bp, Homo sapiens
ggcgacggcgctgccgccattttgtggggtgtttgtcgcagcggccgaggagggaagacggcagtttggcgacatttctcggccgaagggccatttgcttttgcggagatgcggcattccaaaagaactcactgtcctgattgggatagcagagaaagctggggacatgaaagctatcgtggaagtcacaagcggaagaggagatctcatagtagcacacaagagaacaggcattgtaaaccacatcaccagtttaaagaatctgattgtcattatttagaagcaaggtccttgaatgagcgagattatcgggaccggagatacgttgacgaatacaggaatgactactgtgaaggatatgttcctagacattatcacagagacattgaaagcgggtatcgaatccactgcagtaaatcttcagtccgcagcaggagaagcagtcctaaaaggaagcgcaatagacactgttcaagtcatcagtcacgttcgaagagccaccgaaggaaaagatccaggagtatagaggatgatgaggagggtcacctgatctgtcaaagtggagacgttctaagagcaagatatgaaatcgtggacactttgggtgaaggagcctttggcaaagttgtagagtgcattgatcatggcatggatggcatgcatgtagcagtgaaaatcgtaaaaaatgtaggccgttaccgtgaagcagctcgttcagaaatccaagtattagagcacttaaatagtactgatcccaatagtgtcttccgatgtgtccagatgctagaatggtttgatcatcatggtcatgtttgtattgtgtttgaactactgggacttagtacttacgatttcattaaagaaaacagctttctgccatttcaaattgaccacatcaggcagatggcgtatcagatctgccagtcaataaattttttacatcataataaattaacccatacagatctgaagcctgaaaatattttgtttgtgaagtctgactatgtagtcaaatataattctaaaatgaaacgtgatgaacgcacactgaaaaacacagatatcaaagttgttgactttggaagtgcaacgtatgatgatgaacatcacagtactttggtgtctacccggcactacagagctcccgaggtcattttggctttaggttggtctcagccttgtgatgtttggagcataggttgcattcttattgaatattaccttggtttcacagtctttcagactcatgatagtaaagagcacctggcaatgatggaacgaatattaggacccataccacaacacatgattcagaaaacaagaaaacgcaagtattttcaccataaccagctagattgggatgaacacagttctgctggtagatatgttaggagacgctgcaaaccgttgaaggaatttatgctttgtcatgatgaagaacatgagaaactgtttgacctggttcgaagaatgttagaatatgatccaactcaaagaattaccttggatgaagcattgcagcatcctttctttgacttattaaaaaagaaatgaaatgggaatcagtggtcttactatatacttctctagaagagattacttaagactgtgtcagtcaactaaacattctaatatttttgtaaacattaaattattttgtacagttaagtgtaaaaaaaaaaaaaaaaaaaaaaaaaaaaaaaaaaaaaaaaaaaaaaaaaaaaaaaaaaaaaaaaaaaaaaaaaaaaacttgtcggccgcttgggccaagcccattttaaatttggccaggttaagctttgggcccgaattcgaggttaatttgccaaagtcccttattggggagggggtttcaatataaaggcccgtggtttaacaatcacaggctggaaaaacccaaggctttcccaaactaaatcttttggggtaaaaccccctttccctaggggggggtatagtaaaaagggcccgccccgatcgtcttttcaaaacgtgggggaaccctaaatggcaaatggaaatttggaacgcgtaactatttttttttccggtttacttttggttgccacttaagtttttaccctgggccgggtgggt

SEQ ID NO: 17706 - DNA, 447 bp, Homo sapiens
tccttgccatgtttttcttctgtaacataaactgtgccctgtgaatttctggggactgaatttgaaattgctcctgccaactgttcgtggcctggtgcttatctgaatgcctgaatatctccccgctgaatgaattgcgtattctgccctgaattcactctgatatattgattggctggacgatcttggtgctgcccacttgccgttccagaagagccaccgaaggaaaagatccaggagtatagaggatgatgaggagggtcacctgatctgtcaaagtggagacgttctaagagcaagatgtatagaatatttttcaacactttttaaactttgcagaaagaataatctttttaagaatagtttgtcagcggggggctaaagaactcttcattgcttttttattttgctttttgtgggtttgtttgttcttttatatttcttctt

SEQ ID NO: 17707 - DNA, 234 bp, Homo sapiens
gatggggtttcactgtgttagccagaatggtctccatcttctgacctcgtaatccacccacctcagtctcccaaagtgctgggattacaggcgtgagccaccgcacctggccctgtcttttctaatttcttaactatcatttctatccccttagaattgattctccactcagcatgcagaattatccctttgaaaatcagattatattcctacctaaaccacccccaatagctt

SEQ ID NO: 17708 - DNA, 677 bp, Homo sapiens
gcgtgggtgtgagtgtgcctgtgtgtgtgctcgtacagcagttgttatcatgatgtacttactggctgtctaccgatggctttcctttcattctactattttttggttgacttctgtgagctgtgagtcatcggtggtaacattatgcattgaatggattagctggtacctaaaaatagccgaggccctcatgcaggcggcacatgagcctgtagagtcagtccctttgcagccaaggcagacccacttgccaacattgaacatgccgagcttggtggcgatgaatcctaatgtatcaaaaaatagatagttggtgactgccctgtgtgcagagcccagccctggatttgtgccgcagttgttggtaatacacacttcctgtctgttctggtgctggaaaggctccaacagagaaactatgtcaaaccacatttttgtttgtgggtctttgtacctctctaaaaaaaaaaaaaaaggagaaaaatgctctcctttaaactgtatgtgctatatgtgcccccaactgggtcatcttatatgttttgattctctcagactgttgttgtttatagcatttagaaaaaaattaaagactattgtttaaagcagttttaggtgtacagcaagtagagagaggtctcacacacctaacagttttccctgttattaaaatcttg

SEQ ID NO: 17709 - DNA, 428 bp, Homo sapiens
gaaaagagtaggaaatgggtaaggatttaacaggcaattcacagaagacaaagtaaccggcccctaaatgggagcatatcctcaacttcactagtaataaaggaaacgaatttaaaagacgatacatttctcacttcttctctccttatagctgtattccacctttgaccatacagcctgtttttatttatcgtaagcataggttaataaatacagggcttaccatgttaatatcttctttctatggatgcgtaacaacttattttatcattccgtttgtgactgaaattgaatttctttctgtaaacctgaaaatatctgagacaagcctcgatcaacttagaagtttactttgccaagattaaggacacgtcttgggagacaggtctgtgcctttctccaaagatgatttcgagggcttcagtatt

SEQ ID NO: 17710 - DNA, 2023 bp, Homo sapiens
ttaatggcaaattatttaacattatctgataataatctgcagaaggtttaattttcctcctcaatttgaagttcaagatgtttttctcttccagggagattttttcgactgacatctttaacttaccttccaatcatattactaacgtagccttcttcctagattttttaattgtttgatcatgagcgaacacttctactctctgtgatagatttgcaaacagaggaaataacgcatcctcgtgtccctcttcttggtgttccacaggccatgtgtgccctagccctcgttcatgcaaggtctgtgtagggaaggtggacttcagctcagcaacagcatcccttcccacagggatcaggtgggtggcttgagataccccttccatggggcaccacccattcagtgagacggggaagccctgggtgggagggagaacacctccacatgtcttctactctctccataggatggaatgagtgtcccagtcccaggagtatccatttcccactgtgtagcccagtactctggtctcactgtctctgctgaatcctgtctcactgtgcatattattgtggtttatatcagtcagtaaaccaatgtgagtcttcatctcttgcattcttaggttcatagttttgtgtgtctcctgtaatgacccttctctttccctttccaactcctgaaagattgccactatttcctctggaactttgtttcgttaccagcaaaatcctcgacatccatacccgtttcctggctttccctctcctttcctctgaatggtagtcttttatattcagctgtccacttgacatcaaaatagacattttgaactcaatttgcctaaaacttacccacaaatttctccccaagtctctccctaactgcaacaacaaaaaccacaggcttctccctgtcactggatggcaactccattcttttgattgcttaagccaggcatccgattgagtactttcttgattttctccagcccacatccagtccatcggcaagccctgttggtcctaccttcagaatatgtccggggttccagttgtcctggccaccctgctgctgtaaccatggtcagaactccatcctgcccctctggattatgactttcgtttcctcacagtggtcctgcttgggctctaggcccttccactcccattctctctacagcagctgggctgattcctttagcacccaaggatatgttggcatcacagtgacttagataccatcacaaagacctcccattcaacttagagtgaaagtcagaatcctcacagtgaatccccaggccctagaggatgtgaacccccaggccctagaggatctgaacccccatccctcctctgattatctctcccacccccacttccctttgcattctgctccagctgccctggcctcatggctgggtttccaccaaagcaggcacttcccatcacagggccatttccccgcctgtggcttctgcttgacattcccttttccctgatatccccttgactcattattccctttcttccttaactcttctgagatccagcttctcagtgataccacacagccctactccccccagagcccatctagagctcacctttccagtcgcccttgccaggctcagtggaggctctttgttccccatacagtacgtgtcgtcgtactatattgttaggcttatttaatttatgtatgttttgcctttttgtgctaaatgtaaacaccacaaggggaggtatctttgtctgttgacaatgatacattcaatgtttctcaagcacccccaatgctggtttgtatgtggttatcattcaatctgtatttgttgaatgaataaatgattgactatgtggagagcaaaattgatggacctgaaaatgttttgcaaaatgtaatatagtctactgatacaatatttattattattggccaataatgtttaatgccaagtgctaaattagtaaaattttggggatatagagaaaaattgagcagaagtcttaagtttgta

SEQ ID NO: 17711 - DNA, 358 bp, Homo sapiens
cattatatgcacagtatgtacagcttatttaatttatgtatgttttgcctttttgtgctaaatgtaaacaccacaaggggaggtatctttgtctgttgacaatgatacattcaatgtttctcaagcacccccaatgctggtttgtatgtggttatcattcaatctgtatttgttgaatgaataaatgattgactatgtggagagcaaaattgatggacctgaaaatgttttgcaaaatgtaatatagtctactgatacaatatttattattattggccaataatgtttaatgccaagtgctaaattagtaaaattttggggatatagagaaaaattgagcagaagtcttaagtttgta

SEQ ID NO: 17712 - DNA, 506 bp, Homo sapiens
tctttaaacacgctggtaatgggcataagaaaacacttgtgaagtgtaatcagttattagcagctgatcaattatcctcatggatagctgttgggggggagaaaagaagcaataataagccccttgattaactaatttgaatatctttggggaacaaattctgaaatttctttctattttctccctcgctattgtaattgtaacgccggccgcacatctgctggataaagacggatggaaatggtaatgagtgttctgctgtgaacaggccccttgttcgggatccaggaatgaaggcgctggaggtgtgggggctgcgggggctgccggctgggcctggggacctctcactggctggagtgggcagcactgccatgggcttggcctccgcctcctgatgagatgtcaaggtcgggggaagccggctgcgatgggcaaagggcatgcgcagacaggtgcccctctgggaaacattacagattctcctgaagaccctctagggccag

SEQ ID NO: 17713 - DNA, 380 bp, Homo sapiens
ataccagttgtactggaataaggcccaccctaatgacttcatcttaattaatgatatctgcagtgacccaatttcaattcaacacatacagatggataggaagatagctagttttgtgtctctaaaatcttagttaagagtggctgcagtcaagcaacctcagtcaagcaacctacagatttggaattagcacctactgtgcattaaaccattaattaattaattaactaatgatagcctgggcgacagagtgagacattgtctcaaaaaaaaggaaatatatatatatatatatatgtgtgtgtgtgtgtgtgtgtgtgtaaaatagaatgaacgttatagacaagcaggcacactgtagaagcttctactcatctgtg

SEQ ID NO: 17714 - DNA, 708 bp, Homo sapiens
tttgcattagagtatgattctgtctggagtagaggtcaagaactggttcccccagttcgggaaactgttccacagactgcctcacagctttgccacagaaccttctgctcaccacttgtgtttggcaggtgatttcatgtataaatctgctttctgctcgaggatgtcaatctagagtttctggggactgcttaaggcaaattcgtaaataatttggctctcttagtaataaatgagtggctctgcacagactgttgttttgacttggagagaagtctgcccaggattccatcttaatgcacgtgctgatcttctggcatgtcctgagctttagtccatctgttaggggcattgtgcccattgcagaggtagcctgccaacaccaagcatcctgaaatgaagcaagtaaattccattcattgattggtataaaaagtgccatggggtgctcaaagctgcctagtgtgtacccatgtaacagacagtttcattttagaccatgcttagttaataagagaaacattcattcactccctcagaacattttattagtggccaagtgctgtggctcatgcctgtggtcctaggctacttgggaagctgaggttggaggatcacttgagcccaggagattgaggctgcattgaactgtgattgtgccactgaactccagcttggatgacacagtgagaccctgtctcaaaaaaa

SEQ ID NO: 17715 - DNA, 617 bp, Homo sapiens
gacaccaggcccggctaatttttttgtatgtttagtagagatggggtttcaccgtgttagccaggatggtctcaatctcctgaccttgtgatccacccgcctcggcctcccaaagtgctgggattacaggtgtgagccactgcgtccagccccagcaaggaatgttttcatgagataggaggaagatatttttcctttgaagtctgtacagacaaccaacagaagttggggctgtttctctggagagacacaatggagagccagctctcaggttctgtggggactgtcttagctgggcagtgccagggtggctgaccccaaggtggctgacctctggctggggcagcgacccctggccctactgaatcagaagagcccgtatttccaggtctttggccacattttctttggcatatctggtacctcttgaaatcagagctgtgaaacccataaatgaccccagaaggtcatttttattggcatttctgacctctgctgtggggttgaatcctactttgcttgcaagcgttgcagtgacactgttcaccctgactaagtctccatttgattcagagagctgttaaagagtatgaacttggggtacgtgttgtactgga

SEQ ID NO: 17716 - DNA, 451 bp, Homo sapiens
ttttctttcctaaactgaacttcatctgttgtcctaattcacttagagtcctagactcctggatgtgcaatgttctttgagatgatcatgtccaatttccccgttataaagattcaggaagctgaaactcagaaatattagcagacaactcacaaagatgggaataaacttgtaatgctctccagtttaatccctttttttaaatattaaggccattatgcctttgttccaatctctaaaacaatttctatttgtgttttaagcctcggttcttaattgtttcttgttgaagcagaggaatataatataatcctgaaaagaaagacttacttcttttcagtagccttctaatagatttcccagaaatgttgcagttgcattttttagcatatggtaggtatacttttttttttttatagagtcttatatgttctttaagttttaaaaatgg

SEQ ID NO: 17717 - DNA, 530 bp, Homo sapiens
aggttacagtgtaggttttccagagtttttgggctgggcacacacactcttaagttggcagctttctttttaacagtggtggtgagcttctttaaataacgacttcctaaatttgtgaaagagtgtgtgtactgggagggagagaagtgctgttacaaaaccccaaggcttcttgtctgtgggttgagcacagcccgctacggttttggaaagatggatttcctggaagacaactttgctactgagcatcatctagtaaataaagtactaagacacagaagtctataacaaatattggaaattattgttaatccaaacaatctcagatatatttgacatccatatgttttaattgtatagcccagttatgtcaagcagagtcatgtactggcataaagatgttttggtccaatgatccaactgccatatatggatgggtgggtactgtggaggtccttatgggagctgaaaattccctattgcctaatgacatcatagctgtcataacttcatagcacaacatgtcactc

SEQ ID NO: 17718 - DNA, 1358 bp, Homo sapiens
  misc_feature (940)..(940): n is a, c, g, or t
  misc_feature (1014)..(1014): n is a, c, g, or t
  misc_feature (1018)..(1018): n is a, c, g, or t
  misc_feature (1061)..(1061): n is a, c, g, or t
gaaactgggggagggcatggggacgggggactcaacaggacgctgcttatggtggtatcacagctaagacttattgtaatgacagaattcaaagcaaaattagcaaagggaaaaagcaccttgggtgaagtcgggggaggccaggctggagcttccagagtcctcttccagggggttcctacaggatgcacttaatgtctttagcaatgagttgtgacaacatgtaggagatgttgtctagcagggaagctcattagaaattcagtgcccatggtgttttgctaggggccagtcatgtgggcacctctgcctggcaggtaccaaaattctaggctctgggaaggaaagcaggtgctgagcaagaaccatattgtttgtacaaataatttcggcccagtgaactactctcatcagttaggggatggtggggaccctcctgaaatctgggttcccagatgccagcagaattcctaaggagagcagcttcaggcctgtggcgtgaactctgttctactcacgggtgatctcatgcccatcccaccaggctctcgagggcaagcactccccagtcgtgggcgtaagtgaggcctttaatgagctcttctttgccacaggggcctggaaggtcctcagcatgctgggccataatgaagaaaacatcctttccctatagtgtacgtgataataacctaggcatttatggccctgcgtgtggctatcttgcataccttacttttgctcttgcaaaaattctgtcaggtcgggagagttctctctgttttacagatgaggacgcgactctcagttaagaagaaccaactgcagttctctgacctcaaatctagttttatttccactatcatttcctgacttcattctggaaccaccttcctgttgtttttgatgacacatgtgtgtcacttcggttatttacttaaanaaaaaagtctcgttaaaaagagctgggtatagtggctcatggctgtaattccactgctttgggaggctgaggcnggangatcacttgaggctaggagtttgacgccagcctgggcaacatngtgaaactctgtctctacaaaaataataatgataaataggctgggtgtggtggctcacgcctgtaatcccactttgggaggccaaggtgggcagttcgcttgctgccaggagtttgagaccagcctggtcaacatggtgaaaccctgtctttactaaaaatacaaaaattagccgagtgtgctggcgcacacctgtagtcccagctactggggaggctgaggcaggacaatcgcttgaactcaggaggcagaggttgcctgcactccagcctagatgactgagtaagactctgtctc

SEQ ID NO: 17719 - DNA, 237 bp, Homo sapiens
caagctgcccggctctccagccccggcgcctgcctctttatctgtaccttcaaaaacagtaataagcaaacccaggcacctctgggaacagcctctggcctcctgccctgccctgtgtaaccagcctgtcctcacacccaccagggaggaggagtcggcactggttaaccctctggtctaccaggcccggttcccaggttgcagcagggagacaaactgttgctcaagaaaatcctt

SEQ ID NO: 17720 - DNA, 377 bp, Homo sapiens
tccaaaaagtgtttatgcttgaaactaaccaattggtaatatatggataacgtattccctatcatctacctgtgtctttctcttagttgtagttaagtgactggaaggcaaaagagtgaaattgacaatgatggaaatcacatttaattagcatgaaatggtaagcagctgctatgttcaaatcttcctgttatgagattgtcagacttataaaatattatccacatggcgcagttttgaacagtgaaagagaagttgaatcaaaatttaaaagctcagtgcatagaaattttgggtcctaggagacacacaagaatttcccttttaaggaaattggctacgtattgtttgcaaacccctattctggtaaaaaaaaa

SEQ ID NO: 17721 - DNA, 689 bp, Homo sapiens
atagaaagagataaggaagtaaagatagccaatgaagagtgtgttttaagttagttattctgtgtgcaagtagaacttaacctggggaactatgagaagcaatgaaaaatacaagcctcagagttatctcaatcccaataagcaccagttaagggctgagggctgctcttaggagaacttcattccgaagacctgtgaaccacatgggttccagggccaaagaaagcccacaagcaaagagatacaagtgtgggtagttggaagtcagggcaggacactctgagaaagtcaaggccaagggggagatcgatatacagatagataggtagatagatagataggtagatagatagatagatagatagatagatagatagaagatagatagatacagatagatttatatatgtgtgtttgtgtgtgtgcgtgcgtgtgtatatctcaaattattaaagtcttctggtagtttctctggtgataatgtatttaatctttgtagcactttgcctcccaagagcaatgtatgtttgaaatctgccataaataatgtgaaaatgcttgaccaactgatttggttagcaaacgctctctggctaacatccagaagtgctacagttttctgtattttttattttgataaattttgttgtagaacaagaaaaagatatagacacttaaaaaaaaaaaaa

SEQ ID NO: 17722 - DNA, 461 bp, Homo sapiens
tttccatgtttctgtcctgggagtgatttggaggaataaaccaggatggctagggtaattgctctgagcaggtacattgtccttcacctcttcttgaagggctaactcctattcatccttcaagtctcagcatagggatcacctctatggagacatcttccctgacatctgtgaccacgttgcttccccaaggcttccacagccctgggcttcccctgtcacagaactcatcacattatattaaaattaccatatattgcatctgtctctccaactagactgtagggttcactggagtcatgaaccatattctaatcatctttatatcctcagcacttagtacaataactgctcgtagctgctccaccaatgtttatggagctgagctcattctgcttgcaaacgtcattatttgttgtttcttaatttccacaaagaagaaggagaaaaggaaaaaggag

SEQ ID NO: 17723 - DNA, 279 bp, Homo sapiens
gagacggttttcaccatgttggccaggatggtctccatcctctgacctcatgatccgcccacctcggcctcccaaagtgctgggattacaggcgtaagacccgcgccctgccctggagtcccttctatactcgggcatccaagacagaaaacttacctcaaatggaaataaataaatgtttattaagtttggaaccttgagttaggtggactctgctatttcaggaatgatgaacttgaactacacatttggtcttaataatgccctttgactctggac

SEQ ID NO: 17724 - DNA, 311 bp, Homo sapiens
acaagtttttagccgtatctcaaaaaccaataaattttcctgaaaaacccatacattatcattcacaattaaacttatataaagatgtcctaggagagccatttgcaaattatcatcttcatcctatactgtgaaatgtctacttttaaaactctgtctatttttgcctgcatgttcatgatatatattagtgtctgcatatatatactgcaaattcaatattttgaagtaattatctttatattatctttataatataatttatctttatattttatactgttagtgtagttcagtacatgtttattacc

SEQ ID NO: 17725 - DNA, 407 bp, Homo sapiens
atacaaggatgttcatcgcaggtgatggtgctagcaaaaaatgagaaacaccctaaatgtccattgataggagaatgagaattcggtagtggtgagtcccttccagggaatgggatggagtattggaagagatgagctttatgtcattgaactggtaagaaaagatcttcaaaatacatttttagtggaaaaaaagatggagcagaaaatgttcagttgtgagttgatttatgtaatcagatgataagcttgtatatgtatatatacgtgtttataaagtacaagagcaagtcaggaagggcagacatcaacacatatcagtcgttaccatgggtggtgggttgagacttccactctgggttctgggtactgagttctctacagtacccagaatttcttgttagaca

SEQ ID NO: 17726 - DNA, 487 bp, Homo sapiens
aaatggttatgccaatggcagaattagccatggtccatagtgactaattctgtttatgcttattagtcttatatgcttgtattcataattcaaagtcctagaaaagaaaaagaaacaagtgaagaaaactcaaaatgcctaaacatccaaataaaagaaagtttcagaactttgagctcaaagagagctacatgttcaagtgagctctgtgagacaaggcaaaatgccttcctcataatatcttaagccaggaatatgttctttgaatttacgacttcttaaaataggagtcaataaaaaaaatgcagcaagtgtttgcaagttaactggggagaaaaatgtttttctcctaacaccacattcaagttctatgtattgacactaatatgagtatatacaaacttgtaaccagaagaggtagattctctaatcctttatgtaagttaactcatatatgcttaaatttgttatttttatgtaaaacaat

SEQ ID NO: 17727 - DNA, 420 bp, Homo sapiens
gactcagtacaataccaaccaacaaattagcaggcttttttttctttggtagacattaacaaacattctaaaattacatggaaatgtaaaagacctagaatatttttaaaaactgaaaaattagaaccaattggaggactaacattatgtgatttaaagacttaagctttagtcaacaagaccatgtgttattggtgcaaatagaaaaatggaacaaaatagagagcgaagaaatatatggaagcacaaagatgtcaagataactcagtaaaaaagaatattcttttcaacaaatgttgccagaataattggatactcgtaaaaaattaactcttatttataccacttactatatacaaaaatcaactcaaattggatcatggacctacatgtaaaatctaaaacaataaaacgtataaa

SEQ ID NO: 17728 - DNA, 383 bp, Homo sapiens
gaaatcagaacagtggtttcctctggggggataaagattaactgaaagggaatactgggaaactttccagatgacagaatatattttgtctgggtggtggttatgtgggtgtatacacttatccaaatccaaatgtatcttgtatattcaacatacagctgtgtgtttcactgcatgtaaattttaatttactgtataataatgcgtaagtatacaggtgcatacttatatttgtgatggacatcccaacaactgaaaagtaagttctacttaaagatgaaaaaatacgatacatttaactacgtattttatctcctctttttttgaccattgtaaacataggatatcttaaaataaataataaagattttaaaaatgtttat

SEQ ID NO: 17729 - DNA, 311 bp, Homo sapiens
actttctccagaatgaaaatgcaaatcattaaagtaattgctctcttcttcaaaagatcactttactcacaaccctcttttaagattttttttaagagtttctagtttccttcccaacaactctgatcagcagttctcagagtcccactgtttacattcattctcttgttgtattgcagccaagcaaatatttggtctgtgcagccagcagaaaggtgagagcagatgagatgatgaatctaaacggttggatgttatgagtcctcctgccttgttaggaggtacaggcacccagtacatcagctaagcac

SEQ ID NO: 17730 - DNA, 429 bp, Homo sapiens
gcatttcttaactgttttacaatataatatctaatatgtttttccaagccaggattcatattttttcagtatctctgatagttatttctaccttttgctgaatataactttcatgttagcctattaattttttagaaattaagaaactataattttgtatttcttcttgttaatttaatgacactcttctctggtcacagtctcagaattgtgactttagtgtcacctatattgtgaaatattcattttaaaaattagtttttttttttttgagacggagtctcactccgttgcccaggtggagtgcattggcatgatctcgactcactgcaacctccgcctgctgggttcaagcaattctcttgccttagcctcctgagtggctggcactactacaggcacacaccaccatgctcagctaattttttg

SEQ ID NO: 17731 - DNA, 241 bp, Homo sapiens
attctattggtattggaagtaaaatccatcaaggtgctttggttaataaatgaaatatttttcttagagttctgctgagtcagtgacttttgactatttgaatgagtccattctttaactgaagtttaatctctacatattatagacctgaatgctgataggttaatggacatttttttctcaaaaagtgtcttttggacttcaatttgatggttgtgatacgagaaaggggtcctgatct

SEQ ID NO: 17732 - DNA, 466 bp, Homo sapiens
gcgattactttaaaaaatatatggcaatgtcaaaataaatgccaagaatcatatttctaggaatgcaaaagtgcttctcatatactcatatattaggtttcacagtattggttgcttactatatttgtttttatttttattatatatcataattacacatttttatttgcatttgttgcttattgtagtaaaaaggtaaaaaaaaaatgaacttgttaatgattagcttttatttgactaaccagttgaccaattttgctctgttttcaaattgcatatgatggggtattatgctgaaactgctaatatattgggtatttattgatacttaggaatagtcagtatttataaatatttaagaatgtcatggtccttatgttttgatgtttaaaatgttcactttgttgtacgttacatagtgtcttattcaaaattgaaaataataaaggtatttctaatagatgta

SEQ ID NO: 17733 - DNA, 350 bp, Homo sapiens
gtcttcagcttatagaagaatacctggaaatattaggtgtacaatatgttaatttatgttaaatgagtctatgaaatgaacacatacataatgtgaaatagaaactaaggccttaaaggtgactaaaagtcaggattccccacacctcacccaaatatagagtaaggagaattatgagtggttctgaattaagacaagattagtgaaagcaagtttttgctaagattcaaccattgtaagtaaaatttaaatgattaaaatgagagaatcaagatttattatattggaccccttattcttcagatagaaaccaggaatgaaccatctaccttctttgtgtacctaataat

SEQ ID NO: 17734 - DNA, 288 bp, Homo sapiens
tttatcttctctagcttactttattgcaagcgtgtactatataatacatattgacaaaatatgtggaaattgttctcagtgaggcatccagtcaacagtaggctatcagtagttaggtttttggaaagtaaaaagttatacatagatctttgactgcgtgtggggtcagcacccctaacccctgtgttgttcaagggtcaactgtgctcttttgcaagctttgaagcatgtgaacgccagcacctaccctgttcttgaggaaatccagcgttcccttgatacttgacc

SEQ ID NO: 17735 - DNA, 384 bp, Homo sapiens
cctgtaatcccagcactttgagaggccaatgcaggaggatcacttgaggccaggtggttgaggctacagttagctatgatcacaccactgcattcctgtctggacaacagaacaagacccaaactcatttaaataaaaaaaaaaaaaaaggaaagaagaaagaaagagtttaagaaaaatccatttggaggttcattgattgatttattcacttagaaattgtatattgagtgctcactatgtgccaaacattattctaggtactggaggtaaagcaattaacaaagcatatgaaatttctatcctcgtgaaacttatgttttggtgggacaagatagacaataaacagaaaaatagataatttggcaatgaaaatcagtgcta

SEQ ID NO: 17736 - DNA, 1964 bp, Homo sapiens
aagccaggtatgataaacgccatacagcgcttagtgacaaacacataaaactgtagctcctgcctctgtagcagaggtgacagccaagggcagtcctgtgctatccaggcctggtaggggggcagcctcgcctcagttgagggctgagggagagactgaggtgcagcagatggcagtggtaaccaaaccagttcccttgccgtgggtggggacacaggagaagcacggaagcatctggaactgagcaatcaggacaggaggctcaagcctgggtgagtcaggagtccgggggctttcttttcatccaacccattgtctgctggtgtctcggcaaaagccagccagccagccgtggcccttcaccgttcttcagactctagggtgagcccagcccagcgacacaacagaaaccaagtgccacgggggccggtgtcctccaccagcatttctcctctggtcacatctacgtcctgatgggacttctccctcctccttggaccatcagctttacagtccagaccaccctgcagccacccggtggtctcccagctgccccagtctcgggcaggatggcttttgagcctgttgggagagaccttgccaggagaatggtgcccagggcaggcaagaggacacagactctgggagctagaagagttgcggcccaggggccaggcccactcccagaggacaggaggcccaaaagcggggaaaggctccatgttacggtggccccatgctgggagtttgtgctgccttctgtctccctgactgcccaagcgtggggtggtgtggggcaggaggcatcctctggtgttccctagcagcccaggctgtgtgcaggggctcccattttgtgtctcagctgcaagaaggccacaaagggaggaggggctcatgggactgctgagaagaaggtgtgcagaaagggagtgtggccctagatcagtcctttaaaaagcctctgttacctgaaaggaggtcaagcagagaggaatggctgcgtgtgtgtcctaccgggcaggacaggacagagggaggtcattgttacacacacatcccccctcctttcctccttcccctccacttccctgtgaaggcctgaggcaggctgtggccaggctcaggccctgactgtggggtacacaccagggagggccacgcctccccacagacggggtggagtggtcagtggagccagcaccctctgctgcttcagcatctccgcctggagccagctgtcccctctctctcaggctccatccgaacaaaaggaaggcagagcctgagatccggcaccccatccccctccactcagcactgagttagagctgggtgggggcatgtctgccttcacacgctgccttatggcttctgtgtctccaacagccctcagcctctggctgctctccttcccaatagtcacaagatttaccatgataataataggttaagacttgaatggtgttttcatcttctttcatcttcaccctgtctcacgttacgttatttttatcctgatgacagaataggtactacaggtatttttactctggttttacagtcaaagaaactgaggcacaggcaggtttgcccaaggtcacataactgcttaatagcagggtagacaggtgaagtaactggatgtgtatcagccatgccctttccccatgcccccggcactccccatgacagctctctgaatcccaacattttattcttttgcaggattagacccaagcatataaattcctttttccctctctccattcccacattcttttattttcacgtacttactataggccttgtaggggctctgtgaacaagacaaaggccaggtgctgtggctgatgcctgtaatcccaatgctttgggaggctaggcatttgagaccaacctgggtaacaaagcaagacccggtctctataaaaaataaaaattacccgggtatggtggtgtgc

SEQ ID NO: 17737 - DNA, 1885 bp, Homo sapiens
aagccaggtatgataaacgccatacagcgcttagtgacaaacacataaaactgtagctcctgcctctgtagcagaggtgacagccaagggcagtcctgtgctatccaggcctggtaggggggcagcctcgcctcagttgagggctgagggagagactgaggtgcagcagatggcagtggtaaccaaaccagttcccttgccgtgggtggggacacaggagaagcacggaagcatctggaactgagcaatcaggacaggaggctcaagcctgggtgagtcaggagtccgggggctttcttttcatccaacccattgtctgctggtgtctcggcaaaagccagccagccagccgtggcccttcaccgttcttcagactctagggtgagcccagcccagcgacacaacagaaaccaagtgccacgggggccggtgtcctccaccagcatttctcctctggtcacatctacgtcctgatgggacttctccctcctccttggaccatcagctttacagtccagaccaccctgcagccacccggtggtctcccagctgccccagtctcgggcaggatggcttttgagcctgttgggagagaccttgccaggagaatggtgcccagggcaggcaagaggacacagactctgggagctagaagagttgcggcccaggggccaggcccactcccagaggacaggaggcccaaaagcggggaaaggctccatgttacggtggccccatgctgggagtttgtgctgccttctgtctccctgactgcccaagcgtggggtggtgtggggcaggaggcatcctctggtgttccctagcagcccaggctgtgtgcaggggctcccattttgtgtctcagctgcaagaaggccacaaagggaggaggggctcatgggactgctgagaagaaggtgtgcagaaagggagtgtggccctagatcagtcctttaaaaagcctctgttacctgaaaggaggtcaagcagagaggaatggctgcgtgtgtgtcctaccgggcaggacaggacagagggaggtcattgttacacacacatcccccctcctttcctccttcccctccacttccctgtgaaggcctgaggcaggctgtggccaggctcaggccctgactgtggggtacacaccagggagggccacgcctccccacagacggggtggagtggtcagtggagccagcaccctctgctgcttcagcatctccgcctggagccagctgtcccctctctctcaggctccatccgaacaaaaggaaggcagagcctgagatccggcaccccatccccctccactcagcactgagttagagctgggtgggggcatgtctgccttcacacgctgccttatggcttctgtgtctccaacagccctcagcctctggctgctctccttcccaatagtcacaagatttaccatgataataataggttaagacttgaatggtgttttcatcttctttcatcttcaccctgtctcacgttacgttatttttatcctgatgacagaataggtactacaggtatttttactctggttttacagtcaaagaaactgaggcacaggcaggtttgcccaaggtcacataactgcttaatagcagggtagacaggtgaagtaactggatgtgtatcagccatgccctttccccatgcccccggcactcctccattcccacattcttttattttcacgtacttactataggccttgtaggggctctgtgaacaagacaaaggccaggtgctgtggctgatgcctgtaatcccaatgctttgggaggctaggcatttgagaccaacctgggtaacaaagcaagacccggtctctataaaaaataaaaattacccgggtatggtggtgtgc

SEQ ID NO: 17738 - DNA, 388 bp, Homo sapiens
tcagcccacttttgctccccacgtggcaagcacactcccccaaacaagcaatagcctgtggcttcagaggaacctacaaaggcagcatctgtagatttttccttcttcaactctaagacttgaatgtttccctcttccccacacactttttttttaaaccaagaaataaaaaagttttcactcttaaaggtgcaaagcagtttcattcttatgcaacacagccttcctcctactgtcttatagtctgtggatgttaaattatagattccaattgaattttaatactctagagattttacatttgtggttgtcaagaccccgttttggtaaacctagggagctccgcacaaaagcattgatattcagaaaaggcactgacctacaaatt

SEQ ID NO: 17739 - DNA, 229 bp, Homo sapiens
accatgtggggctggaacaagcagccctatccagcagtaaggaggagacctgtcccgcttgagtgtcaacagaggtacagtgggaaatctgaacttctaccttcacctggcagcaatgaaatgacaccccctctcatgccaatgcagtgacagacaaagttagttaaaacaaaagttttaaattaagatccaaagtcttataacataatacaaaaatgtccagatctca

SEQ ID NO: 17740 - DNA, 408 bp, Homo sapiens
cctgtctccccgcttgcctactttctctgtcctcacaccaaccttttggttttgaaaagactcatttctggtcttacaaaatgtagctttagtaagactggtcagatataccaaaattgggataaagtcttagcttaagtaaagaaatatttcagctgtgaattgtgtccccccccgcgctccaccccgccaaactgctacatcgaagtgcttaactctcagtacctcagattgggagagaatgccaagggtgtggctggacagccatgtgctaacgaaattaggtacgtgactcacggatccaatcaacctccacagtagatgccagaaatagagaggtggttatctgaaaaagatccgcggagtgccctcttgtctgactgcttggacccccatgacttgcatggg

SEQ ID NO: 17741 - DNA, 261 bp, Homo sapiens
caactgcagtaaaggcagggcctggcggctggactagtgctcaacttcctacttagtaaatttccatgttcatttgggccccgggaagcacgcttccttccctagccggaagcgaaacgggccctgaatcctcaaaccttaatagtctttagaagagagaagccttgacttcacttttgaggaagggaaccgtgacctggatttagtacgacttaagtttattcacacgtaagaaacggaggtctttcaggataagagcaa

SEQ ID NO: 17742 - DNA, 478 bp, Homo sapiens
ctttaaaaaaaaaaaattttttttaacagagatagggtctttgctgtgtggtccaaactggtccacataactcctggcttcaagcaatcctcccacctcagcttcccaaagtcctgggattacaggcgtgagccactgtgcccacctgcatttttcagactcagttcatcatctgttttagtctactactgttttatattcattcttgtttgtatttcctgtttccttccactttcatacatactgagttaatttttttttaagtcccataaaatcatactgacttcctcctattcttactgggattatctgtaattatatgaccagattttccttgtcagaacctcacagaacttggctgggcgcggtggctcacacctggaatcccagcactttgggaggccaaggcgggtggatcacctgaggtcaggagtccaagaccagcctggccaacatggtgaaacctcgtctctactaa

SEQ ID NO: 17743 - DNA, 237 bp, Homo sapiens
ctggcttctaggtacagctgccagtatttacatataaaagctcctactttgcatgtctatgcctgacttctcaggctgctttctgtttagacaggaaatggttttgagctgctttttatgaaaggaaaattccaccgagaactttcaccctttctagctgcctaaaaattatttcttaataactcttgtattattgtctttttattgtttatttatttatttatttaagatggagtc

SEQ ID NO: 17744 - DNA, 767 bp, Homo sapiens
  misc_feature (758)..(758): n is a, c, g, or t
gacaatgggtgaactctagatggtttgaatagattctctttgaggtaccaattctaaaatgtttgctattccttgaatataggaaatgctaaaaacaatatgtgattaaataccaagtgaatagagtaatagtacagtttgaagtttggggtgttaataaatgatcagaatatcatggcttagcttcctgaaggaggttttttttttttttttttttttgagacaaggtcttgctctgttgcccaggttctagagtgcagtggtgcatgatcacggctcattgcagcctcgatcttgagggtccaagtgattctcccaaagtgctgttactacaggtatgacccaccacgcctggcctctgaaggagatttatataagtagaacaatggcaagtaggaaattagaagtattactttattattaatttgggcttttggccaaaataccaatgtaaatttgtgtagtaaacagggtgacatcatattacttaagctccaggactagtcaagggctctctcatcctcctaaatttcactgtcttactactctttggttgatggctttgcagaagaccccaacaattagtcttttagagtgtgtaagagtgaaatgaccaagaacaagaacacaaactcttacatgtatgtgacttttttttctatcttgcacttgaatcaagatttgtgtaacttttaatcttcattgatcttcatagttgtacacagggtattgaagctcatggtgctagctctctcctngtgccgaat

SEQ ID NO: 17745 - DNA, 2498 bp, Homo sapiens
  misc_feature (1899)..(1899): n is a, c, g, or t
  misc_feature (1922)..(1922): n is a, c, g, or t
  misc_feature (1958)..(1958): n is a, c, g, or t
  misc_feature (2291)..(2291): n is a, c, g, or t
  misc_feature (2333)..(2333): n is a, c, g, or t
  misc_feature (2336)..(2336): n is a, c, g, or t
  misc_feature (2338)..(2338): n is a, c, g, or t
  misc_feature (2351)..(2351): n is a, c, g, or t
  misc_feature (2377)..(2378): n is a, c, g, or t
  misc_feature (2387)..(2387): n is a, c, g, or t
  misc_feature (2450)..(2451): n is a, c, g, or t
  misc_feature (2481)..(2481): n is a, c, g, or t
gacaatgggtgaactctagatggtttgaatagattctctttgaggtaccaattctaaaatgtttgctattccttgaatataggaaatgctaaaaacaatatgtgattaaataccaagtgaatagagtaatagtacagtttgaagtttggggtgttaataaatgatcagaatatcatggcttagcttcctgaaggaggttttttttttttttttttttttgagacaaggtcttgctctgttgcccaggttctagagtgcagtggtgcatgatcacggctcattgcagcctcgatcttgagggtccaagtgattctcccacctcggcctcccaaagtgctgttactacaggtatgacccaccacgcctggcctctgaaggagatttatataagtagaacaatggcaagtaggaaattagaagtattactttattattaatttgggcttttggccaaaataccaatgtaaatttgtgtagtaaacagggtgacatcatattacttaagctccaggactagtcaagggctctctcatcctcctaaatttcactgtcttactactctttggttgatggctttgcagaagaccccaacaattagtcttttagagtgtgtaagagtgaaatgaccaagaacaagaacacaaactcttacatgtatgtgacttttttttctatcttgcacttgaatcaagatttgtgtaacttttaatcttcattgatcttcatagttgtacacagggttcaatcagtactgtggactcttgacccaatccgattagtgttccatcctcttagagagattcaagaagaaaggcaattgagggaaagagcaagacctcttgttggtctggcttcaaatctctaatgaggttgatgtaatggcctgtgaggagtaactaaaaatatttggctatctgcctaagcagccctacattctgacatttttcagtatagtccctgggactgggtggggggcggcggaactgcaaagtatttttcaaatttaaggataaagctggatgtggtggctcacaactgtaatcctagtgctttgggaggtcgaggcaggaggctcccttgagaccaggagtttgagaccagcctgggcaacgtaacaagacccccgtctctgcaaaaaaaattaaaaattagccaggcgtggtagcacgtgcctgtagcccaagctactcagaaggctgaggcgggaggattgtttgagcctaggaggtcaaggctgcagtgagccaatattgtgccattgctttccagcctgggagacagagtgagaccctgtctcaacaacaacaaaatgtaaggataagagaaccccataaggtacagttagggaaagatatcttgtgataaataagatttgccatgtggaaaactgacccaccatcagtgataactgctatggcattttggtaagatgctgatgctaattttggtaacaggagtgtcatctttgaggaatatgattatgtgtgattatattagcagagcaaagctgaagtctagtcacattgtactctcatattgtagcctgaagcaagaatatgatgacagcaggggagtgatgaacttggaggctagagaagagggaagcagaggcttctactgcctcggctgcattgatactggcttgcaaactcccggaggaagaggcccatcatctgctttggtcacttcagtgcaccttgcttgcgaagagtacagtaggcattcatttgttaaatgaatgaataatattaacgtatggtattattgaggtagagataagggagatttggcttaatcgcttgaccccaaggcatacttaggaagttattattattattattattttttgagatggagtctccctctgtcaccaagctggacgatctcagctcactgcancctccgcctcctgggctgaagcnattctgctgtctcagcctcccaaggagctggggttncaggcgatcaccaccacacctggctaaattttgtatttttagtagagatgggttttgccatgttgtccaggcaggtcttgaactcctgacctccggtgatctgcccacctctgcctcccaaagtgctgggggattataggtgtgagccaccgtgcctggccaaaaaattattgataataacaattttatacctcaaatatagtgtagaaaaaacattttagagcttagttatttgaataatcaaaaataagtttgttggccgggtgcagtggctcatgcctgtaatcccagcactttgggaggccaacacgggcggattgcctgaggtcagangtttgagaccagcctggccaacatggtgaaaccccatttctnctnanagtacaaaaattngctgggcatggtggcgaatgcctgtnntctcagctncttgggaggctgagacaggagaatctcttgaacccgggaggcagaggttgcagtgagctgaanncgcgccattgcactccagcctggaaaacangtgtgaaattccgtctc

SEQ ID NO: 17746 - DNA, 780 bp, Homo sapiens
  misc_feature (771)..(771): n is a, c, g, or t
gacaatgggtgaactctagatggtttgaatagattctctttgaggtaccaattctaaaatgtttgctattccttgaatataggaaatgctaaaaacaatatgtgattaaataccaagtgaatagagtaatagtacagtttgaagtttggggtgttaataaatgatcagaatatcatggcttagcttcctgaaggaggttttttttttttttttttttttgagacaaggtcttgctctgttgcccaggttctagagtgcagtggtgcatgatcacggctcattgcagcctcgatcttgagggtccaagtgattctcccacctcggcctcccaaagtgctgttactacaggtatgacccaccacgcctggcctctgaaggagatttatataagtagaacaatggcaagtaggaaattagaagtattactttattattaatttgggcttttggccaaaataccaatgtaaatttgtgtagtaaacagggtgacatcatattacttaagctccaggactagtcaagggctctctcatcctcctaaatttcactgtcttactactctttggttgatggctttgcagaagaccccaacaattagtcttttagagtgtgtaagagtgaaatgaccaagaacaagaacacaaactcttacatgtatgtgacttttttttctatcttgcacttgaatcaagatttgtgtaacttttaatcttcattgatcttcatagttgtacacagggtattgaagctcatggtgctagctctctcctngtgccgaat

SEQ ID NO: 17747 - DNA, 2485 bp, Homo sapiens
  misc_feature (1886)..(1886): n is a, c, g, or t
  misc_feature (1909)..(1909): n is a, c, g, or t
  misc_feature (1945)..(1945): n is a, c, g, or t
  misc_feature (2278)..(2278): n is a, c, g, or t
  misc_feature (2320)..(2320): n is a, c, g, or t
  misc_feature (2323)..(2323): n is a, c, g, or t
  misc_feature (2325)..(2325): n is a, c, g, or t
  misc_feature (2338)..(2338): n is a, c, g, or t
  misc_feature (2364)..(2365): n is a, c, g, or t
  misc_feature (2374)..(2374): n is a, c, g, or t
  misc_feature (2437)..(2438): n is a, c, g, or t
  misc_feature (2468)..(2468): n is a, c, g, or t
gacaatgggtgaactctagatggtttgaatagattctctttgaggtaccaattctaaaatgtttgctattccttgaatataggaaatgctaaaaacaatatgtgattaaataccaagtgaatagagtaatagtacagtttgaagtttggggtgttaataaatgatcagaatatcatggcttagcttcctgaaggaggttttttttttttttttttttttgagacaaggtcttgctctgttgcccaggttctagagtgcagtggtgcatgatcacggctcattgcagcctcgatcttgagggtccaagtgattctcccaaagtgctgttactacaggtatgacccaccacgcctggcctctgaaggagatttatataagtagaacaatggcaagtaggaaattagaagtattactttattattaatttgggcttttggccaaaataccaatgtaaatttgtgtagtaaacagggtgacatcatattacttaagctccaggactagtcaagggctctctcatcctcctaaatttcactgtcttactactctttggttgatggctttgcagaagaccccaacaattagtcttttagagtgtgtaagagtgaaatgaccaagaacaagaacacaaactcttacatgtatgtgacttttttttctatcttgcacttgaatcaagatttgtgtaacttttaatcttcattgatcttcatagttgtacacagggttcaatcagtactgtggactcttgacccaatccgattagtgttccatcctcttagagagattcaagaagaaaggcaattgagggaaagagcaagacctcttgttggtctggcttcaaatctctaatgaggttgatgtaatggcctgtgaggagtaactaaaaatatttggctatctgcctaagcagccctacattctgacatttttcagtatagtccctgggactgggtggggggcggcggaactgcaaagtatttttcaaatttaaggataaagctggatgtggtggctcacaactgtaatcctagtgctttgggaggtcgaggcaggaggctcccttgagaccaggagtttgagaccagcctgggcaacgtaacaagacccccgtctctgcaaaaaaaattaaaaattagccaggcgtggtagcacgtgcctgtagcccaagctactcagaaggctgaggcgggaggattgtttgagcctaggaggtcaaggctgcagtgagccaatattgtgccattgctttccagcctgggagacagagtgagaccctgtctcaacaacaacaaaatgtaaggataagagaaccccataaggtacagttagggaaagatatcttgtgataaataagatttgccatgtggaaaactgacccaccatcagtgataactgctatggcattttggtaagatgctgatgctaattttggtaacaggagtgtcatctttgaggaatatgattatgtgtgattatattagcagagcaaagctgaagtctagtcacattgtactctcatattgtagcctgaagcaagaatatgatgacagcaggggagtgatgaacttggaggctagagaagagggaagcagaggcttctactgcctcggctgcattgatactggcttgcaaactcccggaggaagaggcccatcatctgctttggtcacttcagtgcaccttgcttgcgaagagtacagtaggcattcatttgttaaatgaatgaataatattaacgtatggtattattgaggtagagataagggagatttggcttaatcgcttgaccccaaggcatacttaggaagttattattattattattattttttgagatggagtctccctctgtcaccaagctggacgatctcagctcactgcancctccgcctcctgggctgaagcnattctgctgtctcagcctcccaaggagctggggttncaggcgatcaccaccacacctggctaaattttgtatttttagtagagatgggttttgccatgttgtccaggcaggtcttgaactcctgacctccggtgatctgcccacctctgcctcccaaagtgctgggggattataggtgtgagccaccgtgcctggccaaaaaattattgataataacaattttatacctcaaatatagtgtagaaaaaacattttagagcttagttatttgaataatcaaaaataagtttgttggccgggtgcagtggctcatgcctgtaatcccagcactttgggaggccaacacgggcggattgcctgaggtcagangtttgagaccagcctggccaacatggtgaaaccccatttctnctnanagtacaaaaattngctgggcatggtggcgaatgcctgtnntctcagctncttgggaggctgagacaggagaatctcttgaacccgggaggcagaggttgcagtgagctgaanncgcgccattgcactccagcctggaaaacangtgtgaaattccgtctc

SEQ ID NO: 17748 - DNA, 356 bp, Homo sapiens
gaggccatatttttcttactatttatgtgacttaatgaaattatatctaaactctctatgcctcagtttccttatctgtaagatagagataagaacaacttacagttgttgtgaggagtgattattacctcagaaatgcttgaagggatgcctagcacatcaaagattctcaataaatcaataaattatgacactattacaatgattcccattttctaacatttatattaaaaagcatatgctgggcatagtgactcgcacctgtaatcccagcaccttgggaggccaaagtaagaggatcacttgaacccaggagctcaagaccagccagggcaacataggaagaccctgtctct

SEQ ID NO: 17749 - DNA, 169 bp, Homo sapiens
tatatatatatatatatatatatatatacacacacacacacatatatatacacatatatatacacacacacacgtatatacatatatacatatacacatgtgtatatatatatttctagctataaggctttgggtaaaaaaatgagataaataaaataacaagttattg

SEQ ID NO: 17750 - DNA, 490 bp, Homo sapiens
ggtctgggaggttaaaccgtttcctccagatcacattcccgggaagacgaacccagctgtgcctgactgctcctttcttctcactgcttctgcggaggtggagacgcccgcgtagcccgtgttgtcttcctctgcccactccaggccaagcatcccccttcctgtcacgcgctctttgatggcttcactgtcctggacaccccctcagatctgtgctgtctcagagaaagcaagcgagaatgggcccacggtgctcctcgtctttggaaatggattttacctttataagtgagagctttcagaggcacagagtcctggggctgcataggaacagggggcctggtcggggctcttttcctttccgggacctctttctctataaagaaaataaaaatgcgatttgaggactgttggtacaaatatgaatgtaatctaggctggattcataactgtatattattattatattaaaatttgacttgaaaagaag

SEQ ID NO: 17751 - DNA, 416 bp, Homo sapiens
ttgattcataaagtacctcctcattttaaaaagacattatgatgtaagagagccatttgataactttttagtgagctttgaaaggcaagttacagcctcagctagctagtaagattatctacctgccagaatggcacaaattctacattcaagggtagacgctggcacaacctacttacagattagccctttaaagcaatctgtagcattagaagatggaaccaaggaaatgtttgactgtgggttctggctgttgagaaataatttacacaccgaattagtgaaatgagtcactttctcttaatgtatttatgtacctgagagaatgcttttcaatgttaacctaactcaggtttgactaaattattcaattggaaattgtagaatattatttctgataaaccagaaataagtga

SEQ ID NO: 17752 - DNA, 501 bp, Homo sapiens
cttaagatccagcaacaggggattgctgtttaaaaaaaagactgtggtgcttgtttagaatgcgccgctgtgcagacataaaagtgacaacgtgacagtgtatttatggacatcggaggaagttcacggtggagtaaactttatagaaatgttgtttataaaccagtgtgcctgagatggttcgtgtctttgtaaaatctatttatagaagaggcttaggaaggagccgccctaaccacatttctggaggaataggagagaaacctggagggtgtaggtcttcacatttgcatgatcccggggagtgggggcggggaactgcctggggctgcagcgatcttcatcagtcactggtgaccttgagtgaacgagcctcagttccttcatctgtatagtggggatgaagcaggatttttgtactttttaaaaggcgagaattcatttcaaactcctagaaaagtgcctggcactgtgtgagcccttaataaacatgagcaaata

SEQ ID NO: 17753 - DNA, 776 bp, Homo sapiens
gtcacttccacgggacccaccagcttaaatgccggcagccctgggacttctggcctcacaatggttgagaatgcaagaccatcaaggcaaggatgttaattttcttcaatgaggtatctcctgtgtctggaatgatataaggctcatcccagatgatgaatgaacagtgaatctgtggagcttcagcatcctcacctaagatgggaatagctatgcccatctcccgagattattgtggagatcagatgttatgcgtacaaagcacagggcatgatacctgatacacatcttgctctataaagactggtagaggagtgtgttgttattgttatcaatatcattatcatttttatccataaaatgaagattataaaacctaagttgctgtgaatattgagacaaagtatgaaaagtacctggcaactggagatgtttaataaactggaatttattttctaaaaaaaaaaaagacacaacaaaaaaaaaaaaaaaaaaaaaacaaaaaaaaaaacaacaaagacaaaaccaaacaacccaagagggaaacaggacggcaacataggaaacagagaagatgagcaaacacgggaactcaaagccgaaaaaactagtgccacaacagcatacatagagactgcggaagaacagagacagatacacgatgatacaacagacaaacacgtacaaacacgaccgaggtaccacagctagaaaatgaataaaagatgagagacgataaaaaagagacagcacagtatacagggcccacaaaaaga

SEQ ID NO: 17754 - DNA, 406 bp, Homo sapiens
ggaaaatgacttcaagcttcttagagttcccctaaggcattctctatattcaatgaaaagcagctgtgaagtcataattatgttcacttcccactggcaactggcaagccctttatttttgtgcattcggaactcaccaagaataaataaagtccattccctccttgaggggctattctgccattccatctaggatttaaaagtttgccaattcctaaaacatctattgttatcaatagtcttgtgtctttcacaaagcggactttacaaaataagatgccatgtccagccaaataaatgagactgaacttcatggttgttgtttttacttcatcccggcaaaagaaatgaaattaaatataaaaagcagatgaccaaataaagtccaaatgaattaagtattgct

SEQ ID NO: 17755 - DNA, 6135 bp, Homo sapiens
ggggtcacgggcgaactagaacactgggaaaggggctgcaggttccggaccggaccggccgtgacccggaataatgagcaaggagggtgtggtgggttgaaagccatcctactttactcccgagttagagcatggattcagttttagtcttaagggggaagtgagattggagatttttatttttaattttgggcagaagcaggttgactctagggatctccagagcgagaggatttaacttcatgttgctcccgtgtttgaaggaggacaataaaagtcccaccgggcaaaattttcgtaacctctgcggtagaaaacgtcaggtatcttttaaatcgcgatagttttcgctgtgtcaggctttcttcggtggagctccgagggtagctaggttctaggtttgaaacagatgcagaatccaaaggcagcgcaaaaaacagccaccgattttgctatgtctctgagctgcgagataatcagacagctaaatggagtctgagcagctgttccatagaggctactatagaaacagctacaacagtataacaagtgcaagtagtgatgaggaacttttagatggagcaggtgttattatggactttcaaacatctgaagatgacaatttattagatggtgacactgcagttggaactcattatacaatgacaaatggaggcagcattaacagttctacacatttactggatcttttggatgaaccaattccaggtgttggtacatatgatgatttccatactattgattgggtgcgagaaaaatgtaaagacagagaaaggcatagacggatcaacagcaaaaagaaagaatcagcatgggaaatgacaaaaagtttgtatgatgcgtggtcaggatggctagtagtaacactaacaggattggcatcaggggcactggccggattaatagacattgctgccgattggatgactgacctaaaggagggcatttgccttagtgcgttgtggtacaaccacgaacagtgctgttggggatctaatgaaacaacatttgaagagagggataaatgtccacagtggaaaacatgggcagaattaatcataggtcaagcagagggtcctggttcttatatcatgaactacataatgtacatcttctgggccttgagttttgcctttcttgcagtttccctggtaaaggtatttgctccatatgcctgtggctctggaattccagagattaaaactattttaagtggattcatcatcagaggttacttgggaaaatggactttaatgattaaaaccatcacattagtcctggctgtggcatcaggtttgagtttaggaaaagaaggtcccctggtacatgttgcctgttgctgcggaaatatcttttcctacctctttccaaagtatagcacaaacgaagctaaaaaaagggaggtgctatcagctgcctcagctgcaggggtttctgtagcttttggtgcaccaattggaggagttctttttagcctggaagaggttagctattattttcctctcaaaactttatggagatcattttttgctgctttagtggctgcatttgttttgaggtccatcaatccatttggtaacagccgtctggtccttttttatgtggagtatcatacaccatggtacctttttgaactgtttccttttattcttctaggggtatttggagggctttggggagcctttttcattagggcaaatattgcctggtgtcgtcgacgcaagtccacgaaatttggaaagtatcccgttctggaagtcattattgttgcagccattactgctgtgatagccttccctaatccatacactaggctaaacaccagtgaactgatcaaagagctttttacagactgtggtcccctggaatcctcttctctttgtgactacagaaatgacatgaatgccagtaaaattgtcgatgacattcctgatcgtccagcaggcattggagtatattcagctatatggcagttatgcctggcactcatatttaaaatcataatgacagtattcacttttggcatcaaggttccatcaggcttgttcatccccagcatggccattggagcgatcgcaggaaggattgtggggattgcggtggagcagcttgcctactatcaccacgactggtttatctttaaggagtggtgtgaggtcggggctgattgcattacacctggcctttatgccatggttggtgctgctgcatgcttaggtggtgtgacaagaatgactgtctccctggtggttattgtttttgagcttactggaggcttggaatatattgttccccttatggctgcagtcatgaccagtaaatgggttggagatgcctttggcagggaaggcatttatgaagcacacatccgattaaatggataccctttcttggatgcaaaagaagaattcactcataccaccctggctgctgacgttatgagacctcgaaggaatgatcctcccttagctgtcctgacacaggacaatatgacagtggatgatatagaaaacatgattaatgaaaccagctacaatggatttcctgtcataatgtcaaaagaatctcagagattagtgggatttgccctcagaagagacctgacaattgcaatagaaagtgccaggaaaaaacaagaaggtatcgttggcagttctcgggtgtgttttgcacagcacaccccatctcttccagcagaaagtcctcggccattgaagcttcgaagcattcttgacatgagcccttttacagtgacagaccacaccccaatggagatcgtggtggatattttccgaaagctgggactgaggcagtgccttgtaactcacaatgggcgcctccttggcattataacaaaaaaagatatcctccggcatatggcccagacggcaaaccaagaccccgcttcaataatgttcaactgaatctcacagatgaggagagagaagaaacggaagaggaagtttatttgttgaatagcacaactctttaacctgagggagtcatctacttttttttcctcctttacaaaaaaagaaaggaaatataaaagccgggtttttgcaacatggtttgcaaataatgctggtggaatggaggagttgtttggggagggaaaggagagagaaggaaaggagtgaggtatttcccgtctaacagaaagcagcgtatcaactcctattgttctgcactggatgcattcagctgaggatgtgcctgatagtgcaggcttgcgcctcaacagagatgacagcagagtcctcgagcacctggcctgttgctccaacattgcaaagacacattatcagtccctatttctagagggattactttgaattgagccatctataaaactgcaaggtcttgcccttttttttaatcaaaactgttctgtttaattcatgaattgtatagttaagcattacctttctacattccagaagagcctttatttctctctctctctctctctctctctctctctctctactgagctgtaacaaagcctctttaaatcggtgtatccttttgaagcagtcctttctcatattgagatgtactgtgattttactgaggtttcatcacaagaagggagtgtttcttgtgccattaaccatgtagtttgtaccatcactaaatgcttggaacagtacacatgcaccacaacaaaggctcatcaaacaggtaaagtctcgaaggaagcgagaacgaaatctctcattgtgtgccgtgtggctcaaaaccgaaaacaatgaagcttggttttaaaggataaagttttcttttttgttttcctctcagactttatggataatgtgaccgggtcttatgcaaattttctatttctaaaactactactatgatatacaagtgctgttgagcataattaaataaaatgctgctgctttgacagtaaagagaaggaagtattctgattagctgtatctggtattaattgcatgttaaaacactggaatttttaaaattgaaattagatcagtcattcttttcttttctcaagatgtctcatggctgacactgaagaagaaatgtaattcataacttgcactaaatgtatattttttttcttaaaaatttaccattcttatttatatttttatggattaaaatttataaaatacagatcagttaatattgcacttaagtaattttacctttttaatgtgatttttatagaataattcagacttacaaatacagagatatgaacaaagtttacagtgggaacaaaggtttaaaaaaaggttgtggttctctctctgtgatccagtgtgcacataaacctttctctgatctttcactgccatcctctggattatgtcttctgacctgtccattttgacccattaactggaaagttgaaaaactacattaactggaaagttgaaaaactacattactttggagaataaaaccgaaagttcgtgtataccttcttaaaaaaaaaatcaaaccaaaaatgtgaaaacaatagaattgcaaagatagcagttaaaattttaatctgaaaataacctttgaatctcgggctaggttacgtccatatttgaagtggtcagtgatggtttgaacattttttgcaggatgagttaaaatgcactggattatatttgggatttttgtttttggaattgtctgttttaatcacagccttaattcacaattggcaaaggcagtttactcaaaggactgggctaaatattctgtaattatgcatttttgataggaaaatgaaatttttgcaaacagacattttctttttttttggctggagtgcagtggggcatggtcttggctcactgcagcgttgaccacctgggctcaagtgatactcccgcctcagccacccaagtagctggcactacgggcacacgccaccatgcccagctaatttttttgtatttttagtagagatggggttttgccatgctgcccaggctggtctcaactcctcagctcaagcaatctgcctgcgtgagcctcccaaagtggtggaattacaggcgtgggccactgcgcctggcccagacagacattttctgaaacacaactggcaatgagctgtttttacattttgaaagtgattcttcacttcctagttcttaattatagtatacctattaagatctgtaagatcctgaagacataagatcatgaagccatataagaatgaggattgaaagttgagcaaaattttcgggattttgggaaacattcttagctgtgctatctgcctaaaattattccttattacttctctcctttgacagacttcaagttttcttcatagccctttcaaagttttttgagccatccagagtaaaatcatttctaaatgatagttctgtatatctccaactcgtcttaagtgtatttgcctgtgtgcaacgtattgctagactatgaactcctcagcatggctgctggataacttaattgtcctgagttaatagccttcaaaggacaaatcggtttctttgcagatagcttcgtaaaacttcacatggagtttattttatcatatttcccttttttatttctgctcctcctttaattgcccatcttgcttcagagactgacatttcagggtggatattaattaaagcattaattttgttttttggtatatttctatccctagtatttctatcttactgctaaaatacaggaaaagtgccgtatttttaatgcatttagtggttttctttggtgttatctgttccatttttctttttcatacattgaagtgtgtctccttttcaaccaaaataatgaaatagtggagaccatgaaattgttgtgcctggctaattggcaaattaatttaccaatataataagtgtagcgccttgtttgaataccctttttgagaaggtatgatgagaatgggcaagggtgtcagcatctcttcttcttaataattaattgttttcagttttggttcacgaagaatgcttagttaatctgtaatgttgcctagagctgtatttatctgtttttatttatactagtgtagtaaagctgcatatcattacagtaaaaacgactactgtgatgagttaatcagaaaatctattaaaatctatatgacaa

SEQ ID NO: 17756 - DNA, 6080 bp, Homo sapiens
ggggtcacgggcgaactagaacactgggaaaggggctgcaggttccggaccggaccggccgtgacccggaataatgagcaaggagggtgtggtgggttgaaagccatcctactttactcccgagttagagcatggattcagttttagtcttaagggggaagtgagattggagatttttatttttaattttgggcagaagcaggttgactctagggatctccagagcgagaggatttaacttcatgttgctcccgtgtttgaaggaggacaataaaagtcccaccgggcaaaattttcgtaacctctgcggtagaaaacgtcaggtatcttttaaatcgcgatagttttcgctgtgtcaggctttcttcggtggagctccgagggtagctaggttctaggtttgaaacagatgcagaatccaaaggcagcgcaaaaaacagccaccgattttgctatgtctctgagctgcgagataatcagacagctaaatggagtctgagcagctgttccatagaggctactatagaaacagctacaacagtataacaagtgcaagtagtgatgaggaacttttagatggagcaggtgttattatggactttcaaacatctgaagatgacaatttattagatggtgacactgcagttggaactcattatacaatgacaaatggaggcagcattaacagttctacacatttactggatcttttggatgaaccaattccaggtgttggtacatatgatgatttccatactattgattgggtgcgagaaaaatgtaaagacagagaaaggcatagacggatcaacagcaaaaagaaagaatcagcatgggaaatgacaaaaagtttgtatgatgcgtggtcaggatggctagtagtaacactaacaggattggcatcaggggcactggccggattaatagacattgctgccgattggatgactgacctaaaggagggcatttgccttagtgcgttgtggtacaaccacgaacagtgctgttggggatctaatgaaacaacatttgaagagagggataaatgtccacagtggaaaacatgggcagaattaatcataggtcaagcagagggtcctggttcttatatcatgaactacataatgtacatcttctgggccttgagttttgcctttcttgcagtttccctggtaaaggtatttgctccatatgcctgtggctctggaattccagagattaaaactattttaagtggattcatcatcagaggttacttgggaaaatggactttaatgattaaaaccatcacattagtcctggctgtggcatcaggtttgagtttaggaaaagaaggtcccctggtacatgttgcctgttgctgcggaaatatcttttcctacctctttccaaagtatagcacaaacgaagctaaaaaaagggaggtgctatcagctgcctcagctgcaggggtttctgtagcttttggtgcaccaattggaggagttctttttagcctggaagaggttagctattattttcctctcaaaactttatggagatcattttttgctgctttagtggctgcatttgttttgaggtccatcaatccatttggtaacagccgtctggtccttttttatgtggagtatcatacaccatggtacctttttgaactgtttccttttattcttctaggggtatttggagggctttggggagcctttttcattagggcaaatattgcctggtgtcgtcgacgcaagtccacgaaatttggaaagtatcccgttctggaagtcattattgttgcagccattactgctgtgatagccttccctaatccatacactaggctaaacaccagtgaactgatcaaagagctttttacagactgtggtcccctggaatcctcttctctttgtgactacagaaatgacatgaatgccagtaaaattgtcgatgacattcctgatcgtccagcaggcattggagtatattcagctatatggcagttatgcctggcactcatatttaaaatcataatgacagtattcacttttggcatcaaggttccatcaggcttgttcatccccagcatggccattggagcgatcgcaggaaggattgtggggattgcggtggagcagcttgcctactatcaccacgactggtttatctttaaggagtggtgtgaggtcggggctgattgcattacacctggcctttatgccatggttggtgctgctgcatgcttaggtggtgtgacaagaatgactgtctccctggtggttattgtttttgagcttactggaggcttggaatatattgttccccttatggctgcagtcatgaccagtaaatgggttggagatgcctttggcagggaaggcatttatgaagcacacatccgattaaatggataccctttcttggatgcaaaagaagaattcactcataccaccctggctgctgacgttatgagacctcgaaggaatgatcctcccttagctgtcctgacacaggacaatatgacagtggatgatatagaaaacatgattaatgaaaccagctacaatggatttcctgtcataatgtcaaaagaatctcagagattagtgggatttgccctcagaagagacctgacaattgcaatagaaagtgccaggaaaaaacaagaaggtatcgttggcagttctcgggtgtgttttgcacagcacaccccatctcttccagcagaaagtcctcggccattgaagcttcgaagcattcttgacatgagcccttttacagtgacagaccacaccccaatggagatcgtggtggatattttccgaaagctgggactgaggcagtgccttgtaactcacaatgggcgcctccttggcattataacaaaaaaagatatcctccggcatatggcccagacggcaaaccaagaccccgcttcaataatgttcaactgaatctcacagatgaggagagagaagaaacggaagaggaagtttatttgttgaatagcacaactctttaacctgagggagtcatctacttttttttcctcctttacaaaaaaagaaaggaaatataaaagccgggtttttgcaacatggtttgcaaataatgctggtggaatggaggagttgtttggggagggaaaggagagagaaggaaaggagtgaggtatttcccgtctaacagaaagcagcgtatcaactcctattgttctgcactggatgcattcagctgaggatgtgcctgatagtgcaggcttgcgcctcaacagagatgacagcagagtcctcgagcacctggcctgttgctccaacattgcaaagacacattatcagtccctatttctagagggattactttgaattgagccatctataaaactgcaaggtcttgcccttttttttaatcaaaactgttctgtttaattcatgaattgtatagttaagcattacctttctacattccagaagagcctttatttctctctctctctctctctctctctctctctctctactgagctgtaacaaagcctctttaaatcggtgtatccttttgaagcagtcctttctcatattgagatgtactgtgattttactgaggtttcatcacaagaagggagtgtttcttgtgccattaaccatgtagtttgtaccatcactaaatgcttggaacagtacacatgcaccacaacaaaggctcatcaaacaggtaaagtctcgaaggaagcgagaacgaaatctctcattgtgtgccgtgtggctcaaaaccgaaaacaatgaagcttggttttaaaggataaagttttcttttttgttttcctctcagactttatggataatgtgaccgggtcttatgcaaattttctatttctaaaactactactatgatatacaagtgctgttgagcataattaaataaaatgctgctgctttgacagtaaagagaaggaagtattctgattagctgtatctggtattaattgcatgttaaaacactggaatttttaaaattgaaattagatcagtcattcttttcttttctcaagatgtctcatggctgacactgaagaagaaatgtaattcataacttgcactaaatgtatattttttttcttaaaaatttaccattcttatttatatttttatggattaaaatttataaaatacagatcagttaatattgcacttaagtaattttacctttttaatgtgatttttatagaataattcagacttacaaatacagagatatgaacaaagtttacagtgggaacaaaggtttaaaaaaaggttgtggttctctctctgtgatccagtgtgcacataaacctttctctgatctttcactgccatcctctggattatgtcttctgacctgtccattttgacccattaactggaaagttgaaaaactacattaactggaaagttgaaaaactacattactttggagaataaaaccgaaagttcgtgtataccttcttaaaaaaaaaatcaaaccaaaaatgtgaaaacaatagaattgcaaagatagcagttaaaattttaatctgaaaataacctttgaatctcgggctaggttacgtccatatttgaagtggtcagtgatggtttgaacattttttgcaggatgagttaaaatgcactggattatatttgggatttttgtttttggaattgtctgttttaatcacagccttaattcacaattggcaaaggcagtttactcaaaggactgggctaaatattctgtaattatgcatttttgataggaaaatgaaatttttgcaaacagacattttctttttttttggctggagtgcagtggggcatggtcttggctcactgcagcgttgaccacctgggctcaagtgatactcccgcctcagccacccaagtagctggcactacgggcacacgccaccatgcccagctaatttttttgtatttttagtagagatggggttttgccatgctgcccaggctggtctcaactcctcagctcaagcaatctgcctgcgtgagcctcccaaagtggtggaattacaggcgtgggccactgcgcctggcccagacagacattttctgaaacacaactggcaatgagctgtttttacattttgaaagtgattcttcacttcctagttcttaattatagtatacctattaagatctgtaagatcctgaagacataagatcatgaagccatataagaatgaggattgaaagttgagcaaaattttcgggattttgggaaacattcttagctgtgctatctgcctaaaattattccttattacttctctcctttgacagacttcaagttttcttcatagccctttcaaagttttttgagccatccagagtaaaatcatttctaaatgatagttctgtatatctccaactcgtcttaagtgtatttgcctgtgtgcaacgtattgctagactatgaactcctcagcatggctgctggataacttaattgtcctgagttaatagccttcaaaggacaaatcggtttctttgcagatagcttcgtaaaacttcacatggagtttattttatcatatttcccttttttatttctgctcctcctttaattgcccatcttgcttcagagactgacatttcagggtggatattaattaaagcattaattttgttttttggtatatttctatccctagtatttctatcttactgctaaaatacaggaaaagtgccgtatttttaatgcatttagtggttttctttggtgttatctgttccatttttctttttcatacattgaagtgtgtctccttttcaaccaaaataatgaaatagtggagaccatgaaattgttgtgcctggctaattggcaaattaatttaccaatataataagtgtagcgccttgtttgaataccctttttgagaaggtatgatgagaatgggcaagggtgtcagcatctcttcttcttaataattaattgttttcagttttggttcacgaagaatgcttagttaatctgtaatgttgcctagagctgtatttatctgtttttatttatactagtgtagtaaagctgcatatcattacagt

SEQ ID NO: 17757 - DNA, 5751 bp, Homo sapiens
ggggtcacgggcgaactagaacactgggaaaggggctgcaggttccggaccggaccggccgtgacccggaataatgagcaaggagggtgtggtgggttgaaagccatcctactttactcccgagttagagcatggattcagttttagtcttaagggggaagtgagattggagatttttatttttaattttgggcagaagcaggttgactctagggatctccagagcgagaggatttaacttcatgttgctcccgtgtttgaaggaggacaataaaagtcccaccgggcaaaattttcgtaacctctgcggtagaaaacgtcaggtatcttttaaatcgcgatagttttcgctgtgtcaggctttcttcggtggagctccgagggtagctaggttctaggtttgaaacagatgcagaatccaaaggcagcgcaaaaaacagccaccgattttgctatgtctctgagctgcgagataatcagacagctaaatggagtctgagcagctgttccatagaggctactatagaaacagctacaacagtataacaagtgcaagtagtgatgaggaacttttagatggagcaggtgttattatggactttcaaacatctgaagatgacaatttattagatggtgacactgcagttggaactcattatacaatgacaaatggaggcagcattaacagttctacacatttactggatcttttggatgaaccaattccaggtgttggtacatatgatgatttccatactattgattgggtgcgagaaaaatgtaaagacagagaaaggcatagacggatcaacagcaaaaagaaagaatcagcatgggaaatgacaaaaagtttgtatgatgcgtggtcaggatggctagtagtaacactaacaggattggcatcaggggcactggccggattaatagacattgctgccgattggatgactgacctaaaggagggcatttgccttagtgcgttgtggtacaaccacgaacagtgctgttggggatctaatgaaacaacatttgaagagagggataaatgtccacagtggaaaacatgggcagaattaatcataggtcaagcagagggtcctggttcttatatcatgaactacataatgtacatcttctgggccttgagttttgcctttcttgcagtttccctggtaaaggtatttgctccatatgcctgtggctctggaattccagagattaaaactattttaagtggattcatcatcagaggttacttgggaaaatggactttaatgattaaaaccatcacattagtcctggctgtggcatcaggtttgagtttaggaaaagaaggtcccctggtacatgttgcctgttgctgcggaaatatcttttcctacctctttccaaagtatagcacaaacgaagctaaaaaaagggaggtgctatcagctgcctcagctgcaggggtttctgtagcttttggtgcaccaattggaggagttctttttagcctggaagaggttagctattattttcctctcaaaactttatggagatcattttttgctgctttagtggctgcatttgttttgaggtccatcaatccatttggtaacagccgtctggtccttttttatgtggagtatcatacaccatggtacctttttgaactgtttccttttattcttctaggggtatttggagggctttggggagcctttttcattagggcaaatattgcctggtgtcgtcgacgcaagtccacgaaatttggaaagtatcccgttctggaagtcattattgttgcagccattactgctgtgatagccttccctaatccatacactaggctaaacaccagtgaactgatcaaagagctttttacagactgtggtcccctggaatcctcttctctttgtgactacagaaatgacatgaatgccagtaaaattgtcgatgacattcctgatcgtccagcaggcattggagtatattcagctatatggcagttatgcctggcactcatatttaaaatcataatgacagtattcacttttggcatcaaggttccatcaggcttgttcatccccagcatggccattggagcgatcgcaggaaggattgtggggattgcggtggagcagcttgcctactatcaccacgactggtttatctttaaggagtggtgtgaggtcggggctgattgcattacacctggcctttatgccatggttggtgctgctgcatgcttaggtggtgtgacaagaatgactgtctccctggtggttattgtttttgagcttactggaggcttggaatatattgttccccttatggctgcagtcatgaccagtaaatgggttggagatgcctttggcagggaaggcatttatgaagcacacatccgattaaatggataccctttcttggatgcaaaagaagaattcactcataccaccctggctgctgacgttatgagacctcgaaggaatgatcctcccttagctgtcctgacacaggacaatatgacagtggatgatatagaaaacatgattaatgaaaccagctacaatggatttcctgtcataatgtcaaaagaatctcagagattagtgggatttgccctcagaagagacctgacaattgcaatagaaagtgccaggaaaaaacaagaaggtatcgttggcagttctcgggtgtgttttgcacagcacaccccatctcttccagcagaaagtcctcggccattgaagcttcgaagcattcttgacatgagcccttttacagtgacagaccacaccccaatggagatcgtggtggatattttccgaaagctgggactgaggcagtgccttgtaactcacaatgggcgcctccttggcattataacaaaaaaagatatcctccggcatatggcccagacggcaaaccaagaccccgcttcaataatgttcaactgaatctcacagatgaggagagagaagaaacggaagaggaagtttatttgttgaatagcacaactctttaacctgagggagtcatctacttttttttcctcctttacaaaaaaagaaaggaaatataaaagccgggtttttgcaacatggtttgcaaataatgctggtggaatggaggagttgtttggggagggaaaggagagagaaggaaaggagtgaggtatttcccgtctaacagaaagcagcgtatcaactcctattgttctgcactggatgcattcagctgaggatgtgcctgatagtgcaggcttgcgcctcaacagagatgacagcagagtcctcgagcacctggcctgttgctccaacattgcaaagacacattatcagtccctatttctagagggattactttgaattgagccatctataaaactgcaaggtcttgcccttttttttaatcaaaactgttctgtttaattcatgaattgtatagttaagcattacctttctacattccagaagagcctttatttctctctctctctctctctctctctctctctctctactgagctgtaacaaagcctctttaaatcggtgtatccttttgaagcagtcctttctcatattgagatgtactgtgattttactgaggtttcatcacaagaagggagtgtttcttgtgccattaaccatgtagtttgtaccatcactaaatgcttggaacagtacacatgcaccacaacaaaggctcatcaaacaggtaaagtctcgaaggaagcgagaacgaaatctctcattgtgtgccgtgtggctcaaaaccgaaaacaatgaagcttggttttaaaggataaagttttcttttttgttttcctctcagactttatggataatgtgaccgggtcttatgcaaattttctatttctaaaactactactatgatatacaagtgctgttgagcataattaaataaaatgctgctgctttgacagtaaagagaaggaagtattctgattagctgtatctggtattaattgcatgttaaaacactggaatttttaaaattgaaattagatcagtcattcttttcttttctcaagatgtctcatggctgacactgaagaagaaatgtaattcataacttgcactaaatgtatattttttttcttaaaaatttaccattcttatttatatttttatggattaaaatttataaaatacagatcagttaatattgcacttaagtaattttacctttttaatgtgatttttatagaataattcagacttacaaatacagagatatgaacaaagtttacagtgggaacaaaggtttaaaaaaaggttgtggttctctctctgtgatccagtgtgcacataaacctttctctgatctttcactgccatcctctggattatgtcttctgacctgtccattttgacccattaactggaaagttgaaaaactacattaactggaaagttgaaaaactacattactttggagaataaaaccgaaagttcgtgtataccttcttaaaaaaaaaatcaaaccaaaaatgtgaaaacaatagaattgcaaagatagcagttaaaattttaatctgaaaataacctttgaatctcgggctaggttacgtccatatttgaagtggtcagtgatggtttgaacattttttgcaggatgagttaaaatgcactggattatatttgggatttttgtttttggaattgtctgttttaatcacagccttaattcacaattggcaaaggcagtttactcaaaggactgggctaaatattctgtaattatgcatttttgataggaaaatgaaatttttgcaaacagacattttctttttttttggctggagtgcagtggggcatggtcttggctcactgcagcgttgaccacctgggctcaagtgatactcccgcctcagccacccaagtagctggcactacgggcacacgccaccatgcccagctaatttttttgtatttttagtagagatggggttttgccatgctgcccaggctggtctcaactcctcagctcaagcaatctgcctgcgtgagcctcccaaagtggtggaattacaggcgtgggccactgcgcctggcccagacagacattttctgaaacacaactggcaatgagctgtttttacattttgaaagtgattcttcacttcctagttcttaattatagtatacctattaagatctgtaagatcctgaagacataagatcatgaagccatataagaatgaggattgaaagttgagcaaaattttcgggattttgggaaacattcttagctgtgctatctgcctaaaattattccttattacttctctcctttgacagacttcaagttttcttcatagccctttcaaagttttttgagccatccagagtaaaatcatttctaaatgatagttctgtatatctccaactcgtcttaagtgtatttgcctgtgtgcaacgtattgctagactatgaactcctcagcatggctgctggataacttaattgtcctgagttaatagccttcaaaggacaaatcggtttctttgcagatagcttcgtaaaacttcacatggagtttattttatcatatttcccttttttatttctgctcctcctttaattgcccatcttgcttcagagactgacatttcagggtggatattaattaaagcattaattttgttttttggtatatttctatccctagtatttctatcttactgctaaaatacctggatacaagtgtccgttgttcttcgaacgaggggaacctct

SEQ ID NO: 17758 - DNA, 6151 bp, Homo sapiens
ttctcttccccttccgtgggtcagggccggtccggtccggaacctgcagcccctttcccagtgttctagttcgcccgtgacccggaataatgagcaaggagggtgtggtgggttgaaagccatcctactttactcccgagttagagcatggattcagttttagtcttaagggggaagtgagattggagatttttatttttaattttgggcagaagcaggttgactctagggatctccagagcgagaggatttaacttcatgttgctcccgtgtttgaaggaggacaataaaagtcccaccgggcaaaattttcgtaacctctgcggtagaaaacgtcaggtatcttttaaatcgcgatagttttcgctgtgtcaggctttcttcggtggagctccgagggtagctaggttctaggtttgaaacagatgcagaatccaaaggcagcgcaaaaaacagccaccgattttgctatgtctctgagctgcgagataatcagacagctaaatggagtctgagcagctgttccatagaggctactatagaaacagctacaacagtataacaagtgcaagtagtgatgaggaacttttagatggagcaggtgttattatggactttcaaacatctgaagatgacaatttattagatggtgacactgcagttggaactcattatacaatgacaaatggaggcagcattaacagttctacacatttactggatcttttggatgaaccaattccaggtgttggtacatatgatgatttccatactattgattgggtgcgagaaaaatgtaaagacagagaaaggcatagacggatcaacagcaaaaagaaagaatcagcatgggaaatgacaaaaagtttgtatgatgcgtggtcaggatggctagtagtaacactaacaggattggcatcaggggcactggccggattaatagacattgctgccgattggatgactgacctaaaggagggcatttgccttagtgcgttgtggtacaaccacgaacagtgctgttggggatctaatgaaacaacatttgaagagagggataaatgtccacagtggaaaacatgggcagaattaatcataggtcaagcagagggtcctggttcttatatcatgaactacataatgtacatcttctgggccttgagttttgcctttcttgcagtttccctggtaaaggtatttgctccatatgcctgtggctctggaattccagagattaaaactattttaagtggattcatcatcagaggttacttgggaaaatggactttaatgattaaaaccatcacattagtcctggctgtggcatcaggtttgagtttaggaaaagaaggtcccctggtacatgttgcctgttgctgcggaaatatcttttcctacctctttccaaagtatagcacaaacgaagctaaaaaaagggaggtgctatcagctgcctcagctgcaggggtttctgtagcttttggtgcaccaattggaggagttctttttagcctggaagaggttagctattattttcctctcaaaactttatggagatcattttttgctgctttagtggctgcatttgttttgaggtccatcaatccatttggtaacagccgtctggtccttttttatgtggagtatcatacaccatggtacctttttgaactgtttccttttattcttctaggggtatttggagggctttggggagcctttttcattagggcaaatattgcctggtgtcgtcgacgcaagtccacgaaatttggaaagtatcccgttctggaagtcattattgttgcagccattactgctgtgatagccttccctaatccatacactaggctaaacaccagtgaactgatcaaagagctttttacagactgtggtcccctggaatcctcttctctttgtgactacagaaatgacatgaatgccagtaaaattgtcgatgacattcctgatcgtccagcaggcattggagtatattcagctatatggcagttatgcctggcactcatatttaaaatcataatgacagtattcacttttggcatcaaggttccatcaggcttgttcatccccagcatggccattggagcgatcgcaggaaggattgtggggattgcggtggagcagcttgcctactatcaccacgactggtttatctttaaggagtggtgtgaggtcggggctgattgcattacacctggcctttatgccatggttggtgctgctgcatgcttaggtggtgtgacaagaatgactgtctccctggtggttattgtttttgagcttactggaggcttggaatatattgttccccttatggctgcagtcatgaccagtaaatgggttggagatgcctttggcagggaaggcatttatgaagcacacatccgattaaatggataccctttcttggatgcaaaagaagaattcactcataccaccctggctgctgacgttatgagacctcgaaggaatgatcctcccttagctgtcctgacacaggacaatatgacagtggatgatatagaaaacatgattaatgaaaccagctacaatggatttcctgtcataatgtcaaaagaatctcagagattagtgggatttgccctcagaagagacctgacaattgcaatagaaagtgccaggaaaaaacaagaaggtatcgttggcagttctcgggtgtgttttgcacagcacaccccatctcttccagcagaaagtcctcggccattgaagcttcgaagcattcttgacatgagcccttttacagtgacagaccacaccccaatggagatcgtggtggatattttccgaaagctgggactgaggcagtgccttgtaactcacaatgggcgcctccttggcattataacaaaaaaagatatcctccggcatatggcccagacggcaaaccaagaccccgcttcaataatgttcaactgaatctcacagatgaggagagagaagaaacggaagaggaagtttatttgttgaatagcacaactctttaacctgagggagtcatctacttttttttcctcctttacaaaaaaagaaaggaaatataaaagccgggtttttgcaacatggtttgcaaataatgctggtggaatggaggagttgtttggggagggaaaggagagagaaggaaaggagtgaggtatttcccgtctaacagaaagcagcgtatcaactcctattgttctgcactggatgcattcagctgaggatgtgcctgatagtgcaggcttgcgcctcaacagagatgacagcagagtcctcgagcacctggcctgttgctccaacattgcaaagacacattatcagtccctatttctagagggattactttgaattgagccatctataaaactgcaaggtcttgcccttttttttaatcaaaactgttctgtttaattcatgaattgtatagttaagcattacctttctacattccagaagagcctttatttctctctctctctctctctctctctctctctctctactgagctgtaacaaagcctctttaaatcggtgtatccttttgaagcagtcctttctcatattgagatgtactgtgattttactgaggtttcatcacaagaagggagtgtttcttgtgccattaaccatgtagtttgtaccatcactaaatgcttggaacagtacacatgcaccacaacaaaggctcatcaaacaggtaaagtctcgaaggaagcgagaacgaaatctctcattgtgtgccgtgtggctcaaaaccgaaaacaatgaagcttggttttaaaggataaagttttcttttttgttttcctctcagactttatggataatgtgaccgggtcttatgcaaattttctatttctaaaactactactatgatatacaagtgctgttgagcataattaaataaaatgctgctgctttgacagtaaagagaaggaagtattctgattagctgtatctggtattaattgcatgttaaaacactggaatttttaaaattgaaattagatcagtcattcttttcttttctcaagatgtctcatggctgacactgaagaagaaatgtaattcataacttgcactaaatgtatattttttttcttaaaaatttaccattcttatttatatttttatggattaaaatttataaaatacagatcagttaatattgcacttaagtaattttacctttttaatgtgatttttatagaataattcagacttacaaatacagagatatgaacaaagtttacagtgggaacaaaggtttaaaaaaaggttgtggttctctctctgtgatccagtgtgcacataaacctttctctgatctttcactgccatcctctggattatgtcttctgacctgtccattttgacccattaactggaaagttgaaaaactacattaactggaaagttgaaaaactacattactttggagaataaaaccgaaagttcgtgtataccttcttaaaaaaaaaatcaaaccaaaaatgtgaaaacaatagaattgcaaagatagcagttaaaattttaatctgaaaataacctttgaatctcgggctaggttacgtccatatttgaagtggtcagtgatggtttgaacattttttgcaggatgagttaaaatgcactggattatatttgggatttttgtttttggaattgtctgttttaatcacagccttaattcacaattggcaaaggcagtttactcaaaggactgggctaaatattctgtaattatgcatttttgataggaaaatgaaatttttgcaaacagacattttctttttttttggctggagtgcagtggggcatggtcttggctcactgcagcgttgaccacctgggctcaagtgatactcccgcctcagccacccaagtagctggcactacgggcacacgccaccatgcccagctaatttttttgtatttttagtagagatggggttttgccatgctgcccaggctggtctcaactcctcagctcaagcaatctgcctgcgtgagcctcccaaagtggtggaattacaggcgtgggccactgcgcctggcccagacagacattttctgaaacacaactggcaatgagctgtttttacattttgaaagtgattcttcacttcctagttcttaattatagtatacctattaagatctgtaagatcctgaagacataagatcatgaagccatataagaatgaggattgaaagttgagcaaaattttcgggattttgggaaacattcttagctgtgctatctgcctaaaattattccttattacttctctcctttgacagacttcaagttttcttcatagccctttcaaagttttttgagccatccagagtaaaatcatttctaaatgatagttctgtatatctccaactcgtcttaagtgtatttgcctgtgtgcaacgtattgctagactatgaactcctcagcatggctgctggataacttaattgtcctgagttaatagccttcaaaggacaaatcggtttctttgcagatagcttcgtaaaacttcacatggagtttattttatcatatttcccttttttatttctgctcctcctttaattgcccatcttgcttcagagactgacatttcagggtggatattaattaaagcattaattttgttttttggtatatttctatccctagtatttctatcttactgctaaaatacaggaaaagtgccgtatttttaatgcatttagtggttttctttggtgttatctgttccatttttctttttcatacattgaagtgtgtctccttttcaaccaaaataatgaaatagtggagaccatgaaattgttgtgcctggctaattggcaaattaatttaccaatataataagtgtagcgccttgtttgaataccctttttgagaaggtatgatgagaatgggcaagggtgtcagcatctcttcttcttaataattaattgttttcagttttggttcacgaagaatgcttagttaatctgtaatgttgcctagagctgtatttatctgtttttatttatactagtgtagtaaagctgcatatcattacagtaaaaacgactactgtgatgagttaatcagaaaatctattaaaatctatatgacaa

SEQ ID NO: 17759 - DNA, 4727 bp, Homo sapiens
ggggtcacgggcgaactagaacactgggaaaggggctgcaggttccggaccggaccggccgtgacccggaataatgagcaaggagggtgtggtgggttgaaagccatcctactttactcccgagttagagcatggattcagttttagtcttaagggggaagtgagattggagatttttatttttaattttgggcagaagcaggttgactctagggatctccagagcgagaggatttaacttcatgttgctcccgtgtttgaaggaggacaataaaagtcccaccgggcaaaattttcgtaacctctgcggtagaaaacgtcaggtatcttttaaatcgcgatagttttcgctgtgtcaggctttcttcggtggagctccgagggtagctaggttctaggtttgaaacagatgcagaatccaaaggcagcgcaaaaaacagccaccgattttgctatgtctctgagctgcgagataatcagacagctaaatggagtctgagcagctgttccatagaggctactatagaaacagctacaacagtataacaagtgcaagtagtgatgaggaacttttagatggagcaggtgttattatggactttcaaacatctgaagatgacaatttattagatggtgacactgcagttggaactcattatacaatgacaaatggaggcagcattaacagttctacacatttactggatcttttggatgaaccaattccaggtgttggtacatatgatgatttccatactattgattgggtgcgagaaaaatgtaaagacagagaaaggcatagacggatcaacagcaaaaagaaagaatcagcatgggaaatgacaaaaagtttgtatgatgcgtggtcaggatggctagtagtaacactaacaggattggcatcaggggcactggccggattaatagacattgctgccgattggatgactgacctaaaggagggcatttgccttagtgcgttgtggtacaaccacgaacagtgctgttggggatctaatgaaacaacatttgaagagagggataaatgtccacagtggaaaacatgggcagaattaatcataggtcaagcagagggtcctggttcttatatcatgaactacataatgtacatcttctgggccttgagttttgcctttcttgcagtttccctggtaaaggtatttgctccatatgcctgtggctctggaattccagagattaaaactattttaagtggattcatcatcagaggttacttgggaaaatggactttaatgattaaaaccatcacattagtcctggctgtggcatcaggtttgagtttaggaaaagaaggtcccctggtacatgttgcctgttgctgcggaaatatcttttcctacctctttccaaagtatagcacaaacgaagctaaaaaaagggaggtgctatcagctgcctcagctgcaggggtttctgtagcttttggtgcaccaattggaggagttctttttagcctggaagaggttagctattattttcctctcaaaactttatggagatcattttttgctgctttagtggctgcatttgttttgaggtccatcaatccatttggtaacagccgtctggtccttttttatgtggagtatcatacaccatggtacctttttgaactgtttccttttattcttctaggggtatttggagggctttggggagcctttttcattagggcaaatattgcctggtgtcgtcgacgcaagtccacgaaatttggaaagtatcccgttctggaagtcattattgttgcagccattactgctgtgatagccttccctaatccatacactaggctaaacaccagtgaactgatcaaagagctttttacagactgtggtcccctggaatcctcttctctttgtgactacagaaatgacatgaatgccagtaaaattgtcgatgacattcctgatcgtccagcaggcattggagtatattcagctatatggcagttatgcctggcactcatatttaaaatcataatgacagtattcacttttggcatcaaggttccatcaggcttgttcatccccagcatggccattggagcgatcgcaggaaggattgtggggattgcggtggagcagcttgcctactatcaccacgactggtttatctttaaggagtggtgtgaggtcggggctgattgcattacacctggcctttatgccatggttggtgctgctgcatgcttaggtggtgtgacaagaatgactgtctccctggtggttattgtttttgagcttactggaggcttggaatatattgttccccttatggctgcagtcatgaccagtaaatgggttggagatgcctttggcagggaaggcatttatgaagcacacatccgattaaatggataccctttcttggatgcaaaagaagaattcactcataccaccctggctgctgacgttatgagacctcgaaggaatgatcctcccttagctgtcctgacacaggacaatatgacagtggatgatatagaaaacatgattaatgaaaccagctacaatggatttcctgtcataatgtcaaaagaatctcagagattagtgggatttgccctcagaagagacctgacaattgcaatagaaagtgccaggaaaaaacaagaaggtatcgttggcagttctcgggtgtgttttgcacagcacaccccatctcttccagcagaaagtcctcggccattgaagcttcgaagcattcttgacatgagcccttttacagtgacagaccacaccccaatggagatcgtggtggatattttccgaaagctgggactgaggcagtgccttgtaactcacaatgggcgcctccttggcattataacaaaaaaagatatcctccggcatatggcccagacggcaaaccaagaccccgcttcaataatgttcaactgaatctcacagatgaggagagagaagaaacggaagaggaagtttatttgttgaatagcacaactctttaacctgagggagtcatctacttttttttcctcctttacaaaaaaagaaaggaaatataaaagccgggtttttgcaacatggtttgcaaataatgctggtggaatggaggagttgtttggggagggaaaggagagagaaggaaaggagtgaggtatttcccgtctaacagaaagcagcgtatcaactcctattgttctgcactggatgcattcagctgaggatgtgcctgatagtgcaggcttgcgcctcaacagagatgacagcagagtcctcgagcacctggcctgttgctccaacattgcaaagacacattatcagtccctatttctagagggattactttgaattgagccatctataaaactgcaaggtcttgcccttttttttaatcaaaactgttctgtttaattcatgaattgtatagttaagcattacctttctacattccagaagagcctttatttctctctctctctctctctctctctctctctctctactgagctgtaacaaagcctctttaaatcggtgtatccttttgaagcagtcctttctcatattgagatgtactgtgattttactgaggtttcatcacaagaagggagtgtttcttgtgccattaaccatgtagtttgtaccatcactaaatgcttggaacagtacacatgcaccacaacaaaggctcatcaaacaggtaaagtctcgaaggaagcgagaacgaaatctctcattgtgtgccgtgtggctcaaaaccgaaaacaatgaagcttggttttaaaggataaagttttcttttttgttttcctctcagactttatggataatgtgaccgggtcttatgcaaattttctatttctaaaactactactatgatatacaagtgctgttgagcataattaaataaaatgctgctgctttgacagtaaagagaaggaagtattctgattagctgtatctggtattaattgcatgttaaaacactggaatttttaaaattgaaattagatcagtcattcttttcttttctcaagatgtctcatggctgacactgaagaagaaatgtaattcataacttgcactaaatgtatattttttttcttaaaaatttaccattcttatttatatttttatggattaaaatttataaaatacagatcagttaatattgcacttaagtaattttacctttttaatgtgatttttatagaataattcagacttacaaatacagagatatgaacaaagtttacagtgggaacaaaggtttaaaaaaaggttgtggttctctctctgtgatccagtgtgcacataaacctttctctgatctttcactgccatcctctggattatgtcttctgacctgtccattttgacccattaactggaaagttgaaaaactacattaactggaaagttgaaaaactacattactttggagaataaaaccgaaagttcgtgtataccttcttaaaaaaaaaatcaaaccaaaaatgtgaaaacaatagaattgcaaagatagcagttaaaattttaatctgaaaataacctttgaatctcgggctaggttacgtccatatttgaagtggtcagtgatggtttgaacattttttgcaggatgagttaaaatgcataattacagaatatttagcccagtcctttgagtaaactgcctttgccaattgtgaattaaggctgtgattaaaacagacaattcca

SEQ ID NO: 17760 - DNA, 4481 bp, Homo sapiens
ggggtcacgggcgaactagaacactgggaaaggggctgcaggttccggaccggaccggccgtgacccggaataatgagcaaggagggtgtggtgggttgaaagccatcctactttactcccgagttagagcatggattcagttttagtcttaagggggaagtgagattggagatttttatttttaattttgggcagaagcaggttgactctagggatctccagagcgagaggatttaacttcatgttgctcccgtgtttgaaggaggacaataaaagtcccaccgggcaaaattttcgtaacctctgcggtagaaaacgtcaggtatcttttaaatcgcgatagttttcgctgtgtcaggctttcttcggtggagctccgagggtagctaggttctaggtttgaaacagatgcagaatccaaaggcagcgcaaaaaacagccaccgattttgctatgtctctgagctgcgagataatcagacagctaaatggagtctgagcagctgttccatagaggctactatagaaacagctacaacagtataacaagtgcaagtagtgatgaggaacttttagatggagcaggtgttattatggactttcaaacatctgaagatgacaatttattagatggtgacactgcagttggaactcattatacaatgacaaatggaggcagcattaacagttctacacatttactggatcttttggatgaaccaattccaggtgttggtacatatgatgatttccatactattgattgggtgcgagaaaaatgtaaagacagagaaaggcatagacggatcaacagcaaaaagaaagaatcagcatgggaaatgacaaaaagtttgtatgatgcgtggtcaggatggctagtagtaacactaacaggattggcatcaggggcactggccggattaatagacattgctgccgattggatgactgacctaaaggagggcatttgccttagtgcgttgtggtacaaccacgaacagtgctgttggggatctaatgaaacaacatttgaagagagggataaatgtccacagtggaaaacatgggcagaattaatcataggtcaagcagagggtcctggttcttatatcatgaactacataatgtacatcttctgggccttgagttttgcctttcttgcagtttccctggtaaaggtatttgctccatatgcctgtggctctggaattccagagattaaaactattttaagtggattcatcatcagaggttacttgggaaaatggactttaatgattaaaaccatcacattagtcctggctgtggcatcaggtttgagtttaggaaaagaaggtcccctggtacatgttgcctgttgctgcggaaatatcttttcctacctctttccaaagtatagcacaaacgaagctaaaaaaagggaggtgctatcagctgcctcagctgcaggggtttctgtagcttttggtgcaccaattggaggagttctttttagcctggaagaggttagctattattttcctctcaaaactttatggagatcattttttgctgctttagtggctgcatttgttttgaggtccatcaatccatttggtaacagccgtctggtccttttttatgtggagtatcatacaccatggtacctttttgaactgtttccttttattcttctaggggtatttggagggctttggggagcctttttcattagggcaaatattgcctggtgtcgtcgacgcaagtccacgaaatttggaaagtatcccgttctggaagtcattattgttgcagccattactgctgtgatagccttccctaatccatacactaggctaaacaccagtgaactgatcaaagagctttttacagactgtggtcccctggaatcctcttctctttgtgactacagaaatgacatgaatgccagtaaaattgtcgatgacattcctgatcgtccagcaggcattggagtatattcagctatatggcagttatgcctggcactcatatttaaaatcataatgacagtattcacttttggcatcaaggttccatcaggcttgttcatccccagcatggccattggagcgatcgcaggaaggattgtggggattgcggtggagcagcttgcctactatcaccacgactggtttatctttaaggagtggtgtgaggtcggggctgattgcattacacctggcctttatgccatggttggtgctgctgcatgcttaggtggtgtgacaagaatgactgtctccctggtggttattgtttttgagcttactggaggcttggaatatattgttccccttatggctgcagtcatgaccagtaaatgggttggagatgcctttggcagggaaggcatttatgaagcacacatccgattaaatggataccctttcttggatgcaaaagaagaattcactcataccaccctggctgctgacgttatgagacctcgaaggaatgatcctcccttagctgtcctgacacaggacaatatgacagtggatgatatagaaaacatgattaatgaaaccagctacaatggatttcctgtcataatgtcaaaagaatctcagagattagtgggatttgccctcagaagagacctgacaattgcaatagaaagtgccaggaaaaaacaagaaggtatcgttggcagttctcgggtgtgttttgcacagcacaccccatctcttccagcagaaagtcctcggccattgaagcttcgaagcattcttgacatgagcccttttacagtgacagaccacaccccaatggagatcgtggtggatattttccgaaagctgggactgaggcagtgccttgtaactcacaatgggcgcctccttggcattataacaaaaaaagatatcctccggcatatggcccagacggcaaaccaagaccccgcttcaataatgttcaactgaatctcacagatgaggagagagaagaaacggaagaggaagtttatttgttgaatagcacaactctttaacctgagggagtcatctacttttttttcctcctttacaaaaaaagaaaggaaatataaaagccgggtttttgcaacatggtttgcaaataatgctggtggaatggaggagttgtttggggagggaaaggagagagaaggaaaggagtgaggtatttcccgtctaacagaaagcagcgtatcaactcctattgttctgcactggatgcattcagctgaggatgtgcctgatagtgcaggcttgcgcctcaacagagatgacagcagagtcctcgagcacctggcctgttgctccaacattgcaaagacacattatcagtccctatttctagagggattactttgaattgagccatctataaaactgcaaggtcttgcccttttttttaatcaaaactgttctgtttaattcatgaattgtatagttaagcattacctttctacattccagaagagcctttatttctctctctctctctctctctctctctctctctctactgagctgtaacaaagcctctttaaatcggtgtatccttttgaagcagtcctttctcatattgagatgtactgtgattttactgaggtttcatcacaagaagggagtgtttcttgtgccattaaccatgtagtttgtaccatcactaaatgcttggaacagtacacatgcaccacaacaaaggctcatcaaacaggtaaagtctcgaaggaagcgagaacgaaatctctcattgtgtgccgtgtggctcaaaaccgaaaacaatgaagcttggttttaaaggataaagttttcttttttgttttcctctcagactttatggataatgtgaccgggtcttatgcaaattttctatttctaaaactactactatgatatacaagtgctgttgagcataattaaataaaatgctgctgctttgacagtaaagagaaggaagtattctgattagctgtatctggtattaattgcatgttaaaacactggaatttttaaaattgaaattagatcagtcattcttttcttttctcaagatgtctcatggctgacactgaagaagaaatgtaattcataacttgcactaaatgtatattttttttcttaaaaatttaccattcttatttatatttttatggattaaaatttataaaatacagatcagttaatattgcacttaagtaattttacctttttaatgtgatttttatagaataattcagacttacaaatacagagatatgaacaaagtttacagtgggaacaaaggtttaaaaaaaggttgtggttctctctctgtgatccagtgtgcacataaacctttctctgatctttcactgccatcctctggattatgtcttctgacctgtccattttgacccattaactggaaagttgaaaaactacattaactggaaagttgaaaaactacattactttggagaataaaaccgaaagttcgtgtataccttctta

SEQ ID NO: 17761 - DNA, 6101 bp, Homo sapiens
ttctcttccccttccgtgggtcagggccggtccggtccggaacctgcagcccctttcccagtgttctagttcgcccgtgacccggaataatgagcaaggagggtgtggtgggttgaaagccatcctactttactcccgagttagagcatggattcagttttagtcttaagggggaagtgagattggagatttttatttttaattttgggcagaagcaggttgactctagggatctccagagcgagaggatttaacttcatgttgctcccgtgtttgaaggaggacaataaaagtcccaccgggcaaaattttcgtaacctctgcggtagaaaacgtcaggtatcttttaaatcgcgatagttttcgctgtgtcaggctttcttcggtggagctccgagggtagctaggttctaggtttgaaacagatgcagaatccaaaggcagcgcaaaaaacagccaccgattttgctatgtctctgagctgcgagataatcagacagctaaatggagtctgagcagctgttccatagaggctactatagaaacagctacaacagtataacaagtgcaagtagtgatgaggaacttttagatggagcaggtgttattatggactttcaaacatctgaagatgacaatttattagatggtgacactgcagttggaactcattatacaatgacaaatggaggcagcattaacagttctacacatttactggatcttttggatgaaccaattccaggtgttggtacatatgatgatttccatactattgattgggtgcgagaaaaatgtaaagacagagaaaggcatagacggatcaacagcaaaaagaaagaatcagcatgggaaatgacaaaaagtttgtatgatgcgtggtcaggatggctagtagtaacactaacaggattggcatcaggggcactggccggattaatagacattgctgccgattggatgactgacctaaaggagggcatttgccttagtgcgttgtggtacaaccacgaacagtgctgttggggatctaatgaaacaacatttgaagagagggataaatgtccacagtggaaaacatgggcagaattaatcataggtcaagcagagggtcctggttcttatatcatgaactacataatgtacatcttctgggccttgagttttgcctttcttgcagtttccctggtaaaggtatttgctccatatgcctgtggctctggaattccagagattaaaactattttaagtggattcatcatcagaggttacttgggaaaatggactttaatgattaaaaccatcacattagtcctggctgtggcatcaggtttgagtttaggaaaagaaggtcccctggtacatgttgcctgttgctgcggaaatatcttttcctacctctttccaaagtatagcacaaacgaagctaaaaaaagggaggtgctatcagctgcctcagctgcaggggtttctgtagcttttggtgcaccaattggaggagttctttttagcctggaagaggttagctattattttcctctcaaaactttatggagatcattttttgctgctttagtggctgcatttgttttgaggtccatcaatccatttggtaacagccgtctggtccttttttatgtggagtatcatacaccatggtacctttttgaactgtttccttttattcttctaggggtatttggagggctttggggagcctttttcattagggcaaatattgcctggtgtcgtcgacgcaagtccacgaaatttggaaagtatcccgttctggaagtcattattgttgcagccattactgctgtgatagccttccctaatccatacactaggctaaacaccagtgaactgatcaaagagctttttacagactgtggtcccctggaatcctcttctctttgtgactacagaaatgacatgaatgccagtaaaattgtcgatgacattcctgatcgtccagcaggcattggagtatattcagctatatggcagttatgcctggcactcatatttaaaatcataatgacagtattcacttttggcatcaaggttccatcaggcttgttcatccccagcatggccattggagcgatcgcaggaaggattgtggggattgcggtggagcagcttgcctactatcaccacgactggtttatctttaaggagtggtgtgaggtcggggctgattgcattacacctggcctttatgccatggttggtgctgctgcatgcttaggtggtgtgacaagaatgactgtctccctggtggttattgtttttgagcttactggaggcttggaatatattgttccccttatggctgcagtcatgaccagtaaatgggttggagatgcctttggcagggaaggcatttatgaagcacacatccgattaaatggataccctttcttggatgcaaaagaagaattcactcataccaccctggctgctgacgttatgagacctcgaaggaatgatcctcccttagctgtcctgacacaggacaatatgacagtggatgatatagaaaacatgattaatgaaaccagctacaatggatttcctgtcataatgtcaaaagaatctcagagattagtgggatttgccctcagaagagacctgacaattgcaatagaaagtgccaggaaaaaacaagaaggtatcgttggcagttctcgggtgtgttttgcacagcacaccccatctcttccagcagaaagtcctcggccattgaagcttcgaagcattcttgacatgagcccttttacagtgacagaccacaccccaatggagatcgtggtggatattttccgaaagctgggactgaggcagtgccttgtaactcacaatgggcgcctccttggcattataacaaaaaaagatatcctccggcatatggcccagacggcaaaccaagaccccgcttcaataatgttcaactgaatctcacagatgaggagagagaagaaacggaagaggaagtttatttgttgaatagcacaactctttaacctgagggagtcatctacttttttttcctcctttacaaaaaaagaaaggaaatataaaagccgggtttttgcaacatggtttgcaaataatgctggtggaatggaggagttgtttggggagggaaaggagagagaaggaaaggagtgagtggatgcattcagctgaggatgtgcctgatagtgcaggcttgcgcctcaacagagatgacagcagagtcctcgagcacctggcctgttgctccaacattgcaaagacacattatcagtccctatttctagagggattactttgaattgagccatctataaaactgcaaggtcttgcccttttttttaatcaaaactgttctgtttaattcatgaattgtatagttaagcattacctttctacattccagaagagcctttatttctctctctctctctctctctctctctctctctctactgagctgtaacaaagcctctttaaatcggtgtatccttttgaagcagtcctttctcatattgagatgtactgtgattttactgaggtttcatcacaagaagggagtgtttcttgtgccattaaccatgtagtttgtaccatcactaaatgcttggaacagtacacatgcaccacaacaaaggctcatcaaacaggtaaagtctcgaaggaagcgagaacgaaatctctcattgtgtgccgtgtggctcaaaaccgaaaacaatgaagcttggttttaaaggataaagttttcttttttgttttcctctcagactttatggataatgtgaccgggtcttatgcaaattttctatttctaaaactactactatgatatacaagtgctgttgagcataattaaataaaatgctgctgctttgacagtaaagagaaggaagtattctgattagctgtatctggtattaattgcatgttaaaacactggaatttttaaaattgaaattagatcagtcattcttttcttttctcaagatgtctcatggctgacactgaagaagaaatgtaattcataacttgcactaaatgtatattttttttcttaaaaatttaccattcttatttatatttttatggattaaaatttataaaatacagatcagttaatattgcacttaagtaattttacctttttaatgtgatttttatagaataattcagacttacaaatacagagatatgaacaaagtttacagtgggaacaaaggtttaaaaaaaggttgtggttctctctctgtgatccagtgtgcacataaacctttctctgatctttcactgccatcctctggattatgtcttctgacctgtccattttgacccattaactggaaagttgaaaaactacattaactggaaagttgaaaaactacattactttggagaataaaaccgaaagttcgtgtataccttcttaaaaaaaaaatcaaaccaaaaatgtgaaaacaatagaattgcaaagatagcagttaaaattttaatctgaaaataacctttgaatctcgggctaggttacgtccatatttgaagtggtcagtgatggtttgaacattttttgcaggatgagttaaaatgcactggattatatttgggatttttgtttttggaattgtctgttttaatcacagccttaattcacaattggcaaaggcagtttactcaaaggactgggctaaatattctgtaattatgcatttttgataggaaaatgaaatttttgcaaacagacattttctttttttttggctggagtgcagtggggcatggtcttggctcactgcagcgttgaccacctgggctcaagtgatactcccgcctcagccacccaagtagctggcactacgggcacacgccaccatgcccagctaatttttttgtatttttagtagagatggggttttgccatgctgcccaggctggtctcaactcctcagctcaagcaatctgcctgcgtgagcctcccaaagtggtggaattacaggcgtgggccactgcgcctggcccagacagacattttctgaaacacaactggcaatgagctgtttttacattttgaaagtgattcttcacttcctagttcttaattatagtatacctattaagatctgtaagatcctgaagacataagatcatgaagccatataagaatgaggattgaaagttgagcaaaattttcgggattttgggaaacattcttagctgtgctatctgcctaaaattattccttattacttctctcctttgacagacttcaagttttcttcatagccctttcaaagttttttgagccatccagagtaaaatcatttctaaatgatagttctgtatatctccaactcgtcttaagtgtatttgcctgtgtgcaacgtattgctagactatgaactcctcagcatggctgctggataacttaattgtcctgagttaatagccttcaaaggacaaatcggtttctttgcagatagcttcgtaaaacttcacatggagtttattttatcatatttcccttttttatttctgctcctcctttaattgcccatcttgcttcagagactgacatttcagggtggatattaattaaagcattaattttgttttttggtatatttctatccctagtatttctatcttactgctaaaatacaggaaaagtgccgtatttttaatgcatttagtggttttctttggtgttatctgttccatttttctttttcatacattgaagtgtgtctccttttcaaccaaaataatgaaatagtggagaccatgaaattgttgtgcctggctaattggcaaattaatttaccaatataataagtgtagcgccttgtttgaataccctttttgagaaggtatgatgagaatgggcaagggtgtcagcatctcttcttcttaataattaattgttttcagttttggttcacgaagaatgcttagttaatctgtaatgttgcctagagctgtatttatctgtttttatttatactagtgtagtaaagctgcatatcattacagtaaaaacgactactgtgatgagttaatcagaaaatctattaaaatctatatgacaa

SEQ ID NO: 17762 - DNA, 5600 bp, Homo sapiens
tctggccaacatagcgaggcccagtctcattgaaagaaaaaaaattttttaataaaaaataaaagcagatcttgggtaaagacatgtagtctggtttacaggtattaacaactgtctgtaatgtagtgattttgctccagacttaccttttccattatttagttctgaaattactgttctatgtatggtaaatgagaaaaattgctagattctagaactgtggcttctattcatagttggaaaaatgaagcataaacatttctaatttcagatcaacagcaaaaagaaagaatcagcatgggaaatgacaaaaagtttgtatgatgcgtggtcaggatggctagtagtaacactaacaggattggcatcaggggcactggccggattaatagacattgctgccgattggatgactgacctaaaggagggcatttgccttagtgcgttgtggtacaaccacgaacagtgctgttggggatctaatgaaacaacatttgaagagagggataaatgtccacagtggaaaacatgggcagaattaatcataggtcaagcagagggtcctggttcttatatcatgaactacataatgtacatcttctgggccttgagttttgcctttcttgcagtttccctggtaaaggtatttgctccatatgcctgtggctctggaattccagagattaaaactattttaagtggattcatcatcagaggttacttgggaaaatggactttaatgattaaaaccatcacattagtcctggctgtggcatcaggtttgagtttaggaaaagaaggtcccctggtacatgttgcctgttgctgcggaaatatcttttcctacctctttccaaagtatagcacaaacgaagctaaaaaaagggaggtgctatcagctgcctcagctgcaggggtttctgtagcttttggtgcaccaattggaggagttctttttagcctggaagaggttagctattattttcctctcaaaactttatggagatcattttttgctgctttagtggctgcatttgttttgaggtccatcaatccatttggtaacagccgtctggtccttttttatgtggagtatcatacaccatggtacctttttgaactgtttccttttattcttctaggggtatttggagggctttggggagcctttttcattagggcaaatattgcctggtgtcgtcgacgcaagtccacgaaatttggaaagtatcccgttctggaagtcattattgttgcagccattactgctgtgatagccttccctaatccatacactaggctaaacaccagtgaactgatcaaagagctttttacagactgtggtcccctggaatcctcttctctttgtgactacagaaatgacatgaatgccagtaaaattgtcgatgacattcctgatcgtccagcaggcattggagtatattcagctatatggcagttatgcctggcactcatatttaaaatcataatgacagtattcacttttggcatcaaggttccatcaggcttgttcatccccagcatggccattggagcgatcgcaggaaggattgtggggattgcggtggagcagcttgcctactatcaccacgactggtttatctttaaggagtggtgtgaggtcggggctgattgcattacacctggcctttatgccatggttggtgctgctgcatgcttaggtggtgtgacaagaatgactgtctccctggtggttattgtttttgagcttactggaggcttggaatatattgttccccttatggctgcagtcatgaccagtaaatgggttggagatgcctttggcagggaaggcatttatgaagcacacatccgattaaatggataccctttcttggatgcaaaagaagaattcactcataccaccctggctgctgacgttatgagacctcgaaggaatgatcctcccttagctgtcctgacacaggacaatatgacagtggatgatatagaaaacatgattaatgaaaccagctacaatggatttcctgtcataatgtcaaaagaatctcagagattagtgggatttgccctcagaagagacctgacaattgcaatagaaagtgccaggaaaaaacaagaaggtatcgttggcagttctcgggtgtgttttgcacagcacaccccatctcttccagcagaaagtcctcggccattgaagcttcgaagcattcttgacatgagcccttttacagtgacagaccacaccccaatggagatcgtggtggatattttccgaaagctgggactgaggcagtgccttgtaactcacaatgggcgcctccttggcattataacaaaaaaagatatcctccggcatatggcccagacggcaaaccaagaccccgcttcaataatgttcaactgaatctcacagatgaggagagagaagaaacggaagaggaagtttatttgttgaatagcacaactctttaacctgagggagtcatctacttttttttcctcctttacaaaaaaagaaaggaaatataaaagccgggtttttgcaacatggtttgcaaataatgctggtggaatggaggagttgtttggggagggaaaggagagagaaggaaaggagtgaggtatttcccgtctaacagaaagcagcgtatcaactcctattgttctgcactggatgcattcagctgaggatgtgcctgatagtgcaggcttgcgcctcaacagagatgacagcagagtcctcgagcacctggcctgttgctccaacattgcaaagacacattatcagtccctatttctagagggattactttgaattgagccatctataaaactgcaaggtcttgcccttttttttaatcaaaactgttctgtttaattcatgaattgtatagttaagcattacctttctacattccagaagagcctttatttctctctctctctctctctctctctctctctctctactgagctgtaacaaagcctctttaaatcggtgtatccttttgaagcagtcctttctcatattgagatgtactgtgattttactgaggtttcatcacaagaagggagtgtttcttgtgccattaaccatgtagtttgtaccatcactaaatgcttggaacagtacacatgcaccacaacaaaggctcatcaaacaggtaaagtctcgaaggaagcgagaacgaaatctctcattgtgtgccgtgtggctcaaaaccgaaaacaatgaagcttggttttaaaggataaagttttcttttttgttttcctctcagactttatggataatgtgaccgggtcttatgcaaattttctatttctaaaactactactatgatatacaagtgctgttgagcataattaaataaaatgctgctgctttgacagtaaagagaaggaagtattctgattagctgtatctggtattaattgcatgttaaaacactggaatttttaaaattgaaattagatcagtcattcttttcttttctcaagatgtctcatggctgacactgaagaagaaatgtaattcataacttgcactaaatgtatattttttttcttaaaaatttaccattcttatttatatttttatggattaaaatttataaaatacagatcagttaatattgcacttaagtaattttacctttttaatgtgatttttatagaataattcagacttacaaatacagagatatgaacaaagtttacagtgggaacaaaggtttaaaaaaaggttgtggttctctctctgtgatccagtgtgcacataaacctttctctgatctttcactgccatcctctggattatgtcttctgacctgtccattttgacccattaactggaaagttgaaaaactacattaactggaaagttgaaaaactacattactttggagaataaaaccgaaagttcgtgtataccttcttaaaaaaaaaatcaaaccaaaaatgtgaaaacaatagaattgcaaagatagcagttaaaattttaatctgaaaataacctttgaatctcgggctaggttacgtccatatttgaagtggtcagtgatggtttgaacattttttgcaggatgagttaaaatgcactggattatatttgggatttttgtttttggaattgtctgttttaatcacagccttaattcacaattggcaaaggcagtttactcaaaggactgggctaaatattctgtaattatgcatttttgataggaaaatgaaatttttgcaaacagacattttctttttttttggctggagtgcagtggggcatggtcttggctcactgcagcgttgaccacctgggctcaagtgatactcccgcctcagccacccaagtagctggcactacgggcacacgccaccatgcccagctaatttttttgtatttttagtagagatggggttttgccatgctgcccaggctggtctcaactcctcagctcaagcaatctgcctgcgtgagcctcccaaagtggtggaattacaggcgtgggccactgcgcctggcccagacagacattttctgaaacacaactggcaatgagctgtttttacattttgaaagtgattcttcacttcctagttcttaattatagtatacctattaagatctgtaagatcctgaagacataagatcatgaagccatataagaatgaggattgaaagttgagcaaaattttcgggattttgggaaacattcttagctgtgctatctgcctaaaattattccttattacttctctcctttgacagacttcaagttttcttcatagccctttcaaagttttttgagccatccagagtaaaatcatttctaaatgatagttctgtatatctccaactcgtcttaagtgtatttgcctgtgtgcaacgtattgctagactatgaactcctcagcatggctgctggataacttaattgtcctgagttaatagccttcaaaggacaaatcggtttctttgcagatagcttcgtaaaacttcacatggagtttattttatcatatttcccttttttatttctgctcctcctttaattgcccatcttgcttcagagactgacatttcagggtggatattaattaaagcattaattttgttttttggtatatttctatccctagtatttctatcttactgctaaaatacaggaaaagtgccgtatttttaatgcatttagtggttttctttggtgttatctgttccatttttctttttcatacattgaagtgtgtctccttttcaaccaaaataatgaaatagtggagaccatgaaattgttgtgcctggctaattggcaaattaatttaccaatataataagtgtagcgccttgtttgaataccctttttgagaaggtatgatgagaatgggcaagggtgtcagcatctcttcttcttaataattaattgttttcagttttggttcacgaagaatgcttagttaatctgtaatgttgcctagagctgtatttatctgtttttatttatactagtgtagtaaagctgcatatcattacagtaaaaacgactactgtgatgagttaatcagaaaatctattaaaatctatatgacaa

SEQ ID NO: 17763 - DNA, 5306 bp, Homo sapiens
ctttaatttttttgtagaggtcggttggtgagactgtaccttgaggagctgttgtgtgtgctttcagaatgaggctctctagattatagtattttagcaggatttcagaatgcatagggtagtgaaaatatagggaatcttacaaggtcttcggttccctgcatatcttgctacgatttggaatagagtatttatggtggagcagttagctctaaaatttgaagaaatgatatcctatttaaaaatagctccccatcccagttactgccctcccctcttacctacacaaacatacgttttgaaaattgtctatattcattgcctcctcctctttacaccctattcacattagtatatctggcaaaaattttttttaactgaatggtaaatgcatgactgacctttcaattaaagccaggagaaagaaacaaatcttaatagaagaaatggatagttaccctttgcttagggagcaaggaaacatgcaagttaaattcagaaaatccatttggaaaattcaagtaacatgaagaatttttatttggtatgtttgaatttctatgaaattatgaaataagccatatcctctttctaggtgctatcagctgcctcagctgcaggggtttctgtagcttttggtgcaccaattggaggagttctttttagcctggaagaggttagctattattttcctctcaaaactttatggagatcattttttgctgctttagtggctgcatttgttttgaggtccatcaatccatttggtaacagccgtctggtccttttttatgtggagtatcatacaccatggtacctttttgaactgtttccttttattcttctaggggtatttggagggctttggggagcctttttcattagggcaaatattgcctggtgtcgtcgacgcaagtccacgaaatttggaaagtatcccgttctggaagtcattattgttgcagccattactgctgtgatagccttccctaatccatacactaggctaaacaccagtgaactgatcaaagagctttttacagactgtggtcccctggaatcctcttctctttgtgactacagaaatgacatgaatgccagtaaaattgtcgatgacattcctgatcgtccagcaggcattggagtatattcagctatatggcagttatgcctggcactcatatttaaaatcataatgacagtattcacttttggcatcaaggttccatcaggcttgttcatccccagcatggccattggagcgatcgcaggaaggattgtggggattgcggtggagcagcttgcctactatcaccacgactggtttatctttaaggagtggtgtgaggtcggggctgattgcattacacctggcctttatgccatggttggtgctgctgcatgcttaggtggtgtgacaagaatgactgtctccctggtggttattgtttttgagcttactggaggcttggaatatattgttccccttatggctgcagtcatgaccagtaaatgggttggagatgcctttggcagggaaggcatttatgaagcacacatccgattaaatggataccctttcttggatgcaaaagaagaattcactcataccaccctggctgctgacgttatgagacctcgaaggaatgatcctcccttagctgtcctgacacaggacaatatgacagtggatgatatagaaaacatgattaatgaaaccagctacaatggatttcctgtcataatgtcaaaagaatctcagagattagtgggatttgccctcagaagagacctgacaattgcaatagaaagtgccaggaaaaaacaagaaggtatcgttggcagttctcgggtgtgttttgcacagcacaccccatctcttccagcagaaagtcctcggccattgaagcttcgaagcattcttgacatgagcccttttacagtgacagaccacaccccaatggagatcgtggtggatattttccgaaagctgggactgaggcagtgccttgtaactcacaatgggcgcctccttggcattataacaaaaaaagatatcctccggcatatggcccagacggcaaaccaagaccccgcttcaataatgttcaactgaatctcacagatgaggagagagaagaaacggaagaggaagtttatttgttgaatagcacaactctttaacctgagggagtcatctacttttttttcctcctttacaaaaaaagaaaggaaatataaaagccgggtttttgcaacatggtttgcaaataatgctggtggaatggaggagttgtttggggagggaaaggagagagaaggaaaggagtgaggtatttcccgtctaacagaaagcagcgtatcaactcctattgttctgcactggatgcattcagctgaggatgtgcctgatagtgcaggcttgcgcctcaacagagatgacagcagagtcctcgagcacctggcctgttgctccaacattgcaaagacacattatcagtccctatttctagagggattactttgaattgagccatctataaaactgcaaggtcttgcccttttttttaatcaaaactgttctgtttaattcatgaattgtatagttaagcattacctttctacattccagaagagcctttatttctctctctctctctctctctctctctctctctctactgagctgtaacaaagcctctttaaatcggtgtatccttttgaagcagtcctttctcatattgagatgtactgtgattttactgaggtttcatcacaagaagggagtgtttcttgtgccattaaccatgtagtttgtaccatcactaaatgcttggaacagtacacatgcaccacaacaaaggctcatcaaacaggtaaagtctcgaaggaagcgagaacgaaatctctcattgtgtgccgtgtggctcaaaaccgaaaacaatgaagcttggttttaaaggataaagttttcttttttgttttcctctcagactttatggataatgtgaccgggtcttatgcaaattttctatttctaaaactactactatgatatacaagtgctgttgagcataattaaataaaatgctgctgctttgacagtaaagagaaggaagtattctgattagctgtatctggtattaattgcatgttaaaacactggaatttttaaaattgaaattagatcagtcattcttttcttttctcaagatgtctcatggctgacactgaagaagaaatgtaattcataacttgcactaaatgtatattttttttcttaaaaatttaccattcttatttatatttttatggattaaaatttataaaatacagatcagttaatattgcacttaagtaattttacctttttaatgtgatttttatagaataattcagacttacaaatacagagatatgaacaaagtttacagtgggaacaaaggtttaaaaaaaggttgtggttctctctctgtgatccagtgtgcacataaacctttctctgatctttcactgccatcctctggattatgtcttctgacctgtccattttgacccattaactggaaagttgaaaaactacattaactggaaagttgaaaaactacattactttggagaataaaaccgaaagttcgtgtataccttcttaaaaaaaaaatcaaaccaaaaatgtgaaaacaatagaattgcaaagatagcagttaaaattttaatctgaaaataacctttgaatctcgggctaggttacgtccatatttgaagtggtcagtgatggtttgaacattttttgcaggatgagttaaaatgcactggattatatttgggatttttgtttttggaattgtctgttttaatcacagccttaattcacaattggcaaaggcagtttactcaaaggactgggctaaatattctgtaattatgcatttttgataggaaaatgaaatttttgcaaacagacattttctttttttttggctggagtgcagtggggcatggtcttggctcactgcagcgttgaccacctgggctcaagtgatactcccgcctcagccacccaagtagctggcactacgggcacacgccaccatgcccagctaatttttttgtatttttagtagagatggggttttgccatgctgcccaggctggtctcaactcctcagctcaagcaatctgcctgcgtgagcctcccaaagtggtggaattacaggcgtgggccactgcgcctggcccagacagacattttctgaaacacaactggcaatgagctgtttttacattttgaaagtgattcttcacttcctagttcttaattatagtatacctattaagatctgtaagatcctgaagacataagatcatgaagccatataagaatgaggattgaaagttgagcaaaattttcgggattttgggaaacattcttagctgtgctatctgcctaaaattattccttattacttctctcctttgacagacttcaagttttcttcatagccctttcaaagttttttgagccatccagagtaaaatcatttctaaatgatagttctgtatatctccaactcgtcttaagtgtatttgcctgtgtgcaacgtattgctagactatgaactcctcagcatggctgctggataacttaattgtcctgagttaatagccttcaaaggacaaatcggtttctttgcagatagcttcgtaaaacttcacatggagtttattttatcatatttcccttttttatttctgctcctcctttaattgcccatcttgcttcagagactgacatttcagggtggatattaattaaagcattaattttgttttttggtatatttctatccctagtatttctatcttactgctaaaatacaggaaaagtgccgtatttttaatgcatttagtggttttctttggtgttatctgttccatttttctttttcatacattgaagtgtgtctccttttcaaccaaaataatgaaatagtggagaccatgaaattgttgtgcctggctaattggcaaattaatttaccaatataataagtgtagcgccttgtttgaataccctttttgagaaggtatgatgagaatgggcaagggtgtcagcatctcttcttcttaataattaattgttttcagttttggttcacgaagaatgcttagttaatctgtaatgttgcctagagctgtatttatctgtttttatttatactagtgtagtaaagctgcatatcattacagtaaaaacgactactgtgatgagttaatcagaaaatctattaaaatctatatgacaa

SEQ ID NO: 17764 - DNA, 4408 bp, Homo sapiens
cggacgcgtgggtcgcggacgcgtgggtttggaaagtatcccgttctggaagtcattattgttgcagccattactgctgtgatagccttccctaatccatacactaggctaaacaccagtgaactgatcaaagagctttttacagactgtggtcccctggaatcctcttctctttgtgactacagaaatgacatgaatgccagtaaaattgtcgatgacattcctgatcgtccagcaggcattggagtatattcagctatatggcagttatgcctggcactcatatttaaaatcataatgacagtattcacttttggcatcaaggttccatcaggcttgttcatccccagcatggccattggagcgatcgcaggaaggattgtggggattgcggtggagcagcttgcctactatcaccacgactggtttatctttaaggagtggtgtgaggtcggggctgattgcattacacctggcctttatgccatggttggtgctgctgcatgcttaggtggtgtgacaagaatgactgtctccctggtggttattgtttttgagcttactggaggcttggaatatattgttccccttatggctgcagtcatgaccagtaaatgggttggagatgcctttggcagggaaggcatttatgaagcacacatccgattaaatggataccctttcttggatgcaaaagaagaattcactcataccaccctggctgctgacgttatgagacctcgaaggaatgatcctcccttagctgtcctgacacaggacaatatgacagtggatgatatagaaaacatgattaatgaaaccagctacaatggatttcctgtcataatgtcaaaagaatctcagagattagtgggatttgccctcagaagagacctgacaattgcaatagaaagtgccaggaaaaaacaagaaggtatcgttggcagttctcgggtgtgttttgcacagcacaccccatctcttccagcagaaagtcctcggccattgaagcttcgaagcattcttgacatgagcccttttacagtgacagaccacaccccaatggagatcgtggtggatattttccgaaagctgggactgaggcagtgccttgtaactcacaatgggcgcctccttggcattataacaaaaaaagatatcctccggcatatggcccagacggcaaaccaagaccccgcttcaataatgttcaactgaatctcacagatgaggagagagaagaaacggaagaggaagtttatttgttgaatagcacaactctttaacctgagggagtcatctacttttttttcctcctttacaaaaaaagaaaggaaatataaaagccgggtttttgcaacatggtttgcaaataatgctggtggaatggaggagttgtttggggagggaaaggagagagaaggaaaggagtgaggtatttcccgtctaacagaaagcagcgtatcaactcctattgttctgcactggatgcattcagctgaggatgtgcctgatagtgcaggcttgcgcctcaacagagatgacagcagagtcctcgagcacctggcctgttgctccaacattgcaaagacacattatcagtccctatttctagagggattactttgaattgagccatctataaaactgcaaggtcttgcccttttttttaatcaaaactgttctgtttaattcatgaattgtatagttaagcattacctttctacattccagaagagcctttatttctctctctctctctctctctctctctctctctctactgagctgtaacaaagcctctttaaatcggtgtatccttttgaagcagtcctttctcatattgagatgtactgtgattttactgaggtttcatcacaagaagggagtgtttcttgtgccattaaccatgtagtttgtaccatcactaaatgcttggaacagtacacatgcaccacaacaaaggctcatcaaacaggtaaagtctcgaaggaagcgagaacgaaatctctcattgtgtgccgtgtggctcaaaaccgaaaacaatgaagcttggttttaaaggataaagttttcttttttgttttcctctcagactttatggataatgtgaccgggtcttatgcaaattttctatttctaaaactactactatgatatacaagtgctgttgagcataattaaataaaatgctgctgctttgacagtaaagagaaggaagtattctgattagctgtatctggtattaattgcatgttaaaacactggaatttttaaaattgaaattagatcagtcattcttttcttttctcaagatgtctcatggctgacactgaagaagaaatgtaattcataacttgcactaaatgtatattttttttcttaaaaatttaccattcttatttatatttttatggattaaaatttataaaatacagatcagttaatattgcacttaagtaattttacctttttaatgtgatttttatagaataattcagacttacaaatacagagatatgaacaaagtttacagtgggaacaaaggtttaaaaaaaggttgtggttctctctctgtgatccagtgtgcacataaacctttctctgatctttcactgccatcctctggattatgtcttctgacctgtccattttgacccattaactggaaagttgaaaaactacattaactggaaagttgaaaaactacattactttggagaataaaaccgaaagttcgtgtataccttcttaaaaaaaaaatcaaaccaaaaatgtgaaaacaatagaattgcaaagatagcagttaaaattttaatctgaaaataacctttgaatctcgggctaggttacgtccatatttgaagtggtcagtgatggtttgaacattttttgcaggatgagttaaaatgcactggattatatttgggatttttgtttttggaattgtctgttttaatcacagccttaattcacaattggcaaaggcagtttactcaaaggactgggctaaatattctgtaattatgcatttttgataggaaaatgaaatttttgcaaacagacattttctttttttttggctggagtgcagtggggcatggtcttggctcactgcagcgttgaccacctgggctcaagtgatactcccgcctcagccacccaagtagctggcactacgggcacacgccaccatgcccagctaatttttttgtatttttagtagagatggggttttgccatgctgcccaggctggtctcaactcctcagctcaagcaatctgcctgcgtgagcctcccaaagtggtggaattacaggcgtgggccactgcgcctggcccagacagacattttctgaaacacaactggcaatgagctgtttttacattttgaaagtgattcttcacttcctagttcttaattatagtatacctattaagatctgtaagatcctgaagacataagatcatgaagccatataagaatgaggattgaaagttgagcaaaattttcgggattttgggaaacattcttagctgtgctatctgcctaaaattattccttattacttctctcctttgacagacttcaagttttcttcatagccctttcaaagttttttgagccatccagagtaaaatcatttctaaatgatagttctgtatatctccaactcgtcttaagtgtatttgcctgtgtgcaacgtattgctagactatgaactcctcagcatggctgctggataacttaattgtcctgagttaatagccttcaaaggacaaatcggtttctttgcagatagcttcgtaaaacttcacatggagtttattttatcatatttcccttttttatttctgctcctcctttaattgcccatcttgcttcagagactgacatttcagggtggatattaattaaagcattaattttgttttttggtatatttctatccctagtatttctatcttactgctaaaatacaggaaaagtgccgtatttttaatgcatttagtggttttctttggtgttatctgttccatttttctttttcatacattgaagtgtgtctccttttcaaccaaaataatgaaatagtggagaccatgaaattgttgtgcctggctaattggcaaattaatttaccaatataataagtgtagcgccttgtttgaataccctttttgagaaggtatgatgagaatgggcaagggtgtcagcatctcttcttcttaataattaattgttttcagttttggttcacgaagaatgcttagttaatctgtaatgttgcctagagctgtatttatctgtttttatttatactagtgtagtaaagctgcatatcattacagtaaaaacgactactgtgatgagttaatcagaaaatctattaaaatctatatgacaa

SEQ ID NO: 17765 - DNA, 6221 bp, Homo sapiens
ttctcttccccttccgtgggtcagggccggtccggtccggaacctgcagcccctttcccagtgttctagttcgcccgtgacccggaataatgagcaaggagggtgtggtgggttgaaagccatcctactttactcccgagttagagcatggattcagttttagtcttaagggggaagtgagattggagatttttatttttaattttgggcagaagcaggttgactctagggatctccagagcgagaggatttaacttcatgttgctcccgtgtttgaaggaggacaataaaagtcccaccgggcaaaattttcgtaacctctgcggtagaaaacgtcaggtatcttttaaatcgcgatagttttcgctgtgtcaggctttcttcggtggagctccgagggtagctaggttctaggtttgaaacagatgcagaatccaaaggcagcgcaaaaaacagccaccgattttgctatgtctctgagctgcgagataatcagacagctaaatggagtctgagcagctgttccatagaggctactatagaaacagctacaacagtataacaagtgcaagtagtgatgaggaacttttagatggagcaggtgttattatggactttcaaacatctgaagatgacaatttattagatggtgacactgcagttggaactcattatacaatgacaaatggaggcagcattaacagttctacacatttactggatcttttggatgaaccaattccaggtgttggtacatatgatgatttccatactattgattgggtgcgagaaaaatgtaaagacagagaaaggcatagacggatcaacagcaaaaagaaagaatcagcatgggaaatgacaaaaagtttgtatgatgcgtggtcaggatggctagtagtaacactaacaggattggcatcaggggcactggccggattaatagacattgctgccgattggatgactgacctaaaggagggcatttgccttagtgcgttgtggtacaaccacgaacagtgctgttggggatctaatgaaacaacatttgaagagagggataaatgtccacagtggaaaacatgggcagaattaatcataggtcaagcagagggtcctggttcttatatcatgaactacataatgtacatcttctgggccttgagttttgcctttcttgcagtttccctggtaaaggtatttgctccatatgcctgtggctctggaattccagagattaaaactattttaagtggattcatcatcagaggttacttgggaaaatggactttaatgattaaaaccatcacattagtcctggctgtggcatcaggtttgagtttaggaaaagaaggtcccctggtacatgttgcctgttgctgcggaaatatcttttcctacctctttccaaagtatagcacaaacgaagctaaaaaaagggaggtgctatcagctgcctcagctgcaggggtttctgtagcttttggtgcaccaattggaggagttctttttagcctggaagaggttagctattattttcctctcaaaactttatggagatcattttttgctgctttagtggctgcatttgttttgaggtccatcaatccatttggtaacagccgtctggtccttttttatgtggagtatcatacaccatggtacctttttgaactgtttccttttattcttctaggggtatttggagggctttggggagcctttttcattagggcaaatattgcctggtgtcgtcgacgcaagtccacgaaatttggaaagtatcccgttctggaagtcattattgttgcagccattactgctgtgatagccttccctaatccatacactaggctaaacaccagtgaactgatcaaagagctttttacagactgtggtcccctggaatcctcttctctttgtgactacagaaatgacatgaatgccagtaaaattgtcgatgacattcctgatcgtccagcaggcattggagtatattcagctatatggcagttatgcctggcactcatatttaaaatcataatgacagtattcacttttggcatcaaggttccatcaggcttgttcatccccagcatggccattggagcgatcgcaggaaggattgtggggattgcggtggagcagcttgcctactatcaccacgactggtttatctttaaggagtggtgtgaggtcggggctgattgcattacacctggcctttatgccatggttggtgctgctgcatgcttaggtggtgtgacaagaatgactgtctccctggtggttattgtttttgagcttactggaggcttggaatatattgttccccttatggctgcagtcatgaccagtaaatgggttggagatgcctttggcagggaaggcatttatgaagcacacatccgattaaatggataccctttcttggatgcaaaagaagaattcactcataccaccctggctgctgacgttatgagacctcgaaggaatgatcctcccttagctgtcctgacacaggacaatatgacagtggatgatatagaaaacatgattaatgaaaccagctacaatggatttcctgtcataatgtcaaaagaatctcagagattagtgggatttgccctcagaagagacctgacaattgcaatagaaagtgccaggaaaaaacaagaaggtatcgttggcagttctcgggtgtgttttgcacagcacaccccatctcttccagcagaaagtcctcggccattgaagcttcgaagcattcttgacatgagcccttttacagtgacagaccacaccccaatggagatcgtggtggatattttccgaaagctgggactgaggcagtgccttgtaactcacaatgggattgtcttggggatcatcacaaagaagaacatattagagcatctcgagcaactaaagcagcacgtcgaagcgcctccttggcattataacaaaaaaagatatcctccggcatatggcccagacggcaaaccaagaccccgcttcaataatgttcaactgaatctcacagatgaggagagagaagaaacggaagaggaagtttatttgttgaatagcacaactctttaacctgagggagtcatctacttttttttcctcctttacaaaaaaagaaaggaaatataaaagccgggtttttgcaacatggtttgcaaataatgctggtggaatggaggagttgtttggggagggaaaggagagagaaggaaaggagtgaggtatttcccgtctaacagaaagcagcgtatcaactcctattgttctgcactggatgcattcagctgaggatgtgcctgatagtgcaggcttgcgcctcaacagagatgacagcagagtcctcgagcacctggcctgttgctccaacattgcaaagacacattatcagtccctatttctagagggattactttgaattgagccatctataaaactgcaaggtcttgcccttttttttaatcaaaactgttctgtttaattcatgaattgtatagttaagcattacctttctacattccagaagagcctttatttctctctctctctctctctctctctctctctctctactgagctgtaacaaagcctctttaaatcggtgtatccttttgaagcagtcctttctcatattgagatgtactgtgattttactgaggtttcatcacaagaagggagtgtttcttgtgccattaaccatgtagtttgtaccatcactaaatgcttggaacagtacacatgcaccacaacaaaggctcatcaaacaggtaaagtctcgaaggaagcgagaacgaaatctctcattgtgtgccgtgtggctcaaaaccgaaaacaatgaagcttggttttaaaggataaagttttcttttttgttttcctctcagactttatggataatgtgaccgggtcttatgcaaattttctatttctaaaactactactatgatatacaagtgctgttgagcataattaaataaaatgctgctgctttgacagtaaagagaaggaagtattctgattagctgtatctggtattaattgcatgttaaaacactggaatttttaaaattgaaattagatcagtcattcttttcttttctcaagatgtctcatggctgacactgaagaagaaatgtaattcataacttgcactaaatgtatattttttttcttaaaaatttaccattcttatttatatttttatggattaaaatttataaaatacagatcagttaatattgcacttaagtaattttacctttttaatgtgatttttatagaataattcagacttacaaatacagagatatgaacaaagtttacagtgggaacaaaggtttaaaaaaaggttgtggttctctctctgtgatccagtgtgcacataaacctttctctgatctttcactgccatcctctggattatgtcttctgacctgtccattttgacccattaactggaaagttgaaaaactacattaactggaaagttgaaaaactacattactttggagaataaaaccgaaagttcgtgtataccttcttaaaaaaaaaatcaaaccaaaaatgtgaaaacaatagaattgcaaagatagcagttaaaattttaatctgaaaataacctttgaatctcgggctaggttacgtccatatttgaagtggtcagtgatggtttgaacattttttgcaggatgagttaaaatgcactggattatatttgggatttttgtttttggaattgtctgttttaatcacagccttaattcacaattggcaaaggcagtttactcaaaggactgggctaaatattctgtaattatgcatttttgataggaaaatgaaatttttgcaaacagacattttctttttttttggctggagtgcagtggggcatggtcttggctcactgcagcgttgaccacctgggctcaagtgatactcccgcctcagccacccaagtagctggcactacgggcacacgccaccatgcccagctaatttttttgtatttttagtagagatggggttttgccatgctgcccaggctggtctcaactcctcagctcaagcaatctgcctgcgtgagcctcccaaagtggtggaattacaggcgtgggccactgcgcctggcccagacagacattttctgaaacacaactggcaatgagctgtttttacattttgaaagtgattcttcacttcctagttcttaattatagtatacctattaagatctgtaagatcctgaagacataagatcatgaagccatataagaatgaggattgaaagttgagcaaaattttcgggattttgggaaacattcttagctgtgctatctgcctaaaattattccttattacttctctcctttgacagacttcaagttttcttcatagccctttcaaagttttttgagccatccagagtaaaatcatttctaaatgatagttctgtatatctccaactcgtcttaagtgtatttgcctgtgtgcaacgtattgctagactatgaactcctcagcatggctgctggataacttaattgtcctgagttaatagccttcaaaggacaaatcggtttctttgcagatagcttcgtaaaacttcacatggagtttattttatcatatttcccttttttatttctgctcctcctttaattgcccatcttgcttcagagactgacatttcagggtggatattaattaaagcattaattttgttttttggtatatttctatccctagtatttctatcttactgctaaaatacaggaaaagtgccgtatttttaatgcatttagtggttttctttggtgttatctgttccatttttctttttcatacattgaagtgtgtctccttttcaaccaaaataatgaaatagtggagaccatgaaattgttgtgcctggctaattggcaaattaatttaccaatataataagtgtagcgccttgtttgaataccctttttgagaaggtatgatgagaatgggcaagggtgtcagcatctcttcttcttaataattaattgttttcagttttggttcacgaagaatgcttagttaatctgtaatgttgcctagagctgtatttatctgtttttatttatactagtgtagtaaagctgcatatcattacagtaaaaacgactactgtgatgagttaatcagaaaatctattaaaatctatatgacaa

SEQ ID NO: 17766 - DNA, 3867 bp, Homo sapiens
gtggcacatgcctgtaatcccagctacttgggaagctgaggcaggagaattgcttgaaccggggacccaggaggcggaggttgcagtgagctgagatcgcgccactgcactccagcctgggctacagagcgagactctgtctcaaaaaataaataaataaataaatgaaaaagagaaaatattgagaggatttggtcatcattttactgctctcttcatgtgatggaaatcaattttccttctcaaatgggatcagtatcatttcctagtcatacatccatccagtttttgttacttttttgttggcatacattaatcaaaatagctctgcttcattgaggcatgcagtcctcagactctcggtggaaaggctgtcatactattagtgaccatagtaactttttataccaaaggatggttgctggataattttaatatctttaccaataaagtactttttggaaatacaaaatcaggctgcttgctttgctctattcctgtcaacaaaaaggatttagctatagatttagcttctccttttattttcccttttatttcataggagtcttctgtttattcctttcaggcgcctccttggcattataacaaaaaaagatatcctccggcatatggcccagacggcaaaccaagaccccgcttcaataatgttcaactgaatctcacagatgaggagagagaagaaacggaagaggaagtttatttgttgaatagcacaactctttaacctgagggagtcatctacttttttttcctcctttacaaaaaaagaaaggaaatataaaagccgggtttttgcaacatggtttgcaaataatgctggtggaatggaggagttgtttggggagggaaaggagagagaaggaaaggagtgaggtatttcccgtctaacagaaagcagcgtatcaactcctattgttctgcactggatgcattcagctgaggatgtgcctgatagtgcaggcttgcgcctcaacagagatgacagcagagtcctcgagcacctggcctgttgctccaacattgcaaagacacattatcagtccctatttctagagggattactttgaattgagccatctataaaactgcaaggtcttgcccttttttttaatcaaaactgttctgtttaattcatgaattgtatagttaagcattacctttctacattccagaagagcctttatttctctctctctctctctctctctctctctctctctactgagctgtaacaaagcctctttaaatcggtgtatccttttgaagcagtcctttctcatattgagatgtactgtgattttactgaggtttcatcacaagaagggagtgtttcttgtgccattaaccatgtagtttgtaccatcactaaatgcttggaacagtacacatgcaccacaacaaaggctcatcaaacaggtaaagtctcgaaggaagcgagaacgaaatctctcattgtgtgccgtgtggctcaaaaccgaaaacaatgaagcttggttttaaaggataaagttttcttttttgttttcctctcagactttatggataatgtgaccgggtcttatgcaaattttctatttctaaaactactactatgatatacaagtgctgttgagcataattaaataaaatgctgctgctttgacagtaaagagaaggaagtattctgattagctgtatctggtattaattgcatgttaaaacactggaatttttaaaattgaaattagatcagtcattcttttcttttctcaagatgtctcatggctgacactgaagaagaaatgtaattcataacttgcactaaatgtatattttttttcttaaaaatttaccattcttatttatatttttatggattaaaatttataaaatacagatcagttaatattgcacttaagtaattttacctttttaatgtgatttttatagaataattcagacttacaaatacagagatatgaacaaagtttacagtgggaacaaaggtttaaaaaaaggttgtggttctctctctgtgatccagtgtgcacataaacctttctctgatctttcactgccatcctctggattatgtcttctgacctgtccattttgacccattaactggaaagttgaaaaactacattaactggaaagttgaaaaactacattactttggagaataaaaccgaaagttcgtgtataccttcttaaaaaaaaaatcaaaccaaaaatgtgaaaacaatagaattgcaaagatagcagttaaaattttaatctgaaaataacctttgaatctcgggctaggttacgtccatatttgaagtggtcagtgatggtttgaacattttttgcaggatgagttaaaatgcactggattatatttgggatttttgtttttggaattgtctgttttaatcacagccttaattcacaattggcaaaggcagtttactcaaaggactgggctaaatattctgtaattatgcatttttgataggaaaatgaaatttttgcaaacagacattttctttttttttggctggagtgcagtggggcatggtcttggctcactgcagcgttgaccacctgggctcaagtgatactcccgcctcagccacccaagtagctggcactacgggcacacgccaccatgcccagctaatttttttgtatttttagtagagatggggttttgccatgctgcccaggctggtctcaactcctcagctcaagcaatctgcctgcgtgagcctcccaaagtggtggaattacaggcgtgggccactgcgcctggcccagacagacattttctgaaacacaactggcaatgagctgtttttacattttgaaagtgattcttcacttcctagttcttaattatagtatacctattaagatctgtaagatcctgaagacataagatcatgaagccatataagaatgaggattgaaagttgagcaaaattttcgggattttgggaaacattcttagctgtgctatctgcctaaaattattccttattacttctctcctttgacagacttcaagttttcttcatagccctttcaaagttttttgagccatccagagtaaaatcatttctaaatgatagttctgtatatctccaactcgtcttaagtgtatttgcctgtgtgcaacgtattgctagactatgaactcctcagcatggctgctggataacttaattgtcctgagttaatagccttcaaaggacaaatcggtttctttgcagatagcttcgtaaaacttcacatggagtttattttatcatatttcccttttttatttctgctcctcctttaattgcccatcttgcttcagagactgacatttcagggtggatattaattaaagcattaattttgttttttggtatatttctatccctagtatttctatcttactgctaaaatacaggaaaagtgccgtatttttaatgcatttagtggttttctttggtgttatctgttccatttttctttttcatacattgaagtgtgtctccttttcaaccaaaataatgaaatagtggagaccatgaaattgttgtgcctggctaattggcaaattaatttaccaatataataagtgtagcgccttgtttgaataccctttttgagaaggtatgatgagaatgggcaagggtgtcagcatctcttcttcttaataattaattgttttcagttttggttcacgaagaatgcttagttaatctgtaatgttgcctagagctgtatttatctgtttttatttatactagtgtagtaaagctgcatatcattacagtaaaaacgactactgtgatgagttaatcagaaaatctattaaaatctatatgacaa

SEQ ID NO: 17767 - DNA, 3952 bp, Homo sapiens
ttctcttccccttccgtgggtcagggccggtccggtccggaacctgcagcccctttcccagtgttctagttcgcccgtgacccggaataatgagcaaggagggtgtggtgggttgaaagccatcctactttactcccgagttagagcatggattcagttttagtcttaagggggaagtgagattggagatttttatttttaattttgggcagaagcaggttgactctagggatctccagagcgagaggatttaacttcatgttgctcccgtgtttgaaggaggacaataaaagtcccaccgggcaaaattttcgtaacctctgcggtagaaaacgtcaggtatcttttaaatcgcgatagttttcgctgtgtcaggctttcttcggtggagctccgagggtagctaggttctaggtttgaaacagatgcagaatccaaaggcagcgcaaaaaacagccaccgattttgctatgtctctgagctgcgagataatcagacagctaaatggagtctgagcagctgttccatagaggctactatagaaacagctacaacagtataacaagtgcaagtagtgatgaggaacttttagatggagcaggtgttattatggactttcaaacatctgaagatgacaatttattagatggtgacactgcagttggaactcattatacaatgacaaatggaggcagcattaacagttctacacatttactggatcttttggatgaaccaattccaggtgttggtacatatgatgatttccatactattgattgggtgcgagaaaaatgtaaagacagagaaaggcatagacggatcaacagcaaaaagaaagaatcagcatgggaaatgacaaaaagtttgtatgatgcgtggtcaggatggctagtagtaacactaacaggattggcatcaggggcactggccggattaatagacattgctgccgattggatgactgacctaaaggagggcatttgccttagtgcgttgtggtacaaccacgaacagtgctgttggggatctaatgaaacaacatttgaagagagggataaatgtccacagtggaaaacatgggcagaattaatcataggtcaagcagagggtcctggttcttatatcatgaactacataatgtacatcttctgggccttgagttttgcctttcttgcagtttccctggtaaaggtatttgctccatatgcctgtggctctggaattccagagattaaaactattttaagtggattcatcatcagaggttacttgggaaaatggactttaatgattaaaaccatcacattagtcctggctgtggcatcaggtttgagtttaggaaaagaaggtcccctggtacatgttgcctgttgctgcggaaatatcttttcctacctctttccaaagtatagcacaaacgaagctaaaaaaagggaggtgctatcagctgcctcagctgcaggggtttctgtagcttttggtgcaccaattggaggagttctttttagcctggaagaggttagctattattttcctctcaaaactttatggagatcattttttgctgctttagtggctgcatttgttttgaggtccatcaatccatttggtaacagccgtctggtccttttttatgtggagtatcatacaccatggtacctttttgaactgtttccttttattcttctaggggtatttggagggctttggggagcctttttcattagggcaaatattgcctggtgtcgtcgacgcaagtccacgaaatttggaaagtatcccgttctggaagtcattattgttgcagccattactgctgtgatagccttccctaatccatacactaggctaaacaccagtgaactgatcaaagagctttttacagactgtggtcccctggaatcctcttctctttgtgactacagaaatgacatgaatgccagtaaaattgtcgatgacattcctgatcgtccagcaggcattggagtatattcagctatatggcagttatgcctggcactcatatttaaaatcataatgacagtattcacttttggcatcaaggttccatcaggcttgttcatccccagcatggccattggagcgatcgcaggaaggattgtggggattgcggtggagcagcttgcctactatcaccacgactggtttatctttaaggagtggtgtgaggtcggggctgattgcattacacctggcctttatgccatggttggtgctgctgcatgcttaggtggtgtgacaagaatgactgtctccctggtggttattgtttttgagcttactggaggcttggaatatattgttccccttatggctgcagtcatgaccagtaaatgggttggagatgcctttggcagggaaggcatttatgaagcacacatccgattaaatggataccctttcttggatgcaaaagaagaattcactcataccaccctggctgctgacgttatgagacctcgaaggaatgatcctcccttagctgtcctgacacaggacaatatgacagtggatgatatagaaaacatgattaatgaaaccagctacaatggatttcctgtcataatgtcaaaagaatctcagagattagtgggatttgccctcagaagagacctgacaattgcaatagaaagtgccaggaaaaaacaagaaggtatcgttggcagttctcgggtgtgttttgcacagcacaccccatctcttccagcagaaagtcctcggccattgaagcttcgaagcattcttgacatgagcccttttacagtgacagaccacaccccaatggagatcgtggtggatattttccgaaagctgggactgaggcagtgccttgtaactcacaatgggcgcctccttggcattataacaaaaaaagatatcctccggcatatggcccagacggcaaaccaagaccccgcttcaataatgttcaactgaatctcacagatgaggagagagaagaaacggaagaggaagtttatttgttgaatagcacaactctttaacctgagggagtcatctacttttttttcctcctttacaaaaaaagaaaggaaatataaaagccgggtttttgcaacatggtttgcaaataatgctggtggaatggaggagttgtttggggagggaaaggagagagaaggaaaggagtgaggtatttcccgtctaacagaaagcagcgtatcaactcctattgttctgcactggatgcattcagctgaggatgtgcctgatagtgcaggcttgcgcctcaacagagatgacagcagagtcctcgagcacctggcctgttgctccaacattgcaaagacacattatcagtccctatttctagagggattactttgaattgagccatctataaaactgcaaggtcttgcccttttttttaatcaaaactgttctgtttaattcatgaattgtatagttaagcattacctttctacattccagaagagcctttatttctctctctctctctctctctctctctctctctctactgagctgtaacaaagcctctttaaatcggtgtatccttttgaagcagtcctttctcatattgagatgtactgtgattttactgaggtttcatcacaagaagggagtgtttcttgtgccattaaccatgtagtttgtaccatcactaaatgcttggaacagtacacatgcaccacaacaaaggctcatcaaacaggtaaagtctcgaaggaagcgagaacgaaatctctcattgtgtgccgtgtggctcaaaaccgaaaacaatgaagcttggttttaaaggataaagttttcttttttgttttcctctcagactttatggataatgtgaccgggtcttatgcaaattttctatttctaaaactactactatgatatacaagtgctgttgagcataattaaataaaatgctgctgctttgacagta

SEQ ID NO: 17768 - DNA, 3356 bp, Homo sapiens
ttcggaaaagttcaaaagttgtgacaacaccctggggcctttcggagtcctatctactttcacacacaagtagtctccggttcttctcccaatggagcttgcagtccaccacattgaaccggatagcttgcggcaagctatccgggcttcaataatgttcaactgaatctcacagatgaggagagagaagaaacggaagaggaagtttatttgttgaatagcacaactctttaacctgagggagtcatctacttttttttcctcctttacaaaaaaagaaaggaaatataaaagccgggtttttgcaacatggtttgcaaataatgctggtggaatggaggagttgtttggggagggaaaggagagagaaggaaaggagtgaggtatttcccgtctaacagaaagcagcgtatcaactcctattgttctgcactggatgcattcagctgaggatgtgcctgatagtgcaggcttgcgcctcaacagagatgacagcagagtcctcgagcacctggcctgttgctccaacattgcaaagacacattatcagtccctatttctagagggattactttgaattgagccatctataaaactgcaaggtcttgcccttttttttaatcaaaactgttctgtttaattcatgaattgtatagttaagcattacctttctacattccagaagagcctttatttctctctctctctctctctctctctctctctctctactgagctgtaacaaagcctctttaaatcggtgtatccttttgaagcagtcctttctcatattgagatgtactgtgattttactgaggtttcatcacaagaagggagtgtttcttgtgccattaaccatgtagtttgtaccatcactaaatgcttggaacagtacacatgcaccacaacaaaggctcatcaaacaggtaaagtctcgaaggaagcgagaacgaaatctctcattgtgtgccgtgtggctcaaaaccgaaaacaatgaagcttggttttaaaggataaagttttcttttttgttttcctctcagactttatggataatgtgaccgggtcttatgcaaattttctatttctaaaactactactatgatatacaagtgctgttgagcataattaaataaaatgctgctgctttgacagtaaagagaaggaagtattctgattagctgtatctggtattaattgcatgttaaaacactggaatttttaaaattgaaattagatcagtcattcttttcttttctcaagatgtctcatggctgacactgaagaagaaatgtaattcataacttgcactaaatgtatattttttttcttaaaaatttaccattcttatttatatttttatggattaaaatttataaaatacagatcagttaatattgcacttaagtaattttacctttttaatgtgatttttatagaataattcagacttacaaatacagagatatgaacaaagtttacagtgggaacaaaggtttaaaaaaaggttgtggttctctctctgtgatccagtgtgcacataaacctttctctgatctttcactgccatcctctggattatgtcttctgacctgtccattttgacccattaactggaaagttgaaaaactacattaactggaaagttgaaaaactacattactttggagaataaaaccgaaagttcgtgtataccttcttaaaaaaaaaatcaaaccaaaaatgtgaaaacaatagaattgcaaagatagcagttaaaattttaatctgaaaataacctttgaatctcgggctaggttacgtccatatttgaagtggtcagtgatggtttgaacattttttgcaggatgagttaaaatgcactggattatatttgggatttttgtttttggaattgtctgttttaatcacagccttaattcacaattggcaaaggcagtttactcaaaggactgggctaaatattctgtaattatgcatttttgataggaaaatgaaatttttgcaaacagacattttctttttttttggctggagtgcagtggggcatggtcttggctcactgcagcgttgaccacctgggctcaagtgatactcccgcctcagccacccaagtagctggcactacgggcacacgccaccatgcccagctaatttttttgtatttttagtagagatggggttttgccatgctgcccaggctggtctcaactcctcagctcaagcaatctgcctgcgtgagcctcccaaagtggtggaattacaggcgtgggccactgcgcctggcccagacagacattttctgaaacacaactggcaatgagctgtttttacattttgaaagtgattcttcacttcctagttcttaattatagtatacctattaagatctgtaagatcctgaagacataagatcatgaagccatataagaatgaggattgaaagttgagcaaaattttcgggattttgggaaacattcttagctgtgctatctgcctaaaattattccttattacttctctcctttgacagacttcaagttttcttcatagccctttcaaagttttttgagccatccagagtaaaatcatttctaaatgatagttctgtatatctccaactcgtcttaagtgtatttgcctgtgtgcaacgtattgctagactatgaactcctcagcatggctgctggataacttaattgtcctgagttaatagccttcaaaggacaaatcggtttctttgcagatagcttcgtaaaacttcacatggagtttattttatcatatttcccttttttatttctgctcctcctttaattgcccatcttgcttcagagactgacatttcagggtggatattaattaaagcattaattttgttttttggtatatttctatccctagtatttctatcttactgctaaaatacaggaaaagtgccgtatttttaatgcatttagtggttttctttggtgttatctgttccatttttctttttcatacattgaagtgtgtctccttttcaaccaaaataatgaaatagtggagaccatgaaattgttgtgcctggctaattggcaaattaatttaccaatataataagtgtagcgccttgtttgaataccctttttgagaaggtatgatgagaatgggcaagggtgtcagcatctcttcttcttaataattaattgttttcagttttggttcacgaagaatgcttagttaatctgtaatgttgcctagagctgtatttatctgtttttatttatactagtgtagtaaagctgcatatcattacagtaaaaacgactactgtgatgagttaatcagaaaatctattaaaatctatatgacaa

SEQ ID NO: 17769 - DNA, 3240 bp, Homo sapiens
ggtgatctagaggatcttggagctatcgggcttcaataatgttcaactgaatctcacagatgaggagagagaagaaacggaagaggaagtttatttgttgaatagcacaactctttaacctgagggagtcatctacttttttttcctcctttacaaaaaaagaaaggaaatataaaagccgggtttttgcaacatggtttgcaaataatgctggtggaatggaggagttgtttggggagggaaaggagagagaaggaaaggagtgaggtatttcccgtctaacagaaagcagcgtatcaactcctattgttctgcactggatgcattcagctgaggatgtgcctgatagtgcaggcttgcgcctcaacagagatgacagcagagtcctcgagcacctggcctgttgctccaacattgcaaagacacattatcagtccctatttctagagggattactttgaattgagccatctataaaactgcaaggtcttgcccttttttttaatcaaaactgttctgtttaattcatgaattgtatagttaagcattacctttctacattccagaagagcctttatttctctctctctctctctctctctctctctctctctactgagctgtaacaaagcctctttaaatcggtgtatccttttgaagcagtcctttctcatattgagatgtactgtgattttactgaggtttcatcacaagaagggagtgtttcttgtgccattaaccatgtagtttgtaccatcactaaatgcttggaacagtacacatgcaccacaacaaaggctcatcaaacaggtaaagtctcgaaggaagcgagaacgaaatctctcattgtgtgccgtgtggctcaaaaccgaaaacaatgaagcttggttttaaaggataaagttttcttttttgttttcctctcagactttatggataatgtgaccgggtcttatgcaaattttctatttctaaaactactactatgatatacaagtgctgttgagcataattaaataaaatgctgctgctttgacagtaaagagaaggaagtattctgattagctgtatctggtattaattgcatgttaaaacactggaatttttaaaattgaaattagatcagtcattcttttcttttctcaagatgtctcatggctgacactgaagaagaaatgtaattcataacttgcactaaatgtatattttttttcttaaaaatttaccattcttatttatatttttatggattaaaatttataaaatacagatcagttaatattgcacttaagtaattttacctttttaatgtgatttttatagaataattcagacttacaaatacagagatatgaacaaagtttacagtgggaacaaaggtttaaaaaaaggttgtggttctctctctgtgatccagtgtgcacataaacctttctctgatctttcactgccatcctctggattatgtcttctgacctgtccattttgacccattaactggaaagttgaaaaactacattaactggaaagttgaaaaactacattactttggagaataaaaccgaaagttcgtgtataccttcttaaaaaaaaaatcaaaccaaaaatgtgaaaacaatagaattgcaaagatagcagttaaaattttaatctgaaaataacctttgaatctcgggctaggttacgtccatatttgaagtggtcagtgatggtttgaacattttttgcaggatgagttaaaatgcactggattatatttgggatttttgtttttggaattgtctgttttaatcacagccttaattcacaattggcaaaggcagtttactcaaaggactgggctaaatattctgtaattatgcatttttgataggaaaatgaaatttttgcaaacagacattttctttttttttggctggagtgcagtggggcatggtcttggctcactgcagcgttgaccacctgggctcaagtgatactcccgcctcagccacccaagtagctggcactacgggcacacgccaccatgcccagctaatttttttgtatttttagtagagatggggttttgccatgctgcccaggctggtctcaactcctcagctcaagcaatctgcctgcgtgagcctcccaaagtggtggaattacaggcgtgggccactgcgcctggcccagacagacattttctgaaacacaactggcaatgagctgtttttacattttgaaagtgattcttcacttcctagttcttaattatagtatacctattaagatctgtaagatcctgaagacataagatcatgaagccatataagaatgaggattgaaagttgagcaaaattttcgggattttgggaaacattcttagctgtgctatctgcctaaaattattccttattacttctctcctttgacagacttcaagttttcttcatagccctttcaaagttttttgagccatccagagtaaaatcatttctaaatgatagttctgtatatctccaactcgtcttaagtgtatttgcctgtgtgcaacgtattgctagactatgaactcctcagcatggctgctggataacttaattgtcctgagttaatagccttcaaaggacaaatcggtttctttgcagatagcttcgtaaaacttcacatggagtttattttatcatatttcccttttttatttctgctcctcctttaattgcccatcttgcttcagagactgacatttcagggtggatattaattaaagcattaattttgttttttggtatatttctatccctagtatttctatcttactgctaaaatacaggaaaagtgccgtatttttaatgcatttagtggttttctttggtgttatctgttccatttttctttttcatacattgaagtgtgtctccttttcaaccaaaataatgaaatagtggagaccatgaaattgttgtgcctggctaattggcaaattaatttaccaatataataagtgtagcgccttgtttgaataccctttttgagaaggtatgatgagaatgggcaagggtgtcagcatctcttcttcttaataattaattgttttcagttttggttcacgaagaatgcttagttaatctgtaatgttgcctagagctgtatttatctgtttttatttatactagtgtagtaaagctgcatatcattacagtaaaaacgactactgtgatgagttaatcagaaaatctattaaaatctatatgacaa

SEQ ID NO: 17770 - DNA, 3385 bp, Homo sapiens
  misc_feature (10)..(10): n is a, c, g, or t
  misc_feature (127)..(127): n is a, c, g, or t
ggtgcaagcntccgtgggagatgatgtcctcaggcccatgattaggggcatgatggatgaggaagggaacccagtttgtggcctatttcctgcctgtagaagagacgttgaagaaacgaaagcgggncccaggaaataggccacaaactggctcccttcctctttcctctcttcgcttcaataatgttcaactgaatctcacagatgaggagagagaagaaacggaagaggaagtttatttgttgaatagcacaactctttaacctgagggagtcatctacttttttttcctcctttacaaaaaaagaaaggaaatataaaagccgggtttttgcaacatggtttgcaaataatgctggtggaatggaggagttgtttggggagggaaaggagagagaaggaaaggagtgaggtatttcccgtctaacagaaagcagcgtatcaactcctattgttctgcactggatgcattcagctgaggatgtgcctgatagtgcaggcttgcgcctcaacagagatgacagcagagtcctcgagcacctggcctgttgctccaacattgcaaagacacattatcagtccctatttctagagggattactttgaattgagccatctataaaactgcaaggtcttgcccttttttttaatcaaaactgttctgtttaattcatgaattgtatagttaagcattacctttctacattccagaagagcctttatttctctctctctctctctctctctctctctctctctactgagctgtaacaaagcctctttaaatcggtgtatccttttgaagcagtcctttctcatattgagatgtactgtgattttactgaggtttcatcacaagaagggagtgtttcttgtgccattaaccatgtagtttgtaccatcactaaatgcttggaacagtacacatgcaccacaacaaaggctcatcaaacaggtaaagtctcgaaggaagcgagaacgaaatctctcattgtgtgccgtgtggctcaaaaccgaaaacaatgaagcttggttttaaaggataaagttttcttttttgttttcctctcagactttatggataatgtgaccgggtcttatgcaaattttctatttctaaaactactactatgatatacaagtgctgttgagcataattaaataaaatgctgctgctttgacagtaaagagaaggaagtattctgattagctgtatctggtattaattgcatgttaaaacactggaatttttaaaattgaaattagatcagtcattcttttcttttctcaagatgtctcatggctgacactgaagaagaaatgtaattcataacttgcactaaatgtatattttttttcttaaaaatttaccattcttatttatatttttatggattaaaatttataaaatacagatcagttaatattgcacttaagtaattttacctttttaatgtgatttttatagaataattcagacttacaaatacagagatatgaacaaagtttacagtgggaacaaaggtttaaaaaaaggttgtggttctctctctgtgatccagtgtgcacataaacctttctctgatctttcactgccatcctctggattatgtcttctgacctgtccattttgacccattaactggaaagttgaaaaactacattaactggaaagttgaaaaactacattactttggagaataaaaccgaaagttcgtgtataccttcttaaaaaaaaaatcaaaccaaaaatgtgaaaacaatagaattgcaaagatagcagttaaaattttaatctgaaaataacctttgaatctcgggctaggttacgtccatatttgaagtggtcagtgatggtttgaacattttttgcaggatgagttaaaatgcactggattatatttgggatttttgtttttggaattgtctgttttaatcacagccttaattcacaattggcaaaggcagtttactcaaaggactgggctaaatattctgtaattatgcatttttgataggaaaatgaaatttttgcaaacagacattttctttttttttggctggagtgcagtggggcatggtcttggctcactgcagcgttgaccacctgggctcaagtgatactcccgcctcagccacccaagtagctggcactacgggcacacgccaccatgcccagctaatttttttgtatttttagtagagatggggttttgccatgctgcccaggctggtctcaactcctcagctcaagcaatctgcctgcgtgagcctcccaaagtggtggaattacaggcgtgggccactgcgcctggcccagacagacattttctgaaacacaactggcaatgagctgtttttacattttgaaagtgattcttcacttcctagttcttaattatagtatacctattaagatctgtaagatcctgaagacataagatcatgaagccatataagaatgaggattgaaagttgagcaaaattttcgggattttgggaaacattcttagctgtgctatctgcctaaaattattccttattacttctctcctttgacagacttcaagttttcttcatagccctttcaaagttttttgagccatccagagtaaaatcatttctaaatgatagttctgtatatctccaactcgtcttaagtgtatttgcctgtgtgcaacgtattgctagactatgaactcctcagcatggctgctggataacttaattgtcctgagttaatagccttcaaaggacaaatcggtttctttgcagatagcttcgtaaaacttcacatggagtttattttatcatatttcccttttttatttctgctcctcctttaattgcccatcttgcttcagagactgacatttcagggtggatattaattaaagcattaattttgttttttggtatatttctatccctagtatttctatcttactgctaaaatacaggaaaagtgccgtatttttaatgcatttagtggttttctttggtgttatctgttccatttttctttttcatacattgaagtgtgtctccttttcaaccaaaataatgaaatagtggagaccatgaaattgttgtgcctggctaattggcaaattaatttaccaatataataagtgtagcgccttgtttgaataccctttttgagaaggtatgatgagaatgggcaagggtgtcagcatctcttcttcttaataattaattgttttcagttttggttcacgaagaatgcttagttaatctgtaatgttgcctagagctgtatttatctgtttttatttatactagtgtagtaaagctgcatatcattacagtaaaaacgactactgtgatgagttaatcagaaaatctattaaaatctatatgacaa

SEQ ID NO: 17771 - DNA, 4279 bp, Homo sapiens
ttctcttccccttccgtgggtcagggccggtccggtccggaacctgcagcccctttcccagtgttctagttcgcccgtgacccggaataatgagcaaggagggtgtggtgggttgaaagccatcctactttactcccgagttagagcatggattcagttttagtcttaagggggaagtgagattggagatttttatttttaattttgggcagaagcaggttgactctagggatctccagagcgagaggatttaacttcatgttgctcccgtgtttgaaggaggacaataaaagtcccaccgggcaaaattttcgtaacctctgcggtagaaaacgtcaggtatcttttaaatcgcgatagttttcgctgtgtcaggctttcttcggtggagctccgagggtagctaggttctaggtttgaaacagatgcagaatccaaaggcagcgcaaaaaacagccaccgattttgctatgtctctgagctgcgagataatcagacagctaaatggagtctgagcagctgttccatagaggctactatagaaacagctacaacagtataacaagtgcaagtagtgatgaggaacttttagatggagcaggtgttattatggactttcaaacatctgaagatgacaatttattagatggtgacactgcagttggaactcattatacaatgacaaatggaggcagcattaacagttctacacatttactggatcttttggatgaaccaattccaggtgttggtacatatgatgatttccatactattgattgggtgcgagaaaaatgtaaagacagagaaaggcatagacggatcaacagcaaaaagaaagaatcagcatgggaaatgacaaaaagtttgtatgatgcgtggtcaggatggctagtagtaacactaacaggattggcatcaggggcactggccggattaatagacattgctgccgattggatgactgacctaaaggagggcatttgccttagtgcgttgtggtacaaccacgaacagtgctgttggggatctaatgaaacaacatttgaagagagggataaatgtccacagtggaaaacatgggcagaattaatcataggtcaagcagagggtcctggttcttatatcatgaactacataatgtacatcttctgggccttgagttttgcctttcttgcagtttccctggtaaaggtatttgctccatatgcctgtggctctggaattccagagattaaaactattttaagtggattcatcatcagaggttacttgggaaaatggactttaatgattaaaaccatcacattagtcctggctgtggcatcaggtttgagtttaggaaaagaaggtcccctggtacatgttgcctgttgctgcggaaatatcttttcctacctctttccaaagtatagcacaaacgaagctaaaaaaagggaggtgctatcagctgcctcagctgcaggggtttctgtagcttttggtgcaccaattggaggagttctttttagcctggaagagcaaggtcttgcccttttttttaatcaaaactgttctgtttaattcatgaattgtatagttaagcattacctttctacattccagaagagcctttatttctctctctctctctctctctctctctctctctctactgagctgtaacaaagcctctttaaatcggtgtatccttttgaagcagtcctttctcatattgagatgtactgtgattttactgaggtttcatcacaagaagggagtgtttcttgtgccattaaccatgtagtttgtaccatcactaaatgcttggaacagtacacatgcaccacaacaaaggctcatcaaacaggtaaagtctcgaaggaagcgagaacgaaatctctcattgtgtgccgtgtggctcaaaaccgaaaacaatgaagcttggttttaaaggataaagttttcttttttgttttcctctcagactttatggataatgtgaccgggtcttatgcaaattttctatttctaaaactactactatgatatacaagtgctgttgagcataattaaataaaatgctgctgctttgacagtaaagagaaggaagtattctgattagctgtatctggtattaattgcatgttaaaacactggaatttttaaaattgaaattagatcagtcattcttttcttttctcaagatgtctcatggctgacactgaagaagaaatgtaattcataacttgcactaaatgtatattttttttcttaaaaatttaccattcttatttatatttttatggattaaaatttataaaatacagatcagttaatattgcacttaagtaattttacctttttaatgtgatttttatagaataattcagacttacaaatacagagatatgaacaaagtttacagtgggaacaaaggtttaaaaaaaggttgtggttctctctctgtgatccagtgtgcacataaacctttctctgatctttcactgccatcctctggattatgtcttctgacctgtccattttgacccattaactggaaagttgaaaaactacattaactggaaagttgaaaaactacattactttggagaataaaaccgaaagttcgtgtataccttcttaaaaaaaaaatcaaaccaaaaatgtgaaaacaatagaattgcaaagatagcagttaaaattttaatctgaaaataacctttgaatctcgggctaggttacgtccatatttgaagtggtcagtgatggtttgaacattttttgcaggatgagttaaaatgcactggattatatttgggatttttgtttttggaattgtctgttttaatcacagccttaattcacaattggcaaaggcagtttactcaaaggactgggctaaatattctgtaattatgcatttttgataggaaaatgaaatttttgcaaacagacattttctttttttttggctggagtgcagtggggcatggtcttggctcactgcagcgttgaccacctgggctcaagtgatactcccgcctcagccacccaagtagctggcactacgggcacacgccaccatgcccagctaatttttttgtatttttagtagagatggggttttgccatgctgcccaggctggtctcaactcctcagctcaagcaatctgcctgcgtgagcctcccaaagtggtggaattacaggcgtgggccactgcgcctggcccagacagacattttctgaaacacaactggcaatgagctgtttttacattttgaaagtgattcttcacttcctagttcttaattatagtatacctattaagatctgtaagatcctgaagacataagatcatgaagccatataagaatgaggattgaaagttgagcaaaattttcgggattttgggaaacattcttagctgtgctatctgcctaaaattattccttattacttctctcctttgacagacttcaagttttcttcatagccctttcaaagttttttgagccatccagagtaaaatcatttctaaatgatagttctgtatatctccaactcgtcttaagtgtatttgcctgtgtgcaacgtattgctagactatgaactcctcagcatggctgctggataacttaattgtcctgagttaatagccttcaaaggacaaatcggtttctttgcagatagcttcgtaaaacttcacatggagtttattttatcatatttcccttttttatttctgctcctcctttaattgcccatcttgcttcagagactgacatttcagggtggatattaattaaagcattaattttgttttttggtatatttctatccctagtatttctatcttactgctaaaatacaggaaaagtgccgtatttttaatgcatttagtggttttctttggtgttatctgttccatttttctttttcatacattgaagtgtgtctccttttcaaccaaaataatgaaatagtggagaccatgaaattgttgtgcctggctaattggcaaattaatttaccaatataataagtgtagcgccttgtttgaataccctttttgagaaggtatgatgagaatgggcaagggtgtcagcatctcttcttcttaataattaattgttttcagttttggttcacgaagaatgcttagttaatctgtaatgttgcctagagctgtatttatctgtttttatttatactagtgtagtaaagctgcatatcattacagtaaaaacgactactgtgatgagttaatcagaaaatctattaaaatctatatgacaa

SEQ ID NO: 17772 - DNA, 2562 bp, Homo sapiens
tctagaggatccactattgcatttagacatcacaagaagggagtgtttcttgtgccattaaccatgtagtttgtaccatcactaaatgcttggaacagtacacatgcaccacaacaaaggctcatcaaacaggtaaagtctcgaaggaagcgagaacgaaatctctcattgtgtgccgtgtggctcaaaaccgaaaacaatgaagcttggttttaaaggataaagttttcttttttgttttcctctcagactttatggataatgtgaccgggtcttatgcaaattttctatttctaaaactactactatgatatacaagtgctgttgagcataattaaataaaatgctgctgctttgacagtaaagagaaggaagtattctgattagctgtatctggtattaattgcatgttaaaacactggaatttttaaaattgaaattagatcagtcattcttttcttttctcaagatgtctcatggctgacactgaagaagaaatgtaattcataacttgcactaaatgtatattttttttcttaaaaatttaccattcttatttatatttttatggattaaaatttataaaatacagatcagttaatattgcacttaagtaattttacctttttaatgtgatttttatagaataattcagacttacaaatacagagatatgaacaaagtttacagtgggaacaaaggtttaaaaaaaggttgtggttctctctctgtgatccagtgtgcacataaacctttctctgatctttcactgccatcctctggattatgtcttctgacctgtccattttgacccattaactggaaagttgaaaaactacattaactggaaagttgaaaaactacattactttggagaataaaaccgaaagttcgtgtataccttcttaaaaaaaaaatcaaaccaaaaatgtgaaaacaatagaattgcaaagatagcagttaaaattttaatctgaaaataacctttgaatctcgggctaggttacgtccatatttgaagtggtcagtgatggtttgaacattttttgcaggatgagttaaaatgcactggattatatttgggatttttgtttttggaattgtctgttttaatcacagccttaattcacaattggcaaaggcagtttactcaaaggactgggctaaatattctgtaattatgcatttttgataggaaaatgaaatttttgcaaacagacattttctttttttttggctggagtgcagtggggcatggtcttggctcactgcagcgttgaccacctgggctcaagtgatactcccgcctcagccacccaagtagctggcactacgggcacacgccaccatgcccagctaatttttttgtatttttagtagagatggggttttgccatgctgcccaggctggtctcaactcctcagctcaagcaatctgcctgcgtgagcctcccaaagtggtggaattacaggcgtgggccactgcgcctggcccagacagacattttctgaaacacaactggcaatgagctgtttttacattttgaaagtgattcttcacttcctagttcttaattatagtatacctattaagatctgtaagatcctgaagacataagatcatgaagccatataagaatgaggattgaaagttgagcaaaattttcgggattttgggaaacattcttagctgtgctatctgcctaaaattattccttattacttctctcctttgacagacttcaagttttcttcatagccctttcaaagttttttgagccatccagagtaaaatcatttctaaatgatagttctgtatatctccaactcgtcttaagtgtatttgcctgtgtgcaacgtattgctagactatgaactcctcagcatggctgctggataacttaattgtcctgagttaatagccttcaaaggacaaatcggtttctttgcagatagcttcgtaaaacttcacatggagtttattttatcatatttcccttttttatttctgctcctcctttaattgcccatcttgcttcagagactgacatttcagggtggatattaattaaagcattaattttgttttttggtatatttctatccctagtatttctatcttactgctaaaatacaggaaaagtgccgtatttttaatgcatttagtggttttctttggtgttatctgttccatttttctttttcatacattgaagtgtgtctccttttcaaccaaaataatgaaatagtggagaccatgaaattgttgtgcctggctaattggcaaattaatttaccaatataataagtgtagcgccttgtttgaataccctttttgagaaggtatgatgagaatgggcaagggtgtcagcatctcttcttcttaataattaattgttttcagttttggttcacgaagaatgcttagttaatctgtaatgttgcctagagctgtatttatctgtttttatttatactagtgtagtaaagctgcatatcattacagtaaaaacgactactgtgatgagttaatcagaaaatctattaaaatctatatgacaa

SEQ ID NO: 17773 - DNA, 3356 bp, Homo sapiens
ttctcttccccttccgtgggtcagggccggtccggtccggaacctgcagcccctttcccagtgttctagttcgcccgtgacccggaataatgagcaaggagggtgtggtgggttgaaagccatcctactttactcccgagttagagcatggattcagttttagtcttaagggggaagtgagattggagatttttatttttaattttgggcagaagcaggttgactctagggatctccagagcgagaggatttaacttcatgttgctcccgtgtttgaaggaggacaataaaagtcccaccgggcaaaattttcgtaacctctgcggtagaaaacgtcaggtatcttttaaatcgcgatagttttcgctgtgtcaggctttcttcggtggagctccgagggtagctaggttctaggtttgaaacagatgcagaatccaaaggcagcgcaaaaaacagccaccgattttgctatgtctctgagctgcgagataatcagacagctaaatggagtctgagcagctgttccatagaggctactatagaaacagctacaacagtataacaagtgcaagtagtgatgaggaacttttagatggagcaggtgttattatggactttcaaacatctgaagatgacaatttattagatggtgacactgcagttggaactcattatacaatgacaaatggaggcagcattaacagttctacacatttactggatcttttggatgaaccaattccaggtgttggtacatatgatgatttccatactattgattgggtgcgagaaaaatgtaaagacagagaaaggcatagacggatcaacagcaaaaagaaagaatcagcatgggaaatgacaaaaagtttgtatgatgcgtggtcaggatggctagtagtaacactaacaggattggcatcaggggcactggccggattaatagacattgctgccgattggatgactgacctaaaggagggcatttgccttagtgcgttgtggtacaaccacgaacagtgctgttggggatctaatgaaacaacatttgaagagagggataaatgtccacagtggaaaacatgggcagaattaatcataggtcaagcagagggtcctggttcttatatcatgaactacataatgtacatcttctgggccttgagttttgcctttcttgcagtttccctggtaaaggtatttgctccatatgcctgtggctctggaattccagagattaaaactattttaagtggattcatcatcagaggttacttgggaaaatggactttaatgattaaaaccatcacattagtcctggctgtggcatcaggtttgagtttaggaaaagaaggtcccctggtacatgttgcctgttgctgcggaaatatcttttcctacctctttccaaagtatagcacaaacgaagctaaaaaaagggaggtgctatcagctgcctcagctgcaggggtttctgtagcttttggtgcaccaattggaggagttctttttagcctggaagaggttagctattattttcctctcaaaactttatggagatcattttttgctgctttagtggctgcatttgttttgaggtccatcaatccatttggtaacagccgtctggtccttttttatgtggagtatcatacaccatggtacctttttgaactgtttccttttattcttctaggggtatttggagggctttggggagcctttttcattagggcaaatattgcctggtgtcgtcgacgcaagtccacgaaatttggaaagtatcccgttctggaagtcattattgttgcagccattactgctgtgatagccttccctaatccatacactaggctaaacaccagtgaactgatcaaagagctttttacagactgtggtcccctggaatcctcttctctttgtgactacagaaatgacatgaatgccagtaaaattgtcgatgacattcctgatcgtccagcaggcattggagtatattcagctatatggcagttatgcctggcactcatatttaaaatcataatgacagtattcacttttggcatcaaggttccatcaggcttgttcatccccagcatggccattggagcgatcgcaggaaggattgtggggattgcggtggagcagcttgcctactatcaccacgactggtttatctttaaggagtggtgtgaggtcggggctgattgcattacacctggcctttatgccatggttggtgctgctgcatgcttaggtggtgtgacaagaatgactgtctccctggtggttattgtttttgagcttactggaggcttggaatatattgttccccttatggctgcagtcatgaccagtaaatgggttggagatgcctttggcagggaaggcatttatgaagcacacatccgattaaatggataccctttcttggatgcaaaagaagaattcactcataccaccctggctgctgacgttatgagacctcgaaggaatgatcctcccttagctgtcctgacacaggacaatatgacagtggatgatatagaaaacatgattaatgaaaccagctacaatggatttcctgtcataatgtcaaaagaatctcagagattagtgggatttgccctcagaagagacctgacaattgcaatagaaagtgccaggaaaaaacaagaaggtatcgttggcagttctcgggtgtgttttgcacagcacaccccatctcttccagcagaaagtcctcggccattgaagcttcgaagcattcttgacatgagcccttttacagtgacagaccacaccccaatggagatcgtggtggatattttccgaaagctgggactgaggcagtgccttgtaactcacaatgggcgcctccttggcattataacaaaaaaagatatcctccggcatatggcccagacggcaaaccaagaccccgcttcaataatgttcaactgaatctcacagatgaggagagagaagaaacggaagaggaagtttatttgttgaatagcacaactctttaacctgagggagtcatctacttttttttcctcctttacaaaaaaagaaaggaaatataaaagccgggtttttgcaacatggtttgcaaataatgctggtggaatggaggagttgtttggggagggaaaggagagagaaggaaaggagtgaggtatttcccgtctaacagaaagcagcgtatcaactcctattgttctgcactggatgcattcagctgaggatgtgcctgatagtgcaggcttgcgcctcaacagagatgacagcagagtcctcgagcacctggcctgttgctccaacattgcaacacggtctctcaggggatcctctag

SEQ ID NO: 17774 - DNA, 1504 bp, Homo sapiens
aagcatggtatcatcgcagagtgcccattacggccgggggaattgtctgttttaatcacagccttaattcacaattggcaaaggcagtttactcaaaggactgggctaaatattctgtaattatgcatttttgataggaaaatgaaatttttgcaaacagacattttctttttttttggctggagtgcagtggggcatggtcttggctcactgcagcgttgaccacctgggctcaagtgatactcccgcctcagccacccaagtagctggcactacgggcacacgccaccatgcccagctaatttttttgtatttttagtagagatggggttttgccatgctgcccaggctggtctcaactcctcagctcaagcaatctgcctgcgtgagcctcccaaagtggtggaattacaggcgtgggccactgcgcctggcccagacagacattttctgaaacacaactggcaatgagctgtttttacattttgaaagtgattcttcacttcctagttcttaattatagtatacctattaagatctgtaagatcctgaagacataagatcatgaagccatataagaatgaggattgaaagttgagcaaaattttcgggattttgggaaacattcttagctgtgctatctgcctaaaattattccttattacttctctcctttgacagacttcaagttttcttcatagccctttcaaagttttttgagccatccagagtaaaatcatttctaaatgatagttctgtatatctccaactcgtcttaagtgtatttgcctgtgtgcaacgtattgctagactatgaactcctcagcatggctgctggataacttaattgtcctgagttaatagccttcaaaggacaaatcggtttctttgcagatagcttcgtaaaacttcacatggagtttattttatcatatttcccttttttatttctgctcctcctttaattgcccatcttgcttcagagactgacatttcagggtggatattaattaaagcattaattttgttttttggtatatttctatccctagtatttctatcttactgctaaaatacaggaaaagtgccgtatttttaatgcatttagtggttttctttggtgttatctgttccatttttctttttcatacattgaagtgtgtctccttttcaaccaaaataatgaaatagtggagaccatgaaattgttgtgcctggctaattggcaaattaatttaccaatataataagtgtagcgccttgtttgaataccctttttgagaaggtatgatgagaatgggcaagggtgtcagcatctcttcttcttaataattaattgttttcagttttggttcacgaagaatgcttagttaatctgtaatgttgcctagagctgtatttatctgtttttatttatactagtgtagtaaagctgcatatcattacagtaaaaacgactactgtgatgagttaatcagaaaatctattaaaatctatatgacaa

SEQ ID NO: 17775 - DNA, 1554 bp, Homo sapiens
  misc_feature (10)..(10): n is a, c, g, or t
gcatccctcngacagcggacccctggtttgaacattttttgcaggatgagttaaaatgcactggattatatttgggatttttgtttttggaattgtctgttttaatcacagccttaattcacaattggcaaaggcagtttactcaaaggactgggctaaatattctgtaattatgcatttttgataggaaaatgaaatttttgcaaacagacattttctttttttttggctggagtgcagtggggcatggtcttggctcactgcagcgttgaccacctgggctcaagtgatactcccgcctcagccacccaagtagctggcactacgggcacacgccaccatgcccagctaatttttttgtatttttagtagagatggggttttgccatgctgcccaggctggtctcaactcctcagctcaagcaatctgcctgcgtgagcctcccaaagtggtggaattacaggcgtgggccactgcgcctggcccagacagacattttctgaaacacaactggcaatgagctgtttttacattttgaaagtgattcttcacttcctagttcttaattatagtatacctattaagatctgtaagatcctgaagacataagatcatgaagccatataagaatgaggattgaaagttgagcaaaattttcgggattttgggaaacattcttagctgtgctatctgcctaaaattattccttattacttctctcctttgacagacttcaagttttcttcatagccctttcaaagttttttgagccatccagagtaaaatcatttctaaatgatagttctgtatatctccaactcgtcttaagtgtatttgcctgtgtgcaacgtattgctagactatgaactcctcagcatggctgctggataacttaattgtcctgagttaatagccttcaaaggacaaatcggtttctttgcagatagcttcgtaaaacttcacatggagtttattttatcatatttcccttttttatttctgctcctcctttaattgcccatcttgcttcagagactgacatttcagggtggatattaattaaagcattaattttgttttttggtatatttctatccctagtatttctatcttactgctaaaatacaggaaaagtgccgtatttttaatgcatttagtggttttctttggtgttatctgttccatttttctttttcatacattgaagtgtgtctccttttcaaccaaaataatgaaatagtggagaccatgaaattgttgtgcctggctaattggcaaattaatttaccaatataataagtgtagcgccttgtttgaataccctttttgagaaggtatgatgagaatgggcaagggtgtcagcatctcttcttcttaataattaattgttttcagttttggttcacgaagaatgcttagttaatctgtaatgttgcctagagctgtatttatctgtttttatttatactagtgtagtaaagctgcatatcattacagtaaaaacgactactgtgatgagttaatcagaaaatctattaaaatctatatgacaa

SEQ ID NO: 17776 - DNA, 2967 bp, Homo sapiens
ttctcttccccttccgtgggtcagggccggtccggtccggaacctgcagcccctttcccagtgttctagttcgcccgtgacccggaataatgagcaaggagggtgtggtgggttgaaagccatcctactttactcccgagttagagcatggattcagttttagtcttaagggggaagtgagattggagatttttatttttaattttgggcagaagcaggttgactctagggatctccagagcgagaggatttaacttcatgttgctcccgtgtttgaaggaggacaataaaagtcccaccgggcaaaattttcgtaacctctgcggtagaaaacgtcaggtatcttttaaatcgcgatagttttcgctgtgtcaggctttcttcggtggagctccgagggtagctaggttctaggtttgaaacagatgcagaatccaaaggcagcgcaaaaaacagccaccgattttgctatgtctctgagctgcgagataatcagacagctaaatggagtctgagcagctgttccatagaggctactatagaaacagctacaacagtataacaagtgcaagtagtgatgaggaacttttagatggagcaggtgttattatggactttcaaacatctgaagatgacaatttattagatggtgacactgcagttggaactcattatacaatgacaaatggaggcagcattaacagttctacacatttactggatcttttggatgaaccaattccaggtgttggtacatatgatgatttccatactattgattgggtgcgagaaaaatgtaaagacagagaaaggcatagacggatcaacagcaaaaagaaagaatcagcatgggaaatgacaaaaagtttgtatgatgcgtggtcaggatggctagtagtaacactaacaggattggcatcaggggcactggccggattaatagacattgctgccgattggatgactgacctaaaggagggcatttgccttagtgcgttgtggtacaaccacgaacagtgctgttggggatctaatgaaacaacatttgaagagagggataaatgtccacagtggaaaacatgggcagaattaatcataggtcaagcagagggtcctggttcttatatcatgaactacataatgtacatcttctgggccttgagttttgcctttcttgcagtttccctggtaaaggtatttgctccatatgcctgtggctctggaattccagagattaaaactattttaagtggattcatcatcagaggttacttgggaaaatggactttaatgattaaaaccatcacattagtcctggctgtggcatcaggtttgagtttaggaaaagaaggtcccctggtacatgttgcctgttgctgcggaaatatcttttcctacctctttccaaagtatagcacaaacgaagctaaaaaaagggaggtgctatcagctgcctcagctgcaggggtttctgtagcttttggtgcaccaattggaggagttctttttagcctggaagaggttagctattattttcctctcaaaactttatggagatcattttttgctgctttagtggctgcatttgttttgaggtccatcaatccatttggtaacagccgtctggtccttttttatgtggagtatcatacaccatggtacctttttgaactgtttccttttattcttctaggggtatttggagggctttggggagcctttttcattagggcaaatattgcctggtgtcgtcgacgcaagtccacgaaatttggaaagtatcccgttctggaagtcattattgttgcagccattactgctgtgatagccttccctaatccatacactaggctaaacaccagtgaactgatcaaagagctttttacagactgtggtcccctggaatcctcttctctttgtgactacagaaatgacatgaatgccagtaaaattgtcgatgacattcctgatcgtccagcaggcattggagtatattcagctatatggcagttatgcctggcactcatatttaaaatcataatgacagtattcacttttggcatcaaggttccatcaggcttgttcatccccagcatggccattggagcgatcgcaggaaggattgtggggattgcggtggagcagcttgcctactatcaccacgactggtttatctttaaggagtggtgtgaggtcggggctgattgcattacacctggcctttatgccatggttggtgctgctgcatgcttaggtggtgtgacaagaatgactgtctccctggtggttattgtttttgagcttactggaggcttggaatatattgttccccttatggctgcagtcatgaccagtaaatgggttggagatgcctttggcagggaaggcatttatgaagcacacatccgattaaatggataccctttcttggatgcaaaagaagaattcactcataccaccctggctgctgacgttatgagacctcgaaggaatgatcctcccttagctgtcctgacacaggacaatatgacagtggatgatatagaaaacatgattaatgaaaccagctacaatggatttcctgtcataatgtcaaaagaatctcagagattagtgggatttgccctcagaagagacctgacaattgcaatagaaagtgccaggaaaaaacaagaaggtatcgttggcagttctcgggtgtgttttgcacagcacaccccatctcttccagcagaaagtcctcggccattgaagcttcgaagcattcttgacatgagcccttttacagtgacagaccacaccccaatggagatcgtggtggatattttccgaaagctgggactgaggcagtgccttgtaactcacaatgggattgtcttggggatcatcacaaagaagaacatattagagcatctcgagcaactaaagcagcacgtcgaacaccaggacagctgcaccacccaggac

SEQ ID NO: 17777 - DNA, 3368 bp, Homo sapiens
ttctcttccccttccgtgggtcagggccggtccggtccggaacctgcagcccctttcccagtgttctagttcgcccgtgacccggaataatgagcaaggagggtgtggtgggttgaaagccatcctactttactcccgagttagagcatggattcagttttagtcttaagggggaagtgagattggagatttttatttttaattttgggcagaagcaggttgactctagggatctccagagcgagaggatttaacttcatgttgctcccgtgtttgaaggaggacaataaaagtcccaccgggcaaaattttcgtaacctctgcggtagaaaacgtcaggtatcttttaaatcgcgatagttttcgctgtgtcaggctttcttcggtggagctccgagggtagctaggttctaggtttgaaacagatgcagaatccaaaggcagcgcaaaaaacagccaccgattttgctatgtctctgagctgcgagataatcagacagctaaatggagtctgagcagctgttccatagaggctactatagaaacagctacaacagtataacaagtgcaagtagtgatgaggaacttttagatggagcaggtgttattatggactttcaaacatctgaagatgacaatttattagatggtgacactgcagttggaactcattatacaatgacaaatggaggcagcattaacagttctacacatttactggatcttttggatgaaccaattccaggtgttggtacatatgatgatttccatactattgattgggtgcgagaaaaatgtaaagacagagaaaggcatagacggatcaacagcaaaaagaaagaatcagcatgggaaatgacaaaaagtttgtatgatgcgtggtcaggatggctagtagtaacactaacaggattggcatcaggggcactggccggattaatagacattgctgccgattggatgactgacctaaaggagggcatttgccttagtgcgttgtggtacaaccacgaacagtgctgttggggatctaatgaaacaacatttgaagagagggataaatgtccacagtggaaaacatgggcagaattaatcataggtcaagcagagggtcctggttcttatatcatgaactacataatgtacatcttctgggccttgagttttgcctttcttgcagtttccctggtaaaggtatttgctccatatgcctgtggctctggaattccagagattaaaactattttaagtggattcatcatcagaggttacttgggaaaatggactttaatgattaaaaccatcacattagtcctggctgtggcatcaggtttgagtttaggaaaagaaggtcccctggtacatgttgcctgttgctgcggaaatatcttttcctacctctttccaaagtatagcacaaacgaagctaaaaaaagggaggtgctatcagctgcctcagctgcaggggtttctgtagcttttggtgcaccaattggaggagttctttttagcctggaagaggttagctattattttcctctcaaaactttatggagatcattttttgctgctttagtggctgcatttgttttgaggtccatcaatccatttggtaacagccgtctggtccttttttatgtggagtatcatacaccatggtacctttttgaactgtttccttttattcttctaggggtatttggagggctttggggagcctttttcattagggcaaatattgcctggtgtcgtcgacgcaagtccacgaaatttggaaagtatcccgttctggaagtcattattgttgcagccattactgctgtgatagccttccctaatccatacactaggctaaacaccagtgaactgatcaaagagctttttacagactgtggtcccctggaatcctcttctctttgtgactacagaaatgacatgaatgccagtaaaattgtcgatgacattcctgatcgtccagcaggcattggagtatattcagctatatggcagttatgcctggcactcatatttaaaatcataatgacagtattcacttttggcatcaaggttccatcaggcttgttcatccccagcatggccattggagcgatcgcaggaaggattgtggggattgcggtggagcagcttgcctactatcaccacgactggtttatctttaaggagtggtgtgaggtcggggctgattgcattacacctggcctttatgccatggttggtgctgctgcatgcttaggtggtgtgacaagaatgactgtctccctggtggttattgtttttgagcttactggaggcttggaatatattgttccccttatggctgcagtcatgaccagtaaatgggttggagatgcctttggcagggaaggcatttatgaagcacacatccgattaaatggataccctttcttggatgcaaaagaagaattcactcataccaccctggctgctgacgttatgagacctcgaaggaatgatcctcccttagctgtcctgacacaggacaatatgacagtggatgatatagaaaacatgattaatgaaaccagctacaatggatttcctgtcataatgtcaaaagaatctcagagattagtgggatttgccctcagaagagacctgacaattgcaataggtaccctttcaaaaatatatatatgtatatatgagatggatttctggaagaaaggaaagcaataagcagtaacatttaatgggttggatttgtgggggcaagggacattattttatgtcccttaaaatcttctgttctttaggaaaggaaggtatgcttcagtggatgattttctgctatttagcagaaaatctgtatttcagttttgtcttttgatctggcattgtaccagaaattggagtcagattattttcccactcagataagcctagataagttgatcttggttattcaaaacagcatgtaatataagaccttagctaaatgcattcagtcaaatacattcttgtatttaataaagttggcttattggaatacaagttattgaaaatctcatcttcatcagtctctttcatattagaataacactgttttgctttatcagtctttggggttagaattataatattaatttataatatctgatttaaagtgacaatcactgagatttttatttctgatcaaatgccaggttgaaaaagtataacgtatcagtcctgttgtgttttatgcagactttcctgaaaatactgtttaaaggtattagccatagtgtatttcttggagataaattaaactttctatagttctgtttctctaaaatttgtttttctctttaccttatagtcccgcagtattgatgaggagaccatta

SEQ ID NO: 17778 - DNA, 2704 bp, Homo sapiens
ttctcttccccttccgtgggtcagggccggtccggtccggaacctgcagcccctttcccagtgttctagttcgcccgtgacccggaataatgagcaaggagggtgtggtgggttgaaagccatcctactttactcccgagttagagcatggattcagttttagtcttaagggggaagtgagattggagatttttatttttaattttgggcagaagcaggttgactctagggatctccagagcgagaggatttaacttcatgttgctcccgtgtttgaaggaggacaataaaagtcccaccgggcaaaattttcgtaacctctgcggtagaaaacgtcaggtatcttttaaatcgcgatagttttcgctgtgtcaggctttcttcggtggagctccgagggtagctaggttctaggtttgaaacagatgcagaatccaaaggcagcgcaaaaaacagccaccgattttgctatgtctctgagctgcgagataatcagacagctaaatggagtctgagcagctgttccatagaggctactatagaaacagctacaacagtataacaagtgcaagtagtgatgaggaacttttagatggagcaggtgttattatggactttcaaacatctgaagatgacaatttattagatggtgacactgcagttggaactcattatacaatgacaaatggaggcagcattaacagttctacacatttactggatcttttggatgaaccaattccaggtgttggtacatatgatgatttccatactattgattgggtgcgagaaaaatgtaaagacagagaaaggcatagacggatcaacagcaaaaagaaagaatcagcatgggaaatgacaaaaagtttgtatgatgcgtggtcaggatggctagtagtaacactaacaggattggcatcaggggcactggccggattaatagacattgctgccgattggatgactgacctaaaggagggcatttgccttagtgcgttgtggtacaaccacgaacagtgctgttggggatctaatgaaacaacatttgaagagagggataaatgtccacagtggaaaacatgggcagaattaatcataggtcaagcagagggtcctggttcttatatcatgaactacataatgtacatcttctgggccttgagttttgcctttcttgcagtttccctggtaaaggtatttgctccatatgcctgtggctctggaattccagagattaaaactattttaagtggattcatcatcagaggttacttgggaaaatggactttaatgattaaaaccatcacattagtcctggctgtggcatcaggtttgagtttaggaaaagaaggtcccctggtacatgttgcctgttgctgcggaaatatcttttcctacctctttccaaagtatagcacaaacgaagctaaaaaaagggaggtgctatcagctgcctcagctgcaggggtttctgtagcttttggtgcaccaattggaggagttctttttagcctggaagaggttagctattattttcctctcaaaactttatggagatcattttttgctgctttagtggctgcatttgttttgaggtccatcaatccatttggtaacagccgtctggtccttttttatgtggagtatcatacaccatggtacctttttgaactgtttccttttattcttctaggggtatttggagggctttggggagcctttttcattagggcaaatattgcctggtgtcgtcgacgcaagtccacgaaatttggaaagtatcccgttctggaagtcattattgttgcagccattactgctgtgatagccttccctaatccatacactaggctaaacaccagtgaactgatcaaagagctttttacagactgtggtcccctggaatcctcttctctttgtgactacagaaatgacatgaatgccagtaaaattgtcgatgacattcctgatcgtccagcaggcattggagtatattcagctatatggcagttatgcctggcactcatatttaaaatcataatgacagtattcacttttggcatcaaggttccatcaggcttgttcatccccagcatggccattggagcgatcgcaggaaggattgtggggattgcggtggagcagcttgcctactatcaccacgactggtttatctttaaggagtggtgtgaggtcggggctgattgcattacacctggcctttatgccatggttggtgctgctgcatgcttaggtggtgtgacaagaatgactgtctccctggtggttattgtttttgagcttactggaggcttggaatatattgttccccttatggctgcagtcatgaccagtaaatgggttggagatgcctttggcagggaaggcatttatgaagcacacatccgattaaatggataccctttcttggatgcaaaagaagaattcactcataccaccctggctgctgacgttatgagacctcgaaggaatgatcctcccttagctgtcctgacacaggacaatatgacagtggatgatatagaaaacatgattaatgaaaccagctacaatggatttcctgtcataatgtcaaaagaatctcagagattagtgggtgaattcctgttggtggtcagcaacctcctaattcgggtgttggtgctaggcttgagtggtagaaagctcaaaagaatccagtgaa

SEQ ID NO: 17779 - DNA, 1063 bp, Homo sapiens
ttctcttccccttccgtgggtcagggccggtccggtccggaacctgcagcccctttcccagtgttctagttcgcccgtgacccggaataatgagcaaggagggtgtggtgggttgaaagccatcctactttactcccgagttagagcatggattcagttttagtcttaagggggaagtgagattggagatttttatttttaattttgggcagaagcaggttgactctagggatctccagagcgagaggatttaacttcatgttgctcccgtgtttgaaggaggacaataaaagtcccaccgggcaaaattttcgtaacctctgcggtagaaaacgtcaggtatcttttaaatcgcgatagttttcgctgtgtcaggctttcttcggtggagctccgagggtagctaggttctaggtttgaaacagatgcagaatccaaaggcagcgcaaaaaacagccaccgattttgctatgtctctgagctgcgagataatcagacagctaaatggagtctgagcagctgttccatagaggctactatagaaacagctacaacagtataacaagtgcaagtagtgatgaggaacttttagatggagcaggtgttattatggactttcaaacatctgaagatgacaatttattagatggtgacactgcagttggaactcattatacaatgacaaatggaggcagcattaacagttctacacatttactggatcttttggatgaaccaattccaggtgttggtacatatgatgatttccatactattgattgggtgcgagaaaaatgtaaagacagagaaaggcatagacggatcaacagcaaaaagaaagaatcagcatgggaaatgacaaaaagtttgtatgatgcgtggtcaggatggctagtagtaacactaacaggattggcatcaggggcactggccggatttgcgtaaaacaggataggaatagcaaaatcaggtgtgtacggtgacctgcaaatgaaacaccatctacctggagcagctgtgcaagcacaggctgttacatcatatatgtaatagtttatgctgt

SEQ ID NO: 17780 - DNA, 1177 bp, Homo sapiens
ttctcttccccttccgtgggtcagggccggtccggtccggaacctgcagcccctttcccagtgttctagttcgcccgtgacccggaataatgagcaaggagggtgtggtgggttgaaagccatcctactttactcccgagttagagcatggattcagttttagtcttaagggggaagtgagattggagatttttatttttaattttgggcagaagcaggttgactctagggatctccagagcgagaggatttaacttcatgttgctcccgtgtttgaaggaggacaataaaagtcccaccgggcaaaattttcgtaacctctgcggtagaaaacgtcaggtatcttttaaatcgcgatagttttcgctgtgtcaggctttcttcggtggagctccgagggtagctaggttctaggtttgaaacagatgcagaatccaaaggcagcgcaaaaaacagccaccgattttgctatgtctctgagctgcgagataatcagacagctaaatggagtctgagcagctgttccatagaggctactatagaaacagctacaacagtataacaagtgcaagtagtgatgaggaacttttagatggagcaggtgttattatggactttcaaacatctgaagatgacaatttattagatggtgacactgcagttggaactcattatacaatgacaaatggaggcagcattaacagttctacacatttactggatcttttggatgaaccaattccaggtgttggtacatatgatgatttccatactattgattgggtgcgagaaaaatgtaaagacagagaaaggcatagacggtttacttataccctgtaactttccagaaaggatttcaggtagctaaaaaacaaagaaatacaataagaagacaaaataagaaggaaagggaaaaatacagcacaggagttggggggaagaacaagccaagttccagatatggaggtcagcatgattttgggctttgagcagcccaccagctaaggcaaaaaaggaaactcattgcatagctcttacctatggaaaaagaagaaatctactgggggcagatggtcttgtgggattttgctgttttcttttatctcctttcccagcatttgattctgagatatttctcaatttggctcccaaataaagcttattgagtgttgtaatg

SEQ ID NO: 17781 - DNA, 365 bp, Homo sapiens
tgacattagggcacccttgagctaccttgagctaaaggaaataacccttgaatttttttctgtttggcctaaagaatgtggtttgttttgtaactgaattcatgggattgttaaggtacaaaattttgctttagttttatttgtactaggattttgctatattaatacaatgtgaaaagaatcaaaagtgttagaaataaatgcatagaatgtaagtttcaggcatgtgagtagaggatctctgctccataaagagttctgttgttgttataggttccatcaggcttgttcatccccagcatggccattggagcgatcgcaggaaggattgtggggattgcggtggagcagcttgcctactatca

SEQ ID NO: 17782 - DNA, 325 bp, Homo sapiens
gcaaggagggaaaaggataatttgctttacagccatgggtagatgacagtgtcatcaaaccagatagatttgtttggggccacatacatatgaattcatatttaattatgtattcaaatgtttgttgattaaccttaaaatacttccaccaaacaaagagaaactatgaccaaagtggcattttatttcatatttctttcttgaaaatgaaagaaccatgtactatgctgttttccaaggtaccatctgaaaaatagagtaaaataggatgaggacaatatgtttagtttctgattctctgatttgaaagaaacaatctgccaac

SEQ ID NO: 17783 - DNA, 272 bp, Homo sapiens
ctccagcgagtaaacgcagaaggagtgatgggatccgaagatcaccgttttgcaaaccttcaggaaacgccagagggggaggtctggacaccgtgttgagacagctgtgggatgcatctgcacactgaggagccatgatggctgtgggacgcccagaagctgggggaggcctggagcagcctctcccttacagcctcagggggaatcagcctgctgtgagataataaatgtctgttgtttaagcccccagtgtgtggtggcttattgtgaca

SEQ ID NO: 17784 - DNA, 240 bp, Homo sapiens
ctccagcgagtaaacgcagaaggagtgatgggatccgaagatcaccgttttgcaaaccttcaggaaacgccagagggggaggtctggacaccgtgttgagacagctgtgggatgcatctgcacactgaggagccatgatggctgtgggacgcccagaagctgggggaggcctggagcagcctctcccttacagcctcagggggaatcagcctgctgtgagataataaatgtctgttgttt

SEQ ID NO: 17785 - DNA, 351 bp, Homo sapiens
cgaggctgggcccatcccattttggaacgagtagccaggctgtccctgccaccccggaccccgaagtgtggccgggtggggcccctgaccctctcctgggctccaggtgctgtctcctgtctccatcttgggtgcacatgccaggccccctgggtgccgtgtgctccccaccccttcacgcgtgggcactgtctcatccctgccccagcccccaccctcagaccatcaggtgaagcccctgcacccacctgtctgtctgaacaagagcgtggcccttcccgccctgcctgcagtggctgtggcttcctggggacaggaggcagctgggtggggatctggaggatgctcctc

SEQ ID NO: 17786 - DNA, 283 bp, Homo sapiens
tctgctgcgtgacctcagccctcccgcctgccgatgggagctgggtcatctcttacgcctttcagctttggcttcttccgcagtgtatgtgaaggggtcacacagagcatccagcggtcaccatggtgaacaagaagccaggaaggaaggaagcaatgtcggcaaaagggctcagatgacaaccaaacagaacggtttcccaccctgggcctcctttccacacacacagcatcgtgggtattttaaaataaacaagatcaacgtccaaacctgcactgaggcc

SEQ ID NO: 17787 - DNA, 419 bp, Homo sapiens
catgaaatacagcacttctggccaagaagtctaaatcacagccgatctacacgaggcggatggtccacaacgccaagttcctacccgggcactgagctcaacgctcgcacaactccaaacgagggcgcaaccatattcccactgacatcctccttggggcagcaagacaagctccgaacagcctgtcctgggccaacaagagaagctggcgggcgcccgctgagcactgtgagccatcttgtgcatccagcggtcaccatggtgaacaagaagccaggaaggaaggaagcaatgtcggcaaaagggctcagatgacaaccaaacagaacggtttcccaccctgggcctcctttccacacacacagcatcgtgggtattttaaaataaacaagatcaacgtccaaacctgcactgaggcc

SEQ ID NO: 17788 - DNA, 480 bp, Homo sapiens
aggaagtgaggcaagaagcctcaagattaacttggcatcttgcaagtctttttgaaaaaatccccaacggggttgtcaaaaagccttcctgtgttttcctcagatgcttgtacttgcctcaagcctgcttccttgctggatgtgcaacttgaaccagtccttagatactcaaccttggcagtatttaaagcaaatcatttcttgcttagcacttttccctgggtaggagggaggactcttatgagcgggtgttggcatggttaatgtaaagctatgttcttccaggtaatattttgaggagaaaagcagaatgatgtcattcctgcaggcatgtcccccatcgccaacacacacacacacacacacccctacattgaggtcctgttgaataactgacagactaaatgttcaattctctatttcacttttctattgagatatataaggcttcaaaataaagtgatacttttcagagaaagg

SEQ ID NO: 17789 - DNA, 764 bp, Homo sapiens
  misc_feature (696)..(696): n is a, c, g, or t
  misc_feature (698)..(698): n is a, c, g, or t
  misc_feature (700)..(700): n is a, c, g, or t
  misc_feature (709)..(709): n is a, c, g, or t
  misc_feature (719)..(720): n is a, c, g, or t
  misc_feature (728)..(728): n is a, c, g, or t
taaaccttccctttttcattaatgtttcagtgagtgatcttaactcaagcacttctaattaaaatgtaaagatcattagcatgccccgttaatagaggtttttctttcaactcagaatgctccggatggaggtgccaggcacactcctacacccaccggtgctgaacaattgctgctcttggcaaggtttcagaacagctgggggtttctgtctgttacctgagctgctggtgacaactgcaacttatgtcaggctcaggggcaaggaaacaggaggcagggctggaggagccaggaggagaaaaaaaaactgcaaaggcagcttttcccttcttactgctatcagtctctcagggttggcattgctgaatgagaaagagggagatatatgctaatgctaataagaaaggcattaaataatattttaaaattatttactcaaaaagaaaaataaattgagatgtatactcatatggtacagaccgtcggaattctaccacaggggagcaaaacaaaagaggtaagtcaattttgccttattcagtatgtactcagtagtagccaaggaactggagttaaggagttcaagacctagcttaatcccatcacagaatgactagcagtaagaaagctgtggtagttacgaaagctaatcagttgtgcaaaggagtctgctagcatcagtgttaatccagncngnacaggggangagctggcanncaagcatngagtctactgtgctccaagctgcagatacatatgag

SEQ ID NO: 17790 - DNA, 433 bp, Homo sapiens
gaaaactctgtccccaacatcctccaacattctcttatttctgtcactgtcccagccatgggacagtggaaaggggcaatcttaagaaacagcagagagataagaaaagagagaaatgaacagaataacacctttcattgccttttgtgacatattcccaagctgacctttctgaagctgaaagaaaactattctgtctgaaacaaaaggaaatgaatagtcagttcaaatagcatagttcttaggaggagctccagctgtagatccagacaggcatggctctgattcccagttctgccattcactggctgggggaccctgttactaacctctgtaaacctcagttttctcatccaaaaagtggagataataatgtctccttcctcgcagagctattgtaaacattcaatgagctggctatgaagatggcctc

SEQ ID NO: 17791 - DNA, 209 bp, Homo sapiens
attagtgactatagctgctgttgacttcttttaaaatatttttaagttttatttttaatagatagaatttacatagttcaaaatacacaaaagggccagacacggtggctcatgcctagaatcccagtactttgggaggctgaggcaggagggtcgtttgagcccaggagttggagaccaacttgggcaacatggtaaaattccgtctc

SEQ ID NO: 17792 - DNA, 1249 bp, Homo sapiens
ctgtctgtatgctcccctagaggtttgagcagcgggacactgaagaattgagccacacccccatcacacacctgcaagtgggacaagggaacctttcccatttcactgctgtgacagtgcaaagctattaaaatctgaattgcttagcaggcatgtaaggtcctctctgctctggtctcatttaatctttcaggttctatcttcaccttcatttctgcaggagaaacacatctctgtaccaaaagttcttcggtttggtcaccctttcccctgaaaaaaacgtattaagctctgtaagcataacttagataccattacactgtgaaaccttctcagttttccatagaatacatttctgtgttctgtctgttcctttgaaaacatttttttagtttgtattgtactatatgtggtgcagtgtgcaatgaactatatgtccctggcatatagttatccctgaattatgtggtgaatctataatattaagctaatatgttatgcttgatttctggggaccaagtagatgatcatttggaaaaatataccaccattgtgcatggcagaggaacttcatttggtaaagaattgtgtcacatggttataggttgtaagatactatctttttcctttccgtcttatctttcttattatttattttttgagacagagtcttgctctgtcacccaggttggcatgtagtggtgccatcacggcttactgcagcctcaaactcctgggctcaggcatttctcccacctcagccttccaagtagctggggctacaggcatgcaccaccacactcagctaatttttaaattttttgtagagacagggtttccctgtgttgcctaggctggtcttgaacttgtgacctcaagcaatcctcccaccttggcctcccaatagttttcatttttattgaaattatacactaacatagtttaaaggctttaatatttctttgtttgttaaaaaaaaaaaaaaaaactattcccagcattttgctctctagtggcaactacttgtacctccttgagccgagtactttgttgtttatatcctgtttttaggtatatactcatattactttatatttcagtttttaccaataactcttgattcatgacaatggatgatgacaacttagttctttcctacctagtcacactcttcctttatcctgttttgcttagatcaatgttgataaaatattcactgtttatattatgtgagcattattcacatgtg

SEQ ID NO: 17793 - DNA, 531 bp, Homo sapiens
gcacgagcagatctcatgagacttattcactatcacgagaacagcattgcaaagacttgcccccatgattcaattacctgggtccctcccacaacacgtgggaattcaagatgagatttgggtggggacacagccaaaccatatcagtaggtaatgaaataaagggtagttcttagctgatgtcaaagtaacaattgaatgttgtgcttttttatacttttttttctttgaggcagtggctggtcttttaaaatgccttcattaaagtttctagtacattataccaaatagaaattaaaagacatgcaagttgctgctggctggcatctataatcccagctattcaggagtctgagacaggatgattgcttaaggccaggagtttgagactagcccgggcaacatagtgagactctatctcctaaaaaagttagctgaatgtggtggtgtgctcctgtaatgcccactcctcatagatatttcaaaatagtaatatttattgctgccaatgtgagtaggccaaaaaaaaaa

SEQ ID NO: 17794 - DNA, 573 bp, Homo sapiens
ctggttcatcagttttctgatctcatctcaaatatcatctcctgccttgctaccctatctaaagttgcctctcattctgtctctatcctgttacactgctttatttatttttttcatagaacttacctatatctctatgcttttgtctatttccatttatttccctgtttattttctatttcaggggtttgcagactactgtgggtcaaatcaagcctgcctggttccataaataaagttatattggaaaatggcctggcctgtttgtttatgcattgtcaatggctgctttggctctataagggcattactgaatagtggtgacagagacgatctggactgcaaagcctaaaatatttagtatctggccctttacagaaaaatttactgacacctgctctatctccctccactacttaactgtcttgttcactgctaattccccagcacctagtacagttctgggcacatggtggttctcaataaatacttgtcaactgaacttagtcaatgaaggaacacaggacattgtgactggttttgactctagttgtggatgtcttttgaccctta

SEQ ID NO: 17795 - DNA, 762 bp, Homo sapiens
tcacctccctagagcctctgcttcctcatccaagactgggggtatagctgtgctcacccactaacactgctgtattgtttaacgtaaaggcaagatgagaacatggagtttcaacctgaaaggcattgagcacgttggttgtcattactgttgggtgacttcctactttccctgcgtacctctgaaaggagaactattttgcttattactgagttgcaatttccttctatattctgaatacaaattcatcatcagatatatgtgttgtgaagttttcttcgaggattttccagggttgcatctctgtggcttagacgttggccacttcatcttggcatgactattatataacaggaggatggagaaatggccggggtttgcagactactgtgggtcaaatcaagcctgcctggttccataaataaagttatattggaaaatggcctggcctgtttgtttatgcattgtcaatggctgctttggctctataagggcattactgaatagtggtgacagagacgatctggactgcaaagcctaaaatatttagtatctggccctttacagaaaaatttactgacacctgctctatctccctccactacttaactgtcttgttcactgctaattccccagcacctagtacagttctgggcacatggtggttctcaataaatacttgtcaactgaacttagtcaatgaaggaacacaggacattgtgactggttttgactctagttgtggatgtcttttgaccctta

SEQ ID NO: 17796 - DNA, 380 bp, Homo sapiens
gccttttgccatattattagagtaaatatgctcttggctccagaaacatgggaaaagggtgcaacgaaggggtcaaagtaataatacccaggagcaaagaagcagaggccgggaggagacggtgttcgaggaacacacttgcaaagcagatgctggtgtgtcttgctacacaattgtcagtagcctaagagtaatacacagacatttccatgacctaaaaacttaagagagtgaaatgcaacatagaaatcaactgatttgggccgggagcggcggctcacctgtgtaatcccagcactttggaaggctgaggcgagtggatcacctgaggccaggagttcgagaccagcctgggaaatataccaagaccccaaatctac

SEQ ID NO: 17797 - DNA, 522 bp, Homo sapiens
tgtgaggcaaggtctagcccaggctagagtgcagtggcacaatcacggctcactgcagccttgaccactgaagctcaagcgatcctcccacctcagcctcccaagcagctgggactacaggcatgtgccaccatgcctggctaatttttaaatttttttgtagagataaggtctcgctatgttgctcaggctggtcttaaactcctgacctcaactgatcctcctgccttggcctcccaaagtgctggcattacaggcacgagccaccatacctggccggaagtcatcattttcaatgagacattaaagagaagacagaaccagaataaagtaagaatgtacaaaatcacaagagaaaaaatataaaaaagagaaaggaagaggctttctagagaaacaaaaaaaaaagacagaaaataaatagagaaatggcagaagataaagtgaacatgagtaacaggcaagggacaaagagttaacatcatcttctctctccctttaaggtgggtagctctgttctca

SEQ ID NO: 17798 - DNA, 509 bp, Homo sapiens
tttctagaggctgcctgcattccttggctaatgactttgcatcactctgacgtcttgctcccatggtcgtatcacctactactggccctgatctcactacttgttatatggaacaaagggataaggaagtgacttgcctaagtcactgaggaacctaatattgagattagcactcaatgattcctggctctcagaatgtgtgctgctaccaccaggccacactcttccctccagagagaagatgtgtcagcacggaattgtgctgaagcaaagatgtgaaatagaatgattacatatctacctagtgggaagatctggggaagaatctatcagtgctggcagagaagcaaaccatacgacatcactcatccccagaaagtgaagttaagggaaataaaaaacaatctacaccatttagaaaacacagccaccccatacccttggaaaaaatacactaaaatatcttcatctgatttgacctctaataacatgaataattgtcttataac

SEQ ID NO: 17799 - DNA, 288 bp, Homo sapiens
gagaccagcttgggtgatcttgtttcttaaaagaaaaaggaaaagagactgggtgcactggcttacgcctataatcccagcgttttgggagcccgaggctggtggatcacctgaggtcaggagttcgagaccagcctggccaacatggtgaaaccccaactctactaaaaatacaaaattagccaggagtggttcatacatctgtaatcccagctacttgggaggctgagccaggagaatcacttgaacccaggaggcggagcttgcagtgagctgagatcgcaccac

SEQ ID NO: 17800 - DNA, 436 bp, Homo sapiens
agctatttggaagtgacatagccaaaatgctggaagaacataattactttcactcatcttctcacttcagaacaaaggttaaaacactatgtttcatgtttactctatttgtaaatgtacatataatagtatgttactttatatggatccaagtgattgcaatgaataattcttacaaccttaatattggcataagagggtgtctttacaatatgtatttatgagttaatttctttaaggaagagccgtaagtataagaactgatgcagaagaatataagtatgtttatgaatgagaggaactagtttctgatcttgattctgaactgatacataccacaataaccaataagccaaactacaaccaactagtttgttaacaagattagtgctattggtatgtttcatagaattatttttaatggcacccaaaactt

SEQ ID NO: 17801 - DNA, 355 bp, Homo sapiens
gtagattagtaagtgctacagagataaaagggaggcctgttgcgatttcaccgagggtggtcagtgtagacttctttgtgaagaagagaaaataaaccatgcagatatctgaggggacattggttttctgttgctgtgtaacaaattaccacaggccaggcacggtggcttgtgcctgtaatcccagcactttgggagtctgaagcgagaggatcacttaagcccaggaattagagaccagcctgggcaacatagggagacccaggctctataaaatgtttttaaaaaattagctgggtttgttggcatgcacctgcagtcccagctacttgggaggctgagacaggaagatcac

SEQ ID NO: 17802 - DNA, 149 bp, Homo sapiens
atggacagtagcttatgcgaaataaaacctttggtctttttagtgaactatttttattatgatgaaatgagatcatactaaccttctcccataacttgtaacactaaaatctttaaatcagacagattatctcacaagtacattttttg

SEQ ID NO: 17803 - DNA, 260 bp, Homo sapiens
gatctgcccacctcggcctcccaaagtgctgggattacaggcgtgagctactgcacccagcctttttttaaaatttttaaacaagaactttccctgatttctgtctttgaagtttgtcctagacctagaccatgaacattttataaattctttaacttaaattagtaaattctggagcaagtgtaaaaaccttctttcccatcctattattagggaagaagatcctgtttaacagtccctcagaaatttttattatggag

SEQ ID NO: 17804 - DNA, 590 bp, Homo sapiens
tgcttttatgaatccggtgactgttgacatctgtgagaggagagctggctttcctgctgtgtttatttcagtgtccccctgccacgtcatgcagttgtcttgcttctgtgtctggaacatcccaagttgcaccattctaagaaaattaagtgcaatgaaatatgttaattcaacattatggcttaagaattatatttcctggacctcacgtgtacttaaaagttgaatcgatcaaattttattgcttccttttcccttagagcagcacgttgagagtgatggttttttctgcaatcataactcagtggccttggtgacttttgtcttgtgttaatacttaaaagtagatccatttcctctggggccatgcatattcaaaggggctgaggctgtagtcatccccagagctgctcttgacacttcttgagttcatagcgctctgtcacacagcctctgttgtaactacagagaccgtttttactcttcagcattgatcatgaagagaagagataaggggtttttatgcatagccgtcataccagtaacttctgtgactgaactctccacctgtctgcatcagtaaaaaaaaa

SEQ ID NO: 17805 - DNA, 383 bp, Homo sapiens
aggacaaaaaaaaatgtttaagcaaatgaaaacaaaaccatgacatacccaaactcaggaggaggcaacaaaggcagtgctaaagggaagcttacagccgcagatgcttaaattaaaaagaagaaagatctcaaagccatgctaaagggaagcttatagctgcaggtgattaaattaaaaagaagaaagatctcaaatcaataacctaacattacacctaaaggggaaaaaaaaaaaaaaaactaatgacaaaccaagcaaaaggaagaaaataacagattagaacagagataagcagaataagatcagaaaaaaaggaaaaaaaaaccactgagtttgtttttttaaagatcaataaaaattctaaaactcacagctatatt

SEQ ID NO: 17806 - DNA, 338 bp, Homo sapiens
gatgtgctagccctggcgctggctattgaagagctagcagtggccacatggaagccctggacagcttagtggtgtgctctacaaatgactctgtccagggcatctcccaacacagcagtgggacaagaagacaatgacgggatgttgcatgaactgaccctcagaacccaatgtccaggagaacatgaactgggatcttgaagttcttcagaaagatcagagtgagcggtggccctgagtcactctgtagcagtcatggcagtgagaagagccactctctaatcataatggaattgcaagattgccaaattaagtcacccagttaattgtggccctta

SEQ ID NO: 17807 - DNA, 409 bp, Homo sapiens
acttactcaaaagaattgaaagcagggacttgaacaggtatttgcacacccatgttcacaacagcatcattcatagtaaccaaaaggtggaaacatcctcagtgtccattgatagttgaaaggataaacaaaatgtagcatatacaatggaacattatttagccttaaaaaggagaaaattttgatgcatgttgtaacatggatgaagcttgaagacattatgctaacttagtcataggacaaattttgtataattccttttatatgaggttccttagagtatatgtaaatggatgataagtgtatgaaaagatgctcattatcagtcattcaggaatgaaataccactgcaacccactaaaatataggttgggcaagagtaattgcgttttttgccattgaaagctgc

SEQ ID NO: 17808 - DNA, 453 bp, Homo sapiens
atgtgctgccgtcccctgtgaggtgagggggagtacatttccaaggggcaaaattaggcaaactcttgaatccatccataactgctgttgtggtagatattcctgaatacccaaaaattaaaagtgaatttaaactgtcagtggaaacacagcagtcctgcattttaaaaacttagagctgtcccaggcacatagaaaagttaactgtctgaggggaaatagaatgtggttaagtttaaagaatatgcttagtattataaatgttgagtgatgagttgtttaccatttataataaactgttaaatgtatttctgggaacattccatggcagcatattctgggttgttgtttatgtgttccaatgtagacaaattatatttgccttgggaaaaattctaagtaatcaaaattatatttaaatattaaaaaatcacattgaagttcaaaaaaaat

SEQ ID NO: 17809 - DNA, 965 bp, Homo sapiens
  misc_feature (11)..(11): n is a, c, g, or t
cctcaaaggcnactgccccctgggtgcaaagtgcaagaagaaacacacgctgctgtgccccgactttgcccgcaggggggcgtgtccccgcggcgcccagtgccagctgctccaccgtacccagaaacgccacagtcggcgggcagccacgtcccccgccccagggcccagcgacgcaaccgccaggagcagggtctcggccagccacgggcccaggaagccttcagcatcccagcgccccaccaggcagacgcccagctcggctgccctcactgcggctgccgtggctgcacctccccactgcccaggggggtcagcctctccctcatcctcgaaggcttcctcctcctcctcctcctcctcatcccctcccgcttccttggaccacgaggcaccatctctccaggaggctgccttagcagcagcgtgctccaacaggctctgcaagctgccttccttcatctccctgcagtcctcgccgagcccaggagcccagcccagggtccgggcccctagggcccccctcaccaaggactcagggaagcctctgcacatcaaaccacgtctgtgaggaccccagggaccggcctgcacctacctcagaccctcatccttggagaggaaagaggctctgtccaccactctaccccacaggagggccgcccgccaccaagcctcacctgggggccacagggacactgctctgcctgcctggccctcaaccttccatgaccagcgtgtgcgcagggcctggtcttcctcccccaagccaggcccctgtccccaccccaccaccttccagggtgccaggcagggctggcctccaggcctgtccccgactgccattggcaacagtggccctgcagcccccagccctccccacccaggttttcggcccagtgaagaggccactggccaggcctcccaggcaggtgttttatgttcagcaataaaggttctatccg

SEQ ID NO: 17810 - DNA, 1038 bp, Homo sapiens
  misc_feature (11)..(11): n is a, c, g, or t
cctcaaaggcnactgccccctgggtgcaaagtgcaagaagaaacacacgctgctgtgccccgactttgcccgcaggggggcgtgtccccgcggcgcccagtgccagctgctccaccgtacccagaaacgccacagtcggcgggcagccacgtcccccgccccagggcccagcgacgcaaccgccaggagcagggtctcggccagccacgggcccaggaagccttcagcatcccagcgccccaccaggcagacgcccagctcggctgccctcactgcggctgccgtggctgcacctccccactgcccaggggggtcagcctctccctcatcctcgaaggcttcctcctcctcctcctcctcctcatcccctcccgcttccttggaccacgaggcaccatctctccaggaggctgccttagcagcagcgtgctccaacaggctctgcaagctgccttccttcatctccctgcagtcctcgccgagcccaggagcccagcccagggtccgggcccctagggcccccctcaccaaggactcagggaagcctctgcacatcaaaccacgtctgtgaggaccccagggaccggcctgcacctacctcagaccctcatccttggagaggaaagaggctctgtccaccactctaccccacaggagggccgcccgccaccaagcctcacctgggggccacagggacactgctctgcctgcctggccctcaaccttccatgaccagcgtgtgcgcagggcctggtcttcctcccccaagccaggcccctgtccccaccccaccaccttccagggtgccaggcagggctggcctccaggcctgtccccgactgccattggcaacagtggccctgcagcccccagccctccccacccaggttttcggcccagtgaagaggccactggccaggcctcccaggcaggtgttttatgttcagcaataaaggttctatccgccagaaaaatactaagaaaccccggcggtcgcccacaaattcccaataaagaggcttaattaaagccggaccc

SEQ ID NO: 17811 - DNA, 1102 bp, Homo sapiens
  misc_feature (11)..(11): n is a, c, g, or t
cctcaaaggcnactgccccctgggtgcaaagtgcaagaagaaacacacgctgctgtgccccgactttgcccgcaggggggcgtgtccccgcggcgcccagtgccagctgctccaccgtacccagaaacgccacagtcggcgggcagccacgtcccccgccccagggcccagcgacgcaaccgccaggagcagggtctcggccagccacgggcccaggaagccttcagcatcccagcgccccaccaggcagacgcccagctcggctgccctcactgcggctgccgtggctgcacctccccactgcccaggggggtcagcctctccctcatcctcgaaggcttcctcctcctcctcctcctcctcatcccctcccgcttccttggaccacgaggcaccatctctccaggaggctgccttagcagcagcgtgctccaacaggctctgcaagctgccttccttcatctccctgcagtcctcgccgagcccaggagcccagcccagggtccgggcccctagggcccccctcaccaaggactcagggaagcctctgcacatcaaaccacgtctgtgaggaccccaggggaaccgggcttggaactaacttaaaagacccctctctatcttttgtgggacgagggaagaagagctgcttcgtgctacaactactactcactccctaatgaggaggtgggcccgcccggccaaagaacataccctctagcttgggcgaccccaggaggggatgacttgcgtctagccttggccttgtgcccctctaaccctttccacatagacccaaggcggttggtagcagcaagggggcccttgggatctttccccatcccccaccaaaaaggacacaaggggaccaccctgatccccacaaacgcaccataccaaagacattacacaggagcatcagaccagagggcaaagggatagcaggccacaacacacgagacctagatcaccaaggcacaggccaaagaggcgaacaaaaatagatgggccacagacaagccacgacaggaaagcaagacaaacacaaggagtcctacagcaccaaaacgacagaaggaccacgagacgcacgcgacaacca

SEQ ID NO: 17812 - DNA, 985 bp, Homo sapiens
acttaccaaagacaccctcagagttacggatggtcacaaatccaggtatatggcacccagagaacaagacttgggttgtcagtggtttgcattcaagaataactcaggaagaagaaaaccaatagagaaagtttcagtctgctgtggaccattatttttctcatggcacttaacttcgtttttgatgtgatgccccgtaagcttcgcattggttgggttgtgaaatgccatcctacagaggaggacttacaaggacctcactgcccacattaagcacagcactggctttggctctaaattaggtctcatcaccccttcagacagatgctcacaggagcttagagctcagagggccattagggacacactgaagaaacagaggcaggagaagttaatgacttgctgagttctcttgttactggatgccacgattagaccacacatcctttgtgaaatgcagagaagcttttttgcttttattaatgaataaagtgtttcaaattcatctggtataattgaggacacatgatgaaattgagaggagccagaggttgcacactggctgagctgtgatttcaaagcagtttctctccatttacattaaggctgaccccacaggaccctagacaaggaggcccttcaccaggggactgcagtggtggaaccacagtgagaggtgaggcagaaaagagcaaggacaggccagagcatcttccaagccctgaaaccattcaggcagagtcgagaataccatttgatgaaaacacctctctttaatctgtcggaaccgattctgttcgatttgtcctgaatataatcttgaaccaccctgcatgtattataaaacacccagagtcatcttgtgaagatacgtaagttgtttgcaagctgcgaggggattattttttttttggataagatgtctaggactgtgattcagagggaaccttataacatattgggtgcaatgctctacatctcttaa

SEQ ID NO: 17813 - DNA, 238 bp, Homo sapiens
catatgctgttaaggaatctgatgccagaaatcttactccagttctttttgttgttgttgttgtttgtttttttaaagacaaggtctcactttgttgcccaggctggagtgtagtggtgcaatcacggctcactgcagccttgacctccccaggctcaagcaatcctcccacctcagcctcctgagtagctggcactacaggtgcacaccaccagagctggctaattcttctaatttt

SEQ ID NO: 17814 - DNA, 366 bp, Homo sapiens
gctgctattcgctgccccttctgcctccgaggcggtagcagatgccacgttggcggggtcggtgaaggtcaggactctaggcctccctccgccaagccagagggatgagcaatcacgcctgagagcccactgcgtgccatgcagtccgcacagccgcagcggttttctagatggagaaactgaggctcagtgacttgcccgctgcactctgtccacggccgctgcacacgcccccttgggctgcgctcccggaccttctaatgtgaccacggctcccggcatgcaggccctgccagcggagggagcccggtggtgacccttggtctgcagccctctttggaggtgaataaatgcggtctggagccc

SEQ ID NO: 17815 - DNA, 441 bp, Homo sapiens
taaaatagcaatttttatacataatccatccatgtgctaataggcacctgtatagcacattatattttacaaagtatcgtaggaatttatatttgagattcccagtaacattctgaggttggcattagtattttcttacttttccaaatgagaaaactgggggtcaaaaaagcaaagtgactggtacaagactattcagttggtgaataagaaaccaggatttaaacacagatcttgggactctgaagtttatgctttatcttgtatagagtagctgatcctttcataccaatctccttagggattgccattatcttgccagatttttctattgcttttcaaactgcaggtggcagcccattagaaggttgtgaagtcaatgtaatagattgtaaggtcagtgtaatgagccatgaaagcattaaaaaatcagttagaata

SEQ ID NO: 17816 - DNA, 205 bp, Homo sapiens
ggaacatcaatttagtctcgaaaaacatgtttactacaactccatatgaaacaaaaatctttctgtccttccttgataattcagtcaaaaagccattagcagacctgagaaacaagggactcctaacggagtctgatcccattcaaggaaggtagccaaatgggatagtggcctggtaaggtcgagatcagtcacatacaacagg

SEQ ID NO: 17817 - DNA, 938 bp, Homo sapiens
cctcattgataacctctgctagggcagtgaggaagggaaatgttgggtgggagcccccacacagagtccctactggggtaccgcctggtggacctgtgggaagagggccaccatcctccagacctcagaatgttagatccaccaacaacaccatgtgcctgggaaagccacagacactcaacaccagcccacaaaagcagccagaaggcaggctatatcccgcaaagccacaggggcagagctgcccaataccatgggaacccacctcttgcatctgcatgatcaggatgtgagacatggagtcaaaggagatcattttggagctttaagatttggctgcccctctggatttcggacttgcatggggtcaagaaatgaaaagcataaaaattgaaaagtgaaaagaaaaaatatttttattcacagaacatatatatgtatattgtatatgaagaaaatcctaatatatttatttaaaaagctgtgaataataagaatcaaattcaataatggtgcagaatgtgtagaatgcaaggtcaatacacaaaatacaatatggaaaattaatggaatttctaaatactagaaataaacaattgagaatacatttaaaagtaaaattttaatggtataaaaatagttaagaataatttaagtgaaacctttaaaaatctttcacactaaaactttttaaaatttcttgtagagaaacattacagaagacttaaataaatgtaaagatctaccatgttcttagatttgaagatgcaacattgatgtgaattctctggaagttaatctttagaatcaatgcagtagcggctgggcgcagttgctcatgcctgtaatcccagcactttgggaggccaaggtgggcggatcacaaggtcaggagatcaagactatactggctaacacgataaaaccctgtctctact

SEQ ID NO: 17818 - DNA, 439 bp, Homo sapiens
acaacttgaccaagattgaacttgccaatcctttggttcaagagccaaacaaaatcgttcccttaaaatattgcttcatgggaacagtcttcttcaaacatcttttagcacaggcaagattcccatttatacattaattctgttcaagacaatgagattgggcagaaaaggcattgagttggaagtcaatggatatgagtttttatcccagttttaccacaaattagctgagcataacttccacagatgcatttatcaagtagttttcatggtcattgcaatgccaaaaaactgtagcatttagaaaatttagttttcagacttggaaactatttaaggcatttcatatgaagggtgtgtccttgtaagagtttgcttatgcaagataaggcttctttcagctgcaagtcaggagcgaaccaaaactcaaagcagcagc

SEQ ID NO: 17819 - DNA, 341 bp, Homo sapiens
tgtctttgtgtcatggtgtttactatctataatgtgattagatgttctctaagatcttacagagcattgacattcatattctaattagtttcttgaagccatttttgttttttatggtaacctcttgaattacagtgtcaattcataatgcctccctatgtttactctttgtatacaagcacgcgcgcgcgcacacacacacacacacacacacacaactacctcccgacacacacattgatacatcaggtaacagtagtcttagaaggttgtgcatttggcttagctgtgactagcttttagagattttcacacgtgaccgctaagctgatccacagtta

SEQ ID NO: 17820 - DNA, 730 bp, Homo sapiens
acactttcacaatttattctaataattgaattagtatatgtaaatctcttagcacagttgacgtctgatatggtgtagtaaactctcaataaacattagctatttttattatatcctctccataactgttcaaacaaggtattatattgttacactatagatgaggaaactgaggttctgatgttagttttccaaggcccacagtagtaaaagcaaagtttggatttgaaccaaagattagttccagtttccagagccctcttctctcctcgacaggccttccctaaagcatcaagaagtttatgcaaattagtggttcacctgagtgaacatttaaaaaatttaatagtaccacttcctcttgacctgtttgtaaggagttcctcttaaatgcaatttctgaaaaagagaagcataaactgagacatccacattttttccttatttggccaaatagaagtgagaacctctgaggatagaggaattggatggaggtgcccttcagaactcatggagaaaagcactgctcccagtaaaatatctctcattctaatgaatgggtaagtatcctacaaatctttcacttctgtacaatctaggtctggtaggttacttgcacacactgggtggaggtggaaggggcaaagtattcctgaggtgatggccctgatcctacctcacatctccttggggcctggttggacctggctgagcgtgtttgagcagtggc

SEQ ID NO: 17821 - DNA, 474 bp, Homo sapiens
atgaaaactaagcccacgaagcttgagtcatctggagatgaagcagtcgcagcggagcagtcttggtaatggagaagatcatgtcagcgctgagaaaggcagggagggaggcctgagcaaggaagcttggagaagcctctggaggatgcctggccagggctgaatgctcagaaatggaagggaaagctcaggagattatcactgaatcaaagtgagaacctctgaggatagaggaattggatggaggtgcccttcagaactcatggagaaaagcactgctcccagtaaaatatctctcattctaatgaatgggaggactcttctccaggaggctgtgactaccaaggttgcaaatgctccacctgaacttgggtgcatgagggatctctctctctcacacacacacacccccccaccgcgtaagataaatttctgtttgtgagctgcctacattaaatgctttgctcctgaaaa

SEQ ID NO: 17822 - DNA, 514 bp, Homo sapiens
aactcatggccaagcagattttccagataagacttttattatggggcttatgctcaagtgcaagggagacagcaacggtgagaaagatcctctggctagctcccaaagaaacgccattagggattttttttttttttaattagacaaaacatgggaattgatttcaagactagtgtatgcaggctgggctgggcaaagcatgtgaagggtaggggatgcaggtcagcatgtctggttgtgatggttctcttgagtaatgaaccacctggtggtctggtgggggcagcgaagcagtaatcaatttttcagtttttcttcccaaggaaggacactcgcaaccttgtttgatgtttagctctcctaaggtcagtttctggaattctctaagtaaaaggaatggttgaacattatgagagcacagaagaatggctatttgctttgtgtgacagaagcctcagggttaatgggtataccatccatgaagtagtggtgtgggttttgtgaagagaagaaa

SEQ ID NO: 17823 - DNA, 301 bp, Homo sapiens
ccatatttcagattctgtgccagcggatgatagttttctgtctcattaggtttcataagtttacacaaagcacagggcaagtgttacacgtaactaaaaagttcagattttaatcagattagcagtgaccctggtttctggaagtagggaagttttttgttgttggtgttgctgttcacataagcatttctttatgttcatctgcaagtgaaactgtgtttaattctttaagcttgttttttttttttttctgagaattccataacatttaaattatatactaattataagtgaagcttca

SEQ ID NO: 17824 - DNA, 478 bp, Homo sapiens
ttcattctcttctctccttctgtgaggagcgcttctatactaagaccctgaaggttaactagaaagagacaaactcccaccaagtcatcccagtggtgcacctttgaggacttcccactactcgcctaggttcctatgaggccagtatggagacagagaggtgggggcctgtggggaactggaggctacaggccccacttctaggagatctcccagctccagcccactgtgccatcaggaatgtgggcccatggctgcctggctttcaagagaagctagaaatctgctttctatgtgaaaacctcttgatttttaaatgcttgcaatgaattaaaaatttatcaaaactgtgttgtccaaacaatcatgtatgtgaccaaacatggcctacaaaatgctaatttactacctctgaactagcacaatatcctgaaaaaaggcataaataaaaaaatattggcagaatgcagcatgagca

SEQ ID NO: 17825 - DNA, 414 bp, Homo sapiens
tgcccctaatggtggtttatacccatattaaggaggatgtgtagagtgtggtaatggtagtgactggagtgtggtaagggccttcctctgatgctaataatgtaacagtttctcggccgggagcagtggctcacgcctgtaatcccagcacttcgggaggccgaagcgggcggatcacctgaggtcaggagttccagaccagcctgaacaacatggagaaaccccatctctactaaaatacaacaaaacaaaacaaaaattagctggatgtggtggcacacgcctgtagtcccagctgcttgggaagctgaggcccgagaatcacttgaacctaggaggcggaggttgcagtaaaccgagattgcgccactggactccagtctgggcgacagaatgagactccgtctcaaaaaa

SEQ ID NO: 17826 - DNA, 416 bp, Homo sapiens
aaaatatgagtctgataatattaagtgctgacaagggatattggtcagtggaaattctcatacacagctggcaggactgtaatttggcacaacttttgaaagcaatttattcttacctctattaccacacagttctgccattccactcccaggaacagaccctggtggaaagagaataagctttggagtcagtccaggatttgaatccatcttttaccattttcttttctttctttctttctttctttttttttttgagatggagtctcattctgtctctacttaaaaaaaatacaaaaattagctggatgttgtggcacatgccagtcatctcagctacttgggaggctgaggccagagaatcgcttgaacccaggcagcagagtttgcagtgagccgagatagtgccatggcac

SEQ ID NO: 17827 - DNA, 2855 bp, Homo sapiens
cgctgggggcggggcgacgccggactccggagcgcccgcttacgcagttcctcccggggtcggaggccgattcgccgtgtggcgggttcgagtcccgcctcctgactctggcctctagtccctgagtcccgggcgggctgcattcgtcggggaaacctctcctcgaccaggggcacctctactcgaccaggggcgacggcgtactttgggcttcatcatggaggactacctgcagggttgtcgagctgctctgcaggagtcccgacctctacatgttgtgctgggaaatgaagcctgtgatttggactccacagtgtctgctcttgccctggctttttacctagcaaagaagtgacacagccctagaggaggcagtagcagaggtgctagaccatcgacccatcgagccgaaacactgccctccctgccatgtttcagttgagctggtggggtcctgtgctaccctggtgaccgagagaatcctgcagggggcaccagagatcttggacaggcaaactgcagcccttctgcatggaaccatcatcctggactgtgtcaacatggaccttaaaattggaaaggcaaccccaaaggacagcaaatatgtggagaaactagaggcccttttcccagacctacccaagagaaatgatatatttgattccctacaaaaggcaaagtttgatgtatcaggactgaccactgagcagatgctgagaaaagaccagaagactatctatagacaaggcgtcaaggtggccattagtgcaatatatatggatttggaggcctttctgcagaggtctaacctccttgcagatctccatgctttctgccaggctcacagctatgatgtcctggttgccatgactatctttttcaacactcacaatgagccagtgcggcagttggctattttctgtccccatgtggcactccaaacaacgatctgtgaagtcctggaacgctcccactctccacccctgaagctgacccctgcctcaagtacccaccctaacctccatgcctatcttcaaggcaacacccaggtctctcgaaagaaacttctgcccctgctccaggaagccctgtcagcatattttgactccatgaagatcccttcaggacagcctgagacagcagatgtgtccagggagcaagtggacaaggaattggacagggcaagtaactccctgatttctggactgagtcaagatgaggaggaccctccgctgcccccgacgcccatgaacagcttggtggatgagtgccctctagatcaggggctgcctaaactctctgctgaggccgtcttcgagaagtgcagtcagatctcactgtcacagtctaccacagcctccctgtccaagaagtgactgttgagaggcgaggaggtagtgggtgaggctacctgactcacttcaaatgcatgttttgagatgtttggagattcagcaattctgtcttcattgctccaggatctggtatactgttctcataaaactgagaggagaaaaaaagtgaaagaaagcagctgctttaagaatggttttccaccttttccccctaatctctaccaatcagacacattttattatttaaatctgcacctctctctattttatttgccaggggcacgatgtgacatatctgcagtcccagcacagtgggacaaaaagaatttagaccccaaaagtgtcctcggcatggatcttgaacagaaccagtatctgtcatggaactgaacattcatcgatggtctccatgtattcatttattcacttgttcattcaagtatttattgaatacctgcctcaagctagagagaaaagagagtgcgctttggaaatttattccagttttcagcctacagcagattatcagctcggtgacttttctttctgccaccatttaggtgatggtgtttgattcagagatggctgaatttctattcttagcttattgtgactgtttcagatctagtttgggaacagattagaggccattgtcttctgtcctgatcaggtggcctggctgtttctttggatccctctgtcccagagccacccagaaccctgactcttgagaatcaagaaaacacccagaaaggccttaatgacctcataggcactcttccaaaaagacaacagaactggaatgagaggcctgggtctgtctcctgccttagcaggcctatcaatttcttgtcaatctctttttttccttgctcacattaaaaggaagcatggagttctaatgctcccataaactatgtattttggcaagacacttcactactccaggtctcactttccccatctgtaaaacagggtttggactaggtgttccctggtattctgtgatctgcctcttgctgccattctttctctcctctgcttctctgtatttttcttctgttatccctgggggtgctcaggttcacttgattgtctgtatttctgtgtggttgtagcaaggactcagcctcatgtagcacgaataggggtgtggttcatggcgtgttgacccagcagagcactccctcccactaacttgttctgcatgtgtagagtctccccattttttttaacgcaaccctttcccctttttcctaccccacagctctgttccatgtaagttgccaacagtttcactgaacagtggggtatgtgatggttttggcatgacatcttcagtatgagggggacagtttgacttcactttgagggtgtgatgtctgtagctatgtggaaggtaaaaatagtggtgtgatcatgaaccaaaggaatttatgttttgtaacttgggtactttattttgcattttgttatactattaaataattttttcctgtt

SEQ ID NO: 17828 - DNA, 2900 bp, Homo sapiens
cgctgggggcggggcgacgccggactccggagcgcccgcttacgcagttcctcccggggtcggaggccgattcgccgtgtggcgggttcgagtcccgcctcctgactctggcctctagtccctgagtcccgggcgggctgcattcgtcggggaaacctctcctcgaccaggggcacctctactcgaccaggggcgacggcgtactttgggcttcatcatggaggactacctgcagggttgtcgagctgctctgcaggagtcccgacctctacatgttgtgctgggaaatgaagcctgtgatttggactccacagtgtctgctcttgccctggctttttacctagcaaagacaactgaggctgaggaagtctttgtgccagttttaaatataaaacgttctgaactacctctgcgaggtgacattgtcttctttcttcagaaggttcatattccagagagtatcttgatttttcgggatgagattgacctccatgcattataccaggctggccaactcaccctcatccttgtcgaccatcatatcttatccaaaagtgacacagccctagaggaggcagtagcagaggtgctagaccatcgacccatcgagccgaaacactgccctccctgccatgtttcagttgagctggtggggtcctgtgctaccctggtgaccgagagaatcctgcagggggcaccagagatcttggacaggcaaactgcagcccttctgcatggaaccatcatcctggactgtgtcaacatggaccttaaaattggaaaggcaaccccaaaggacagcaaatatgtggagaaactagaggcccttttcccagacctacccaagagaaatgatatatttgattccctacaaaaggcaaagtttgatgtatcagggactgaccactgagcagatgctgagaaaagaccagaagactatctatagacaaggcgtcaaggtggccattagtgcaatatatatggatttggagatctgtgaagtcctggaacgctcccactctccacccctgaagctgacccctgcctcaagtacccaccctaacctccatgcctatcttcaaggcaacacccaggtctctcgaaagaaacttctgcccctgctccaggaagccctgtcagcatattttgactccatgaagatcccttcaggacagcctgagacagcagatgtgtccagggagcaagtggacaaggaattggacagggcaagtaactccctgatttctggactgagtcaagatgaggaggaccctccgctgcccccgacgcccatgaacagcttggtggatgagtgccctctagatcaggggctgcctaaactctctgctgaggccgtcttcgagaagtgcagtcagatctcactgtcacagtctaccacagcctccctgtccaagaagtgactgttgagaggcgaggaggtagtgggtgaggctacctgactcacttcaaatgcatgttttgagatgtttggagattcagcaattctgtcttcattgctccaggatctggtatactgttctcataaaactgagaggagaaaaaaagtgaaagaaagcagctgctttaagaatggttttccaccttttccccctaatctctaccaatcagacacattttattatttaaatctgcacctctctctattttatttgccaggggcacgatgtgacatatctgcagtcccagcacagtgggacaaaaagaatttagaccccaaaagtgtcctcggcatggatcttgaacagaaccagtatctgtcatggaactgaacattcatcgatggtctccatgtattcatttattcacttgttcattcaagtatttattgaatacctgcctcaagctagagagaaaagagagtgcgctttggaaatttattccagttttcagcctacagcagattatcagctcggtgacttttctttctgccaccatttaggtgatggtgtttgattcagagatggctgaatttctattcttagcttattgtgactgtttcagatctagtttgggaacagattagaggccattgtcttctgtcctgatcaggtggcctggctgtttctttggatccctctgtcccagagccacccagaaccctgactcttgagaatcaagaaaacacccagaaaggccttaatgacctcataggcactcttccaaaaagacaacagaactggaatgagaggcctgggtctgtctcctgccttagcaggcctatcaatttcttgtcaatctctttttttccttgctcacattaaaaggaagcatggagttctaatgctcccataaactatgtattttggcaagacacttcactactccaggtctcactttccccatctgtaaaacagggtttggactaggtgttccctggtattctgtgatctgcctcttgctgccattctttctctcctctgcttctctgtatttttcttctgttatccctgggggtgctcaggttcacttgattgtctgtatttctgtgtggttgtagcaaggactcagcctcatgtagcacgaataggggtgtggttcatggcgtgttgacccagcagagcactccctcccactaacttgttctgcatgtgtagagtctccccattttttttaacgcaaccctttcccctttttcctaccccacagctctgttccatgtaagttgccaacagtttcactgaacagtggggtatgtgatggttttggcatgacatcttcagtatgagggggacagtttgacttcactttgagggtgtgatgtctgtagctatgtggaaggtaaaaatagtggtgtgatcatgaaccaaaggaatttatgttttgtaacttgggtactttattttgcattttgttatactattaaataattttttcctgtt

SEQ ID NO: 17829 - DNA, 3058 bp, Homo sapiens
cgctgggggcggggcgacgccggactccggagcgcccgcttacgcagttcctcccggggtcggaggccgattcgccgtgtggcgggttcgagtcccgcctcctgactctggcctctagtccctgagtcccgggcgggctgcattcgtcggggaaacctctcctcgaccaggggcacctctactcgaccaggggcgacggcgtactttgggcttcatcatggaggactacctgcagggttgtcgagctgctctgcaggagtcccgacctctacatgttgtgctgggaaatgaagcctgtgatttggactccacagtgtctgctcttgccctggctttttacctagcaaagacaactgaggctgaggaagtctttgtgccagttttaaatataaaacgttctgaactacctctgcgaggtgacattgtcttctttcttcagaaggttcatattccagagagtatcttgatttttcgggatgagattgacctccatgcattataccaggctggccaactcaccctcatccttgtcgaccatcatatcttatccaaaagtgacacagccctagaggaggcagtagcagaggtgctagaccatcgacccatcgagccgaaacactgccctccctgccatgtttcagttgagctggtggggtcctgtgctaccctggtgaccgagagaatcctgcagggggcaccagagatcttggacaggcaaactgcagcccttctgcatggaaccatcatcctggactgtgtcaacatggaccttaaaattggaaaggcaaccccaaaggacagcaaatatgtggagaaactagaggcccttttcccagacctacccaagagaaatgatatatttgattccctacaaaaggcaaagtttgatgtatcaggactgaccactgagcagatgctgagaaaagaccagaagactatctatagacaaggcgtcaaggtggccattagtgcaatatatatggatttggaggcctttctgcagaggtctaacctccttgcagatctccatgctttctgccaggctcacagctatgatgtcctggttgccatgactatctttttcaacactcacaatgagccagtgcggcagttggctattttctgtccccatgtggcactccaaacaacgatctgtgaagtcctggaacgctcccactctccacccctgaagctgacccctgcctcaagtacccaccctaacctccatgcctatcttcaaggcaacacccaggtctctcgaaagaaacttctgcccctgctccaggaagccctgtcagcatattttgactccatgaagatcccttcaggacagcctgagacagcagatgtgtccagggagcaagtggacaaggaattggacagggcaagtaactccctgatttctggactgagtcaagatgaggaggaccctccgctgcccccgacgcccatgaacagcttggtggatgagtgccctctagatcaggggctgcctaaactctctgctgaggccgtcttcgagaagtgcagtcagatctcactgtcacagtctaccacagcctccctgtccaagaagtgactgttgagaggcgaggaggtagtgggtgaggctacctgactcacttcaaatgcatgttttgagatgtttggagattcagcaattctgtcttcattgctccaggatctggtatactgttctcataaaactgagaggagaaaaaaagtgaaagaaagcagctgctttaagaatggttttccaccttttccccctaatctctaccaatcagacacattttattatttaaatctgcacctctctctattttatttgccaggggcacgatgtgacatatctgcagtcccagcacagtgggacaaaaagaatttagaccccaaaagtgtcctcggcatggatcttgaacagaaccagtatctgtcatggaactgaacattcatcgatggtctccatgtattcatttattcacttgttcattcaagtatttattgaatacctgcctcaagctagagagaaaagagagtgcgctttggaaatttattccagttttcagcctacagcagattatcagctcggtgacttttctttctgccaccatttaggtgatggtgtttgattcagagatggctgaatttctattcttagcttattgtgactgtttcagatctagtttgggaacagattagaggccattgtcttctgtcctgatcaggtggcctggctgtttctttggatccctctgtcccagagccacccagaaccctgactcttgagaatcaagaaaacacccagaaaggccttaatgacctcataggcactcttccaaaaagacaacagaactggaatgagaggcctgggtctgtctcctgccttagcaggcctatcaatttcttgtcaatctctttttttccttgctcacattaaaaggaagcatggagttctaatgctcccataaactatgtattttggcaagacacttcactactccaggtctcactttccccatctgtaaaacagggtttggactaggtgttccctggtattctgtgatctgcctcttgctgccattctttctctcctctgcttctctgtatttttcttctgttatccctgggggtgctcaggttcacttgattgtctgtatttctgtgtggttgtagcaaggactcagcctcatgtagcacgaataggggtgtggttcatggcgtgttgacccagcagagcactccctcccactaacttgttctgcatgtgtagagtctccccattttttttaacgcaaccctttcccctttttcctaccccacagctctgttccatgtaagttgccaacagtttcactgaacagtggggtatgtgatggttttggcatgacatcttcagtatgagggggacagtttgacttcactttgagggtgtgatgtctgtagctatgtggaaggtaaaaatagtggtgtgatcatgaaccaaaggaatttatgttttgtaacttgggtactttattttgcattttgttatactattaaataattttttcctgtt

SEQ ID NO: 17830 - DNA, 2810 bp, Homo sapiens
cgctgggggcggggcgacgccggactccggagcgcccgcttacgcagttcctcccggggtcggaggccgattcgccgtgtggcgggttcgagtcccgcctcctgactctggcctctagtccctgagtcccgggcgggctgcattcgtcggggaaacctctcctcgaccaggggcacctctactcgaccaggggcgacggcgtactttgggcttcatcatggaggactacctgcagggttgtcgagctgctctgcaggagtcccgacctctacatgttgtgctgggaaatgaagcctgtgatttggactccacagtgtctgctcttgccctggctttttacctagcaaagaaggttcatattccagagagtatcttgatttttcgggatgagattgacctccatgcattataccaggctggccaactcaccctcatccttgtcgaccatcatatcttatccaaaagtgacacagccctagaggaggcagtagcagaggtgctagaccatcgacccatcgagccgaaacactgccctccctgccatgtttcagttgagctggtggggtcctgtgctaccctggtgaccgagagaatcctgcagggggcaccagagatcttggacaggcaaactgcagcccttctgcatggaaccatcatcctggactgtgtcaacatggaccttaaaattggaaaggcaaccccaaaggacagcaaatatgtggagaaactagaggcccttttcccagacctacccaagagaaatgatatatttgattccctacaaaaggcaaagtttgatgtatcagggactgaccactgagcagatgctgagaaaagaccagaagactatctatagacaaggcgtcaaggtggccattagtgcaatatatatggatttggagatctgtgaagtcctggaacgctcccactctccacccctgaagctgacccctgcctcaagtacccaccctaacctccatgcctatcttcaaggcaacacccaggtctctcgaaagaaacttctgcccctgctccaggaagccctgtcagcatattttgactccatgaagatcccttcaggacagcctgagacagcagatgtgtccagggagcaagtggacaaggaattggacagggcaagtaactccctgatttctggactgagtcaagatgaggaggaccctccgctgcccccgacgcccatgaacagcttggtggatgagtgccctctagatcaggggctgcctaaactctctgctgaggccgtcttcgagaagtgcagtcagatctcactgtcacagtctaccacagcctccctgtccaagaagtgactgttgagaggcgaggaggtagtgggtgaggctacctgactcacttcaaatgcatgttttgagatgtttggagattcagcaattctgtcttcattgctccaggatctggtatactgttctcataaaactgagaggagaaaaaaagtgaaagaaagcagctgctttaagaatggttttccaccttttccccctaatctctaccaatcagacacattttattatttaaatctgcacctctctctattttatttgccaggggcacgatgtgacatatctgcagtcccagcacagtgggacaaaaagaatttagaccccaaaagtgtcctcggcatggatcttgaacagaaccagtatctgtcatggaactgaacattcatcgatggtctccatgtattcatttattcacttgttcattcaagtatttattgaatacctgcctcaagctagagagaaaagagagtgcgctttggaaatttattccagttttcagcctacagcagattatcagctcggtgacttttctttctgccaccatttaggtgatggtgtttgattcagagatggctgaatttctattcttagcttattgtgactgtttcagatctagtttgggaacagattagaggccattgtcttctgtcctgatcaggtggcctggctgtttctttggatccctctgtcccagagccacccagaaccctgactcttgagaatcaagaaaacacccagaaaggccttaatgacctcataggcactcttccaaaaagacaacagaactggaatgagaggcctgggtctgtctcctgccttagcaggcctatcaatttcttgtcaatctctttttttccttgctcacattaaaaggaagcatggagttctaatgctcccataaactatgtattttggcaagacacttcactactccaggtctcactttccccatctgtaaaacagggtttggactaggtgttccctggtattctgtgatctgcctcttgctgccattctttctctcctctgcttctctgtatttttcttctgttatccctgggggtgctcaggttcacttgattgtctgtatttctgtgtggttgtagcaaggactcagcctcatgtagcacgaataggggtgtggttcatggcgtgttgacccagcagagcactccctcccactaacttgttctgcatgtgtagagtctccccattttttttaacgcaaccctttcccctttttcctaccccacagctctgttccatgtaagttgccaacagtttcactgaacagtggggtatgtgatggttttggcatgacatcttcagtatgagggggacagtttgacttcactttgagggtgtgatgtctgtagctatgtggaaggtaaaaatagtggtgtgatcatgaaccaaaggaatttatgttttgtaacttgggtactttattttgcattttgttatactattaaataattttttcctgtt

SEQ ID NO: 17831 - DNA, 2676 bp, Homo sapiens
ccggtaagattggacctctccggaagattgacgagtcccgacctctacatgttgtgctgggaaatgaagcctgtgatttggactccacagtgtctgctcttgccctggctttttacctagcaaagacaactgaggctgaggaagtctttgtgccagttttaaatataaaacgttctgaactacctctgcgaggtgacattgtcttctttcttcagaaggttcatattccagagagtatcttgatttttcgggatgagattgacctccatgcattataccaggctggccaactcaccctcatccttgtcgaccatcatatcttatccaaaagtgacacagccctagaggaggcagtagcagaggtgctagaccatcgacccatcgagccgaaacactgccctccctgccatgtttcagttgagctggtggggtcctgtgctaccctggtgaccgagagaatcctgcagggggcaccagagatcttggacaggcaaactgcagcccttctgcatggaaccatcatcctggactgtgtcaacatggaccttaaaattggaaaggcaaccccaaaggacagcaaatatgtggagaaactagaggcccttttcccagacctacccaagagaaatgatatatttgattccctacaaaaggcaaagtttgatgtatcagggactgaccactgagcagatgctgagaaaagaccagaagactatctatagacaaggcgtcaaggtggccattagtgcaatatatatggatttggagatctgtgaagtcctggaacgctcccactctccacccctgaagctgacccctgcctcaagtacccaccctaacctccatgcctatcttcaaggcaacacccaggtctctcgaaagaaacttctgcccctgctccaggaagccctgtcagcatattttgactccatgaagatcccttcaggacagcctgagacagcagatgtgtccagggagcaagtggacaaggaattggacagggcaagtaactccctgatttctggactgagtcaagatgaggaggaccctccgctgcccccgacgcccatgaacagcttggtggatgagtgccctctagatcaggggctgcctaaactctctgctgaggccgtcttcgagaagtgcagtcagatctcactgtcacagtctaccacagcctccctgtccaagaagtgactgttgagaggcgaggaggtagtgggtgaggctacctgactcacttcaaatgcatgttttgagatgtttggagattcagcaattctgtcttcattgctccaggatctggtatactgttctcataaaactgagaggagaaaaaaagtgaaagaaagcagctgctttaagaatggttttccaccttttccccctaatctctaccaatcagacacattttattatttaaatctgcacctctctctattttatttgccaggggcacgatgtgacatatctgcagtcccagcacagtgggacaaaaagaatttagaccccaaaagtgtcctcggcatggatcttgaacagaaccagtatctgtcatggaactgaacattcatcgatggtctccatgtattcatttattcacttgttcattcaagtatttattgaatacctgcctcaagctagagagaaaagagagtgcgctttggaaatttattccagttttcagcctacagcagattatcagctcggtgacttttctttctgccaccatttaggtgatggtgtttgattcagagatggctgaatttctattcttagcttattgtgactgtttcagatctagtttgggaacagattagaggccattgtcttctgtcctgatcaggtggcctggctgtttctttggatccctctgtcccagagccacccagaaccctgactcttgagaatcaagaaaacacccagaaaggccttaatgacctcataggcactcttccaaaaagacaacagaactggaatgagaggcctgggtctgtctcctgccttagcaggcctatcaatttcttgtcaatctctttttttccttgctcacattaaaaggaagcatggagttctaatgctcccataaactatgtattttggcaagacacttcactactccaggtctcactttccccatctgtaaaacagggtttggactaggtgttccctggtattctgtgatctgcctcttgctgccattctttctctcctctgcttctctgtatttttcttctgttatccctgggggtgctcaggttcacttgattgtctgtatttctgtgtggttgtagcaaggactcagcctcatgtagcacgaataggggtgtggttcatggcgtgttgacccagcagagcactccctcccactaacttgttctgcatgtgtagagtctccccattttttttaacgcaaccctttcccctttttcctaccccacagctctgttccatgtaagttgccaacagtttcactgaacagtggggtatgtgatggttttggcatgacatcttcagtatgagggggacagtttgacttcactttgagggtgtgatgtctgtagctatgtggaaggtaaaaatagtggtgtgatcatgaaccaaaggaatttatgttttgtaacttgggtactttattttgcattttgttatactattaaataattttttcctgtt

SEQ ID NO: 17832 - DNA, 2419 bp, Homo sapiens
cgctgggggcggggcgacgccggactccggagcgcccgcttacgcagttcctcccggggtcggaggccgattcgccgtgtggcgggttcgagtcccgcctcctgactctggcctctagtccctgagtcccgggcgggctgcattcgtcggggaaacctctcctcgaccaggggcacctctactcgaccaggggcgacggcgtactttgggcttcatcatggaggactacctgcagggttgtcgagctgctctgcaggaaccatcatcctggactgtgtcaacatggaccttaaaattggaaaggcaaccccaaaggacagcaaatatgtggagaaactagaggcccttttcccagacctacccaagagaaatgatatatttgattccctacaaaaggcaaagtttgatgtatcagggactgaccactgagcagatgctgagaaaagaccagaagactatctatagacaaggcgtcaaggtggccattagtgcaatatatatggatttggagatctgtgaagtcctggaacgctcccactctccacccctgaagctgacccctgcctcaagtacccaccctaacctccatgcctatcttcaaggcaacacccaggtctctcgaaagaaacttctgcccctgctccaggaagccctgtcagcatattttgactccatgaagatcccttcaggacagcctgagacagcagatgtgtccagggagcaagtggacaaggaattggacagggcaagtaactccctgatttctggactgagtcaagatgaggaggaccctccgctgcccccgacgcccatgaacagcttggtggatgagtgccctctagatcaggggctgcctaaactctctgctgaggccgtcttcgagaagtgcagtcagatctcactgtcacagtctaccacagcctccctgtccaagaagtgactgttgagaggcgaggaggtagtgggtgaggctacctgactcacttcaaatgcatgttttgagatgtttggagattcagcaattctgtcttcattgctccaggatctggtatactgttctcataaaactgagaggagaaaaaaagtgaaagaaagcagctgctttaagaatggttttccaccttttccccctaatctctaccaatcagacacattttattatttaaatctgcacctctctctattttatttgccaggggcacgatgtgacatatctgcagtcccagcacagtgggacaaaaagaatttagaccccaaaagtgtcctcggcatggatcttgaacagaaccagtatctgtcatggaactgaacattcatcgatggtctccatgtattcatttattcacttgttcattcaagtatttattgaatacctgcctcaagctagagagaaaagagagtgcgctttggaaatttattccagttttcagcctacagcagattatcagctcggtgacttttctttctgccaccatttaggtgatggtgtttgattcagagatggctgaatttctattcttagcttattgtgactgtttcagatctagtttgggaacagattagaggccattgtcttctgtcctgatcaggtggcctggctgtttctttggatccctctgtcccagagccacccagaaccctgactcttgagaatcaagaaaacacccagaaaggccttaatgacctcataggcactcttccaaaaagacaacagaactggaatgagaggcctgggtctgtctcctgccttagcaggcctatcaatttcttgtcaatctctttttttccttgctcacattaaaaggaagcatggagttctaatgctcccataaactatgtattttggcaagacacttcactactccaggtctcactttccccatctgtaaaacagggtttggactaggtgttccctggtattctgtgatctgcctcttgctgccattctttctctcctctgcttctctgtatttttcttctgttatccctgggggtgctcaggttcacttgattgtctgtatttctgtgtggttgtagcaaggactcagcctcatgtagcacgaataggggtgtggttcatggcgtgttgacccagcagagcactccctcccactaacttgttctgcatgtgtagagtctccccattttttttaacgcaaccctttcccctttttcctaccccacagctctgttccatgtaagttgccaacagtttcactgaacagtggggtatgtgatggttttggcatgacatcttcagtatgagggggacagtttgacttcactttgagggtgtgatgtctgtagctatgtggaaggtaaaaatagtggtgtgatcatgaaccaaaggaatttatgttttgtaacttgggtactttattttgcattttgttatactattaaataattttttcctgtt

SEQ ID NO: 17833 - DNA, 3151 bp, Homo sapiens
cgctgggggcggggcgacgccggactccggagcgcccgcttacgcagttcctcccggggtcggaggccgattcgccgtgtggcgggttcgagtcccgcctcctgactctggcctctagtccctgagtcccgggcgggctgcattcgtcggggaaacctctcctcgaccaggggcacctctactcgaccaggggcgacggcgtactttgggcttcatcatggaggactacctgcagggttgtcgagctgctctgcaggagtcccgacctctacatgttgtgctgggaaatgaagcctgtgatttggactccacagtgtctgctcttgccctggctttttacctagcaaagacaactgaggctgaggaagtctttgtgccagttttaaatataaaacgttctgaactacctctgcgaggtgacattgtcttctttcttcagaaggttcatattccagagagtatcttgatttttcgggatgagattgacctccatgcattataccaggctggccaactcaccctcatccttgtcgaccatcatatcttatccaaaagtgacacagccctagaggaggcagtagcagaggtgctagaccatcgacccatcgagccgaaacactgccctccctgccatgtttcagttgagctggtggggtcctgtgctaccctggtgaccgagagaatcctgcagggggcaccagagatcttggacaggcaaactgcagcccttctgcatggaaccatcatcctggactgtgtcaacatggaccttaaaattggaaaggcaaccccaaaggacagcaaatatgtggagaaactagaggcccttttcccagacctacccaagagaaatgatatatttgattccctacaaaaggcaaagtttgatgtatcaggactgaccactgagcagatgctgagaaaagaccagaagactatctatagacaaggcgtcaaggtggccattagtgcaatatatatggatttggaggcctttctgcagaggtctaacctccttgcagatctccatgctttctgccaggctcacagctatgatgtcctggttgccatgactatctttttcaacactcacaatgagccagtgcggcagttggctattttctgtccccatgtggcactccaaacaacgggacagagtctcgctatgttgcccaggctggtctcgaactcctggactcaagtgatccaccagcctcagcttcccagagttctggaattgcagatctgtgaagtcctggaacgctcccactctccacccctgaagctgacccctgcctcaagtacccaccctaacctccatgcctatcttcaaggcaacacccaggtctctcgaaagaaacttctgcccctgctccaggaagccctgtcagcatattttgactccatgaagatcccttcaggacagcctgagacagcagatgtgtccagggagcaagtggacaaggaattggacagggcaagtaactccctgatttctggactgagtcaagatgaggaggaccctccgctgcccccgacgcccatgaacagcttggtggatgagtgccctctagatcaggggctgcctaaactctctgctgaggccgtcttcgagaagtgcagtcagatctcactgtcacagtctaccacagcctccctgtccaagaagtgactgttgagaggcgaggaggtagtgggtgaggctacctgactcacttcaaatgcatgttttgagatgtttggagattcagcaattctgtcttcattgctccaggatctggtatactgttctcataaaactgagaggagaaaaaaagtgaaagaaagcagctgctttaagaatggttttccaccttttccccctaatctctaccaatcagacacattttattatttaaatctgcacctctctctattttatttgccaggggcacgatgtgacatatctgcagtcccagcacagtgggacaaaaagaatttagaccccaaaagtgtcctcggcatggatcttgaacagaaccagtatctgtcatggaactgaacattcatcgatggtctccatgtattcatttattcacttgttcattcaagtatttattgaatacctgcctcaagctagagagaaaagagagtgcgctttggaaatttattccagttttcagcctacagcagattatcagctcggtgacttttctttctgccaccatttaggtgatggtgtttgattcagagatggctgaatttctattcttagcttattgtgactgtttcagatctagtttgggaacagattagaggccattgtcttctgtcctgatcaggtggcctggctgtttctttggatccctctgtcccagagccacccagaaccctgactcttgagaatcaagaaaacacccagaaaggccttaatgacctcataggcactcttccaaaaagacaacagaactggaatgagaggcctgggtctgtctcctgccttagcaggcctatcaatttcttgtcaatctctttttttccttgctcacattaaaaggaagcatggagttctaatgctcccataaactatgtattttggcaagacacttcactactccaggtctcactttccccatctgtaaaacagggtttggactaggtgttccctggtattctgtgatctgcctcttgctgccattctttctctcctctgcttctctgtatttttcttctgttatccctgggggtgctcaggttcacttgattgtctgtatttctgtgtggttgtagcaaggactcagcctcatgtagcacgaataggggtgtggttcatggcgtgttgacccagcagagcactccctcccactaacttgttctgcatgtgtagagtctccccattttttttaacgcaaccctttcccctttttcctaccccacagctctgttccatgtaagttgccaacagtttcactgaacagtggggtatgtgatggttttggcatgacatcttcagtatgagggggacagtttgacttcactttgagggtgtgatgtctgtagctatgtggaaggtaaaaatagtggtgtgatcatgaaccaaaggaatttatgttttgtaacttgggtactttattttgcattttgttatactattaaataattttttcctgtt

SEQ ID NO: 17834 - DNA, 2968 bp, Homo sapiens
cgctgggggcggggcgacgccggactccggagcgcccgcttacgcagttcctcccggggtcggaggccgattcgccgtgtggcgggttcgagtcccgcctcctgactctggcctctagtccctgagtcccgggcgggctgcattcgtcggggaaacctctcctcgaccaggggcacctctactcgaccaggggcgacggcgtactttgggcttcatcatggaggactacctgcagggttgtcgagctgctctgcaggagtcccgacctctacatgttgtgctgggaaatgaagcctgtgatttggactccacagtgtctgctcttgccctggctttttacctagcaaagaaggttcatattccagagagtatcttgatttttcgggatgagattgacctccatgcattataccaggctggccaactcaccctcatccttgtcgaccatcatatcttatccaaaagtgacacagccctagaggaggcagtagcagaggtgctagaccatcgacccatcgagccgaaacactgccctccctgccatgtttcagttgagctggtggggtcctgtgctaccctggtgaccgagagaatcctgcagggggcaccagagatcttggacaggcaaactgcagcccttctgcatggaaccatcatcctggactgtgtcaacatggaccttaaaattggaaaggcaaccccaaaggacagcaaatatgtggagaaactagaggcccttttcccagacctacccaagagaaatgatatatttgattccctacaaaaggcaaagtttgatgtatcaggactgaccactgagcagatgctgagaaaagaccagaagactatctatagacaaggcgtcaaggtggccattagtgcaatatatatggatttggaggcctttctgcagaggtctaacctccttgcagatctccatgctttctgccaggctcacagctatgatgtcctggttgccatgactatctttttcaacactcacaatgagccagtgcggcagttggctattttctgtccccatgtggcactccaaacaacgatctgtgaagtcctggaacgctcccactctccacccctgaagctgacccctgcctcaagtacccaccctaacctccatgcctatcttcaaggcaacacccaggtctctcgaaagaaacttctgcccctgctccaggaagccctgtcagcatattttgactccatgaagatcccttcaggacagcctgagacagcagatgtgtccagggagcaagtggacaaggaattggacagggcaagtaactccctgatttctggactgagtcaagatgaggaggaccctccgctgcccccgacgcccatgaacagcttggtggatgagtgccctctagatcaggggctgcctaaactctctgctgaggccgtcttcgagaagtgcagtcagatctcactgtcacagtctaccacagcctccctgtccaagaagtgactgttgagaggcgaggaggtagtgggtgaggctacctgactcacttcaaatgcatgttttgagatgtttggagattcagcaattctgtcttcattgctccaggatctggtatactgttctcataaaactgagaggagaaaaaaagtgaaagaaagcagctgctttaagaatggttttccaccttttccccctaatctctaccaatcagacacattttattatttaaatctgcacctctctctattttatttgccaggggcacgatgtgacatatctgcagtcccagcacagtgggacaaaaagaatttagaccccaaaagtgtcctcggcatggatcttgaacagaaccagtatctgtcatggaactgaacattcatcgatggtctccatgtattcatttattcacttgttcattcaagtatttattgaatacctgcctcaagctagagagaaaagagagtgcgctttggaaatttattccagttttcagcctacagcagattatcagctcggtgacttttctttctgccaccatttaggtgatggtgtttgattcagagatggctgaatttctattcttagcttattgtgactgtttcagatctagtttgggaacagattagaggccattgtcttctgtcctgatcaggtggcctggctgtttctttggatccctctgtcccagagccacccagaaccctgactcttgagaatcaagaaaacacccagaaaggccttaatgacctcataggcactcttccaaaaagacaacagaactggaatgagaggcctgggtctgtctcctgccttagcaggcctatcaatttcttgtcaatctctttttttccttgctcacattaaaaggaagcatggagttctaatgctcccataaactatgtattttggcaagacacttcactactccaggtctcactttccccatctgtaaaacagggtttggactaggtgttccctggtattctgtgatctgcctcttgctgccattctttctctcctctgcttctctgtatttttcttctgttatccctgggggtgctcaggttcacttgattgtctgtatttctgtgtggttgtagcaaggactcagcctcatgtagcacgaataggggtgtggttcatggcgtgttgacccagcagagcactccctcccactaacttgttctgcatgtgtagagtctccccattttttttaacgcaaccctttcccctttttcctaccccacagctctgttccatgtaagttgccaacagtttcactgaacagtggggtatgtgatggttttggcatgacatcttcagtatgagggggacagtttgacttcactttgagggtgtgatgtctgtagctatgtggaaggtaaaaatagtggtgtgatcatgaaccaaaggaatttatgttttgtaacttgggtactttattttgcattttgttatactattaaataattttttcctgtt

SEQ ID NO: 17835 - DNA, 2462 bp, Homo sapiens
cacacgaagtatgtaccaggccggtcaccgtttttatttccatgaccgggacggggcttagttgtagattcctggccccgggccgtacatgttattcgtcggggaaacctctcctcgaccaggggcacctctactcgaccaggggcgacggcgtactttgggcttcatcatggaggactacctgcagggttgtcgagctgctctgcaggagtcccgacctctacatgttgtgctgggaaatgaagcctgtgatttggactccacagtgtctgctcttgccctggctttttacctagcaaagactgaccactgagcagatgctgagaaaagaccagaagactatctatagacaaggcgtcaaggtggccattagtgcaatatatatggatttggaggcctttctgcagaggtctaacctccttgcagatctccatgctttctgccaggctcacagctatgatgtcctggttgccatgactatctttttcaacactcacaatgagccagtgcggcagttggctattttctgtccccatgtggcactccaaacaacgatctgtgaagtcctggaacgctcccactctccacccctgaagctgacccctgcctcaagtacccaccctaacctccatgcctatcttcaaggcaacacccaggtctctcgaaagaaacttctgcccctgctccaggaagccctgtcagcatattttgactccatgaagatcccttcaggacagcctgagacagcagatgtgtccagggagcaagtggacaaggaattggacagggcaagtaactccctgatttctggactgagtcaagatgaggaggaccctccgctgcccccgacgcccatgaacagcttggtggatgagtgccctctagatcaggggctgcctaaactctctgctgaggccgtcttcgagaagtgcagtcagatctcactgtcacagtctaccacagcctccctgtccaagaagtgactgttgagaggcgaggaggtagtgggtgaggctacctgactcacttcaaatgcatgttttgagatgtttggagattcagcaattctgtcttcattgctccaggatctggtatactgttctcataaaactgagaggagaaaaaaagtgaaagaaagcagctgctttaagaatggttttccaccttttccccctaatctctaccaatcagacacattttattatttaaatctgcacctctctctattttatttgccaggggcacgatgtgacatatctgcagtcccagcacagtgggacaaaaagaatttagaccccaaaagtgtcctcggcatggatcttgaacagaaccagtatctgtcatggaactgaacattcatcgatggtctccatgtattcatttattcacttgttcattcaagtatttattgaatacctgcctcaagctagagagaaaagagagtgcgctttggaaatttattccagttttcagcctacagcagattatcagctcggtgacttttctttctgccaccatttaggtgatggtgtttgattcagagatggctgaatttctattcttagcttattgtgactgtttcagatctagtttgggaacagattagaggccattgtcttctgtcctgatcaggtggcctggctgtttctttggatccctctgtcccagagccacccagaaccctgactcttgagaatcaagaaaacacccagaaaggccttaatgacctcataggcactcttccaaaaagacaacagaactggaatgagaggcctgggtctgtctcctgccttagcaggcctatcaatttcttgtcaatctctttttttccttgctcacattaaaaggaagcatggagttctaatgctcccataaactatgtattttggcaagacacttcactactccaggtctcactttccccatctgtaaaacagggtttggactaggtgttccctggtattctgtgatctgcctcttgctgccattctttctctcctctgcttctctgtatttttcttctgttatccctgggggtgctcaggttcacttgattgtctgtatttctgtgtggttgtagcaaggactcagcctcatgtagcacgaataggggtgtggttcatggcgtgttgacccagcagagcactccctcccactaacttgttctgcatgtgtagagtctccccattttttttaacgcaaccctttcccctttttcctaccccacagctctgttccatgtaagttgccaacagtttcactgaacagtggggtatgtgatggttttggcatgacatcttcagtatgagggggacagtttgacttcactttgagggtgtgatgtctgtagctatgtggaaggtaaaaatagtggtgtgatcatgaaccaaaggaatttatgttttgtaacttgggtactttattttgcattttgttatactattaaataattttttcctgtt

SEQ ID NO: 17836 - DNA, 2623 bp, Homo sapiens
cgctgggggcggggcgacgccggactccggagcgcccgcttacgcagttcctcccggggtcggaggccgattcgccgtgtggcgggttcgagtcccgcctcctgactctggcctctagtccctgagtcccgggcgggctgcattcgtcggggaaacctctcctcgaccaggggcacctctactcgaccaggggcgacggcgtactttgggcttcatcatggaggactacctgcagggttgtcgagctgctctgcaggagtcccgacctctacatgttgtgctgggaaatgaagcctgtgatttggactccacagtgtctgctcttgccctggctttttacctagcaaagaaggttcatattccagagagtatcttgatttttcgggatgagattgacctccatgcattataccaggctggccaactcaccctcatccttgtcgaccatcatatcttatccaaactgaccactgagcagatgctgagaaaagaccagaagactatctatagacaaggcgtcaaggtggccattagtgcaatatatatggatttggaggcctttctgcagaggtctaacctccttgcagatctccatgctttctgccaggctcacagctatgatgtcctggttgccatgactatctttttcaacactcacaatgagccagtgcggcagttggctattttctgtccccatgtggcactccaaacaacgatctgtgaagtcctggaacgctcccactctccacccctgaagctgacccctgcctcaagtacccaccctaacctccatgcctatcttcaaggcaacacccaggtctctcgaaagaaacttctgcccctgctccaggaagccctgtcagcatattttgactccatgaagatcccttcaggacagcctgagacagcagatgtgtccagggagcaagtggacaaggaattggacagggcaagtaactccctgatttctggactgagtcaagatgaggaggaccctccgctgcccccgacgcccatgaacagcttggtggatgagtgccctctagatcaggggctgcctaaactctctgctgaggccgtcttcgagaagtgcagtcagatctcactgtcacagtctaccacagcctccctgtccaagaagtgactgttgagaggcgaggaggtagtgggtgaggctacctgactcacttcaaatgcatgttttgagatgtttggagattcagcaattctgtcttcattgctccaggatctggtatactgttctcataaaactgagaggagaaaaaaagtgaaagaaagcagctgctttaagaatggttttccaccttttccccctaatctctaccaatcagacacattttattatttaaatctgcacctctctctattttatttgccaggggcacgatgtgacatatctgcagtcccagcacagtgggacaaaaagaatttagaccccaaaagtgtcctcggcatggatcttgaacagaaccagtatctgtcatggaactgaacattcatcgatggtctccatgtattcatttattcacttgttcattcaagtatttattgaatacctgcctcaagctagagagaaaagagagtgcgctttggaaatttattccagttttcagcctacagcagattatcagctcggtgacttttctttctgccaccatttaggtgatggtgtttgattcagagatggctgaatttctattcttagcttattgtgactgtttcagatctagtttgggaacagattagaggccattgtcttctgtcctgatcaggtggcctggctgtttctttggatccctctgtcccagagccacccagaaccctgactcttgagaatcaagaaaacacccagaaaggccttaatgacctcataggcactcttccaaaaagacaacagaactggaatgagaggcctgggtctgtctcctgccttagcaggcctatcaatttcttgtcaatctctttttttccttgctcacattaaaaggaagcatggagttctaatgctcccataaactatgtattttggcaagacacttcactactccaggtctcactttccccatctgtaaaacagggtttggactaggtgttccctggtattctgtgatctgcctcttgctgccattctttctctcctctgcttctctgtatttttcttctgttatccctgggggtgctcaggttcacttgattgtctgtatttctgtgtggttgtagcaaggactcagcctcatgtagcacgaataggggtgtggttcatggcgtgttgacccagcagagcactccctcccactaacttgttctgcatgtgtagagtctccccattttttttaacgcaaccctttcccctttttcctaccccacagctctgttccatgtaagttgccaacagtttcactgaacagtggggtatgtgatggttttggcatgacatcttcagtatgagggggacagtttgacttcactttgagggtgtgatgtctgtagctatgtggaaggtaaaaatagtggtgtgatcatgaaccaaaggaatttatgttttgtaacttgggtactttattttgcattttgttatactattaaataattttttcctgtt

SEQ ID NO: 17837 - DNA, 2510 bp, Homo sapiens
cgctgggggcggggcgacgccggactccggagcgcccgcttacgcagttcctcccggggtcggaggccgattcgccgtgtggcgggttcgagtcccgcctcctgactctggcctctagtccctgagtcccgggcgggctgcattcgtcggggaaacctctcctcgaccaggggcacctctactcgaccaggggcgacggcgtactttgggcttcatcatggaggactacctgcagggttgtcgagctgctctgcaggagtcccgacctctacatgttgtgctgggaaatgaagcctgtgatttggactccacagtgtctgctcttgccctggctttttacctagcaaagactgaccactgagcagatgctgagaaaagaccagaagactatctatagacaaggcgtcaaggtggccattagtgcaatatatatggatttggaggcctttctgcagaggtctaacctccttgcagatctccatgctttctgccaggctcacagctatgatgtcctggttgccatgactatctttttcaacactcacaatgagccagtgcggcagttggctattttctgtccccatgtggcactccaaacaacgatctgtgaagtcctggaacgctcccactctccacccctgaagctgacccctgcctcaagtacccaccctaacctccatgcctatcttcaaggcaacacccaggtctctcgaaagaaacttctgcccctgctccaggaagccctgtcagcatattttgactccatgaagatcccttcaggacagcctgagacagcagatgtgtccagggagcaagtggacaaggaattggacagggcaagtaactccctgatttctggactgagtcaagatgaggaggaccctccgctgcccccgacgcccatgaacagcttggtggatgagtgccctctagatcaggggctgcctaaactctctgctgaggccgtcttcgagaagtgcagtcagatctcactgtcacagtctaccacagcctccctgtccaagaagtgactgttgagaggcgaggaggtagtgggtgaggctacctgactcacttcaaatgcatgttttgagatgtttggagattcagcaattctgtcttcattgctccaggatctggtatactgttctcataaaactgagaggagaaaaaaagtgaaagaaagcagctgctttaagaatggttttccaccttttccccctaatctctaccaatcagacacattttattatttaaatctgcacctctctctattttatttgccaggggcacgatgtgacatatctgcagtcccagcacagtgggacaaaaagaatttagaccccaaaagtgtcctcggcatggatcttgaacagaaccagtatctgtcatggaactgaacattcatcgatggtctccatgtattcatttattcacttgttcattcaagtatttattgaatacctgcctcaagctagagagaaaagagagtgcgctttggaaatttattccagttttcagcctacagcagattatcagctcggtgacttttctttctgccaccatttaggtgatggtgtttgattcagagatggctgaatttctattcttagcttattgtgactgtttcagatctagtttgggaacagattagaggccattgtcttctgtcctgatcaggtggcctggctgtttctttggatccctctgtcccagagccacccagaaccctgactcttgagaatcaagaaaacacccagaaaggccttaatgacctcataggcactcttccaaaaagacaacagaactggaatgagaggcctgggtctgtctcctgccttagcaggcctatcaatttcttgtcaatctctttttttccttgctcacattaaaaggaagcatggagttctaatgctcccataaactatgtattttggcaagacacttcactactccaggtctcactttccccatctgtaaaacagggtttggactaggtgttccctggtattctgtgatctgcctcttgctgccattctttctctcctctgcttctctgtatttttcttctgttatccctgggggtgctcaggttcacttgattgtctgtatttctgtgtggttgtagcaaggactcagcctcatgtagcacgaataggggtgtggttcatggcgtgttgacccagcagagcactccctcccactaacttgttctgcatgtgtagagtctccccattttttttaacgcaaccctttcccctttttcctaccccacagctctgttccatgtaagttgccaacagtttcactgaacagtggggtatgtgatggttttggcatgacatcttcagtatgagggggacagtttgacttcactttgagggtgtgatgtctgtagctatgtggaaggtaaaaatagtggtgtgatcatgaaccaaaggaatttatgttttgtaacttgggtactttattttgcattttgttatactattaaataattttttcctgtt

SEQ ID NO: 17838 - DNA, 2206 bp, Homo sapiens
ccaagctgaattctactcccaaaggccaaagtttgatgtatcaggactgaccactgagcagatgctgagaaaagaccagaagactatctatagacaaggcgtcaaggtggccattagtgcaatatatatggatttggaggcctttctgcagaggtctaacctccttgcagatctccatgctttctgccaggctcacagctatgatgtcctggttgccatgactatctttttcaacactcacaatgagccagtgcggcagttggctattttctgtccccatgtggcactccaaacaacgatctgtgaagtcctggaacgctcccactctccacccctgaagctgacccctgcctcaagtacccaccctaacctccatgcctatcttcaaggcaacacccaggtctctcgaaagaaacttctgcccctgctccaggaagccctgtcagcatattttgactccatgaagatcccttcaggacagcctgagacagcagatgtgtccagggagcaagtggacaaggaattggacagggcaagtaactccctgatttctggactgagtcaagatgaggaggaccctccgctgcccccgacgcccatgaacagcttggtggatgagtgccctctagatcaggggctgcctaaactctctgctgaggccgtcttcgagaagtgcagtcagatctcactgtcacagtctaccacagcctccctgtccaagaagtgactgttgagaggcgaggaggtagtgggtgaggctacctgactcacttcaaatgcatgttttgagatgtttggagattcagcaattctgtcttcattgctccaggatctggtatactgttctcataaaactgagaggagaaaaaaagtgaaagaaagcagctgctttaagaatggttttccaccttttccccctaatctctaccaatcagacacattttattatttaaatctgcacctctctctattttatttgccaggggcacgatgtgacatatctgcagtcccagcacagtgggacaaaaagaatttagaccccaaaagtgtcctcggcatggatcttgaacagaaccagtatctgtcatggaactgaacattcatcgatggtctccatgtattcatttattcacttgttcattcaagtatttattgaatacctgcctcaagctagagagaaaagagagtgcgctttggaaatttattccagttttcagcctacagcagattatcagctcggtgacttttctttctgccaccatttaggtgatggtgtttgattcagagatggctgaatttctattcttagcttattgtgactgtttcagatctagtttgggaacagattagaggccattgtcttctgtcctgatcaggtggcctggctgtttctttggatccctctgtcccagagccacccagaaccctgactcttgagaatcaagaaaacacccagaaaggccttaatgacctcataggcactcttccaaaaagacaacagaactggaatgagaggcctgggtctgtctcctgccttagcaggcctatcaatttcttgtcaatctctttttttccttgctcacattaaaaggaagcatggagttctaatgctcccataaactatgtattttggcaagacacttcactactccaggtctcactttccccatctgtaaaacagggtttggactaggtgttccctggtattctgtgatctgcctcttgctgccattctttctctcctctgcttctctgtatttttcttctgttatccctgggggtgctcaggttcacttgattgtctgtatttctgtgtggttgtagcaaggactcagcctcatgtagcacgaataggggtgtggttcatggcgtgttgacccagcagagcactccctcccactaacttgttctgcatgtgtagagtctccccattttttttaacgcaaccctttcccctttttcctaccccacagctctgttccatgtaagttgccaacagtttcactgaacagtggggtatgtgatggttttggcatgacatcttcagtatgagggggacagtttgacttcactttgagggtgtgatgtctgtagctatgtggaaggtaaaaatagtggtgtgatcatgaaccaaaggaatttatgttttgtaacttgggtactttattttgcattttgttatactattaaataattttttcctgtt

SEQ ID NO: 17839 - DNA, 2555 bp, Homo sapiens
cgctgggggcggggcgacgccggactccggagcgcccgcttacgcagttcctcccggggtcggaggccgattcgccgtgtggcgggttcgagtcccgcctcctgactctggcctctagtccctgagtcccgggcgggctgcattcgtcggggaaacctctcctcgaccaggggcacctctactcgaccaggggcgacggcgtactttgggcttcatcatggaggactacctgcagggttgtcgagctgctctgcaggagtcccgacctctacatgttgtgctgggaaatgaagcctgtgatttggactccacagtgtctgctcttgccctggctttttacctagcaaagacaactgaggctgaggaagtctttgtgccagttttaaatataaaacgttctgaactacctctgcgaggtgacattgtcttctttcttcagaaggttcatattccagagagtatcttgatttttcgggatgagattgacctccatgcattataccaggctggccaactcaccctcatccttgtcgaccatcatatcttatccaagactgaccactgagcagatgctgagaaaagaccagaagactatctatagacaaggcgtcaaggtggccattagtgcaatatatatggatttggagatctgtgaagtcctggaacgctcccactctccacccctgaagctgacccctgcctcaagtacccaccctaacctccatgcctatcttcaaggcaacacccaggtctctcgaaagaaacttctgcccctgctccaggaagccctgtcagcatattttgactccatgaagatcccttcaggacagcctgagacagcagatgtgtccagggagcaagtggacaaggaattggacagggcaagtaactccctgatttctggactgagtcaagatgaggaggaccctccgctgcccccgacgcccatgaacagcttggtggatgagtgccctctagatcaggggctgcctaaactctctgctgaggccgtcttcgagaagtgcagtcagatctcactgtcacagtctaccacagcctccctgtccaagaagtgactgttgagaggcgaggaggtagtgggtgaggctacctgactcacttcaaatgcatgttttgagatgtttggagattcagcaattctgtcttcattgctccaggatctggtatactgttctcataaaactgagaggagaaaaaaagtgaaagaaagcagctgctttaagaatggttttccaccttttccccctaatctctaccaatcagacacattttattatttaaatctgcacctctctctattttatttgccaggggcacgatgtgacatatctgcagtcccagcacagtgggacaaaaagaatttagaccccaaaagtgtcctcggcatggatcttgaacagaaccagtatctgtcatggaactgaacattcatcgatggtctccatgtattcatttattcacttgttcattcaagtatttattgaatacctgcctcaagctagagagaaaagagagtgcgctttggaaatttattccagttttcagcctacagcagattatcagctcggtgacttttctttctgccaccatttaggtgatggtgtttgattcagagatggctgaatttctattcttagcttattgtgactgtttcagatctagtttgggaacagattagaggccattgtcttctgtcctgatcaggtggcctggctgtttctttggatccctctgtcccagagccacccagaaccctgactcttgagaatcaagaaaacacccagaaaggccttaatgacctcataggcactcttccaaaaagacaacagaactggaatgagaggcctgggtctgtctcctgccttagcaggcctatcaatttcttgtcaatctctttttttccttgctcacattaaaaggaagcatggagttctaatgctcccataaactatgtattttggcaagacacttcactactccaggtctcactttccccatctgtaaaacagggtttggactaggtgttccctggtattctgtgatctgcctcttgctgccattctttctctcctctgcttctctgtatttttcttctgttatccctgggggtgctcaggttcacttgattgtctgtatttctgtgtggttgtagcaaggactcagcctcatgtagcacgaataggggtgtggttcatggcgtgttgacccagcagagcactccctcccactaacttgttctgcatgtgtagagtctccccattttttttaacgcaaccctttcccctttttcctaccccacagctctgttccatgtaagttgccaacagtttcactgaacagtggggtatgtgatggttttggcatgacatcttcagtatgagggggacagtttgacttcactttgagggtgtgatgtctgtagctatgtggaaggtaaaaatagtggtgtgatcatgaaccaaaggaatttatgttttgtaacttgggtactttattttgcattttgttatactattaaataattttttcctgtt

SEQ ID NO: 17840 - DNA, 2903 bp, Homo sapiens
cgctgggggcggggcgacgccggactccggagcgcccgcttacgcagttcctcccggggtcggaggccgattcgccgtgtggcgggttcgagtcccgcctcctgactctggcctctagtccctgagtcccgggcgggctgcattcgtcggggaaacctctcctcgaccaggggcacctctactcgaccaggggcgacggcgtactttgggcttcatcatggaggactacctgcagggttgtcgagctgctctgcaggagtcccgacctctacatgttgtgctgggaaatgaagcctgtgatttggactccacagtgtctgctcttgccctggctttttacctagcaaagacaactgaggctgaggaagtctttgtgccagttttaaatataaaacgttctgaactacctctgcgaggtgacattgtcttctttcttcagaaggttcatattccagagagtatcttgatttttcgggatgagattgacctccatgcattataccaggctggccaactcaccctcatccttgtcgaccatcatatcttatccaaaagtgacacagccctagaggaggcagtagcagaggtgctagaccatcgacccatcgagccgaaacactgccctccctgccatgtttcagttgagctggtggggtcctgtgctaccctggtgaccgagagaatcctgcagggggcaccagagatcttggacaggcaaactgcagcccttctgcatggaaccatcatcctggactgtgtcaacatggaccttaaaattggaaaggcaaccccaaaggacagcaaatatgtggagaaactagaggcccttttcccagacctacccaagagaaatgatatatttgattccctacaaaaggcaaagtttgatgtatcaggactgaccactgagcagatgctgagaaaagaccagaagactatctatagacaaggcgtcaaggtggccattagtgcaatatatatggatttggaggcctttctgcagaggtctaacctccttgcagatctccatgctttctgccaggctcacagctatgatgtcctggttgccatgactatctttttcaacactcacaatgagccagtgcggcagttggctattttctgtccccatgtggcactccaaacaacgtgactccatgaagatcccttcaggacagcctgagacagcagatgtgtccagggagcaagtggacaaggaattggacagggcaagtaactccctgatttctggactgagtcaagatgaggaggaccctccgctgcccccgacgcccatgaacagcttggtggatgagtgccctctagatcaggggctgcctaaactctctgctgaggccgtcttcgagaagtgcagtcagatctcactgtcacagtctaccacagcctccctgtccaagaagtgactgttgagaggcgaggaggtagtgggtgaggctacctgactcacttcaaatgcatgttttgagatgtttggagattcagcaattctgtcttcattgctccaggatctggtatactgttctcataaaactgagaggagaaaaaaagtgaaagaaagcagctgctttaagaatggttttccaccttttccccctaatctctaccaatcagacacattttattatttaaatctgcacctctctctattttatttgccaggggcacgatgtgacatatctgcagtcccagcacagtgggacaaaaagaatttagaccccaaaagtgtcctcggcatggatcttgaacagaaccagtatctgtcatggaactgaacattcatcgatggtctccatgtattcatttattcacttgttcattcaagtatttattgaatacctgcctcaagctagagagaaaagagagtgcgctttggaaatttattccagttttcagcctacagcagattatcagctcggtgacttttctttctgccaccatttaggtgatggtgtttgattcagagatggctgaatttctattcttagcttattgtgactgtttcagatctagtttgggaacagattagaggccattgtcttctgtcctgatcaggtggcctggctgtttctttggatccctctgtcccagagccacccagaaccctgactcttgagaatcaagaaaacacccagaaaggccttaatgacctcataggcactcttccaaaaagacaacagaactggaatgagaggcctgggtctgtctcctgccttagcaggcctatcaatttcttgtcaatctctttttttccttgctcacattaaaaggaagcatggagttctaatgctcccataaactatgtattttggcaagacacttcactactccaggtctcactttccccatctgtaaaacagggtttggactaggtgttccctggtattctgtgatctgcctcttgctgccattctttctctcctctgcttctctgtatttttcttctgttatccctgggggtgctcaggttcacttgattgtctgtatttctgtgtggttgtagcaaggactcagcctcatgtagcacgaataggggtgtggttcatggcgtgttgacccagcagagcactccctcccactaacttgttctgcatgtgtagagtctccccattttttttaacgcaaccctttcccctttttcctaccccacagctctgttccatgtaagttgccaacagtttcactgaacagtggggtatgtgatggttttggcatgacatcttcagtatgagggggacagtttgacttcactttgagggtgtgatgtctgtagctatgtggaaggtaaaaatagtggtgtgatcatgaaccaaaggaatttatgttttgtaacttgggtactttattttgcattttgttatactattaaataattttttcctgtt

SEQ ID NO: 17841 - DNA, 2512 bp, Homo sapiens
cgctgggggcggggcgacgccggactccggagcgcccgcttacgcagttcctcccggggtcggaggccgattcgccgtgtggcgggttcgagtcccgcctcctgactctggcctctagtccctgagtcccgggcgggctgcattcgtcggggaaacctctcctcgaccaggggcacctctactcgaccaggggcgacggcgtactttgggcttcatcatggaggactacctgcagggttgtcgagctgctctgcaggagtcccgacctctacatgttgtgctgggaaatgaagcctgtgatttggactccacagtgtctgctcttgccctggctttttacctagcaaaggaaccatcatcctggactgtgtcaacatggaccttaaaattggaaaggcaaccccaaaggacagcaaatatgtggagaaactagaggcccttttcccagacctacccaagagaaatgatatatttgattccctacaaaaggcaaagtttgatgtatcagggactgaccactgagcagatgctgagaaaagaccagaagactatctatagacaaggcgtcaaggtggccattagtgcaatatatatggatttggagatctgtgaagtcctggaacgctcccactctccacccctgaagctgacccctgcctcaagtacccaccctaacctccatgcctatcttcaaggcaacacccaggtctctcgaaagaaacttctgcccctgctccaggaagccctgtcagcatattttgactccatgaagatcccttcaggacagcctgagacagcagatgtgtccagggagcaagtggacaaggaattggacagggcaagtaactccctgatttctggactgagtcaagatgaggaggaccctccgctgcccccgacgcccatgaacagcttggtggatgagtgccctctagatcaggggctgcctaaactctctgctgaggccgtcttcgagaagtgcagtcagatctcactgtcacagtctaccacagcctccctgtccaagaagtgactgttgagaggcgaggaggtagtgggtgaggctacctgactcacttcaaatgcatgttttgagatgtttggagattcagcaattctgtcttcattgctccaggatctggtatactgttctcataaaactgagaggagaaaaaaagtgaaagaaagcagctgctttaagaatggttttccaccttttccccctaatctctaccaatcagacacattttattatttaaatctgcacctctctctattttatttgccaggggcacgatgtgacatatctgcagtcccagcacagtgggacaaaaagaatttagaccccaaaagtgtcctcggcatggatcttgaacagaaccagtatctgtcatggaactgaacattcatcgatggtctccatgtattcatttattcacttgttcattcaagtatttattgaatacctgcctcaagctagagagaaaagagagtgcgctttggaaatttattccagttttcagcctacagcagattatcagctcggtgacttttctttctgccaccatttaggtgatggtgtttgattcagagatggctgaatttctattcttagcttattgtgactgtttcagatctagtttgggaacagattagaggccattgtcttctgtcctgatcaggtggcctggctgtttctttggatccctctgtcccagagccacccagaaccctgactcttgagaatcaagaaaacacccagaaaggccttaatgacctcataggcactcttccaaaaagacaacagaactggaatgagaggcctgggtctgtctcctgccttagcaggcctatcaatttcttgtcaatctctttttttccttgctcacattaaaaggaagcatggagttctaatgctcccataaactatgtattttggcaagacacttcactactccaggtctcactttccccatctgtaaaacagggtttggactaggtgttccctggtattctgtgatctgcctcttgctgccattctttctctcctctgcttctctgtatttttcttctgttatccctgggggtgctcaggttcacttgattgtctgtatttctgtgtggttgtagcaaggactcagcctcatgtagcacgaataggggtgtggttcatggcgtgttgacccagcagagcactccctcccactaacttgttctgcatgtgtagagtctccccattttttttaacgcaaccctttcccctttttcctaccccacagctctgttccatgtaagttgccaacagtttcactgaacagtggggtatgtgatggttttggcatgacatcttcagtatgagggggacagtttgacttcactttgagggtgtgatgtctgtagctatgtggaaggtaaaaatagtggtgtgatcatgaaccaaaggaatttatgttttgtaacttgggtactttattttgcattttgttatactattaaataattttttcctgtt

SEQ ID NO: 17842 - DNA, 2352 bp, Homo sapiens
cgctgggggcggggcgacgccggactccggagcgcccgcttacgcagttcctcccggggtcggaggccgattcgccgtgtggcgggttcgagtcccgcctcctgactctggcctctagtccctgagtcccgggcgggctgcattcgtcggggaaacctctcctcgaccaggggcacctctactcgaccaggggcgacggcgtactttgggcttcatcatggaggactacctgcagggttgtcgagctgctctgcaggagtcccgacctctacatgttgtgctgggaaatgaagcctgtgatttggactccacagtgtctgctcttgccctggctttttacctagcaaaggactgaccactgagcagatgctgagaaaagaccagaagactatctatagacaaggcgtcaaggtggccattagtgcaatatatatggatttggagatctgtgaagtcctggaacgctcccactctccacccctgaagctgacccctgcctcaagtacccaccctaacctccatgcctatcttcaaggcaacacccaggtctctcgaaagaaacttctgcccctgctccaggaagccctgtcagcatattttgactccatgaagatcccttcaggacagcctgagacagcagatgtgtccagggagcaagtggacaaggaattggacagggcaagtaactccctgatttctggactgagtcaagatgaggaggaccctccgctgcccccgacgcccatgaacagcttggtggatgagtgccctctagatcaggggctgcctaaactctctgctgaggccgtcttcgagaagtgcagtcagatctcactgtcacagtctaccacagcctccctgtccaagaagtgactgttgagaggcgaggaggtagtgggtgaggctacctgactcacttcaaatgcatgttttgagatgtttggagattcagcaattctgtcttcattgctccaggatctggtatactgttctcataaaactgagaggagaaaaaaagtgaaagaaagcagctgctttaagaatggttttccaccttttccccctaatctctaccaatcagacacattttattatttaaatctgcacctctctctattttatttgccaggggcacgatgtgacatatctgcagtcccagcacagtgggacaaaaagaatttagaccccaaaagtgtcctcggcatggatcttgaacagaaccagtatctgtcatggaactgaacattcatcgatggtctccatgtattcatttattcacttgttcattcaagtatttattgaatacctgcctcaagctagagagaaaagagagtgcgctttggaaatttattccagttttcagcctacagcagattatcagctcggtgacttttctttctgccaccatttaggtgatggtgtttgattcagagatggctgaatttctattcttagcttattgtgactgtttcagatctagtttgggaacagattagaggccattgtcttctgtcctgatcaggtggcctggctgtttctttggatccctctgtcccagagccacccagaaccctgactcttgagaatcaagaaaacacccagaaaggccttaatgacctcataggcactcttccaaaaagacaacagaactggaatgagaggcctgggtctgtctcctgccttagcaggcctatcaatttcttgtcaatctctttttttccttgctcacattaaaaggaagcatggagttctaatgctcccataaactatgtattttggcaagacacttcactactccaggtctcactttccccatctgtaaaacagggtttggactaggtgttccctggtattctgtgatctgcctcttgctgccattctttctctcctctgcttctctgtatttttcttctgttatccctgggggtgctcaggttcacttgattgtctgtatttctgtgtggttgtagcaaggactcagcctcatgtagcacgaataggggtgtggttcatggcgtgttgacccagcagagcactccctcccactaacttgttctgcatgtgtagagtctccccattttttttaacgcaaccctttcccctttttcctaccccacagctctgttccatgtaagttgccaacagtttcactgaacagtggggtatgtgatggttttggcatgacatcttcagtatgagggggacagtttgacttcactttgagggtgtgatgtctgtagctatgtggaaggtaaaaatagtggtgtgatcatgaaccaaaggaatttatgttttgtaacttgggtactttattttgcattttgttatactattaaataattttttcctgtt

SEQ ID NO: 17843 - DNA, 2295 bp, Homo sapiens
  misc_feature (228)..(230): n is a, c, g, or t
tatctcccccattcattgccccaaagagaggctgtttttccttccttgacccatctggctgtccttgccttcttggtcttgggaccctggcctaccctgtttgacccctagtctctcatctgctttctaggactgaccactgagcagatgctgagaaaagaccagaagactatctatagacaaggcgtcaaggtggccattagtgcaatatatatggatttggaggcnnnctttctgcagaggtctaacctccttgcagatctccatgctttctgccaggctcacagctatgatgtcctggttgccatgactatctttttcaacactcacaatgagccagtgcggcagttggctattttctgtccccatgtggcactccaaacaacgatctgtgaagtcctggaacgctcccactctccacccctgaagctgacccctgcctcaagtacccaccctaacctccatgcctatcttcaaggcaacacccaggtctctcgaaagaaacttctgcccctgctccaggaagccctgtcagcatattttgactccatgaagatcccttcaggacagcctgagacagcagatgtgtccagggagcaagtggacaaggaattggacagggcaagtaactccctgatttctggactgagtcaagatgaggaggaccctccgctgcccccgacgcccatgaacagcttggtggatgagtgccctctagatcaggggctgcctaaactctctgctgaggccgtcttcgagaagtgcagtcagatctcactgtcacagtctaccacagcctccctgtccaagaagtgactgttgagaggcgaggaggtagtgggtgaggctacctgactcacttcaaatgcatgttttgagatgtttggagattcagcaattctgtcttcattgctccaggatctggtatactgttctcataaaactgagaggagaaaaaaagtgaaagaaagcagctgctttaagaatggttttccaccttttccccctaatctctaccaatcagacacattttattatttaaatctgcacctctctctattttatttgccaggggcacgatgtgacatatctgcagtcccagcacagtgggacaaaaagaatttagaccccaaaagtgtcctcggcatggatcttgaacagaaccagtatctgtcatggaactgaacattcatcgatggtctccatgtattcatttattcacttgttcattcaagtatttattgaatacctgcctcaagctagagagaaaagagagtgcgctttggaaatttattccagttttcagcctacagcagattatcagctcggtgacttttctttctgccaccatttaggtgatggtgtttgattcagagatggctgaatttctattcttagcttattgtgactgtttcagatctagtttgggaacagattagaggccattgtcttctgtcctgatcaggtggcctggctgtttctttggatccctctgtcccagagccacccagaaccctgactcttgagaatcaagaaaacacccagaaaggccttaatgacctcataggcactcttccaaaaagacaacagaactggaatgagaggcctgggtctgtctcctgccttagcaggcctatcaatttcttgtcaatctctttttttccttgctcacattaaaaggaagcatggagttctaatgctcccataaactatgtattttggcaagacacttcactactccaggtctcactttccccatctgtaaaacagggtttggactaggtgttccctggtattctgtgatctgcctcttgctgccattctttctctcctctgcttctctgtatttttcttctgttatccctgggggtgctcaggttcacttgattgtctgtatttctgtgtggttgtagcaaggactcagcctcatgtagcacgaataggggtgtggttcatggcgtgttgacccagcagagcactccctcccactaacttgttctgcatgtgtagagtctccccattttttttaacgcaaccctttcccctttttcctaccccacagctctgttccatgtaagttgccaacagtttcactgaacagtggggtatgtgatggttttggcatgacatcttcagtatgagggggacagtttgacttcactttgagggtgtgatgtctgtagctatgtggaaggtaaaaatagtggtgtgatcatgaaccaaaggaatttatgttttgtaacttgggtactttattttgcattttgttatactattaaataattttttcctgtt

SEQ ID NO: 17844 - DNA, 3004 bp, Homo sapiens
cgctgggggcggggcgacgccggactccggagcgcccgcttacgcagttcctcccggggtcggaggccgattcgccgtgtggcgggttcgagtcccgcctcctgactctggcctctagtccctgagtcccgggcgggctgcattcgtcggggaaacctctcctcgaccaggggcacctctactcgaccaggggcgacggcgtactttgggcttcatcatggaggactacctgcagggttgtcgagctgctctgcaggagtcccgacctctacatgttgtgctgggaaatgaagcctgtgatttggactccacagtgtctgctcttgccctggctttttacctagcaaagacaactgaggctgaggaagtctttgtgccagttttaaatataaaacgttctgaactacctctgcgaggtgacattgtcttctttcttcagaaggttcatattccagagagtatcttgatttttcgggatgagattgacctccatgcattataccaggctggccaactcaccctcatccttgtcgaccatcatatcttatccaaaagtgacacagccctagaggaggcagtagcagaggtgctagaccatcgacccatcgagccgaaacactgccctccctgccatgtttcagttgagctggtggggtcctgtgctaccctggtgaccgagagaatcctgcagggggcaccagagatcttggacaggcaaactgcagcccttctgcatggaaccatcatcctggactgtgtcaacatggaccttaaaattggaaaggcaaccccaaaggacagcaaatatgtggagaaactagaggcccttttcccagacctacccaagagaaatgatatatttgattccctacaaaaggcaaagtttgatgtatcaggactgaccactgagcagatgctgagaaaagaccagaagactatctatagacaaggcgtcaaggtggccattagtgcaatatatatggatttggaggcctttctgcagaggtctaacctccttgcagatctccatgctttctgccaggctcacagctatgatgtcctggttgccatgactatctttttcaacactcacaatgagccagtgcggcagttggctattttctgtccccatgtggcactccaaacaacgatctgtgaagtcctggaacgctcccactctccacccctgaagctgacccctgcctcaagtacccaccctaacctccatgcctatcttcaaggcaacacccaggtctctcgaaagaaacttctgcccctgctccaggaagccctgtcagcatattttgactccatgaagatcccttcaggacagcctgagacagcagatgtgtccagggagcaagtggacaaggaattggacagggcaagtaactccctgatttctggactgagtcaagatgaggaggaccctccgctgcccccgacgcccatgaacagcttggtggatgagtgccctctagatcaggggctgcctaaactctctgctgaggccgtcttcgagaagtgcagtcagatctcactgtcacagtctaccacagcctccctgtccaagaagtgactgttgagaggcgaggaggtagtgggtgaggctacctgactcacttcaaatgcatgttttgagatgtttggagattcagcaattctgtcttcattgctccaggatctggtatactgttctcataaaactgagaggagaaaaaaagtgaaagaaagcagctgctttaagaatggttttccaccttttccccctaatctctaccaatcagacacattttattatttaaatctgcacctctctctattttatttgccaggggcacgatgtgacatatctgcagtcccagcacagtgggacaaaaagaatttagaccccaaaagtgtcctcggcatggatcttgaacagaaccagtatctgtcatggaactgaacattcatcgatggtctccatgtattcatttattcacttgttcattcaagtatttattgaatacctgcctcaagctagagagcagctcggtgacttttctttctgccaccatttaggtgatggtgtttgattcagagatggctgaatttctattcttagcttattgtgactgtttcagatctagtttgggaacagattagaggccattgtcttctgtcctgatcaggtggcctggctgtttctttggatccctctgtcccagagccacccagaaccctgactcttgagaatcaagaaaacacccagaaaggccttaatgacctcataggcactcttccaaaaagacaacagaactggaatgagaggcctgggtctgtctcctgccttagcaggcctatcaatttcttgtcaatctctttttttccttgctcacattaaaaggaagcatggagttctaatgctcccataaactatgtattttggcaagacacttcactactccaggtctcactttccccatctgtaaaacagggtttggactaggtgttccctggtattctgtgatctgcctcttgctgccattctttctctcctctgcttctctgtatttttcttctgttatccctgggggtgctcaggttcacttgattgtctgtatttctgtgtggttgtagcaaggactcagcctcatgtagcacgaataggggtgtggttcatggcgtgttgacccagcagagcactccctcccactaacttgttctgcatgtgtagagtctccccattttttttaacgcaaccctttcccctttttcctaccccacagctctgttccatgtaagttgccaacagtttcactgaacagtggggtatgtgatggttttggcatgacatcttcagtatgagggggacagtttgacttcactttgagggtgtgatgtctgtagctatgtggaaggtaaaaatagtggtgtgatcatgaaccaaaggaatttatgttttgtaacttgggtactttattttgcattttgttatactattaaataattttttcctgtt

SEQ ID NO: 17845 - DNA, 1531 bp, Homo sapiens
  misc_feature (9)..(9): n is a, c, g, or t
  misc_feature (16)..(16): n is a, c, g, or t
ctcgtgccntcgtgcngctcgtgccgctcgtgcctccctgtccaagaagtgactgttgagaggcgaggaggtagtgggtgaggctacctgactcacttcaaatgcatgttttgagatgtttggagattcagcaattctgtcttcattgctccaggatctggtatactgttctcataaaactgagaggagaaaaaaagtgaaagaaagcagctgctttaagaatggttttccaccttttccccctaatctctaccaatcagacacattttattatttaaatctgcacctctctctattttatttgccaggggcacgatgtgacatatctgcagtcccagcacagtgggacaaaaagaatttagaccccaaaagtgtcctcggcatggatcttgaacagaaccagtatctgtcatggaactgaacattcatcgatggtctccatgtattcatttattcacttgttcattcaagtatttattgaatacctgcctcaagctagagagaaaagagagtgcgctttggaaatttattccagttttcagcctacagcagattatcagctcggtgacttttctttctgccaccatttaggtgatggtgtttgattcagagatggctgaatttctattcttagcttattgtgactgtttcagatctagtttgggaacagattagaggccattgtcttctgtcctgatcaggtggcctggctgtttctttggatccctctgtcccagagccacccagaaccctgactcttgagaatcaagaaaacacccagaaaggccttaatgacctcataggcactcttccaaaaagacaacagaactggaatgagaggcctgggtctgtctcctgccttagcaggcctatcaatttcttgtcaatctctttttttccttgctcacattaaaaggaagcatggagttctaatgctcccataaactatgtattttggcaagacacttcactactccaggtctcactttccccatctgtaaaacagggtttggactaggtgttccctggtattctgtgatctgcctcttgctgccattctttctctcctctgcttctctgtatttttcttctgttatccctgggggtgctcaggttcacttgattgtctgtatttctgtgtggttgtagcaaggactcagcctcatgtagcacgaataggggtgtggttcatggcgtgttgacccagcagagcactccctcccactaacttgttctgcatgtgtagagtctccccattttttttaacgcaaccctttcccctttttcctaccccacagctctgttccatgtaagttgccaacagtttcactgaacagtggggtatgtgatggttttggcatgacatcttcagtatgagggggacagtttgacttcactttgagggtgtgatgtctgtagctatgtggaaggtaaaaatagtggtgtgatcatgaaccaaaggaatttatgttttgtaacttgggtactttattttgcattttgttatactattaaataattttttcctgtt

SEQ ID NO: 17846 - DNA, 3164 bp, Homo sapiens
cgctgggggcggggcgacgccggactccggagcgcccgcttacgcagttcctcccggggtcggaggccgattcgccgtgtggcgggttcgagtcccgcctcctgactctggcctctagtccctgagtcccgggcgggctgcattcgtcggggaaacctctcctcgaccaggggcacctctactcgaccaggggcgacggcgtactttgggcttcatcatggaggactacctgcagggttgtcgagctgctctgcaggagtcccgacctctacatgttgtgctgggaaatgaagcctgtgatttggactccacagtgtctgctcttgccctggctttttacctagcaaagacaactgaggctgaggaagtctttgtgccagttttaaatataaaacgttctgaactacctctgcgaggtgacattgtcttctttcttcagaaggttcatattccagagagtatcttgatttttcgggatgagattgacctccatgcattataccaggctggccaactcaccctcatccttgtcgaccatcatatcttatccaaaagtgacacagccctagaggaggcagtagcagaggtgctagaccatcgacccatcgagccgaaacactgccctccctgccatgtttcagttgagctggtggggtcctgtgctaccctggtgaccgagagaatcctgcagggggcaccagagatcttggacaggcaaactgcagcccttctgcatggaaccatcatcctggactgtgtcaacatggaccttaaaattggaaaggcaaccccaaaggacagcaaatatgtggagaaactagaggcccttttcccagacctacccaagagaaatgatatatttgattccctacaaaaggcaaagtttgatgtatcaggactgaccactgagcagatgctgagaaaagaccagaagactatctatagacaaggcgtcaaggtggccattagtgcaatatatatggatttggaggcctttctgcagaggtctaacctccttgcagatctccatgctttctgccaggctcacagctatgatgtcctggttgccatgactatctttttcaacactcacaatgagccagtgcggcagttggctattttctgtccccatgtggcactccaaacaacgatctgtgaagtcctggaacgctcccactctccacccctgaagctgacccctgcctcaagtacccaccctaacctccatgcctatcttcaaggcaacacccaggtctctcgaaagaaacttctgcccctgctccaggaagccctgtcagcatattttgactccatgaagatcccttcaggacagcctgagacagcagatgtgtccagggagcaagtggacaaggaattggacagggcaagtaactccctgatttctggactgagtcaagatgaggaggaccctccgctgcccccgacgcccatgaacagcttggtggatgagtgccctctagatcaggggctgcctaaactctctgctgaggccgtcttcgagaagtgcagtcagatctcactgtcacagtctaccacagcctccctgtccaagaagtgactgttgagaggcgaggaggtagtgggtgaggctacctgactcacttcaaatgcatgttttgagatgtttggagattcagcaattctgtcttcattgctccaggatctggtatactgttctcataaaactgagaggagaaaaaaagtgaaagaaagcagctgctttaagaatggttttccaccttttccccctaatctctaccaatcagacacattttattatttaaatctgcacctctctctattttatttgccaggggcacgatgtgacatatctgcagtcccagcacagtgggacaaaaagaatttagaccccaaaagtgtcctcggcatggatcttgaacagaaccagtatctgtcatggaactgaacattcatcgatggtctccatgtattcatttattcacttgttcattcaagtatttattgaatacctgcctcaagctagagagaaaagagagtgcgctttggaaatttattccagttttcagcctacagcagattatcagctcggtgacttttctttctgccaccatttaggtgatggtgtttgattcagagatggctgaatttctattcttagcttattgtgactgtttcagatctagtttgggaacagattagaggccattgtcttctgtcctgatcaggtggcctggctgtttctttggatccctctgtcccagagccacccagaaccctgactcttgagaatcaagaaaacacccagaaaggccttaatgacctcataggcactcttccaaaaagacaacagaactggaatgagaggcctgggtctgtctcctgccttagcaggcctatcaatttcttgtcaatctctttttttccttgctcacattaaaaggaagcatggagttctaatgctcccataaactatgtattttggcaagacacttcactactccaggtctcactttccccatctgtaaaacagggtttggactaggtgttccctggtattctgtgatctgcctcttgctgccattctttctctcctctgcttctctgtatttttcttctgttatccctgggggtgctcaggttcacttgattgtctgtatttctgtgtggttgtagcaaggactcagcctcatgtagcacgaataggggtgtggttcatggcgtgttgacccagcagagcactccctcccactaacttgttctgcatgtgtagagtctccccattttttttaacgcaaccctttcccctttttcctaccccacagctctgttccatgtaagttgccaacagtttcactgaacagtggggtatgtgatggttttggcatgacatcttcagtatgagggggacagtttgacttcactttgagggtgtgatgtctgtagctatgtggaaggtaaaaatagtggtgtgatcatgaaccaaaggaatttatgttttgtaacttgggtactttattttgcattttgttatactattaaataattttttcctgtttgggggtcttactgtctttttttacaagtgtattcaggcctttctctgtgatagttgtttcagtctcctcaaaattgatcccccttcttcctactatacttaatgt

SEQ ID NO: 17847 - DNA, 2627 bp, Homo sapiens
cgctgggggcggggcgacgccggactccggagcgcccgcttacgcagttcctcccggggtcggaggccgattcgccgtgtggcgggttcgagtcccgcctcctgactctggcctctagtccctgagtcccgggcgggctgcattcgtcggggaaacctctcctcgaccaggggcacctctactcgaccaggggcgacggcgtactttgggcttcatcatggaggactacctgcagggttgtcgagctgctctgcaggagtcccgacctctacatgttgtgctgggaaatgaagcctgtgatttggactccacagtgtctgctcttgccctggctttttacctagcaaagacaactgaggctgaggaagtctttgtgccagttttaaatataaaacgttctgaactacctctgcgaggtgacattgtcttctttcttcagaaggttcatattccagagagtatcttgatttttcgggatgagattgacctccatgcattataccaggctggccaactcaccctcatccttgtcgaccatcatatcttatccaaaagtgacacagccctagaggaggcagtagcagaggtgctagaccatcgacccatcgagccgaaacactgccctccctgccatgtttcagttgagctggtggggtcctgtgctaccctggtgaccgagagaatcctgcagggggcaccagagatcttggacaggcaaactgcagcccttctgcatggaaccatcatcctggactgtgtcaacatggaccttaaaattggaaaggcaaccccaaaggacagcaaatatgtggagaaactagaggcccttttcccagacctacccaagagaaatgatatatttgattccctacaaaaggcaaagtttgatgtatcaggactgaccactgagcagatgctgagaaaagaccagaagactatctatagacaaggcgtcaaggtggccattagtgcaatatatatggatttggaggcctttctgcagaggtctaacctccttgcagatctccatgctttctgccaggctcacagctatgatgtcctggttgccatgactatctttttcaacactcacaatgagccagtgcggcagttggctattttctgtccccatgtggcactccaaacaacgatctgtgaagtcctggaacgctcccactctccacccctgaagctgacccctgcctcaagtacccaccctaacctccatgcctatcttcaaggcaacacccaggtctctcgaaagaaacttctgcccctgctccaggaagccctgtcagcatattttgactccatgaagatcccttcaggacagcctgagacagcagatgtgtccagggagcaagtggacaaggaattggacagggcaagtaactccctgatttctggactgagtcaagatgaggaggaccctccgctgcccccgacgcccatgaacagcttggtggatgagtgccctctagatcaggggctgcctaaactctctgctgaggccgtcttcgagaagtgcagtcagatctcactgtcacagtctaccacagcctccctgtccaagaagtgactgttgagaggcgaggaggtagtgggtgaggctacctgactcacttcaaatgcatgttttgagatgtttggagattcagcaattctgtcttcattgctccaggatctggtatactgttctcataaaactgagaggagaaaaaaagtgaaagaaagcagctgctttaagaatggttttccaccttttccccctaatctctaccaatcagacacattttattatttaaatctgcacctctctctattttatttgccaggggcacgatgtgacatatctgcagtcccagcacagtgggacaaaaagaatttagaccccaaaagtgtcctcggcatggatcttgaacagaaccagtatctgtcatggaactgaacattcatcgatggtctccatgtattcatttattcacttgttcattcaagtatttattgaatacctgcctcaagctagagagaaaagagagtgcgctttggaaatttattccagttttcagcctacagcagattatcagctcggtgacttttctttctgccaccatttaggtgatggtgtttgattcagagatggctgaatttctattcttagcttattgtgactgtttcagatctagtttgggaacagattagaggccattgtcttctgtcctgatcaggtggcctggctgtttctttggatccctctgtcccagagccacccagaaccctgactcttgagaatcaagaaaacacccagaaaggccttaatgacctcataggcactcttccaaaaagacaacagaactggaatgagaggcctgggtctgtctcctgccttagcaggcctatcaatttcttgtcaatctctttttttccttgctcacattaaaaggaagcatggagttctaatgctcccataaactatgtattttggcaagacacttcactactccaggtctcactttccccatctgtaaaacagggtttggactaggtgttccctggtattctgtgatctgcctcttgctgccattctttctctcctctgcttctacggggggggatccttctagagt

SEQ ID NO: 17848 - DNA, 2084 bp, Homo sapiens
  misc_feature (995)..(997): n is a, c, g, or t
cgctgggggcggggcgacgccggactccggagcgcccgcttacgcagttcctcccggggtcggaggccgattcgccgtgtggcgggttcgagtcccgcctcctgactctggcctctagtccctgagtcccgggcgggctgcattcgtcggggaaacctctcctcgaccaggggcacctctactcgaccaggggcgacggcgtactttgggcttcatcatggaggactacctgcagggttgtcgagctgctctgcaggagtcccgacctctacatgttgtgctgggaaatgaagcctgtgatttggactccacagtgtctgctcttgccctggctttttacctagcaaagacaactgaggctgaggaagtctttgtgccagttttaaatataaaacgttctgaactacctctgcgaggtgacattgtcttctttcttcagaaggttcatattccagagagtatcttgatttttcgggatgagattgacctccatgcattataccaggctggccaactcaccctcatccttgtcgaccatcatatcttatccaaaagtgacacagccctagaggaggcagtagcagaggtgctagaccatcgacccatcgagccgaaacactgccctccctgccatgtttcagttgagctggtggggtcctgtgctaccctggtgaccgagagaatcctgcagggggcaccagagatcttggacaggcaaactgcagcccttctgcatggaaccatcatcctggactgtgtcaacatggaccttaaaattggaaaggcaaccccaaaggacagcaaatatgtggagaaactagaggcccttttcccagacctacccaagagaaatgatatatttgattccctacaaaaggcaaagtttgatgtatcagggactgaccactgagcagatgctgagaaaagaccagaagactatctatagacaaggcgtcaaggtggccattagtgcaatatatatggatttggaggcnnnctttctgcagaggtctaacctccttgcagatctccatgctttctgccaggctcacagctatgatgtcctggttgccatgactatctttttcaacactcacaatgagccagtgcggcagttggctattttctgtccccatgtggcactccaaacaacgatctgtgaagtcctggaacgctcccactctccacccctgaagctgacccctgcctcaagtacccaccctaacctccatgcctatcttcaaggcaacacccaggtctctcgaaagaaacttctgcccctgctccaggaagccctgtcagcatattttcttgagaatcaagaaaacacccagaaaggccttaatgacctcataggcactcttccaaaaagacaacagaactggaatgagaggcctgggtctgtctcctgccttagcaggcctatcaatttcttgtcaatctctttttttccttgctcacattaaaaggaagcatggagttctaatgctcccataaactatgtattttggcaagacacttcactactccaggtctcactttccccatctgtaaaacagggtttggactaggtgttccctggtattctgtgatctgcctcttgctgccattctttctctcctctgcttctctgtatttttcttctgttatccctgggggtgctcaggttcacttgattgtctgtatttctgtgtggttgtagcaaggactcagcctcatgtagcacgaataggggtgtggttcatggcgtgttgacccagcagagcactccctcccactaacttgttctgcatgtgtagagtctccccattttttttaacgcaaccctttcccctttttcctaccccacagctctgttccatgtaagttgccaacagtttcactgaacagtggggtatgtgatggttttggcatgacatcttcagtatgagggggacagtttgacttcactttgagggtgtgatgtctgtagctatgtggaaggtaaaaatagtggtgtgatcatgaaccaaaggaatttatgttttgtaacttgggtactttattttgcattttgttatactattaaataattttttcctgtt

SEQ ID NO: 17849 - DNA, 499 bp, Homo sapiens
ttttttaacaggaaaaaattatttaatagtataacaaaatgcaaaataaagtacccaagttacaaaacataaattcctttggttcacttgattgtctgtatttctgtgtggttgtagcaaggactcagcctcatgtagcacgaataggggtgtggttcatggcgtgttgacccagcagagcactccctcccactaacttgttctgcatgtgtagagtctccccattttttttaacgcaaccctttcccctttttcctaccccacagctctgttccatgtaagttgccaacagtttcactgaacagtggggtatgtgatggttttggcatgacatcttcagtatgagggggacagtttgacttcactttgagggtgtgatgtctgtagctatgtggaaggtaaaaatagtggtgtgatcatgaaccaaaggaatttatgttttgtaacttgggtactttattttgcattttgttatactattaaataattttttcctgtt

SEQ ID NO: 17850 - DNA, 1327 bp, Homo sapiens
cgctgggggcggggcgacgccggactccggagcgcccgcttacgcagttcctcccggggtcggaggccgattcgccgtgtggcgggttcgagtcccgcctcctgactctggcctctagtccctgagtcccgggcgggctgcattcgtcggggaaacctctcctcgaccaggggcacctctactcgaccaggggcgacggcgtactttgggcttcatcatggaggactacctgcagggttgtcgagctgctctgcaggagtcccgacctctacatgttgtgctgggaaatgaagcctgtgatttggactccacagtgtctgctcttgccctggctttttacctagcaaagacaactgaggctgaggaagtctttgtgccagttttaaatataaaacgttctgaactacctctgcgaggtgacattgtcttctttcttcagaaggttcatattccagagagtatcttgatttttcgggatgagattgacctccatgcattataccaggctggccaactcaccctcatccttgtcgaccatcatatcttatccaaaagtgacacagccctagaggaggcagtagcagaggtgctagaccatcgacccatcgagccgaaacactgccctccctgccatgtttcagttgagctggtggggtcctgtgctaccctggtgaccgagagaatcctgcagggggcaccagagatcttggacaggcaaactgcagcccttctgcatggaaccatcatcctggactgtgtcaacatggaccttaaaattggaaaggcaaccccaaaggacagcaaatatgtggagaaactagaggcccttttcccagacctacccaagagaaatgatatatttgattccctacaaaaggcaaagtttgatgtatcagggactgaccactgagcagatgctgagaaaagaccagaagactatctatagacaaggcgtcaaggtggccattagtgcaatatatatggatttggagatctgtgaagtcctggaacgctcccactctccacccctgaagctgacccctgcctcaagtacccaccctaacctccatgcctatcttcaaggcaacacccaggtctctcgaaagaaacttctgcccctgctccaggaagccctgtcagcatattttgactccatgaagatcccttcaggacagcctgagacagcagatgtgtccagggagcaagtggacaaggaattggacagggcaagtaactccctgatttctggactgagtcaagatgaggaggaccctccgccaaagtgacgaattcggcacgaggaccattctgatgttggagcggccgc

SEQ ID NO: 17851 - DNA, 708 bp, Homo sapiens
  misc_feature (626)..(626): n is a, c, g, or t
gcactgcctgagactactccagcctcccccgtccctgatgtcacaattcagaggctgctgcctgcttaggaggttgtagaaagctctgtaggttctctctgtgtgtcctacaggagtcttcaggccagctccctgtcggatggcttttatgaaaaaatatctcctccccattctggggctcttcatggcctactactactattctgcaaacgaggaattcagaccagagatgctccaaggaaagaaagtgattgtcacaggggccagcaaagggatcggaagagagatggcttatcatctggcgaagatgggagcccatgtggtggtgacagcgagctcagcacactacattgctggcaccatggaagacatgaccttcgcagagcaatttgttgcccaagcaggaaagctcatgggaggactagacatgctcattctcaaccacatcaccaacacttctttgaatctttttcatgatgatattcaccatgtgcgcaaaagcatggaagtcaacttcctcagttacgtggtcctgactgtagctgccttgcccatgctgaagcagagcaatggaagcatgtgcgctcttctgctggaatgctatcatgttgtgcatctgagcagtngttgatggtctctctcatagaagatatcaggcaggcatgatatactttggtctgctataccagacgctaggcgtctgatgca

SEQ ID NO: 17852 - DNA, 1935 bp, Homo sapiens
ggtgaaaagggaaaacctgcccaaatccagtttttgtttcagtaacttcctttgagacaaagtcaggaatctgagagtaagcacctgctaagggtgggacaggggctctgtctggtatgcctctcccatgttaagagctaacaatagtaatggataagtctccagggcaaccaggaccacttccaagcattcctgtcttgggctgcctcgagggctcctctgtcctttggggagtactgattgatgcctgatgcccagaactggcccactctggcttctctttggagctgtctctgcaggcgccttctggctgccagctcggtcctagcataagggacttcttccttggcctgggtttcaccttcttgtatcaggtggcagaccagctggtttcagtcccaaatcaggtcttctgactcctcccagaaaccaaccaacttctgagcaggaaatcctgcccctccccaaagagtgggaaaccgcaaaggaagagagagatgaaacagaaggaaaggcagaggaggagggagagagagagaagagaagaaaaagaaaaaagaacatcaataaaaagaagtcagatttgttcgaaatcttgaggagtcttcaggccagctccctgtcggatggcttttatgaaaaaatatctcctccccattctggggctcttcatggcctactactactattctgcaaacgaggaattcagaccagagatgctccaaggaaagaaagtgattgtcacaggggccagcaaagggatcggaagagagatggcttatcatctggcgaagatgggagcccatgtggtggtgacagcgaggtcaaaagaaactctacagaaggtggtatcccactgcctggagcttggagcagcctcagcacactacattgctggcaccatggaagacatgaccttcgcagagcaatttgttgcccaagcaggaaagctcatgggaggactagacatgctcattctcaaccacatcaccaacacttctttgaatctttttcatgatgatattcaccatgtgcgcaaaagcatggaagtcaacttcctcagttacgtggtcctgactgtagctgccttgcccatgctgaagcagagcaatggaagcattgttgtcgtctcctctctggctgggaaagtggcttatccaatggttgctgcctattctgcaagcaagtttgctttggatgggttcttctcctccatcagaaaggaatattcagtgtccagggtcaatgtatcaatcactctctgtgttcttggcctcatagacacagaaacagccatgaaggcagtttctgggatagtccatatgcaagcagctccaaaggaggaatgtgccctggagatcatcaaagggggagctctgcgccaagaagaagtgtattatgacagctcactctggaccactcttctgatcagaaatccatgcaggaagatcctggaatttctctactcaacgagctataatatggacagattcataaacaagtaggaactccctgagggctgggcatgctgagggattttgggactgttctgtctcatgtttatctgagctcttatctatgaagacatcttcccagagtgtccccagagacatgcaagtcatgggtcacacctgacaaatggaaggagttcctctaacatttgcaaaatggaaatgtaataataatgaatgtcatgcaccgctgcagccagcagttgtaaaattgttagtaaacataggtataattaccagatagttatattaaatttatatcttatatataataatatgtgatgattaatacaatattaattataataaaggtcacataaactttataaattcataactggtagctataacttgagcttattcaggatggtttctttaaaaccataaactgtacaaatgaaatttttcaatatttgtttcttat

SEQ ID NO: 17853 - DNA, 1821 bp, Homo sapiens
ggtgaaaagggaaaacctgcccaaatccagtttttgtttcagtaacttcctttgagacaaagtcaggaatctgagagtaagcacctgctaagggtgggacaggggctctgtctggtatgcctctcccatgttaagagctaacaatagtaatggataagtctccagggcaaccaggaccacttccaagcattcctgtcttgggctgcctcgagggctcctctgtcctttggggagtactgattgatgcctgatgcccagaactggcccactctggcttctctttggagctgtctctgcaggcgccttctggctgccagctcggtcctagcataagggacttcttccttggcctgggtttcaccttcttgtatcaggtggcagaccagctggtttcagtcccaaatcaggtcttctgactcctcccagaaaccaaccaacttctgagcaggaaatcctgcccctccccaaagagtgggaaaccgcaaaggaagagagagatgaaacagaaggaaaggcagaggaggagggagagagagagaagagaagaaaaagaaaaaagaacatcaataaaaagaagtcagatttgttcgaaatcttgagagatgctccaaggaaagaaagtgattgtcacaggggccagcaaagggatcggaagagagatggcttatcatctggcgaagatgggagcccatgtggtggtgacagcgaggtcaaaagaaactctacagaaggtggtatcccactgcctggagcttggagcagcctcagcacactacattgctggcaccatggaagacatgaccttcgcagagcaatttgttgcccaagcaggaaagctcatgggaggactagacatgctcattctcaaccacatcaccaacacttctttgaatctttttcatgatgatattcaccatgtgcgcaaaagcatggaagtcaacttcctcagttacgtggtcctgactgtagctgccttgcccatgctgaagcagagcaatggaagcattgttgtcgtctcctctctggctgggaaagtggcttatccaatggttgctgcctattctgcaagcaagtttgctttggatgggttcttctcctccatcagaaaggaatattcagtgtccagggtcaatgtatcaatcactctctgtgttcttggcctcatagacacagaaacagccatgaaggcagtttctgggatagtccatatgcaagcagctccaaaggaggaatgtgccctggagatcatcaaagggggagctctgcgccaagaagaagtgtattatgacagctcactctggaccactcttctgatcagaaatccatgcaggaagatcctggaatttctctactcaacgagctataatatggacagattcataaacaagtaggaactccctgagggctgggcatgctgagggattttgggactgttctgtctcatgtttatctgagctcttatctatgaagacatcttcccagagtgtccccagagacatgcaagtcatgggtcacacctgacaaatggaaggagttcctctaacatttgcaaaatggaaatgtaataataatgaatgtcatgcaccgctgcagccagcagttgtaaaattgttagtaaacataggtataattaccagatagttatattaaatttatatcttatatataataatatgtgatgattaatacaatattaattataataaaggtcacataaactttataaattcataactggtagctataacttgagcttattcaggatggtttctttaaaaccataaactgtacaaatgaaatttttcaatatttgtttcttat

SEQ ID NO: 17854 - DNA, 1448 bp, Homo sapiens
gcactgcctgagactactccagcctcccccgtccctgatgtcacaattcagaggctgctgcctgcttaggaggttgtagaaagctctgtaggttctctctgtgtgtcctacaggagtcttcaggccagctccctgtcggatggcttttatgaaaaaatatctcctccccattctggggctcttcatggcctactactactattctgcaaacgaggaattcagaccagagatgctccaaggaaagaaagtgattgtcacaggggccagcaaagggatcggaagagagatggcttatcatctggcgaagatgggagcccatgtggtggtgacagcgaggtcaaaagaaactctacagaaggtggtatcccactgcctggagcttggagcagcctcagcacactacattgctggcaccatggaagacatgaccttcgcagagcaatttgttgcccaagcaggaaagctcatgggaggactagacatgctcattctcaaccacatcaccaacacttctttgaatctttttcatgatgatattcaccatgtgcgcaaaagcatggaagtcaacttcctcagttacgtggtcctgactgtagctgccttgcccatgctgaagcagagcaatggaagcattgttgtcgtctcctctctggctgggaaagtggcttatccaatggttgctgcctattctgcaagcaagtttgctttggatgggttcttctcctccatcagaaaggaatattcagtgtccagggtcaatgtatcaatcactctctgtgttcttggcctcatagacacagaaacagccatgaaggcagtttctgggatagtccatatgcaagcagctccaaaggaggaatgtgccctggagatcatcaaagggggagctctgcgccaagaagaagtgtattatgacagctcactctggaccactcttctgatcagaaatccatgcaggaagatcctggaatttctctactcaacgagctataatatggacagattcataaacaagtaggaactccctgagggctgggcatgctgagggattttgggactgttctgtctcatgtttatctgagctcttatctatgaagacatcttcccagagtgtccccagagacatgcaagtcatgggtcacacctgacaaatggaaggagttcctctaacatttgcaaaatggaaatgtaataataatgaatgtcatgcaccgctgcagccagcagttgtaaaattgttagtaaacataggtataattaccagatagttatattaaatttatatcttatatataataatatgtgatgattaatacaatattaattataataaaggtcacataaactttataaattcataactggtagctataacttgagcttattcaggatggtttctttaaaaccataaactgtacaaatgaaatttttcaatatttgtttcttat

SEQ ID NO: 17855 - DNA, 1355 bp, Homo sapiens
gcactgcctgagactactccagcctcccccgtccctgatgtcacaattcagaggctgctgcctgcttaggaggttgtagaaagctctgtaggttctctctgtgtgtcctacaggagtcttcaggccagctccctgtcggatggcttttatgaaaaaatatctcctccccattctggggctcttcatggcctactactactattctgcaaacgaggaattcagaccagagatgctccaaggaaagaaagtgattgtcacaggggccagcaaagggatcggaagagagatggcttatcatctggcgaagatgggagcccatgtggtggtgacagcgaggtcaaaagaaactctacagaaggtggtatcccactgcctggagcttggagcagcctcagcacactacattgctggcaccatggaagacatgaccttcgcagagcaatttgttgcccaagcaggaaagctcatgggaggactagacatgctcattctcaaccacatcaccaacacttctttgaatctttttcatgatgatattcaccatgtgcgcaaaagcatggaagtcaacttcctcagttacgtggtcctgactgtagctgccttgcccatgctgaagcagagcaatggaagcattgttgtcgtctcctctctggctgggaaagtggcttatccaatggttgctgcctattctgcaagcaagtttgctttggatgggttcttctcctccatcagaaaggaatattcagtgtccagggtcaatgtatcaatcactctctgtgttcttggcctcatagacacagaaacagccatgaaggcagtttctgggatagtccatatgcaagcagctccaaaggaggaatgtgccctggagatcatcaaagggggagctctgcgccaagaagaagtgtattatgacagctcactctggaccactcttctgatcagaaatccatgcaggaagatcctggaatttctctactcaacgagctataatatggacagattcataaacaagtaggaactccctgagggctgggcatgctgagggattttgggactgttctgtctcatgtttatctgagctcttatctatgaagacatcttcccagagtgtccccagagacatgcaagtcatgggtcacacctgacaaatggaaggagttcctctaacatttgcaaaatggaaatgtaataataatgaatgtcatgcaccgctgcagccagcagttgtaaaattgttagtaaacataggtataattaccagatagttatattaaatttatatcttatatataataatatgtgatgattaatacaatattaattataataaaggtcacataaactttataaat

SEQ ID NO: 17856 - DNA, 1394 bp, Homo sapiens
gcactgcctgagactactccagcctcccccgtccctgatgtcacaattcagaggctgctgcctgcttaggaggttgtagaaagctctgtaggttctctctgtgtgtcctacaggagtcttcaggccagctccctgtcggatggcttttatgaaaaaatatctcctccccattctggggctcttcatggcctactactactattctgcaaacgaggaattcagaccagagatgctccaaggaaagaaagtgattgtcacaggggccagcaaagggatcggaagagagatggcttatcatctggcgaagatgggagcccatgtggtggtgacagcgaggtcaaaagaaactctacagaaggtggtatcccactgcctggagcttggagcagcctcagcacactacattgctggcaccatggaagacatgaccttcgcagagcaatttgttgcccaagcaggaaagctcatgggaggactagacatgctcattctcaaccacatcaccaacacttctttgaatctttttcatgatgatattcaccatgtgcgcaaaagcatggaagtcaacttcctcagttacgtggtcctgactgtagctgccttgcccatgctgaagcagagcaatggaagcattgttgtcgtctcctctctggctgggaaagtggcttatccaatggttgctgcctattctgcaagcaagtttgctttggatgggttcttctcctccatcagaaaggaatattcagtgtccagggtcaatgtatcaatcactctctgtgttcttggcctcatagacacagaaacagccatgaaggcagtttctgggatagtccatatgcaagcagctccaaaggaggaatgtgccctggagatcatcaaagggggagctctgcgccaagaagaagtgtattatgacagctcactctggaccactcttctgatcagaaatccatgcaggaagatcctggaatttctctactcaacgagctataatatggagggactgttctgtctcatgtttatctgagctcttatctatgaagacatcttcccagagtgtccccagagacatgcaagtcatgggtcacacctgacaaatggaaggagttcctctaacatttgcaaaatggaaatgtaataataatgaatgtcatgcaccgctgcagccagcagttgtaaaattgttagtaaacataggtataattaccagatagttatattaaatttatatcttatatataataatatgtgatgattaatacaatattaattataataaaggtcacataaactttataaattcataactggtagctataacttgagcttattcaggatggtttctttaaaaccataaactgtacaaatgaaatttttcaatatttgtttcttat

SEQ ID NO: 17857 - DNA, 1394 bp, Homo sapiens
gcactgcctgagactactccagcctcccccgtccctgatgtcacaattcagaggctgctgcctgcttaggaggttgtagaaagctctgtaggttctctctgtgtgtcctacaggagtcttcaggccagctccctgtcggatggcttttatgaaaaaatatctcctccccattctggggctcttcatggcctactactactattctgcaaacgaggaattcagaccagagatgctccaaggaaagaaagtgattgtcacaggggccagcaaagggatcggaagagagatggcttatcatctggcgaagatgggagcccatgtggtggtgacagcgaggtcaaaagaaactctacagaaggtggtatcccactgcctggagcttggagcagcctcagcacactacattgctggcaccatggaagacatgaccttcgcagagcaatttgttgcccaagcaggaaagctcatgggaggactagacatgctcattctcaaccacatcaccaacacttctttgaatctttttcatgatgatattcaccatgtgcgccccatgctgaagcagagcaatggaagcattgttgtcgtctcctctctggctgggaaagtggcttatccaatggttgctgcctattctgcaagcaagtttgctttggatgggttcttctcctccatcagaaaggaatattcagtgtccagggtcaatgtatcaatcactctctgtgttcttggcctcatagacacagaaacagccatgaaggcagtttctgggatagtccatatgcaagcagctccaaaggaggaatgtgccctggagatcatcaaagggggagctctgcgccaagaagaagtgtattatgacagctcactctggaccactcttctgatcagaaatccatgcaggaagatcctggaatttctctactcaacgagctataatatggacagattcataaacaagtaggaactccctgagggctgggcatgctgagggattttgggactgttctgtctcatgtttatctgagctcttatctatgaagacatcttcccagagtgtccccagagacatgcaagtcatgggtcacacctgacaaatggaaggagttcctctaacatttgcaaaatggaaatgtaataataatgaatgtcatgcaccgctgcagccagcagttgtaaaattgttagtaaacataggtataattaccagatagttatattaaatttatatcttatatataataatatgtgatgattaatacaatattaattataataaaggtcacataaactttataaattcataactggtagctataacttgagcttattcaggatggtttctttaaaaccataaactgtacaaatgaaatttttcaatatttgtttcttat

SEQ ID NO: 17858 - DNA, 1394 bp, Homo sapiens
gcactgcctgagactactccagcctcccccgtccctgatgtcacaattcagaggctgctgcctgcttaggaggttgtagaaagctctgtaggttctctctgtgtgtcctacaggagtcttcaggccagctccctgtcggatggcttttatgaaaaaatatctcctccccattctggggctcttcatggcctactactactattctgcaaacgaggaattcagaccagagatgctccaaggaaagaaagtgattgtcacaggggccagcaaagggatcggaagagagatggcttatcatctggcgaagatgggagcccatgtggtggtgacagcgagctcagcacactacattgctggcaccatggaagacatgaccttcgcagagcaatttgttgcccaagcaggaaagctcatgggaggactagacatgctcattctcaaccacatcaccaacacttctttgaatctttttcatgatgatattcaccatgtgcgcaaaagcatggaagtcaacttcctcagttacgtggtcctgactgtagctgccttgcccatgctgaagcagagcaatggaagcattgttgtcgtctcctctctggctgggaaagtggcttatccaatggttgctgcctattctgcaagcaagtttgctttggatgggttcttctcctccatcagaaaggaatattcagtgtccagggtcaatgtatcaatcactctctgtgttcttggcctcatagacacagaaacagccatgaaggcagtttctgggatagtccatatgcaagcagctccaaaggaggaatgtgccctggagatcatcaaagggggagctctgcgccaagaagaagtgtattatgacagctcactctggaccactcttctgatcagaaatccatgcaggaagatcctggaatttctctactcaacgagctataatatggacagattcataaacaagtaggaactccctgagggctgggcatgctgagggattttgggactgttctgtctcatgtttatctgagctcttatctatgaagacatcttcccagagtgtccccagagacatgcaagtcatgggtcacacctgacaaatggaaggagttcctctaacatttgcaaaatggaaatgtaataataatgaatgtcatgcaccgctgcagccagcagttgtaaaattgttagtaaacataggtataattaccagatagttatattaaatttatatcttatatataataatatgtgatgattaatacaatattaattataataaaggtcacataaactttataaattcataactggtagctataacttgagcttattcaggatggtttctttaaaaccataaactgtacaaatgaaatttttcaatatttgtttcttat

SEQ ID NO: 17859 - DNA, 1304 bp, Homo sapiens
gcactgcctgagactactccagcctcccccgtccctgatgtcacaattcagaggctgctgcctgcttaggaggttgtagaaagctctgtaggttctctctgtgtgtcctacaggagtcttcaggccagctccctgtcggatggcttttatgaaaaaatatctcctccccattctggggctcttcatggcctactactactattctgcaaacgaggaattcagaccagagatgctccaaggaaagaaagtgattgtcacaggggccagcaaagggatcggaagagagatggcttatcatctggcgaagatgggagcccatgtggtggtgacagcgaggtcaaaagaaactctacagaaggtggtatcccactgcctggagcttggagcagcctcagcacactacattgctggcaccatggaagacatgaccttcgcagagcaatttgttgcccaagcaggaaagctcatgggaggactagacatgctcattctcaaccacatcaccaacacttctttgaatctttttcatgatgatattcaccatgtgcgcaaaagcatggaagtcaacttcctcagttacgtggtcctgactgtagctgccttgcccatgctgaagcagagcaatggaagcattgttgtcgtctcctctctggctgaaacagccatgaaggcagtttctgggatagtccatatgcaagcagctccaaaggaggaatgtgccctggagatcatcaaagggggagctctgcgccaagaagaagtgtattatgacagctcactctggaccactcttctgatcagaaatccatgcaggaagatcctggaatttctctactcaacgagctataatatggacagattcataaacaagtaggaactccctgagggctgggcatgctgagggattttgggactgttctgtctcatgtttatctgagctcttatctatgaagacatcttcccagagtgtccccagagacatgcaagtcatgggtcacacctgacaaatggaaggagttcctctaacatttgcaaaatggaaatgtaataataatgaatgtcatgcaccgctgcagccagcagttgtaaaattgttagtaaacataggtataattaccagatagttatattaaatttatatcttatatataataatatgtgatgattaatacaatattaattataataaaggtcacataaactttataaattcataactggtagctataacttgagcttattcaggatggtttctttaaaaccataaactgtacaaatgaaatttttcaatatttgtttcttat

SEQ ID NO: 17860 - DNA, 1247 bp, Homo sapiens
  misc_feature (914)..(914): n is a, c, g, or t
  misc_feature (920)..(920): n is a, c, g, or t
  misc_feature (929)..(929): n is a, c, g, or t
  misc_feature (931)..(931): n is a, c, g, or t
  misc_feature (953)..(953): n is a, c, g, or t
  misc_feature (956)..(956): n is a, c, g, or t
  misc_feature (992)..(992): n is a, c, g, or t
attatcataatgaggttgacattgtaggaaatattcaagctacttctccatgtttacatcctactgatcttcaaaaagttgcagaaatgattcgagaagaaggatatgattctgttttctctgttgtgagacgccatcagtttcgatggagtgaaattcagaaaggagttcgtgaagtgaccgaacctctgaatttaaatccagctaaacggcctcgtcgacaagactgggatggagaattatatgaaaatggctcattttattttgctaaaagacatttgatagagatgggttacttgcagggtggaaaaatggcatactacgaaatgcgagctgaacatagtgtggatatagatgtggatattgattggcctattgcagagcaaagagtattaagatatggctattttggcaaagagaagcttaaggaaataaaacttttggtttgcaatattgatggatgtctcaccaatggccacatttatgtatcaggagaccaaaaagaaataatatcttatgatgtaaaagatgctattgggataagtttattaaagaaaagtggtattgaggtgaggctaatctcagaaagggcctgttcaaagcagacgctgtcttctttaaaactggattgcaaaatggaagtcagtgtatcagacaagctagcagttgtagatgaatggagaaaagaaatgggcctgtgctggaaagaagtggcatatcttggaaatgaagtgtctgatgaagagtgcttgaagagaggtgggcctaagtggcgctcctgctgatgcctgttctactgcccagaaggctgttggatacatttgcaaatgtaatggtggccgtggtgccatccgagaatttgcagagcacatttgccctactaatggaaaaggttaataattcatgccaaaaanagaaantagcgtaanantgagaaaaaaatgatacagccntcntcagccagtttgcttttatttttgattaagtaaatnccatgttgtaatgttacagagagtgtgatttggttgtgatatatatatattgtgctctacttttctctttacgcaagataattatttagagactgattacagtctttctcagatttttagtaaatgcagtaagaacatcatcaaagttcacttgtattgtaccctgtaaaactgtgtgtggtgtgctttcaaagatgttgggatttatttatctggggacaggtgtatggtaagacatgcccttctattaataca

SEQ ID NO: 17861 - DNA, 446 bp, Homo sapiens
tcctttcagatcctccacttggcaggcagggccaacagcagcccccgggccaggtgtcctggagcagcagcagctgcccgtgcaggcccggactctccctagctaagggccatgtgcggtggagtgtcctaattttgcagggttcctttctgtgggggtacctgtggggtacttcaaacagccctagcagcaaaggcccttgagcagcgcggtgtgaaactgggataaaaacggggcttggccgaaggacttttatctgtcttggtcaccccggccaggccccggaagcagcagccagggatggtccttcctcacccacaggcgtgtgtcactgtggctgggacggcagcgctcagaggagcctccagttactttcctcacatctcccaaactctctcttaattgcgataattcacagaacataaaattcacgatcttaaaaaaaa

SEQ ID NO: 17862 - DNA, 1061 bp, Homo sapiens
  misc_feature (25)..(25): n is a, c, g, or t
aaggctagtacgaggctggtgtganttcggccgaggaagaactgaacagggtcttagaatgatcaaatggatggtttgtttggttggtgggagatgttgaaacgtgggtaaggaatggtgtccttagaagagaggttgccctagatgccgaaaccctggaggtccatggttgccagcagaaacttacagctgggaggagcctgcacccatctctggctcttgtgaatgagaagactcaatttgtgtttttgtttttttgagaaagggtcttgctctgtcacccagactgaagtacagtagcgtgatctcagttcactgcagccttgacctcctgggcccaagcgatcctcccacctcagcctcctgagtagttaagacttcaggtatgcattaccatgcctggctaatgtttttttattttttgtagagacaaggtctccctcgttgcccaggctggtctcaaactcttgggctcaagtgactttcctgcctcggccatccaaagtgctgggattacaggcataagccaccgcaacatgccccagttgcttttaaactgttaaatgtgggatttaaagaataatctagttctacccattttatgaatgaagaaaagaaactgggacccagagagaaaaggtgcccggtccaaggttacagagcccgttggactcagaagtgaagctggaacactggccaatgccctcccatccgccaggtgacttctctgcagtcccctttaccatctgcccgggtcctttgggatacggctgactaggggtttgaagaacagcaattggcctttgttatgaatctttttgtggagataaacccagtagaagtatcacggttctgaccatgaaagtgtgttcaactctaatccagcacaattaggattccagatcatttgattctgtgtcgtctaaatatcacagaaagttaaaaacaaattagcctcaatggaattaatggcttaatatccataatttagttttaatgctaggaggaagggctcctgtgaatgtgttcttacaaatcaaataaagaaaatcaaatagaga

SEQ ID NO: 17863 - DNA, 1509 bp, Homo sapiens
ggctctgtcacccaggctggagtgcagtggtgcaatcatggttgattgcaacctcaacctccctggttcaagccatcctcccacctcagtctcctgagtagctgggactacaggtgcacatcaccatgcccggctaatttttttgtatttttttactagagatgaggttctactatgtagcccaggctgctctggaactcctgggctcaagcaatcctcccacctcggcctcccaaagtgctgggattgcaggcatgagccaccatactggcctaagtgcagaaatttgaacatgtgcctccaccccaagccaaaatttcccttgaggagcactatctatctgatgatgtctttgaaacggtatgaaattaaaataattaaaacatcctgcacataggtggtagcatctaatatgaaagatggatttatgcttagagctcagaaaaatcctcataaaattattgtgtcttatcctcggcacctaaagaactgaacagggtcttagaatgatcaaatggatggtttgtttggttggtgggagatgttgaaacgtgggtaaggaatggtgtccttagaagagaggttgccctagatgccgaaaccctggaggtccatggttgccagcagaaacttacagctgggaggagcctgcacccatctctggctcttgtgaatgagaagactcaatttgtgtttttgtttttttgagaaagggtcttgctctgtcacccagactgaagtacagtagcgtgatctcagttcactgcagccttgacctcctgggcccaagcgatcctcccacctcagcctcctgagtagttaagacttcaggtatgcattaccatgcctggctaatgtttttttattttttgtagagacaaggtctccctcgttgcccaggctggtctcaaactcttgggctcaagtgactttcctgcctcggccatccaaagtgctgggattacaggcataagccaccgcaacatgccccagttgcttttaaactgttaaatgtgggatttaaagaataatctagttctacccattttatgaatgaagaaaagaaactgggacccagagagaaaaggtgcccggtccaaggttacagagcccgttggactcagaagtgaagctggaacactggccaatgccctcccatccgccaggtgacttctctgcagtcccctttaccatctgcccgggtcctttgggatacggctgactaggggtttgaagaacagcaattggcctttgttatgaatctttttgtggagataaacccagtagaagtatcacggttctgaccatgaaagtgtgttcaactctaatccagcacaattaggattccagatcatttgattctgtgtcgtctaaatatcacagaaagttaaaaacaaattagcctcaatggaattaatggcttaatatccataatttagttttaatgctaggaggaagggctcctgtgaatgtgttcttacaaatcaaataaagaaaatcaaatagaga

SEQ ID NO: 17864 - DNA, 228 bp, Homo sapiens
acatcttgaaagttaggcaccatctcacacaaatgttctctcccgtttttcctctaagaccacctgagtttggtgttgactgggaagcctcctaaagcctctgctgctgcctaagccctcattgaccctccctcttccaaatcccagcagcactttttgtctcgatacctccctgggcaccgagccacgcacctggttagttctttttgtgtataatagcgtgtgttg

SEQ ID NO: 17865 - DNA, 1059 bp, Homo sapiens
tatgaaatgtgtatgcttaaatacattttaggcatattaacaaagttgacatgagctgatggcagtaataacattttataaacaaatataatttataaatataaatacaggaattctttacatttaaaagttattaataggtgtgaagagttttcaaagaattgactctctccatcatctagtaatttgaaattttagaagattctttgaataaacctcatttagtctctctcctataaaaggaaaagcagaacctcaagtccacatttattttgcatttgctctcttgttcacattcttctctatgtcaataaaagttagatggcattttttatagctgtgtatcaaatatgtgaatatagaattccaactaaaatagcaatagatgggaaaactttctagttcattcattgtcaaaagtgagtgctgagaggacatctgaagccccacctaaaagtaaatcctcagcaggaaagataatgcagataaattttgggtccaaattcttaatctgggcaaagaaagaaaacaaacacacttactagatggatttttcataaaagttcctttccatgctgtccaaagtgattaaattagtcatccattcttttatctcttctgttgataatcatataagcaactcctgaatctatatgagtattcagtcttctttattattcagaagatttgccattttagtcaactcaaatatcagtactatttcatagcatgctagttcaggttacacaaagcccaccaggtacacctggaatctagccagaatgcagtccaatcatgagcactttaaacatttacctcattttactatttgtcttagagctatggaaacattattctgtttctggagtatctcacacttcaggagcattagttgaagcagtacagatacagttagtgtcctctctggacattcatttgttaactttgaaacaactggattcaaagaccttaagttaaaaacaaacttattgcctatttatggaagaaaaacctgttattttattctggtttaaaagttaaaagcattgcctctaccac

SEQ ID NO: 17866 - DNA, 224 bp, Homo sapiens
tgctatgctgcccagactggactctaattccttggctcaaggcattctctagcctcagcctcctgagcagctgggaccaaaagcatatgccacagtacctggcctccatccttcctttctgttactgcctgtgttccagactccccacagctctctcggatccttggaacaccttcttaagttcataacctgtctccagacctgttacctttcaaatacatctg

SEQ ID NO: 17867 - DNA, 424 bp, Homo sapiens
gtgacaatccctggctggcaggaagctttgatccttggggagtccagaggaagtcctatgatgtgtgggatccctagagtcacagggattgggaagaagctctataccaggatgggttgctaagatagacccattaattaagcaggaggctttgcttaacactcagttactaaaaacagagatccggtaactgataacagggagctcagcacccctcaagtgtggagtgggttttgcacaggcagtattgttattttaaggacacagaagtgcccagggggaaattcctacccacacggagaaagagcagaatacctgtgagtatccctttttaacaagtaaaagctgactttactttgaatgttaggaggctctagcaaaaaaatctcaaagatatttctaagtgaaagattcctctaaaagg

SEQ ID NO: 17868 - DNA, 586 bp, Homo sapiens
attggataaacatatgaacagatgctcagtatctgtggtaatcaaagatatgcaaattaaaatgatgagttatccttttttacccatcagattggaaaagactaagaagagtgataatgcacagagttagcaggatgtagggaaagcgatgtactcacatgggaatggtgggagtgtaattgataaaacctttccaaagccttacaaatgtatcctctttgacccagcaattctacttctgggaatatatctccaagaaatcacctggtgagtacccagaggcatttcgcagtttgttttagatgtggtttaaatacagggtctacttatctctggcctggcaggtgcggtggctcacacctgtagtaatcccagcactttgggaggccaaggcgggcagatcacctgaggtcaggagttcaagaccagcctaggcaatatggcgaaaccccgtctctatcaaaaaatacaaaaattagccaggcttggtggcacacgcctgtagtcccagctactcgggaggttgcagtgagtcaagattgcaccactgcactccagcctgggtgacagagcgagactctgcctc

SEQ ID NO: 17869 - DNA, 712 bp, Homo sapiens
taggatattatcttcacaataatattggattcaggacagatgattagatgagcaagatattatagtttatagatcggactgtatttaatatagtttgtattttaatttcagtgtctgtgatttaaattacaatgaattttttaaaattgcatataaatgcattgttttagacagattaattctttatattcatagtcatcattaaatgagtttttcagtatggtgaaaacattattttttctttctatgaagatctttgtgtaaagatttccttcagttttatttgaaagaatccattaccttcaaaatagtcatattattttttctttgccagtataagaaactaaagttattgttatgatttgcatatttatattgaattttcctttgtcatttatattatttctatttatttaaaaagtatatgtgaataggctgggtgcggtggctcatacctctaatcccagcacattgggaggctgaggtgggcagttcgcttgaggccaggagtttgagaccagcctggccaacatggtgaaactgcatctctactaagattacaaaaattagctggacatggtagtgcgtgcttgtgatcccagctgctcgggaggctgaggcatgagaatcgcttgaacccaagaggtggaggttgcaattagcggagattgtgccactgcactcaagcctgggtgacagaggaagactgtct

SEQ ID NO: 17870 - DNA, 1024 bp, Homo sapiens
  misc_feature (30)..(30): n is a, c, g, or t
  misc_feature (35)..(35): n is a, c, g, or t
ggtcgactcctactactactaaattcgcgnccgcntcgaccaattactgaatgacagaactggggtaagcacgcggacttctgactccaagaatccattagcttatttggagtttaaatagaaactttaaaaggtttcataaaattaaatgcccattaataatttttttaaaaagaagtagaaaaagtgttctttaacattatagggaatctttatagtcaacagacagctttatatttatttattgaaaaattatagatgtatatatttatggggcacagagtgatgttacgatcttcgactaccatgtgaaatgcttaaatcaactaatgtatcaagctgatatgttaatcaatttccacaactattttacattttttaggtgatgagaacatttgaaatttactcttagcaattttaaaatgttactagctatgttcactgtgttgtgcaataagatcttattaaaaaaaaaaacttatttctcctatcttctaaccatatctggtaaccaccattctactctttgtttctatgagtttgattgttttagattccacatataagtgagagcatgcagtatttgtctttctgtatttggctaatttcacttaataagcatagtattgtctaattccattcatgtttgtcacaaatgacagaatctctctctgttttaaggctgaatgcttttccattatgtatacttatttaggaccacattttctttatccattcatctgttgatgaacacttaggttgattccgtacttggtattttgaatagtgctgcaatgaacatgggagtgtagacatctctttgacatactgttttcgaatcttttgggtaaatacctagaagtgggattgctgggtatttatttattagtttaaaaaaaaaatcctaggctgggcgtggtggctcatacctgtaatcccagcactttgggaagccaaggcaagtggattgtctgagttcaggagtttgagaccagcctgggcaatgtggcaaaacctcctctaa

SEQ ID NO: 17871 - DNA, 416 bp, Homo sapiens
caagtgtggattctggaactcaaaaatgagaaggcagcttgccaagtaaacaggatgtagtggatggtgaaaagcgtgtatgggtgtgtatgaagaaaaatgaatggaattgtcaataacaatgctacacttgcagcctggaaagagtaggagagtgcagcgcgggcctcagcatctgtgttggcccagtctcttggttgattatcagagcacctgagctagccaggcctctgtcctgtcctaggtccagaacgtgcacactcactccctcagcactgaggtttcagcaaaatttaatgcctcagccccacgcattgcccgagaaagcactgggcattaaagatcagcgggaggccacaggatcacttttggccaggagtctgagaacagcatgggtaacatggctagaccccctc

SEQ ID NO: 17872 - DNA, 469 bp, Homo sapiens
agactctcctgcccatctctcctgtcaccacgggtttctccgaggcgtggcatcccggggttggcgtgatgtgggcatgagccactggctgcatgtaaaagggccgtcctgcccaccacactgccacacagatgcttctagactggggctgggctcgcgctccatccctgcccaccacaccgccacacaggtggttctgggccggggctgggcctgcgctccgtgctgctgccggcactgcgcggtttccatgtgatgtggctgcttcccacagccccacagaggacactcctgccccgtgggctgtccatgccctgagctgcctgtgttgattttggctggcctggtggggagtatagtctgacgggttgtgattttgccttttcctgatgttaatgaagttgaatgtttgttatagtcattcgggtcttgctcttcagtaaacttccttttgtttcttgcctttttc

SEQ ID NO: 17873 - DNA, 516 bp, Homo sapiens
caatcctctcacagcctcccaaagtgctggtattacaggcgtgagccaccacacctaacaaaagtttgctttttatctaaaatgacccaggcattgtcactgtactgctatttttttaaaaaaattttgttgttttgttgttgttgtcgtcgttatatagatgagggcttcctgtgttgcccaggctggtttctgacgcctggcctcgcctccttatacaccaggacagcaggactgagccaccacactacccaactgcttttatctcagtgaatgaaaatgatacttgcctggaggcttcccctcatctacccccatgtttctctatttattcctcagttaagtgggcagaccaacatccacctcagcaaaaacttcttcctgacgaatcgcgccagggagcgctcagacaccttcatcaacctccgggaggtgctcaaccgcttcaagctgccgccaggagagtacattctcgtgccttccaccttcgaacccaacaaggatggggatttctgc

SEQ ID NO: 17874 - DNA, 915 bp, Homo sapiens
ggcacgaggctgcctttctccaccagagactcttcctcagggaggacttggtgaattttattcaagcaaattttaagaaacgagaatgtgtcttctttaccaaagattccaaggccacgctcaatgaaatccttccttcctgtccacaccatcgtgcttatcagggagaatgtgtgcaagtgtggctatgcccagagccagcacatggaaggcacccagatcaaccaaagtgagaaatggaactacaagaaacacaccaaggaatttcctaccgacgcctttggggatattcagtttgagacactggggaagaaagggaagtatatacgtctgtcctgcgacacggacgcggaaatcctttacgagctgctgacccagcactggcacctgaaaacacccaacctggtcatttctgtgaccgggggcgccaagaacttcgccctgaagccgcgcatgcgcaagatcttcagccggctcatctacatcgcgcagtccaaaggtgcttggattctcacgggaggcacccattatggcctgatgaagtacatcggggaggtggtgagagataacaccatcagcaggagttcagaggagaatattgtggccattggcatagcagcttggggcatggtctccaaccgggacaccctcatcaggaattgcgatgctgaggtaccggtgggacaggaggaggtctgctaggtcacatggaagaaagaccatggcatgggcctgtggcctgaaccctggggctctgtgatggagccagccagatcatggggaagtctgcctttcaaggagtgcctttgggaccttaaaggaattgaaaacaaggatgacgtacctaattaactgctgggaaagagttaacaatgaatgttttgttcattaaaatgtgttctcagcaatctcata

SEQ ID NO: 17875 - DNA, 318 bp, Homo sapiens
tggctcacatctgtaatcctagcactttgggaggccagggaggagaattgcttgagcccaggatctcgtgaccagcctgggtctcaaaacaacaacaacaaaaaacccaaaatttacaacttacctactttgtcttcatcacatttatttaaaaagaaagagaagggggaaatggagacagtcttacgacttgtgggaaaagggaagggcagacactggtgattttcagtagggaagattcaagcacaggctgggaaaagattgattggggatgatgatgattggagcatcatcccttggagagggtatacaatggga

SEQ ID NO: 17876 - DNA, 505 bp, Homo sapiens
tggaagaagtgggcagtctgaattttcccacatggctggagcctccctgatccgaacagacccagttttctgcgggttctttgagtaatacctaatactgacatagtgctatgtgccaggtagcgttctccacacaattgaggtagatgctgttaacaccctccagtttacagatgaggaaattggagctcagtggggttatttctcagcccaagcttacatggctggtaaataggggagcaaggatttgaactcaaggtgtcttcagagcctggcctcttaaccctgaatctcccctttctaggttcttaaccctgaaactctgttctcagtcagtgatttgccatgatcattgagtgtaagagccatagatcatggaacagaatgttccaatggaatgtgcccagttacatgtgagctgaaattgcccattagttccattccccagatcaaacattgtagtgatagaaaaatagatggagaaagaaggtagacatatggatag

SEQ ID NO: 17877 - DNA, 263 bp, Homo sapiens
tttatctagaaaccaacatcacagatcctgagaaaggctggtaagaacaataaaaccagcttatttgaggggccacatatggaaagaaatgggaccatttcactttttaatgaaaaatcagtaatctcaaggtgaacaagagcttcattttccagctgcagatgaagtgacaagaggtacccaaattctgctccaatatgggttctgcctcaataacaaatccctagaccagtgattctccctgaccctgctgccaggcagct

SEQ ID NO: 17878 - DNA, 324 bp, Homo sapiens
agcaaacactactggggcattggttggacccagacactcaacaatagctcatttaatcctcacaatcaccctctgagatatgtagggactattctaatcattcccaatttacagatgagcaaactgaggcatagagaggtgcagaaacttgcccaagctcaaacagacttggaacaggggcagcttggcttcaaagtctgtggtcttagccacctcgcttcatcagctgcctctcctttccagaatgtgagaacctgagtggaagaggtacggcttttctgtatgggcttgaagccaacaatcacccccaactattcaccatat

SEQ ID NO: 17879 - DNA, 459 bp, Homo sapiens
acagattggaagcaggcttcccccaagtgtgtttccctttgtaatgcccagtgtcgtaacgccactatctatacttttcaacacaattcccaagtgctaccctctgcatggcagaaactatcaaccgtggatggtttctttttagcttgtccttcccgttctacagcatggaggttaagagctctggctttggttccaatcgtgtcccctttcctccctgtgtgttattgattgacctctctgagcccattgataaatggagttaaaaatttatactcactggggtggtgagaaggttaagggcaatgatgtatacaagacattagcatttgctataaggaggatgtatctcagttgccatatttgtatcactaaccatttgaagattttgtgttcaagatttggaagagaatcttcttcccaagccagcattttatattttgcattaaaaaaaaccac

SEQ ID NO: 17880 - DNA, 489 bp, Homo sapiens
tccagtatatcttggtgctgttgataaagagtcagtctgtaaaatatttgaagagattattctgagccaaatatgagcagccagtagcccatgacacagccctcaggagatcctgagaacatgtgccccaagcagtcaaactacaagtttattcatttcaggaagacaataaaatatcagtcaatacatgtaagaggtacattggttggctgggcctggtggctcatgcctgtaatctcagcactttgggaggctgtggcaggcggatcacctgaggtcaggagttcgagaccagcctggccaaaatggtgaaaccctgtctctactaaaaatacaaaatttagctgggcatagtggcaggcacctgtaatcccagctactcagggggctgaggcaggagaatcacttgaacctgggaggcggaggttgcagtgagccgagactgcgccactgcacttcagcctgggcaacagaggtgactccgtctca

SEQ ID NO: 17881 - DNA, 232 bp, Homo sapiens
ggaaggttttcagaaagcaatggcctattccttcatgttaatacattgcgaacttggatttggtgtaaatcaagccctgagaatattgctctgaatttctagcttaatttctgagcaacattctaaagcagttcattaatttactccaaaaacatttcttggacacttcggtgtaggagatatatattgcatggtccttaacctaaaaaattcagagttaaaacttggattt

SEQ ID NO: 17882 - DNA, 846 bp, Homo sapiens
tgggggggtttctttttgctttttaagggtatcatgacccctctttccaggggaagcacaagaagtttatgtgcccagctagatgtcccaagccaggaatgagagctgtgacatctgaacccgggttctgaaactccctgcctcagagcactgcctgctccatatgacctcaaggaaggccagactggagggtcattcacctttgccaccacgcttacaccaggccctgcccaagacctgttgctcctccctcccaggcagaaggaccggggagtcctatccaggctctcctggcttcttcccatcaacaaggccaaacacaaccactagcactttctgttgtcccaggagatccaaaatataccagcaatggtgtaaatgtcccaagacagaaaacagaaatggagtcaatttagtataagaggaccatgagttttggaaattatggaaagtcgacgctagcttagttctgtctcccaggctctcttcagataccagggatgctgcctgtgctcaccgtctttctattctcgacacgatcaatcaagggataccgtaacacatccgcgagggaactgccctgcactctacagagacctctctgcattctaagaaccacatacgggaggtttcatcagatgtaaggcacccaggatgagatgggggacagccttgtccctcactgcgggactgacctttgttccctaagcgtgccaaccagcccgcaatcaactgacctttgctagttgagcaatcgattcagggaaggaagagcagatacaaggagatcacccacccccatcaggtcccaggacgcccaggaaggctgaactcacatctttctgt

SEQ ID NO: 17883 - DNA, 426 bp, Homo sapiens
ctacttactttgtttaaaaccttgcacaaggtcaagtccttaggacacctgagtgtagggaatgagagatccaaaaaggcttcaccgcaaagcccatcatttagtaggaaactaggcccaatttaaaaggtggttagagccggggtggtggctcacacctgtaatcccaacactttgggaggctgaggcaggcagatcacctgaggtcaggatttcgagaccagcctagtggacatggtgaaactctgtctgtactgaaaatacaaaattagctgggcatggtggcatgagcctgtaatcccagctcccagctactcaggaggctgaggcaggagaatcacttaaacccaggaggcggagactgctgtgagccaggattgtgccattgcactccagcctgggcaagaagagtgagactctgtctca

SEQ ID NO: 17884 - DNA, 545 bp, Homo sapiens
tataacattttatttttttcttctcagcaaggcagtttacttctatagaagggggcgccctcacagatggagcaatgccgtgaagaggacgccctgcagacccactgcccaccggctccctcccccgcatccctgcaaccccagaggcgaagatggcctcaggagtgcaagtagctgatgaagtatgtcgcattttttatgacatgaaagttcgtaaatgctccacaccagaagaaatcaagaaaagaaagaaggctgtcatttttttgtctcagtgcagacgaaaagtgcatcattgtagaagaaggcaaagagatcttggttggagatgttggtgtaaccataactggtcctttcaagcattttgtgggaatgcttcctgaaaaagattgtcgctgtgctttgtatgatgcaagctttgaaacaaaagaatccagtacagaagagttgatttttttttgtaggcatgagaactagcacctctgaaaagtaaaatgatctgtgcaacatccaaggatgcaatgaaaaagaaatttcaaggcaaa

SEQ ID NO: 17885 - DNA, 415 bp, Homo sapiens
gcatatttttaatattttatctgagtgcagctaattattttgtttcctaagtatctaatttggtttactgaatgttttagcagtggtagtattgctaccatttgatgaagtaggaagtaaaatatgcatggttgttacttgttaagagttattacaattagtgtataataaatgtttgatttcatggttattatatacttagctcttttacctttctcattcatgaaagataattttaaaaactggtaaatttttaaacagtcattctgtgcaaaaatatagcctttaaacaacaacgacaaatatatatatatatttatctaccaacaactaagaagtatgatctaagtgcagttaattgattcacactgagcttgtaaatttgatttcagaaataatagttcaggatttaatt

SEQ ID NO: 17886 - DNA, 461 bp, Homo sapiens
tcactgagcacttcctgggaacttatttttttgctgctgagggggagtcagtctttaaacaaattgcaattgtgttagagaaaaaagctttatatgcaaaagtaattgatgcaagatacaagacaatgacaaggccatatggcccaagaggtgcagagtgtaagcactctggcatcaaagataaatagggaaaaactataatcataatacaatactgttaatagcagcagcaactgggccttgtgtttgcactgtgtgctgcattgagacaattaaatgttctatgctctggatccaaattcctaggtgtgaattcagcctattgggactgtcgcttgcttactctataaacttggtgaagtcacttcatttcccaatttttccatcaaaacaaaaacaattcccatcttaccagctggttgtaagaattaaaagatttataaagcaagcaacaaagtgcc

SEQ ID NO: 17887 - DNA, 753 bp, Homo sapiens
cagataatgatccattttaagctattggcattgcaataaatgcagttattggatgtgggtggggattctgaattttgttttctggtctatttgtttaaaaaaacaattttttttttctgaaacaagaaataaacaacagtgaaagtatcctcctgccaaatgcagcttgaagacagcctaatgacatttgggtcttaacaatcttccaaggacaacaattctgcctccctgggaagcctctaacatctgtatatattcagctccactgaatgttgcatgaagtttcattgtagaaaattgacacatgccttctgattaatctgttgtttcactcagtcttgtaaagggcacaccctgtagtttccatttgttcaatcatgtattttcctgctcacttaataaatctttttaaaaaataaagaaggaagataacaaaatgatgtcatatgaagcaatataacagtgaaagaattttttttttggtcctcattactttttgtgtcttttcacaaatctgttgagattaaggatagtgtgtaattcatgctaaatagctaggatcaaggtcttcacctttccaggaccaaaagcattttggagttccatggtgcttagttacagattcctgaggtcctgttgaaaaatgcaggacattagtttcagggatagatggaaaatatgaaaaagatgctaagaaatgggacaaggtgtcacagtcattgtgaacaatctagattatcacaaactccagtt

SEQ ID NO: 17888 - DNA, 2103 bp, Homo sapiens
tttctttaacagaattcagtatttaatatttctagtcaaaattgttataattagatttttgcttttttcatttaagaagcaatgagtgatccttgtctagtgtgtctcagttattactgtagtttaaaacaacaaacaagtattaccttccacagttctggatcaggaatctaggagctgcttaactgggtggttctgtcttgagatctcagaaggttgcagtcaagctgttagccaggactgtaccatcttgaagcttgacaaggctagaggagccatttccaagatgtcttgcttacgtggctcttgggcttctgttcctcactgtgtgggtatcacacacagtgcctgatgctcacgtggctcttgggcttcagttccttgggcaccagttgcctggtggacaactggtatgtggcttcccctagagcaggtgatataagaaagtgagcagaaaccatacttttttatgacgtagcctcaggtgacattatttctgccatattccatgagtcacacagaccaaccattgaatcagcttggtatagtgtgggaggggactgcacaaggatgtgaatactgggaggtggatatcattgggccctctaggagactggctatcactgctcagagaagatgctgggcttcgttgactcccaaggtcagggtagttttggttaggttgtgttttattagtctctaaaaggagtagttttctaaatgagggttataaagcactgcactttacagttattcgggatataaaagaaatagtgggtctaaaggctgtgctcttgtggttgggttttcagtggggaggggagactagtctgtctcagactgatgctgttctcactgatttgaatatttctgggaaattggatactacagtcacaaataggaacagtaagcctatagaagtttttcagggagtaaatattttctatggcagtgtcctgaattggttctcccttgcaagactgaactgtaggaacttagtcctagtttatgatacagccaagtaacatagtcacatgggaaaaagagcttgagtcagatttcttaatgtgtgttgttaacttggtagaacattgagaattatttaagtcagagaacgatctgttactggggcagaaattctcaaccttttcagttctccaaaatttaagatacttgatttcttaggtaaaatgtttttgtttttgttttggagacagagtctcgctctgtcgcccaggctggagtgcagtggcgcgatcttggctcactgcaaactccgcctcccagattcaagcaattctgcctgagcctcccaagtagctgcgactagaaagcgcatgccaccacgcctggctaattttttgtattttagtagagatgggggtttcaccgtgttgcccaggctggtctcaaactcctgagcttaggcaatcctcctggggcagcctcccaaagtgctaggattacaggcgagccatggcgcctggccagtaaaatgttttctatctagaatgaatcaaggtattttccttgctcagtagcttctagaataagaaaaaaatagcagcaagatctgattcagaaatagttgggagcagaaagttaatatgaaggagttgctacttgttaacagcctagagttgagatctagaagaattattacctttttaaatttgtgatgaaagcttaaatccagcatttgggaagttactctattggctgaactattttggagtttgtaagctttgtattagatattcctgatttaactgaaactaatttgccacatagctttaatttcatcccagttttacttgttttactgtcctcaaaaactcaagacatctgaactcaaaggatctaagcagtataaattaaagcacatgttgaatcactgtagctttcgtaggacatctgattataatgcttttctttgtttctttgtccatactgaacttgtctagtttatctttgagaaacatttgctagtatcaaaaatcttctgtaaagatttgaacaatcttgaattctccttgtcactagccatctcttcccctaaagtataataaaactgtcaggtactatatgtgtaattgcttatgc

SEQ ID NO: 17889 - DNA, 1979 bp, Homo sapiens
gcggccgcctactactactaaattcgcggccgcgtcgaccaggaatctaggagctgcttaactgggtggttctgtcttgagatctcagaaggttgcagtcaagctgttagccaggactgtaccatcttgaagcttgacaaggctagaggagccatttccaagatgtcttgcttacgtggctcttgggcttctgttcctcactgtgtgggtatcacacacagtgcctgatgctcacgtggctcttgggcttcagttccttgggcaccagttgcctggtggacaactggtatgtggcttcccctagagcaggtgatataagaaagtgagcagaaaccatacttttttatgacgtagcctcaggtgacattatttctgccatattccatgagtcacacagaccaaccattgaatcagcttggtatagtgtgggaggggactgcacaaggatgtgaatactgggaggtggatatcattgggccctctaggagactggctatcactgctcagagaagatgctgggcttcgttgactcccaaggtcagggtagttttggttaggttgtgttttattagtctctaaaaggagtagttttctaaatgagggttataaagcactgcactttacagttattcgggatataaaagaaatagtgggtctaaaggctgtgctcttgtggttgggttttcagtggggaggggagactagtctgtctcagactgatgctgttctcactgatttgaatatttctgggaaattggatactacagtcacaaataggaacagtaagcctatagaagtttttcagggagtaaatattttctatggcagtgtcctgaattggttctcccttgcaagactgaactgtaggaacttagtcctagtttatgatacagccaagtaacatagtcacatgggaaaaagagcttgagtcagatttcttaatgtgtgttgttaacttggtagaacattgagaattatttaagtcagagaacgatctgttactggggcagaaattctcaaccttttcagttctccaaaatttaagatacttgatttcttaggtaaaatgtttttgtttttgttttggagacagagtctcgctctgtcgcccaggctggagtgcagtggcgcgatcttggctcactgcaaactccgcctcccagattcaagcaattctgcctgagcctcccaagtagctgcgactagaaagcgcatgccaccacgcctggctaattttttgtattttagtagagatgggggtttcaccgtgttgcccaggctggtctcaaactcctgagcttaggcaatcctcctggggcagcctcccaaagtgctaggattacaggcgagccatggcgcctggccagtaaaatgttttctatctagaatgaatcaaggtattttccttgctcagtagcttctagaataagaaaaaaatagcagcaagatctgattcagaaatagttgggagcagaaagttaatatgaaggagttgctacttgttaacagcctagagttgagatctagaagaattattacctttttaaatttgtgatgaaagcttaaatccagcatttgggaagttactctattggctgaactattttggagtttgtaagctttgtattagatattcctgatttaactgaaactaatttgccacatagctttaatttcatcccagttttacttgttttactgtcctcaaaaactcaagacatctgaactcaaaggatctaagcagtataaattaaagcacatgttgaatcactgtagctttcgtaggacatctgattataatgcttttctttgtttctttgtccatactgaacttgtctagtttatctttgagaaacatttgctagtatcaaaaatcttctgtaaagatttgaacaatcttgaattctccttgtcactagccatctcttcccctaaagtataataaaactgtcaggtactatatgtgtaattgcttatgc

SEQ ID NO: 17890 - DNA, 442 bp, Homo sapiens
taggaagtaatttaggtaatgtacctaaaagaatgaggcagcgcctggtaatgataagcaattaatgaatgttaggtgggaaatttccggacaccaggggctaggattgggtaggaggagaggggcagtgattgttcatctgggtgtggggtgtgaaaatggttccaatatctgtatccccttctgcatagagtctggtactgcatgcacagccccagattgcttcaagccctggattcaaagggctgagtgggaaaaatcagggtaccaggggtcaggaaccaacaggagaccatccgtggagacccctttttcctttggttcccaactcctcttgcatttttgctctgcaagttgaagctgatttctcatttgccccaagctagtccctgaattaaggagtaggaagtggtagcgagagagctgatcctctctgtgcccc

SEQ ID NO: 17891 - DNA, 442 bp, Homo sapiens
agataccctttgcctgcttcagtgccaagtgaacatcgcagagatctgccttgtgtctccctgcacccctggctgcaggggagctcctgctgcctcctctggagctggtgggggcctcactgccatccttggatccctccctgccgtcagcctgctgtcctcagtgcactgggaggagggggtgcgctgtggttgtgttgagccttcataggtgtcctctggtgggcttagaatgggggttcttaatcccccccagtatgtggatagaattcaggggtctgtgaacatggatgaggaaaaaataacattattatttattactaatgtagctaaaatatgtagtgtgacctttgattataaatgtagacaataaacctcacagcattagaaaggcctgtgactacccacataacaaacaagcacatgtagtccctgaacccaa

SEQ ID NO: 17892 - DNA, 237 bp, Homo sapiens
aacactcacgtggtccaaggttatggcctcccagctatcccctggcctccaggcttaccttcctccatccagccctcctccccctgagggtcaacgtccctaaccacagttcaggactatcactcctgggctcaaaacctccactggtccccactgactctagaagaaagttcaaattcttctaccaggcagtcaagggctctggtctagctccaatcttcctttttaatcttgcct

SEQ ID NO: 17893 - DNA, 558 bp, Homo sapiens
gcctctggcttaggtactccagcctcacctggtctccagatggacctcaactgctcctgcgacactgataaaggatgccgggtttcggggccttgggatctccattttcatgccagaggatagaatgtccctgcggcaggagctgggtcctgcacttatgccagcttctgcaaatgcaaagagtacaaatgcacctcttgcaagaagagtgagtgtgggggccttccctgggaatcagggtgctgggcagagtcagaggagggaaccgagagctcagcaggcaggagcaggacagtgacaagcttcccacatcccctttctgactgctgctcctgctaccctgtgggctgtgccaagtgtgcccaaggctgcatttgcaaaggggcatcagataagtgcagctgctgtgcctgatgctgggacagccctgctcacagatgtagaaagagtgacctatataaacttggaatttttttccatgcaaccatgacccatttactgtatttgtctctcttttatgaaatatgtgaatgataataaaagttgttgacttattct

SEQ ID NO: 17894 - DNA, 928 bp, Homo sapiens
agactgtttctacaggtgcagtgtgccaatcagaagaaaggtggccaggctcaggagaaaggacaggagagtgactctggcaggcttgctccattgtagagatgagatacaccaagatagtgacttcccagcttttctccccaaagcacccctaatagctgagaagaatctggaggcatagctaccatcacagctacactaaccaccatactttactgtatccttcaggtgtctgtcctagctagttttgtggtctggctccttcagtccctgcaacaagcctgtttattttcattatattgatgaggttatagagcttggacaagttacatgacttttcgaagatcacatagctaataagtgtcaagagtcttattctcaaaaccctggtctgtccaactacaagcctgtgctcctgactccactattctgcttaccctaagcctaaagctgcccacttcaagctcaaatcctcttggaggcttcatgctttaaaaaaaaaaaatccatgcaattttttgcatcctaattaataatatatctgtgtgttttagtgtaaatttttttttttaaattaccaattcagttatttagctttttattccccaaatctttggtaccctaggcagatgtgtcatatttatcctgggctttatgtacctctggtttgagggactcttgaacttcattttaagaaacatggcccaatgagtacacagtcaagtcttcatgtccctgaacactgcattataaaatcagcactccttgttctttgtatatttgtgttatcaaataactatgtgattataatctggcttctcatataccataagtgcagaagagaatcaaaagattgagtacctgattccctaaactgtcaaatttcccgttgtatattaataaaatttgtatcgtttcacaaataaga

SEQ ID NO: 17895 - DNA, 243 bp, Homo sapiens
  misc_feature (168)..(170): n is a, c, g, or t
ttttcctgcctcaggtttatttgtacaaatagcacaggaggaccccagccccatgcagatgatagcccaggggtgggggtggggggtcgcaccagtccttctgtcctcatgttggcagagatatctactctgaagcctttgtaggggcctggtgcgaccccccacccnnncccctggctaccatctgcatggggctggggtcctcctgtgctatttgtacaaataaacctgaggcaggattaa

SEQ ID NO: 17896 - DNA, 600 bp, Homo sapiens
ggaggatccctgagtgggggttgaggctgcagtgagccatgatcaagccactgcactccagcctgggcaacactgagacactctctcaaaaacaaaaataaaataaaggcaaggataaaataaaggcaaggatatggctatcactaaagtcagaatcatgagcatgtttaggaataagctggctatgttcagggaggcacagacaggggctttggggagggatcttctcacttctattccttcaactgggtattaatgagttattttttaaaccttacatacaagttttttttgcatttttctaggtactatatacaacatgtgctatatacaacagactcatgtatataaatgtgtatttgttgttgagaattttttttggaaggagacacaggaaattggtaagcctgattacttccataaaggagaactggggttggggtatctgaatgacagaggctgggaggtggaagctgtagtgagccatgatcacaccactgcactccagtctgggcaacagaacaaaacctgtctcaaaaaaaaataaatagaaaataaaagaaagaaaacaaaaataaaacatgtagttttgagccactt

SEQ ID NO: 17897 - DNA, 300 bp, Homo sapiens
ggctgacagtaagttatatacttgctatcagcttgtgttttttttttttaagccttattagggtgtgtctaaaatacttctactctaacactagtttactttttttttttcttttgtgagacaggatcttgctgtcacccagggctagagtgcagtggccaatcatgggctactgcaggccttgaactcctgggtttaagcaatcctcctgtctcactctcctgagtaggctgaaccacagggtgcatacccaccatgctagggctaatttttaaattttagggtctccctttgttgccc

SEQ ID NO: 17898 - DNA, 503 bp, Homo sapiens
gggaaaaaagcttttagggcaaaaatgctttggataaaattccaaaggtttaaatttcacacctttgacagaagtcaaaggtctagataaaacctagatatatgcaggaaagaaaaagatcttctagataaaactgagatatttgcaagaaagaaaaaatgaagacgtcatttttattttctaaaactcactacaggccgggcattgtggctcacacccataagcccaacatttgggagatcaaggcaagaggatcactttaggctgggagttggagaccagcctgggcaatgtagtgagactccatctgtacaaaaaaaatttttttttaattagtcaggtgtggtgacacatgcctgtagtcccagctacttgggaggctgaagtgggaggatcacttgagaccagaagttcaaggctgcaatgagctgtgatcatgccacttcactccagcctgggtgacagagcaagaccctgtctatctctacaataaataaaataaa

SEQ ID NO: 17899 - DNA, 758 bp, Homo sapiens
ccacctataattttcccttgtaagacaattatttcaatgcttgtggcatttcattttatgtgaactcctccaggtttgagtgagctattcaggtcctgcttttctatttgtcatcactccttagaagggaaccaatatgtgctgagcccccctcatggacctgttcacacaatcccattcattccttccccgccaaggtatcattcaccttacctgacagatgaagagactgaggctcagagaggctgggtaactcgcccaggattccaacctcacgctcttcccaggccctgctcctctcctagagctcagggaccacttctgacacttttcttgttttgagatggagtctctgtcacgcaggctgaagtacagtggtgcgatctaggctcgctgcaacctccgcctcccgggttcaagtgattctcctgccttagcctcccgagtagctgggactacaggtgcacgccaccatgaccagctaatgtttgtatttttagtagagacggggtttcaccaggttggccagcctgatcacaaactcttgacctcaggtgatctgcctgcctctgcctgccaaagtgctgggattacagaagtgagttctgacccatttttaatgctgtccctccaagccctcctcaccgccttccatgacatctggggcaaccacagcctagactgtcaaggggtacccacccatctcggagcaaacagagcgcatcgctttccttccttgggccctgactgcacccgcc

SEQ ID NO: 17900 - DNA, 481 bp, Homo sapiens
gctgagaaagctcttcatttccttcattaattttgaaattcctttattccttctacttgttaatagtttagtattattttatgaaagtagatttccaagctgttagggattttatgtagtgttgtgttttttttgttttgttttgttttgttttcagataaaatttattttgaagagccagattagaaacaaatatttagaggtttaagacttttaggccgggtgcagtggctcatgcctgtaatcccagcactttgggaggccgaggcaggcagatcacaaggtcaagagatcgagaccatcttggccaacatggtgaaaccccgtctctgccaaaaatacaaaaagtagctgggcgtggtggtgcgtgcctgtagtcccagctacttaggaggctgaggcaggagaaacacttgaacccaggaggcagagattgcattgagctgagatcacgccactgcactccagcctggcgacagaa

SEQ ID NO: 17901 - DNA, 481 bp, Homo sapiens
tgtacttcctactggacttttccatttgctgaagtcaggagaaccaacatggcttgtttgaattaaataaggtcactgttcgaagaatcaatcttgaggaagagaagtaagagccagtagtagtattgcaaagcataaccctgttcccaaagacacgctgagccctggagactagggcatgaggcaaaggagctgaagaacgctcaaaactgttctcaatgattattccattttggggcaaatgtacatgaaaatggtagtaccagagaaacagctatatgccagaaagcctgagctctgaagagaggcatggagaactcaatttcactaagtccagaggatgactaaaaatgccaagataggctcaaggtgaaatagatcccactggaagttcagaaggacagttttgagggtttctaccccagggaaaccacttagaattgtaaactggatgtttacatgatgaaattggccttgagcc

SEQ ID NO: 17902 - DNA, 485 bp, Homo sapiens
gcaaaacatttaatagaagtattatacaggagagcaaattgaggctcacaggggtaagggaacctgcatgtagtcacacaggcaagctggggccaagcacgactcccctactctgactcaagtgctctttctgccaacaggttccaggtctgagggctctagctatgggatggtgaagagacggagttggcctcgggccttggtcacgctgaaacaagaagtggcccaggtgagcctcatacagactctgtacccaactcagggaacaggagaccactgtgggagaaaagtatgaccaggaagatttttatgtatttgcagaaaatatggtgcaatttctcaatgaaattgatttctgagaccacagagctgccatttaaaaaaaaaaaaaaaaggccaggtgcggtggctcacacctgtaatcccagcactttgggatgccaaggcaggtggatcacgaggtcaggagttcaagaccagcctgg

SEQ ID NO: 17903 - DNA, 424 bp, Homo sapiens
agtacactttgattaatgttattaattggctattgaatctatccaactgattggtctgctcctgattaacacccttttccagtccaaaaggagagcaagagaaatcctgcctggagccctgaagaaatagaatatataatctttgttgcattcttacattttacctctccaagaagagtttcataaaagtaaataaagttaggttagtctaatacatgtttagtaaactcatactgcctccctgaaatgttcacagctttcttaataacgtaggagccatggccacatgggtgaagatgctaactcttctagaaaagaacaacccacggcaacagatctataccaacatatacatatgagacaagcatgctccagctttttactttagaaagggatgggggaaaaggcatgctttgtagggaaa

SEQ ID NO: 17904 - DNA, 335 bp, Homo sapiens
acatatgccctcctggcttctgcacatctagattcctgttcccctctccaaaagctgttgctagcagtcacatttttttctgctgatcaaagaagaaaagcaaaatccatctctccttctctccctccctccttttctctctccctccctccttaaatccctttttcccacttaacttttggaaaaacaattgcgcaagaaattagaaaaccccaaagatagtattttcaaatttcaacaaaattataaaagatacacctttttatttgtgcctcaggatgcacagaaaataatggattttcatatggaaaaaaataaatttcaatgtttcaaga

SEQ ID NO: 17905 - DNA, 302 bp, Homo sapiens
ctcaagccatccacccgccttggccttccaaagtgctggaattacaggcatcagccacgacggccggcacagaggtctaattattaatcagaaggttgcctgttgaggccgggcatggtggctcatgcctgtaatcccaggactttgggagcctgagacaggaggctctcttgagctcaggagttcaagaccagcctgagcaacatggagagaccctgtctctacaaaaaatacaaaaattagccgggcatggtaactcacgcctgtggttccagccacatgggaagctgaggtgggaggat

SEQ ID NO: 17906 - DNA, 492 bp, Homo sapiens
ctctctctcatgctctaataactttgttcccggttactcagtccctgcctcctattaacctggccttttctacccttcagttaacctaaccccactatcaatcaccttgattgtctggccctcagaatgtactttctgcccctagtcatctcacccagcccagtgctggccaatagaaatgtaatgagagccacagatgtaatttaaaattttctagtagccacagtgaaaatgtagaaggatataggtgagcttcattttagtactgttttatttggcacaaaatatcaaaaatattatttcaacacataatcaattatgaaaattattaatgagatgttttatactcctcttgtaaaagtaagtctttggccaggcatggtggtttacacatgtaatcccagcactttgagaggccaaggcagggggaccacttgagcccagaagtctgagaccagcctgggcaatgcagtgagacctcattctgcgaaa

SEQ ID NO: 17907 - DNA, 420 bp, Homo sapiens
tttggaaatttggggaatttccaaaaccatgggaaaggccacagctacaaaggccacagtccacagtcaccctcaagcagcagtaaaccttaaaggaacccagggtcacccacccatcccggctcacctgtatccatttaccttcatcctaattcttaagaaagttgtctttaggaccgggcgcggtggctcacgcctgtaaccccagcactttgggaggccgaggagggcggatcacgaggtcaggagatcaagaccatcctggctaacagggtgaaaccctgtctctactaaaaatacaaaaaattagccgggcgtggtggcgggcgcctgtatcccagctactcaggaggcttgggcaagggaaatccttttaccccgggggcgaaggtttccatgtgtgtggacgcgcccattcac

SEQ ID NO: 17908 - DNA, 584 bp, Homo sapiens
cagtaatttgcatagagaagagaaagcagttcctacaaggaagcatggggcagtggagtaagaacatagggtgaggaactgacgtccattggagtatgaaaagatgacttctgggtgaggtactcaatgtctggtctactctgctggagtaagaagcgtggtgggtagggggatgtggaaatacaatgttctaaaatgtcacctaaacaagaactggttggtgcaagagggcattcccttagaacatcttagcatgttcacagaacaggcaccatcacccaggcccagcatgggggacagggaagaagttgtgcttcttcaaaaacggttccttttcaacatttttattttttatttgtctgggttttttgtttgtttgtttgtttgtttttgtttttgttttgagaccctgtctcttaaaaaaaaaaaaatgctgggagcattttgcatgcctgagtgcctgaggtcccagttactccacagactgaggtgggaggatcttgagtccaggaggttgaggctgcagtgagccatgatcataccactgcaccccagcctgggtgacagtaagacactgtctcagg

SEQ ID NO: 17909 - DNA, 307 bp, Homo sapiens
gaatgttgagccatgtgattgctttagttattcaaaagtaaataaagttttaaagtgttgaaaaatatctaaaaaataaaaacaaaaaaaaaggaccaggcatggtggcatgtgcctgtaatctcagcactttgggaagctgaggcaggaggatcacttgagcccaggagtttgagaccagcctgcacagcacagtgagactctgtctctaaaaaacaaaaagaaaagaaaaacagaccgggtgcggtggctcacacctgtaatcccagcactttgggaggctgaggcaggtggatcacctgaggtc

SEQ ID NO: 17910 - DNA, 159 bp, Homo sapiens
tttcaaaagtttgaaatgtaaaattaattatgattttcaatgtaacccacatacattattaataattgttacattattaatggctcacacctgcacaaggattgtattcattatttacatatgttaaatgtgtttttaaacttaatactcttttcttgc

SEQ ID NO: 17911 - DNA, 532 bp, Homo sapiens
ccagcatgagtggtctatctagtgagtggctgggcacagttgtccccatccatggcggatgcctggtggcagcacccactgggtctcagcccaagtcttccgtggatcctggcaaaatattgatgtccttttccacataatatttaaggtatttgtgtagagtcttatgtacttgcaggagcagttggttaaattaggtacctagaagttgagtaattggcttgagaaacgtgtgcattgaaaatcggtaagttaccaggcgcagtggctcatgcctgtaatcccagtgctctgggaggctgaggtgggttgattgctttgagcccaggagttcaagaccagcctgggcaacatggtcaaaccacgtctctacaaaaaatatgaaaattagctgggcttggtggcgtgcgcttgtagtcccagatactcaggaggctgaggtggaaggatcacttgagtcagggatatgaggctgcagtgagccgtgatcgagccactgcactccaacctgggcaacaaggagaccctgtct

SEQ ID NO: 17912 - DNA, 288 bp, Homo sapiens
gttaaagccaacaagcaccagatcagacaggctgtgaagaagctctatgacagtgatgtggccaaggtcaccaccctgatttgtcctgataaagagaaggcatatgttcgacttgctcctgattatgatgctttcgatgttgtaacaaaattgggatcacctaaactgagtccagctggctaactctaaatatatgtgtatcttttcagcataaaaaaaataatgtttttcataagaatgacaacttaattagaatcaaatctataagctttaagattttacgtttct

SEQ ID NO: 17913 - DNA, 433 bp, Homo sapiens
ccgttaaaaaatactgttaagaaaatgaaaatgcaagccacagacttgaagaaaaattacaaaacacatccgacaaatgacttgtgtctagaatatataaagtcctaaaaagaagcaaccgtccataagacacattcactcgtgtgccatgtcagtttaccattgccttggcaacacccggacattacttccccttcccatggcaaggactcaacaacccagaagttaccacccttttcctagaaactcctgcataatctgccctttaatttacatataattaaaagtggctataaataggactgcagcactgcctctgagctgttactctggacgcactgcctatggggtagccctgctctgcagggagcagcacctgtgctgccgctatgcatggccgcttcaataaaaattgctgtcttaacaccaccag

SEQ ID NO: 17914 - DNA, 188 bp, Homo sapiens
ctggacagacaaggaaggctcaaaagctaaaatagctattgcattagcaaagtgacgtcagcgcactgttgctttaatgtaatggtttttatagtttgtaaaattttaaaatcaggcatagattttttgaaaaggaagtttccccgtgtggttttggagtgctctgtcagctcatgcagtgaaagcct

SEQ ID NO: 17915 - DNA, 463 bp, Homo sapiens
aaattaataattttcataacataaaagttaaaacttacgaatgacagtagaaaccatttttaagaggtggaaatacaagaccttcattgggagaagatatttgcaacatgtaacaaaaaactaattcaggctacccaaaggcctcccaggattcagtaagaaaatcactaacaaacagtccaggtgcagtggctcacgcctgtaatcccagcactttgggaggccgaggcgggcggatcacctgaggtcaggagttcaacaccagcctggtcaacatggtgaaaccccgtctatattaaaaaacacaaaaaattagctgggcgtggtggcaggtgcctgcaatcccagctactcaggaggctgagacaggagaatttattgaacttgagaggcggaggttgcagtgagccgagatcgtgccattgcactccagcctgggcaacaggagtgaaactccatctca

SEQ ID NO: 17916 - DNA, 502 bp, Homo sapiens
gcatcttgtgttgtaatatttcgtattttgtccttggttcatgaagcatttgcatgtcttacaacaaatcttgtaaccatgcctgactttatattactgaggtgatttttggaaagcctttaaataatcacagaataagggctggttgccaagggaatcaaccatgtgattagagggttagaactttcaaccctccctctcgacctctggagaagggaggactggaggctgaattaatcaccagtggccaatcatttattaataatcaatcatgtctatgcaatgaaaccgccattaaaaattactaattaaaagggtttttggagctactgcatgatgaacaagaacacatctgtgtgctggaagggtggtgcattccaaactccacaaggacagaagcttctgtgctcaggacccttccagaccttgccctatgtaccccttcatctggctgtgcatctgtatcctttaatatatcctctgcaataaatctgtaatcgta

SEQ ID NO: 17917 - DNA, 392 bp, Homo sapiens
ctcaggggtaaggaatcaagacccacctagtgtgatgaataaacccagactctcagcaatgcagaaagaaaccagctggcgacttgggggaaaggatcctcagatacaactgcgaccaggtaactctgtgcacagaccaagcctagtcaatgtaaagacaatgaggatgaagacctttatgaagatgacttccacttaatgaataggtttttggagctactgcatgatgaacaagaacacatctgtgtgctggaagggtggtgcattccaaactccacaaggacagaagcttctgtgctcaggacccttccagaccttgccctatgtaccccttcatctggctgtgcatctgtatcctttaatatatcctctgcaataaatctgtaatcgta

SEQ ID NO: 17918 - DNA, 512 bp, Homo sapiens
acacagcttcagctccaggaaggtgggctccttgctggccccacctggagctcctctgtccagctgtttatgcacacagcaacctgggcatgcctctcccaagtgcctaaccgtgccaggtgctgggttcaaaaacctccccctcaagagaggctgccacatgcctcgtgttgagagaccaatgccccaggagctgtgggatccctcctccccaacagagccaaatcctttctttcagggctttcaagttccactcatcctgggacccactccttcctgatcttggcctcgctgctgcccacgtgtagaatcaagtcactctctgactgctacgtgttgttctgggcttaacccttgctgagtggtcagttctgagaaggcagaaattgcctcttgttttatgtgtcttcctattcctctgtccagtcccctgtggacacagggtaggtgcttaataaggatggaatcttggactgtctgaaggaccctcattgctcattggtcccctgccc

SEQ ID NO: 17919 - DNA, 398 bp, Homo sapiens
atgcagcataccagggagtgcagagggcctcgagaagcttgaaaggttaaggaagagaattctccccggagcctccagaaaggagcgcagctctgccatcgcctggatttcagcccaataacaccagtgttagacttttgatctgtagaactataagacatttgtgttattttaagccactacatttgtggtaatttctttacagcagcaaaagaaaactaatacaccagtggaaattaaaaactacataaaataataatgttacatatcaaagcttttgagattctgttaaggcagtaattatagaaagtagacagccttaaaatgcccatactgaaaaaaatttcagataataaagtatacaacccaagaagttagattaatagcagagtaaatgc

SEQ ID NO: 17920 - DNA, 1248 bp, Homo sapiens
gtttttgtttgtttttattgttcttatttgttcattaaacaaaaacttttgatctctgcagtattcccggcattatggtaggcaatgggtttatagaaatgagagatacattcccaacctgagtggaaatccagttcagtttaattggatctttttcctgatttcccatgaaaccttggactaattacttctctaagtttccatttccttgtatgtaaaataggattggatcagatggttagtttataaagtttccttcaccactgtaagattgtttggtttaaagtaaataaatatgaccaccttccttgccattttaaacttgaagctattttctttaattctgcctgttgtagtttgaatttcaaagtatcttactgtaggtgttactgttgttttacgctgaagaagtaagaagccaaattttatagagatggttttatcattaagtaaatgatgaatttatttattagttagaatcattgtaaacatctattaatgtggttactttgcccatggtgtgacatagttcatattgcctcaggtgaaggcttcctgttatactcacaacaacaaatatctcaaataatttttccagaagtcattatccttgctgcttttttccctctccctctatccagtccaccagcaagtcctgttagctatactttcaaaacatatccatatctatccatttatttccccctccctttactaaccaccaggatccaagctactattgtctttcacctgcactaccgcagcagcctcctacctggtctctctgcttctcttggtgctccccaataattcattcaccacagcatgatcttttcaaaacttctgtatgattacctgttaaaaaactgcagtctattctcatttcaattaaaatgaaatccagttcattaactttgttgtctgaagctggatgtgacctggtgcctgcctgcctctccacctcattgagtttccctgtcccctttgcccactatgctctagccctgtgctatccagtaagctagccactagtcttaggagctgttgaacccttgaaatgtggctagtccaaattgagatgtgctgtgagtataaaatataccttgaatttcagacttatgaaaaatcatgtaatattatctcagataataatgttatctcattaataatttttatattatttacatgtttatgataacattttggatatattgggttaaataaaatattttgttaaaattaagttta

SEQ ID NO: 17921 - DNA, 801 bp, Homo sapiens
cagaaggaggtgttctcaactcccccactctcaacctttggttagcttaaacctttcccttattactcagctctttcatgatagtctatagttacatttaggcctttcccaactgaaagagcaaaacaaacccttcttcactcttgtgtcttctctaattactactttcttgttccctccacagcaaaagctctggagacagaagtaggtaaacactgttcctgcttcctctcctcccctcccctctacttgcaacccattgcagcctgctctgtgccttcacgccactgcctctgccggcaggagccactagtggactgtattggatgaattcgaggaatgctctttaaggccttatcctacttgacatctctgtagcatttgacacttgaccaccatcaccttaaacactctcctcccctgttgtctgggttttcttctacctttttgtacgtgccttaatctcctttggaggctgctgttcccactcctcctccagggctctgtcctcaaccatcttttctcattctgcagcctttccctggtgacctcatttgcacttaagattcaactgccgttgctcacgaacaccagagtgattttctagcctaaaactcttaaaacgtattttgagatctaggttctgttatccacctgcccactggacttttctagtaggtgttgcacaggcatcttaattgaacctgtctaaaatggatttttttgtgcccccctctccctgtatcacttcacacacagaatgttctccttcctcctggtcatcagttctcaattcctttc

SEQ ID NO: 17922 - DNA, 446 bp, Homo sapiens
aagaactaggctgatgtcagttatgcatcctgctattagctcccttgttatttaataccatggaataaaaaggcagcgtgaaagtctttttgccactattgcctggcttttattgcagctactcttgcatctataatagtggaagggaagagcaatacggattgtaaaatgaactccatagaagatccactgtggtcagtagatcaaggcatgacagtattgacgttaagaatggacactggagtccagtatatacggattcaaatctgaatgctcagtagctgtatgacttgggcagttacttaacctatttgggtttgagttttcttgtcttcatctgtaaaagtagggctgttagaggtttaagtgaatatatgtgcacatatgtatatatattaagagatatacatgatatatataaataaaatatatatctattcccttga

SEQ ID NO: 17923 - DNA, 321 bp, Homo sapiens
cctcccaaagtgctgggattataggtgtgagccactgcacccagctagctttgtacttcaagaaaaaaaaaaaaaaaacctttctttttaggaaaaccagactaattggtattctggggtttatacatgtaaaaacatatttgcatatgaaaggtaatgtacaaaagctaaaatagtagagtgatgaaatgtaggcaattgctattatttggaatattctagaatagtgtttattaaaaatgtaaagtacagacatgagaagccctaatcgtgtgccataagtaacaatgcaacataataaagacattaaaatctcaagtt

SEQ ID NO: 17924 - DNA, 429 bp, Homo sapiens
taatgtcattatgtacatgatcttaaattatccttttggaagataagtctttttcttttttagtagaaatattaggtcctctgttttcattgttaaccacatcagaatctgtattattacttttttttttggaaatcaattgcagtacagcaggcttaccatatggtggcacccaaaagcccagaaaccaacatcatgcggcccagtattagacatgtgttcaaaaatgtaggcagtcagctttctagtaggtagcaacaggaaataaagcgtcgtaagacagtcatcttaagagggtgctggaaatgttctacatttttatctgggtggtgattacataggtgtatatgtaaaaattcataaagctgtatttttatttgttcattttattatttgtatgttgcacaacaataaaaaaatttaggctgg

SEQ ID NO: 17925 - DNA, 400 bp, Homo sapiens
tcccacagccatgcagttaaggaaaagcatggactctgaagtcaaggtaacctggattctaatcagacccaggctaatctctggcatcctgaccctgggtacactgcttaaccactgtgagcctcactttcctcatcggtaaagtggggaggctgggcgaagtggctcacacctgtaatcccaacactttggatcgcttgagcccaggagtttgaggccagcctgggcaacatagcgagaccctgtctctacaaaaaatttaaaaactagccaggtgtggtggcttatccttgtggtcccagctactctggaggctgaggtgggaggattgcttgagccctggaggtcaaggctgcagtgacctatgatcatcataccactgcactccagcctgggaaaa

SEQ ID NO: 17926 - DNA, 1321 bp, Homo sapiens
actgcttcaacggaactttggtgaatatcaagatgcacagatgctcaaatctctgatataaatggcatagtatttgcatataacctgtgcatatcctcccaaatactttatatcatttctagattacttataatacctaatagaatataaatgctatgtaaatagttgttatactgtattgtttggggaataaagacaagaaaaaaaagtctgcatgtttcaaatacagatgctatattaaactttttggatccaagcttggttgaatccacagacataagagcccatggatatggagggccaactgtataatgtaaaaaaattccttctcatgcgctagtttccagttttcatcctttgtagataaccaggggcaacagtttgatataggtcttttcacctctctttgtgtgcatatacaagtaattatttgcagatttgtctgcatattcagaatttaaaaattacacttttttttagcagctttagatgtacagaaatttgagccgatagcacagaaagttcccatattcccttcccttccctcgtttctcctattgcaaacatcttgcattaatttggcacatttattgcatttgatgagcccatatcaatatgttgttatttattggtctatagtttacatagggcttattctttgtgttgcagtttttttttttttttgttttgtttttttaagatctcactctgtatctcaggctggagtgcactggtgccgtcatggctctgcagcctcgacctcccgggctcaagcgatcctcccaccttagcctcccaaagtgttagggttacagacatgagccactgcacttggccgagagttattttttacaaaaatgggatcaagcccagtggtggcttgcgcctgtagttccagctacttgggaggttgaggtgggaggattgcttgaggctaggagtttgagaccagtctgggcaacacagcatgactctgaccagtctgggcaacacagcatgactctgtctcttaaaaaaaaaaaaaagtgggctgagggtggtggctaacgtcggtaatccttgcactttgggaggccaaggcaggtggatcacctgaggtcaggagttcgggaccagcctggccaacatgaatgaaaccccctctctaccaaaaatatattaaaaaaaaaattatctgggtatggtggcgcgcgcctgtaatcccaactactcaggaggctgaggcaggagaatcgcttgaaactgggaggtggaggttgcagtgaaccgagattgcaccactgcgctctagcctgggcaacaggagcaaaactccatctca

SEQ ID NO: 17927 - DNA, 531 bp, Homo sapiens
tatcacacaaaatcaaattccctccgcagagagcttgaattgctgggaagagcagcagagtcaacacaacaatcacacacccctgtcctcggcgcagaattggagattgtatatatttatttggaaaaggcctgggctacttgtggcatcctgccaagacaatttgaaaggtatcaacagtttaaatgacattttcaccttcagcaaatacatctctgcctgctcggaatgcgacgctatcctgccccggcaatctatgatacagtcgcgtcagaaataggtgtcagctctcattacattcccgaggataaatcccacttatcagggcctgcagagtcccaggcctcctgacatcccatttcagacagcagcctcccacccccgcccctcctctccctaagagatgccgtcggagttttcaatcgctgaacttctgctggatgggaggagacgggcaggcatcgctgagctcctgctggatgggagaagatggagaggcagcctgagattttcggggcatggtggacagga

SEQ ID NO: 17928 - DNA, 383 bp, Homo sapiens
tcacctagaagagttcctgcccatccttcttccagatgccacctctcccatggcccatccaggagagaggtaaatgaggcttttctgtatgtctctgaatttcagttgaagccaaattcttgaggacaataggtgaaaagaactcctacattctactgagaggtgctggctcctgctacacctggacatcctgcaccctgacttgacaccccctccagcccatgcataaaggctggaaaaggattcttccaagggagggacagctggtaggtgaaacttacccctcgctcccagccaagcctggagagaatatgttccatgtccccaagtctggaggtgacagagacaggtacatgactctctcaggaaaaactgtgaaggcc

SEQ ID NO: 17929 - DNA, 1946 bp, Homo sapiens
caggtctcccggcaacggctgcggcctcgcccacgttatggcgcccgaggagaacgcggggaccgaactcttgctgcagggttttgagcgccgcttcctggcggtgcgcacactgcgctccttcccctggcagactgtgaggcatcctgtgtgtgtgaagcacccgccgtcagtcaagtatgcctggttctttctctcagaactcatcaaaaagtcctcaggaggctcggtcacactctccaagagcacagccatcatctcccacggtaccacaggcctggtcacatgggatgccgccctctaccttgcagaatgggccatcgagaacccggcagccttgattaacagacgtgctgtattgcccagaagccatcgtgtcgctggtcggggtcctgcagaggctggctgcctgccgggagcacaagcgggctcctgaggtctacgtggcctttaccgtccgcaacccagagacgtgccagctgttcaccaccgagctaggccgggatgggatcagatgggaagcagaagctcatcatgaccagaaactgtttccctatggagagcacttggagatggcaatgctgaacctcacactgtaggactcacacatgactccaaagggattgtgagaatcaagtcactctcgtgggaagaatttttatatgggaaagtggataaaactttcattggactggaatgtttggagattattaaattccaaatcaggaatcaaaactgccctctaataagacattagctgtctaggcgtgtgggtgccccctttctgccagcagttctggttctcaagaaaatcatcataaatcagacatgaaaattctggctccaaaaatagcattttctttctgcaaataaaaacgtgtgtatcaaggatgacgttcccccaacgtggacacactcggttcctcagaaagccaagcccgctgcagctgccacatcccagggcttatggtgcagcaggcgcttttttcaagacaggaatgaaagtgttaggaacatggcagaaaggtgacacctggagaccaaatgcaggatgaggagtactgcagaggtcacagggaagtcacagaacagtaatacgctagcaggggcatggggcatgaagaacagaagacaggaagcatttcagagactccaaagaagaaatcagggccaaccacagcttcccgggtcattcaccaggtgacaccactgccgtcatttcagcttctggccactgggaggcgctgctcgaaaggctttgccctgagactccaagaagctgcgggaaggacagcaggggccctggggttttagcctctggcccaggagttatgtgtccataaccaaagggagcacagtctgcacccagctctcatcccatcagagctgctgagactcttgcaggttcttccagaactggtttagcttgcctgcaggatcagaaaagtttgagaaaagcatctgcaaaatgctaaagagcagagcttaactcattgcctgtccccaccccatcccaggtcaccacttggatgaccccaggtccccgacccaacaacaacccctcccaagtccctaactccctcacttggacttgagacccttcacaacccccctcacttggacttgagacccttcacaacccagcagcgctccacctccaacttgacatcatgctttctggaaacttccccgtatgtcccactttcccacacttggtgccctggagcaccttccggcctctacatgctgtacgttcccctgtgagcaccctcctctcggcctctggccaacacagtcccacccatctgtgggtaacaagggggtgtgggtgttcttttcagccttgctaaactgtctgaatcaaggatcacaaactacagcctgcaggccaaatccagcccacagcctgtgtttgtaaataaagctttgttggaacaaagccacac

SEQ ID NO: 17930 - DNA, 1928 bp, Homo sapiens
caggtctcccggcaacggctgcggcctcgcccacgttatggcgcccgaggagaacgcggggaccgaactcttgctgcagggttttgagcgccgcttcctggcggtgcgcacactgcgctccttcccctggcagagcttagaggcaaagttaagagactcatcatattctgagctgctgcgggatattttgcagaagtcctcaggaggctcggtcacactctccaagagcacagccatcatctcccacggtaccacaggcctggtcacatgggatgccgccctctaccttgcagaatgggccatcgagaacccggcagccttgattaacagacgtgctgtattgcccagaagccatcgtgtcgctggtcggggtcctgcagaggctggctgcctgccgggagcacaagcgggctcctgaggtctacgtggcctttaccgtccgcaacccagagacgtgccagctgttcaccaccgagctaggccgggatgggatcagatgggaagcagaagctcatcatgaccagaaactgtttccctatggagagcacttggagatggcaatgctgaacctcacactgtaggactcacacatgactccaaagggattgtgagaatcaagtcactctcgtgggaagaatttttatatgggaaagtggataaaactttcattggactggaatgtttggagattattaaattccaaatcaggaatcaaaactgccctctaataagacattagctgtctaggcgtgtgggtgccccctttctgccagcagttctggttctcaagaaaatcatcataaatcagacatgaaaattctggctccaaaaatagcattttctttctgcaaataaaaacgtgtgtatcaaggatgacgttcccccaacgtggacacactcggttcctcagaaagccaagcccgctgcagctgccacatcccagggcttatggtgcagcaggcgcttttttcaagacaggaatgaaagtgttaggaacatggcagaaaggtgacacctggagaccaaatgcaggatgaggagtactgcagaggtcacagggaagtcacagaacagtaatacgctagcaggggcatggggcatgaagaacagaagacaggaagcatttcagagactccaaagaagaaatcagggccaaccacagcttcccgggtcattcaccaggtgacaccactgccgtcatttcagcttctggccactgggaggcgctgctcgaaaggctttgccctgagactccaagaagctgcgggaaggacagcaggggccctggggttttagcctctggcccaggagttatgtgtccataaccaaagggagcacagtctgcacccagctctcatcccatcagagctgctgagactcttgcaggttcttccagaactggtttagcttgcctgcaggatcagaaaagtttgagaaaagcatctgcaaaatgctaaagagcagagcttaactcattgcctgtccccaccccatcccaggtcaccacttggatgaccccaggtccccgacccaacaacaacccctcccaagtccctaactccctcacttggacttgagacccttcacaacccccctcacttggacttgagacccttcacaacccagcagcgctccacctccaacttgacatcatgctttctggaaacttccccgtatgtcccactttcccacacttggtgccctggagcaccttccggcctctacatgctgtacgttcccctgtgagcaccctcctctcggcctctggccaacacagtcccacccatctgtgggtaacaagggggtgtgggtgttcttttcagccttgctaaactgtctgaatcaaggatcacaaactacagcctgcaggccaaatccagcccacagcctgtgtttgtaaataaagctttgttggaacaaagccacac

SEQ ID NO: 17931 - DNA, 2107 bp, Homo sapiens
caggtctcccggcaacggctgcggcctcgcccacgttatggcgcccgaggagaacgcggggaccgaactcttgctgcagggttttgagcgccgcttcctggcggtgcgcacactgcgctccttcccctggcaggtgggcggcggggcgagcggagaggcccgcgggggtcgcgggagtccaggggcagacgggatgggtctccgtgctgaaacccccggcgctccggccacagcttagaggcaaagttaagagactcatcatattctgagctgctgcgggatattttgcagaagactgtgaggcatcctgtgtgtgtgaagcacccgccgtcagtcaagtatgcctggttctttctctcagaactcatcaaaaagtcctcaggaggctcggtcacactctccaagagcacagccatcatctcccacggtaccacaggcctggtcacatgggatgccgccctctaccttgcagaatgggccatcgagaacccggcagccttgattaacagacgtgctgtattgcccagaagccatcgtgtcgctggtcggggtcctgcagaggctggctgcctgccgggagcacaagcgggctcctgaggtctacgtggcctttaccgtccgcaacccagagacgtgccagctgttcaccaccgagctaggccgggatgggatcagatgggaagcagaagctcatcatgaccagaaactgtttccctatggagagcacttggagatggcaatgctgaacctcacactgtaggactcacacatgactccaaagggattgtgagaatcaagtcactctcgtgggaagaatttttatatgggaaagtggataaaactttcattggactggaatgtttggagattattaaattccaaatcaggaatcaaaactgccctctaataagacattagctgtctaggcgtgtgggtgccccctttctgccagcagttctggttctcaagaaaatcatcataaatcagacatgaaaattctggctccaaaaatagcattttctttctgcaaataaaaacgtgtgtatcaaggatgacgttcccccaacgtggacacactcggttcctcagaaagccaagcccgctgcagctgccacatcccagggcttatggtgcagcaggcgcttttttcaagacaggaatgaaagtgttaggaacatggcagaaaggtgacacctggagaccaaatgcaggatgaggagtactgcagaggtcacagggaagtcacagaacagtaatacgctagcaggggcatggggcatgaagaacagaagacaggaagcatttcagagactccaaagaagaaatcagggccaaccacagcttcccgggtcattcaccaggtgacaccactgccgtcatttcagcttctggccactgggaggcgctgctcgaaaggctttgccctgagactccaagaagctgcgggaaggacagcaggggccctggggttttagcctctggcccaggagttatgtgtccataaccaaagggagcacagtctgcacccagctctcatcccatcagagctgctgagactcttgcaggttcttccagaactggtttagcttgcctgcaggatcagaaaagtttgagaaaagcatctgcaaaatgctaaagagcagagcttaactcattgcctgtccccaccccatcccaggtcaccacttggatgaccccaggtccccgacccaacaacaacccctcccaagtccctaactccctcacttggacttgagacccttcacaacccccctcacttggacttgagacccttcacaacccagcagcgctccacctccaacttgacatcatgctttctggaaacttccccgtatgtcccactttcccacacttggtgccctggagcaccttccggcctctacatgctgtacgttcccctgtgagcaccctcctctcggcctctggccaacacagtcccacccatctgtgggtaacaagggggtgtgggtgttcttttcagccttgctaaactgtctgaatcaaggatcacaaactacagcctgcaggccaaatccagcccacagcctgtgtttgtaaataaagctttgttggaacaaagccacac

SEQ ID NO: 17932 - DNA, 1835 bp, Homo sapiens
caggtctcccggcaacggctgcggcctcgcccacgttatggcgcccgaggagaacgcggggaccgaactcttgctgcagggttttgagcgccgcttcctggcgtcctcaggaggctcggtcacactctccaagagcacagccatcatctcccacggtaccacaggcctggtcacatgggatgccgccctctaccttgcagaatgggccatcgagaacccggcagccttgattaacagacgtgctgtattgcccagaagccatcgtgtcgctggtcggggtcctgcagaggctggctgcctgccgggagcacaagcgggctcctgaggtctacgtggcctttaccgtccgcaacccagagacgtgccagctgttcaccaccgagctaggccgggatgggatcagatgggaagcagaagctcatcatgaccagaaactgtttccctatggagagcacttggagatggcaatgctgaacctcacactgtaggactcacacatgactccaaagggattgtgagaatcaagtcactctcgtgggaagaatttttatatgggaaagtggataaaactttcattggactggaatgtttggagattattaaattccaaatcaggaatcaaaactgccctctaataagacattagctgtctaggcgtgtgggtgccccctttctgccagcagttctggttctcaagaaaatcatcataaatcagacatgaaaattctggctccaaaaatagcattttctttctgcaaataaaaacgtgtgtatcaaggatgacgttcccccaacgtggacacactcggttcctcagaaagccaagcccgctgcagctgccacatcccagggcttatggtgcagcaggcgcttttttcaagacaggaatgaaagtgttaggaacatggcagaaaggtgacacctggagaccaaatgcaggatgaggagtactgcagaggtcacagggaagtcacagaacagtaatacgctagcaggggcatggggcatgaagaacagaagacaggaagcatttcagagactccaaagaagaaatcagggccaaccacagcttcccgggtcattcaccaggtgacaccactgccgtcatttcagcttctggccactgggaggcgctgctcgaaaggctttgccctgagactccaagaagctgcgggaaggacagcaggggccctggggttttagcctctggcccaggagttatgtgtccataaccaaagggagcacagtctgcacccagctctcatcccatcagagctgctgagactcttgcaggttcttccagaactggtttagcttgcctgcaggatcagaaaagtttgagaaaagcatctgcaaaatgctaaagagcagagcttaactcattgcctgtccccaccccatcccaggtcaccacttggatgaccccaggtccccgacccaacaacaacccctcccaagtccctaactccctcacttggacttgagacccttcacaacccccctcacttggacttgagacccttcacaacccagcagcgctccacctccaacttgacatcatgctttctggaaacttccccgtatgtcccactttcccacacttggtgccctggagcaccttccggcctctacatgctgtacgttcccctgtgagcaccctcctctcggcctctggccaacacagtcccacccatctgtgggtaacaagggggtgtgggtgttcttttcagccttgctaaactgtctgaatcaaggatcacaaactacagcctgcaggccaaatccagcccacagcctgtgtttgtaaataaagctttgttggaacaaagccacac

SEQ ID NO: 17933 - DNA, 906 bp, Homo sapiens
cggtaccacaggcctggtcacatgggatgccgccctctaccttgcagaatgggccatcgagaacccggcagccttgattaacaggtgacctcggggcacagggcagggcaccgaggcaggcttaccctggtgcagtcgaaaacacggtcccctttcctcccgccaggactgtcctagagcttggcagtggtgccggcctcacaggccttgccatctgcaagatgtgccgcccccgggcatacatcttcagcgaccctcacagccgggtcctcgagcagctccgagggaatgtccttctcaatggcctctcattagaggcagacatcactggcaacttagacagccccagggtgacagtggcccagctggactgggacgtagcaatggtccatcagctctctgccttccagccagatgttgtcattgcagcaggtaatgcccagccccgggcatcctgtgcaggcggtgtccttgcagctctacccagctcttggctctgggaaaagggaacaatggacactgtcgggcatggacgtgatggggcttccagaagagttactctgggcctccagggtgacatcaaaggacaggggtgcctcttaaggtgaccttcaagccacagccctgttgttggagacaggcatactcccgttacagtcgtcaccacatggctctgtcccagagccatgccctgtgtccttcagagaccgcaggaggaaaacaaccacttctggtacgaggtcagggcccttgagagaaggtgctgtttggctgggccaccaaaaacccctcacccctgtgagcacactcagtcccctctctggtggaacagagctctgcctgtagtcctgggtcccagccctgaaacccacaggtccagcggtggccagggacacaggcccaccc

SEQ ID NO: 17934 - DNA, 493 bp, Homo sapiens
cactagggatatttaattcaattcatatacattcagttcaattcaaatcagcatatatttgctaaatgctttctctttgccaggcattgcagctgcatctggaggagggttgagctatttcaccatatagatctcctacgactttgagactgtgatgtaaagaaataggcaactgtgatggttattttatttgacaacttggctgggctgtggtacccagatatttggttaaacgttattctggatgttttggtgaaggtgtttttggatgagattaacattttaaccagtggattttaagtaaagcagattactttccataatatggacgggcctcatcaatcggttgaaggccttcataaatcaaagactgacctccccagagaaggaaggaattctgccagcaggttgcctttggactcaagcagaaactgagtccccacaatcatgtgtgccaattccttaaaataaacatctatatctataatatcta

SEQ ID NO: 17935 - DNA, 130 bp, Homo sapiens
ggtaaccaatgctgtcactatgttaatctgctgttcttcatcactacactacggtttcctccaaggttaatgttgtgagaaacagaatgaagggtggaagggaactctttgctctctatctgcaactcca

SEQ ID NO: 17936 - DNA, 1705 bp, Homo sapiens
  misc_feature (1294)..(1294): n is a, c, g, or t
  misc_feature (1309)..(1309): n is a, c, g, or t
  misc_feature (1354)..(1354): n is a, c, g, or t
  misc_feature (1370)..(1370): n is a, c, g, or t
  misc_feature (1392)..(1392): n is a, c, g, or t
  misc_feature (1401)..(1401): n is a, c, g, or t
  misc_feature (1409)..(1409): n is a, c, g, or t
  misc_feature (1430)..(1430): n is a, c, g, or t
  misc_feature (1563)..(1563): n is a, c, g, or t
  misc_feature (1637)..(1637): n is a, c, g, or t
  misc_feature (1699)..(1699): n is a, c, g, or t
aaattttaggagattctttgaataaacctcatttagtctctctcctataaaaggaaaagcagaacctcaagtccacatttattttgcatttgctctcttgttcacattcttctctatgtcaataaaagttagatggcattttttatagctgtgtatcaaatatgtgaatatagaattccaactaaaatagcaatagatgggaaaactttctagttcattcattgtcaaaagtgagtgctgagaggacatctgaagccccacctaaaagtaaatcctcagcaggaaagataatgcagataaattttgggtccaaattcttaatctgggcaaagaaagaaaacaaacacacttactagatggatttttcataaaagttcctttccatgctgtccaaagtgattaaattagtcatccattcttttatctcttctgttgataatcatataagcaactcctgaatctatatgagtattcagtcttctttattattcagaagatttgccattttagtcaactcaaatatcagtactatttcatagcatgctagttcaggttacacaaagcccaccaggtacacctggaatctagccagaatgcagtccaatcatgagcactttaaacatttacctcattttactatttgtcttagagctatggaaacattattctgtttctggagtatctcacacttcaggagcattagttgaagcagtacagatacagttagtgtcctctctggacattcatttgttaactttgaaacaactggattcaaagaccttaagttaaaaacaaacttattgcctatttatggaagaaaaacctgttattttattctggtttaaaagttaaaagcgttgcctctaccactggataacctgtttgcacaattaaatgatttccggagttaaaacattatgattataaattttctctgaataagttgataggagattattcctgttcttataatgaggtttttcccttagcacttttcaagtgtgcctttcaaccaatgatatgtttttaaaaaataatgtaacttaagtaccttatgattaaccatcatggagtctagaaaatgtggagattctaaaacagtattgtctgaaaacatagaatagttggacttaatgttctcttcagaaaatctaactgtaaacttggtactttcctacagttcacttgtgaaaaataatatctatgaagatggagagattcctaaaggaattccactattttaccatagagcccaaagtttccttgacccaagcaagaccatcaaggagctatntggattgtatgatantggacctcagtagaactacttttactgaattgctggagccaaaantaggctgcagcaaganaaggcaattagggtacaaaatntaaggaagntgtcattntgaggatcatatgatagatgntgggttaagacatatggctgggcatggtggctcatgcctgtaatcccagccctttgagaggccaaggcaggtggatcacttgaggtcaggagttcaagaccagcctgggcaacatggtgaaaccccacatctnctaaaaatacaaaaacagctgggcgtggtggcatggacctctaatcccagttacttaggaggctgaggcagganaatagcttgaacccaggaggtggacgttgcagtgagccgagatcatgccactcgactccagngtgggc

SEQ ID NO: 17937 - DNA, 249 bp, Homo sapiens
gctgagtttgcattgcaaaaggaaggtagagcacgggccatctctccctcctccacttatatttattctgcacctacctgcacgtgacactctgctattcttcagagaaggttctgacctttgtgaccacgctttacattttcacattgcaaggcaatttctaaagagcttttcccagctaagatctcatttgagcctcacaacaactctggggcaaaggagactgtaaaacaaacaaaaacaaaaaca

SEQ ID NO: 17938 - DNA, 826 bp, Homo sapiens
ataactactgctttgaggatatttacccataatatcaaaggactaactaccacataaatgtatcacgcatacttatttgcatctctaaaatttgatgtcatattggaaagaatttttagtgaaatagtaaatacagatgatgagaatgccacctggagaaagagataatgtgattgttaagaactcaaggattgttttattatatggctgttattagaaaaaatgatcttaagaaattaccttggctttagcctgtgtagaaaattaagtattaaaatataagagatattttaattttgcaatgctgactagaagtaaaatctaagaagaaaatttaactttccttggaagttacattttagtgtttaatttctgctaccaattcatttctgaaagcacatgaccattcttagctgatttgctgctgctaggaagtctctgtatactgtattatgatagagaatgttgtgctgtaattcatggaattctgaatgaattgccaaatcaagatacggttgtttgatgtgaggttctgggaagaaaaaaaaaaaaaaaaaaaacggcagagtttataccctccccttgttttcttgctttattctgggcaagtttgaaggggaaaatttgtgctgctgttagtgcaactgctgtgtatgttgagccactgttgtcatgccagccaggtgcaaaggcagcttagctactgaggtagcgaatgttctgaggacattctagactacagcttaggtcctttttcaggctcatttgcttgtgcttttttgttgaatgattccaatcgtaaataaagcttttaataattttgtga

SEQ ID NO: 17939 - DNA, 277 bp, Homo sapiens
gcagaatttgtgcatgggatttctctcagatctcccagtatttgtctgcactgtttcatttgctgcagtcttttatctttaaataaagaccttattaagtatgctgtatgaatttatatgttccaaagagaataagtgtgttctatgaagtctggtggctctttcaaatatctgaacttgagaaacctttgcaatgcctcaaacaaatacttgataacttccaaaaatagaattaacataagcaatattcacttactacagtgcaataaactagatg

SEQ ID NO: 17940 - DNA, 305 bp, Homo sapiens
ttctttagtcaattagttctcatctccagaaaaaggagacaggaagacagaccgtccctatatagatcggatgtgtttcagcaaggctggctctcaaacaaaaatgttgaaacacatggtgttttctcattgatttccataacagaatttgggatgcacacttctgaggaaaatcaggtcttctgcagaacaagggcacacacaaagccacacacacagtattttccaaaagataaaatgggatcttgaggcactgtgtcttctggcccatgggaaccacccagggtatgccctgtgttctttct

SEQ ID NO: 17941 - DNA, 221 bp, Homo sapiens
gaggaatatgatttcagtttcatgaacatcaagtttgaagtacagatgggacaacccaagagaagtgttcctctgatagaaattcagaactggatgccaagcagagttcaatattagagataaattcagagagtcgtttccagatgtgttagtgttaacgacatggaatatatgcagttccctgaaactgggcctggagactcaaaaaagacccctcaatc

SEQ ID NO: 17942 - DNA, 903 bp, Homo sapiens
caaccttttaatatgcgtatcttaaaggaaaatattataaaacaagatattaatactaaagtgttaacattaatatgttgttctcatggaagaaaagtagaaaatgtgataggcttagaaattattttttatcagcattaagtgcttcaatttctccccataaagattctaaggaaatttcagttcctcatattatagttttccccataatttaatattactaagtatttctctgcccagtaatgttgatgcagtttgcataaatagccttggaagtaaggaggcaggacagaaagccaaatatcgaaatctctggccttgatttagtgacagtttattctaatggggaccataggtgttattagtaaaaagatagtgtacaaggcctaagttcagtttacattgttctttgaaatgagttcatcttttgtgttgaataattgtattctaagtaggagatgcctgtatttaacataatcatgctttctatataatcaaatatgtatttgttggaatactggtagaaataaccttcccttcctccactgtgcagtggaaaaaaaactcccgatttatactgtatataaattaggaaattatgttacatatttacatttttaaaaatataaaaatgacatattattttgaagtgattgtattatagtttctgaagcttatgactggctataaatataacaacatacccatgagaaaccagaccaaaattgaatatatatcatcactgtgaccttgaacttatagtcatttgggataaaacagagtgtgccttgaaatgataaagagtgccctgcaattttataactgtacattttattatgggtggtcctctcaaattggccccaaatccttgtcttcgaggttggtgaaataaaagtttaaaat

SEQ ID NO: 17943 - DNA, 301 bp, Homo sapiens
ggagatcatagattttggatatttcaacatctttactgattctatcactgtttaaagaatttaactaagtgacctaaacatgctccttcggacagccaacaacaaataagaatttcttgatttgcttcaaaattaaaatcgctattttctctattatagtataatagttatacgtttagtaaatgcttgttgattaatgtctagtaacaaataagttttataaatttaagggtctgttacttactattacgctaagaagatcctcctactactattaaattttctagttggggaaaaaaaa

SEQ ID NO: 17944 - DNA, 342 bp, Homo sapiens
gtgctgggataactgctagccatctgcagaagattgaagctggatccctaactttcactgtatgcaaaaattaattcaaaatggatcaaagatttaaatgtaaggcctcaaattattaaaatcctggacaacaacctaactcttctcaacattggccttgacaaagaattttttactaagtccccaaaggcaattgcgataaaaacaaaaacgaacaatgggacctttttaagctaaagagcttctgcacagcaaaataaactatcaacagaacaaatagacaacctacagaatgggagaagataactcaacctatgcatctgacaaaggcttaatattcag

SEQ ID NO: 17945 - DNA, 296 bp, Homo sapiens
ttttttttttggtaggtttttaattactgcttcaagtttggaattccgtattggtctgttcagggtttcagtttcttactgattcaatcttgggagagtgtgtatttctaggactttatccacttcctctagattttctagtttgtgtgcatagaggtgctcattatagtctctgaggatcttttgtatttctgtgagatcacttgtaatgtcacttctgttgtttctgattgtacttatttggatcatcttttgtttgtttgtttgttaatctagctagcagtctatcaatatgg

SEQ ID NO: 17946 - DNA, 310 bp, Homo sapiens
gcccaagcaggtgagcatcaagcaatcgtggggaactgtagggggccacagagcagattttcaagaagtcaccagtggagttcttgctgctagtaacccagaaatgagaaaagtgtccccaaaaggccacctggaggttatacctagaagtagatggagatggccagaaatcttgtggagttctgttcagatgtcgctgcattttggattattgactttccataacacaaataattttgttttagttgaaattgtatttttctgtcaaaaccctacattcatattaaacagtgcaaatcttagagaaaca

SEQ ID NO: 17947 - DNA, 371 bp, Homo sapiens
tgaaatgtgagaagaacatgagatttgggagaggccaagggtggaatgatatggttcggctctatgtccccacccaaatctcatctcaaattgtaatcctcacatgttgtgggaggggcctggtgggacgtgattgaatcatgggggtggatttcccccttgctgttctcttgatagtgagtgagttcttgcaagatctggttgtctgaaagtgtgtgacatgtctccctttgctctttctccatcctgccaccatgtgaaggaggtccttacttccccttcaccttctgccttaatgttaagtttcctgaggccttccagccatgctttctgttaagcctgtgggtcaattaaacctctcttcataaatt

SEQ ID NO: 17948 - DNA, 329 bp, Homo sapiens
ttagttatccctttaatagcatgtttcctcggttaatgacaaactttcccactaggctgtctttgtgaccgcaggagccctgctcttgtttacccctgtggtaatccagtgcctatctcaggctggcacctaggcattcagagggataaatgaaggaaagaattggccaacctgttgaccaatgacgttggctggcctccttccttgcttggtatcggttttgtttctaacacttgcaccaagaaaaccacacagggttatactgtctgcctagtttaggaacttcctttaacagtatttctttactctctgagtttctggtgagctaa

SEQ ID NO: 17949 - DNA, 457 bp, Homo sapiens
tcctgtgcccctgaaaccttgagtacagccaagctaagcattaaggtgggaaaagtttttcctcaaatcagttgccttggctgtatctcatgctcatgcacagatctagcatgctcttactttctctcttctgtatattggaatctacatgatttggccgaaaattgagcttttgtcgtgaagctgtccctcttcttcctaccattgccctcattagaccaaagtaagcagtacccctcagcaaaccaccttgaactcaatttttgtattttttctaatcgttaacactttgtcattagccaggtgtagtggtgcgtgcctgtagtcccagccagctacccgggaggctgaggtgggaggatcacctgagcctgggaggtcaaggctgcggtgagccgagatgacaccactgtactccagcctgggtgacagagtgagagcttgtctcaaaaaaaaa

SEQ ID NO: 17950 - DNA, 417 bp, Homo sapiens
acatctgctcaacaattccctgtccagtctcagacttgttattgatctttgtagccaaggataattatttcaaaacaattatgtaatcctcctcattttttcatttaaaaacccttgtcttcctttatctccctgaatttgcacatatttcactatggtatacagattcccattgcaatgctctattgctaaacaaatatcttttctttcagagagactctttctgtttgttaaataggttgacatatatggtgtttgaaacaggacctgaaaaagttcactagcagaagaaatggtgaccaggcatagtgtctcacacctgtaatcccagcactctgggaggctgaggcgggcagatcacctgaggttgggaggtccagaccagcctggccaacatggtgaaaccccgtctatact

SEQ ID NO: 17951 - DNA, 587 bp, Homo sapiens
atagtgcttttgtgaacattctttacatttctcatatatatgtacatggatttccttaggttgtattcttacaaatgacatttttcaggtcatagggcatgtgtatcttcatcattattaattaggccctatttcttcccccaaactggttgtaacaatatataccacactcagcagagtttgcgtgttcatgatgctccaggctcctgccaacgctgatatgtcagactttaacattttcaaacttgtcgtgtatgaaatattttctaactgtgttgtaatttgtttttccctaattactaatgagattgatcacatagtcacatgattattattggccacttgggatttttttcctgcgaagcgccttttcaagtctcttgctgatttttcttagggtcgttaatgtagtagaatttgtcagtctgttcctccaagattcacactatattctggtcttctctatcttgaggtcatgaaaatgttcatattgttttctaaacatttctgaaaacatacttttgacttttaagtctaaagtcttcactttacctgagtcccccttctttacttttttccttccatct

SEQ ID NO: 17952 - DNA, 302 bp, Homo sapiens
agacaatgaggttattggactgatcagagaacctcaatatataataaaggaaaatgtataagttataaaaggtatggtcttagaatcaaatgaaaaagcctgggtgacaaagtgacagcctgtctcaaaataataataacaaaaacaataacaaaagaaataaaaatatatataatttcacatattttgtgctaaatcagcttatattagatttttatgtagagaaacagcaagatctacaaatataaaagaaacagttattaaaagttttagtttttacctatcatttaatgcaaaactgt

SEQ ID NO: 17953 - DNA, 408 bp, Homo sapiens
tatactgtctccacatactactatttacaatactaaaacatctgaggagctacctattaataaaataaaggatctgatttaatattttggtatttttatatatttgaataaaatatgacatgtaaaagtattattattatttttttaattcctgggccaggcacggtggctcatgcctgtaatctcagcactgtgggaggccgaggcaggtggatcacgaggtcagaagttcgagaccagcctggccaacgtggtgaagccccgtctgtactgaaaatacaaagattagctgggcttggtggtgagtgcctgtaatcccagctactagggaggctgaggcaggagaatggcttgaactcaggaggcggaggttgcagtcagccaagatcgtgccactgcactgtagcc

SEQ ID NO: 17954 - DNA, 304 bp, Homo sapiens
tttttatggattaaggtaaaacaaacacctttcctttattttagaaacacgttatttttgggaaccgagacgggaggattgcttgaggccgggagtttgagaccagcctgagcaacatagtgagattccacttgtaccaaaaaaagaaaaaaattagccagatgtggtggcatgtacctgtagtccccactacttgggaggctgcaatggaaggattgtttgagcccaggagatccaggttgcagtgagctatgaccataccactgcactccagcttgggcaacagagtgcaaccctatctcgg

SEQ ID NO: 17955 - DNA, 401 bp, Homo sapiens
gactgtgttttccaaaccaaaatctgacacacatgggctggcagataggaatgtagttatgaaaagaacagggcaggatgttgggaatcatgatcatggtggaaaatttgggatttgcagtcccgacttgtggagaagactccagaacccagaagtgctgcccttgagtcctggccatgactatctgtgtggccttgagccaggaggtgctgttgcctctctgtgaccctctggaaggtgcagacatcagccgctccaggacagtgagctgccaagtctctcctaatcccaacagtctgatcagctcctatcaagatgcccaggccggcttcccaggctgccctggatcaagccacactaaacttaatccagcaggaatgccatttcttttgagttttttt

SEQ ID NO: 17956 - DNA, 215 bp, Homo sapiens
tgatttattgatgagtactgcttccacagatgaaacgataggaattgttgaagaataaactgctaagcactcccttccctgggctctgggccccctgctccaattataagcacatactccaggctgagatttcttgtcttgtgttcacagggaattcacatagtaaggaggtcaccggactttctaatattgaaaaactcagtctcagtagcagc

SEQ ID NO: 17957 - DNA, 10317 bp, Homo sapiens
  misc_feature (5000)..(5000): n is a, c, g, or t
  misc_feature (9302)..(9302): n is a, c, g, or t
tgagcgaggagctcccctccctcgctcgctcctcgcaagctcccgctcgctccctgcccactcccggggggacgttccgtgccgcggccgccgcggccgctgcttctttcacactttagttgggagctgcgcgccgcgctcagttactggagagctggccgcgcgccgccgcctcccgcacgcttgcacgcgggcccggcttcggggttttgggttcttactccaagcggcggggaggagggggagccccggacacactgtggggaggaggaggaagaagaggaggagggaggaagaaaaaagacgaggaggacaggggcggggggcgggaggcttgccaccttcagcccccccgcgaacgcccaaggtgcacacatcttgaccaactcagcagcaaggtggattttctttgtgtttaaagaaaaaaaatgtccctgtgtctgtagagatgatttgcagttcagcccggctgaagctgaccgaatgagactatgggctgtgcctccgccaagcatgttgccactgttcaaaatgaagaggaagcccagaaagggaaaaactaccagaacggagatgtgtttggcgatgagtataggatcaaaccagtggaagaggtcaaatacatgaaaaatggggcagaagaagagcagaaaatagcagccaggaaccaagaaaacttggaaaaaagtgccagctcaaatgtaagacttaaaactaataaagaggttccgggattagttcatcaacccagagcaaacatgcacatctctgaaagccaacaagaattcttcagaatgctggatgaaaaaattgaaaagggtcgggattactgttcggaagaagaggatatcacatagcaccaattttaccactcaaaccaggagctactactgtgtaaataggttacaccccagttgaaatctttgcaaaggtcggttctattcagcgaacagcactatagcaaaagaagatcgttccatattgtacgccccattaaattacagtgtttcttaatgaacttgcaaaggaatattgctaaaaacaaacaaaaaaaactgttatcgaactttctttgttgctgctagttaaaacttgttgcaacttttcacttctcttgtgtccaggtatgcagcaaaattctgcaatttcaccttaaagatactgttggttttacagatgctctccaacctattttctataagatgaggtagtggtgaactcagataacaaacttctcttctaaactggttctgcttctaagacaagcatctcctgccctctctccttcctccccatctctcgcacgcagtctagagatggactgagccttgcttctcactggcagtgttgagctttggagatgggatggttgctatgccaagccttgtttctctgctcagaagaagtagagaagctattatcaattaaaagcatgctgtgatgtgactcctggaagtgacgtaggagtgagtggcaggttgtttgatttaataggtatcttaatcaagaattaagcttgcaacattggctttgctcagatgcagatggaagtgtgatcacaatcattttgaatccctcttcctcacttttttttctaagaaaataaacattttactgtttttatggatccttgtcttctcccattcatccagctcagtgttttaagatgatcctgggtgcagaagttgagccctcctttgcattgacactgataattagcctatagggctccctacccttccattaagaatctaccaagcattagcaaggctgaaagtggtctaagaggtgaggggacatcctatgactttttaggaaggcctgaaaccaccttgttacctttcattttgttagcaaataaaccatcctattttgtaactctcccccttcaaaatgctacatgagccttgccacttcctttttctcttacttccagcacactagacatagcaaaagtgtttgcctactcaaaaacataatacttttatgctgatgatggtatttggagatgtgaaagccaaaagcccctggcagtggtggggaatgttgactgagtgttcagcagagtttatttttccatactatatgaagagaatgatctcttctcaaagacagaagtgatatttttaacaaatattgtcacaagtaaatagcaatcaaaaggagaaaataacttttgtatttttttaatgtgtttgatagctttgacgagggttctctttgttactttcaggggagggcatcctattaaatgccacgccagcagtccgggtctgggtttgtcccacaaaatcacaggagcactgtatgttcctctcttttggagttgtgactttgaagggcctcaatattagccacactgccgcctgcagaaggtggagagttaagatgttctatgtcaatttgctcttgccgaaaagatgagcctcgattttaaaatctatccacatccaactgatggcaccattgatgtgcaaataatgagattccctatctccttttagacctgggacggcaaaagggaagggaaggaaacttagcagagtgctattgactatagattcacatattagcaacaaaatcccgtaattcttttggccaacagcagctattttggggagcagctgtggctgttacataaatagagatgcagccaaaattttaggccttttatcctgcttctagcagaaaaatgcagggagagtcaagtagtctagggtttcaggttgcctcccctcatatggtttttggccaagtgactaaaacagttttccacaactgtaaacaaactggtaagccccacctcaaacttgttcactggggactttgcttaccgttctgtgggtgaccttttccgggatttcttgttcttatcaagcaagaattaagcacatgctaaacgtcttccatttgacttctctactcggtgtctcagacagtgtcttcccagaaaaccaccaccctctacccaaagatgaaacatgctcatgtcatttttctcatggtcacatttaacagttttgacatgttatacttgcgcatagatccaagcgtttcttgggaacctgacttttgagtgtttaataaagccggaagtggtgttgccctgaaccagcagattttcacctgggttctggctccggtgtttaacactggatacatctttgatgtgcgaaagtgagttcatcttcagacacatttggtacatccagaaatagatccaagaaatggggtggttgagtgggtccgcacgaaatgcttgattatgtcagcaacacccaacactgtctgttttccatttgttggttttaatcataaaattgtcaagtgattcgtgttgtactttatttttgtgccttctgaacggatctaaaacaaaagtattttgccttttttaccccacgtgtatctgaacattaagcagattggctcagacaccatgaaaaggatactccaatgtacgtgctggtgcactctgctagttgttatctctgtagggctcaagaagctggaaggaggaagggagggtaagtggcctggtgagtggaggtagaaaaatgatgagaaatgaactgagagcattaagcagagagggttgataggctggccgtgtccggggtgaaattggaaatccagctgcctagtggccagtgggtggggcaagactgtcaacgagatttacagctggcttacacatgccttatgtcctctgagttgtagagttgtaaaagttcagcagtgtgtgcacagctttcttttggttggcagagattcaggatcatggagtactgctctcataattgaagacgtgtttgttattggcagagaaccttaaaaaaggcctttacctcagcgatgcttcctagccccaggcttgcagagaacacagagtggtgttgtggtctatttagggacaaagaaggtataaagtccagagatgagaaaactgggtcagccctcagaaactgcagcagccacgcacacagaagcctgctggaagacaggtctctctccgtccacagtgcccatcatctgagcctgggctgggatgactcaacttagcaaagacggacccaggaggagtgctggttcttcagtctttgtactggccccatcctctcctcactgtaatgtgaggaagcacctctgtgtcagggctcacctgggcatccaaagcggccacgcccacaatccgacagcccccaggagcaggtccagggatgatgcagcccccttcttggtcccatgtgatgtcatcctgctttgttatcttcttataactttatcctgctataactttatcctcttcccagcctcatccctgtttttctgttagggcaagactcttccataagcctgctaaaaaacagagatgatacctcttacaaactttacctcatagcctgtgaagcaggttggcatgtggattacaagtcctgctttgacactgggcaagaatttaagattgttctatctctactagtcatagaaaagaaacattgttaaacatgttgagttttaaaggaagaaatattttcaaattcttaatccaagaaaatactgagttggaatcttagacttcgggactctgacacgttctttatgaaaggcaaaataattggtatctaaagttctctccttcctgcctcccctaaagaaaaaggatattagattgcacactataattttacataagatctgccttccacacttccctgctggaaggcattctcagagctttatgtcttcgtacctctcagagattggactttttcttgtttaaaaccccaaccaaaaaaaataataaggcatgattggtggggagggaatgtgtatttaggggcataataaaaaggtggctcgaagcaggaactttggcctcatggtgtcatgggtggatgcctggactccagtgtgcctgtgaggggctgggttaggcagtcggctgtcacactcacatgtgcctgcaataaaccttttggaatttcatgaacgaggtnctatgaattgccttttgccaatgaatggatgtatttttccaaggggggaatagtatccttgactttggcagtcacctttttgtatgtctctagaaaggggtcaaaaaaactatggtaaagatgaggcttatgagtgaatacctctgggacaaaccttaggactcacaagctatgccatgtttttcaggagactcttgtaccttatctggaatccaatcctgggagaagaggaaaaaggagctaatatttgtcctttatactcactctgtgccagatactgtgccaggcattttataattgttttgtgtcatccccatgatatccgttaaattaatctattacccccgtgttctaaataatagatcttaagtgtggaatgcatctatccaacataaatgcccatgttgaaagaaggaaagatgtcattcaagtatttttcaaattctttttattatgactatgcccttcgcaacactgtgaaaacaacccctgggggcatctgccttccagaatctctctctggcttctcaccagcttggtttcctcatggggagtgttttatttggcctcccctatctgagctgcacacacaccagggggaggccactggctaacagtaggacttcagtgccctgaggaaaaggctttgggaatttaggcacacgtttctctccttggaatccttctagcatctggaaaaggaacctggtatttctgcagttagataccagatgcaaccagaacaggctttcgagtgctgtgatttctttcctgggttcccaagtcttgttgtttcatcacaaactgtatctttttaaggttaaaagtcttgaccttcatgggggtctgggacaatccgatctccaagcatggaggaaaggcaatgcctggaccactgacttgcattgaaatcctttcttgtgggctagggtttgatgtctctttttcatctttggactggggatctgcatcttccaggtccatttaagcactgaaactagatgcaaatctctttcgagaccttacatgttttagatagtcatgtaatgacttggatagacatttaaataacttgttccaaggtcggaagagcccaagaactcctcagagttcctcttcttgcttcttgaatcacatcctctaaagatgactcatgtctccatagcaactgttaaaggtgctgcctagacgggacccgctcccacctttacttactttgctcgaaggaaccaaaacaatgtccttgtgtaaaggggctgtcatatccagttttcctttgaaatctggcccccaagatcctgcttctttctaacctggcagctgtcatgtcccttcaagatgatgtgggaaatggcccttacaacttgggaaccacagaaattgctgtatttcgggaagattcacctctaaactgaaggcttcattctgatagtgtctgccctctctaccctgatttcgcccttctttgcttccatttttagcccaaggctttgaatttgattgagtaagacttagaggcagtataaagaacaccataaacttaggcagaggtcccttagggtctctagagttgaaaataattctacagccttagggggacctcttggcattgactctaaagggagagaatagcccctgtgtcctggcatttcagtctagaccttcaaggactgttctctcttgacaggcaagcaagcaaagaaagttttgcaatagatttcaagccagtttttccattcaaaccaagatgcaaattcataaaattactcttttcctggaatagatccaggcagctgccttattagaactttagattcggatctattttcttaacacacatacacatacacgcgcatacatacatatacagagagatacgtggagaaaggaaatttactctatcattgcaatacttcaagaaagagctgtattttgcctttctgtaatctccaagatagtgtctaggaaagtaatagtataactatagggataccgaaacaggaaaaaccagccatcactcttgagaaagtttgagttcgactcacatgggagaatcgaggtctgctactcgtcttgctttgtgccccatctgtgcctggatgccctactacatctgcttgactcgtctgggctgctagccggggtgttgtggctgacatcctttcctggccttacacacataatagacacatccctaacggcgtgtgcctggtccagccacatacagccaccacatgtgtcacacactgtccccctcatccatgtggacttgactggcatttcagcagctccactgggatgctctaaccccagtgtgtggagttggggtcccttcatctaggttgacccaggtatagcatttttagcattgcctttccagtcttgatgattcattcattgaactcatttatttctggagcccctggtacactccaggcactgcgctaattgccagcaaagcacaactgaactaaatccaccttcaaggaacctagccataacgagggaggcagcatggaagtaccctacaggggaaagtcctgagtgctgtgggagcatctcaccgtggcagccagcccagttttggcaatcaggggcttcctgaaagaggtgacatcaaagcccggatgtgtcagaggactgagggagagtgttactaaaggactttcaggctgagaggatagcacaggactcagcccaaaggagggccagtgtggactgtccagggccagcctgcagtacagaggctggagcttggacttgtagagggagagagaagagcaagggacgtggacggggcagtgagccaggctagccacagagggttcccggggctttgctggggattcagggagcataaataagagctttaggtggtgctgtgtcctctgcagcccactgctgaggtcctccagacaggtaaggtgtggtcacaatcagggccggggtttccctgctcactgcggcagtgcaggggtgcttgctgagatgattcatcccagggtgtcctctgtcccttacccagccccaactcctcttcctctgccaaaagctatttgaattcaaggactttaacctgggccggatctggtttggagacaaaggggacagctctgggtcagcatgaccttctttagagccactaaggcgaaaaataccgtttgggaccaggctggcctagacccagggatgagaatgcaccctaaaataaatatacgggaagcagcagagggcttccctgtctagtgtgtgatcctaactaaaggcagctctcttggacagccttcccctggattaggtcacatacacctggtggccaagcctctgctgggtcccaaatacacacccgagtcctgccaaagaaaggagatttttaaaaagcacagacaaattgtatgcaagtggaaaatacccataggcctagacagctgtggagggaagacctcgtgggtacctggaggctgccagagctgggagctctgcaggtatgagtcagggaaggctcagagacaagcagaatctctctatggagacaacttgcagtgccttttaggttttccaaataacctcggagttcagagcattgggtttttttctcccctccccacccccagaaaaataattagaaaaatgtttaggagaaaggaaaagaattagatgcatcagaataccagctataagccaacactgtttccagaaactcaagaaaaagctcaaacagaagacagttcccctgagaggctggaggcgttggtgctgaaggcaattttcctagctaaggggcactgggccttgctgcaccttggggctgaccttttttgcaaaacacccacccctgccctcctggcatactcaacagcaacgccagctttctggacccttggaaagatgttagctcaaacacccactttttccagatcttcctcttgctcttcactgaggaatttgtaattctgaggctagcgatgccgactcggatattccgcaggcccaggtgtttagattagaatttgtccagcggtaatcctgatgctggaaaccaacaaacatttggcctcatattcacccatttaaaaactagagcccctggcaggtccccttagggccatgtgttcatggaatataagccaagtttgccttagcgcttgttcatggaatataagccaagtttacctctccccattttctgccctggcccacttcccactcacctccacctcattgccaggaagggatcaaaatgcctccatgccagttgttaaatggctacatatttgcccttcccaagggtatttgcatttntatttaggaacatggccttatattcaaggaaaatctagcatcaagattacgaggcatcacctctcaatcaggtctgggaggtatcttggggcattgctcttctgaacacctgcagaggcttcctcaggtgagtgtgggagcccggaaggtggcctccctaaccactctgcctgcacatgaattctccaaagcagtgggcccccatctgtttcaattacacatgcctgtcagcaaaaacttcgtgagatgcactctctctgtgtgtttattaatttatttaaagcatatatccctttacttttgtactactatattaggcacattataaaaagtatacagcatagaaactttaaatgaataagacacaaaatattataaacagaggttctggcattttctctctgaactcctgagggggaccttgggcacctcctggtatgtgcacaccccactttgaacacccttgctttagtgcaaatcagcacgcctaaatagcatcccaaaccactgtgcgacatttggcctgcagaataagaaagtcctaaggcagaatccccaggaacttcaaatctgggagatgaggaaagaaaactcactcacaaacaacataaatgtaaataattcaaaaccctaaaggagagctgtccctagacagtagtggctacaggtgctaagcaaaagtcaggtacactggacagagccatgcgattgattgttcatcttccctctctgggtctccagaaaaggacactggcaatatccccagctctctcctgattggaattctttgaaccctcgaagtgctccagcagtactaccccccacgtagcagtgggcccatgtcgcttgaatattatttttgatttgaccaccaagatgtaatgatgattctattccattttgaaaagggtctgagaaagtgtacaggtctaattatatatacatatttatacatgtgtatttttgtttattgttacattttgacattggactttctattaaataatttttaaga

SEQ ID NO: 17958 - DNA, 1119 bp, Homo sapiens
aaaaagaagctgtaccgtccggaattcccggatagcccagaaagggaaaaactaccagaacggagatgtgtttggcgatgagtataggatcaaaccagtggaagaggtcaaatacatgaaaaatggggcagaagaagagcagaaaatagcagccaggaaccaagaaaacttggaaaaaagtgccagctcaaatgtaagacttaaaactaataaagaggttccgggattagttcatcaacccagagcaaacatgcacatctctgaaagccaacaagaattcttcagaatgctggatgaaaaaattgaaaagggtcgggattactgttcggaagaagaggatatcacatagcaccaattttaccactcaaaccaggagctactactgtgtaaataggttacaccccagttgaaatctttgcaaaggtcggttctattcagcgaacagcactatagcaaaagaagatcgttccatattgtacgccccattaaattacagtgtttcttaatgaacttgcaaaggaatattgctaaaaacaaacaaaaaaaactgttatcgaactttctttgttgctgctagttaaaacttgttgcaacttttcacttctcttgtgtccaggtatgcagcaaaattctgcaatttcaccttaaagatactgttggttttacagatgctctccaacctattttctataagatgaggtagtggtgaactcagataacaaacttctcttctaaactggttctgcttctaagacaagcatctcctgccctctctccttcctccccatctctcgcacgcagtctagagatggactgagccttgcttctcactggcagtgttgagctttggagatgggatggttgctatgccaagccttgtttctctgctcagaagaagtagagaagctattatcaattaaaagcatgctgtgatgtgactcctggaagtgacgtaggagtgagtggcaggttgtttgatttaataggtatcttaatcaagaattaagcttgcaacattggctttgctcagatgcagatggaagtgtgatcacaatcattttgaatccctcttcctcacttttttttctaagaaaataaacattttactgtttttatgga

SEQ ID NO: 17959 - DNA, 452 bp, Homo sapiens
tgagcgaggagctcccctccctcgctcgctcctcgcaagctcccgctcgctccctgcccactcccggggggacgttccgtgccgcggccgccgcggccgctgcttctttcacactttagttgggagctgcgcgccgcgctcagttactggagagctggccgcgcgccgccgcctcccgcacgcttgcacgcgggcccggcttcggggttttgggttcttactccaagcggcggggaggagggggagccccggacacactgtggggaggaggaggaagaagaggaggagggaggaagaaaaaagacgaggaggacaggggcggggggcgggagcctcaaaggattttgaagccagctgaagggaacccaactgatcaggctggcttttctgaagacagagattttggttacagtgtgggcctgaatcctgcagaggaggaagctgtgacatcc

SEQ ID NO: 17960 - DNA, 428 bp, Homo sapiens
agaaataaacccttgttgttttaagccattctgttttggggatgtttgttactacaacataaccaaactaaaatacctcacctatggataatgagtggtaacatgtcaggttgtagatgaagtacctggcaagcatgtcagaattctgagctgccactggatgagaaacttccatgtcagagaatcctttctccttcctacatggagaggtgccctagggtgaaatgcttcagtggaaattctccttcgattatgaagttgcaaagtctgtccttcggtctgccaacttttccttcttactatctgtcaaatcctgatttattcagaaaaaagtgccagctcaaatgtaagacttaaaactaataaagaggttccgggattagttcatcaacccagagcaaagtacatcacaattggaaagttaaaaa

SEQ ID NO: 17961 - DNA, 10117 bp, Homo sapiens
  misc_feature (4800)..(4800): n is a, c, g, or t
  misc_feature (9102)..(9102): n is a, c, g, or t
ttaccagggccgtgtcttttctttggttcgtagccacgtggtcatcccatgtacaaactgtggggaggaggaggaagaagaggaggagggaggaagaaaaaagacgaggaggacaggggcggggggcgggaggcttgccaccttcagcccccccgcgaacgcccaaggtgcacacatcttgaccaactcagcagcaaggtggattttctttgtgtttaaagaaaaaaaatgtccctgtgtctgtagagatgatttgcagttcagcccggctgaagctgaccgaatgagactatgggctgtgcctccgccaagcatgttgccactgttcaaaatgaagaggaagcccagaaagggaaaaactaccagaacggagatgtgtttggcgatgagtataggatcaaaccagtggaagaggtcaaatacatgaaaaatggggcagaagaagagcagaaaatagcagccaggaaccaagaaaacttggaaaaaagtgccagctcaaatgtaagacttaaaactaataaagaggttccgggattagttcatcaacccagagcaaacatgcacatctctgaaagccaacaagaattcttcagaatgctggatgaaaaaattgaaaagggtcgggattactgttcggaagaagaggatatcacatagcaccaattttaccactcaaaccaggagctactactgtgtaaataggttacaccccagttgaaatctttgcaaaggtcggttctattcagcgaacagcactatagcaaaagaagatcgttccatattgtacgccccattaaattacagtgtttcttaatgaacttgcaaaggaatattgctaaaaacaaacaaaaaaaactgttatcgaactttctttgttgctgctagttaaaacttgttgcaacttttcacttctcttgtgtccaggtatgcagcaaaattctgcaatttcaccttaaagatactgttggttttacagatgctctccaacctattttctataagatgaggtagtggtgaactcagataacaaacttctcttctaaactggttctgcttctaagacaagcatctcctgccctctctccttcctccccatctctcgcacgcagtctagagatggactgagccttgcttctcactggcagtgttgagctttggagatgggatggttgctatgccaagccttgtttctctgctcagaagaagtagagaagctattatcaattaaaagcatgctgtgatgtgactcctggaagtgacgtaggagtgagtggcaggttgtttgatttaataggtatcttaatcaagaattaagcttgcaacattggctttgctcagatgcagatggaagtgtgatcacaatcattttgaatccctcttcctcacttttttttctaagaaaataaacattttactgtttttatggatccttgtcttctcccattcatccagctcagtgttttaagatgatcctgggtgcagaagttgagccctcctttgcattgacactgataattagcctatagggctccctacccttccattaagaatctaccaagcattagcaaggctgaaagtggtctaagaggtgaggggacatcctatgactttttaggaaggcctgaaaccaccttgttacctttcattttgttagcaaataaaccatcctattttgtaactctcccccttcaaaatgctacatgagccttgccacttcctttttctcttacttccagcacactagacatagcaaaagtgtttgcctactcaaaaacataatacttttatgctgatgatggtatttggagatgtgaaagccaaaagcccctggcagtggtggggaatgttgactgagtgttcagcagagtttatttttccatactatatgaagagaatgatctcttctcaaagacagaagtgatatttttaacaaatattgtcacaagtaaatagcaatcaaaaggagaaaataacttttgtatttttttaatgtgtttgatagctttgacgagggttctctttgttactttcaggggagggcatcctattaaatgccacgccagcagtccgggtctgggtttgtcccacaaaatcacaggagcactgtatgttcctctcttttggagttgtgactttgaagggcctcaatattagccacactgccgcctgcagaaggtggagagttaagatgttctatgtcaatttgctcttgccgaaaagatgagcctcgattttaaaatctatccacatccaactgatggcaccattgatgtgcaaataatgagattccctatctccttttagacctgggacggcaaaagggaagggaaggaaacttagcagagtgctattgactatagattcacatattagcaacaaaatcccgtaattcttttggccaacagcagctattttggggagcagctgtggctgttacataaatagagatgcagccaaaattttaggccttttatcctgcttctagcagaaaaatgcagggagagtcaagtagtctagggtttcaggttgcctcccctcatatggtttttggccaagtgactaaaacagttttccacaactgtaaacaaactggtaagccccacctcaaacttgttcactggggactttgcttaccgttctgtgggtgaccttttccgggatttcttgttcttatcaagcaagaattaagcacatgctaaacgtcttccatttgacttctctactcggtgtctcagacagtgtcttcccagaaaaccaccaccctctacccaaagatgaaacatgctcatgtcatttttctcatggtcacatttaacagttttgacatgttatacttgcgcatagatccaagcgtttcttgggaacctgacttttgagtgtttaataaagccggaagtggtgttgccctgaaccagcagattttcacctgggttctggctccggtgtttaacactggatacatctttgatgtgcgaaagtgagttcatcttcagacacatttggtacatccagaaatagatccaagaaatggggtggttgagtgggtccgcacgaaatgcttgattatgtcagcaacacccaacactgtctgttttccatttgttggttttaatcataaaattgtcaagtgattcgtgttgtactttatttttgtgccttctgaacggatctaaaacaaaagtattttgccttttttaccccacgtgtatctgaacattaagcagattggctcagacaccatgaaaaggatactccaatgtacgtgctggtgcactctgctagttgttatctctgtagggctcaagaagctggaaggaggaagggagggtaagtggcctggtgagtggaggtagaaaaatgatgagaaatgaactgagagcattaagcagagagggttgataggctggccgtgtccggggtgaaattggaaatccagctgcctagtggccagtgggtggggcaagactgtcaacgagatttacagctggcttacacatgccttatgtcctctgagttgtagagttgtaaaagttcagcagtgtgtgcacagctttcttttggttggcagagattcaggatcatggagtactgctctcataattgaagacgtgtttgttattggcagagaaccttaaaaaaggcctttacctcagcgatgcttcctagccccaggcttgcagagaacacagagtggtgttgtggtctatttagggacaaagaaggtataaagtccagagatgagaaaactgggtcagccctcagaaactgcagcagccacgcacacagaagcctgctggaagacaggtctctctccgtccacagtgcccatcatctgagcctgggctgggatgactcaacttagcaaagacggacccaggaggagtgctggttcttcagtctttgtactggccccatcctctcctcactgtaatgtgaggaagcacctctgtgtcagggctcacctgggcatccaaagcggccacgcccacaatccgacagcccccaggagcaggtccagggatgatgcagcccccttcttggtcccatgtgatgtcatcctgctttgttatcttcttataactttatcctgctataactttatcctcttcccagcctcatccctgtttttctgttagggcaagactcttccataagcctgctaaaaaacagagatgatacctcttacaaactttacctcatagcctgtgaagcaggttggcatgtggattacaagtcctgctttgacactgggcaagaatttaagattgttctatctctactagtcatagaaaagaaacattgttaaacatgttgagttttaaaggaagaaatattttcaaattcttaatccaagaaaatactgagttggaatcttagacttcgggactctgacacgttctttatgaaaggcaaaataattggtatctaaagttctctccttcctgcctcccctaaagaaaaaggatattagattgcacactataattttacataagatctgccttccacacttccctgctggaaggcattctcagagctttatgtcttcgtacctctcagagattggactttttcttgtttaaaaccccaaccaaaaaaaataataaggcatgattggtggggagggaatgtgtatttaggggcataataaaaaggtggctcgaagcaggaactttggcctcatggtgtcatgggtggatgcctggactccagtgtgcctgtgaggggctgggttaggcagtcggctgtcacactcacatgtgcctgcaataaaccttttggaatttcatgaacgaggtnctatgaattgccttttgccaatgaatggatgtatttttccaaggggggaatagtatccttgactttggcagtcacctttttgtatgtctctagaaaggggtcaaaaaaactatggtaaagatgaggcttatgagtgaatacctctgggacaaaccttaggactcacaagctatgccatgtttttcaggagactcttgtaccttatctggaatccaatcctgggagaagaggaaaaaggagctaatatttgtcctttatactcactctgtgccagatactgtgccaggcattttataattgttttgtgtcatccccatgatatccgttaaattaatctattacccccgtgttctaaataatagatcttaagtgtggaatgcatctatccaacataaatgcccatgttgaaagaaggaaagatgtcattcaagtatttttcaaattctttttattatgactatgcccttcgcaacactgtgaaaacaacccctgggggcatctgccttccagaatctctctctggcttctcaccagcttggtttcctcatggggagtgttttatttggcctcccctatctgagctgcacacacaccagggggaggccactggctaacagtaggacttcagtgccctgaggaaaaggctttgggaatttaggcacacgtttctctccttggaatccttctagcatctggaaaaggaacctggtatttctgcagttagataccagatgcaaccagaacaggctttcgagtgctgtgatttctttcctgggttcccaagtcttgttgtttcatcacaaactgtatctttttaaggttaaaagtcttgaccttcatgggggtctgggacaatccgatctccaagcatggaggaaaggcaatgcctggaccactgacttgcattgaaatcctttcttgtgggctagggtttgatgtctctttttcatctttggactggggatctgcatcttccaggtccatttaagcactgaaactagatgcaaatctctttcgagaccttacatgttttagatagtcatgtaatgacttggatagacatttaaataacttgttccaaggtcggaagagcccaagaactcctcagagttcctcttcttgcttcttgaatcacatcctctaaagatgactcatgtctccatagcaactgttaaaggtgctgcctagacgggacccgctcccacctttacttactttgctcgaaggaaccaaaacaatgtccttgtgtaaaggggctgtcatatccagttttcctttgaaatctggcccccaagatcctgcttctttctaacctggcagctgtcatgtcccttcaagatgatgtgggaaatggcccttacaacttgggaaccacagaaattgctgtatttcgggaagattcacctctaaactgaaggcttcattctgatagtgtctgccctctctaccctgatttcgcccttctttgcttccatttttagcccaaggctttgaatttgattgagtaagacttagaggcagtataaagaacaccataaacttaggcagaggtcccttagggtctctagagttgaaaataattctacagccttagggggacctcttggcattgactctaaagggagagaatagcccctgtgtcctggcatttcagtctagaccttcaaggactgttctctcttgacaggcaagcaagcaaagaaagttttgcaatagatttcaagccagtttttccattcaaaccaagatgcaaattcataaaattactcttttcctggaatagatccaggcagctgccttattagaactttagattcggatctattttcttaacacacatacacatacacgcgcatacatacatatacagagagatacgtggagaaaggaaatttactctatcattgcaatacttcaagaaagagctgtattttgcctttctgtaatctccaagatagtgtctaggaaagtaatagtataactatagggataccgaaacaggaaaaaccagccatcactcttgagaaagtttgagttcgactcacatgggagaatcgaggtctgctactcgtcttgctttgtgccccatctgtgcctggatgccctactacatctgcttgactcgtctgggctgctagccggggtgttgtggctgacatcctttcctggccttacacacataatagacacatccctaacggcgtgtgcctggtccagccacatacagccaccacatgtgtcacacactgtccccctcatccatgtggacttgactggcatttcagcagctccactgggatgctctaaccccagtgtgtggagttggggtcccttcatctaggttgacccaggtatagcatttttagcattgcctttccagtcttgatgattcattcattgaactcatttatttctggagcccctggtacactccaggcactgcgctaattgccagcaaagcacaactgaactaaatccaccttcaaggaacctagccataacgagggaggcagcatggaagtaccctacaggggaaagtcctgagtgctgtgggagcatctcaccgtggcagccagcccagttttggcaatcaggggcttcctgaaagaggtgacatcaaagcccggatgtgtcagaggactgagggagagtgttactaaaggactttcaggctgagaggatagcacaggactcagcccaaaggagggccagtgtggactgtccagggccagcctgcagtacagaggctggagcttggacttgtagagggagagagaagagcaagggacgtggacggggcagtgagccaggctagccacagagggttcccggggctttgctggggattcagggagcataaataagagctttaggtggtgctgtgtcctctgcagcccactgctgaggtcctccagacaggtaaggtgtggtcacaatcagggccggggtttccctgctcactgcggcagtgcaggggtgcttgctgagatgattcatcccagggtgtcctctgtcccttacccagccccaactcctcttcctctgccaaaagctatttgaattcaaggactttaacctgggccggatctggtttggagacaaaggggacagctctgggtcagcatgaccttctttagagccactaaggcgaaaaataccgtttgggaccaggctggcctagacccagggatgagaatgcaccctaaaataaatatacgggaagcagcagagggcttccctgtctagtgtgtgatcctaactaaaggcagctctcttggacagccttcccctggattaggtcacatacacctggtggccaagcctctgctgggtcccaaatacacacccgagtcctgccaaagaaaggagatttttaaaaagcacagacaaattgtatgcaagtggaaaatacccataggcctagacagctgtggagggaagacctcgtgggtacctggaggctgccagagctgggagctctgcaggtatgagtcagggaaggctcagagacaagcagaatctctctatggagacaacttgcagtgccttttaggttttccaaataacctcggagttcagagcattgggtttttttctcccctccccacccccagaaaaataattagaaaaatgtttaggagaaaggaaaagaattagatgcatcagaataccagctataagccaacactgtttccagaaactcaagaaaaagctcaaacagaagacagttcccctgagaggctggaggcgttggtgctgaaggcaattttcctagctaaggggcactgggccttgctgcaccttggggctgaccttttttgcaaaacacccacccctgccctcctggcatactcaacagcaacgccagctttctggacccttggaaagatgttagctcaaacacccactttttccagatcttcctcttgctcttcactgaggaatttgtaattctgaggctagcgatgccgactcggatattccgcaggcccaggtgtttagattagaatttgtccagcggtaatcctgatgctggaaaccaacaaacatttggcctcatattcacccatttaaaaactagagcccctggcaggtccccttagggccatgtgttcatggaatataagccaagtttgccttagcgcttgttcatggaatataagccaagtttacctctccccattttctgccctggcccacttcccactcacctccacctcattgccaggaagggatcaaaatgcctccatgccagttgttaaatggctacatatttgcccttcccaagggtatttgcatttntatttaggaacatggccttatattcaaggaaaatctagcatcaagattacgaggcatcacctctcaatcaggtctgggaggtatcttggggcattgctcttctgaacacctgcagaggcttcctcaggtgagtgtgggagcccggaaggtggcctccctaaccactctgcctgcacatgaattctccaaagcagtgggcccccatctgtttcaattacacatgcctgtcagcaaaaacttcgtgagatgcactctctctgtgtgtttattaatttatttaaagcatatatccctttacttttgtactactatattaggcacattataaaaagtatacagcatagaaactttaaatgaataagacacaaaatattataaacagaggttctggcattttctctctgaactcctgagggggaccttgggcacctcctggtatgtgcacaccccactttgaacacccttgctttagtgcaaatcagcacgcctaaatagcatcccaaaccactgtgcgacatttggcctgcagaataagaaagtcctaaggcagaatccccaggaacttcaaatctgggagatgaggaaagaaaactcactcacaaacaacataaatgtaaataattcaaaaccctaaaggagagctgtccctagacagtagtggctacaggtgctaagcaaaagtcaggtacactggacagagccatgcgattgattgttcatcttccctctctgggtctccagaaaaggacactggcaatatccccagctctctcctgattggaattctttgaaccctcgaagtgctccagcagtactaccccccacgtagcagtgggcccatgtcgcttgaatattatttttgatttgaccaccaagatgtaatgatgattctattccattttgaaaagggtctgagaaagtgtacaggtctaattatatatacatatttatacatgtgtatttttgtttattgttacattttgacattggactttctattaaataatttttaaga

SEQ ID NO: 17962 - DNA, 10174 bp, Homo sapiens
  misc_feature (4857)..(4857): n is a, c, g, or t
  misc_feature (9159)..(9159): n is a, c, g, or t
tgagcgaggagctcccctccctcgctcgctcctcgcaagctcccgctcgctccctgcccactcccggggggacgttccgtgccgcggccgccgcggccgctgcttctttcacactttagttgggagctgcgcgccgcgctcagttactggagagctggccgcgcgccgccgcctcccgcacgcttgcacgcttgccaccttcagcccccccgcgaacgcccaaggtgcacacatcttgaccaactcagcagcaaggtggattttctttgtgtttaaagaaaaaaaatgtccctgtgtctgtagagatgatttgcagttcagcccggctgaagctgaccgaatgagactatgggctgtgcctccgccaagcatgttgccactgttcaaaatgaagaggaagcccagaaagggaaaaactaccagaacggagatgtgtttggcgatgagtataggatcaaaccagtggaagaggtcaaatacatgaaaaatggggcagaagaagagcagaaaatagcagccaggaaccaagaaaacttggaaaaaagtgccagctcaaatgtaagacttaaaactaataaagaggttccgggattagttcatcaacccagagcaaacatgcacatctctgaaagccaacaagaattcttcagaatgctggatgaaaaaattgaaaagggtcgggattactgttcggaagaagaggatatcacatagcaccaattttaccactcaaaccaggagctactactgtgtaaataggttacaccccagttgaaatctttgcaaaggtcggttctattcagcgaacagcactatagcaaaagaagatcgttccatattgtacgccccattaaattacagtgtttcttaatgaacttgcaaaggaatattgctaaaaacaaacaaaaaaaactgttatcgaactttctttgttgctgctagttaaaacttgttgcaacttttcacttctcttgtgtccaggtatgcagcaaaattctgcaatttcaccttaaagatactgttggttttacagatgctctccaacctattttctataagatgaggtagtggtgaactcagataacaaacttctcttctaaactggttctgcttctaagacaagcatctcctgccctctctccttcctccccatctctcgcacgcagtctagagatggactgagccttgcttctcactggcagtgttgagctttggagatgggatggttgctatgccaagccttgtttctctgctcagaagaagtagagaagctattatcaattaaaagcatgctgtgatgtgactcctggaagtgacgtaggagtgagtggcaggttgtttgatttaataggtatcttaatcaagaattaagcttgcaacattggctttgctcagatgcagatggaagtgtgatcacaatcattttgaatccctcttcctcacttttttttctaagaaaataaacattttactgtttttatggatccttgtcttctcccattcatccagctcagtgttttaagatgatcctgggtgcagaagttgagccctcctttgcattgacactgataattagcctatagggctccctacccttccattaagaatctaccaagcattagcaaggctgaaagtggtctaagaggtgaggggacatcctatgactttttaggaaggcctgaaaccaccttgttacctttcattttgttagcaaataaaccatcctattttgtaactctcccccttcaaaatgctacatgagccttgccacttcctttttctcttacttccagcacactagacatagcaaaagtgtttgcctactcaaaaacataatacttttatgctgatgatggtatttggagatgtgaaagccaaaagcccctggcagtggtggggaatgttgactgagtgttcagcagagtttatttttccatactatatgaagagaatgatctcttctcaaagacagaagtgatatttttaacaaatattgtcacaagtaaatagcaatcaaaaggagaaaataacttttgtatttttttaatgtgtttgatagctttgacgagggttctctttgttactttcaggggagggcatcctattaaatgccacgccagcagtccgggtctgggtttgtcccacaaaatcacaggagcactgtatgttcctctcttttggagttgtgactttgaagggcctcaatattagccacactgccgcctgcagaaggtggagagttaagatgttctatgtcaatttgctcttgccgaaaagatgagcctcgattttaaaatctatccacatccaactgatggcaccattgatgtgcaaataatgagattccctatctccttttagacctgggacggcaaaagggaagggaaggaaacttagcagagtgctattgactatagattcacatattagcaacaaaatcccgtaattcttttggccaacagcagctattttggggagcagctgtggctgttacataaatagagatgcagccaaaattttaggccttttatcctgcttctagcagaaaaatgcagggagagtcaagtagtctagggtttcaggttgcctcccctcatatggtttttggccaagtgactaaaacagttttccacaactgtaaacaaactggtaagccccacctcaaacttgttcactggggactttgcttaccgttctgtgggtgaccttttccgggatttcttgttcttatcaagcaagaattaagcacatgctaaacgtcttccatttgacttctctactcggtgtctcagacagtgtcttcccagaaaaccaccaccctctacccaaagatgaaacatgctcatgtcatttttctcatggtcacatttaacagttttgacatgttatacttgcgcatagatccaagcgtttcttgggaacctgacttttgagtgtttaataaagccggaagtggtgttgccctgaaccagcagattttcacctgggttctggctccggtgtttaacactggatacatctttgatgtgcgaaagtgagttcatcttcagacacatttggtacatccagaaatagatccaagaaatggggtggttgagtgggtccgcacgaaatgcttgattatgtcagcaacacccaacactgtctgttttccatttgttggttttaatcataaaattgtcaagtgattcgtgttgtactttatttttgtgccttctgaacggatctaaaacaaaagtattttgccttttttaccccacgtgtatctgaacattaagcagattggctcagacaccatgaaaaggatactccaatgtacgtgctggtgcactctgctagttgttatctctgtagggctcaagaagctggaaggaggaagggagggtaagtggcctggtgagtggaggtagaaaaatgatgagaaatgaactgagagcattaagcagagagggttgataggctggccgtgtccggggtgaaattggaaatccagctgcctagtggccagtgggtggggcaagactgtcaacgagatttacagctggcttacacatgccttatgtcctctgagttgtagagttgtaaaagttcagcagtgtgtgcacagctttcttttggttggcagagattcaggatcatggagtactgctctcataattgaagacgtgtttgttattggcagagaaccttaaaaaaggcctttacctcagcgatgcttcctagccccaggcttgcagagaacacagagtggtgttgtggtctatttagggacaaagaaggtataaagtccagagatgagaaaactgggtcagccctcagaaactgcagcagccacgcacacagaagcctgctggaagacaggtctctctccgtccacagtgcccatcatctgagcctgggctgggatgactcaacttagcaaagacggacccaggaggagtgctggttcttcagtctttgtactggccccatcctctcctcactgtaatgtgaggaagcacctctgtgtcagggctcacctgggcatccaaagcggccacgcccacaatccgacagcccccaggagcaggtccagggatgatgcagcccccttcttggtcccatgtgatgtcatcctgctttgttatcttcttataactttatcctgctataactttatcctcttcccagcctcatccctgtttttctgttagggcaagactcttccataagcctgctaaaaaacagagatgatacctcttacaaactttacctcatagcctgtgaagcaggttggcatgtggattacaagtcctgctttgacactgggcaagaatttaagattgttctatctctactagtcatagaaaagaaacattgttaaacatgttgagttttaaaggaagaaatattttcaaattcttaatccaagaaaatactgagttggaatcttagacttcgggactctgacacgttctttatgaaaggcaaaataattggtatctaaagttctctccttcctgcctcccctaaagaaaaaggatattagattgcacactataattttacataagatctgccttccacacttccctgctggaaggcattctcagagctttatgtcttcgtacctctcagagattggactttttcttgtttaaaaccccaaccaaaaaaaataataaggcatgattggtggggagggaatgtgtatttaggggcataataaaaaggtggctcgaagcaggaactttggcctcatggtgtcatgggtggatgcctggactccagtgtgcctgtgaggggctgggttaggcagtcggctgtcacactcacatgtgcctgcaataaaccttttggaatttcatgaacgaggtnctatgaattgccttttgccaatgaatggatgtatttttccaaggggggaatagtatccttgactttggcagtcacctttttgtatgtctctagaaaggggtcaaaaaaactatggtaaagatgaggcttatgagtgaatacctctgggacaaaccttaggactcacaagctatgccatgtttttcaggagactcttgtaccttatctggaatccaatcctgggagaagaggaaaaaggagctaatatttgtcctttatactcactctgtgccagatactgtgccaggcattttataattgttttgtgtcatccccatgatatccgttaaattaatctattacccccgtgttctaaataatagatcttaagtgtggaatgcatctatccaacataaatgcccatgttgaaagaaggaaagatgtcattcaagtatttttcaaattctttttattatgactatgcccttcgcaacactgtgaaaacaacccctgggggcatctgccttccagaatctctctctggcttctcaccagcttggtttcctcatggggagtgttttatttggcctcccctatctgagctgcacacacaccagggggaggccactggctaacagtaggacttcagtgccctgaggaaaaggctttgggaatttaggcacacgtttctctccttggaatccttctagcatctggaaaaggaacctggtatttctgcagttagataccagatgcaaccagaacaggctttcgagtgctgtgatttctttcctgggttcccaagtcttgttgtttcatcacaaactgtatctttttaaggttaaaagtcttgaccttcatgggggtctgggacaatccgatctccaagcatggaggaaaggcaatgcctggaccactgacttgcattgaaatcctttcttgtgggctagggtttgatgtctctttttcatctttggactggggatctgcatcttccaggtccatttaagcactgaaactagatgcaaatctctttcgagaccttacatgttttagatagtcatgtaatgacttggatagacatttaaataacttgttccaaggtcggaagagcccaagaactcctcagagttcctcttcttgcttcttgaatcacatcctctaaagatgactcatgtctccatagcaactgttaaaggtgctgcctagacgggacccgctcccacctttacttactttgctcgaaggaaccaaaacaatgtccttgtgtaaaggggctgtcatatccagttttcctttgaaatctggcccccaagatcctgcttctttctaacctggcagctgtcatgtcccttcaagatgatgtgggaaatggcccttacaacttgggaaccacagaaattgctgtatttcgggaagattcacctctaaactgaaggcttcattctgatagtgtctgccctctctaccctgatttcgcccttctttgcttccatttttagcccaaggctttgaatttgattgagtaagacttagaggcagtataaagaacaccataaacttaggcagaggtcccttagggtctctagagttgaaaataattctacagccttagggggacctcttggcattgactctaaagggagagaatagcccctgtgtcctggcatttcagtctagaccttcaaggactgttctctcttgacaggcaagcaagcaaagaaagttttgcaatagatttcaagccagtttttccattcaaaccaagatgcaaattcataaaattactcttttcctggaatagatccaggcagctgccttattagaactttagattcggatctattttcttaacacacatacacatacacgcgcatacatacatatacagagagatacgtggagaaaggaaatttactctatcattgcaatacttcaagaaagagctgtattttgcctttctgtaatctccaagatagtgtctaggaaagtaatagtataactatagggataccgaaacaggaaaaaccagccatcactcttgagaaagtttgagttcgactcacatgggagaatcgaggtctgctactcgtcttgctttgtgccccatctgtgcctggatgccctactacatctgcttgactcgtctgggctgctagccggggtgttgtggctgacatcctttcctggccttacacacataatagacacatccctaacggcgtgtgcctggtccagccacatacagccaccacatgtgtcacacactgtccccctcatccatgtggacttgactggcatttcagcagctccactgggatgctctaaccccagtgtgtggagttggggtcccttcatctaggttgacccaggtatagcatttttagcattgcctttccagtcttgatgattcattcattgaactcatttatttctggagcccctggtacactccaggcactgcgctaattgccagcaaagcacaactgaactaaatccaccttcaaggaacctagccataacgagggaggcagcatggaagtaccctacaggggaaagtcctgagtgctgtgggagcatctcaccgtggcagccagcccagttttggcaatcaggggcttcctgaaagaggtgacatcaaagcccggatgtgtcagaggactgagggagagtgttactaaaggactttcaggctgagaggatagcacaggactcagcccaaaggagggccagtgtggactgtccagggccagcctgcagtacagaggctggagcttggacttgtagagggagagagaagagcaagggacgtggacggggcagtgagccaggctagccacagagggttcccggggctttgctggggattcagggagcataaataagagctttaggtggtgctgtgtcctctgcagcccactgctgaggtcctccagacaggtaaggtgtggtcacaatcagggccggggtttccctgctcactgcggcagtgcaggggtgcttgctgagatgattcatcccagggtgtcctctgtcccttacccagccccaactcctcttcctctgccaaaagctatttgaattcaaggactttaacctgggccggatctggtttggagacaaaggggacagctctgggtcagcatgaccttctttagagccactaaggcgaaaaataccgtttgggaccaggctggcctagacccagggatgagaatgcaccctaaaataaatatacgggaagcagcagagggcttccctgtctagtgtgtgatcctaactaaaggcagctctcttggacagccttcccctggattaggtcacatacacctggtggccaagcctctgctgggtcccaaatacacacccgagtcctgccaaagaaaggagatttttaaaaagcacagacaaattgtatgcaagtggaaaatacccataggcctagacagctgtggagggaagacctcgtgggtacctggaggctgccagagctgggagctctgcaggtatgagtcagggaaggctcagagacaagcagaatctctctatggagacaacttgcagtgccttttaggttttccaaataacctcggagttcagagcattgggtttttttctcccctccccacccccagaaaaataattagaaaaatgtttaggagaaaggaaaagaattagatgcatcagaataccagctataagccaacactgtttccagaaactcaagaaaaagctcaaacagaagacagttcccctgagaggctggaggcgttggtgctgaaggcaattttcctagctaaggggcactgggccttgctgcaccttggggctgaccttttttgcaaaacacccacccctgccctcctggcatactcaacagcaacgccagctttctggacccttggaaagatgttagctcaaacacccactttttccagatcttcctcttgctcttcactgaggaatttgtaattctgaggctagcgatgccgactcggatattccgcaggcccaggtgtttagattagaatttgtccagcggtaatcctgatgctggaaaccaacaaacatttggcctcatattcacccatttaaaaactagagcccctggcaggtccccttagggccatgtgttcatggaatataagccaagtttgccttagcgcttgttcatggaatataagccaagtttacctctccccattttctgccctggcccacttcccactcacctccacctcattgccaggaagggatcaaaatgcctccatgccagttgttaaatggctacatatttgcccttcccaagggtatttgcatttntatttaggaacatggccttatattcaaggaaaatctagcatcaagattacgaggcatcacctctcaatcaggtctgggaggtatcttggggcattgctcttctgaacacctgcagaggcttcctcaggtgagtgtgggagcccggaaggtggcctccctaaccactctgcctgcacatgaattctccaaagcagtgggcccccatctgtttcaattacacatgcctgtcagcaaaaacttcgtgagatgcactctctctgtgtgtttattaatttatttaaagcatatatccctttacttttgtactactatattaggcacattataaaaagtatacagcatagaaactttaaatgaataagacacaaaatattataaacagaggttctggcattttctctctgaactcctgagggggaccttgggcacctcctggtatgtgcacaccccactttgaacacccttgctttagtgcaaatcagcacgcctaaatagcatcccaaaccactgtgcgacatttggcctgcagaataagaaagtcctaaggcagaatccccaggaacttcaaatctgggagatgaggaaagaaaactcactcacaaacaacataaatgtaaataattcaaaaccctaaaggagagctgtccctagacagtagtggctacaggtgctaagcaaaagtcaggtacactggacagagccatgcgattgattgttcatcttccctctctgggtctccagaaaaggacactggcaatatccccagctctctcctgattggaattctttgaaccctcgaagtgctccagcagtactaccccccacgtagcagtgggcccatgtcgcttgaatattatttttgatttgaccaccaagatgtaatgatgattctattccattttgaaaagggtctgagaaagtgtacaggtctaattatatatacatatttatacatgtgtatttttgtttattgttacattttgacattggactttctattaaataatttttaaga

SEQ ID NO: 17963 - DNA, 9825 bp, Homo sapiens
  misc_feature (4508)..(4508): n is a, c, g, or t
  misc_feature (8810)..(8810): n is a, c, g, or t
ggcttcctcttcattttgaacagtggcaacatgcttggcggaggcacagagcccagaaagggaaaaactaccagaacggagatgtgtttggcgatgagtataggatcaaaccagtggaagaggtcaaatacatgaaaaatggggcagaagaagagcagaaaatagcagccaggaaccaagaaaacttggaaaaaagtgccagctcaaatgtaagacttaaaactaataaagaggttccgggattagttcatcaacccagagcaaacatgcacatctctgaaagccaacaagaattcttcagaatgctggatgaaaaaattgaaaagggtcgggattactgttcggaagaagaggatatcacatagcaccaattttaccactcaaaccaggagctactactgtgtaaataggttacaccccagttgaaatctttgcaaaggtcggttctattcagcgaacagcactatagcaaaagaagatcgttccatattgtacgccccattaaattacagtgtttcttaatgaacttgcaaaggaatattgctaaaaacaaacaaaaaaaactgttatcgaactttctttgttgctgctagttaaaacttgttgcaacttttcacttctcttgtgtccaggtatgcagcaaaattctgcaatttcaccttaaagatactgttggttttacagatgctctccaacctattttctataagatgaggtagtggtgaactcagataacaaacttctcttctaaactggttctgcttctaagacaagcatctcctgccctctctccttcctccccatctctcgcacgcagtctagagatggactgagccttgcttctcactggcagtgttgagctttggagatgggatggttgctatgccaagccttgtttctctgctcagaagaagtagagaagctattatcaattaaaagcatgctgtgatgtgactcctggaagtgacgtaggagtgagtggcaggttgtttgatttaataggtatcttaatcaagaattaagcttgcaacattggctttgctcagatgcagatggaagtgtgatcacaatcattttgaatccctcttcctcacttttttttctaagaaaataaacattttactgtttttatggatccttgtcttctcccattcatccagctcagtgttttaagatgatcctgggtgcagaagttgagccctcctttgcattgacactgataattagcctatagggctccctacccttccattaagaatctaccaagcattagcaaggctgaaagtggtctaagaggtgaggggacatcctatgactttttaggaaggcctgaaaccaccttgttacctttcattttgttagcaaataaaccatcctattttgtaactctcccccttcaaaatgctacatgagccttgccacttcctttttctcttacttccagcacactagacatagcaaaagtgtttgcctactcaaaaacataatacttttatgctgatgatggtatttggagatgtgaaagccaaaagcccctggcagtggtggggaatgttgactgagtgttcagcagagtttatttttccatactatatgaagagaatgatctcttctcaaagacagaagtgatatttttaacaaatattgtcacaagtaaatagcaatcaaaaggagaaaataacttttgtatttttttaatgtgtttgatagctttgacgagggttctctttgttactttcaggggagggcatcctattaaatgccacgccagcagtccgggtctgggtttgtcccacaaaatcacaggagcactgtatgttcctctcttttggagttgtgactttgaagggcctcaatattagccacactgccgcctgcagaaggtggagagttaagatgttctatgtcaatttgctcttgccgaaaagatgagcctcgattttaaaatctatccacatccaactgatggcaccattgatgtgcaaataatgagattccctatctccttttagacctgggacggcaaaagggaagggaaggaaacttagcagagtgctattgactatagattcacatattagcaacaaaatcccgtaattcttttggccaacagcagctattttggggagcagctgtggctgttacataaatagagatgcagccaaaattttaggccttttatcctgcttctagcagaaaaatgcagggagagtcaagtagtctagggtttcaggttgcctcccctcatatggtttttggccaagtgactaaaacagttttccacaactgtaaacaaactggtaagccccacctcaaacttgttcactggggactttgcttaccgttctgtgggtgaccttttccgggatttcttgttcttatcaagcaagaattaagcacatgctaaacgtcttccatttgacttctctactcggtgtctcagacagtgtcttcccagaaaaccaccaccctctacccaaagatgaaacatgctcatgtcatttttctcatggtcacatttaacagttttgacatgttatacttgcgcatagatccaagcgtttcttgggaacctgacttttgagtgtttaataaagccggaagtggtgttgccctgaaccagcagattttcacctgggttctggctccggtgtttaacactggatacatctttgatgtgcgaaagtgagttcatcttcagacacatttggtacatccagaaatagatccaagaaatggggtggttgagtgggtccgcacgaaatgcttgattatgtcagcaacacccaacactgtctgttttccatttgttggttttaatcataaaattgtcaagtgattcgtgttgtactttatttttgtgccttctgaacggatctaaaacaaaagtattttgccttttttaccccacgtgtatctgaacattaagcagattggctcagacaccatgaaaaggatactccaatgtacgtgctggtgcactctgctagttgttatctctgtagggctcaagaagctggaaggaggaagggagggtaagtggcctggtgagtggaggtagaaaaatgatgagaaatgaactgagagcattaagcagagagggttgataggctggccgtgtccggggtgaaattggaaatccagctgcctagtggccagtgggtggggcaagactgtcaacgagatttacagctggcttacacatgccttatgtcctctgagttgtagagttgtaaaagttcagcagtgtgtgcacagctttcttttggttggcagagattcaggatcatggagtactgctctcataattgaagacgtgtttgttattggcagagaaccttaaaaaaggcctttacctcagcgatgcttcctagccccaggcttgcagagaacacagagtggtgttgtggtctatttagggacaaagaaggtataaagtccagagatgagaaaactgggtcagccctcagaaactgcagcagccacgcacacagaagcctgctggaagacaggtctctctccgtccacagtgcccatcatctgagcctgggctgggatgactcaacttagcaaagacggacccaggaggagtgctggttcttcagtctttgtactggccccatcctctcctcactgtaatgtgaggaagcacctctgtgtcagggctcacctgggcatccaaagcggccacgcccacaatccgacagcccccaggagcaggtccagggatgatgcagcccccttcttggtcccatgtgatgtcatcctgctttgttatcttcttataactttatcctgctataactttatcctcttcccagcctcatccctgtttttctgttagggcaagactcttccataagcctgctaaaaaacagagatgatacctcttacaaactttacctcatagcctgtgaagcaggttggcatgtggattacaagtcctgctttgacactgggcaagaatttaagattgttctatctctactagtcatagaaaagaaacattgttaaacatgttgagttttaaaggaagaaatattttcaaattcttaatccaagaaaatactgagttggaatcttagacttcgggactctgacacgttctttatgaaaggcaaaataattggtatctaaagttctctccttcctgcctcccctaaagaaaaaggatattagattgcacactataattttacataagatctgccttccacacttccctgctggaaggcattctcagagctttatgtcttcgtacctctcagagattggactttttcttgtttaaaaccccaaccaaaaaaaataataaggcatgattggtggggagggaatgtgtatttaggggcataataaaaaggtggctcgaagcaggaactttggcctcatggtgtcatgggtggatgcctggactccagtgtgcctgtgaggggctgggttaggcagtcggctgtcacactcacatgtgcctgcaataaaccttttggaatttcatgaacgaggtnctatgaattgccttttgccaatgaatggatgtatttttccaaggggggaatagtatccttgactttggcagtcacctttttgtatgtctctagaaaggggtcaaaaaaactatggtaaagatgaggcttatgagtgaatacctctgggacaaaccttaggactcacaagctatgccatgtttttcaggagactcttgtaccttatctggaatccaatcctgggagaagaggaaaaaggagctaatatttgtcctttatactcactctgtgccagatactgtgccaggcattttataattgttttgtgtcatccccatgatatccgttaaattaatctattacccccgtgttctaaataatagatcttaagtgtggaatgcatctatccaacataaatgcccatgttgaaagaaggaaagatgtcattcaagtatttttcaaattctttttattatgactatgcccttcgcaacactgtgaaaacaacccctgggggcatctgccttccagaatctctctctggcttctcaccagcttggtttcctcatggggagtgttttatttggcctcccctatctgagctgcacacacaccagggggaggccactggctaacagtaggacttcagtgccctgaggaaaaggctttgggaatttaggcacacgtttctctccttggaatccttctagcatctggaaaaggaacctggtatttctgcagttagataccagatgcaaccagaacaggctttcgagtgctgtgatttctttcctgggttcccaagtcttgttgtttcatcacaaactgtatctttttaaggttaaaagtcttgaccttcatgggggtctgggacaatccgatctccaagcatggaggaaaggcaatgcctggaccactgacttgcattgaaatcctttcttgtgggctagggtttgatgtctctttttcatctttggactggggatctgcatcttccaggtccatttaagcactgaaactagatgcaaatctctttcgagaccttacatgttttagatagtcatgtaatgacttggatagacatttaaataacttgttccaaggtcggaagagcccaagaactcctcagagttcctcttcttgcttcttgaatcacatcctctaaagatgactcatgtctccatagcaactgttaaaggtgctgcctagacgggacccgctcccacctttacttactttgctcgaaggaaccaaaacaatgtccttgtgtaaaggggctgtcatatccagttttcctttgaaatctggcccccaagatcctgcttctttctaacctggcagctgtcatgtcccttcaagatgatgtgggaaatggcccttacaacttgggaaccacagaaattgctgtatttcgggaagattcacctctaaactgaaggcttcattctgatagtgtctgccctctctaccctgatttcgcccttctttgcttccatttttagcccaaggctttgaatttgattgagtaagacttagaggcagtataaagaacaccataaacttaggcagaggtcccttagggtctctagagttgaaaataattctacagccttagggggacctcttggcattgactctaaagggagagaatagcccctgtgtcctggcatttcagtctagaccttcaaggactgttctctcttgacaggcaagcaagcaaagaaagttttgcaatagatttcaagccagtttttccattcaaaccaagatgcaaattcataaaattactcttttcctggaatagatccaggcagctgccttattagaactttagattcggatctattttcttaacacacatacacatacacgcgcatacatacatatacagagagatacgtggagaaaggaaatttactctatcattgcaatacttcaagaaagagctgtattttgcctttctgtaatctccaagatagtgtctaggaaagtaatagtataactatagggataccgaaacaggaaaaaccagccatcactcttgagaaagtttgagttcgactcacatgggagaatcgaggtctgctactcgtcttgctttgtgccccatctgtgcctggatgccctactacatctgcttgactcgtctgggctgctagccggggtgttgtggctgacatcctttcctggccttacacacataatagacacatccctaacggcgtgtgcctggtccagccacatacagccaccacatgtgtcacacactgtccccctcatccatgtggacttgactggcatttcagcagctccactgggatgctctaaccccagtgtgtggagttggggtcccttcatctaggttgacccaggtatagcatttttagcattgcctttccagtcttgatgattcattcattgaactcatttatttctggagcccctggtacactccaggcactgcgctaattgccagcaaagcacaactgaactaaatccaccttcaaggaacctagccataacgagggaggcagcatggaagtaccctacaggggaaagtcctgagtgctgtgggagcatctcaccgtggcagccagcccagttttggcaatcaggggcttcctgaaagaggtgacatcaaagcccggatgtgtcagaggactgagggagagtgttactaaaggactttcaggctgagaggatagcacaggactcagcccaaaggagggccagtgtggactgtccagggccagcctgcagtacagaggctggagcttggacttgtagagggagagagaagagcaagggacgtggacggggcagtgagccaggctagccacagagggttcccggggctttgctggggattcagggagcataaataagagctttaggtggtgctgtgtcctctgcagcccactgctgaggtcctccagacaggtaaggtgtggtcacaatcagggccggggtttccctgctcactgcggcagtgcaggggtgcttgctgagatgattcatcccagggtgtcctctgtcccttacccagccccaactcctcttcctctgccaaaagctatttgaattcaaggactttaacctgggccggatctggtttggagacaaaggggacagctctgggtcagcatgaccttctttagagccactaaggcgaaaaataccgtttgggaccaggctggcctagacccagggatgagaatgcaccctaaaataaatatacgggaagcagcagagggcttccctgtctagtgtgtgatcctaactaaaggcagctctcttggacagccttcccctggattaggtcacatacacctggtggccaagcctctgctgggtcccaaatacacacccgagtcctgccaaagaaaggagatttttaaaaagcacagacaaattgtatgcaagtggaaaatacccataggcctagacagctgtggagggaagacctcgtgggtacctggaggctgccagagctgggagctctgcaggtatgagtcagggaaggctcagagacaagcagaatctctctatggagacaacttgcagtgccttttaggttttccaaataacctcggagttcagagcattgggtttttttctcccctccccacccccagaaaaataattagaaaaatgtttaggagaaaggaaaagaattagatgcatcagaataccagctataagccaacactgtttccagaaactcaagaaaaagctcaaacagaagacagttcccctgagaggctggaggcgttggtgctgaaggcaattttcctagctaaggggcactgggccttgctgcaccttggggctgaccttttttgcaaaacacccacccctgccctcctggcatactcaacagcaacgccagctttctggacccttggaaagatgttagctcaaacacccactttttccagatcttcctcttgctcttcactgaggaatttgtaattctgaggctagcgatgccgactcggatattccgcaggcccaggtgtttagattagaatttgtccagcggtaatcctgatgctggaaaccaacaaacatttggcctcatattcacccatttaaaaactagagcccctggcaggtccccttagggccatgtgttcatggaatataagccaagtttgccttagcgcttgttcatggaatataagccaagtttacctctccccattttctgccctggcccacttcccactcacctccacctcattgccaggaagggatcaaaatgcctccatgccagttgttaaatggctacatatttgcccttcccaagggtatttgcatttntatttaggaacatggccttatattcaaggaaaatctagcatcaagattacgaggcatcacctctcaatcaggtctgggaggtatcttggggcattgctcttctgaacacctgcagaggcttcctcaggtgagtgtgggagcccggaaggtggcctccctaaccactctgcctgcacatgaattctccaaagcagtgggcccccatctgtttcaattacacatgcctgtcagcaaaaacttcgtgagatgcactctctctgtgtgtttattaatttatttaaagcatatatccctttacttttgtactactatattaggcacattataaaaagtatacagcatagaaactttaaatgaataagacacaaaatattataaacagaggttctggcattttctctctgaactcctgagggggaccttgggcacctcctggtatgtgcacaccccactttgaacacccttgctttagtgcaaatcagcacgcctaaatagcatcccaaaccactgtgcgacatttggcctgcagaataagaaagtcctaaggcagaatccccaggaacttcaaatctgggagatgaggaaagaaaactcactcacaaacaacataaatgtaaataattcaaaaccctaaaggagagctgtccctagacagtagtggctacaggtgctaagcaaaagtcaggtacactggacagagccatgcgattgattgttcatcttccctctctgggtctccagaaaaggacactggcaatatccccagctctctcctgattggaattctttgaaccctcgaagtgctccagcagtactaccccccacgtagcagtgggcccatgtcgcttgaatattatttttgatttgaccaccaagatgtaatgatgattctattccattttgaaaagggtctgagaaagtgtacaggtctaattatatatacatatttatacatgtgtatttttgtttattgttacattttgacattggactttctattaaataatttttaaga

SEQ ID NO: 17964 - DNA, 9725 bp, Homo sapiens
  misc_feature (4408)..(4408): n is a, c, g, or t
  misc_feature (8710)..(8710): n is a, c, g, or t
cactggcaaccaccattctactttctgtctccatgaatttgactactccaggctgctgtgcattttagagaagttcttatgtgatactgaaaaaagtgccagctcaaatgtaagacttaaaactaataaagaggttccgggattagttcatcaacccagagcaaacatgcacatctctgaaagccaacaagaattcttcagaatgctggatgaaaaaattgaaaagggtcgggattactgttcggaagaagaggatatcacatagcaccaattttaccactcaaaccaggagctactactgtgtaaataggttacaccccagttgaaatctttgcaaaggtcggttctattcagcgaacagcactatagcaaaagaagatcgttccatattgtacgccccattaaattacagtgtttcttaatgaacttgcaaaggaatattgctaaaaacaaacaaaaaaaactgttatcgaactttctttgttgctgctagttaaaacttgttgcaacttttcacttctcttgtgtccaggtatgcagcaaaattctgcaatttcaccttaaagatactgttggttttacagatgctctccaacctattttctataagatgaggtagtggtgaactcagataacaaacttctcttctaaactggttctgcttctaagacaagcatctcctgccctctctccttcctccccatctctcgcacgcagtctagagatggactgagccttgcttctcactggcagtgttgagctttggagatgggatggttgctatgccaagccttgtttctctgctcagaagaagtagagaagctattatcaattaaaagcatgctgtgatgtgactcctggaagtgacgtaggagtgagtggcaggttgtttgatttaataggtatcttaatcaagaattaagcttgcaacattggctttgctcagatgcagatggaagtgtgatcacaatcattttgaatccctcttcctcacttttttttctaagaaaataaacattttactgtttttatggatccttgtcttctcccattcatccagctcagtgttttaagatgatcctgggtgcagaagttgagccctcctttgcattgacactgataattagcctatagggctccctacccttccattaagaatctaccaagcattagcaaggctgaaagtggtctaagaggtgaggggacatcctatgactttttaggaaggcctgaaaccaccttgttacctttcattttgttagcaaataaaccatcctattttgtaactctcccccttcaaaatgctacatgagccttgccacttcctttttctcttacttccagcacactagacatagcaaaagtgtttgcctactcaaaaacataatacttttatgctgatgatggtatttggagatgtgaaagccaaaagcccctggcagtggtggggaatgttgactgagtgttcagcagagtttatttttccatactatatgaagagaatgatctcttctcaaagacagaagtgatatttttaacaaatattgtcacaagtaaatagcaatcaaaaggagaaaataacttttgtatttttttaatgtgtttgatagctttgacgagggttctctttgttactttcaggggagggcatcctattaaatgccacgccagcagtccgggtctgggtttgtcccacaaaatcacaggagcactgtatgttcctctcttttggagttgtgactttgaagggcctcaatattagccacactgccgcctgcagaaggtggagagttaagatgttctatgtcaatttgctcttgccgaaaagatgagcctcgattttaaaatctatccacatccaactgatggcaccattgatgtgcaaataatgagattccctatctccttttagacctgggacggcaaaagggaagggaaggaaacttagcagagtgctattgactatagattcacatattagcaacaaaatcccgtaattcttttggccaacagcagctattttggggagcagctgtggctgttacataaatagagatgcagccaaaattttaggccttttatcctgcttctagcagaaaaatgcagggagagtcaagtagtctagggtttcaggttgcctcccctcatatggtttttggccaagtgactaaaacagttttccacaactgtaaacaaactggtaagccccacctcaaacttgttcactggggactttgcttaccgttctgtgggtgaccttttccgggatttcttgttcttatcaagcaagaattaagcacatgctaaacgtcttccatttgacttctctactcggtgtctcagacagtgtcttcccagaaaaccaccaccctctacccaaagatgaaacatgctcatgtcatttttctcatggtcacatttaacagttttgacatgttatacttgcgcatagatccaagcgtttcttgggaacctgacttttgagtgtttaataaagccggaagtggtgttgccctgaaccagcagattttcacctgggttctggctccggtgtttaacactggatacatctttgatgtgcgaaagtgagttcatcttcagacacatttggtacatccagaaatagatccaagaaatggggtggttgagtgggtccgcacgaaatgcttgattatgtcagcaacacccaacactgtctgttttccatttgttggttttaatcataaaattgtcaagtgattcgtgttgtactttatttttgtgccttctgaacggatctaaaacaaaagtattttgccttttttaccccacgtgtatctgaacattaagcagattggctcagacaccatgaaaaggatactccaatgtacgtgctggtgcactctgctagttgttatctctgtagggctcaagaagctggaaggaggaagggagggtaagtggcctggtgagtggaggtagaaaaatgatgagaaatgaactgagagcattaagcagagagggttgataggctggccgtgtccggggtgaaattggaaatccagctgcctagtggccagtgggtggggcaagactgtcaacgagatttacagctggcttacacatgccttatgtcctctgagttgtagagttgtaaaagttcagcagtgtgtgcacagctttcttttggttggcagagattcaggatcatggagtactgctctcataattgaagacgtgtttgttattggcagagaaccttaaaaaaggcctttacctcagcgatgcttcctagccccaggcttgcagagaacacagagtggtgttgtggtctatttagggacaaagaaggtataaagtccagagatgagaaaactgggtcagccctcagaaactgcagcagccacgcacacagaagcctgctggaagacaggtctctctccgtccacagtgcccatcatctgagcctgggctgggatgactcaacttagcaaagacggacccaggaggagtgctggttcttcagtctttgtactggccccatcctctcctcactgtaatgtgaggaagcacctctgtgtcagggctcacctgggcatccaaagcggccacgcccacaatccgacagcccccaggagcaggtccagggatgatgcagcccccttcttggtcccatgtgatgtcatcctgctttgttatcttcttataactttatcctgctataactttatcctcttcccagcctcatccctgtttttctgttagggcaagactcttccataagcctgctaaaaaacagagatgatacctcttacaaactttacctcatagcctgtgaagcaggttggcatgtggattacaagtcctgctttgacactgggcaagaatttaagattgttctatctctactagtcatagaaaagaaacattgttaaacatgttgagttttaaaggaagaaatattttcaaattcttaatccaagaaaatactgagttggaatcttagacttcgggactctgacacgttctttatgaaaggcaaaataattggtatctaaagttctctccttcctgcctcccctaaagaaaaaggatattagattgcacactataattttacataagatctgccttccacacttccctgctggaaggcattctcagagctttatgtcttcgtacctctcagagattggactttttcttgtttaaaaccccaaccaaaaaaaataataaggcatgattggtggggagggaatgtgtatttaggggcataataaaaaggtggctcgaagcaggaactttggcctcatggtgtcatgggtggatgcctggactccagtgtgcctgtgaggggctgggttaggcagtcggctgtcacactcacatgtgcctgcaataaaccttttggaatttcatgaacgaggtnctatgaattgccttttgccaatgaatggatgtatttttccaaggggggaatagtatccttgactttggcagtcacctttttgtatgtctctagaaaggggtcaaaaaaactatggtaaagatgaggcttatgagtgaatacctctgggacaaaccttaggactcacaagctatgccatgtttttcaggagactcttgtaccttatctggaatccaatcctgggagaagaggaaaaaggagctaatatttgtcctttatactcactctgtgccagatactgtgccaggcattttataattgttttgtgtcatccccatgatatccgttaaattaatctattacccccgtgttctaaataatagatcttaagtgtggaatgcatctatccaacataaatgcccatgttgaaagaaggaaagatgtcattcaagtatttttcaaattctttttattatgactatgcccttcgcaacactgtgaaaacaacccctgggggcatctgccttccagaatctctctctggcttctcaccagcttggtttcctcatggggagtgttttatttggcctcccctatctgagctgcacacacaccagggggaggccactggctaacagtaggacttcagtgccctgaggaaaaggctttgggaatttaggcacacgtttctctccttggaatccttctagcatctggaaaaggaacctggtatttctgcagttagataccagatgcaaccagaacaggctttcgagtgctgtgatttctttcctgggttcccaagtcttgttgtttcatcacaaactgtatctttttaaggttaaaagtcttgaccttcatgggggtctgggacaatccgatctccaagcatggaggaaaggcaatgcctggaccactgacttgcattgaaatcctttcttgtgggctagggtttgatgtctctttttcatctttggactggggatctgcatcttccaggtccatttaagcactgaaactagatgcaaatctctttcgagaccttacatgttttagatagtcatgtaatgacttggatagacatttaaataacttgttccaaggtcggaagagcccaagaactcctcagagttcctcttcttgcttcttgaatcacatcctctaaagatgactcatgtctccatagcaactgttaaaggtgctgcctagacgggacccgctcccacctttacttactttgctcgaaggaaccaaaacaatgtccttgtgtaaaggggctgtcatatccagttttcctttgaaatctggcccccaagatcctgcttctttctaacctggcagctgtcatgtcccttcaagatgatgtgggaaatggcccttacaacttgggaaccacagaaattgctgtatttcgggaagattcacctctaaactgaaggcttcattctgatagtgtctgccctctctaccctgatttcgcccttctttgcttccatttttagcccaaggctttgaatttgattgagtaagacttagaggcagtataaagaacaccataaacttaggcagaggtcccttagggtctctagagttgaaaataattctacagccttagggggacctcttggcattgactctaaagggagagaatagcccctgtgtcctggcatttcagtctagaccttcaaggactgttctctcttgacaggcaagcaagcaaagaaagttttgcaatagatttcaagccagtttttccattcaaaccaagatgcaaattcataaaattactcttttcctggaatagatccaggcagctgccttattagaactttagattcggatctattttcttaacacacatacacatacacgcgcatacatacatatacagagagatacgtggagaaaggaaatttactctatcattgcaatacttcaagaaagagctgtattttgcctttctgtaatctccaagatagtgtctaggaaagtaatagtataactatagggataccgaaacaggaaaaaccagccatcactcttgagaaagtttgagttcgactcacatgggagaatcgaggtctgctactcgtcttgctttgtgccccatctgtgcctggatgccctactacatctgcttgactcgtctgggctgctagccggggtgttgtggctgacatcctttcctggccttacacacataatagacacatccctaacggcgtgtgcctggtccagccacatacagccaccacatgtgtcacacactgtccccctcatccatgtggacttgactggcatttcagcagctccactgggatgctctaaccccagtgtgtggagttggggtcccttcatctaggttgacccaggtatagcatttttagcattgcctttccagtcttgatgattcattcattgaactcatttatttctggagcccctggtacactccaggcactgcgctaattgccagcaaagcacaactgaactaaatccaccttcaaggaacctagccataacgagggaggcagcatggaagtaccctacaggggaaagtcctgagtgctgtgggagcatctcaccgtggcagccagcccagttttggcaatcaggggcttcctgaaagaggtgacatcaaagcccggatgtgtcagaggactgagggagagtgttactaaaggactttcaggctgagaggatagcacaggactcagcccaaaggagggccagtgtggactgtccagggccagcctgcagtacagaggctggagcttggacttgtagagggagagagaagagcaagggacgtggacggggcagtgagccaggctagccacagagggttcccggggctttgctggggattcagggagcataaataagagctttaggtggtgctgtgtcctctgcagcccactgctgaggtcctccagacaggtaaggtgtggtcacaatcagggccggggtttccctgctcactgcggcagtgcaggggtgcttgctgagatgattcatcccagggtgtcctctgtcccttacccagccccaactcctcttcctctgccaaaagctatttgaattcaaggactttaacctgggccggatctggtttggagacaaaggggacagctctgggtcagcatgaccttctttagagccactaaggcgaaaaataccgtttgggaccaggctggcctagacccagggatgagaatgcaccctaaaataaatatacgggaagcagcagagggcttccctgtctagtgtgtgatcctaactaaaggcagctctcttggacagccttcccctggattaggtcacatacacctggtggccaagcctctgctgggtcccaaatacacacccgagtcctgccaaagaaaggagatttttaaaaagcacagacaaattgtatgcaagtggaaaatacccataggcctagacagctgtggagggaagacctcgtgggtacctggaggctgccagagctgggagctctgcaggtatgagtcagggaaggctcagagacaagcagaatctctctatggagacaacttgcagtgccttttaggttttccaaataacctcggagttcagagcattgggtttttttctcccctccccacccccagaaaaataattagaaaaatgtttaggagaaaggaaaagaattagatgcatcagaataccagctataagccaacactgtttccagaaactcaagaaaaagctcaaacagaagacagttcccctgagaggctggaggcgttggtgctgaaggcaattttcctagctaaggggcactgggccttgctgcaccttggggctgaccttttttgcaaaacacccacccctgccctcctggcatactcaacagcaacgccagctttctggacccttggaaagatgttagctcaaacacccactttttccagatcttcctcttgctcttcactgaggaatttgtaattctgaggctagcgatgccgactcggatattccgcaggcccaggtgtttagattagaatttgtccagcggtaatcctgatgctggaaaccaacaaacatttggcctcatattcacccatttaaaaactagagcccctggcaggtccccttagggccatgtgttcatggaatataagccaagtttgccttagcgcttgttcatggaatataagccaagtttacctctccccattttctgccctggcccacttcccactcacctccacctcattgccaggaagggatcaaaatgcctccatgccagttgttaaatggctacatatttgcccttcccaagggtatttgcatttntatttaggaacatggccttatattcaaggaaaatctagcatcaagattacgaggcatcacctctcaatcaggtctgggaggtatcttggggcattgctcttctgaacacctgcagaggcttcctcaggtgagtgtgggagcccggaaggtggcctccctaaccactctgcctgcacatgaattctccaaagcagtgggcccccatctgtttcaattacacatgcctgtcagcaaaaacttcgtgagatgcactctctctgtgtgtttattaatttatttaaagcatatatccctttacttttgtactactatattaggcacattataaaaagtatacagcatagaaactttaaatgaataagacacaaaatattataaacagaggttctggcattttctctctgaactcctgagggggaccttgggcacctcctggtatgtgcacaccccactttgaacacccttgctttagtgcaaatcagcacgcctaaatagcatcccaaaccactgtgcgacatttggcctgcagaataagaaagtcctaaggcagaatccccaggaacttcaaatctgggagatgaggaaagaaaactcactcacaaacaacataaatgtaaataattcaaaaccctaaaggagagctgtccctagacagtagtggctacaggtgctaagcaaaagtcaggtacactggacagagccatgcgattgattgttcatcttccctctctgggtctccagaaaaggacactggcaatatccccagctctctcctgattggaattctttgaaccctcgaagtgctccagcagtactaccccccacgtagcagtgggcccatgtcgcttgaatattatttttgatttgaccaccaagatgtaatgatgattctattccattttgaaaagggtctgagaaagtgtacaggtctaattatatatacatatttatacatgtgtatttttgtttattgttacattttgacattggactttctattaaataatttttaaga

SEQ ID NO: 17965 - DNA, 9687 bp, Homo sapiens
  misc_feature (37)..(37): n is a, c, g, or t
  misc_feature (4370)..(4370): n is a, c, g, or t
  misc_feature (8672)..(8672): n is a, c, g, or t
tcgtctatattccgcaaatgtaacatattaaaatttntttttttcattaagaaaaaagtgccagctcaaatgtaagacttaaaactaataaagaggttccgggattagttcatcaacccagagcaaacatgcacatctctgaaagccaacaagaattcttcagaatgctggatgaaaaaattgaaaagggtcgggattactgttcggaagaagaggatatcacatagcaccaattttaccactcaaaccaggagctactactgtgtaaataggttacaccccagttgaaatctttgcaaaggtcggttctattcagcgaacagcactatagcaaaagaagatcgttccatattgtacgccccattaaattacagtgtttcttaatgaacttgcaaaggaatattgctaaaaacaaacaaaaaaaactgttatcgaactttctttgttgctgctagttaaaacttgttgcaacttttcacttctcttgtgtccaggtatgcagcaaaattctgcaatttcaccttaaagatactgttggttttacagatgctctccaacctattttctataagatgaggtagtggtgaactcagataacaaacttctcttctaaactggttctgcttctaagacaagcatctcctgccctctctccttcctccccatctctcgcacgcagtctagagatggactgagccttgcttctcactggcagtgttgagctttggagatgggatggttgctatgccaagccttgtttctctgctcagaagaagtagagaagctattatcaattaaaagcatgctgtgatgtgactcctggaagtgacgtaggagtgagtggcaggttgtttgatttaataggtatcttaatcaagaattaagcttgcaacattggctttgctcagatgcagatggaagtgtgatcacaatcattttgaatccctcttcctcacttttttttctaagaaaataaacattttactgtttttatggatccttgtcttctcccattcatccagctcagtgttttaagatgatcctgggtgcagaagttgagccctcctttgcattgacactgataattagcctatagggctccctacccttccattaagaatctaccaagcattagcaaggctgaaagtggtctaagaggtgaggggacatcctatgactttttaggaaggcctgaaaccaccttgttacctttcattttgttagcaaataaaccatcctattttgtaactctcccccttcaaaatgctacatgagccttgccacttcctttttctcttacttccagcacactagacatagcaaaagtgtttgcctactcaaaaacataatacttttatgctgatgatggtatttggagatgtgaaagccaaaagcccctggcagtggtggggaatgttgactgagtgttcagcagagtttatttttccatactatatgaagagaatgatctcttctcaaagacagaagtgatatttttaacaaatattgtcacaagtaaatagcaatcaaaaggagaaaataacttttgtatttttttaatgtgtttgatagctttgacgagggttctctttgttactttcaggggagggcatcctattaaatgccacgccagcagtccgggtctgggtttgtcccacaaaatcacaggagcactgtatgttcctctcttttggagttgtgactttgaagggcctcaatattagccacactgccgcctgcagaaggtggagagttaagatgttctatgtcaatttgctcttgccgaaaagatgagcctcgattttaaaatctatccacatccaactgatggcaccattgatgtgcaaataatgagattccctatctccttttagacctgggacggcaaaagggaagggaaggaaacttagcagagtgctattgactatagattcacatattagcaacaaaatcccgtaattcttttggccaacagcagctattttggggagcagctgtggctgttacataaatagagatgcagccaaaattttaggccttttatcctgcttctagcagaaaaatgcagggagagtcaagtagtctagggtttcaggttgcctcccctcatatggtttttggccaagtgactaaaacagttttccacaactgtaaacaaactggtaagccccacctcaaacttgttcactggggactttgcttaccgttctgtgggtgaccttttccgggatttcttgttcttatcaagcaagaattaagcacatgctaaacgtcttccatttgacttctctactcggtgtctcagacagtgtcttcccagaaaaccaccaccctctacccaaagatgaaacatgctcatgtcatttttctcatggtcacatttaacagttttgacatgttatacttgcgcatagatccaagcgtttcttgggaacctgacttttgagtgtttaataaagccggaagtggtgttgccctgaaccagcagattttcacctgggttctggctccggtgtttaacactggatacatctttgatgtgcgaaagtgagttcatcttcagacacatttggtacatccagaaatagatccaagaaatggggtggttgagtgggtccgcacgaaatgcttgattatgtcagcaacacccaacactgtctgttttccatttgttggttttaatcataaaattgtcaagtgattcgtgttgtactttatttttgtgccttctgaacggatctaaaacaaaagtattttgccttttttaccccacgtgtatctgaacattaagcagattggctcagacaccatgaaaaggatactccaatgtacgtgctggtgcactctgctagttgttatctctgtagggctcaagaagctggaaggaggaagggagggtaagtggcctggtgagtggaggtagaaaaatgatgagaaatgaactgagagcattaagcagagagggttgataggctggccgtgtccggggtgaaattggaaatccagctgcctagtggccagtgggtggggcaagactgtcaacgagatttacagctggcttacacatgccttatgtcctctgagttgtagagttgtaaaagttcagcagtgtgtgcacagctttcttttggttggcagagattcaggatcatggagtactgctctcataattgaagacgtgtttgttattggcagagaaccttaaaaaaggcctttacctcagcgatgcttcctagccccaggcttgcagagaacacagagtggtgttgtggtctatttagggacaaagaaggtataaagtccagagatgagaaaactgggtcagccctcagaaactgcagcagccacgcacacagaagcctgctggaagacaggtctctctccgtccacagtgcccatcatctgagcctgggctgggatgactcaacttagcaaagacggacccaggaggagtgctggttcttcagtctttgtactggccccatcctctcctcactgtaatgtgaggaagcacctctgtgtcagggctcacctgggcatccaaagcggccacgcccacaatccgacagcccccaggagcaggtccagggatgatgcagcccccttcttggtcccatgtgatgtcatcctgctttgttatcttcttataactttatcctgctataactttatcctcttcccagcctcatccctgtttttctgttagggcaagactcttccataagcctgctaaaaaacagagatgatacctcttacaaactttacctcatagcctgtgaagcaggttggcatgtggattacaagtcctgctttgacactgggcaagaatttaagattgttctatctctactagtcatagaaaagaaacattgttaaacatgttgagttttaaaggaagaaatattttcaaattcttaatccaagaaaatactgagttggaatcttagacttcgggactctgacacgttctttatgaaaggcaaaataattggtatctaaagttctctccttcctgcctcccctaaagaaaaaggatattagattgcacactataattttacataagatctgccttccacacttccctgctggaaggcattctcagagctttatgtcttcgtacctctcagagattggactttttcttgtttaaaaccccaaccaaaaaaaataataaggcatgattggtggggagggaatgtgtatttaggggcataataaaaaggtggctcgaagcaggaactttggcctcatggtgtcatgggtggatgcctggactccagtgtgcctgtgaggggctgggttaggcagtcggctgtcacactcacatgtgcctgcaataaaccttttggaatttcatgaacgaggtnctatgaattgccttttgccaatgaatggatgtatttttccaaggggggaatagtatccttgactttggcagtcacctttttgtatgtctctagaaaggggtcaaaaaaactatggtaaagatgaggcttatgagtgaatacctctgggacaaaccttaggactcacaagctatgccatgtttttcaggagactcttgtaccttatctggaatccaatcctgggagaagaggaaaaaggagctaatatttgtcctttatactcactctgtgccagatactgtgccaggcattttataattgttttgtgtcatccccatgatatccgttaaattaatctattacccccgtgttctaaataatagatcttaagtgtggaatgcatctatccaacataaatgcccatgttgaaagaaggaaagatgtcattcaagtatttttcaaattctttttattatgactatgcccttcgcaacactgtgaaaacaacccctgggggcatctgccttccagaatctctctctggcttctcaccagcttggtttcctcatggggagtgttttatttggcctcccctatctgagctgcacacacaccagggggaggccactggctaacagtaggacttcagtgccctgaggaaaaggctttgggaatttaggcacacgtttctctccttggaatccttctagcatctggaaaaggaacctggtatttctgcagttagataccagatgcaaccagaacaggctttcgagtgctgtgatttctttcctgggttcccaagtcttgttgtttcatcacaaactgtatctttttaaggttaaaagtcttgaccttcatgggggtctgggacaatccgatctccaagcatggaggaaaggcaatgcctggaccactgacttgcattgaaatcctttcttgtgggctagggtttgatgtctctttttcatctttggactggggatctgcatcttccaggtccatttaagcactgaaactagatgcaaatctctttcgagaccttacatgttttagatagtcatgtaatgacttggatagacatttaaataacttgttccaaggtcggaagagcccaagaactcctcagagttcctcttcttgcttcttgaatcacatcctctaaagatgactcatgtctccatagcaactgttaaaggtgctgcctagacgggacccgctcccacctttacttactttgctcgaaggaaccaaaacaatgtccttgtgtaaaggggctgtcatatccagttttcctttgaaatctggcccccaagatcctgcttctttctaacctggcagctgtcatgtcccttcaagatgatgtgggaaatggcccttacaacttgggaaccacagaaattgctgtatttcgggaagattcacctctaaactgaaggcttcattctgatagtgtctgccctctctaccctgatttcgcccttctttgcttccatttttagcccaaggctttgaatttgattgagtaagacttagaggcagtataaagaacaccataaacttaggcagaggtcccttagggtctctagagttgaaaataattctacagccttagggggacctcttggcattgactctaaagggagagaatagcccctgtgtcctggcatttcagtctagaccttcaaggactgttctctcttgacaggcaagcaagcaaagaaagttttgcaatagatttcaagccagtttttccattcaaaccaagatgcaaattcataaaattactcttttcctggaatagatccaggcagctgccttattagaactttagattcggatctattttcttaacacacatacacatacacgcgcatacatacatatacagagagatacgtggagaaaggaaatttactctatcattgcaatacttcaagaaagagctgtattttgcctttctgtaatctccaagatagtgtctaggaaagtaatagtataactatagggataccgaaacaggaaaaaccagccatcactcttgagaaagtttgagttcgactcacatgggagaatcgaggtctgctactcgtcttgctttgtgccccatctgtgcctggatgccctactacatctgcttgactcgtctgggctgctagccggggtgttgtggctgacatcctttcctggccttacacacataatagacacatccctaacggcgtgtgcctggtccagccacatacagccaccacatgtgtcacacactgtccccctcatccatgtggacttgactggcatttcagcagctccactgggatgctctaaccccagtgtgtggagttggggtcccttcatctaggttgacccaggtatagcatttttagcattgcctttccagtcttgatgattcattcattgaactcatttatttctggagcccctggtacactccaggcactgcgctaattgccagcaaagcacaactgaactaaatccaccttcaaggaacctagccataacgagggaggcagcatggaagtaccctacaggggaaagtcctgagtgctgtgggagcatctcaccgtggcagccagcccagttttggcaatcaggggcttcctgaaagaggtgacatcaaagcccggatgtgtcagaggactgagggagagtgttactaaaggactttcaggctgagaggatagcacaggactcagcccaaaggagggccagtgtggactgtccagggccagcctgcagtacagaggctggagcttggacttgtagagggagagagaagagcaagggacgtggacggggcagtgagccaggctagccacagagggttcccggggctttgctggggattcagggagcataaataagagctttaggtggtgctgtgtcctctgcagcccactgctgaggtcctccagacaggtaaggtgtggtcacaatcagggccggggtttccctgctcactgcggcagtgcaggggtgcttgctgagatgattcatcccagggtgtcctctgtcccttacccagccccaactcctcttcctctgccaaaagctatttgaattcaaggactttaacctgggccggatctggtttggagacaaaggggacagctctgggtcagcatgaccttctttagagccactaaggcgaaaaataccgtttgggaccaggctggcctagacccagggatgagaatgcaccctaaaataaatatacgggaagcagcagagggcttccctgtctagtgtgtgatcctaactaaaggcagctctcttggacagccttcccctggattaggtcacatacacctggtggccaagcctctgctgggtcccaaatacacacccgagtcctgccaaagaaaggagatttttaaaaagcacagacaaattgtatgcaagtggaaaatacccataggcctagacagctgtggagggaagacctcgtgggtacctggaggctgccagagctgggagctctgcaggtatgagtcagggaaggctcagagacaagcagaatctctctatggagacaacttgcagtgccttttaggttttccaaataacctcggagttcagagcattgggtttttttctcccctccccacccccagaaaaataattagaaaaatgtttaggagaaaggaaaagaattagatgcatcagaataccagctataagccaacactgtttccagaaactcaagaaaaagctcaaacagaagacagttcccctgagaggctggaggcgttggtgctgaaggcaattttcctagctaaggggcactgggccttgctgcaccttggggctgaccttttttgcaaaacacccacccctgccctcctggcatactcaacagcaacgccagctttctggacccttggaaagatgttagctcaaacacccactttttccagatcttcctcttgctcttcactgaggaatttgtaattctgaggctagcgatgccgactcggatattccgcaggcccaggtgtttagattagaatttgtccagcggtaatcctgatgctggaaaccaacaaacatttggcctcatattcacccatttaaaaactagagcccctggcaggtccccttagggccatgtgttcatggaatataagccaagtttgccttagcgcttgttcatggaatataagccaagtttacctctccccattttctgccctggcccacttcccactcacctccacctcattgccaggaagggatcaaaatgcctccatgccagttgttaaatggctacatatttgcccttcccaagggtatttgcatttntatttaggaacatggccttatattcaaggaaaatctagcatcaagattacgaggcatcacctctcaatcaggtctgggaggtatcttggggcattgctcttctgaacacctgcagaggcttcctcaggtgagtgtgggagcccggaaggtggcctccctaaccactctgcctgcacatgaattctccaaagcagtgggcccccatctgtttcaattacacatgcctgtcagcaaaaacttcgtgagatgcactctctctgtgtgtttattaatttatttaaagcatatatccctttacttttgtactactatattaggcacattataaaaagtatacagcatagaaactttaaatgaataagacacaaaatattataaacagaggttctggcattttctctctgaactcctgagggggaccttgggcacctcctggtatgtgcacaccccactttgaacacccttgctttagtgcaaatcagcacgcctaaatagcatcccaaaccactgtgcgacatttggcctgcagaataagaaagtcctaaggcagaatccccaggaacttcaaatctgggagatgaggaaagaaaactcactcacaaacaacataaatgtaaataattcaaaaccctaaaggagagctgtccctagacagtagtggctacaggtgctaagcaaaagtcaggtacactggacagagccatgcgattgattgttcatcttccctctctgggtctccagaaaaggacactggcaatatccccagctctctcctgattggaattctttgaaccctcgaagtgctccagcagtactaccccccacgtagcagtgggcccatgtcgcttgaatattatttttgatttgaccaccaagatgtaatgatgattctattccattttgaaaagggtctgagaaagtgtacaggtctaattatatatacatatttatacatgtgtatttttgtttattgttacattttgacattggactttctattaaataatttttaaga

SEQ ID NO: 17966 - DNA, 1627 bp, Homo sapiens
tgagcgaggagctcccctccctcgctcgctcctcgcaagctcccgctcgctccctgcccactcccggggggacgttccgtgccgcggccgccgcggccgctgcttctttcacactttagttgggagctgcgcgccgcgctcagttactggagagctggccgcgcgccgccgcctcccgcacgcttgcacgcgggcccggcttcggggttttgggttcttactccaagcggcggggaggagggggagccccggacacactgtggggaggaggaggaagaagaggaggagggaggaagaaaaaagacgaggaggacaggggcggggggcgggaggcttgccaccttcagcccccccgcgaacgcccaaggtgcacacatcttgaccaactcagcagcaaggtggattttctttgtgtttaaagaaaaaaaatgtccctgtgtctgtagagatgatttgcagttcagcccggctgaagctgaccgaatgagactatgggctgtgcctccgccaagcatgttgccactgttcaaaatgaagaggaagcccagaaagggaaaaactaccagaacggagatgtgtttggcgatgagtataggatcaaaccagtggaagaggtcaaatacatgaaaaatggggcagaagaagagcagaaaatagcagccaggaaccaagaaaacttggaaaaaagtgccagctcaaatgtaagacttaaaactaataaagaggttccgggattagttcatcaacccagagcaaacatgcacatctctgaaagccaacaagaattcttcagaatgctggatgaaaaaattgaaaagggtcgggattactgttcggaagaagaggatatcacatagcaccaattttaccactcaaaccaggagctactactgtgtaaataggttacaccccagttgaaatctttgcaaaggtcggttctattcagcgaacagcactatagcaaaagaagatcgttccatattgtacgccccattaaattacagtgtttcttaatgaacttgcaaaggaatattgctaaaaacaaacaaaaaaaactgttatcgaactttctttgttgctgctagttaaaacttgttgcaacttttcacttctcttgtgtccaggtatgcagcaaaattctgcaatttcaccttaaagatactgttggttttacagatgctctccaacctattttctataagatgaggtagtggtgaactcagataacaaacttctcttctaaactggttctgcttctaagacaagcatctcctgccctctctccttcctccccatctctcgcacgcagtctagagatggactgagccttgcttctcactggcagtgttgagctttggagatgggatggttgctatgccaagccttgtttctctgctcagaagaagtagagaagctattatcaattaaaagcatgctgtgatgtgactcctggaagtgacgtaggagtgagtggcaggttgtttgatttaataggtatcttaatcaagaattaagcttgcaacattggctttgctcagatgcagatggaagtgtgatcacaatcattttgaatccctcttcctcacttttttttctaagaaaataaacattttactgtttttatgga

SEQ ID NO: 17967 - DNA, 3331 bp, Homo sapiens
tgagcgaggagctcccctccctcgctcgctcctcgcaagctcccgctcgctccctgcccactcccggggggacgttccgtgccgcggccgccgcggccgctgcttctttcacactttagttgggagctgcgcgccgcgctcagttactggagagctggccgcgcgccgccgcctcccgcacgcttgcacgcgggcccggcttcggggttttgggttcttactccaagcggcggggaggagggggagccccggacacactgtggggaggaggaggaagaagaggaggagggaggaagaaaaaagacgaggaggacaggggcggggggcgggaggcttgccaccttcagcccccccgcgaacgcccaaggtgcacacatcttgaccaactcagcagcaaggtggattttctttgtgtttaaagaaaaaaaatgtccctgtgtctgtagagatgatttgcagttcagcccggctgaagctgaccgaatgagactatgggctgtgcctccgccaagcatgttgccactgttcaaaatgaagaggaagcccagaaagggaaaaactaccagaacggagatgtgtttggcgatgagtataggatcaaaccagtggaagaggtcaaatacatgaaaaatggggcagaagaagagcagaaaatagcagccaggaaccaagaaaacttggaaaaaagtgccagctcaaatgtaagacttaaaactaataaagaggttccgggattagttcatcaacccagagcaaacatgcacatctctgaaagccaacaagaattcttcagaatgctggatgaaaaaattgaaaagggtcgggattactgttcggaagaagaggatatcacatagcaccaattttaccactcaaaccaggagctactactgtgtaaataggttacaccccagttgaaatctttgcaaaggtcggttctattcagcgaacagcactatagcaaaagaagatcgttccatattgtacgccccattaaattacagtgtttcttaatgaacttgcaaaggaatattgctaaaaacaaacaaaaaaaactgttatcgaactttctttgttgctgctagttaaaacttgttgcaacttttcacttctcttgtgtccaggtatgcagcaaaattctgcaatttcaccttaaagatactgttggttttacagatgctctccaacctattttctataagatgaggtagtggtgaactcagataacaaacttctcttctaaactggttctgcttctaagacaagcatctcctgccctctctccttcctccccatctctcgcacgcagtctagagatggactgagccttgcttctcactggcagtgttgagctttggagatgggatggttgctatgccaagccttgtttctctgctcagaagaagtagagaagctattatcaattaaaagcatgctgtgatgtgactcctggaagtgacgtaggagtgagtggcaggttgtttgatttaataggtatcttaatcaagaattaagcttgcaacattggctttgctcagatgcagatggaagtgtgatcacaatcattttgaatccctcttcctcacttttttttctaagaaaataaacattttactgtttttatggatccttgtcttctcccattcatccagctcagtgttttaagatgatcctgggtgcagaagttgagccctcctttgcattgacactgataattagcctatagggctccctacccttccattaagaatctaccaagcattagcaaggctgaaagtggtctaagaggtgaggggacatcctatgactttttaggaaggcctgaaaccaccttgttacctttcattttgttagcaaataaaccatcctattttgtaactctcccccttcaaaatgctacatgagccttgccacttcctttttctcttacttccagcacactagacatagcaaaagtgtttgcctactcaaaaacataatacttttatgctgatgatggtatttggagatgtgaaagccaaaagcccctggcagtggtggggaatgttgactgagtgttcagcagagtttatttttccatactatatgaagagaatgatctcttctcaaagacagaagtgatatttttaacaaatattgtcacaagtaaatagcaatcaaaaggagaaaataacttttgtatttttttaatgtgtttgatagctttgacgagggttctctttgttactttcaggggagggcatcctattaaatgccacgccagcagtccgggtctgggtttgtcccacaaaatcacaggagcactgtatgttcctctcttttggagttgtgactttgaagggcctcaatattagccacactgccgcctgcagaaggtggagagttaagatgttctatgtcaatttgctcttgccgaaaagatgagcctcgattttaaaatctatccacatccaactgatggcaccattgatgtgcaaataatgagattccctatctccttttagacctgggacggcaaaagggaagggaaggaaacttagcagagtgctattgactatagattcacatattagcaacaaaatcccgtaattcttttggccaacagcagctattttggggagcagctgtggctgttacataaatagagatgcagccaaaattttaggccttttatcctgcttctagcagaaaaatgcagggagagtcaagtagtctagggtttcaggttgcctcccctcatatggtttttggccaagtgactaaaacagttttccacaactgtaaacaaactggtaagccccacctcaaacttgttcactggggactttgcttaccgttctgtgggtgaccttttccgggatttcttgttcttatcaagcaagaattaagcacatgctaaacgtcttccatttgacttctctactcggtgtctcagacagtgtcttcccagaaaaccaccaccctctacccaaagatgaaacatgctcatgtcatttttctcatggtcacatttaacagttttgacatgttatacttgcgcatagatccaagcgtttcttgggaacctgacttttgagtgtttaataaagccggaagtggtgttgccctgaaccagcagattttcacctgggttctggctccggtgtttaacactggatacatctttgatgtgcgaaagtgagttcatcttcagacacatttggtacatccagaaatagatccaagaaatggggtggttgagtgggtccgcacgaaatgcttgattatgtcagcaacacccaacactgtctgttttccatttgttggttttaatcataaaattgtcaagtga

SEQ ID NO: 17968 - DNA, 9701 bp, Homo sapiens
  misc_feature (4384)..(4384): n is a, c, g, or t
  misc_feature (8686)..(8686): n is a, c, g, or t
acacatttgcaggattactgtactgtttatccttaatgtaacttcagagtatttcagtggaaaagttctgcatttttcctttgaggggaccaggtttagcaaagcactaaaatatgcacttaactaccctttgtttttcagcatgcacatctctgaaagccaacaagaattcttcagaatgctggatgaaaaaattgaaaagggtcgggattactgttcggaagaagaggatatcacatagcaccaattttaccactcaaaccaggagctactactgtgtaaataggttacaccccagttgaaatctttgcaaaggtcggttctattcagcgaacagcactatagcaaaagaagatcgttccatattgtacgccccattaaattacagtgtttcttaatgaacttgcaaaggaatattgctaaaaacaaacaaaaaaaactgttatcgaactttctttgttgctgctagttaaaacttgttgcaacttttcacttctcttgtgtccaggtatgcagcaaaattctgcaatttcaccttaaagatactgttggttttacagatgctctccaacctattttctataagatgaggtagtggtgaactcagataacaaacttctcttctaaactggttctgcttctaagacaagcatctcctgccctctctccttcctccccatctctcgcacgcagtctagagatggactgagccttgcttctcactggcagtgttgagctttggagatgggatggttgctatgccaagccttgtttctctgctcagaagaagtagagaagctattatcaattaaaagcatgctgtgatgtgactcctggaagtgacgtaggagtgagtggcaggttgtttgatttaataggtatcttaatcaagaattaagcttgcaacattggctttgctcagatgcagatggaagtgtgatcacaatcattttgaatccctcttcctcacttttttttctaagaaaataaacattttactgtttttatggatccttgtcttctcccattcatccagctcagtgttttaagatgatcctgggtgcagaagttgagccctcctttgcattgacactgataattagcctatagggctccctacccttccattaagaatctaccaagcattagcaaggctgaaagtggtctaagaggtgaggggacatcctatgactttttaggaaggcctgaaaccaccttgttacctttcattttgttagcaaataaaccatcctattttgtaactctcccccttcaaaatgctacatgagccttgccacttcctttttctcttacttccagcacactagacatagcaaaagtgtttgcctactcaaaaacataatacttttatgctgatgatggtatttggagatgtgaaagccaaaagcccctggcagtggtggggaatgttgactgagtgttcagcagagtttatttttccatactatatgaagagaatgatctcttctcaaagacagaagtgatatttttaacaaatattgtcacaagtaaatagcaatcaaaaggagaaaataacttttgtatttttttaatgtgtttgatagctttgacgagggttctctttgttactttcaggggagggcatcctattaaatgccacgccagcagtccgggtctgggtttgtcccacaaaatcacaggagcactgtatgttcctctcttttggagttgtgactttgaagggcctcaatattagccacactgccgcctgcagaaggtggagagttaagatgttctatgtcaatttgctcttgccgaaaagatgagcctcgattttaaaatctatccacatccaactgatggcaccattgatgtgcaaataatgagattccctatctccttttagacctgggacggcaaaagggaagggaaggaaacttagcagagtgctattgactatagattcacatattagcaacaaaatcccgtaattcttttggccaacagcagctattttggggagcagctgtggctgttacataaatagagatgcagccaaaattttaggccttttatcctgcttctagcagaaaaatgcagggagagtcaagtagtctagggtttcaggttgcctcccctcatatggtttttggccaagtgactaaaacagttttccacaactgtaaacaaactggtaagccccacctcaaacttgttcactggggactttgcttaccgttctgtgggtgaccttttccgggatttcttgttcttatcaagcaagaattaagcacatgctaaacgtcttccatttgacttctctactcggtgtctcagacagtgtcttcccagaaaaccaccaccctctacccaaagatgaaacatgctcatgtcatttttctcatggtcacatttaacagttttgacatgttatacttgcgcatagatccaagcgtttcttgggaacctgacttttgagtgtttaataaagccggaagtggtgttgccctgaaccagcagattttcacctgggttctggctccggtgtttaacactggatacatctttgatgtgcgaaagtgagttcatcttcagacacatttggtacatccagaaatagatccaagaaatggggtggttgagtgggtccgcacgaaatgcttgattatgtcagcaacacccaacactgtctgttttccatttgttggttttaatcataaaattgtcaagtgattcgtgttgtactttatttttgtgccttctgaacggatctaaaacaaaagtattttgccttttttaccccacgtgtatctgaacattaagcagattggctcagacaccatgaaaaggatactccaatgtacgtgctggtgcactctgctagttgttatctctgtagggctcaagaagctggaaggaggaagggagggtaagtggcctggtgagtggaggtagaaaaatgatgagaaatgaactgagagcattaagcagagagggttgataggctggccgtgtccggggtgaaattggaaatccagctgcctagtggccagtgggtggggcaagactgtcaacgagatttacagctggcttacacatgccttatgtcctctgagttgtagagttgtaaaagttcagcagtgtgtgcacagctttcttttggttggcagagattcaggatcatggagtactgctctcataattgaagacgtgtttgttattggcagagaaccttaaaaaaggcctttacctcagcgatgcttcctagccccaggcttgcagagaacacagagtggtgttgtggtctatttagggacaaagaaggtataaagtccagagatgagaaaactgggtcagccctcagaaactgcagcagccacgcacacagaagcctgctggaagacaggtctctctccgtccacagtgcccatcatctgagcctgggctgggatgactcaacttagcaaagacggacccaggaggagtgctggttcttcagtctttgtactggccccatcctctcctcactgtaatgtgaggaagcacctctgtgtcagggctcacctgggcatccaaagcggccacgcccacaatccgacagcccccaggagcaggtccagggatgatgcagcccccttcttggtcccatgtgatgtcatcctgctttgttatcttcttataactttatcctgctataactttatcctcttcccagcctcatccctgtttttctgttagggcaagactcttccataagcctgctaaaaaacagagatgatacctcttacaaactttacctcatagcctgtgaagcaggttggcatgtggattacaagtcctgctttgacactgggcaagaatttaagattgttctatctctactagtcatagaaaagaaacattgttaaacatgttgagttttaaaggaagaaatattttcaaattcttaatccaagaaaatactgagttggaatcttagacttcgggactctgacacgttctttatgaaaggcaaaataattggtatctaaagttctctccttcctgcctcccctaaagaaaaaggatattagattgcacactataattttacataagatctgccttccacacttccctgctggaaggcattctcagagctttatgtcttcgtacctctcagagattggactttttcttgtttaaaaccccaaccaaaaaaaataataaggcatgattggtggggagggaatgtgtatttaggggcataataaaaaggtggctcgaagcaggaactttggcctcatggtgtcatgggtggatgcctggactccagtgtgcctgtgaggggctgggttaggcagtcggctgtcacactcacatgtgcctgcaataaaccttttggaatttcatgaacgaggtnctatgaattgccttttgccaatgaatggatgtatttttccaaggggggaatagtatccttgactttggcagtcacctttttgtatgtctctagaaaggggtcaaaaaaactatggtaaagatgaggcttatgagtgaatacctctgggacaaaccttaggactcacaagctatgccatgtttttcaggagactcttgtaccttatctggaatccaatcctgggagaagaggaaaaaggagctaatatttgtcctttatactcactctgtgccagatactgtgccaggcattttataattgttttgtgtcatccccatgatatccgttaaattaatctattacccccgtgttctaaataatagatcttaagtgtggaatgcatctatccaacataaatgcccatgttgaaagaaggaaagatgtcattcaagtatttttcaaattctttttattatgactatgcccttcgcaacactgtgaaaacaacccctgggggcatctgccttccagaatctctctctggcttctcaccagcttggtttcctcatggggagtgttttatttggcctcccctatctgagctgcacacacaccagggggaggccactggctaacagtaggacttcagtgccctgaggaaaaggctttgggaatttaggcacacgtttctctccttggaatccttctagcatctggaaaaggaacctggtatttctgcagttagataccagatgcaaccagaacaggctttcgagtgctgtgatttctttcctgggttcccaagtcttgttgtttcatcacaaactgtatctttttaaggttaaaagtcttgaccttcatgggggtctgggacaatccgatctccaagcatggaggaaaggcaatgcctggaccactgacttgcattgaaatcctttcttgtgggctagggtttgatgtctctttttcatctttggactggggatctgcatcttccaggtccatttaagcactgaaactagatgcaaatctctttcgagaccttacatgttttagatagtcatgtaatgacttggatagacatttaaataacttgttccaaggtcggaagagcccaagaactcctcagagttcctcttcttgcttcttgaatcacatcctctaaagatgactcatgtctccatagcaactgttaaaggtgctgcctagacgggacccgctcccacctttacttactttgctcgaaggaaccaaaacaatgtccttgtgtaaaggggctgtcatatccagttttcctttgaaatctggcccccaagatcctgcttctttctaacctggcagctgtcatgtcccttcaagatgatgtgggaaatggcccttacaacttgggaaccacagaaattgctgtatttcgggaagattcacctctaaactgaaggcttcattctgatagtgtctgccctctctaccctgatttcgcccttctttgcttccatttttagcccaaggctttgaatttgattgagtaagacttagaggcagtataaagaacaccataaacttaggcagaggtcccttagggtctctagagttgaaaataattctacagccttagggggacctcttggcattgactctaaagggagagaatagcccctgtgtcctggcatttcagtctagaccttcaaggactgttctctcttgacaggcaagcaagcaaagaaagttttgcaatagatttcaagccagtttttccattcaaaccaagatgcaaattcataaaattactcttttcctggaatagatccaggcagctgccttattagaactttagattcggatctattttcttaacacacatacacatacacgcgcatacatacatatacagagagatacgtggagaaaggaaatttactctatcattgcaatacttcaagaaagagctgtattttgcctttctgtaatctccaagatagtgtctaggaaagtaatagtataactatagggataccgaaacaggaaaaaccagccatcactcttgagaaagtttgagttcgactcacatgggagaatcgaggtctgctactcgtcttgctttgtgccccatctgtgcctggatgccctactacatctgcttgactcgtctgggctgctagccggggtgttgtggctgacatcctttcctggccttacacacataatagacacatccctaacggcgtgtgcctggtccagccacatacagccaccacatgtgtcacacactgtccccctcatccatgtggacttgactggcatttcagcagctccactgggatgctctaaccccagtgtgtggagttggggtcccttcatctaggttgacccaggtatagcatttttagcattgcctttccagtcttgatgattcattcattgaactcatttatttctggagcccctggtacactccaggcactgcgctaattgccagcaaagcacaactgaactaaatccaccttcaaggaacctagccataacgagggaggcagcatggaagtaccctacaggggaaagtcctgagtgctgtgggagcatctcaccgtggcagccagcccagttttggcaatcaggggcttcctgaaagaggtgacatcaaagcccggatgtgtcagaggactgagggagagtgttactaaaggactttcaggctgagaggatagcacaggactcagcccaaaggagggccagtgtggactgtccagggccagcctgcagtacagaggctggagcttggacttgtagagggagagagaagagcaagggacgtggacggggcagtgagccaggctagccacagagggttcccggggctttgctggggattcagggagcataaataagagctttaggtggtgctgtgtcctctgcagcccactgctgaggtcctccagacaggtaaggtgtggtcacaatcagggccggggtttccctgctcactgcggcagtgcaggggtgcttgctgagatgattcatcccagggtgtcctctgtcccttacccagccccaactcctcttcctctgccaaaagctatttgaattcaaggactttaacctgggccggatctggtttggagacaaaggggacagctctgggtcagcatgaccttctttagagccactaaggcgaaaaataccgtttgggaccaggctggcctagacccagggatgagaatgcaccctaaaataaatatacgggaagcagcagagggcttccctgtctagtgtgtgatcctaactaaaggcagctctcttggacagccttcccctggattaggtcacatacacctggtggccaagcctctgctgggtcccaaatacacacccgagtcctgccaaagaaaggagatttttaaaaagcacagacaaattgtatgcaagtggaaaatacccataggcctagacagctgtggagggaagacctcgtgggtacctggaggctgccagagctgggagctctgcaggtatgagtcagggaaggctcagagacaagcagaatctctctatggagacaacttgcagtgccttttaggttttccaaataacctcggagttcagagcattgggtttttttctcccctccccacccccagaaaaataattagaaaaatgtttaggagaaaggaaaagaattagatgcatcagaataccagctataagccaacactgtttccagaaactcaagaaaaagctcaaacagaagacagttcccctgagaggctggaggcgttggtgctgaaggcaattttcctagctaaggggcactgggccttgctgcaccttggggctgaccttttttgcaaaacacccacccctgccctcctggcatactcaacagcaacgccagctttctggacccttggaaagatgttagctcaaacacccactttttccagatcttcctcttgctcttcactgaggaatttgtaattctgaggctagcgatgccgactcggatattccgcaggcccaggtgtttagattagaatttgtccagcggtaatcctgatgctggaaaccaacaaacatttggcctcatattcacccatttaaaaactagagcccctggcaggtccccttagggccatgtgttcatggaatataagccaagtttgccttagcgcttgttcatggaatataagccaagtttacctctccccattttctgccctggcccacttcccactcacctccacctcattgccaggaagggatcaaaatgcctccatgccagttgttaaatggctacatatttgcccttcccaagggtatttgcatttntatttaggaacatggccttatattcaaggaaaatctagcatcaagattacgaggcatcacctctcaatcaggtctgggaggtatcttggggcattgctcttctgaacacctgcagaggcttcctcaggtgagtgtgggagcccggaaggtggcctccctaaccactctgcctgcacatgaattctccaaagcagtgggcccccatctgtttcaattacacatgcctgtcagcaaaaacttcgtgagatgcactctctctgtgtgtttattaatttatttaaagcatatatccctttacttttgtactactatattaggcacattataaaaagtatacagcatagaaactttaaatgaataagacacaaaatattataaacagaggttctggcattttctctctgaactcctgagggggaccttgggcacctcctggtatgtgcacaccccactttgaacacccttgctttagtgcaaatcagcacgcctaaatagcatcccaaaccactgtgcgacatttggcctgcagaataagaaagtcctaaggcagaatccccaggaacttcaaatctgggagatgaggaaagaaaactcactcacaaacaacataaatgtaaataattcaaaaccctaaaggagagctgtccctagacagtagtggctacaggtgctaagcaaaagtcaggtacactggacagagccatgcgattgattgttcatcttccctctctgggtctccagaaaaggacactggcaatatccccagctctctcctgattggaattctttgaaccctcgaagtgctccagcagtactaccccccacgtagcagtgggcccatgtcgcttgaatattatttttgatttgaccaccaagatgtaatgatgattctattccattttgaaaagggtctgagaaagtgtacaggtctaattatatatacatatttatacatgtgtatttttgtttattgttacattttgacattggactttctattaaataatttttaaga

SEQ ID NO: 17969 - DNA, 2169 bp, Homo sapiens
  misc_feature (2169)..(2169): n is a, c, g, or t
tgagcgaggagctcccctccctcgctcgctcctcgcaagctcccgctcgctccctgcccactcccggggggacgttccgtgccgcggccgccgcggccgctgcttctttcacactttagttgggagctgcgcgccgcgctcagttactggagagctggccgcgcgccgccgcctcccgcacgcttgcacgcgggcccggcttcggggttttgggttcttactccaagcggcggggaggagggggagccccggacacactgtggggaggaggaggaagaagaggaggagggaggaagaaaaaagacgaggaggacaggggcggggggcgggaggcttgccaccttcagcccccccgcgaacgcccaaggtgcacacatcttgaccaactcagcagcaaggtggattttctttgtgtttaaagaaaaaaaatgtccctgtgtctgtagagatgatttgcagttcagcccggctgaagctgaccgaatgagactatgggctgtgcctccgccaagcatgttgccactgttcaaaatgaagaggaagcccagaaagggaaaaactaccagaacggagatgtgtttggcgatgagtataggatcaaaccagtggaagaggtcaaatacatgaaaaatggggcagaagaagagcagaaaatagcagccaggaaccaagaaaacttggaaaaaagtgccagctcaaatgtaagacttaaaactaataaagaggttccgggattagttcatcaacccagagcaaacatgcacatctctgaaagccaacaagaattcttcagaatgctggatgaaaaaattgaaaagggtcgggattactgttcggaagaagaggatatcacatagcaccaattttaccactcaaaccaggagctactactgtgtaaataggttacaccccagttgaaatctttgcaaaggtcggttctattcagcgaacagcactatagcaaaagaagatcgttccatattgtacgccccattaaattacagtgtttcttaatgaacttgcaaaggaatattgctaaaaacaaacaaaaaaaactgttatcgaactttctttgttgctgctagttaaaacttgttgcaacttttcacttctcttgtgtccaggtatgcagcaaaattctgcaatttcaccttaaagatactgttggttttacagatgctctccaacctattttctataagatgaggtagtggtgaactcagataacaaacttctcttctaaactggttctgcttctaagacaagcatctcctgccctctctccttcctccccatctctcgcacgcagtctagagatggactgagccttgcttctcactggcagtgttgagctttggagatgggatggttgctatgccaagccttgtttctctgctcagaagaagtagagaagctattatcaattaaaagcatgctgtgatgtgactcctggaagtgacgtaggagtgagtggcaggttgtttgatttaataggtatcttaatcaagaattaagcttgcaacattggctttgctcagatgcagatggaagtgtgatcacaatcattttgaatccctcttcctcacttttttttctaagaaaataaacattttactgtttttatggaaaaaaaaaaaaaaaaaaaaaaaaaaaaaaaaaaaaaaaaaagaggggggggcgggcccaaaagattccccccgggggggccccatttcgcgcgcccccccgtttttgtgtgaaaaaagggggggcccccatatatggggaggcacgcgtattatatatagtgcgaggcagcacggggccggcggttataaacacaagcgttggcgtgggcagcgggaaaacaacgcgcgccccggctggggaacaccttctgggggggaggagacccccctctaatctagcgcgcggggcgggggacaccatttatgtgtggcgcacctactctctccatctcccagggaggatttttagacagcggctgcgaggggggatgcatattcctacacgattcttttcacgcggtgtttctagtgggcgtgtttaaccaccaccgcgcggccgtattcatgatcgggggggtccttgggtaagaaatttggggcctgacaggcgggtaattgtttctcttggagggactacattttttttttccgcggggctccn

SEQ ID NO: 17970 - DNA, 402 bp, Homo sapiens
caccaccatgcccggctaatttttgtatttttggcagagatgaggtctcgctatgtggcccaggctggtcttgaactcctgagctcaagtgatcctcccaactcggcctcccaaagtactgggattataggcatgggccaccacgcatggcctaggtcaaatttttattatatattttttagcagataataaaggttaaacatcccaaatcaaaaaatccaaaatccaaaatgctccaaaatctgcaactttttgagcactgacatcaaattctcactggaacatttcggacttcagattttcagattagggatgctcgttcagtaagtataatattctacaatctaaaaaaatctgacacccaaaacacttctggtcccaagctttttcagtaaaggatac

SEQ ID NO: 17971 - DNA, 513 bp, Homo sapiens
tgggtgacaggctgtcattgatagagctagataacgatgaaggtgatgataatgatagccaatcctatgtagcactcattaagtaccaagcactattaagtgcttgagggagaataaatcatacaatcctatgtggctcgtattcttgtcatatgcattttgttgatataaaaaaaaaatcaaggcacagaatgattaagacacatacctgaggtcatacagctagtaagttgcagagcaagaatggaacccaaggccgggcgcggtggctcatgcctgtaatcccagcactttgggaggctgaggctcgtggagcacaaggtcaggagttcgagaccagcctggccaacatagtgaaaccccgtctctactaaaaacacaaaaagtaaaattagccgggcatggtggcacacgcctgtagtcccagatactcaggagcctgaggcaggagaatcacttgaacctgggaggcggacattgcagtgagccgagatcgcgccactgcagtccagc

SEQ ID NO: 17972 - DNA, 748 bp, Homo sapiens
aaaattaaaccacaaagagagaacactgcacacccaccagaattgctaagatgaaatagatggtataccaaatattgacaaagctatgaaaaagcacaaactcatacactggtaatgggagtacaagttgttgcaaccatttggcattatctgcctaagctgcagatacgtgtattgtgtgacccagcattttcactcatccttatgtactgtagagaaatgcatttgtgcatcacgagtaccaagagatatgtaaaagaatgtgtacaacattatgttaaagtcattgtctagaaatagtacagatctctgtcaacagtagaatggataaatataagagtacattcatatgaaagaatattatactgcagtgaaaatgaaatcacagcagttctcaacatggatgaatgtcaccaaacattatgaattaaagaagatagatacatactcaagattctaactatataaagtttgaaaagcaggccaaaaaaactatagtgtttgggatgcttgtgtagatagatggcagagccataaagaaaaaccaagaaattactgtaaaattcacaatagtggttactttgggtaggtgggactctcggaatattttagggggcccaattatggaaacttctggggttctggcagtattcttaatctgaatggtggttacgtggatcttcactttatgataaatccttaacctatacgtttttgttttgtacattttctgtttatgtgttacatt

SEQ ID NO: 17973 - DNA, 430 bp, Homo sapiens
gattttcttatcaataccttgcctttctttctccctggagatggataacaaggaataaactcttaggaggattctacctcccactactgccattccaagcatcagtccctttctcctgacccatggatgtactgactcacttcccaaagggtggagccttcccaagtccctgtgcccatgtgccaatcacagggaccccagcagggtttgtgcacagggagagcaaaagagggacagatcacacgtgatgttttgtatggatctttcccttctccttctttctccccacctcacctcccaccagtggcctctcccactgccagccagtgccttgctcagaacctacctcttcctcctacacagaaaggtatgaaacccatcagcgcttgtttttagctgggaacaaactgttcacacatttcattaacta

SEQ ID NO: 17974 - DNA, 261 bp, Homo sapiens
ccttatctgtagattttgtttttgatagggtgggatagtaatagtaactacaaggtttcacaaggttgtgaaattgaatgagaaatacatggcactttaacaagtcactatggattatttaatttcttttcttcttcttctgctgctgcttctccctgcccgcccctacccttttttttagagacagggtcttgctctgttgtccaggctagagagaaatacaatttatttactcccagtaaggaaaatcttagaaatgtt

SEQ ID NO: 17975 - DNA, 334 bp, Homo sapiens
tttgacagacactaagatgtcattaaatttgcattggatgggctttgacatataattagttttgattgctaaaataattttttaagattatgacatttctgatttatttttcagctttattttattttttgcagttaatattttatttttgctgtgggtgggccttgaaaattagtagttagtttaaaaataattttaaaatcagtaatagtaagtaatcattttatgcattaaaaattgctgtagcttcagtagaaagtttgagtgttactttgaaatggacaggagtactttactgaaaacagctgtgtgtcactagtttatctgacatagc

SEQ ID NO: 17976 - DNA, 784 bp, Homo sapiens
aaaatgtgttgaactagaagacgctaagtttgcaccggcccattttttgaaggcagttttaccccccatgtgattcctaactccccttccctgatgggcccgggttcacagcggaatgtgcagagcctggttcttcaaaccgcctctcacctctagattttctgactgcctctctgatcaccactcagatcaccacttggccactttaggccaagaagagctgataacaccacttttaacaaaactgaactatacccattgcatctgcagctgctcatacaagctttgaaaagttaggccagatagaaaagccctccaggaaagaacttatttggaagaaatttcaggctggtgttactttataggaagggaaaaatgtcagaggaggaaacctgtgaacccatttaacacaactggcttcaggtgtaatgtttcaagtgaactgagagcgattgtggcaaggtctttgggtccaacatctaatgttaaaaaagaaaagagaaggaatgaaagtctgtctttcagcatgagcaaggctcttttaaaaataataaaacagtttgaggaggtggctatgacaagactgtgacacataatttagcaggtcttcaaagcaataacagagagggcaagctatggtgattaacagcagaagcagggaaagcaggaatggtgtgaggaggaaggaagcttgacagcacaaagcttaggggaatggggtggtgtaggagtgaaggatgaggttgtgatggataggactctagaatgctgaaagataggatga

SEQ ID NO: 17977 - DNA, 316 bp, Homo sapiens
tgttatagggaagtcccttaagtgcttattgacttttctcatccactgccttggaaggtaagagcaaaaattactaaaggcagagacagagttaacataataaattgtggatgctcccgaagctaaaaacaatgcctttgctggcttctaaagaaaaaaactctagggttgggtaatggctcacacgtctaatcccagcactttaggggactgaggtgggaggatcgcttaagcccaggagtttgagggtgcagtgagctatgatgctgccactgcactctagcctggatgacagagcaagaccctgcctctacaa

SEQ ID NO: 17978 - DNA, 1328 bp, Homo sapiens
aaaccagcatggtttgacaccacatgggaacatgaataaatctgtctcatgatttgaaaagtacaccttgcaaagttttaaaaataaagtttttaggcaaatgcgataagaaaccgtcatttccagtcacagtaggcgatctttcgtaatttcataaaagcagttcgtttgcagtatggcttttgtgtagttaggggttttttaagtgtgaagaaaggtatgtgggctttaaaagtgattctaaatcttgaatagaaaacacatgaattggctttaataaaaatgtcacctttttattattgacattaagtaatggtaccatatattttttaaaatacatattgacttgaattgtgaggcaataagataccttctatatgtaatgatcacagaactaacccttataatatagttttacttattttgtttactctaaaaatctatagcagagtttctctattttatatttcatagatttaaaaaacccaaataaagatggatttaaaattcactgtggaaaagagtattgagttacaaactgagaagaaaaagcaggaagttccctaataatctggaatattctacatggcttgattacatagcaaacaagaccaagatttagggctgtctttaacatcactgccgtcttgaagcagggtacacacgttaggtattgtgaagaacatcaatccgaacttttcttctgttgtttgcactgatgcgattttttgttcttttatgtttatacaacgtatctatgttgtgtaggggaaattttttcattttttaaaaattctactttggttttgttgttgttttgatttgtttttggctaagtagaggacatggactagttgtagcaaacagaacatgctgtttgctcttgccaaaggtcagtgagtgagtgcatttgctgcagtggtggcacgtagagaactagatggtaataaagatttaaaactatgaagaaggttacagtgtaactattttggtactagaaccagttcatgctggccgaaacgacaatggtttatggacttgcatccattttgtatttttgtaatatttgtaaatatgaactttttaaattgctgcaaagatggtttcttttgtaagatgttttcaacgtttacattcaatccaagcctttgtatattttagagctgtgcaacactttaagtcttgtatttatttttagtaaaaatggtgacagtttcattgtgaacccctctcaaaaaaaatgtatcagaaaagtttgattacctagaaagtgtgtatagaaactgcaaataaacgtgactgcaattaaacaaccggtttctctcttc

SEQ ID NO: 17979 - DNA, 394 bp, Homo sapiens
gcggaggttgcagtgagcggagattgcaccattgcactctagcctgggcaaaaaagagcgaaactacatctcaaaaacaaaacaacaacaacaacaacaaaaacaaaaaaaatcctgctataggctggtgagccgtcaaatgctcactgcgctcttatggtggtgataagatgctttttctcctggagtctttgggacttgcccaaatgcactgagtggacattctgggtttggagggcgctgataagcagcaagcatgacagtggtcccgaggagcttgggaaagcagtggggaatgggagtctgcacactgacacaaatggagagatccagcgtttgctccacttagcaggggacaaaaatacctgttctattacttggaaaaaataaaaaa

SEQ ID NO: 17980 - DNA, 306 bp, Homo sapiens
ccccacaaagtattggaaaggcagacatgacttagaatgatgctcttaggactgagaaacaggagaccttggtatgagacttactttggcctccagtgagcaggggaaggtcacttcaccatctttatctaaaaaataaaggctttgggctctgatccacagagatgggtgagtcctaatgctctgtgactctatgcatctggtatccttttcctgtccagggctagaaatatattttgtcttttccagtcataagaaaagtgggaggagcctgggcaacataacaaaaccccatctctacaaaaa

SEQ ID NO: 17981 - DNA, 1675 bp, Homo sapiens
gcccacgcgtccggagaatttctccgacatttaagtaacccttgatccatgcaagtgctatcaaaggatgactgcgtatgtttccaagtagcatctgtaaaggcggctctgggtaccatcattattgaggaaggcactaatacgtccaacaaaaggacttttgtttcatttaaaaccaaggaaaaagaaacaaaaacctcacctaactttaatgatcttgtgtgatttttccgtaagagaagcttcaatgctacttccagtctgagaaggctcagactcgccaggtaacagtttgttgctgctaaatatttctttacccagacttcagacttgatgtcccttgagttgtaaatgatagtctcagtcatcctcagcaagtccagtgttagagaggaaggttttagagcccaggggcacaccctcgagagtgagatgagaacagacagaaaggactaggggaggcgggagaggacatactggggaaggagagaagggcttaggacatcacagtgggggatgaagcatgataaaaactagctcactggtgagtccttcaatattttgggatttgtattgaaagcatgtctatgaacattttaattaaatcaagtaaatctggatgagcagaaacaggattttttctttctcaaaacagggtcttgctctgttgcccaggctggagtgcagtggtgtgatcacagcccactgcagcctcagcctctgggactcgatcaatcctcccacctcagcctcctgagtagctgggaccacaggtgcccaccaccactcccagctaaatttttgtagagatggggtctgcctatgttgccagggctggtctcaaactcctgggctcaagccatcttcccgccttggcctcccaaagtgctgggattacaggcaagagtcaccatgcccagccagaaacaggatttattattattattgttgttggtgttatcaaacacttgtagcccttagtgtgtgccaggctgttccgagcactgggcctgagtgaactcattgagtcttcacctcagctctgtgaggtcagtgctcttttattccctttataaagatggagatactgagtccccagtaggttaaataactagtccaggtctcatagctgctaagcagtttctggccagccagccagctcccaagcccaatgctccaaggaggagcagcagaacccaaggagggtaaaggagcggaggataggcctcaagaactagttactgcatgtagcgtttttaaaaaacttttttcattttcatacatttaaaaattacaataaagtacagggaagtcagcaaacacccagattcctactacttagaattaacggccattaacagttggacacatttgtttctggggttgttttttcttcttttatttgcagctctcgttacagacatggtaaaacccccttgaaccaccagctctggtaatttcccttctcccctccccagaggcagctgccacatttaggctcctttctgtatgcatattactgcatcccaaaagagtgtgtagaattgctctggaggccgggcacaatggcacatgcctgtaatcccagcactttgggatgccgaagtgggtggatcacttgagctcaggagtttgagaccagcctgggtaacatgacgaaagctcatctctaccc

SEQ ID NO: 17982 - DNA, 340 bp, Homo sapiens
ctatgtccttgtctgttggaaggtcttctaagtgtagtttttaatagaaacaatattaggaatggtttggttccatggctgattaaccaaaacttacttgactaggctctgcaatccatattttacaattttacatgctatatatagtattatgaaacctaaccaacctgcagagagtgggggcaggagcctctcaagcagctttgcctactagtgtaggggctgtctacttgtgcctctccaagtctgccagtgaaggcagagttcttacccagctaaaggtcaccaaggtggctcctgtgctgtgtctgagggtgggaatgactccttctgaggtgga

SEQ ID NO: 17983 - DNA, 354 bp, Homo sapiens
ggtaatctagtccctgatatgtgtgtgtgtgtgtgtgtgtgtgtgtgtgtctgtgtgtgtgtgtgtgtgccatttaaaaaaccttcacatttatttatttttaataacaggcaatttttaactaaatgtttacattattgactaaagatagttaaaccaattgttagtactaaaagaatttatgctgaaatgtaggtttggggactcagtgtctacaggatatcatgtttcactcaggtatttacagtagagctattattagattcaaaattgcccgattctaatttatattttaagtgtaacttagagatttttgcattatttacagctttattttcacaattcatttatgct

SEQ ID NO: 17984 - DNA, 224 bp, Homo sapiens
gtagaagagtcccaggcagataacctagaaataagcctgcctggctagtgttacagcacagaggcaaagacttagaggcaaggggaaaaagaaacattcagacaaatgaaagtagctaggaaaggctagagtgtagggttcaaggtgatagataatcagggagttactgttgaaaggttgttgatagtcagttaagggttgtaagatatcatgaaaggtagtct

SEQ ID NO: 17985 - DNA, 334 bp, Homo sapiens
gcctcacagccacttccttttttgaagctctgctgggagcaaatttcacataaagattaaagatacgcatgtcagggtgggttgactcttcgtttatagttttggggggttactatgtcgaatttttactctggacagtttctttttcttttaacaatttcaagtgtacagggaagttttaacagtagaacaaagaattctcgtgtcctccttctagactcctcctatggtaacatctcatatatttattcctgctgtatatatgtaggtacatatatatgtgtgtatatatgtgtatgtgtatgtatgtatatactgatacacatacacacac

SEQ ID NO: 17986 - DNA, 359 bp, Homo sapiens
gatgtgtgtctggtctgaagaggaggtagagacttcctgcgaaggctagcagagtaaaggtttgctttctccctttcctccccgaagaccagcacatcagatgaaaagaaccccccaaatcaagtaaaacttttatctgcagtgaaattaagagataactcatatccccaactatagaaaactgccgaatataatataaatccagaccacatggagggaaagacttcgagagctggtccatacctctcagctctcctgcctgttcgcctcccaaatgcccaacctccaaataccatcacatgtgggttagggttgccaggagtaaatttccttgttaataaaatgaatgagataggaaa

SEQ ID NO: 17987 - DNA, 520 bp, Homo sapiens
gcactccagcctgggtaacaggttgagactctgtctcaaaaaaaaatttttttttatcgagatggagtctcactgtgttccccaggctgatctcaaactcctggcatcaagtgatcctctcacttcggcctcccaaagtgctgggattataggcgtgagccaccatgcccagcctggttaagtaaaattttaacatgaatttataatattgatctaaataatagacttcctttgggtatttgcactagggtattctcctttcttccataactgaagagagtgtagtattgtaaaaaaaattgcatgcacgcacacacctgtatgaactttaaaaaaggaaaaggccaacacatgaggaggatttttatcttttacttcagcattattgttaaaaattagttatgtttattttttagagcagttttaggtttataaaaaaatagggcagaaagtactgagttcccatataccccctcacctccacacctagttttccttgttattatatatgttttaactt

SEQ ID NO: 17988 - DNA, 171 bp, Homo sapiens
catggatgtggtcacctaggaggttaagaaaaattagatccagggatagtattctggaggagaatagcatttttaggatggacagaggaaaaccaggtgttagtagtcaggtagataggaagaaaattggcagatgaatttgttacggaagccagaattgggaagagtttc

SEQ ID NO: 17989 - DNA, 343 bp, Homo sapiens
taagtagcaaataaaaatgcttatctgtgggcatgatggggacaggatacatggtgacaagttggcagtgagactttgttttaatttttgaactatgtaaacatatgacctttttcaaaaaagctattgttaagctagaaacaaaaatgagcatgtagagtattaatctttaagaattagttaggataacacttggtgctgtaccagcagccagccacatgaggccttactcacgttgcataggtgagaactacttacctggctacacctgcctccatgttgagctgggaaatgtagcccccagctaggcagccattcccatgcccaactctacactccgtag

SEQ ID NO: 17990 - DNA, 1241 bp, Homo sapiens
ccagctggaaccaagaaggttgtgtcccccttcctctgggtgtccttgtctcctgctatcaggaactgcttaacgtctacagcaaggcctaataggggacctgagggcacagtcctcaggatgtttcggggagaataggagccagaacctgagcccctaagccattcccctcaccaatgatggggtccccagagcagaaccattacctggcccagctgtttggcctgtacggcgagaatgggacgctgactgcagggggcttggcgcggcttctccacagcctggggctaggccgagttcaggggcttcgcctgggacagcatgggcctctgactggacgggctgcatccccagctgcagacaattccacacacaggccacagaaccctgagctgagtgtggatgtctgggcagggatgcctctgggtccctcagggtggggtgacctggaagagtcaaaggcccctcacctaccccgtgggccagccccctcgggcctggacctccttcacaggcttctgttgctggaccactcattggctgaccacctgaatgaggattgtctgaacggctcccagctgctggtcaattttggcttgagccccgctgctcctctgacccctcgtcagtttgctctgctgtgcccagccctgctttatcagatcgacagccgcgtctgcatcggcgctccggcccctgcacccccaggggatctactatctgccctgcttcagagtgccctggcagtcctgttgctcagcctcccttctcccctatccctgctgctgctgcggctcctgggacctcgtctactacggcccttgctgggcttcctggggggcctggcggtgggcactctttgtggggatgcactgctacatctgctaccgcatgcacaagaagggcggcacgcaggacctggcggactaccagagaaggacctgggcccggggctgtcagtgctcggaggcctcttcctgctctttgtgctggagaacatgctggggcttttgcggcaccgagggctcaggccagtgagtgatacccttttctcctccttctgctgagaccagagtcccagtcaagaactgggccaggccgggcgcggtggctcacgcctgtaatcccagcactttgggagcccaaggcgggcagatcacaaggttaggagttcgagtccagcctgaccaacatggtgaaaccctgtctctactaaaaatacaaaaattagctgggcgtgg

SEQ ID NO: 17991 - DNA, 1293 bp, Homo sapiens
gcctggattcccccttccctgactcaggaactgcttaacgtctacagcaaggcctaataggggacctgagggcacagtcctcaggatgtttcggggagaataggagccagaacctgagcccctaagccattcccctcaccaatgatggggtccccagtgagtcatctgctggccggcttctgtgtgtgggtcgtcttgggctgggtagggggctcagtccccaacctgggccctgctgagcaggagcagaaccattacctggcccagctgtttggcctgtacggcgagaatgggacgctgactgcagggggcttggcgcggcttctccacagcctggggctaggccgagttcaggggcttcgcctgggacagcatgggcctctgactggacgggctgcatccccagctgcagacaattccacacacaggccacagaaccctgagctgagtgtggatgtctgggcagggatgcctctgggtccctcagggtggggtgacctggaagagtcaaaggcccctcacctaccccgtgggccagccccctcgggcctggacctccttcacaggcttctgttgctggaccactcattggctgaccacctgaatgaggattgtctgaacggctcccagctgctggtcaattttggcttgagccccgctgctcctctgacccctcgtcagtttgctctgctgtgcccagccctgctttatcagatcgacagccgcgtctgcatcggcgctccggcccctgcacccccaggggatctactatctgccctgcttcagagtgccctggcagtcctgttgctcagcctcccttctcccctatccctgctgctgctgcggctcctgggacctcgtctactacggcccttgctgggcttcctggggggcctggcggtgggcactctttgtggggatgcactgctacatctgctaccgcatgcacaagaagggcggcacgcaggacctggcggactaccagagaaggacctgggcccggggctgtcagtgctcggaggcctcttcctgctctttgtgctggagaacatgctggggcttttgcggcaccgagggctcaggccagtgagtgatacccttttctcctccttctgctgagaccagagtcccagtcaagaactgggccaggccgggcgcggtggctcacgcctgtaatcccagcactttgggagcccaaggcgggcagatcacaaggttaggagttcgagtccagcctgaccaacatggtgaaaccctgtctctactaaaaatacaaaaattagctgggcgtgg

SEQ ID NO: 17992 - DNA, 1285 bp, Homo sapiens
ccagctggaaccaagaaggttgtgtcccccttcctctgggtgtccttgtctcctgctatcagggcacagtcctcaggatgtttcggggagaataggagccagaacctgagcccctaagccattcccctcaccaatgatggggtccccagtgagtcatctgctggccggcttctgtgtgtgggtcgtcttgggctgggtagggggctcagtccccaacctgggccctgctgagcaggagcagaaccattacctggcccagctgtttggcctgtacggcgagaatgggacgctgactgcagggggcttggcgcggcttctccacagcctggggctaggccgagttcaggggcttcgcctgggacagcatgggcctctgactggacgggctgcatccccagctgcagacaattccacacacaggccacagaaccctgagctgagtgtggatgtctgggcagggatgcctctgggtccctcagggtggggtgacctggaagagtcaaaggcccctcacctaccccgtgggccagccccctcgggcctggacctccttcacaggcttctgttgctggaccactcattggctgaccacctgaatgaggattgtctgaacggctcccagctgctggtcaattttggcttgagccccgctgctcctctgacccctcgtcagtttgctctgctgtgcccagccctgctttatcagatcgacagccgcgtctgcatcggcgctccggcccctgcacccccaggggatctactatctgccctgcttcagagtgccctggcagtcctgttgctcagcctcccttctcccctatccctgctgctgctgcggctcctgggacctcgtctactacggcccttgctgggcttcctggggggcctggcggtgggcactctttgtggggatgcactgctacatctgctaccgcatgcacaagaagggcggcacgcaggacctggcggactaccagagaaggacctgggcccggggctgtcagtgctcggaggcctcttcctgctctttgtgctggagaacatgctggggcttttgcggcaccgagggctcaggccagtgagtgatacccttttctcctccttctgctgagaccagagtcccagtcaagaactgggccaggccgggcgcggtggctcacgcctgtaatcccagcactttgggagcccaaggcgggcagatcacaaggttaggagttcgagtccagcctgaccaacatggtgaaaccctgtctctactaaaaatacaaaaattagctgggcgtgg

SEQ ID NO: 17993 - DNA, 1341 bp, Homo sapiens
ccagctggaaccaagaaggttgtgtcccccttcctctgggtgtccttgtctcctgctatcagggcttcccctttcttggtcatcgatccctagagctctggctctttctcttcttgggggcacagtcctcaggatgtttcggggagaataggagccagaacctgagcccctaagccattcccctcaccaatgatggggtccccagtgagtcatctgctggccggcttctgtgtgtgggtcgtcttgggctgggtagggggctcagtccccaacctgggccctgctgagcaggagcagaaccattacctggcccagctgtttggcctgtacggcgagaatgggacgctgactgcagggggcttggcgcggcttctccacagcctggggctaggccgagttcaggggcttcgcctgggacagcatgggcctctgactggacgggctgcatccccagctgcagacaattccacacacaggccacagaaccctgagctgagtgtggatgtctgggcagggatgcctctgggtccctcagggtggggtgacctggaagagtcaaaggcccctcacctaccccgtgggccagccccctcgggcctggacctccttcacaggcttctgttgctggaccactcattggctgaccacctgaatgaggattgtctgaacggctcccagctgctggtcaattttggcttgagccccgctgctcctctgacccctcgtcagtttgctctgctgtgcccagccctgctttatcagatcgacagccgcgtctgcatcggcgctccggcccctgcacccccaggggatctactatctgccctgcttcagagtgccctggcagtcctgttgctcagcctcccttctcccctatccctgctgctgctgcggctcctgggacctcgtctactacggcccttgctgggcttcctggggggcctggcggtgggcactctttgtggggatgcactgctacatctgctaccgcatgcacaagaagggcggcacgcaggacctggcggactaccagagaaggacctgggcccggggctgtcagtgctcggaggcctcttcctgctctttgtgctggagaacatgctggggcttttgcggcaccgagggctcaggccagtgagtgatacccttttctcctccttctgctgagaccagagtcccagtcaagaactgggccaggccgggcgcggtggctcacgcctgtaatcccagcactttgggagcccaaggcgggcagatcacaaggttaggagttcgagtccagcctgaccaacatggtgaaaccctgtctctactaaaaatacaaaaattagctgggcgtgg

SEQ ID NO: 17994 - DNA, 1261 bp, Homo sapiens
atctcgcttctcttgctggcctgcatctgctatggtgatcagtgctctagatgggaggagcgacaatatcatccgaacatgatcgcgaaaccaccaccacccctcaccaatgatggggtccccagtgagtcatctgctggccggcttctgtgtgtgggtcgtcttgggctgggtagggggctcagtccccaacctgggccctgctgagcaggagcagaaccattacctggcccagctgtttggcctgtacggcgagaatgggacgctgactgcagggggcttggcgcggcttctccacagcctggggctaggccgagttcaggggcttcgcctgggacagcatgggcctctgactggacgggctgcatccccagctgcagacaattccacacacaggccacagaaccctgagctgagtgtggatgtctgggcagggatgcctctgggtccctcagggtggggtgacctggaagagtcaaaggcccctcacctaccccgtgggccagccccctcgggcctggacctccttcacaggcttctgttgctggaccactcattggctgaccacctgaatgaggattgtctgaacggctcccagctgctggtcaattttggcttgagccccgctgctcctctgacccctcgtcagtttgctctgctgtgcccagccctgctttatcagatcgacagccgcgtctgcatcggcgctccggcccctgcacccccaggggatctactatctgccctgcttcagagtgccctggcagtcctgttgctcagcctcccttctcccctatccctgctgctgctgcggctcctgggacctcgtctactacggcccttgctgggcttcctggggggcctggcggtgggcactctttgtggggatgcactgctacatctgctaccgcatgcacaagaagggcggcacgcaggacctggcggactaccagagaaggacctgggcccggggctgtcagtgctcggaggcctcttcctgctctttgtgctggagaacatgctggggcttttgcggcaccgagggctcaggccagtgagtgatacccttttctcctccttctgctgagaccagagtcccagtcaagaactgggccaggccgggcgcggtggctcacgcctgtaatcccagcactttgggagcccaaggcgggcagatcacaaggttaggagttcgagtccagcctgaccaacatggtgaaaccctgtctctactaaaaatacaaaaattagctgggcgtgg

SEQ ID NO: 17995 - DNA, 447 bp, Homo sapiens
aaatcatgattgagatgacatggcatgttttccacatttcaattttcaatactttgtatctatcccagagaattctttccacagcacacttttcttatttttgttattcatccagacctgaattttttaatacattcagcaatttttatcaaacatgagtgattggagtttttccagacaagtaatgtttttttttcaagtgtgagattttgtgtgcgtgcatgtgtgtgtgcgtgtgcatatcttctgtagagttatagaaagctcagttttaaaaggtggccaaaaaaatgaatcaatgaataaagtggaattaagagtcacccgtaaccttgatgctagtggtggtacagatgtgtacatttgtaaaacctcatggaactgaacagttaaaattgatacatttattgtatatacattatacttcaataaaatttttaattaaag

SEQ ID NO: 17996 - DNA, 889 bp, Homo sapiens
cttttgttccttccactctaatcacttgacctcctgacctcagtcatgctaataaactcatgcctcatttagatttattttcctagtggaagaaaatgcattgatctgtgaacacaaatacatggtttatctgttacagttctcattgcatgtcaacaaactgacattctgatgtgtacatccatctcttatgagtctgcttagtgtgaatctgccccctctggtagtactgacaagattgtgtttctcagcccacagagctaagacacagactcatgagacccagtctctgtctataccactagagttctactgcccctgaatggcattgcctgcacagacagctggccttcctcagcagacacacagcctttgtaccatataactcttcagacttgctatgatgtaccaatgtctttccttgaaatgctcttctgaaaatgataaatgctaaaactgattacaatgctattgaaagtggatgagcaagttgatctgctgagatgtgaaaacaaattctattttaatttttaatctaaaatattagaaagaattttgtttcctatactttgctatatttagtaaatatacactaatataagaattttgctttactaaaacagtagaaccctcagttagccaggcagtcatcatctgtcacataaaaggtgtcctgaggaggaatgggagtgcctcccctggggaagaggctgatggtggctctggctctcagtcagtcgctttccttatcttggtatttactgtcatttatctgggcttagctaaacagatttatagagaattaactctcacaaaatgggaacataatttaaaagatttctgcaaagaattggacaggaactcttgtcaaaattgtaagcagaagaaa

SEQ ID NO: 17997 - DNA, 2224 bp, Homo sapiens
  misc_feature (18)..(18): n is a, c, g, or t
  misc_feature (786)..(786): n is a, c, g, or t
aaagtacttacagccaanagagcttcctctggggcttgcatattcagtttcctttgtcatgtaatcatttaagactgaactctgcttattgatatgtagtattctattctaggttgagctcaaactggtagctgaaatttaggagacatttttaattcatttagtattaggcatcttttgaccttactaaagtaccagtagtagaaaaatatttttgtgtgatgaaactgaaaacatcagtggtcgtatttaataaaaggtgactagtactgcccatttaaagtaggtgtctaactttgaataaatgtggatagcaatgaataagaaatgaccatgcatggtgttagcagaaaattttaacatgtgttttacctttagaatactaactgggttcagcgtagtatgtaattttccttccttatatccatgaaaaaaaatgtacgagtgctccctttcatttcaaaccttcagtagaggaaggaggaagagtagcatttaaaatgtacattaggactggttaggttgcttttcctagttagcactgatcttagaaagaaggttggtaggcatattccaactgccacagcacccttcctgtttcaaatgtggcaggttattcattttgggtgcagtttgtctcctccaatgattagacgaaagagttttctgaccatcattcaaaaggaatgtgagaagttaatgaatcctagaggaaagcggctgagaaaaggcatctggcatttggttgagagcctcctatgtggtgctagtcaaactacttttacntggaccctgaattcaggacagaaaacactgctccttctcctcgctctcagttgttgggaaagcatggttacattgaatggtcagcgttaagtgagctttgcaatagttgctgtgcttataaagcaactgacaactggcccttgtcctttcctaggtattgttgcagcatctggcagtgagactgaggatgaggacagcatggacattcccttggacctttcttcatccgctggctcaggcaagagaaggagaaggggcaacctacccaaggagtctgtgcagattcttcgggattggctgtatgagcaccgttacaatgcctatccttcagagcaagaaaaagcgttgctgtcccagcaaacacacctgtctacgctacaggtctgtaactggttcatcaacgcccgccgcaggctcctccctgacatgctgagaaaggatggcaaagatccaaatcagttcacaatttcccgccgtggggccaagatttctgaaacgagctctgtggagtccgtgatgggcatcaaaaacttcatgccagctctagaggagaccccatttcattcctgtacagctgggccaaacccaaccctagggaggccactgtctcctaagccgtcatccccgggatcagttttggctcgtccatcagtgatctgccataccactgtgactgcattgaaagatgtccctttctctctctgccagtcggtcggtgtgggacaaaacacagatatacagcagatagcggccaaaaacttcacagacacctctctcatgtacccagaggacacttgtaaatctggaccaagtacgaatacacagagtggtcttttcaacactcctccccctactccaccggacctcaaccaggacttcagtggatttcagcttctagtggatgttgcactcaaacgggctgcagagatggagcttcaggcaaaacttacagcttaacccattttcaagcaaaacagttctcagaaatgtcatgattgccggggtgaaggcaagagatgaattgcattattttatatattttttattaatatttgcacatgggattgctaaaacagcttcctgttactgagatgtcttcaatggaatacagtcattccaagaactataaacttaaagctactgtagaaacaaagggttttcttttttaaatgtttcttggtagattattcataatgtgagatggttcccaatatcatgtgattttttttttcctccccttccctttttttgttattttttcagactgtgcaatacttagagaacctatagcatcttctcattcccatgtggaacaggatgcccacatactgtctaattaataaattttccattttttttcaaacaagtatgaatctagttggttgatgccttttttttcatgacataataaagtattttctttaaaaaaaaattgtaa

SEQ ID NO: 17998 - DNA, 2151 bp, Homo sapiens
  misc_feature (18)..(18): n is a, c, g, or t
  misc_feature (786)..(786): n is a, c, g, or t
aaagtacttacagccaanagagcttcctctggggcttgcatattcagtttcctttgtcatgtaatcatttaagactgaactctgcttattgatatgtagtattctattctaggttgagctcaaactggtagctgaaatttaggagacatttttaattcatttagtattaggcatcttttgaccttactaaagtaccagtagtagaaaaatatttttgtgtgatgaaactgaaaacatcagtggtcgtatttaataaaaggtgactagtactgcccatttaaagtaggtgtctaactttgaataaatgtggatagcaatgaataagaaatgaccatgcatggtgttagcagaaaattttaacatgtgttttacctttagaatactaactgggttcagcgtagtatgtaattttccttccttatatccatgaaaaaaaatgtacgagtgctccctttcatttcaaaccttcagtagaggaaggaggaagagtagcatttaaaatgtacattaggactggttaggttgcttttcctagttagcactgatcttagaaagaaggttggtaggcatattccaactgccacagcacccttcctgtttcaaatgtggcaggttattcattttgggtgcagtttgtctcctccaatgattagacgaaagagttttctgaccatcattcaaaaggaatgtgagaagttaatgaatcctagaggaaagcggctgagaaaaggcatctggcatttggttgagagcctcctatgtggtgctagtcaaactacttttacntggaccctgaattcaggacagaaaacactgctccttctcctcgctctcagttgttgggaaagcatggttacattgaatggtcagcgttaagtgagctttgcaatagttgctgtgcttataaagcaactgacaactggcccttgtcctttcctaggtattgttgcagcatctggcagtgagactgaggatgaggacagcatggacattcccttggacctttcttcatccgctggctcaggcaagagaaggagaaggggcaacctacccaaggagtctgtgcagattcttcgggattggctgtatgagcaccgttacaatgcctatccttcagagcaagaaaaagcgttgctgtcccagcaaacacacctgtctacgctacaggtctgtaactggttcatcaacgcccgccgcaggctcctccctgacatgctgagaaaggatggcaaagatccaaatcagttcacaatttcccgccgtggggccaagatttctgaaacgagctctgtggagtccgtgatgggcatcaaaaacttcatgccagctctagaggagaccccatttcattcctgtacagctgggccaaacccaaccctagggaggccactgtctcctaagccgtcatccccgggatcagttttggctcgtccatcagtgatctgccataccactgtgactgcattgaaagatgtccctttctctctctgccagtcggtcggtgtgggacaaaacacagatatacagcagatagcggccaaaaacttcacagacacctctctcatgtacccagaggacacttgtaaatctggaccaagtacgaatacacagagtggtcttttcaacactcctccccctactccaccggacctcaaccaggacttcagtggatttcagcttctagtggatgttgcactcaaacgggctgcagagatggagcttcaggcaaaacttacagcttaacccattttcaagcaaaacagttctcagaaatgtcatgattgccggggtgaaggcaagagatgaattgcattattttatatattttttattaatatttgcacatgggattgctaaaacagcttcctgttactgagatgtcttcaatggaatacagtcattccaagaactataaacttaaagctactgtagaaacaaagggttttcttttttaaatgtttcttggtagattattcataatgtgagatggttcccaatatcatgtgattttttttttcctccccttccctttttttgttattttttcagactgtgcaatacttagagaacctatagcatcttctcattcccatgtggaacaggatgcccacatactgtctaattaataaattttccattttttttcaaaca

SEQ ID NO: 17999 - DNA, 2169 bp, Homo sapiens
  misc_feature (18)..(18): n is a, c, g, or t
  misc_feature (786)..(786): n is a, c, g, or t
aaagtacttacagccaanagagcttcctctggggcttgcatattcagtttcctttgtcatgtaatcatttaagactgaactctgcttattgatatgtagtattctattctaggttgagctcaaactggtagctgaaatttaggagacatttttaattcatttagtattaggcatcttttgaccttactaaagtaccagtagtagaaaaatatttttgtgtgatgaaactgaaaacatcagtggtcgtatttaataaaaggtgactagtactgcccatttaaagtaggtgtctaactttgaataaatgtggatagcaatgaataagaaatgaccatgcatggtgttagcagaaaattttaacatgtgttttacctttagaatactaactgggttcagcgtagtatgtaattttccttccttatatccatgaaaaaaaatgtacgagtgctccctttcatttcaaaccttcagtagaggaaggaggaagagtagcatttaaaatgtacattaggactggttaggttgcttttcctagttagcactgatcttagaaagaaggttggtaggcatattccaactgccacagcacccttcctgtttcaaatgtggcaggttattcattttgggtgcagtttgtctcctccaatgattagacgaaagagttttctgaccatcattcaaaaggaatgtgagaagttaatgaatcctagaggaaagcggctgagaaaaggcatctggcatttggttgagagcctcctatgtggtgctagtcaaactacttttacntggaccctgaattcaggacagaaaacactgctccttctcctcgctctcagttgttgggaaagcatggttacattgaatggtcagcgttaagtgagctttgcaatagttgctgtgcttataaagcaactgacaactggcccttgtcctttcctaggtattgttgcagcatctggcagtgagactgaggatgaggacagcatggacattcccttggacctttcttcatccgctggctcaggcaagagaaggagaaggggcaacctacccaaggagtctgtgcagattcttcgggattggctgtatgagcaccgttacaatgcctatccttcagagcaagaaaaagcgttgctgtcccagcaaacacacctgtctacgctacaggtctgtaactggttcatcaacgcccgccgcaggctcctccctgacatgctgagaaaggatggcaaagatccaaatcagttcacaatttcccgccgtggggccaagatttctgaaacgagctctgtggagtccgtgatgggcatcaaaaacttcatgccagctctagaggagaccccatttcattcctgtacagctgggccaaacccaaccctagggaggccactgtctcctaagccgtcatccccgggatcagttttggctcgtccatcagtgatctgccataccactgtgactgcattgaaagatgtccctttctctctctgccagtcggtcggtgtgggacaaaacacagatatacagcagatagcggccaaaaacttcacagacacctctctcatgtacccagaggacacttgtaaatctggaccaagtacgaatacacagagtggtcttttcaacactcctccccctactccaccggacctcaaccaggacttcagtggatttcagcttctagtggatgttgcactcaaacgggctgcagagatggagcttcaggcaaaacttacagcttaacccattttcaagcaaaacagttctcagaaatgtcatgattgccggggtgaaggcaagagatgaattgcattattttatatattttttattaatatttgcacatgggattaactataaacttaaagctactgtagaaacaaagggttttcttttttaaatgtttcttggtagattattcataatgtgagatggttcccaatatcatgtgattttttttttcctccccttccctttttttgttattttttcagactgtgcaatacttagagaacctatagcatcttctcattcccatgtggaacaggatgcccacatactgtctaattaataaattttccattttttttcaaacaagtatgaatctagttggttgatgccttttttttcatgacataataaagtattttctttaaaaaaaaattgtaa

SEQ ID NO: 18000 - DNA, 2201 bp, Homo sapiens
  misc_feature (18)..(18): n is a, c, g, or t
  misc_feature (786)..(786): n is a, c, g, or t
aaagtacttacagccaanagagcttcctctggggcttgcatattcagtttcctttgtcatgtaatcatttaagactgaactctgcttattgatatgtagtattctattctaggttgagctcaaactggtagctgaaatttaggagacatttttaattcatttagtattaggcatcttttgaccttactaaagtaccagtagtagaaaaatatttttgtgtgatgaaactgaaaacatcagtggtcgtatttaataaaaggtgactagtactgcccatttaaagtaggtgtctaactttgaataaatgtggatagcaatgaataagaaatgaccatgcatggtgttagcagaaaattttaacatgtgttttacctttagaatactaactgggttcagcgtagtatgtaattttccttccttatatccatgaaaaaaaatgtacgagtgctccctttcatttcaaaccttcagtagaggaaggaggaagagtagcatttaaaatgtacattaggactggttaggttgcttttcctagttagcactgatcttagaaagaaggttggtaggcatattccaactgccacagcacccttcctgtttcaaatgtggcaggttattcattttgggtgcagtttgtctcctccaatgattagacgaaagagttttctgaccatcattcaaaaggaatgtgagaagttaatgaatcctagaggaaagcggctgagaaaaggcatctggcatttggttgagagcctcctatgtggtgctagtcaaactacttttacntggaccctgaattcaggacagaaaacactgctccttctcctcgctctcagttgttgggaaagcatggttacattgaatggtcagcgttaagtgagctttgcaatagttgctgtgcttataaagcaactgacaactggcccttgtcctttcctaggtattgttgcagcatctggcagtgagactgaggatgaggacagcatggacattcccttggacctttcttcatccgctggctcaggcaagagaaggagaaggggcaacctacccaaggagtctgtgcagattcttcgggattggctgtatgagcaccgttacaatgcctatccttcagagcaagaaaaagcgttgctgtcccagcaaacacacctgtctacgctacaggtctgtaactggttcatcaacgcccgccgcaggctcctccctgacatgctgagaaaggatggcaaagatccaaatcagttcacaatttcccgccgtggggccaagatttctgaaacgagctctgtggagtccgtgatgggcatcaaaaacttcatgccagctctagaggagaccccatttcattcctgtacagctgggccaaacccaaccctagggaggccactgtctcctaagccgtcatccccgggatcagttttggctcgtccatcagtgatctgccataccactgtgactgcattgaaagatgtccctttctctctctgccagtcggtcggtgtgggacaaaacacagatatacagcagatagcggccaaaaacttcacagacacctctctcatgtacccagaggacacttgtaaatctggaccaagtacgaatacacagagtggtcttttcaacactcctccccctactccaccggacctcaaccaggacttcagtggatttcagcttctagtggatgttgcactcaaacgggctgcagagatggagcttcaggcaaaacttacagcttaacccattttcaagcaaaacagttctcagaaatgtcatgattgccggggtgaaggcaagagatgaattgcattattttatatattttttattaatatttgcacatgggattgctaaaacagcttcctgttactgagatgtcttcaatggaatacagtcattccaagaactataaacttaaagctactgtagaaacaaagggttttcttttttaaatgtttcttggtagcccaatatcatgtgattttttttttcctccccttccctttttttgttattttttcagactgtgcaatacttagagaacctatagcatcttctcattcccatgtggaacaggatgcccacatactgtctaattaataaattttccattttttttcaaacaagtatgaatctagttggttgatgccttttttttcatgacataataaagtattttctttaaaaaaaaattgtaa

SEQ ID NO: 18001 - DNA, 131 bp, Homo sapiens
tgcagagctagcttggcactttgcaccaagaatctcaagtgctctttctgaccttacccccattttttcctctgccaaggtagcatctctaccccaaaactgttttgaggatccagaattcttttcttttt

SEQ ID NO: 18002 - DNA, 453 bp, Homo sapiens
ttgaatctttttctttcttcttgctacagttgtctcaggctttgaaccattgctgagggagatttccttttaagtttgaagagcttgtaagcatccgaggagacaacttctgggtcacttagtggctgagcaaggcctattcctagactctgattgttgacttggggcttctaaccttgtgttggggccggttttgggagcacagaggtggggttagataggctgcaggagccaccagcctgcctgcgctcgctctggcaggatgactgatgccaggaggatgggaatgaggactagtgaccttcctctctctgttccctttttctcccttgggggaaaaactagtatagtaaaagctcagcactcgttttgaatataggtgtaatttgctgcgttaacagtttcagtttattgtgtgttttggtggcgttattcctgaaagcttcttaaaat

SEQ ID NO: 18003 - DNA, 859 bp, Homo sapiens
gcggcacgagcggcacgagcggcacgagggagtctgagtagggcggccccggtgactgagatggcatcatctctaaagatctggggcacactcttggccctactttgcatcctatgcacactgcttgtacagagcaaagaagtttcttggagagaattcatgaaacagcactacttaagtccaagtcgagaattcagagagtacaaatgtgatgtcctcatgagagaaaatgaagctctgaaagacaagagctctcacatgtttatctatatctcatggtacaaaatcgagcatatatgcactagtgacaactggatggatcgcttccgaaatgcatatgtatgggtccagaatcctctcaaagtactcaagtgtcaccaggagaattccaaaaatagctacacagagagcaggagcttcaactacattgaattccattgtagcatggacgggtatgttgatagcatagaagacctaaagatggtagaacctatcggcaactagaaagtctatgcacatcctcaggtattggtagagtattcagtgctctctaagtagcagcccctgcctccatcaatagtcctaccactcccctcttgcatttatttgtcaatgttttccaaatacttagagttatgaatagcataatttcttgataccataactttgcctgtgttgtttctctgcctggaatacacttttgtcttcatttacctaatttactcttatacttttgtcgacattcagctcatatggcatctgttcttgattaacccaagactttcctgatattgactctcttgatacatacccaagctgaacaatcttcccttccctaaataaattatatgactgcaaa

SEQ ID NO: 18004 - DNA, 348 bp, Homo sapiens
atactgtgagtaatatatttgtgtgcaaggagtcattgccaaactcaagatcatctagattttatcctatgttatctagtaggagttttatagctttgcattttatgtttatgtctgtgatccattctgagttcatttttgtgaagggtgtcaggtctgtgtctagcttcgttttctgatgtgatgtccagttgtcccagcaccatttgttgaaaagacttatctttgcataattgttttgccctttctcctttgtcaaaggtcagttgactgtatttatgtgggtctatttctgggttgtctattctgttccctggatctatttgtctgttcttttgatagtactac

SEQ ID NO: 18005 - DNA, 1195 bp, Homo sapiens
aggattagagtgattgttctgagtatatcatttcttagtatttcatgaaagccatgtacagtacagcttttattcatacagagataaaatgaatgaaataaactttgggtttttttttgttttatttgaatattagtcttgtatacactttatattaaagtgcatttgtagggaataattcacttatttaatattttatgagcatctacaatatgcatagtccctgctttcagggagtttacacttctggggcatgagggtggagacagatgagtctacaaataactatgccattataattaagttttaatgaaatactaaaatgggaaattggaggattttgactatggagtttgaggtagacttcgtgttctttcattctgaaaatcaagggaaggtcattttagacaaaggaaaagtattgagccaagacaaatatctggattgcatgatataatagagactgggttggctctgaagtcagactacctaagctgaatctggctcctcctattacctgccatgtgaccttgggcaaacagtctgttgttagtttttttatctataaattgaagataatattttctttgcctcataggaaaactgcacatgtaagagaaaatgaaatgtcataaaccgagtgtacctgtgtaacttgcacttaaattaaaaacaaaaacagaacattatcagtatcccaggaggtttttacattctccattgtgttgtttcgaggattcactattatttgtaaggtggacctggcagtgactcacacctgtaaccctagcactttggtaggcctaggctggaggattttaatcccaggattttgagactagcgtgaacagcaaagtgagactctgtattattaataaaatgaagaaaagaaaacattatttgtgaagtgttcagaacagtatctggcatatattatatctctatcaatgttagccattattcagtaggtggctggtgaatatggatgaaactagagaaagtacagtgcctggcatatatcaagcattcagtagacatgttttaaattatttatagaaaaataaagaatacaactatggggccaggcacggtggtcacgcctgtgttaccagcactttgggaggctgaggcgggcagatcacaaggtcaggagatcgagaccatcctggctaacacggtgaaaccacgtgtctac

SEQ ID NO: 18006 - DNA, 381 bp, Homo sapiens
agagcagcctgagctgagtccttatttcttcacttttgtaaaacaatgataagtgttcatgagacaattggcatccctgacccctccccttgtgtgtggaacgcaggtcctctcccagcctgacttactgggttacgtttgctctctgggctgggttgtgttcacctcagaggtcttggtgaaaatgacctctttggtctcctgaagcctcatttcgttattttggctctgtgggtggtatctttcatgcgtcagtcgagcatgctgtttaaatcaagagttgtcactgattctcccattccctcatcccaaattcctggtgacctgtggctgaagcactagccaggattttagaatgaataaacctctttatatttgcaa

SEQ ID NO: 18007 - DNA, 254 bp, Homo sapiens
gattgcctggtcaatgagcccgccgtgtttattgagcatctactatgtgctgagtgctggggtccatgggaagctgagtgctggcggaatgggaaggcaactacaaatgataaacagcagcagacgttgcaggctgggtgggccagccccgtgtggggcctgatgaacaggtttttttccctgacgatcggctttgcaggctttgtgggctttgtggggaaggagccctttgtgcagaactggtagccatgagg

SEQ ID NO: 18008 - DNA, 437 bp, Homo sapiens
aaaccattttaactgatgtggtttaataattgctctaccatatatatttgtaagcagcattctctgctttgcccttaatctttgaggtcagcattgcctcctggatcagagcggttccttgtgacttgcctggggtcacctggctggtgaaggaagcccccctttctgtttaccaccatctctagtgcccccctcacacagcagcctccagagtttgcaccctgacttggagtcgctgctggtgccctgattgagttgagctgtgtcctttaacaatggggtcacttcaggtgagcatagaagtgatgtgtcccttatctccaaggcttccgtggagtgccctggggggtgtgggtcatgtttacagagcgtggaggccacggccaggcagcatctttagctggacaggaaaatgagaagtgacagcatttagaggg

SEQ ID NO: 18009 - DNA, 324 bp, Homo sapiens
tgcccggctaatttttgtatttttagtagagatggggtttcaccttattggccaggctggtcttgaacttctgaccttgtgatctgcccacctcggcctcccaaagtgctgggattataggcgtgagcgaccgtgcccagcctagactgtgttattttgttcacccatgtatacctttattcactccctcctgccccaaatgttattgaacatcgactaagccaggcactctgcaaactgtatcaatctaactgaggctccatccccaacctggagagcttgtaagctaagcactattaaaggagttcctgtatgaaccaaatc

SEQ ID NO: 18010 - DNA, 301 bp, Homo sapiens
aagagatctgattaatactctatattgccattcccttccccttttttttgagttctggagtcagtgtgtggtaatgttcaaccacccatcttaaaccatgaagtaaattggaaggtggagaccacatactgatggcactacagcagtatcatactagcctgatactgcccatttatggagataacactacttgggaggctgaggcatgagaatcgcttgaacctgggaggtagaagttgcagtgagcctagatcatgtcactgcactccagcctggatgggtgacagcgagactccatctc

SEQ ID NO: 18011 - DNA, 214 bp, Homo sapiens
atgtattttgactggggaaaattttcccttttattctggggagctgttactcagcataagagaatgtagaggagaatcacccctttcacatatctaatagctttaccacattactacagtagtatcttatgttgtatgcattgattgtcaatctcttctcctcatctccaccattttgatagcttaaggcttatcattcattctctgtgcatag

SEQ ID NO: 18012 - DNA, 1042 bp, Homo sapiens
agtaaaatcctacccctctctgttgtctccatgatacttggtgatctctggataatgtctgtgtgtttctgcaggcaaaaacaacaacaacaaataagccacattgcagaatagagaatagatcctgtttctgttatggattgagaagggtattttatatcatcctgttaatgatacttaaccaaatgcttttaacatttctagttgattgtagatattcaacaaacattgcagtgttggggaatgaccaacttccctggttgaaacccagtaatagccgttgccagagcattaaattaaaaatattaatttaccccaatctagaaatagttttatgctttttttaaataatagtccccgcacaaacaaacatacagacagcactggagagggccttataaaatgagcttctagccaggcacagtggcccacacctgtgatcccagcactttgggaggacgaggtgggcggatcacttgagctcaggagtttgagaccggcctgggcaacatggcaaaaccccatctctacaaaaaaatagccgggcgtcatggctcttgcctgtactcccagctactggggaggcattgaagcgggagaatcacttgagtgcagggggttgaggctgcagtgagccgtgatcacaccactgcacttcagcctgggcaacagagtgagtccctgtctcaaaaaataaaatgagctccttaccaactatataaatatacaggtcacctttgtatgccttttaaaatatcaccttcctcagaaatcaattgtaaaatgaggtcatttggtggtgtggatagggcagtgacttcctgctttatttacaatcaacaggagggacagctaggctaattcaaattccattaacaatccatcttccccttggtgatatttccctagctgggttcctcagcatgttatttaacatgatgaagttccatacagtcatgtttatttgcttcagggaagaatgatggtcaccattagtaaccccatctaaaaaccgaactaagagtcccagttttttacctta

SEQ ID NO: 18013 - DNA, 469 bp, Homo sapiens
gccacctccctgtatggtttccgcagcccactgcattacccctgactgttggacagtccttccttgtattgagctgaaatccaattccagttccaatcacactgtttctccagggtgcacataaatatatggtgaaatgtattatttagtttcaattctaaatatcctttatttgtcattgtttctcgaattgtatttattctgttcccttttctcttgacttgctcaagtacttcagcatttcatttggactaaaaaactcaacacaattctgtctgctttcttatagtatgatattttcatttttaggaagtgacacattatcaaaacccataagaactaaatttttttaagagggggaaaaagacaaggtcaggaggctgaggtgggaggatcgcttgagcccaggagttcgagaccagcctgggcaacagagtgagaccctgtctctacaaacaccaccaccacc

SEQ ID NO: 18014 - DNA, 798 bp, Homo sapiens
caccattcactcttcagcctactacagtctgtctttggtaccaaaactgttcttgtaaacaccttgtttatcaaacacctccatttgcaacatccagtggctagttctgtcttacttatcagctgcattagatatagctgaccatccctattttaaaacacttcttagcttcagtgataactaaactctatttcccttctcttcactggcagccctgtctcagatttccttactggcgtttcctactctgtctgtccatagaatatttgtgcactcctggattcagtccttagtcctgttctctcttctgctgtgtctcctcctcccccccattttatctcctctagtcctgttaccctaaatgtcatatcatatccagtgactctgaaatccttatctcgaccttttccttgagttctagaattacatagccacctgcccactcagtagccccccaagatatctaatagacactcccaagctcgggctgcgcagcatctgctgctttctctgcccaaaatgttatttccccagttcatcaagtcacgggcaccgcatcatccttaagatcttcgctcaagtatcactttctctgagggctctcctgatgtcccccgctgcccccagagtaggttcgtgccccatgtcactttatttccttcccagaacttgccagaaatagttttatgtgttgacttgattactgcctgttctccacattgactgctataagccctgtgagagtggggccttgcttatcttgttctttgctgtattctaagttcccagaacagtgcc

SEQ ID NO: 18015 - DNA, 355 bp, Homo sapiens
tttctgagtcccgtgatgattaatatttgatgaattatattttgaatagcctccacatgcatttttctcttttgttcacttcctcaccattttgcttcactttttttttaactgcttcctttgtgtctttcccattcctttacctttgttttctccttgacttcctattgttggccattgtgggcattgtttagcattttcagtggaaagaatcaggggaaagaaaatactaaatcttagtatagttaatatttgatattatcaacgagaagtaagaaatgttttgaaaaacacaaatcagtagttttatataacttaataaattgaacagatgatcattttttgtaaaaaaaaa

SEQ ID NO: 18016 - DNA, 375 bp, Homo sapiens
cgagctcggtacccaatcagtttacacaaataaagaatgattccagcttcctcagtacacttcatgaagtctacttgcaggttctgaccaagaacaaagacaaccacaacctatgactggagcagaataagtctaaaggcagagccccagcctcagagacaaataggcttcatcatggaaacttctgagcagaacattgagtttgagaatcctgaaattgagcctatgagaaagagactcatttcttaagaatgttttccaagtgacattctcagtgataatggaggtttcactgtgaagcatcaccagcagatccttgttttgacagatgatagaagaaagaaaatcccgggtgtcttttattgcttcatcggg

SEQ ID NO: 18017 - DNA, 720 bp, Homo sapiens
  misc_feature (676)..(677): n is a, c, g, or t
taacgtaaggacaagatgagttgtagatcaggacgagggatggaggcgctgagtcgagctgggcaggagatgagcctagcggccctgaagcaacacgacccctatatcaccagcatcgcagacctcacgggccaggtcgctctgtacaccttctgccccaaggccaaccagtgggagaagactgatatagaagggaccttattcgtatatcgaaggtcagcttccccttaccatggttttaccattgtgaatcgactaaatatgcacaatctagttgaaccagtgaataaagatttggaatttcagctccatgaaccatttcttctgtatagaaatgcaagcttgtcgatatatagtatctggttttatgacaagaatgactgtcaccgcatagcaaaactcatggctgatgtggtagaagaggagacacggcgatcccagcaagctgctcgggacaaacagagtcccagccaggccaatggctgcagcgaccacaggcccatcgacatcctggagatgctgagcagagccaaggatgagtatgagaggaatcagatgggtgactcaaatatctccagccctgggttacagccaagcactcagctctccaatctgggaagcaccgagactctagaagaaatgccctccgggtcacaggataagtctgctcatctgnncacaagcatctggcggtaaagcttgggatcctctggaatcagc

SEQ ID NO: 18018 - DNA, 828 bp, Homo sapiens
ggggactgacgcagatgggggaattttgcctcgatggcactttcctgtccgcgactccgcccccaccagaggggctaggctctgggattcaagatggaggcgctgagtcgagctgggcaggagatgagcctagcggccctgaagcaacacgacccctatatcaccagcatcgcagacctcacgggccaggtcgctctgtacaccttctgccccaaggccaaccagtgggagaagactgatatagaagggaccttattcgtatatcgaaggtcagcttccccttaccatggttttaccattgtgaatcgactaaatatgcacaatctagttgaaccagtgaataaagatttggaatttcagctccatgaaccatttcttctgtatagaaatgcaagctgttgagaaaacaagaggctcagagctgtttaggaatctgctcgagattcgcaaagtgtcgatatatagtatctggttttatgacaagaatgactgtcaccgcatagcaaaactcatggctgatgtggtagaagaggagacacggcgatcccagcaagctgctcgggacaaacagagtcccagccaggccaatggctgcagcgaccacaggcccatcgacatcctggagatgctgagcagagccaaggatgagtatgagaggaatcagatgggtgactcaaatatctccagccctgggttacagccaagcactcagctctccaatctgggaagcaccgagactctagaagaaatgccctccgggtcacaggataagtctgctccatctgaaccagcttgcggagaaaggattgggaccttggcagggaccgc

SEQ ID NO: 18019 - DNA, 2180 bp, Homo sapiens
ggggactgacgcagatgggggaattttgcctcgatggcactttcctgtccgcgactccgcccccaccagaggggctaggctctgggattcaagatggaggcgctgagtcgagctgggcaggagatgagcctagcggccctgaagcaacacgacccctatatcaccagcatcgcagacctcacgggccaggtcgctctgtacaccttctgccccaaggccaaccagtgggagaagactgatatagaagggaccttattcgtatatcgaaggtcagcttccccttaccatggttttaccattgtgaatcgactaaatatgcacaatctagttgaaccagtgaataaagatttggaatttcagctccatgaaccatttcttctgtatagaaatgcaagcttgtcgatatatagtatctggttttatgacaagaatgactgtcaccgcatagcaaaactcatggctgatgtggtagaagaggagacacggcgatcccagcaagctgctcgggacaaacagagtcccagccaggccaatggctgcagcgaccacaggcccatcgacatcctggagatgctgagcagagccaaggatgagtatgagaggaatcagatgggtgactcaaatatctccagccctgggttacagccaagcactcagctctccaatctgggaagcaccgagactctagaagaaatgccctccgggtcacaggataagtctgctccatctggacacaagcatctgacggtagaagagttatttggaacctctttgccaaaggaacaaccagcagttgtgggtctggattcagaagaaatggagaggttgccaggagatgcctcccagaaagagcccaattcattcctaccatttccctttgagcagttaggaggagcccctcaatcagaaaccctgggtgtcccttctgctgcccaccattcagtccagcctgaaatcaccaccccggtgctaatcactccagcctccatcacacagtccaatgaaaagcatgctccaacctacacaatcccgttgagccctgttctcagtcccactctgccagctgaagctcctactgcacaggttccccccagcttacctcgaaacagcaccatgatgcaggcagtgaagaccacgcctagacagaggtctccactcctgaaccagccagtccctgagctaagccatgccagtctgattgccaaccagagccccttcagggccccattgaacgtgacgaacacagctggcacatccctcccaagcgttgatcttctccagaaactcaggttgaccccacagcatgaccaaatacagacacaaccacttgggaaaggtgcaatggtagccagcttttctccggcagctggtcagctagccacacctgagagcttcatagagcctccctctaagacagcagcagcaagagtggcggcctcagcctccctgagcaacatggtgcttgctccccttcagtctatgcagcagaaccaggatcctgaagtatttgtgcagcctaaggtgttatccagtgccatcccggttgcaggcgccccactggttactgcaacgaccactgcagtgtcttcagtcctgctggccccaagtgttttccagcagacagttacaagatcttcggaccttgagaggaaagccagctccccttctcctctaactattggaacgccagaaagtcagagaaagccttccattattctcagcaagtctcagctccaggatacattaatacatctaataaagaatgattccagcttcctcagtacacttcatgaagtctacttgcaggttctgaccaagaacaaagacaaccacaacctatgactggagcagaataagtctaaaggcagagccccagcctcagagacaaataggcttcatcatggaaacttctgagcagaacattgagtttgagaatcctgaaattgagcctatgagaaagagactcatttcttaagaatgttttccaagtgacattctcagtgataatggaggtttcactgtgaagcatcaccagcagatccttgttttgacaaaaaaaaaaaaaaaaaaaaaaagggttttttttgggggggggggggggggaaaaaattgggttaggcattttttaaagcggttttccttttaaggtcaaaaaaagggcttcctttttttccaaaaaa

SEQ ID NO: 18020 - DNA, 2066 bp, Homo sapiens
ggggactgacgcagatgggggaattttgcctcgatggcactttcctgtccgcgactccgcccccaccagaggggctaggctctgggattcaagatggaggcgctgagtcgagctgggcaggagatgagcctagcggccctgaagcaacacgacccctatatcaccagcatcgcagacctcacgggccaggtcgctctgtacaccttctgccccaaggccaaccagtgggagaagactgatatagaagggaccttattcgtatatcgaaggtcagcttccccttaccatggttttaccattgtgaatcgactaaatatgcacaatctagttgaaccagtgaataaagatttggaatttcagctccatgaaccatttcttctgtatagaaatgcaagcttgtcgatatatagtatctggttttatgacaagaatgactgtcaccgcatagcaaaactcatggctgatgtggtagaagaggagacacggcgatcccagcaagctgctcgggacaaacagagtcccagccaggccaatggctgcagcgaccacaggcccatcgacatcctggagatgctgagcagagccaaggatgagtatgagaggtctgctccatctggacacaagcatctgacggtagaagagttatttggaacctctttgccaaaggaacaaccagcagttgtgggtctggattcagaagaaatggagaggttgccaggagatgcctcccagaaagagcccaattcattcctaccatttccctttgagcagttaggaggagcccctcaatcagaaaccctgggtgtcccttctgctgcccaccattcagtccagcctgaaatcaccaccccggtgctaatcactccagcctccatcacacagtccaatgaaaagcatgctccaacctacacaatcccgttgagccctgttctcagtcccactctgccagctgaagctcctactgcacaggttccccccagcttacctcgaaacagcaccatgatgcaggcagtgaagaccacgcctagacagaggtctccactcctgaaccagccagtccctgagctaagccatgccagtctgattgccaaccagagccccttcagggccccattgaacgtgacgaacacagctggcacatccctcccaagcgttgatcttctccagaaactcaggttgaccccacagcatgaccaaatacagacacaaccacttgggaaaggtgcaatggtagccagcttttctccggcagctggtcagctagccacacctgagagcttcatagagcctccctctaagacagcagcagcaagagtggcggcctcagcctccctgagcaacatggtgcttgctccccttcagtctatgcagcagaaccaggatcctgaagtatttgtgcagcctaaggtgttatccagtgccatcccggttgcaggcgccccactggttactgcaacgaccactgcagtgtcttcagtcctgctggccccaagtgttttccagcagacagttacaagatcttcggaccttgagaggaaagccagctccccttctcctctaactattggaacgccagaaagtcagagaaagccttccattattctcagcaagtctcagctccaggatacattaatacatctaataaagaatgattccagcttcctcagtacacttcatgaagtctacttgcaggttctgaccaagaacaaagacaaccacaacctatgactggagcagaataagtctaaaggcagagccccagcctcagagacaaataggcttcatcatggaaacttctgagcagaacattgagtttgagaatcctgaaattgagcctatgagaaagagactcatttcttaagaatgttttccaagtgacattctcagtgataatggaggtttcactgtgaagcatcaccagcagatccttgttttgacaaaaaaaaaaaaaaaaaaaaaaagggttttttttgggggggggggggggggaaaaaattgggttaggcattttttaaagcggttttccttttaaggtcaaaaaaagggcttcctttttttccaaaaaa

SEQ ID NO: 18021 - DNA, 2141 bp, Homo sapiens
ggggactgacgcagatgggggaattttgcctcgatggcactttcctgtccgcgactccgcccccaccagaggggctaggctctgggattcaagatggaggcgctgagtcgagctgggcaggagatgagcctagcggccctgaagcaacacgacccctatatcaccagcatcgcagacctcacgggccaggagaagactgatatagaagggaccttattcgtatatcgaaggtcagcttccccttaccatggttttaccattgtgaatcgactaaatatgcacaatctagttgaaccagtgaataaagatttggaatttcagctccatgaaccatttcttctgtatagaaatgcaagcttgtcgatatatagtatctggttttatgacaagaatgactgtcaccgcatagcaaaactcatggctgatgtggtagaagaggagacacggcgatcccagcaagctgctcgggacaaacagagtcccagccaggccaatggctgcagcgaccacaggcccatcgacatcctggagatgctgagcagagccaaggatgagtatgagaggaatcagatgggtgactcaaatatctccagccctgggttacagccaagcactcagctctccaatctgggaagcaccgagactctagaagaaatgccctccgggtcacaggataagtctgctccatctggacacaagcatctgacggtagaagagttatttggaacctctttgccaaaggaacaaccagcagttgtgggtctggattcagaagaaatggagaggttgccaggagatgcctcccagaaagagcccaattcattcctaccatttccctttgagcagttaggaggagcccctcaatcagaaaccctgggtgtcccttctgctgcccaccattcagtccagcctgaaatcaccaccccggtgctaatcactccagcctccatcacacagtccaatgaaaagcatgctccaacctacacaatcccgttgagccctgttctcagtcccactctgccagctgaagctcctactgcacaggttccccccagcttacctcgaaacagcaccatgatgcaggcagtgaagaccacgcctagacagaggtctccactcctgaaccagccagtccctgagctaagccatgccagtctgattgccaaccagagccccttcagggccccattgaacgtgacgaacacagctggcacatccctcccaagcgttgatcttctccagaaactcaggttgaccccacagcatgaccaaatacagacacaaccacttgggaaaggtgcaatggtagccagcttttctccggcagctggtcagctagccacacctgagagcttcatagagcctccctctaagacagcagcagcaagagtggcggcctcagcctccctgagcaacatggtgcttgctccccttcagtctatgcagcagaaccaggatcctgaagtatttgtgcagcctaaggtgttatccagtgccatcccggttgcaggcgccccactggttactgcaacgaccactgcagtgtcttcagtcctgctggccccaagtgttttccagcagacagttacaagatcttcggaccttgagaggaaagccagctccccttctcctctaactattggaacgccagaaagtcagagaaagccttccattattctcagcaagtctcagctccaggatacattaatacatctaataaagaatgattccagcttcctcagtacacttcatgaagtctacttgcaggttctgaccaagaacaaagacaaccacaacctatgactggagcagaataagtctaaaggcagagccccagcctcagagacaaataggcttcatcatggaaacttctgagcagaacattgagtttgagaatcctgaaattgagcctatgagaaagagactcatttcttaagaatgttttccaagtgacattctcagtgataatggaggtttcactgtgaagcatcaccagcagatccttgttttgacaaaaaaaaaaaaaaaaaaaaaaagggttttttttgggggggggggggggggaaaaaattgggttaggcattttttaaagcggttttccttttaaggtcaaaaaaagggcttcctttttttccaaaaaa

SEQ ID NO: 18022 - DNA, 1998 bp, Homo sapiens
taacgtaaggacaagatgagttgtagatcaggacgagggatggaggcgctgagtcgagctgggcaggagatgagcctagcggccctgaagcaacacgacccctatatcaccagcatcgcagacctcacgggccaggtcgctctgtacaccttctgccccaaggccaaccagtgggagaagactgatatagaagggaccttattcgtatatcgaagtgtcgatatatagtatctggttttatgacaagaatgactgtcaccgcatagcaaaactcatggctgatgtggtagaagaggagacacggcgatcccagcaagctgctcgggacaaacagagtcccagccaggccaatggctgcagcgaccacaggcccatcgacatcctggagatgctgagcagagccaaggatgagtatgagaggaatcagatgggtgactcaaatatctccagccctgggttacagccaagcactcagctctccaatctgggaagcaccgagactctagaagaaatgccctccgggtcacaggataagtctgctccatctggacacaagcatctgacggtagaagagttatttggaacctctttgccaaaggaacaaccagcagttgtgggtctggattcagaagaaatggagaggttgccaggagatgcctcccagaaagagcccaattcattcctaccatttccctttgagcagttaggaggagcccctcaatcagaaaccctgggtgtcccttctgctgcccaccattcagtccagcctgaaatcaccaccccggtgctaatcactccagcctccatcacacagtccaatgaaaagcatgctccaacctacacaatcccgttgagccctgttctcagtcccactctgccagctgaagctcctactgcacaggttccccccagcttacctcgaaacagcaccatgatgcaggcagtgaagaccacgcctagacagaggtctccactcctgaaccagccagtccctgagctaagccatgccagtctgattgccaaccagagccccttcagggccccattgaacgtgacgaacacagctggcacatccctcccaagcgttgatcttctccagaaactcaggttgaccccacagcatgaccaaatacagacacaaccacttgggaaaggtgcaatggtagccagcttttctccggcagctggtcagctagccacacctgagagcttcatagagcctccctctaagacagcagcagcaagagtggcggcctcagcctccctgagcaacatggtgcttgctccccttcagtctatgcagcagaaccaggatcctgaagtatttgtgcagcctaaggtgttatccagtgccatcccggttgcaggcgccccactggttactgcaacgaccactgcagtgtcttcagtcctgctggccccaagtgttttccagcagacagttacaagatcttcggaccttgagaggaaagccagctccccttctcctctaactattggaacgccagaaagtcagagaaagccttccattattctcagcaagtctcagctccaggatacattaatacatctaataaagaatgattccagcttcctcagtacacttcatgaagtctacttgcaggttctgaccaagaacaaagacaaccacaacctatgactggagcagaataagtctaaaggcagagccccagcctcagagacaaataggcttcatcatggaaacttctgagcagaacattgagtttgagaatcctgaaattgagcctatgagaaagagactcatttcttaagaatgttttccaagtgacattctcagtgataatggaggtttcactgtgaagcatcaccagcagatccttgttttgacaaaaaaaaaaaaaaaaaaaaaaagggttttttttgggggggggggggggggaaaaaattgggttaggcattttttaaagcggttttccttttaaggtcaaaaaaagggcttcctttttttccaaaaaa

SEQ ID NO: 18023 - DNA, 1884 bp, Homo sapiens
taacgtaaggacaagatgagttgtagatcaggacgagggatggaggcgctgagtcgagctgggcaggagatgagcctagcggccctgaagcaacacgacccctatatcaccagcatcgcagacctcacgggccaggtcgctctgtacaccttctgccccaaggccaaccagtgggagaagactgatatagaagggaccttattcgtatatcgaagtgtcgatatatagtatctggttttatgacaagaatgactgtcaccgcatagcaaaactcatggctgatgtggtagaagaggagacacggcgatcccagcaagctgctcgggacaaacagagtcccagccaggccaatggctgcagcgaccacaggcccatcgacatcctggagatgctgagcagagccaaggatgagtatgagaggtctgctccatctggacacaagcatctgacggtagaagagttatttggaacctctttgccaaaggaacaaccagcagttgtgggtctggattcagaagaaatggagaggttgccaggagatgcctcccagaaagagcccaattcattcctaccatttccctttgagcagttaggaggagcccctcaatcagaaaccctgggtgtcccttctgctgcccaccattcagtccagcctgaaatcaccaccccggtgctaatcactccagcctccatcacacagtccaatgaaaagcatgctccaacctacacaatcccgttgagccctgttctcagtcccactctgccagctgaagctcctactgcacaggttccccccagcttacctcgaaacagcaccatgatgcaggcagtgaagaccacgcctagacagaggtctccactcctgaaccagccagtccctgagctaagccatgccagtctgattgccaaccagagccccttcagggccccattgaacgtgacgaacacagctggcacatccctcccaagcgttgatcttctccagaaactcaggttgaccccacagcatgaccaaatacagacacaaccacttgggaaaggtgcaatggtagccagcttttctccggcagctggtcagctagccacacctgagagcttcatagagcctccctctaagacagcagcagcaagagtggcggcctcagcctccctgagcaacatggtgcttgctccccttcagtctatgcagcagaaccaggatcctgaagtatttgtgcagcctaaggtgttatccagtgccatcccggttgcaggcgccccactggttactgcaacgaccactgcagtgtcttcagtcctgctggccccaagtgttttccagcagacagttacaagatcttcggaccttgagaggaaagccagctccccttctcctctaactattggaacgccagaaagtcagagaaagccttccattattctcagcaagtctcagctccaggatacattaatacatctaataaagaatgattccagcttcctcagtacacttcatgaagtctacttgcaggttctgaccaagaacaaagacaaccacaacctatgactggagcagaataagtctaaaggcagagccccagcctcagagacaaataggcttcatcatggaaacttctgagcagaacattgagtttgagaatcctgaaattgagcctatgagaaagagactcatttcttaagaatgttttccaagtgacattctcagtgataatggaggtttcactgtgaagcatcaccagcagatccttgttttgacaaaaaaaaaaaaaaaaaaaaaaagggttttttttgggggggggggggggggaaaaaattgggttaggcattttttaaagcggttttccttttaaggtcaaaaaaagggcttcctttttttccaaaaaa

SEQ ID NO: 18024 - DNA, 774 bp, Homo sapiens
  misc_feature (730)..(731): n is a, c, g, or t
ggggactgacgcagatgggggaattttgcctcgatggcactttcctgtccgcgactccgcccccaccagaggggctaggctctgggattcaagatggaggcgctgagtcgagctgggcaggagatgagcctagcggccctgaagcaacacgacccctatatcaccagcatcgcagacctcacgggccaggtcgctctgtacaccttctgccccaaggccaaccagtgggagaagactgatatagaagggaccttattcgtatatcgaaggtcagcttccccttaccatggttttaccattgtgaatcgactaaatatgcacaatctagttgaaccagtgaataaagatttggaatttcagctccatgaaccatttcttctgtatagaaatgcaagcttgtcgatatatagtatctggttttatgacaagaatgactgtcaccgcatagcaaaactcatggctgatgtggtagaagaggagacacggcgatcccagcaagctgctcgggacaaacagagtcccagccaggccaatggctgcagcgaccacaggcccatcgacatcctggagatgctgagcagagccaaggatgagtatgagaggaatcagatgggtgactcaaatatctccagccctgggttacagccaagcactcagctctccaatctgggaagcaccgagactctagaagaaatgccctccgggtcacaggataagtctgctcatctgnncacaagcatctggcggtaaagcttgggatcctctggaatcagc

SEQ ID NO: 18025 - DNA, 454 bp, Homo sapiens
cgagctcggtacccaatcagtttacacaaataaagaatgattccagcttcctcagtacacttcatgaagtctacttgcaggttctgaccaagaacaaagacaaccacaacctatgactggagcagaataagtctaaaggcagagccccagcctcagagacaaataggcttcatcatggaaacttctgagcagaacattgagtttgagaatcctgaaattgagcctatgagaaagagactcatttcttaagaatgttttccaagtgacattctcagtgataatggaggtttcactgtgaagcatcaccagcagatccttgttttgacaaaaaaaaaaaaaaaaaaaaaaagggttttttttgggggggggggggggggaaaaaattgggttaggcattttttaaagcggttttccttttaaggtcaaaaaaagggcttcctttttttccaaaaaa

SEQ ID NO: 18026 - DNA, 389 bp, Homo sapiens
gttactgcaacgaccactgcagtgtcttcagtcctgctggccccaagtgttttccagcagacagttacaagatcttcggaccttgagaggaaagccagctccccttctcctctaactattggaacgccagaaagtcagagaaagccttccattattctcagcaagtctcagctccaggatacattaatacatctaataaaggtatgtaggataccaattttatctttgatttttcattatttaatgaaagaaattttataaattcctcttacagaatcagttcataaagtaaattcaaaagactagctggaggccaggcaaagtggctcacacctgtaatcccagcactatgggaggccaaggcaggcaaaaaaaaaacaaaaacagac

SEQ ID NO: 18027 - DNA, 351 bp, Homo sapiens
ttttcccccaactaattttataccctgctcctgggcagtactaatttaagccattacccacgctccacaccacccaccatattctttgtctataggatttccaaaatttaacgccttccctcctattcctccgaccaactgcaattttcactgcccctacacccgtaggttccacagttgggaattaaccttttttctgaactccataaatcacaagtgcccaagaacaatctgatcgagatgggctccttagtagcccagagatgcaaattttcagcgcccggagatgcatgttttctaagtttttgtttgcctcgttcgacttaaaaattcgtttctgacacctaagcc

SEQ ID NO: 18028 - DNA, 325 bp, Homo sapiens
gctttacctgcctttggtagggatctcttcttcgtttctttttcagctgtttcagaatcttcaatggcagcacactggataaagcctttcaaggacatctttctagctttaatctcccttagagagaacctttacccagcagattggtctgttctctgtccctgggacagatcatgtgctttcccacctactactctctgataagaaattgcccactcgtctctcaagctatccagatactccctacacttcaaggagcagcttaaattctagtttcttttttttccctacattttcaaataaactttattgatttctccatctc

SEQ ID NO: 18029 - DNA, 571 bp, Homo sapiens
aagcagacccactaggaaagaggacgagacacaaggttaactgccccctcacctccgcgccactatttagaagcccaggaggtgcctcatccctgaagtcaacaggcttgacccccctagtctagaatgcctccacagtgtcaagggagagggcaggatgggaagcggatgttagaaaagttcaacattaacaaggcagggtgtcctgacacaccacttaatgaaaaaatgcaggcaaaacctactgtgtgtgtgtgtgtgtgtgtgtgtctgggaagagagagagagattcatctggaaagatgttcatcaaaatgtgaataacttatgggatttgagtgtacttttatttttactttatatcttacagatttgcaaaaaagaaaccttttacattttaataaaataagtgatacaagaaatctatcatttatttcattaaattttttttcaattaaaaaaagacccagaggaaggatagagagagtggagcagagatgaggccaggagggaatccaggtggagacaggaaaactggagacagtcggtgaggagagaggcctgggtgttg

SEQ ID NO: 18030 - DNA, 495 bp, Homo sapiens
aacctccattgtaggagataatcaaatcttagtcatctcttgtgtgtgactaatacccattgccagggctgttccattctgccgcagaagccactgtaatgactaagccatcaagatggattttttcctgatgacatttgctgcacaggactaaattctattaagccagccttttcgagtctggatctggaggagtcattgtatcactgtctttgaaaattaggctaaagggggtggtatctattaatataccgaggctctagtttccctcctcctaggatgcctgacctctccggcccattcctgtctctttcttactgaacctgctgtgcctgtattgtgggagccagcatgacctcatcgccctgagcatgggagtgttgggctgggccagggccctctcagtgccctcccaggcagagcctccaccctgggttttacaattactcaggggccacagaatgtggatggtgctaaattaacgcagcaaaccag

SEQ ID NO: 18031 - DNA, 2654 bp, Homo sapiens
aagtttatagaaaatgcttgttttatagttggttgttattgagatgagagtccctcaaggaactccctatgctttagggagctttttgttttaaacctactggttagacttgtgggttttaatgttttcagctgtggttgtaagaaacacattttaaattgcacctagtatagacatacatgtaaaacaaacaaaatttttacgaagtagtacttgtattaagagtgatgtactctgctatcttctatttcatttttttaaagttgatattgctgccttaaattgattttttcaaccactaatgagtcaggacccactatttaaaaaatactggtgtgttctcttgctgttacgaattaacccaaaacttagtggtttaaagcaataaacttgtgtttatctcatgtaggttctgtgggtcaggaatctgggagtagcttacttaggtggttctgggtcagggtttttcatgtggctccgcgctctgctccagccaaacttctgcagaccatgtgcagccgaggcgaggaaacttctctccacctattggggctggaggcctgagtcacaagccccttgtttacataaagtgtttaggtagcacaagtccttgagatgctcggggtagagatggagagccactgctcgtatccttctgccggcttctgcttgagatctcttggcctttacccttgtcccttgacttttcgtgtttgttttaatctttaagacttgaaatggagtggcctttagaaccggggagatactgtaaaccagcagtatctttgtgtcaccaatggtaactgaaagtcatgctgaagtacagattcctgtagcgtgcacagaggcagaggtgcttcctttaccttgcagatgagttgagcggcgtaagatgtttctgttagggttgaatttcatggttatttcagcaacgattttcgtttttgaagttttggcccccccaaaaatgaaagtctgcaacgcatgtttgttaagagaacagtttattctcctgttaggttttggtctttgaggtatggattccagagttggctattctgttagatttagaggtgtggaaaatcttttaacggggagatcctgaaacacggaaacatggcagggaagttagaatttcctgatggtcatttttaacattttaaagtttactttttggttgttgccatttttctagaatccgtgtcttttttggggaaatacagtcctttgaggactagaatttaatgatttctttacacatctaggattttttgagatttagaaaggatatggctttattcctaaggaagtggaggcagcagtttctaggatactctggtttcaaggcatgctaacttggttgtgatgtctaacccattttggtttacacagtctgaccactagcacaatgcctggcacatagtttacaaatcatttaaggcaagcttaccatcttaagacaatttaatacatagaagtgtccctcctaaaaatctgagtttgatttagaaatccagttatacctgcaggtactgatgactaattccttctttgaagacaaaatagcagctgtgtagcttcagtggctctcaaatggataatagattcagtgtatactcgctttgaactttcctgttttttgatcagctagataaatgactttagtgggtaaatgtctgcctccaaaaccaaattctgaccctgatctaagtattctactgcaccgctgtcactggaatatcaaagttggccttcagactggtgcctggttccttggattggcttgagtattgaggtctgtctcatcttactagggaactaaaatgatgttgattgttttgtagagaattgtaattagagatctgtaggttcttaattcttttggaattccattctgaaaattttcaaccttatggtgttggtggagtgctcatgtgaagagtgaaactgacttaagaataaaagaaaaagtgggcaaaactaatgctaaacttgagaccattgggcagaaatttgcctgtgtgtgtagagtaattggtcttgagtcaaagtaactatgcttatttttaacatcactgaatattttctagcgttacactctatataggcttgtagaaataaacccaggggtaagcccagaaattgaatatcagtcctaaagaaagcctatcaagagcatcctattctctttaagagctgctattcgaatttaggactgggctggtttgctgctcattctctcgaggcataggcagccacacttgaattttgccaagtatgcagataattccaacttgtagtcaggatcatcaggtaatagcattataaggggagctgtacagactgtatactttctacagtttgttgaaatagaaacatttatatggatacatacatctgcaaaggttagggagaaaacggtagccctggcagagaagagctagttagtgtatttcaggatagggccaagggaagctgtcatttctctactaagtctcattgtggaaaagccacaaatgtccctagtacagtaataaggaaaaaaaggctgagcgtggtggctcacacctgtagtcccaggactttcggaaggattgcttgagcccaggagttgcagatcggccaggacaatgtaagaaaaccccatgtattag

SEQ ID NO: 18032 - DNA, 357 bp, Homo sapiens
tgaaaaatagtggtgttgggagagttggtatacccagtgagggtatggaagctctgtgccacccaccccccagcccaataccttgacctgtgcatctcttccatctggctgtttctgagttttatgtgaagactcggggacacagggacacacaagggaaatgcgatgtgactatggagacacagattagagtgatgggtccacaggtctcagggtcctcaaacaaccaccagaagataggaagaggcaaggatcataccctagagccttcagagacagcatggcccagctgacatcttgaattcagacatctagcctccagaacctccaaagaataaatgtctattgttttaaacc

SEQ ID NO: 18033 - DNA, 645 bp, Homo sapiens
agccaaggaagaagtgaagggataattgtgcttacaccagttagcttttcacacttctctctctcccggtgcagcactgccggtagggggagcagtgagctccaagtttccaggaataattcaaaacacaattattttatattttaaaatataaaatgtatattttaaatatatatacatacatttctatataatatatacaaaagttcaatatacgtatattgaatatatatgtatataagttcaatatatatgtatgtatattcaatatatatgtatgtatatatgtatatatattcaatatatatgtgtatatattgaactttagtcatgtggtgacactttaaacagtacacagagcagcttctgggtccatgaccctccaaaaatttaattactgattctttagaaactaggcaactcagccaggtgtgggggctcacgcctgtaatcccagcactttgggtggccgaggtgggtggatcacctgaggtcgggagttcaagaccagcctgaccagcatggagaaaccctgtctccactaaaaatacaaaattagccaggcgtggtggcacatgcctgtaatcccagctacttgggaggctgaggcaggagaatcacttgaacccgggcgatcgcaccatt

SEQ ID NO: 18034 - DNA, 792 bp, Homo sapiens
aatttaactgaattgtatcatcaaaataaataaaacagggtaataaaaataacaattagggtgactgatgtcagacactcatatcaactcatcattttcttgtagcctctgattctgtactttcttgtgtattattaaagaggtaaatgctctcttaaaatgcctctagttcctcagaggtaggaaaaataaactcaacctgctttggacttgtgtatttacttgggttggtttccagaatctccttattcctgaaacagtatgatcatgtagttaaactactcctttatatctgtaagtactgtgcagccaacatgttcttttttgtccccaacttctgccatctttccaacctctgaggcatgctattttatagtggtttgctctttgaaaaattgtttttgtgccctctcttaatagtcacagatactgacacaaaacttaaaaatgaccagaaaacaatgtataaattatttaaaataaaacattctttttatatcacattatcaaatttgtactctttattcacttttccattaagtgtgatatcaatatagctaggctgttttgagcttgcacagtctgtctaccaagctccttcctaagtactttgagggtaaaatgaagaaggcagtctaggaaggaacacaattacagagccctgtagaaggcagactgcttacaggagctgtataaggaaaattaagcccaacattatgtgctgtgttggccatcatgcaaagctgattgcaaagccctggttacctccttcatcatcttccatggaagata

SEQ ID NO: 18035 - DNA, 368 bp, Homo sapiens
ttgtccaggagagagggagagtgagcagagcagggagacgtttatgtttgggctccttagaagagttagcatattctaggaagaaggggtgacacacacatcctaagaaagaagcctgtgcacagggctcagtgctaaatcctcattgtggttgtcatcaccttcctggcaacagctgcccatctgtggagcccagaaccattgtaagtccttagtgggtgccacccgatttgcgcctctccaagcctgtggaggaaagtctgaggcagagaaggagggcaggggaggacgaaacacaggacgtcaggctgctgcaagaggatgtgtgtccctcaggctgtccctttgtgtggccgctctgctgccgt

SEQ ID NO: 18036 - DNA, 529 bp, Homo sapiens
agcattagctaaggggctgaaagaaatctcagaaaatgataaaaccacacatgggacaaacaggtgtataaaaaactgaactgttagtagttaaagtaacttcatacttatctctatgaatacgacagagccaatattaagatactacaaaattataagacaacacatttcttactcaggaaattatatccaaatgtccatacaactaagtgtgaagtttactaagaaaacaaaggcaggccaggcgcagtggctcacgcctgtaattccagcactttgggaggctatggggggcggattgcttgagctcaggagttcgaaaccagcctgggcaacatggtgaaatactatctccatgaaaattacaaaaaattagttgggagtggtggtgtgtgcctgtagtcccagctacttgggaggctgaggtaggaggatcacttgagcccaggagacagaggctgcagtgagctagctgaatttgtgctactgcattccagcataggtgacagagtgagaccctgtctccgga

SEQ ID NO: 18037 - DNA, 2364 bp, Homo sapiens
atccgcagccaactgtgtggcggtccccactttcgcctagcggcaactccctccctccctgcaatccttccttcttattccggtttccagagcacgtctccaggcttcgacgtcaccacgctgggacgtatgtgccgagggccgcggcgtctgacctcatggcgtagagcctagcaacagcgcaggctcccagccgagtccgttatggccgctgccgtcccgaagaggatgagggggccagcacaagcgaaactgctgcccgggtcggccatccaagcccttgtggggttggcgcggccgctggtcttggcgctcctgcttgtgtccgccgctctatccagtgttgtatcacggactgattcaccgagcccaaccgtactcaactcacatatttctaccccaaatgtgaatgctttaacacatgaaaaccaaaccaaaccttctatttcccaaatcagcaccaccctccctcccacgacgagtaccaagaaaagtggaggagcatctgtggtccctcatccctcgcctactcctctgtctcaagaggaagctgataacaatgaagatcctagtatagaggaggaggatcttctcatgctgaacagttctccatccacagccaaagacactctagacaatggcgattatggagaaccagactatgactggaccacgggccccagggacgacgacgagtctgatgacaccttggaagaaaacaggggttacatggaaattgaacagtcagtgaaatcttttaagatgccatcctcaaatatagaagaggaagacagccatttcttttttcatcttattatttttgctttttgcattgctgttgtttacattacatatcacaacaaaaggaagatttttcttctggttcaaagcaggaaatggcgtgatggcctttgttccaaaacagtggaataccatcgcctagatcagaatgttaatgaggcaatgccttctttgaagattaccaatgattatattttttaaagcactgtgatttgaatttgcttatgtaattttatttgcttgactttttatatgatattgtgcaaatgtttgccataggcaattggtacttaaatgagaggtgagtctctcttttgccttggtgctttggaaattaaatgtcacaaacgagtatataattttttatctgtacttttagagctgagtttaatcaggtgtccaaaatgtgagttaaacattaccttatatttacactgttagtttttattgttttagatttattatgcttcttctggaagtattagtgatgctacttttaaaagatcccaaacttgtaactaaattctgacatatctgttactgctgactcacattcattctccgccattcaaatactattttttatccacatttttttttgttcccaaactgtaatgtacaaggatatgtgtgataatgctttggatttgagtaatatttttttttcttccaagaaaactgctttggatatttttagataatttaaacataatttaggataatgatattgctcaatctgaccacaattttaggtaaaacattaaatgtgtcaagaaatcttggcaacagagactctgcagcttgcagtggacatagataaaatgttacagagatactatttttttggttggaattactatattaaatttagaagcagaaactggtaaaatgttaaatacatgtacaattgcttttagttagcaattgattgtagcatgggttcctccaaggtttcaagcaatgggcagagtttaaaattatatcagattcgtttacttcgtttattattttacagtaaatttgaataaatcttaggggtcattatcacttaaataatactgtacctaggtctttcaaattaaaattatacctgaatgaagttgtttgtatacataaaggatatttgtgtacaattaccttttttcccccacacttgttttctttgtttttgttttttatggcaactggaaagtatttactatgggattcatttatgtctgtctttctatcataaagaattgatcaatatgtaaatatgtgatttgaaccatggttgacttacaagtgtcactacagctttttagaaaacatagccctaatatatgttaagcaggacccgggtgagccagtgggcttgcgctttatgtagagctggaagaaggccgtccatcctgtctcttgggcggacagtgtactttcctaatagggaagggaagcacaatggaaatacccctgaaccgttttattgcagtaatttttttcatatctgaaactattatttaatattttgaataagattttaaaaaataaatggcaaagatataaatctatgaaaaaaaaaag

SEQ ID NO: 18038 - DNA, 2428 bp, Homo sapiens
atccgcagccaactgtgtggcggtccccactttcgcctagcggcaactccctccctccctgcaatccttccttcttattccggtttccagagcacgtctccaggcttcgacgtcaccacgctgggacgtatgtgccgagggccgcggcgtctgacctcatggcgtagagcctagcaacagcgcaggctcccagccgagtccgttatggccgctgccgtcccgaagaggatgagggggccagcacaagcgaaactgctgcccgggtcggccatccaagcccttgtggggttggcgcggccgctggtcttggcgctcctgcttgtgtccgccgctctatccagtggccaagacacagtcctgcgtttctccctaaatttgaattttcagctgcaaaacagtgtgacctgttgtatcacggactgattcaccgagcccaaccgtactcaactcacatatttctaccccaaatgtgaatgctttaacacatgaaaaccaaaccaaaccttctatttcccaaatcagcaccaccctccctcccacgacgagtaccaagaaaagtggaggagcatctgtggtccctcatccctcgcctactcctctgtctcaagaggaagctgataacaatgaagatcctagtatagaggaggaggatcttctcatgctgaacagttctccatccacagccaaagacactctagacaatggcgattatggagaaccagactatgactggaccacgggccccagggacgacgacgagtctgatgacaccttggaagaaaacaggggttacatggaaattgaacagtcagtgaaatcttttaagatgccatcctcaaatatagaagaggaagacagccatttcttttttcatcttattatttttgctttttgcattgctgttgtttacattacatatcacaacaaaaggaagatttttcttctggttcaaagcaggaaatggcgtgatggcctttgttccaaaacagtggaataccatcgcctagatcagaatgttaatgaggcaatgccttctttgaagattaccaatgattatattttttaaagcactgtgatttgaatttgcttatgtaattttatttgcttgactttttatatgatattgtgcaaatgtttgccataggcaattggtacttaaatgagaggtgagtctctcttttgccttggtgctttggaaattaaatgtcacaaacgagtatataattttttatctgtacttttagagctgagtttaatcaggtgtccaaaatgtgagttaaacattaccttatatttacactgttagtttttattgttttagatttattatgcttcttctggaagtattagtgatgctacttttaaaagatcccaaacttgtaactaaattctgacatatctgttactgctgactcacattcattctccgccattcaaatactattttttatccacatttttttttgttcccaaactgtaatgtacaaggatatgtgtgataatgctttggatttgagtaatatttttttttcttccaagaaaactgctttggatatttttagataatttaaacataatttaggataatgatattgctcaatctgaccacaattttaggtaaaacattaaatgtgtcaagaaatcttggcaacagagactctgcagcttgcagtggacatagataaaatgttacagagatactatttttttggttggaattactatattaaatttagaagcagaaactggtaaaatgttaaatacatgtacaattgcttttagttagcaattgattgtagcatgggttcctccaaggtttcaagcaatgggcagagtttaaaattatatcagattcgtttacttcgtttattattttacagtaaatttgaataaatcttaggggtcattatcacttaaataatactgtacctaggtctttcaaattaaaattatacctgaatgaagttgtttgtatacataaaggatatttgtgtacaattaccttttttcccccacacttgttttctttgtttttgttttttatggcaactggaaagtatttactatgggattcatttatgtctgtctttctatcataaagaattgatcaatatgtaaatatgtgatttgaaccatggttgacttacaagtgtcactacagctttttagaaaacatagccctaatatatgttaagcaggacccgggtgagccagtgggcttgcgctttatgtagagctggaagaaggccgtccatcctgtctcttgggcggacagtgtactttcctaatagggaagggaagcacaatggaaatacccctgaaccgttttattgcagtaatttttttcatatctgaaactattatttaatattttgaataagattttaaaaaataaatggcaaagatataaatctatgaaaaaaaaaag

SEQ ID NO: 18039 - DNA, 2310 bp, Homo sapiens
atccgcagccaactgtgtggcggtccccactttcgcctagcggcaactccctccctccctgcaatccttccttcttattccggtttccagagcacgtctccaggcttcgacgtcaccacgctgggacgtatgtgccgagggccgcggcgtctgacctcatggcgtagagcctagcaacagcgcaggctcccagccgagtccgttatggccgctgccgtcccgaagaggatgagggggccagcacaagcgaaactgctgcccgggtcggccatccaagcccttgtggggttggcgcggccgctggtcttggcgctcctgcttgtgtccgccgctctatccagtgttgtatcacggactgattcaccgagcccaaccgtactcaactcacatatttctaccccaaatgtgaatgctttaacacatgaaaaccaaaccaaaccttctatttcccaaatcagcaccaccctccctcccacgacgagtaccaagaaaagtggaggagcatctgtggtccctcatccctcgcctactcctctgtctcaagaggaagctgataacaatgaagatcctagtatagaggaggaggatcttctcatgctgaacagttctccatccacagccaaagacactctagacaatggcgattatggagaaccagactatgactggaccacgggccccagggacgacgacgagtctgatgacaccttggaagaaaacaggggttacatggaaattgaacagtcagtgaaatcttttaagatgccatcctcaaatatagaagaggaagacagccatttcttttttcatcttattatttttgctttttgcattgctgttgtttacattacatatcacaacaaaaggaagatttttcttctggttcaaagcaggaaatggcgtgatggcctttcttctttgaagattaccaatgattatattttttaaagcactgtgatttgaatttgcttatgtaattttatttgcttgactttttatatgatattgtgcaaatgtttgccataggcaattggtacttaaatgagaggtgagtctctcttttgccttggtgctttggaaattaaatgtcacaaacgagtatataattttttatctgtacttttagagctgagtttaatcaggtgtccaaaatgtgagttaaacattaccttatatttacactgttagtttttattgttttagatttattatgcttcttctggaagtattagtgatgctacttttaaaagatcccaaacttgtaactaaattctgacatatctgttactgctgactcacattcattctccgccattcaaatactattttttatccacatttttttttgttcccaaactgtaatgtacaaggatatgtgtgataatgctttggatttgagtaatatttttttttcttccaagaaaactgctttggatatttttagataatttaaacataatttaggataatgatattgctcaatctgaccacaattttaggtaaaacattaaatgtgtcaagaaatcttggcaacagagactctgcagcttgcagtggacatagataaaatgttacagagatactatttttttggttggaattactatattaaatttagaagcagaaactggtaaaatgttaaatacatgtacaattgcttttagttagcaattgattgtagcatgggttcctccaaggtttcaagcaatgggcagagtttaaaattatatcagattcgtttacttcgtttattattttacagtaaatttgaataaatcttaggggtcattatcacttaaataatactgtacctaggtctttcaaattaaaattatacctgaatgaagttgtttgtatacataaaggatatttgtgtacaattaccttttttcccccacacttgttttctttgtttttgttttttatggcaactggaaagtatttactatgggattcatttatgtctgtctttctatcataaagaattgatcaatatgtaaatatgtgatttgaaccatggttgacttacaagtgtcactacagctttttagaaaacatagccctaatatatgttaagcaggacccgggtgagccagtgggcttgcgctttatgtagagctggaagaaggccgtccatcctgtctcttgggcggacagtgtactttcctaatagggaagggaagcacaatggaaatacccctgaaccgttttattgcagtaatttttttcatatctgaaactattatttaatattttgaataagattttaaaaaataaatggcaaagatataaatctatgaaaaaaaaaag

SEQ ID NO: 18040 - DNA, 2284 bp, Homo sapiens
atccgcagccaactgtgtggcggtccccactttcgcctagcggcaactccctccctccctgcaatccttccttcttattccggtttccagagcacgtctccaggcttcgacgtcaccacgctgggacgtatgtgccgagggccgcggcgtctgacctcatggcgtagagcctagcaacagcgcaggctcccagccgagtccgttatggccgctgccgtcccgaagaggatgagggggccagcacaagcgaaactgctgcccggttgtatcacggactgattcaccgagcccaaccgtactcaactcacatatttctaccccaaatgtgaatgctttaacacatgaaaaccaaaccaaaccttctatttcccaaatcagcaccaccctccctcccacgacgagtaccaagaaaagtggaggagcatctgtggtccctcatccctcgcctactcctctgtctcaagaggaagctgataacaatgaagatcctagtatagaggaggaggatcttctcatgctgaacagttctccatccacagccaaagacactctagacaatggcgattatggagaaccagactatgactggaccacgggccccagggacgacgacgagtctgatgacaccttggaagaaaacaggggttacatggaaattgaacagtcagtgaaatcttttaagatgccatcctcaaatatagaagaggaagacagccatttcttttttcatcttattatttttgctttttgcattgctgttgtttacattacatatcacaacaaaaggaagatttttcttctggttcaaagcaggaaatggcgtgatggcctttgttccaaaacagtggaataccatcgcctagatcagaatgttaatgaggcaatgccttctttgaagattaccaatgattatattttttaaagcactgtgatttgaatttgcttatgtaattttatttgcttgactttttatatgatattgtgcaaatgtttgccataggcaattggtacttaaatgagaggtgagtctctcttttgccttggtgctttggaaattaaatgtcacaaacgagtatataattttttatctgtacttttagagctgagtttaatcaggtgtccaaaatgtgagttaaacattaccttatatttacactgttagtttttattgttttagatttattatgcttcttctggaagtattagtgatgctacttttaaaagatcccaaacttgtaactaaattctgacatatctgttactgctgactcacattcattctccgccattcaaatactattttttatccacatttttttttgttcccaaactgtaatgtacaaggatatgtgtgataatgctttggatttgagtaatatttttttttcttccaagaaaactgctttggatatttttagataatttaaacataatttaggataatgatattgctcaatctgaccacaattttaggtaaaacattaaatgtgtcaagaaatcttggcaacagagactctgcagcttgcagtggacatagataaaatgttacagagatactatttttttggttggaattactatattaaatttagaagcagaaactggtaaaatgttaaatacatgtacaattgcttttagttagcaattgattgtagcatgggttcctccaaggtttcaagcaatgggcagagtttaaaattatatcagattcgtttacttcgtttattattttacagtaaatttgaataaatcttaggggtcattatcacttaaataatactgtacctaggtctttcaaattaaaattatacctgaatgaagttgtttgtatacataaaggatatttgtgtacaattaccttttttcccccacacttgttttctttgtttttgttttttatggcaactggaaagtatttactatgggattcatttatgtctgtctttctatcataaagaattgatcaatatgtaaatatgtgatttgaaccatggttgacttacaagtgtcactacagctttttagaaaacatagccctaatatatgttaagcaggacccgggtgagccagtgggcttgcgctttatgtagagctggaagaaggccgtccatcctgtctcttgggcggacagtgtactttcctaatagggaagggaagcacaatggaaatacccctgaaccgttttattgcagtaatttttttcatatctgaaactattatttaatattttgaataagattttaaaaaataaatggcaaagatataaatctatgaaaaaaaaaag

SEQ ID NO: 18041 - DNA, 1764 bp, Homo sapiens
ccaggtgatctagaggatcccgtagtcgttagcagtaatggcgattatggagaaccagactatgactggaccacgggccccagggacgacgacgagtctgatgacaccttggaagaaaacaggggttacatggaaattgaacagtcagtgaaatcttttaagatgccatcctcaaatatagaagaggaagacagccatttcttttttcatcttattatttttgctttttgcattgctgttgtttacattacatatcacaacaaaaggaagatttttcttctggttcaaagcaggaaatggcgtgatggcctttgttccaaaacagtggaataccatcgcctagatcagaatgttaatgaggcaatgccttctttgaagattaccaatgattatattttttaaagcactgtgatttgaatttgcttatgtaattttatttgcttgactttttatatgatattgtgcaaatgtttgccataggcaattggtacttaaatgagaggtgagtctctcttttgccttggtgctttggaaattaaatgtcacaaacgagtatataattttttatctgtacttttagagctgagtttaatcaggtgtccaaaatgtgagttaaacattaccttatatttacactgttagtttttattgttttagatttattatgcttcttctggaagtattagtgatgctacttttaaaagatcccaaacttgtaactaaattctgacatatctgttactgctgactcacattcattctccgccattcaaatactattttttatccacatttttttttgttcccaaactgtaatgtacaaggatatgtgtgataatgctttggatttgagtaatatttttttttcttccaagaaaactgctttggatatttttagataatttaaacataatttaggataatgatattgctcaatctgaccacaattttaggtaaaacattaaatgtgtcaagaaatcttggcaacagagactctgcagcttgcagtggacatagataaaatgttacagagatactatttttttggttggaattactatattaaatttagaagcagaaactggtaaaatgttaaatacatgtacaattgcttttagttagcaattgattgtagcatgggttcctccaaggtttcaagcaatgggcagagtttaaaattatatcagattcgtttacttcgtttattattttacagtaaatttgaataaatcttaggggtcattatcacttaaataatactgtacctaggtctttcaaattaaaattatacctgaatgaagttgtttgtatacataaaggatatttgtgtacaattaccttttttcccccacacttgttttctttgtttttgttttttatggcaactggaaagtatttactatgggattcatttatgtctgtctttctatcataaagaattgatcaatatgtaaatatgtgatttgaaccatggttgacttacaagtgtcactacagctttttagaaaacatagccctaatatatgttaagcaggacccgggtgagccagtgggcttgcgctttatgtagagctggaagaaggccgtccatcctgtctcttgggcggacagtgtactttcctaatagggaagggaagcacaatggaaatacccctgaaccgttttattgcagtaatttttttcatatctgaaactattatttaatattttgaataagattttaaaaaataaatggcaaagatataaatctatgaaaaaaaaaag

SEQ ID NO: 18042 - DNA, 2307 bp, Homo sapiens
atccgcagccaactgtgtggcggtccccactttcgcctagcggcaactccctccctccctgcaatccttccttcttattccggtttccagagcacgtctccaggcttcgacgtcaccacgctgggacgtatgtgccgagggccgcggcgtctgacctcatggcgtagagcctagcaacagcgcaggctcccagccgagtccgttatggccgctgccgtcccgaagaggatgagggggccagcacaagcgaaactgctgcccgggtcggccatccaagcccttgtggggttggcgcggccgctggtcttggcgctcctgcttgtgtccgccgctctatccagtgttgtatcacggactgattcaccgagcccaaccgtactcaactcacatatttctaccccaaatgtgaatgctttaacacatgaaaaccaaaccaaaccttctatttcccaaatcagcaccaccctccctcccacgacgagtaccaagaaaagtggaggagcatctgtggtccctcatccctcgcctactcctctgtctcaagaggaagctgataacaatgaagatcctagtatagaggaggaggatcttctcatgctgaacagttctccatccacagccaaagacactctagacaatggcgattatggagaaccagactatgactggaccacgggccccagggacgacgacgagtctgatgacaccttggaagaaaacaggggttacatggaaattgaacagtcagtgaaatcttttaagatgccatcctcaaatatagaagaggaagacagccatttcttttttcatcttattatttttgctttttgcattgctgttgtttacattacatatcacaacaaaaggaagatttttcttctggttcaaagcaggaaatggcgtgatggcctttgttccaaaacagtggaataccatcgcctagatcagaatgttaatgaggcaatgccttctttgaagattaccaatgattatattttttaaagcactgtgatttgaatttgcttatgtaattttatttgcttgactttttatatgatattgtgcaaatgtttgccataggcaattggtacttaaatgagaggtgagtctctcttttgccttggtgctttggaaattaaatgtcacaaacgagtatataattttttatctgtacttttagagctgagtttaatcaggtgtccaaaatgtgagttaaacattaccttatatttacactgttagtttttattgttttagatttattatgcttcttctggaagtattagtgatgctacttttaaaagatcccaaacttgtaactaaattctgacatatctgttactgctgactcacattcattctccgccattcaaatactattttttatccacatttttttttgttcccaaactgtaatgtacaaggatatgtgtgataatgctttggatttgagtaatatttttttttcttccaagaaaactgctttggatatttttagataatttaaacataatttaggataatgatattgctcaatctgaccacaattttaggtaaaacattaaatgtgtcaagaaatcttggcaacagagactctgcagcttgcagtggacatagataaaatgttacagagatactatttttttggttggaattactatattaaatttagaagcagaaactggtaaaatgttaaatacatgtacaattgcttttagttagcaattgattgtagcatgggttcctccaaggtttcaagcaatgggcagagtttaaaattatatcagattcgtttacttcgtttattattttacagtaaatttgaataaatcttaggggtcattatcacttaaataatactgtacctaggtctttcattaccttttttcccccacacttgttttctttgtttttgttttttatggcaactggaaagtatttactatgggattcatttatgtctgtctttctatcataaagaattgatcaatatgtaaatatgtgatttgaaccatggttgacttacaagtgtcactacagctttttagaaaacatagccctaatatatgttaagcaggacccgggtgagccagtgggcttgcgctttatgtagagctggaagaaggccgtccatcctgtctcttgggcggacagtgtactttcctaatagggaagggaagcacaatggaaatacccctgaaccgttttattgcagtaatttttttcatatctgaaactattatttaatattttgaataagattttaaaaaataaatggcaaagatataaatctatgaaaaaaaaaag

SEQ ID NO: 18043 - DNA, 1273 bp, Homo sapiens
aagcagtggtatcaacgcagagggcccattacggccgggggaaattaaatgtcacaaacgagtatataattttttatctgtacttttagagctgagtttaatcaggtgtccaaaatgtgagttaaacattaccttatatttacactgttagtttttattgttttagatttattatgcttcttctggaagtattagtgatgctacttttaaaagatcccaaacttgtaactaaattctgacatatctgttactgctgactcacattcattctccgccattcaaatactattttttatccacatttttttttgttcccaaactgtaatgtacaaggatatgtgtgataatgctttggatttgagtaatatttttttttcttccaagaaaactgctttggatatttttagataatttaaacataatttaggataatgatattgctcaatctgaccacaattttaggtaaaacattaaatgtgtcaagaaatcttggcaacagagactctgcagcttgcagtggacatagataaaatgttacagagatactatttttttggttggaattactatattaaatttagaagcagaaactggtaaaatgttaaatacatgtacaattgcttttagttagcaattgattgtagcatgggttcctccaaggtttcaagcaatgggcagagtttaaaattatatcagattcgtttacttcgtttattattttacagtaaatttgaataaatcttaggggtcattatcacttaaataatactgtacctaggtctttcaaattaaaattatacctgaatgaagttgtttgtatacataaaggatatttgtgtacaattaccttttttcccccacacttgttttctttgtttttgttttttatggcaactggaaagtatttactatgggattcatttatgtctgtctttctatcataaagaattgatcaatatgtaaatatgtgatttgaaccatggttgacttacaagtgtcactacagctttttagaaaacatagccctaatatatgttaagcaggacccgggtgagccagtgggcttgcgctttatgtagagctggaagaaggccgtccatcctgtctcttgggcggacagtgtactttcctaatagggaagggaagcacaatggaaatacccctgaaccgttttattgcagtaatttttttcatatctgaaactattatttaatattttgaataagattttaaaaaataaatggcaaagatataaatctatgaaaaaaaaaag

SEQ ID NO: 18044 - DNA, 1695 bp, Homo sapiens
  misc_feature (1359)..(1359): n is a, c, g, or t
atccgcagccaactgtgtggcggtccccactttcgcctagcggcaactccctccctccctgcaatccttccttcttattccggtttccagagcacgtctccaggcttcgacgtcaccacgctgggacgtatgtgccgagggccgcggcgtctgacctcatggcgtagagcctagcaacagcgcaggctcccagccgagtccgttatggccgctgccgtcccgaagaggatgagggggccagcacaagcgaaactgctgcccgggtcggccatccaagcccttgtggggttggcgcggccgctggtcttggcgctcctgcttgtgtccgccgctctatccagtgttgtatcacggactgattcaccgagcccaaccgtactcaactcacatatttctaccccaaatgtgaatgctttaacacatgaaaaccaaaccaaaccttctatttcccaaatcagcaccaccctccctcccacgacgagtaccaagaaaagtggaggagcatctgtggtccctcatccctcgcctactcctctgtctcaagaggaagctgataacaatgaagatcctagtatagaggaggaggatcttctcatgctgaacagttctccatccacagccaaagacactctagacaatggcgattatggagaaccagactatgactggaccacgggccccagggacgacgacgagtctgatgacaccttggaagaaaacaggggttacatggaaattgaacagtcagtgaaatcttttaagatgccatcctcaaatatagaagaggaagacagccatttcttttttcatcttattatttttgctttttgcattgctgttgtttacattacatatcacaacaaaaggaagatttttcttctggttcaaagcaggaaatggcgtgatggcctttgttccaaaacagtggaataccatcgcctagatcagaatgttaatgaggcaatgccttctttgaagattaccaatgattatattttttaaagcactgtgatttgaatttgcttatgtaattttatttgcttgactttttatatgatattgtgcaaatgtttgccataggcaattggtacttaaatgagaggtgagtctctcttttgccttggtgctttggaaattaaatgtcacaaacgagtatataattttttatctgtacttttagagctgagtttaatcaggtgtccaaaatgtgagttaaacattaccttatatttacactgttagtttttattgttttagatttattatgcttcttctggaagtattagtgatgctacttttaaaagatcccaaacttgtaactaaattctgacattaaaaatctggggggttactgctganctcacatttcccagttcttcctttccgccgggccccccccaaaaatttttttctcccccccaaaaaaacaaccacaaactttttttcaaaaacccccgcccgcggctttttctccaccaacaaccagcgggggtttttttttcttatgagcgcaatcttggacagactattcaagacgttagtagtacatagacagacttttatagcacgtgttccaccacctaaccaccgcgctcttttttttttttcctcccacagaggccacacccaccaggtagtaaaaagtatgaccggcaccgcagcgaacgaatagaaggagcgcgcttttttttaatg

SEQ ID NO: 18045 - DNA, 1370 bp, Homo sapiens
atccgcagccaactgtgtggcggtccccactttcgcctagcggcaactccctccctccctgcaatccttccttcttattccggtttccagagcacgtctccaggcttcgacgtcaccacgctgggacgtatgtgccgagggccgcggcgtctgacctcatggcgtagagcctagcaacagcgcaggctcccagccgagtccgttatggccgctgccgtcccgaagaggatgagggggccagcacaagcgaaactgctgcccgggtcggccatccaagcccttgtggggttggcgcggccgctggtcttggcgctcctgcttgtgtccgccgctctatccagtgttgtatcacggactgattcaccgagcccaaccgtactcaactcacatatttctaccccaaatgtgaatgctttaacacatgaaaaccaaaccaaaccttctatttcccaaatcagcaccaccctccctcccacgacgagtaccaagaaaagtggaggagcatctgtggtccctcatccctcgcctactcctctgtctcaagaggaagctgataacaatgaagatcctagtatagaggaggaggatcttctcatgctgaacagttctccatccacagccaaagacactctagacaatggcgattatggagaaccagactatgactggaccacgggccccagggacgacgacgagtctgatgacaccttggaagaaaacaggggttacatggaaattgaacagtcagtgaaatcttttaagatgccatcctcaaatatagaagaggaagacagccatttcttttttcatcttattatttttgctttttgcattgctgttgtttacattacatatcacaacaaaaggaagatttttcttctggttcaaagcaggaaatggcgtgatggcctttgttccaaaacagtggaataccatcgcctagatcagaatgttaatgaggcaatgccttctttgaagattaccaatgattatattttttaaagcactgtgatttgaatttgcttatgtaattttatttgcttgactttttatatgatattgtgcaaatgtttgccataggcaattggtacttaaatgagaggtgagtctctcttttgccttggtgctttggaaattaaatgtcacaaacgagtatataattttttatctgtacttttagagctgagtttaatcaggtgtccaaaatgtgagttaaacattaccttatatttacactgttagtttttattgttttagatttattatgcttcttctggaagtattagtgatgctacttttaaaagatcccaaacatataattgaactcctcccacccaattgggccaatctatccccctatagaagaccta

SEQ ID NO: 18046 - DNA, 1257 bp, Homo sapiens
tgctttaagtggtggttcttgtgccatataggccattgccataaaaaaaaattagagtactggaaggaaaatattgagtcatcaaataaagtcaaattcggatttggtatatttgatgatttcatttccttttcagttttggggccatcctctgagtgaagtgaagaggaagtggcacagcctggtataaagtctagggtctggttgtagaatgtacacagcaatccattctcatctctgacaaacttgtaggacaaaaagagaaaagattcgttcagatttccaatgctgggttggagaatatgtctgggtgacaatctatgactggtttaagtttgcacaaagagaaggagacataaggaagctcagatcatgaaaacccaactttctggatagaaaaaaaaaagcctaggttttttttttttttaattagagagacaacaagaagaataagggaaaatgggaagaacagagtgaaattaaagcaaatcttggattcagattccattaaacaggaagtttccttaaaaaaaatcaaatgcttatagcaatgctgagaatttcataggtacttcatgggatctaacaagtgaagatttttctaaattgctttgtggagactaagtgctttaaattatgtattattaacttaacagacactttacatcatgagttagccaaacattcatgtttcaattgacaagggaaagaaagtgaagagatgcttgctgaaggcacaagtttgaatacagaaagctggaatataaaaaactattgacttccaatagttttcatttatcagattactacactattgtaaaaattatcttcttaagacataaattttgtattggttaaagatgtcctgaaaaaattctgtacctccttggctttcactgaagttttggggcagttcttcattaatttgggttatattttaagtccttaggaaaagacagaggccaatttagacagaaagagaaagacgacaaaaaggagaccagagagaaaagacagctggtactataacctcagatttttgactcaaatatcatatcactaaatttgatggcaatcacttcctaaagagaaacagattcagaaacattgcagatcaccaaggtatccttctttgctattccagaataggtctgttacaagaaacccagccaccaaccaaacaaccccaaacaaataaaaataaacataaatccccacacctcttttgacttggtctactcaactctttcatacctc

SEQ ID NO: 18047 - DNA, 419 bp, Homo sapiens
tcttgaactcctgacttcaggtgatccacctgccgcggcctcccaaagtgctgaaattacaggcatgtgccactgtgtctggccaaaataataaatcttatgttagctttaaggagttctgaacttagtatctgtcatgtagtaaataaataaacatgataatcttctaggaattttgggtaaataattttaaacaaattcttaatctcactacactataatctgcctcaacgttgttgttagacgtgtataatgaatattagaagtactggacaaaattccatttgatctcattttcttgaaatgagttaagttattgttgttgccacatttttcatctagaagtcattctgtaataaaactctttgtagttgttatcatctggaactgttacactggacctatggtgctataaagaa

SEQ ID NO: 18048 - DNA, 279 bp, Homo sapiens
tagagtaccattctgcaaagcctgaagtgatattcacagttttcacacttctgaaaatatccaaaaaggcaatgtagctgcttcgtgttaaactacattagaataaattgcagagactgttttccaaataatgccactttttaaattaaatgcccacatgaatgataataatttagaattaacataatttatcatagctaattagaactgaagaatcattttgcgatccaaagaattagaaactctttttgtcttaccagaatttcacagatgtttttc

SEQ ID NO: 18049 - DNA, 337 bp, Homo sapiens
atactgttttgctaaaggctctgagacatgctctctgtttcttaaaatgagaagtaatggtagagaggtgtaaaagatataccaatagctaactgagcatttcttattgaaagagaattgaaaatatattttttctggtgattcagaattatttcatgtatgttcatgtgccatgtaaaatctgtatatcttctaaaatcattttgggtaccattattatttgctctatcacttgtagtccatgtcctacattttgagaagaactgtctcatagcttatcttttctgtccctaagtgaaagtatcttgatagtaagtgttattatatgtgggaaaac

SEQ ID NO: 18050 - DNA, 451 bp, Homo sapiens
ctcttcttctttttttagagacagggtctagttctgtcacccaggctggagcccagtggcacaatcatagcttactgtaacctcaaactcctgggctcaagtgatcctcctgcctcagcatcccaaactgctggattacaggcatgagtcaaacacgcctggtcacacttctcatccagacctcatttgtccacctcccccatcccccgccccaccccacggtctgtcctataacgcccacacaacaggtcactgtttagaaagtgctacaaagttacaaacacagtcccttctgagcctcccaccaatgttggtgggtacaaggtcaaaaaaaaaaaatctcatttatgtaaggggcataggagactttttagttagagggcccaattatagtcctcctgaaaagatgccaaaagtccccttaaacacttagcagctaagattcaagaaa

SEQ ID NO: 18051 - DNA, 334 bp, Homo sapiens
ggtactgaggccagagtgtgtgtcagagacctttccttttagatgttgctcaggtaattttctcatatcccttgaggaatccctcttttttctagttcttgggcatttctaaacagtataccttggtaattgtgggacagtggtcttcctattttatattaatagatttggaaactgaggtgcaaagtagttaagtaacttgccttgaatcatccagctactgagagttaggaaatgttctttcctttgcagcatgttgcctttgtataagacttttagacttcctgttataatttcaactgattataggtcataataaaacaagcagtaaaat

SEQ ID NO: 18052 - DNA, 421 bp, Homo sapiens
tcccggtcagcacctttgccattctgcttaaattctgcttttaagaatagcaaaattcttaaaagaaaaaaaaaccaactagaggtgaaatcaagctgcactgcgaatctgactgttaagaatttcaaagacccagagaaaatgttactgtgtgcctttctagtggtcacaggctgaccaccctccgtgaatatgggattcttccttggccttaaagaagtggagaagggcatctttttcatacacctcaggggaaaaaatcaccaaaccctcaaacaaaacaaatcttcctcatttctattatcttgaaacattagcttattactttctggcattcacacaagtcactgaaaactattgcagaagactgaaactgtttaaagccactttcaataaaagttcacttagcaaaacttaaata

SEQ ID NO: 18053 - DNA, 609 bp, Homo sapiens
actttataacgctagagtagtacagagaactctcatgttgtttaggttttccaactggggacatcctgtgatctgactgttcctagtgcacaagctaatcccacccatatcctgtttgtgagtaattggatggatgcctggaaaatctagtgccagattgtatagtgcctttacaacagaaatctctagtttgaattgatttaccctctacctaaacaaacacctctcataggtgagcctctactctaaaaaggcaagattatataacatagatccctagttcttgtttccatagtcatgctttggatggtactcccattgatctggatcagagacatatgtaaaatacaatttcagggtgttgtttttctgtataactgaagcagtagattttgaattgtatacctcttcccatgaatatagaagacagctttgtaggaaaaaatttcttcttaaatcatcttttttatctaaattattaagaataggaaaataccatttgcatcattgtagtctctcttacttcttgggttctctttacaagatatcaaaatatgtttaaaaaaaaaacccggatgcatataggtgtgtgcaagcttgtcgtaattc

SEQ ID NO: 18054 - DNA, 377 bp, Homo sapiens
gaccccagttttgcagctggatgagccccaagttgctgttcccactcatacacataaaggccagagcttctgtgcccagagcttgtgccatgcagtgctcagccgtgggagacactgcagggagagaaacaggaaagacagggcagcagtgggctctgccctcaggaggtttcctttccagacagcagtgcagagccacattaaaatctatgcagaggggccgagagccccacagcaggaaaacgcagaaaggtgaccgcaagctgcccccctgtacagtggcccactgcagctctgggggtcctatgggttcttcctacagtcaccaaggccccatcgctcagtctgcaattttctcccaaactattcatgtcttt

SEQ ID NO: 18055 - DNA, 568 bp, Homo sapiens
gacccatctatcccccaactctcttctgactcctatacctttctttctattcttcgtaccatttcacttcagacgtcacctggaatactgatgcaggaggctaagctgagtctctcagggtagacagttcaacctttccatggttgttcataaatattactagggatttggaatgcatgttcccactaaaatgatgtaaatgtggttaagtgataccatattaaaatgcatcattacttgtgtgattcagacaaagtatgggttaactaggcattttgaaggcagaattaaaatactaaccaccaccactttctctgtaatagtggttgccaaccaggggtgatccttcctctctccttcagggacatttgtcagtgtctccagacatttggttggtccatctgggtggggtgctattagcatctcttgagtaaaggccaggaatactgctaaacattctgcaatacacaggatagccccctacaatgaataattatccagacccacatggcaagagtgacaaggttgtgaaactttgctctagaaatgtgtacattctttttttttt

SEQ ID NO: 18056 - DNA, 291 bp, Homo sapiens
aaaaagtagaactttatttctgacaaatctgacaaatctttatacctttagcagactttcggaaagatattctccaagcagatgattaaataaacatttttaagctctgacatttgtattatgttttttagttttaaaagtgcttttcgacatgtgaactcttagtttccagtggtgaggaaacagactcagattggttaagataactaaatcatttagtgagcatgcataaggtgcttgcccttgtgctaagcacatcagcataatgaggtgacactgttgttgttctgc

SEQ ID NO: 18057 - DNA, 384 bp, Homo sapiens
tgccagactatctctctacctctcaaagaaaataatttgcattaaaattcctttttttgttatgtaatgaaagtataaaacaagaatttgtacgttactcagtgtgtactgcagtcagatatagttaaaataatttttctgatgcgtaattttaaccaccatttctggagtacctagtatgtgcaggccaaggctttgcctatattattccctttaatcctcaaagtagccttgcaaagaagttattttcattttacagaagagtcaaggattagggggttgaagtgagctgcctagagtcacatacctaaagtccaggtggatcactatgtcttgctttttcaaaagcagttctttctactacagtacaatagtttcatgttt

SEQ ID NO: 18058 - DNA, 407 bp, Homo sapiens
tcttttttcaagctggtgactcaaaatcaggcttttggaatacaacctatcatgaagcagggactgtctatagataggcaggcagaacaagtcgttcacaggcctgccagatattaaataaaggtttagagctgtaaagtttggccttccaaggatgatccttgacaatatttgatgctatgttctataaaaagtttaaagctgataagttgtaagtacagggcttcctaagcagagccagtcaaatatgagtgtgttttatgttcaacagcgttgggtgggctcagagattcaagctgcaagctgcattccagggacagttcagacccatggctggtaatgacatcacctccacaggtgccaaattattctcctctttttttccgatataacctgcccatgctttt

SEQ ID NO: 18059 - DNA, 196 bp, Homo sapiens
cctggtagaactgtagctttattttttcctatagagaagtacatgtatgtagacaaatactatgtgcatttgaattagaagggcttgtaccctacgccaattctttttaggattttggaagtccatatgatctttcattgttaggaagctgcaagctgagaaataaaaccaacttactaatgacaccttcattggg

SEQ ID NO: 18060 - DNA, 468 bp, Homo sapiens
cccatgtagggatgagtaaagtggggtccaaggtcacagggctcaaaagtggtgactctgaagaccagacccaggcagtctggctccagaacctctccagctctacctgggagagtaaatggaatcaaggaattttggagggaggggctcagtgttttgttttaaagaggagaggcccatcggttggcaaggtggagggcattttgtgtggaccagaagtaataacacctgcaaactcctgatcaagctgagggaaggtggcctcatgatggagcttgtaggtatagtttggcagctgtgggagcacatggaggaaaagaagactgaggctggtagggggtggtgtgtatgagggtatactatgccaagctcagaaggatggctgagtccgggcatggtggctcatgcctgtaatcccaggactttgggaggctgaggtgggtggatcacttgaggttaggagttcaa

SEQ ID NO: 18061 - DNA, 2658 bp, Homo sapiens
  misc_feature (991)..(991): n is a, c, g, or t
  misc_feature (1120)..(1120): n is a, c, g, or t
  misc_feature (2552)..(2552): n is a, c, g, or t
acataagcaagggaacaccaaagtcctttgatagtgcttcagcactccttcacaaaatcaaattgaggtagtagtgaggccactgtggggatgtagtagccaatgatgtatcatttatcttgggacacacctgaaagttttaatggcaaaagctgaagttttggaaatctgtcttccttttgagctaaggctttaattctgcctcctctttgatcttcccttccaaaaagctgcctttgagaaatggtacaatttctctctcatgtttaagaggtttgtgacattagctacctggggacattattgtccatcagagaacttatataaagaaaacaaaaaaagatattatatgcacagacactgtctaatggattcttcctgtttcccactcctcttatcttccttgactcagcacaaaagtgctcaacaggccataaactcaaaagaccctcctccctgttagagctaaaaatcctgcgtgataacctttcagatgctcagttaagggcaaatttgtaactgagttttaaaacttggtgtgttaccctaagacttatcaagaaaagaagaaagagactcgaggggttttgaacaaggagttaggaataggtgaaactttttatcatgtttgttcctactgtgtggggttttgggggagtcaggaatggtatccacaagactttggcatttatgatgatattcctgccttgttccggaattcctctatttatccctttgcatgaggacagtgtcaccactgtctattgctaggccctaaattatctcaagaaagggcttaagggtggtgaaggggttgtggaattaccttcccctctcacttttccattctctcttctgccctctccctccttcctcatttcttttccctttactctccttccttcctctcttcttctcccctccctccctctctctcttccttcctttctatttttttacagtacttgctaagtatctactattgtcagtnaatgcacaatgatatgcaataatcatgatagacgtaaactgaggaagtttataagataatgggagaaaacaatttcccaaatcaaaggatcacaaaaatgcactttagcctaggcaacagtgagacgcnatcttaaaaaaaagtagaatgaacaattgtggtgaatcatttggtgaaaaggcacatgatgctataagagcataaaacaaagggatcttataaatatgtgagatttccgagtaatactatttcttggtaatacttaagaaaagaaaaaagctaaatcttaggtagtatctcatctccaccacttactatttaaacttgggcaatttgtttaagctctttgactcataatttgcttatcagtaaagcagagataataatatctacccccatcctcagtttatgtaattggaaatactaaatttgaaatatttagttgacgtacagtgagaatttaatgaaaggtatttcttatcactaagttcttatttcagtggtccttttggtcactgaaaggtgtcaaattcttgctgctatttggtttgtatattaattgcaagtgtaagaaactgaagttatacagactgaagtgagaaagggagattattctctgatgtaatttaaaagtccagtttatctgcaggtacagtttgattcaggtgttcaaatgatgtaattgggaatgtttctctgattctcttcctatgccattctctttgttcccttacttctcgggcaaagagggtctctttccacagtgaaggcttatattctattagccaagcaaacccagtggggaggaaaatgttcccttcctcactagtccctgcagacgttcctgggctggatctccttggactacccctgaacctgttgctgaactggtgctttcttctctttggctatgcttaagtctcctgcctgttcttggagaggagctagaggaggatcacgagacacccaaactacatgatctcagaaagtggggaagagtggcttcccagaggaaaattattgttattactaacaaaaagtaatagaggccgggcgtggtggctcatgcctgtaatcccaggatttggggaggctaaggcaggaggactgcttgagttcaagagtttgagaccagcctggacaacatagtgagatcccatccccacaaaaaaataaaagattagtccgacatggtggtgtatgcctgtaatcccagctactctggaggctgaggtgggaggatcacttgagcctgggagaccaaggctacaggaaggaaggaaggaagaaaggaaggaagggaggggaggggagtggaggagaggggagggcagggcagtttaggtgggaaggaaggaagggcagtttaggtgggaggattgctaggatggaaggaagggaggaaagaaggaaagaaagaaagaagtagagctgaggtgggaggattgctgaggccaggagttcaagaccagcctgggcaacatagggagaccccatctctacagaaaaattcaaaagttagctgggcatggtggtgcatgcctttagtcccagctactcnggagactgaggcaggaggattgcttgagtccaggagttcagagttacagtgagctttgattatgccgttgtactccagcctgggtgacagggagagaccctgtctc

SEQ ID NO: 18062 - DNA, 484 bp, Homo sapiens
agcaccagcccttctagattgtgtagcatttcatcaacaaaaatgactccaggagaccattcttgggtacatttttccacaaagaaaggatgtaaatgacaaaaagaagaaaggcatcggtcactgagagaaggcgtgtgacttctagatttgcaagcagggaaaatgaaagcagaattgccaaaaaagagaaattaaagtagggttgaggagtccaaaaaacagataagggggcgagagggacaaaggggcacgtttgcggcttggggagctaaaatgctttgcaaagacccatgaagcccaagctgctgtttgtttctaacagtgggtcattaaaatcctgtgattgctcaggtggtgggatgccctagtgccctttcattaaagtctgggaaaatctgaacagtgttgtgatgaaggctgctcccctaccctcgcctccccaggtctcctgagtttcaatttaatgagatttttactgcgt

SEQ ID NO: 18063 - DNA, 384 bp, Homo sapiens
acactttagagaagcagcatgctcaaatcacatagatggtaggtgggaaggtaggcttgtttttcaacactgtaagatcttgggcagccataaaaaagaatgagttcatgtcctttgcagggacatggctgaagctggaagctatcattctaagcaaactaatacaggaagagaaaaccaaacaccacatgttctcactcataagtgggagttgaacaatgagaacacatggacacacggaggggaaaatcacatactggggcctctcgatgggtggaggacaaggggaagaagactattaggacaaatacctaatgcatgcggggcttaaaatgtagatgatgggtcaataggcgcagcaaaccaccatgacacatgtacacc

SEQ ID NO: 18064 - DNA, 255 bp, Homo sapiens
ggaattggttagacaacatggaagcaaagctgtaatcatggatttcattctttgggttattgagcttcatttgcaagtgatcaggtccatggttatacacatatattgcaaatttgagttgtaacacatgcctaccagaggacaaataagtatatgtcctgccaatacctggtaagaggtttcttcattgacaacacatatgtagggaaattcttacttgcaatggattaaaaacgtattttgtcttggaaacac

SEQ ID NO: 18065 - DNA, 202 bp, Homo sapiens
gctataattgctgcttctcactatagaggtgcaaagagggcagtggtcattgttgttgtgcctgccaccattactgcaagcccctcctcctcctctggatgaagtgatttccaggagtacttaaaggaccagtccccctttttccctttgggagccagacattcagtactcatacattccaaagcaactgcttatacaggga

SEQ ID NO: 18066 - DNA, 490 bp, Homo sapiens
gcaattcatccagctaaatagcctctaatgctatcatgaatgaagactatagaggtttatcaagatgaaaatagcccattaagaattgatctgaaccagtttagagaagcagagcctgagacctggcctgtgcagctttggctagtaaaagttcacttggtgctgggcatataccagctccacaggccccaactttattagtgtggagataagctgattaggtcctgtcaatcaaaggtgcccatatctcaattgagagacacacactctctctcgatttttctttaagcattgaagcaggcaacaaagaaagagatgtgtggtatgcatccctacggttgtcaccatgcagggtgcaagggtcctgtgatgatgtggtgactgtattaaagagtacatcaatttgttttaaagtgttttgattttttatggtggcattaagagagagaacattgtggttgcagctttactagaaagcaaagagttctag

SEQ ID NO: 18067 - DNA, 409 bp, Homo sapiens
ggcacgagggtaggcgctgaggctgcagagactcgctgtatcccccaggctggagtgtagtggcgtcatctcagctcactgcaacctctgcctcccgagttcaagcaattctcctgttgccttggtctcggggtcgctgtaggcgctgaggctgcagctatcatggtgaacttacttcagattgtgcgggaccactgggttcatgttcttgtccctatgggatttgtcattggatgttatttagacagaaagagtgatgaacggctaactgccttccggaacaagagtatgttatttaaaagggaattgcaacccagtgaagaagttacctggaagtaaagactggctagattatcgaatgttcacattttaaagttctgagagaaataaaaacatgaagaatctgaaa

SEQ ID NO: 18068 - DNA, 724 bp, Homo sapiens
acagtgacattattgaatatagttttcttttttctctcatatcttttaatttcctttctaaatttagttttcagtaattacagctttacctaaagaattccatttctggcaaaattgtattaaatttgtttttgcattgtgagaggttctaaatatgttttacacaagtaaaagtcctaaatgagagccaggtgcagtggtgtatgcctgtggtcccacctctccagtagctgggataacagacgcgcaccaccacacccggctaatttttgtgcttttagtagaaatggggttttgccatgttggccaggctggtctcgaactcctaatctcaagtgatctgcccacctcagcatcccaaagtgctaggattacaggcatgaaccaccgcacctggcccagatgcaatttaaaagctatttcaaaaaaaaaacaaagcagttgtatttctgataatttttttttcttttagctatcatggtgaacttacttcagattgtgcgggaccactgggttcatgttcttgtccctatgggatttgtcattggatgttatttagacagaaagagtgatgaacggctaactgccttccggaacaagagtatgttatttaaaagggaattgcaacccagtgaagaagttacctggaagtaaagactggctagattatcgaatgttcacattttaaagttctgagagaaataaaaacatgaagaatctgaaa

SEQ ID NO: 18069 - DNA, 338 bp, Homo sapiens
ggtcccgaggtcgcagcttccactggcgcgggttgagttccctgttgcccttggtctcggggtcgctgtcggcgctgaggctgcagctatcatggtgaacttacttcagattgtgcgggaccactgggttcatgttcttgtccctatgggatttgtcattggatgttatttagacagaaagagtgatgaacggctaactgccttccggaacaagagtatgttatttaaaagggaattgcaacccagtgaagaagttacctggaagtaaagactggctagattatcgaatgttcacattttaaagttctgagagaaataaaaacatgaagaatctgaaa

SEQ ID NO: 18070 - DNA, 461 bp, Homo sapiens
cgtagagatgtgacccagtgaccgcccgctaaccggactggagagaagaccggcccggatcccacgcctggcctgaagcagggaagacgctgcctcccctccgcgagcagcttacattcgtccaagttccagccttctgtcttctcgctaacctcgctctcttccaaatcgcaaatcctcttgagccgacaccgttgcgcctaaatgatctatcatggtgaacttacttcagattgtgcgggaccactgggttcatgttcttgtccctatgggatttgtcattggatgttatttagacagaaagagtgatgaacggctaactgccttccggaacaagagtatgttatttaaaagggaattgcaacccagtgaagaagttacctggaagtaaagactggctagattatcgaatgttcacattttaaagttctgagagaaataaaaacatgaagaatctgaaa

SEQ ID NO: 18071 - DNA, 694 bp, Homo sapiens
  misc_feature (378)..(378): n is a, c, g, or t
  misc_feature (393)..(394): n is a, c, g, or t
  misc_feature (401)..(401): n is a, c, g, or t
ggtcccgaggtcgcagcttccactggcgcgggttgagttccctgttgcccttggtctcggggtcgctgtcggcgctgaggctgcagctatcatggtgaacttacttcagattgtgcgggaccactgggttcatgttcttgtccctatgggatttgtcattggatgttatttagacagaaagagtgatgaacggctaactgccttccggaacaagagtatgttatttaaaagggaattgcaacccagtgaagaagttacctggaagtaaagactggctagattatcgaatgttcacattttaaagttctgagagaaataaaaacatgaagaatctgaaaagcaaaaaaaaaaaaaaaaaaaaagaaaaaaaaaattttngggcggcttgggccnnggaaaangtttttaaacacattctgtttgggggccgggggccccatgtgtgtatagggacacatggggcaaaagggtgtcccctaagggaaacccggggcaacgacaaaagggcggggaggtcttccacacaatataaaaaagacgcgccgggggggaaacccgaggggtggtgtttttgagacaattctcccgaaggagggaggttccaaagagggcacataaggggagtcttttacaacagggggtgtcccaaaggaggacgtcagatattcaaaattagccccgtgctcgtggggga

SEQ ID NO: 18072 - DNA, 691 bp, Homo sapiens
acagtgacattattgaatatagttttcttttttctctcatatcttttaatttcctttctaaatttagttttcagtaattacagctttacctaaagaattccatttctggcaaaattgtattaaatttgtttttgcattgtgagaggttctaaatatgttttacacaagtaaaagtcctaaatgagagccaggtgcagtggtgtatgcctgtggtcccagctacttgggaggctgaggcaggaggaatgcttgagcccgggagttgagagctgtagtgcctgtgaatagccactgccctccagcctgggcaacatagcaagaccttgtctcttttacaaaaaaaagttccaaaacaacatgaggagggtgcaaacaatcagctgttgcaggtagaatttttttacataccatctctgtttctctgctctgtatcgtatcacatcactattgaagctagtagtaaaatgtaataaatagacccagtgtggtgtaattttatattaatcattgtcccgtatgtaatcttcatcaattagattttaaagtattatactacattctgatgccaggcaaacaaagaggcgtattaggcttttaacatctattacatctatgtctatcatcttcttgtttcagatgcaatttatttattttattgagatggagtcttgctctgtcgcccaggctgaag

SEQ ID NO: 18073 - DNA, 282 bp, Homo sapiens
cctcagcctcccaaagtgctgggattacagctatcatggtgaacttacttcagattgtgcgggaccactgggttcatgttcttgtccctatgggatttgtcattggatgttatttagacagaaagagtgatgaacggctaactgccttccggaacaagagtatgttatttaaaagggaattgcaacccagtgaagaagttacctggaagtaaagactggctagattatcgaatgttcacattttaaagttctgagagaaataaaaacatgaagaatctgaaa

SEQ ID NO: 18074 - DNA, 797 bp, Homo sapiens
  misc_feature (481)..(481): n is a, c, g, or t
  misc_feature (496)..(497): n is a, c, g, or t
  misc_feature (504)..(504): n is a, c, g, or t
ggcacgagggtaggcgctgaggctgcagagactcgctgtatcccccaggctggagtgtagtggcgtcatctcagctcactgcaacctctgcctcccgagttcaagcaattctcctgttgccttggtctcggggtcgctgtaggcgctgaggctgcagctatcatggtgaacttacttcagattgtgcgggaccactgggttcatgttcttgtccctatgggatttgtcattggatgttatttagacagaaagagtgatgaacggctaactgccttccggaacaagagtatgttatttaaaagggaattgcaacccagtgaagaagttacctggaagtaaagactggctagattatcgaatgttcacattttaaagttctgagagaaataaaaacatgaagaatctgaaaaaaaaaaaaaaaaaaaaaaaaaaaaaaaaaaaagcaaaaaaaaaaaaaaaaaaaaagaaaaaaaaaattttngggcggcttgggccnnggaaaangtttttaaacacattctgtttgggggccgggggccccatgtgtgtatagggacacatggggcaaaagggtgtcccctaagggaaacccggggcaacgacaaaagggcggggaggtcttccacacaatataaaaaagacgcgccgggggggaaacccgaggggtggtgtttttgagacaattctcccgaaggagggaggttccaaagagggcacataaggggagtcttttacaacagggggtgtcccaaaggaggacgtcagatattcaaaattagccccgtgctcgtggggga

SEQ ID NO: 18075 - DNA, 787 bp, Homo sapiens
  misc_feature (739)..(739): n is a, c, g, or t
acagtgacattattgaatatagttttcttttttctctcatatcttttaatttcctttctaaatttagttttcagtaattacagctttacctaaagaattccatttctggcaaaattgtattaaatttgtttttgcattgtgagaggttctaaatatgttttacacaagtaaaagtcctaaatgagagccaggtgcagtggtgtatgcctgtggtcccacctctccagtagctgggataacagacgcgcaccaccacacccggctaatttttgtgcttttagtagaaatggggttttgccatgttggccaggctggtctcgaactcctaatctcaagtgatctgcccacctcagcatcccaaagtgctaggattacaggcatgaaccaccgcacctggcccagatgcaatttaaaagctatttcaaaaaaaaaacaaagcagttgtatttctgataatttttttttcttttagctatcatggtgaacttacttcagattgtgcgggaccactgggttcatgttcttgtccctatgggatttgtcattggatgttatttagacagaaagagtgatgaacggctaactgccttccggaacaagagtatgttatttaaaagggaattgcaacccagtgaagaagttacctggaagtaaagactggctagattatcgaatgttcacattttaaagttctgagagaaataaaaacatgaagaatctgaaaaaaaaaacctttagnaggggtaaattcgagcttggcgtaaacatggcatagctgtttctgggt

SEQ ID NO: 18076 - DNA, 622 bp, Homo sapiens
ctagtagtcttttttttttttttgagacagcatcacgctctgtcgtccaggctagagtacagtggtgtgatctcaggtcattgcaacctccgtctcttgggctcaagcaatcctcccacctcagcctccgaagtagctgggactacaggcatatactaccacacccagctaattttttgattttttgtagagacagggttttgccatgttaaccaggctagtctcaagctcctaggctcaagcgatccatccgccttagtctcccaaagtgctgtggttacaggcatgagccacctagtagtcactctataaaagtaaattttcttctccctttgcctttttttttctttcttttttttctgagacagagactcgctgtatcccccaggctggagtgtagtggcgtcatctcagctcactgcaacctctgcctcccgagttcaagcaattctcctgcctcagcctcctgagtaactgggactacaggcatgtgccactacgcccacctaatttttgtatttttagtagagatggagtttcaccatgttggccaggctggtctcgaactcctgaccttgttgtcgtccacccgcctcagcctcccaaagtgctgggattacag

SEQ ID NO: 18077 - DNA, 482 bp, Homo sapiens
  misc_feature (442)..(442): n is a, c, g, or t
  misc_feature (451)..(452): n is a, c, g, or t
  misc_feature (460)..(461): n is a, c, g, or t
ggcacgagggtaggcgctgaggctgcagagactcgctgtatcccccaggctggagtgtagtggcgtcatctcagctcactgcaacctctgcctcccgagttcaagcaattctcctgttgccttggtctcggggtcgctgtaggcgctgaggctgcagctatcatggtgaacttacttcagattgtgcgggaccactgggttcatgttcttgtccctatgggatttgtcattggatgttatttagacagaaagagtgatgaacggctaactgccttccggaacaagagtatgttatttaaaagggaattgcaacccagtgaagaagttacctggaagtaaagactggctagattatcgaatgttcacattttaaagttctgagagaaataaaaacatgaagaatctgaaagatgcggccgaagttttaatttttgtctcaaanttttttttnntctttttnnttttttctttttttttttctt

SEQ ID NO: 18078 - DNA, 294 bp, Homo sapiens
taatgtgaaaggagttgttcacaggttaaaagcaatcacaaatgtcatggtaataaaatggtcttttttttccagttgcacaagagggctttgaaactagttcgttttgccctttattcattaaagtgtaattcatgccttatactctgtcactttcatttgtcgagatggaccaaaagctttggaggtggcctagaaaaaatatctgtggcccacttacaaggttgcttttcttgggaccatttttgacttcgctaataatgtaatagggtgaagctgattgttcttttgaat

SEQ ID NO: 18079 - DNA, 502 bp, Homo sapiens
ataattatgtattacgatatctaaaaactacataaaatatttgtatctattaaaatacatatacaagttaacattttaaaatagagttttatacacaaatatattagcaattcctatatagtatatatgtgataccgcatatttatccagaattcagaaaattcaattgtttttatttaatatatatccctttaatataataagagtgtaagtatattaatgattttaaagatccagaatatcatccgagtgcagtggctcacacctgtaatcccagcactgggaggtggaggcaggcggatcactttaggtcaggggccaacatggtgaaacctcatctctactaaaaatacaaaaattagccaggcgtagtggcgcatgcttgtaatcccagctacttgggagcctgaggccagataatcccttgaacccaggaggagaggctgcagtaagccaagatagcaccactgccctccagcctaggtgacagagcaagactccc

SEQ ID NO: 18080 - DNA, 519 bp, Homo sapiens
ttctacaagaacctgctaaggtcagtcacatctctcttcacctgccttgagtgcttcataatcacgtggctttttcaggaatttcagtgatcaaagatcttctaattctgtgctaccactgacgtttgcacttaatacagagccatttgctctgtggccacctgataaatatttgctgatgataagacaaaaatatacacgtctattaagaggtctgcaatgtctgaacacagtgagggagaaaaatccttagagaaggtcgcttaatctcaattacccaaagtcattgcttggcagaatatctgtggtctgttatccttagtgaagtgacaggcttggagaagcagggtaatgtggggaccatgtgtgctatataaaccaaagactgatcaccatccaaatgaacacatgtttcttccattgactagttgaattttctcccaatgttctcataaataaaagcgaaggtgggttgcatggttgaatgaaaccattaaaccttatggggttttctgttgc

SEQ ID NO: 18081 - DNA, 444 bp, Homo sapiens
ctttttaatttttatagtcataggcttatttaaaaatgttttttggtttttattctgaagtggtcagaagattaaatagagtattccaagagaagcactgagagcggtacctgctgtgtaatatgtgctatgtaaatgttaactgttcatttcttattatgtcatcagtgttccagggtagaaaatgcataacctggctgggcacggtagctcacacctgtaatcccagtactttgggaggctgaggcaggcagatcacttgaggtctggagttcaagaccggcctggccaacgtggtgaaaccccatctctgctaaaaacacaaaaattagccaggcgtggtggcgggcacctgtaatctcagctactcaggaggctagggcaggagaatcgcttgaacccaggaggcgcactctgcagtgagctgagatcgtgccaccgcac

SEQ ID NO: 18082 - DNA, 212 bp, Homo sapiens
gtgtttcttaaagtagtttccataaaacattagttacatgatctgttactagatatcatgggaaaaatgggttccaaggtcaaataagtttggaaaactcaaatgacacattttaagcagacttgcagaagtgttttttaatttcaaagatctcaaaggctttagtctgctgatatccattgtgactcttcaagatgacagtatagtctata

SEQ ID NO: 18083 - DNA, 512 bp, Homo sapiens
  misc_feature (457)..(457): n is a, c, g, or t
gcactgtaggccaggagttcaagaccagcctgggcaacatagtgagaccccccccccatctctacaaaaaaataaaaaaatcttcccgttgctgtatgtggagcccctctagattgtcagtgatagaaaccacttcaaactggctcagccctaaaatagcgatgattttgtggctcacgtaactgaggattccaatgggcacagctggttgcaggccccgctggacccagctctctgctgggccccaggcacttgctggcagcttcccacccactgtcagagcctgtccccccggtggtggtctcacaccatcttcacccctcaactccagggggtgacgcttcctgggcccacctggggttccttgcgcctttccctgaaccaccctcggtgaaccagggttgggtgaccagacctgggaggttggggttgccttgttggagcctgttgggagganggggagaaggttggttcccttgtttgggttgggcagggggcgcgtcttgtggagt

SEQ ID NO: 18084 - DNA, 392 bp, Homo sapiens
ggaagcagacctaggtttgagtctcttactgatcctgtgacctagggcaagtaacttgggctctgtgaacctcagtttgctcatctataaaatgggaatggtaacactgtctcctggggttgtgtgaggatgagggaaatgtgtaaaccccaaacacagcacctggcacggagtgggtgtaagaccccgttcccccttctttctccctccccaacagtgccctgactcatggttgacctctgaggacagcatttatttccagactttcactatcaagaactctcctttttattatttttcccatgctttgggagattttgatcccaaattgcatgttttaagtcattattaatttatctcccattttttattaatcaaagacacagatagct

SEQ ID NO: 18085 - DNA, 387 bp, Homo sapiens
ctaacattgtgcagaactgtgttctcagccagtgctatctaatggaaatagaaagcaagccacaagtgtgggctgcatacgtagttttcagatttgtaatagacacattaaaaaagcaaaaagaggccgggcatggtggctcgtgcctataattccagcactttgggaagctgaggcaggaggatcacttgagcccaggagttagagaccagcctgggcaacaccctgtctctattgttatttttataaaatttaattgtttaaaaaatacgggaagtaaaaagaaacagatgaaattaatttaaacaacatagaactacacaggggttaagggcactagctccctgtgcagttgaaagtccatgtatattttctgaaagtagactc

SEQ ID NO: 18086 - DNA, 501 bp, Homo sapiens
aatcaaaatgacaatgacctaccacttctcacctattaggatggctataaccaaaataatggaaaataacaagcgttgtgagatgtggagaaatctaaacaatacttgtttatgttttgtctgcatattcactgtgctaatctattccgccattgatggtgggagtgtaaaatagtgcaagcactctggaaaacagtttgacagtacttcagaacatgaaacacagcaatactatatgacccagcagttccactcccaggtatatatccaagagaattgagaacataggttcacacaaaaacttgtacatgaacattcataccagcattattaataatagccagaaagtagaaacaacccaaatgttcttccgctgatgaatagataagcaaaatatagtctgttcatacaatgggattttactcagccataaaaaagaaagaagtactaataaatgctacaacatggaagaaccctgaaaacactatgccaggtgagaga

SEQ ID NO: 18087 - DNA, 859 bp, Homo sapiens
cagtttcatgtgcttaagcaactttgcttcaggtcacaccctacgggacacccacggcagcctgccgcctactaatcatagagcccttcgtgttccttttttgtctttttcttaaccaacaatgggtcatttagcaggacatttatttcagtcctaagttgtattatccctggtaatttgcatataccattattaaagtgtggcagtcttttgtaattattgtcttaatctagtgaaaaataatatatctgtatatctggagagaaggctgttctctggatgcagctgagcacttgcatgcactcgatgaacgggaataggactgcatgaggctgacctggatttgacaaccgcaccaggacaaggccgcgtgctgccctgaacagtggcccttgtgctaaatacgaatcctctctctcccacaggcatagcccgtcacctgcgtctggtttttgcctcctcattttcttcaattttcactctatttatagttgagaaccttccatttccccctggttgaaatacattagttgcctatggaaactgcgatccccccggtgtggatggagctgaatgacacctacaattgcagagcacggttggcgttgccagggctgggaaatgggcgtcgtggctggagagggcactgaagggcacagatgagaataatgacagcacacagcacgaccgtcaggaaccgacgcagcaccactgggtcagaagttgtggaagaagccatgggtaacagaagccccccatgccctacaccacacagaggggcgggtcccatcagaggcctaacccctggagggctctcattttcaaaacataaaaaatggagctatagctggtacttgca

SEQ ID NO: 18088 - DNA, 473 bp, Homo sapiens
cagtttcatgtgcttaagcaactttgcttcaggtcacaccctacgggacacccacggcagcctgccgcctactaatcatagagcccttcgtgttccttttttgtctttttcttaaccaacaatgggtcatttagcaggacatttatttcagtcctaagttgtattatccctggtaatttgcatataccattattaaagtgtggcagtcttttgtaattattgtcttaatctagtgaaaaataatatatctgtatatctggagagaaggctgttctctggatgcagctgagcacttgcatgcactcgatgaacgggaataggactgcatgaggctgacctggatttgacaaccgcaccaggacaaggccgcgtgctgccctgaacagtggcccttgtgctaaatacgaatcctctctccctaccgcatcacccgttcggcttcctcagagtcacctgcaactgcagctgctggt

SEQ ID NO: 18089 - DNA, 282 bp, Homo sapiens
acaccatctcctcagaaatctcttatgtcttattggcatttactttgagatagagagggtggatggaaaggtgaaatctaaaagggcatgagcttacccatgatcaaatagctcctaggtagcaggaataaaaatgtacccagtttcctgactcaggggttcctgattgcctgctttatgtttttttcaatgattctccatcactgtttgtatacgtgtaatttttaaaaatttgtttaacttagttcatgtttttctaggagatgctagtctctgatagat

SEQ ID NO: 18090 - DNA, 647 bp, Homo sapiens
cctgccccagtatggcctcattcatggtagacaattgaaactctcaggaattcctccctgcccaaaagtagctagccctcatgtccgctgctatgcaggagggaggtatgtcctggtagtcatcaaatggtgtgcttgaaacacagtggcctgctggaaatggtggctcacacctgcctgtaatcccagcactttgggaggccaaggcaggaggaggaccctcatctctatgaaaaactcaaaaatcatccaggcacggtggtgtgcatgtctggtcccagctacttgggagcctgaggtgggaggatcccttgagccttggaattcaaggtggcagtgagctatgatcacaccactgcacccagcctcagtgacagagtgaaatcctgtttctaaaaaacccaacaggccaggtgcggtggctcacacttgtaatcccagcactttgggaggccgaggtgggcagatcacctgaagtcaggagttcaagaccagcctggccaagatggcaaaaccatgtctctactaaaaattcaaaaattagccggccgtggtggtggacatctgtgatcccagctacttagggggctgaggcaggagaatcgcttgaacgggggcaggtcggggcagggtggcaactccctctt

SEQ ID NO: 18091 - DNA, 538 bp, Homo sapiens
gggcacagtatttcaataaaatacaggtagttaagtaaaggtaatttctagttgagtacataactgagacagaaaatatgtgcatagcaattttaaggtatgttaataaaaaagataaagaatttactaaaattaaattgcaagaattctgcaaccatattttctttgcaatttaattttctgtattttaatttcttgggatatatttatatttggcagtataggatggaattttcaaaaacaatattgaaaagggctgggcatggtggctcacacctgtaaatcccggcactctgggaggctaaagcagaggattgcttgagcccaggagtttgagaccagcctgaacaacacagcaagactctgtctctacaaaaaacaaaaaaacttatctaggtgtggtagcacatgccggtagttccatctacatgggaggctgatgtgggatgatcacttgagcccagtaagtggaggctgcagtgagctgtgatggcactactacactccagcctgggtgacagagcaagaccttgtctca

SEQ ID NO: 18092 - DNA, 417 bp, Homo sapiens
tgtggtggaggaaagaaaaagatggggacaaaggaaaggtaggagtgagaataaagcacgcatggtgaaccacaaataaaaatcctccgtccccactcaagttgattatgcagagcagtaattctaaatagcctctttcaatcagactgtggggcactcactactgcctccctgacccagggcccccaaacgtgctgaaatccacagctctgtcgttcttcttcaccactgcagatgttagtgtggccattcatttctcttactccacccggcatccttccagccacgggctgcgatgctcagacgagctaagacgatgctcagcgtttgtcttagctcctccaggagagaccccagctggagctgggcgtgccgctctccggttccctcaggctaagccggcagcagctgcgtggt

SEQ ID NO: 18093 - DNA, 420 bp, Homo sapiens
ggcctttggtatccagtaaaataaatggagagacgctcagtaaatgtcttttaagtgagtgtcctaataaatgttccctaaagtgtttatttgagtcccgtgtcttatatcatttgacagaaccacacaatttgggttctgtgaggtggatgctagggtctaggtgagatcgttctggttaggatttcctataggcatgtatcaacagagccaaagcacaattattttctccaataaaatagaacttcatttaagcacataaatacaaacataaaggaacattctgtgtaattaaaagacacaatatagagctcaagctaaagacattcatgtgtctaggtgtagttaaatgcctcactaacattcagccattctcagtcactgtaatccaaacccaatatttccctgggcttaagtaga

SEQ ID NO: 18094 - DNA, 888 bp, Homo sapiens
aatttatttccatatgttttattttactgacataataaatgtgcatatggtctgttcccctctttatggcctaattgctataaatagcctagagccctttccactgtactgaaccatcatgtattacaaggttgtttattcttgttttctgaagaagcacgtggcattaaaaattctggaaatgagagtttagaattcaatgaaaagtatactgtgaatattccctatgcataacattgcaacatattaaaaaatatatatttagctgtagtcacatagggaaaaggaaatgtccaccagtttatgttcattcctggattaaaacatatacgaatgacaaagacaaaattaaaaccgtttaaactagatgtattacccatgctcagagggagctacaggaaattctccttaatggctgtttattcttacatttgtttggaatgtggatgtaggagggccaagggcatctctaggtctttagcttccagaaacaaacaagcaaagaagaaaaaattaaaaaggaaaagtgagcaaggggacagtgtttgagggaaggattatttaggaggataattttttgaaaaatgaacacaacacgccccttttagttaaaagtccctgactgtgtcctgtgtcaggcacatcttagatgcatcccagaatgcagaaccaaaggtttctttgtggtcatcaagcaccaccaaaaaccagggatatgatgtgattcatgaagctaattattggcaaagctgagtctgatacttatgcctctaactgctaatccagtgctttgtcaatccttgctctccaacatccattgtagcatttctgatggctggaagccatatttggaggattatttttacaataaaagttgtcatttttaga

SEQ ID NO: 18095 - DNA, 648 bp, Homo sapiens
agaaaatatgtggccctcaaccaagcaagaagccggtgaaggctgggttgagaagaaacaggaatgtgagaagatagatcatcgtcaccgctgccctgtggaagctccgcgcgattatcctcaccactgccctgtggaagctccgcgccttactcagtcaatctctaccacacccttactctgtgtcagcggtggtactaggcactgaggaggagtccaataccttcctctgaaagagctggaattctagccctgcattgtccaacataactttttttttttctcagaaaagtttccataatctttcttccctcactctgttgcccaagctgcagtgccgtggtgcagtcatagctcactgcagtctcaaactcccagacccaagcaatcctcttagcctctcaaggagctaggactacaggtgcatgccaccacacccagctgattgtttcatttcttgcagagacggagtcttgctatcttgcccagtctgggagaactttttgtgatgatgggatattctacatcttcactgtccaatatgatatccagcagacacacgtggctatttccgtttaaatttagaatatggaaatgtaaagacattaagatgaaataaatgtaaaagttcggttcctcaaaaacact

SEQ ID NO: 18096 - DNA, 579 bp, Homo sapiens
gccaagatcgtgtcactgcacttcagcctgggcaacagagcgagactgtatctcaaaataaaaataattgaaatagccacatgtagctatagaggctgccttacacagcacacctctagaagggaaactaagtggtatagttgacatccttaacttccctgttaatattaaaggccggtattggtggcacttaaggattggaatgggtaaagaacttcccagcactgtacagttcttttaaagcacaaagcttgggagaattaatatatgcaggataactgaacgcaagagacttgtggaatgcagttctaacctgataattgtgtgttaatcgggagtaacaggacaggccgttacggttggttacacctacttatgctagatgcataatgtttggagccttccccactgatgagaagcaatttatgatcttgtgctagaaagttaataatgcttcacagcatctttttgagaggttgattagaaaacacacacatacacgttggtagtcacttgtgggtgaagcctgaaggggctatacaatttattttctttcagattgactgatggctttatgga

SEQ ID NO: 18097 - DNA, 267 bp, Homo sapiens
atatttggcatctgcctgggtgtctagaagaaaagatggcaaaaaagcaaagcagtgcaaaaggaggtgtgcacaggtcctgcctggtcgcctgaaatccattctcagatgccaaacatgcttcagacagaggcattctccaagaaccagcacactggcactcttagaagaggccttaatgtgatgccctgttctacacaaggataataaccatcccccatagccaccccccacctacagaaaagaaagagtaaataccctgctttt

SEQ ID NO: 18098 - DNA, 383 bp, Homo sapiens
gggtttcaccacgttagccagcatggtctcgatctcttgacctcgtgatccgcccgcctcggcctcccaaagtgctgggattacaagcatgagccactgcacccagcccttctggctctttttaaatgtcagatattgataactcccagactgaattaagattttatatgtcagatgattaactatcattttgagttgttgcttagttctctgcttgcttggcaacaggtcagtttccatggtattgccatttttgtaccgcattcttagtggagctgagaggttgggggtgaggctacagggccgaactctataaactagaatagctaaacttttatccagtttggtgtataaaattttttgatatacagctcaggaaaagc

SEQ ID NO: 18099 - DNA, 4407 bp, Homo sapiens
tgggggcgtcctccttcgtccccgcccggctgtcaagctgtgttctagcggccgagggaccgaggggggctaagaaagggggcgcccagccatgcagaggcaaaaaggcgctgcggaacggggtccccgtcgccagtgctgaggcaggaggtcggagccacaagtgaggggctgggaagcaggacccagcacgggcgtcttggcaggcggccgggcgcagggccaggctgctggggacgctcagggctttccacccaagccatgggcgctgtcgggcactcgggggtcccctcgtggctccggccactcggcgtgggcattacgttggcttcacatcgccatccagcctcgaagccaacaggactgaaaaatagcttcggccaaacgttctcctcccgctaaggagaggggtcgagtgcgtcagcccgaggggactggagagggatgccctagccctcgaggggcggaggacccgcggttgaaggaggcagcgggagcggagagcgccctccttgaccatcgaatgcctccttctgtgtttccattcctgtcgagtgggctgggccacgctgaccaccctggaggagggacggacgacgctcggcgggctctgaccgtgccgccttcttgtggctgctgactgggatccaggagggagtgggcatggggcgcagccgcgcctccctccctccccgcctcccgggcgccggggttggcgatgtggagacgtgaggggacccgtcggctgctccggcttctccaggactccgccaggcgcccgcgcgtccctcctcacccggaggaggagaggctccgcgcggggctccgaggcgggcggcgcgcggagccggagtcccagcctcgccatgggacataacgggagctggatctctccaaatgccagcgagccgcacaacgcgtccggcgccgaggctgcgggtgtgaaccgcagcgcgctcggggagttcggcgaggcgcagctgtaccgccagttcaccaccaccgtgcaggtcgtcatcttcataggctcgctgctcggaaacttcatggtgttatggtcaacttgccgcacaaccgtgttcaaatctgtcaccaacaggttcattaaaaacctggcctgctcggggatttgtgccagcctggtctgtgtgcccttcgacatcatcctcagcaccagtcctcactgttgctggtggatctacaccatgctcttctgcaaggtcgtcaaatttttgcacaaagtattctgctctgtgaccatcctcagcttccctgctattgctttggacaggtactactcagtcctctatccactggagaggaaaatatctgatgccaagtcccgtgaactggtgatgtacatctgggcccatgcagtggtggccagtgtccctgtgtttgcagtaaccaatgtggctgacatctatgccacgtccacctgcacggaagtctggagcaactccttgggccacctggtgtacgttctggtgtataacatcaccacggtcattgtgcctgtggtggtggtgttcctcttcttgatactgatccgacgggccctgagtgccagccagaagaagaaggtcatcatagcagcgctccggaccccacagaacaccatctctattccctatgcctcccagcgggaggccgagctgcacgccaccctgctctccatggtgatggtcttcatcttgtgtagcgtgccctatgccaccctggtcgtctaccagactgtgctcaatgtccctgacacttccgtcttcttgctgctcactgctgtttggctgcccaaagtctccctgctggcaaaccctgttctctttcttactgtgaacaaatctgtccgcaagtgcttgatagggaccctggtgcaactacaccaccggtacagtcgccgtaatgtggtcagtacagggagtggcatggctgaggccagcctggaacccagcatacgctcgggtagccagctcctggagatgttccacattgggcagcagcagatctttaagcccacagaggatgaggaagagagtgaggccaagtacattggctcagctgacttccaggccaaggagatatttagcacctgcctggagggagagcaggggccacagtttgcgccctctgccccacccctgagcacagtggactctgtatcccaggtggcaccggcagcccctgtggaacctgaaacattccctgataagtattccctgcagtttggctttgggccttttgagttgcctcctcagtggctctcagagacccgaaacagcaagaagcggctgcttccccccttgggcaacaccccagaagagctgatccagacaaaggtgcccaaggtaggcagggtggagcggaagatgagcagaaacaataaagtgagcatttttccaaaggtggattcctagcaaggattgtaaattcttggaagcaacggggagcttccatattcccaccagagtgtgggaatgctgtggccatgtgattgtatgatctccttgcaactcagtgtgagttgattcctccaatatgggccagatgcttttgaatgatagggaaatctacataaaatccagtgtcctctttattgagggagtatatgtatccatctcagtgatccatgtccttagtgaagtccacattattctctgtggggacaagagctgggcagttttgaatgggtcttgaggtgggtaccccatgtgcactttctgaggatgcctcacttccctgggctctgcagagaacacacagagagaagactttcagagctcacaggagcagggagcaggagcactctaagggaattccaagatcatgatggagcatggtggctccagagaaaatgcctgtttgatgaacttaaacatgtcaaacattttctgttgagaaggtagggatttggcgtcttacactgtttctctggaagccccagtcatatgactcactgtttctcctgatacccttcgtccctttcattgggatgtaggtaaggaatgaacgattcctcacctatggtacacatggcgatagatgtgcccgggagtaagggagatattttgtccttgataattctgattttcccttggcatcaccaacgcctcagagagatacacctgcaccctccagtcagggtcagtgttggctggaaaacactgaaaagtcttcgctctgtctttcaccttaaattgtgttttctcaacaaatgagagagaagcttacgggggagatgcctgagagatgcctatggcgctgtagtttttttttcttccctatgatctcacatgaaaggtgctatgtaacaaccagtatgagtcaaatatattgaaaaaatcatcttatgcaaactttaggaattaaaaggtatttttaaaatggagagttagtgtaagctgggtcctttggaaacatcaaactgaaaaggcctgatttggaaaggtgactctgcccaaaaggttggcaagaatctgacaaagatggtttccttccgaggaagactccggaactcaggtgtggccagtctccttttcagtctgtttgtacagctgcggttctctcttaattttggacacagaggaggaacagaacagggagaaataatcattgtagagtgccaaggcaacatctgacccagatgagctcttcacttcctccttccctgtcgttgtagagccagactgggtagaagagggagggcagtgtcctcaactcatcagcctcacaagcaatttgggacccctctggggtggatttcaccaggttgaattagaaccgcagataatacttccctgttagtgaggacaaaccaagcgccagctctgcccttttctctagagtgttgtgttcttgctcttggtacttacaggagctagtctggtgccttgagcaagcttgaagggaagtgggtgtcctcaccagcaaacttccacatctcaactcgtgccctcttttggccacactggccccgtctcttggagggagcccagaccctgtagggagttttgttttcctttcttctcttgggtgtggtgtcttgtgtttctgaatgtgaacccaaagaccctacccctggagaggaagcaccttcctctttgtgttggtctcctcatagcactgtttgctcacagcagaaacggggctgccacagcctcctgcggctctgctgccttctgggccctgcgtgcatggcatctatagctccttgccctgatagtcaatgctgtggcccttcaagcttgtctttcaaagctttcacaatcattacaacttttatcaaggggaataataatctctaggaaaattatgtccactttaggagaatctgtcaagtgtagccactttggtgttgttctgataatatactgtatatgtacaacttaataaattttgatgaggcagaat

SEQ ID NO: 18100 - DNA, 4527 bp, Homo sapiens
tgggggcgtcctccttcgtccccgcccggctgtcaagctgtgttctagcggccgagggaccgaggggggctaagaaagggggcgcccagccatgcagaggcaaaaaggcgctgcggaacggggtccccgtcgccagtgctgaggcaggaggtcggagccacaagtgaggggctgggaagcaggacccagcacgggcgtcttggcaggcggccgggcgcagggccaggctgctggggacgctcagggctttccacccaagccatgggcgctgtcgggcactcgggggtcccctcgtggctccggccactcggcgtgggcattacgttggcttcacatcgccatccagcctcgaagccaacaggactgaaaaatagcttcggccaaacgttctcctcccgctaaggagaggggtcgagtgcgtcagcccgaggggactggagagggatgccctagccctcgaggggcggaggacccgcggttgaaggaggcagcgggagcggagagcgccctccttgaccatcgaatgcctccttctgtgtttccattcctgtcgagtgggctgggccacgctgaccaccctggaggagggacggacgacgctcggcgggctctgaccgtgccgccttcttgtggctgctgactgggatccaggagggagtgggcatggggcgcagccgcgcctccctccctccccgcctcccgggcgccggggttggcgatgtggagacgtgaggggacccgtcggctgctccggcttctccaggactccgccaggcgcccgcgcgtccctcctcacccggaggaggagaggctccgcgcggggctccgaggcgggcggcgcgcggagccggagtcccagcctcgccatgggacataacgggagctggatctctccaaatgccagcgagccgcacaacgcgtccggcgccgaggctgcgggtgtgaaccgcagcgcgctcggggagttcggcgaggcgcagctgtaccgccagttcaccaccaccgtgcaggtcgtcatcttcataggctcgctgctcggaaacttcatggtgttatggtcaacttgccgcacaaccgtgttcaaatctgtcaccaacaggttcattaaaaacctggcctgctcggggatttgtgccagcctggtctgtgtgcccttcgacatcatcctcagcaccagtcctcactgttgctggtggatctacaccatgctcttctgcaaggtcgtcaaatttttgcacaaagtattctgctctgtgaccatcctcagcttccctgctattgctttggacaggtactactcagtcctctatccactggagaggaaaatatctgatgccaagtcccgtgaactggtgatgtacatctgggcccatgcagtggtggccagtgtccctgtgtttgcagtaaccaatgtggctgacatctatgccacgtccacctgcacggaagtctggagcaactccttgggccacctggtgtacgttctggtgtataacatcaccacggtcattgtgcctgtggtggtggtgttcctcttcttgatactgatccgacgggccctgagtgccagccagaagaagaaggtcatcatagcagcgctccggaccccacagaacaccatctctattccctatgcctcccagcgggaggccgagctgcacgccaccctgctctccatggtgatggtcttcatcttgtgtagcgtgccctatgccaccctggtcgtctaccagactgtgctcaatgtccctgacacttccgtcttcttgctgctcactgctgtttggctgcccaaagtctccctgctggcaaaccctgttctctttcttactgtgaacaaatctgtccgcaagtgcttgatagggaccctggtgcaactacaccaccggtacagtcgccgtaatgtggtcagtacagggagtggcatggctgaggccagcctggaacccagcatacgctcgggtagccagctcctggagatgttccacattgggcagcagcagatctttaagcccacagaggatgaggaagagagtgaggccaagtacattggctcagctgacttccaggccaaggagatatttagcacctgcctggagggagagcaggggccacagtttgcgccctctgccccacccctgagcacagtggactctgtatcccaggtggcaccggcagcccctgtggaacctgaaacattccctgataagtattccctgcagtttggctttgggccttttgagttgcctcctcagtggctctcagagacccgaaacagcaagaagcggctgcttccccccttgggcaacaccccagaagagctgatccagacaaaggtgcccaaggtaggcagggtggagcggaagatgagcagaaacaataaagtgagcatttttccaaaggtggattcctagcaaggattgtaaattcttggaagcaacggggagcttccatattcccaccagagtgtgggaatgctgtggccatgtgattgtatgatctccttgcaactcagtgtgagttgattcctccaatatgggccagatgcttttgaatgatagggaaatctacataaaatccagtgtcctctttattgagggagtatatgtatccatctcagtgatccatgtccttagtgaagtccacattattctctgtggggacaagagctgggcagttttgaatgggtcttgaggtgggtaccccatgtgcactttctgaggatgcctcacttccctgggctctgcagagaacacacagagagaagactttcagagctcacaggagcagggagcaggagcactctaagggaattccaagatcatgatggagcatggtggctccagagaaaatgcctgtttgatgaacttaaacatgtcaaacattttctgttgagaaggtagggatttggcgtcttacactgtttctctggaagccccagtcatatgactcactgtttctcctgatacccttcgtccctttcattgggatgtaggtaaggaatgaacgattcctcacctatggtacacatggcgatagatgtgcccgggagtaagggagatattttgtccttgataattctgattttcccttggcatcaccaacgcctcagagagatacacctgcaccctccagtcagggtcagtgttggctggaaaacactgaaaagtcttcgctctgtctttcaccttaaattgtgttttctcaacaaatgagagagaagcttacgggggagatgcctgagagatgcctatggcgctgtagtttttttttcttccctatgatctcacatgaaaggtgctatgtaacaaccagtatgagtcaaatatattgaaaaaatcatcttatgcaaactttaggaattaaaaggtatttttaaaatggagagttagtgtaagctgggtcctttggaaacatcaaactgaaaaggcctgatttggaaaggtgactctgcccaaaaggttggcaagaatctgacaaagatggtttccttccgaggaagactccggaactcaggtgtggccagtctccttttcagtctgtttgtacagctgcggttctctcttaattttggacacagaggaggaacagaacagggagaaataatcattgtagagtgccaaggcaacatctgacccagatgagctcttcacttcctccttccctgtcgttgtagagccagactgggtagaagagggagggcagtgtcctcaactcatcagcctcacaagcaatttgggacccctctggggtggatttcaccaggttgaattagaaccgcagataatacttccctgttagtgaggacaaaccaagcgccagctctgcccttttctctagagtgttgtgttcttgctcttggtacttacaggagctagtctggtgccttgagcaagcttgaagggaagtgggtgtcctcaccagcaaacttccacatctcaactcgtgccctcttttggccacactggccccgtctcttggagggagcccagaccctgtagggagttttgttttcctttcttctcttgggtgtggtgtcttgtgtttctgaatgtgaacccaaagaccctacccctggagaggaagcaccttcctctttgtgttggtctcctcatagcactgtttgctcacagcagaaacggggctgccacagcctcctgcggctctgctgccttctgggccctgcgtgcatggcatctatagctccttgccctgatagtcaatgctgtggcccttcaagcttgtctttcaaagctttcacaatcattacaacttttatcaaggggaataataatctctaggaaaattatgtccactttaggagaatctgtcaagtgtagccactttggtgttgttctgataatatactgtatatgtacaacttaataaattttgatgaggcagaatctggttgggtatgtttcttatatatgtttgaagcagatggctgactactaacaggtcattgccaggtgtatttctatactctttgaagaataacattttaataaaaaattgaaaagcagt

SEQ ID NO: 18101 - DNA, 4594 bp, Homo sapiens
tgggggcgtcctccttcgtccccgcccggctgtcaagctgtgttctagcggccgagggaccgaggggggctaagaaagggggcgcccagccatgcagaggcaaaaaggcgctgcggaacggggtccccgtcgccagtgctgaggcaggaggtcggagccacaagtgaggggctgggaagcaggacccagcacgggcgtcttggcaggcggccgggcgcagggccaggctgctggggacgctcagggctttccacccaagccatgggcgctgtcgggcactcgggggtcccctcgtggctccggccactcggcgtgggcattacgttggcttcacatcgccatccagcctcgaagccaacaggactgaaaaatagcttcggccaaacgttctcctcccgctaaggagaggggtcgagtgcgtcagcccgaggggactggagagggatgccctagccctcgaggggcggaggacccgcggttgaaggaggcagcgggagcggagagcgccctccttgaccatcgaatgcctccttctgtgtttccattcctgtcgagtgggctgggccacgctgaccaccctggaggagggacggacgacgctcggcgggctctgaccgtgccgccttcttgtggctgctgactgggatccaggagggagtgggcatggggcgcagccgcgcctccctccctccccgcctcccgggcgccggggttggcgatgtggagacgtgaggggacccgtcggctgctccggcttctccaggactccgccaggcgcccgcgcgtccctcctcacccggaggaggagaggctccgcgcggggctccgaggcgggcggcgcgcggagccggagtcccagcctcgccatgggacataacgggagctggatctctccaaatgccagcgagccgcacaacgcgtccggcgccgaggctgcgggtgtgaaccgcagcgcgctcggggagttcggcgaggcgcagctgtaccgccagttcaccaccaccgtgcaggtcgtcatcttcataggctcgctgctcgattgtaccagtaaaaatttaagtttaaacaaccaaacactgagagtggaaccaggagaagtgaattctcactccaagggcaaaggctttccacctggtaccaccttcccaaatggagccagtgagtgggcattccaaggcgcccagcaccatattaattgagaatggaacttacgtttcattttcaggaaacttcatggtgttatggtcaacttgccgcacaaccgtgttcaaatctgtcaccaacaggttcattaaaaacctggcctgctcggggatttgtgccagcctggtctgtgtgcccttcgacatcatcctcagcaccagtcctcactgttgctggtggatctacaccatgctcttctgcaaggtcgtcaaatttttgcacaaagtattctgctctgtgaccatcctcagcttccctgctattgctttggacaggtactactcagtcctctatccactggagaggaaaatatctgatgccaagtcccgtgaactggtgatgtacatctgggcccatgcagtggtggccagtgtccctgtgtttgcagtaaccaatgtggctgacatctatgccacgtccacctgcacggaagtctggagcaactccttgggccacctggtgtacgttctggtgtataacatcaccacggtcattgtgcctgtggtggtggtgttcctcttcttgatactgatccgacgggccctgagtgccagccagaagaagaaggtcatcatagcagcgctccggaccccacagaacaccatctctattccctatgcctcccagcgggaggccgagctgcacgccaccctgctctccatggtgatggtcttcatcttgtgtagcgtgccctatgccaccctggtcgtctaccagactgtgctcaatgtccctgacacttccgtcttcttgctgctcactgctgtttggctgcccaaagtctccctgctggcaaaccctgttctctttcttactgtgaacaaatctgtccgcaagtgcttgatagggaccctggtgcaactacaccaccggtacagtcgccgtaatgtggtcagtacagggagtggcatggctgaggccagcctggaacccagcatacgctcgggtagccagctcctggagatgttccacattgggcagcagcagatctttaagcccacagaggatgaggaagagagtgaggccaagtacattggctcagctgacttccaggccaaggagatatttagcacctgcctggagggagagcaggggccacagtttgcgccctctgccccacccctgagcacagtggactctgtatcccaggtggcaccggcagcccctgtggaacctgaaacattccctgataagtattccctgcagtttggctttgggccttttgagttgcctcctcagtggctctcagagacccgaaacagcaagaagcggctgcttccccccttgggcaacaccccagaagagctgatccagacaaaggtgcccaaggtaggcagggtggagcggaagatgagcagaaacaataaagtgagcatttttccaaaggtggattcctagcaaggattgtaaattcttggaagcaacggggagcttccatattcccaccagagtgtgggaatgctgtggccatgtgattgtatgatctccttgcaactcagtgtgagttgattcctccaatatgggccagatgcttttgaatgatagggaaatctacataaaatccagtgtcctctttattgagggagtatatgtatccatctcagtgatccatgtccttagtgaagtccacattattctctgtggggacaagagctgggcagttttgaatgggtcttgaggtgggtaccccatgtgcactttctgaggatgcctcacttccctgggctctgcagagaacacacagagagaagactttcagagctcacaggagcagggagcaggagcactctaagggaattccaagatcatgatggagcatggtggctccagagaaaatgcctgtttgatgaacttaaacatgtcaaacattttctgttgagaaggtagggatttggcgtcttacactgtttctctggaagccccagtcatatgactcactgtttctcctgatacccttcgtccctttcattgggatgtaggtaaggaatgaacgattcctcacctatggtacacatggcgatagatgtgcccgggagtaagggagatattttgtccttgataattctgattttcccttggcatcaccaacgcctcagagagatacacctgcaccctccagtcagggtcagtgttggctggaaaacactgaaaagtcttcgctctgtctttcaccttaaattgtgttttctcaacaaatgagagagaagcttacgggggagatgcctgagagatgcctatggcgctgtagtttttttttcttccctatgatctcacatgaaaggtgctatgtaacaaccagtatgagtcaaatatattgaaaaaatcatcttatgcaaactttaggaattaaaaggtatttttaaaatggagagttagtgtaagctgggtcctttggaaacatcaaactgaaaaggcctgatttggaaaggtgactctgcccaaaaggttggcaagaatctgacaaagatggtttccttccgaggaagactccggaactcaggtgtggccagtctccttttcagtctgtttgtacagctgcggttctctcttaattttggacacagaggaggaacagaacagggagaaataatcattgtagagtgccaaggcaacatctgacccagatgagctcttcacttcctccttccctgtcgttgtagagccagactgggtagaagagggagggcagtgtcctcaactcatcagcctcacaagcaatttgggacccctctggggtggatttcaccaggttgaattagaaccgcagataatacttccctgttagtgaggacaaaccaagcgccagctctgcccttttctctagagtgttgtgttcttgctcttggtacttacaggagctagtctggtgccttgagcaagcttgaagggaagtgggtgtcctcaccagcaaacttccacatctcaactcgtgccctcttttggccacactggccccgtctcttggagggagcccagaccctgtagggagttttgttttcctttcttctcttgggtgtggtgtcttgtgtttctgaatgtgaacccaaagaccctacccctggagaggaagcaccttcctctttgtgttggtctcctcatagcactgtttgctcacagcagaaacggggctgccacagcctcctgcggctctgctgccttctgggccctgcgtgcatggcatctatagctccttgccctgatagtcaatgctgtggcccttcaagcttgtctttcaaagctttcacaatcattacaacttttatcaaggggaataataatctctaggaaaattatgtccactttaggagaatctgtcaagtgtagccactttggtgttgttctgataatatactgtatatgtacaacttaataaattttgatgaggcagaat

SEQ ID NO: 18102 - DNA, 3163 bp, Homo sapiens
ctggaatataagagtgaagtcagagtcctttctcaagagtacttccggtactactcagtcctctatccactggagaggaaaatatctgatgccaagtcccgtgaactggtgatgtacatctgggcccatgcagtggtggccagtgtccctgtgtttgcagtaaccaatgtggctgacatctatgccacgtccacctgcacggaagtctggagcaactccttgggccacctggtgtacgttctggtgtataacatcaccacggtcattgtgcctgtggtggtggtgttcctcttcttgatactgatccgacgggccctgagtgccagccagaagaagaaggtcatcatagcagcgctccggaccccacagaacaccatctctattccctatgcctcccagcgggaggccgagctgcacgccaccctgctctccatggtgatggtcttcatcttgtgtagcgtgccctatgccaccctggtcgtctaccagactgtgctcaatgtccctgacacttccgtcttcttgctgctcactgctgtttggctgcccaaagtctccctgctggcaaaccctgttctctttcttactgtgaacaaatctgtccgcaagtgcttgatagggaccctggtgcaactacaccaccggtacagtcgccgtaatgtggtcagtacagggagtggcatggctgaggccagcctggaacccagcatacgctcgggtagccagctcctggagatgttccacattgggcagcagcagatctttaagcccacagaggatgaggaagagagtgaggccaagtacattggctcagctgacttccaggccaaggagatatttagcacctgcctggagggagagcaggggccacagtttgcgccctctgccccacccctgagcacagtggactctgtatcccaggtggcaccggcagcccctgtggaacctgaaacattccctgataagtattccctgcagtttggctttgggccttttgagttgcctcctcagtggctctcagagacccgaaacagcaagaagcggctgcttccccccttgggcaacaccccagaagagctgatccagacaaaggtgcccaaggtaggcagggtggagcggaagatgagcagaaacaataaagtgagcatttttccaaaggtggattcctagcaaggattgtaaattcttggaagcaacggggagcttccatattcccaccagagtgtgggaatgctgtggccatgtgattgtatgatctccttgcaactcagtgtgagttgattcctccaatatgggccagatgcttttgaatgatagggaaatctacataaaatccagtgtcctctttattgagggagtatatgtatccatctcagtgatccatgtccttagtgaagtccacattattctctgtggggacaagagctgggcagttttgaatgggtcttgaggtgggtaccccatgtgcactttctgaggatgcctcacttccctgggctctgcagagaacacacagagagaagactttcagagctcacaggagcagggagcaggagcactctaagggaattccaagatcatgatggagcatggtggctccagagaaaatgcctgtttgatgaacttaaacatgtcaaacattttctgttgagaaggtagggatttggcgtcttacactgtttctctggaagccccagtcatatgactcactgtttctcctgatacccttcgtccctttcattgggatgtaggtaaggaatgaacgattcctcacctatggtacacatggcgatagatgtgcccgggagtaagggagatattttgtccttgataattctgattttcccttggcatcaccaacgcctcagagagatacacctgcaccctccagtcagggtcagtgttggctggaaaacactgaaaagtcttcgctctgtctttcaccttaaattgtgttttctcaacaaatgagagagaagcttacgggggagatgcctgagagatgcctatggcgctgtagtttttttttcttccctatgatctcacatgaaaggtgctatgtaacaaccagtatgagtcaaatatattgaaaaaatcatcttatgcaaactttaggaattaaaaggtatttttaaaatggagagttagtgtaagctgggtcctttggaaacatcaaactgaaaaggcctgatttggaaaggtgactctgcccaaaaggttggcaagaatctgacaaagatggtttccttccgaggaagactccggaactcaggtgtggccagtctccttttcagtctgtttgtacagctgcggttctctcttaattttggacacagaggaggaacagaacagggagaaataatcattgtagagtgccaaggcaacatctgacccagatgagctcttcacttcctccttccctgtcgttgtagagccagactgggtagaagagggagggcagtgtcctcaactcatcagcctcacaagcaatttgggacccctctggggtggatttcaccaggttgaattagaaccgcagataatacttccctgttagtgaggacaaaccaagcgccagctctgcccttttctctagagtgttgtgttcttgctcttggtacttacaggagctagtctggtgccttgagcaagcttgaagggaagtgggtgtcctcaccagcaaacttccacatctcaactcgtgccctcttttggccacactggccccgtctcttggagggagcccagaccctgtagggagttttgttttcctttcttctcttgggtgtggtgtcttgtgtttctgaatgtgaacccaaagaccctacccctggagaggaagcaccttcctctttgtgttggtctcctcatagcactgtttgctcacagcagaaacggggctgccacagcctcctgcggctctgctgccttctgggccctgcgtgcatggcatctatagctccttgccctgatagtcaatgctgtggcccttcaagcttgtctttcaaagctttcacaatcattacaacttttatcaaggggaataataatctctaggaaaattatgtccactttaggagaatctgtcaagtgtagccactttggtgttgttctgataatatactgtatatgtacaacttaataaattttgatgaggcagaat

SEQ ID NO: 18103 - DNA, 188 bp, Homo sapiens
ccagggcctaggcaagaacagattgcactttgtggccagacgtgcttctctggtgaccattgacatttcagttgattgattttctgttatggattcttccttgtattttttgtagaatcagtactcttaaatcttgtgtgttacaaacttgcatggttgatatatctgttaaaagcctgccagctgag

SEQ ID NO: 18104 - DNA, 185 bp, Homo sapiens
gaagtaaaatatttgtctctttgttactttttactttatttttaaaagtatagaagttatagatgatggctttctttttgtaaaagattcaagaatgtcaaagcatatagggaaaaatgagaaaggccatctctaacaccactttcctttccctctccagagttagccaaaatttgggatatatc

SEQ ID NO: 18105 - DNA, 738 bp, Homo sapiens
gtcaatcagaaagaatgtcattagatcaattagctattactttatattacctaaacttagtataatttaaaatttgataatgagtttattcagtttataaagagttctgtttttggcatggcctagtagctccattgcacaattccttctgcagaaaactactataacctatgaacaaaataggaaaaataactacccgaaagcactggagagcaaacaaaagcagacagaaaatagaagtcaaacattgaaggaaggaaatagcactgggtgagtcccctgccaggtagggtggctgaaactcttgacaaacaaaacccctcagtcttgttggtctgaagaaccaaggacagggtttggtgtagctgcaggccttggaaagtgcgtgtgcatgcatactcaaagtaaattaaattgcctgcttaaatgaaaaagaaaaaaattattcagaaaaaacagaacccaaactttctactcgtattactcacaacatttgcagtagaatgcaaaattattcagtgtacacagaaacaagaagacatgaaccattctgaaaagaaatcaatggactaacttcaagataactcatatgttgctattagcagacaagaatcttaaagcagctgttgtaattgcttaagaacataagggaaaatatgtttgcaatgaataaaaataggaaatattaacagagaatttgaagtaataaaaaagacccaaatataaattctaaaactg

SEQ ID NO: 18106 - DNA, 412 bp, Homo sapiens
ataaagtctatagtagtgtacagtaatgtcctaggccttcacattcattcaccacttacacccaaaataactttgagttctaccagctccattaatggtaagtacttactatgatttgagtgacccccaatgtggcagtattaagaggtggggcccttaagaggtgattggattaatctattcaaggattgatagattaatggattatcatgggaatggggctgatggctttgtaagaagatgaagacctgagctagcatgctcagcgcccccaccatatgatgccctgcactaccttgggagtctgcagagagtccctaccagcaagaagaccctgacctgatgtggccctcaaccttggacttctcagctgctataattctaagaaataaattcatgtttttcttataat

SEQ ID NO: 18107 - DNA, 373 bp, Homo sapiens
gcagcctgcaaatccccaagagtccacgacagaatacaagaatagtaacaatgatttatctcaactgatcttagcttcttcacaaacttgccaataatgacctttcaagaactgcaccgtttgtcctcatctgcgcaatccaacagttcagaaaaactgaagaaaatgcttcttctaaaaataaaacacttgttgtgggggggactactaacaaaaaaaaaggcacactggtttttactgtactgaagcaataaactctccaaataacttcattaaggagtgtcattagcaaagaatgaacaccaaaataccgctcaatccaattttcattgtgaattccgggatctagaaaattaaatgggacggtatcact

SEQ ID NO: 18108 - DNA, 165 bp, Homo sapiens
tcttgtcatggggagcacagggaaatgctggcattgatttttaagacattccagagttcctggaaggtctgttgtgtctgagggtcccggctgcccagcgagcaaggagaagctgctgcccactcgtggggccccaggctccaccaacaccactcagaagctctg

SEQ ID NO: 18109 - DNA, 213 bp, Homo sapiens
atcttggacccaaagaggacttttctaaagagatagagatggctcagtaaaagcacacctcattactagaaaaacaacccaaaacatgtatattattaagagtgggttaacagtctcatttttacatgtaacaaagcaaaagtaaaattttaactccactgagagagccacttaagtggttgtagtgaccagatgagaacatgtcctggattt

SEQ ID NO: 18110 - DNA, 1162 bp, Homo sapiens
agcgggttggctggagctggagtaacaagatggcgtcgtcggcggagtgacaggggtccctctgggccggagccggcggcagtggtggcagcggtaccgctccccagctcactgcgccccttttccagcccggacgtcgccgcgaaagcgaggcagcggcggctgcccagaacaggtggcccagcctggtaaccgctagaagcccttcacaaactgcggcctggcaggcaaccaaccaaaaaacaaacaaagaatcctgaccgagcagcgggcatcaagttcccttcgccggcatctgggccctggacgccgggaaaggcctccgtgttccgcttcctgccgccttccacggtaggcttggcccagcctccatcttcgtctctcaggacggctagcagcagaattcattgtcggaaggaaatataaactgctttggaagatctggtgtagctccttcggagacatctgtctggcgatcagcatcaccaacggtgaagaagtggtagtgaagccagaatctcagggccaggcatccccagttgctgtacaagagcaggctttacaagatgcttcaaggtggggttggcatcccccacatacggtggtgtggtcaggaagaagactataatgtactagtcatggatttttctgggacctagcctcgaagaccaatttctgttcaagaaggttcacaatgaaaactgtacttatattagctgaccagatgatcagtagaattgaacatgtgcatacaaagaattttatacacagagccattaaaccaggaccctgatccatcaatatgactacacatttgattggacaaagttaaagcagaaagcagcacagcaggcagcctcttctagtgggaggggcagcaggcccaaaccccaacagggtatttagagaaattcaatcagagacgatggaactaaagctggcccttctgtgcatacctgtttcctaaagaaatgtttactcctggattgggtcagcccctctgcatttacctataagaatctacatacaagcttgtctatccatcctgcatagagcacaagtcacagaagaaaagctcctctccataaattgcttaacatagtaatcaatatctcttcacattttcagagtaaactatatcacttgaataaacaaaatgcca

SEQ ID NO: 18111 - DNA, 953 bp, Homo sapiens
agcgggttggctggagctggagtaacaagatggcgtcgtcggcggagtgacaggggtccctctgggccggagccggcggcagtggtggcagcggtaccgctccccagctcactgcgccccttttccagcccggacgtcgccgcgaaagcgaggcagcggcggctgcccagaacaggtggcccagcctggtaaccgctagaagcccttcacaaactgcggcctggcaggcaaccaaccaaaaaacaaacaaagaatcctgaccgagcagcgggcatcaagttcccttcgccggcatctgggccctggacgccgggaaaggcctccgtgttccgcttcctgccgccttccacggtaggcttggcccagcctccatcttcgtctctcaggacggctagcagcagaattcattgtcggaaggaaatataaactgctttggaagatctggtgtagctccttcggagacatctgtctggcgatcagcatcaccaacggtgaagaagtggtagtgaagccagaatctcagggccaggcatccccagttgctgtacaagagcaggctttacaagatgcttcaaggaccctgatccatcaatatgactacacatttgattggacaaagttaaagcagaaagcagcacagcaggcagcctcttctagtgggaggggcagcaggcccaaaccccaacagggtatttagagaaattcaatcagagacgatggaactaaagctggcccttctgtgcatacctgtttcctaaagaaatgtttactcctggattgggtcagcccctctgcatttacctataagaatctacatacaagcttgtctatccatcctgcatagagcacaagtcacagaagaaaagctcctctccataaattgcttaacatagtaatcaatatctcttcacattttcagagtaaactatatcacttgaataaacaaaatgcca

SEQ ID NO: 18112 - DNA, 1604 bp, Homo sapiens
tagtgatctagaggatccctcgctatcatcggcgcccttcccagaacttttcctgtgcgtttcagaaccattcgtgggcgtgacgttgtgttaaggtagacaggatggcatcctgcatacaattacgtatctggcgctttttcttgtttagtcttgggaaatgtcgtcaatgtatacgatccgcccctttggttgtttttgtttgttactctctctgtcgcccaggctggagtgcagcggcgcgatcccggctcactgcaacctctgcctcctgggttcaagggatcctcctgccgcagcctcctgagaatctgggattacaggcgcccgccaccacacccagctaaattttgtatttttagtaggggcggggtttcgccgtgttggcgaggctggtctcgaactcctggcctcggcctcccaaagtgctgggattcccggcgtgggccactgcgcccggcctgccccctttgtttttttctgcggcaagaggccccagatgtgttgaggctactttcgtttagccacttgctcatgaggaacattttggtgggctccagctgttgctggaaggaactgcagctgaacccatgacctctcccaagcctggtcttgtcttggggtctcagtctgggggcctgtcctgagatgctcccactatgacttggcagagtcacctgcacccttcttttcctccccccaccccactgccatggtgcccaagtcttgtctgtcagccgcggcgggaggcaggacaggtgtgagaagggagaggtgtgaggtggtttctgtgttggtgtcctggggccgttgtaactcatgaccacagactgggaggcttgcaacagcagagctggactctctcccagttctagaggccagaagtctaaaatcaaggtgtggccacgcagcctctctccagaggctcaggggagggtcctcccgctgcctcccgctcctggggccccacttgttccttggcttgtggccgcatgctccagtctctgcctctgtctttatgtggcctcttccctgtctctctgtgttcccctctctttttataaggacaccagtcattgaatttactgcctaccctaaatccagggtggtcttatctcgagatccttaattaaacacgtttgcaaagaccccgtttccgaataaggtcccattccaaggttctggggctctgggagtggacatggctttggggatcactgttcagctcaccacagtccccgaaggtagcctcacttccccgcgtctgtggtgcaccagcaggcaggtgggctcaggcctggagtgagggcccgtgcctggcgcccccaccatactctcctcctgtcatggatggagcaggtgcgatcacatccagggcaagactgctgcttttgttaaaataattcactgcagggcttctcgtaaagagtgagatttcttagtgcatctaaagcatcacattttaaaattagatccggttgacgtagatacacctgttagagaaaaggacagtcgtgtctcaaatttggaccctcaagtcattgttttcaaacaaccaggaaacgagggttgacgtggatcctttaacccagttctgctgccta

SEQ ID NO: 18113 - DNA, 166 bp, Homo sapiens
atgggactggagctagacaggtgcagaggaagtagagcggtggcgtttgcctttggtttcataatatttataaatttaatttgtaaaacaaaaattgtaataaatgttctggttttgcttttgctttatcctttgcaaaagctatcatactgtcctcattggtttc

SEQ ID NO: 18114 - DNA, 351 bp, Homo sapiens
gaattaaaaaaaaaaaaaaaaagcccaaaagaaaggattctcctgctgggcacttgtttaatgttctcagaaaagtttagaacttctaccataaatcttcagtgcacttactcttctcaacacagactattcttcattatttatatgtcactaatctaacttttaccatagaagcgttttctgatgttgacatgttgacagcagggtaattctttccacagcagaaggattcttctctatacaaaaggattcccattgaattcccttaaaaaccaaccatgaaagggatgttatgcttcatacaaagtttgctttaaaataaaaacaaggacctttaatgcattcaaaaca

SEQ ID NO: 18115 - DNA, 434 bp, Homo sapiens
gaggtgtttatctaactctccctagtgggagatggggaaattttcactgagaatgtaactctgcaccatgagcagatgtttgctaagtgggcaaggattgagtgggggatgtcttaaactgagggaaaacatttgtaaaagcagaaaggggtgaggatatgacagcaaatttactatagctaacatgagagagaagaggaagggtagtaaatagaattgaagagggtagccaagggccaaatataaatttgtattacaagctaaggaatttttatccagtcataaagagccactgaaagattttatgcaggggattataatgatcagattagcatattaagaagatgattttggcaatagtatggagtctggttgatagggaggccaggtaggaggctactgaagtagtctggacaagagatgaagtgtaccta

SEQ ID NO: 18116 - DNA, 252 bp, Homo sapiens
  misc_feature (4)..(4): n is a, c, g, or t
  misc_feature (66)..(66): n is a, c, g, or t
tgtnttcatttagaaatataatgcatgcttattttatacaatacaaaatatatgaaaaagaaaatnaaaatctctaataatctcatcatttttacccaggcatttcaaaagccacctatgtatgtatttatccaactatcagttcatctattcatccatccatccactcctgcatatcctactttacgaatgtatttgacagcttattttatattatgagcatgttcttatctaataaaatatcattaatta

SEQ ID NO: 18117 - DNA, 350 bp, Homo sapiens
ccttgctatttacagtcctgctttttgctattgttgtttgttgtttggttatgatcttgcttcctcctctagttaaggactggcttcccacctaaagcacagtttgtattcatcatcttgagttactttcaggtaacacagtctggccccacccacagggaatgctctgtaacacaggactcaaggccatggggatgctctcagccagctactttcaaccatctgttaagatggtaaggaggaggtggagaagaaaagaagaatagttaatatatttattgagttcttgctgtatatcaggttgttctaataattgtacatggaaaaataaaatgcatatatgttggcca

SEQ ID NO: 18118 - DNA, 2464 bp, Homo sapiens
cggcgcggctgaggcgcggcggccccgtggagcagcgcagtatggcgggcggggcccgggaggtgctcacactgcagttgggacattttgccggtttcgtgggcgcgcactggtggaaccagcaggatgctgcgctgggccgagcgaccgattccaaggagcccccgggagagctgtgccccgacgtcctgtatcgtacgggccggacgctgcacggccaggagacctacacgccgcgactcatcctcatggatctgaagggtagtttgagctccctaaaagaggaaggtggactctacagggacaaacagttggatgctgcaatagcatggcaggggaagctcaccacacacaaagaggaactctatcccaagaacccttatctccaagactttctgagtgcagagggagtgctgagtagtgatggtgtctggagggtcaaatccattcccaatggcaaaggttcctcaccactccccaccgctacaactccaaaaccacttatccctacagaggccagcatcagggtctggtcagacttcctcagagtccatctccatccccggagcatctgtatgattcagaagtacaaccacgatggggaagcaggtcggctggaggcttttggccaaggggaaagtgtcctaaaggaacccaagtaccaggaagagctggaggacaggctgcatttctacgtggaggaatgtgactacttgcagggcttccagatcctgtgtgacctgcacgatggcttctctggggtaggcgcgaaggcggcagagctgctacaagatgaatattcagggcggggaataataacctggggcctgctacctggtccctaccatcgtggggaggcccagagaaacatctatcgtctattaaacacagcttttggtctcgtgcacctgactgctcacagctctcttgtctgccccttgtccttgggtgggagcctgggcctgcgacccgagccacctgtcagcttcccttacctgcattatgatgccactctgcccttccactgcagtgccatcctggctacagccctggacacagtcactgttccttatcgcctgtgttcctctccagtttccatggttcatctggctgacatgctgagcttctgtgggaaaaaggtggtgacagcaggagcaatcatccctttccccttggctccaggccagtcccttcctgattccctgatgcagtttggaggagccaccccatggaccccactgtctgcatgtggggagccttctggaacacgttgctttgcccagtcagtggtgctgaggggtatagacagagcatgccacacaagccagctcaccccagggacacctccaccctctgcccttcatgcatgtaccactggggaagaaatcttggctcagtatttacaacagcagcagcctggagtcatgagttcttcccatctgctgctgactccctgcagggtggctcctccttacccccacctcttctcaagctgcagtccaccgggtatggttctggatggttcccccaagggagcagcagtggagagcatcccagtgtttggggcactgtgttcctcttcgtccctgcaccagaccctggaagccttggccagagacctcaccaaactcgacttgcggcgctgggccagcttcatggatgctggagtggagcacgatgacgtagcagagctgctgcaggagctacaaagcctggcccagtgctaccagggtggtgacagcctcgtggactaaagttcccagtgtgggagaaaggagctagtttgcaataaaaacagctggatgcaggagcccagtgtcttcatgcagaggagctcaatgtcgcgggactagctacaccaacatatgcactttttacatttagaaacactgtgattagaccacagaacaataaatatgtgccatcagaccaaaaaaaagtagagaaaggagctgaactccactctcgatgctacttacagaggacatctgtaaagtcttcataaaagaccttgaatgatgcctaggatggcagagcccctgggtcctactccatcctccagcctttgtccttgtcctggcctcctgctctccagatctgtaaactgggctcaaggactgtacaagcagagtacaactacccgcctccccggtgccagggcgcctgttgggtttggtcctgtgtagatgattcccagagtctcattcatccagctcctcttcagacagaaggtccccatggtcagacagctggtctgcattgctggtactggttgcatcatcctcatcctcagagctggcttcacaggcagtgtggaagagctgcatgagttctcgaaaatggtgggaaacctaagaaaggaggagggctgtattcactgatccttagtaacatgttaacatttatgaagcactatatattgatttgcaaaatcttttgtttattccacacagcaaggttgaga

SEQ ID NO: 18119 - DNA, 1810 bp, Homo sapiens
cggcgcggctgaggcgcggcggccccgtggagcagcgcagtatggcgggcggggcccgggaggtgctcacactgcagttgggacattttgccggtttcgtgggcgcgcactggtggaaccagcaggatgctgcgctgggccgagcgaccgattccaaggagcccccgggagagctgtgccccgacgtcctgtatcgtacgggccggacgctgcacggccaggagacctacacgccgcgactcatcctcatggatctgaagggtagtttgagctccctaaaagaggaaggtggactctacagggacaaacagttggatgctgcaatagcatggcaggggaagctcaccacacacaaagaggaactctatcccaagaacccttatctccaagactttctgagtgcagagggagtgctgagtagtgatggtgtctggagggtcaaatccattcccaatggcaaaggttcctcaccactccccaccgctacaactccaaaaccacttatccctacagaggccagcatcagggtctggtcagacttcctcagagtccatctccatccccggagcatctgtatgattcagaagtacaaccacgatggggaagcaggtcggctggaggcttttggccaaggggaaagtgtcctaaaggaacccaagtaccaggaagagctggaggacaggctgcatttctacgtggaggaatgtgactacttgcagggcttccagatcctgtgtgacctgcacgatggcttctctggggtaggcgcgaaggcggcagagctgctacaagatgaatattcagggcggggaataataacctggggcctgctacctggtccctaccatcgtggggaggcccagagaaacatctatcgtctattaaacacagcttttggtctcgtgcacctgactgctcacagctctcttgtctgccccttgtccttgggtgggagcctgggcctgcgacccgagccacctgtcagcttcccttacctgcattatgatgccactctgcccttccactgcagtgccatcctggctacagccctggacacagtcactgttccttatcgcctgtgttcctctccagtttccatggttcatctggctgacatgctgagcttctgtgggaaaaaggtggtgacagcaggagcaatcatccctttccccttggctccaggccagtcccttcctgattccctgatgcagtttggaggagccaccccatggaccccactgtctgcatgtggggagccttctggaacacgttgctttgcccagtcagtggtgctgaggggtatagacagagcatgccacacaagccagctcaccccagggacacctccaccctctgcccttcatgcatgtaccactggggaagaaatcttggctcagtatttacaacagcagcagcctggagtcatgagttcttcccatctgctgctgactccctgcagggtggctcctccttacccccacctcttctcaagctgcagtccaccgggtatggttctggatggttcccccaagggagcagcagtggagagcatcccagtgtttggggcactgtgttcctcttcgtccctgcaccagaccctggaagccttggccagagacctcaccaaactcgacttgcggcgctgggccagcttcatggatgctggagtggagcacgatgacgtagcagagctgctgcaggagctacaaagcctggcccagtgctaccagggtggtgacagcctcgtggactaaagttcccagtgtgggagaaaggagctagtttgcaataaaaacagctggatgcagga

SEQ ID NO: 18120 - DNA, 953 bp, Homo sapiens
gtggaagccttggccaggtctggtgcagggacgaagaggaacacagtgccccaaacactgtgttcctcttcgtccctgcaccagaccctggaagccttggccagagacctcaccaaactcgacttgcggcgctgggccagcttcatggatgctggagtggagcacgatgacgtagcagagctgctgcaggagctacaaagcctggcccagtgctaccagggtggtgacagcctcgtggactaaagttcccagtgtgggagaaaggagctagtttgcaataaaaacagctggatgcaggagcccagtgtcttcatgcagaggagctcaatgtcgcgggactagctacaccaacatatgcactttttacatttagaaacactgtgattagaccacagaacaataaatatgtgccatcagaccaaaaaaaagtagagaaaggagctgaactccactctcgatgctacttacagaggacatctgtaaagtcttcataaaagaccttgaatgatgcctaggatggcagagcccctgggtcctactccatcctccagcctttgtccttgtcctggcctcctgctctccagatctgtaaactgggctcaaggactgtacaagcagagtacaactacccgcctccccggtgccagggcgcctgttgggtttggtcctgtgtagatgattcccagagtctcattcatccagctcctcttcagacagaaggtccccatggtcagacagctggtctgcattgctggtactggttgcatcatcctcatcctcagagctggcttcacaggcagtgtggaagagctgcatgagttctcgaaaatggtgggaaacctaagaaaggaggagggctgtattcactgatccttagtaacatgttaacatttatgaagcactatatattgatttgcaaaatcttttgtttattccacacagcaaggttgaga

SEQ ID NO: 18121 - DNA, 545 bp, Homo sapiens
gcgctgccgttatcttcaagaccctcccaccttaccgagctccaggaccggagatgaggagctgagcacaacatgccaacactcgaggggcccacgacagttgctcaagagccatttcgggaataggctgctaggccctggagacagtgaggacttgaactgcagcactcctgtcagacccctggatgtggttccccccgcgtcccacagctaatgactaagctgggaaccgaaagatggaatctagattctcctaagccaaggtttttcccccaactagtgtatatcccagaaagcttggaagagccaagtgctggagagatggtgacagcaggttgtcaggtgatcagaggaaggttagctagaggggaagggtgcccaggctttgacctaacattgtctctgttatttctgtacaggtagtttgagctccctaaaagaggaaggtggactctacagggacaaacagttggatgctgcaatagcatggtgtgtaactgatgtatggataagggtggggatcgtgtatgtacgcagaacgctgg

SEQ ID NO: 18122 - DNA, 2755 bp, Homo sapiens
cggcgcggctgaggcgcggcggccccgtggagcagcgcagtatggcgggcggggcccgggaggtgctcacactgcagttgggacattttgccggtttcgtgggcgcgcactggtggaaccagcaggatgctgcgctgggccgagcgaccgattccaaggagcccccgggagagctgtgccccgacgtcctgtatcgtacgggccggacgctgcacggccaggagacctacacgccgcgactcatcctcatggatctgaagggtagtttgagctccctaaaagaggaaggtggactctacagggacaaacagttggatgctgcaatagcatggcaggggaagctcaccacacacaaagaggaactctatcccaagaacccttatctccaagactttctgagtgcagagggagtgctgagtagtgatggtgtctggagggtcaaatccattcccaatggcaaaggttcctcaccactccccaccgctacaactccaaaaccacttatccctacagaggccagcatcagggtctggtcagacttcctcagagtccatctccatccccggagcatctgtatgattcagaagtacaaccacgatggggaagcaggtcggctggaggcttttggccaaggggaaagtgtcctaaaggaacccaagtaccaggaagagctggaggacaggctgcatttctacgtggaggaatgtgactacttgcagggcttccagatcctgtgtgacctgcacgatggcttctctggggtaggcgcgaaggcggcagagctgctacaagatgaatattcagggcggggaataataacctggggcctgctacctggtccctaccatcgtggggaggcccagagaaacatctatcgtctattaaacacagcttttggtctcgtgcacctgactgctcacagctctcttgtctgccccttgtccttgggtgggagcctgggcctgcgacccgagccacctgtcagcttcccttacctgcattatgatgccactctgcccttccactgcagtgccatcctggctacagccctggacacagtcactgttccttatcgcctgtgttcctctccagtttccatggttcatctggctgacatgctgagcttctgtgggaaaaaggtggtgacagcaggagcaatcatccctttccccttggctccaggccagtcccttcctgattccctgatgcagtttggaggagccaccccatggaccccactgtctgcatgtggggagccttctggaacacgttgctttgcccagtcagtggtgctgaggggtatagacagagcatgccacacaagccagctcaccccagggacacctccaccctctgcccttcatgcatgtaccactggggaagaaatcttggctcagtatttacaacagcagcagcctggagtcatgagttcttcccatctgctgctgactccctgcagggtggctcctccttacccccacctcttctcaagctgcagtccaccgggtatggttctggatggttcccccaagggagcaggtatgtaggaggtgaagaaaactgagatttcaagtatgggagagtttttactatctccattcctggattaaaagtgctgaaaaagtccacagttaaacattcctttattcaccctatggctcccaagaaaagcattcttcctctggagtactggtgtactaaggggacaatacaccaaatttgttgagtttacaatcaagtctactaaggttggacttccttatcagtttggcgagtcccagggcagaataatcatccatctacaggtctctgtttcctctccctccacagcagtggagagcatcccagtgtttggggcactgtgttcctcttcgtccctgcaccagaccctggaagccttggccagagacctcaccaaactcgacttgcggcgctgggccagcttcatggatgctggagtggagcacgatgacgtagcagagctgctgcaggagctacaaagcctggcccagtgctaccagggtggtgacagcctcgtggactaaagttcccagtgtgggagaaaggagctagtttgcaataaaaacagctggatgcaggagcccagtgtcttcatgcagaggagctcaatgtcgcgggactagctacaccaacatatgcactttttacatttagaaacactgtgattagaccacagaacaataaatatgtgccatcagaccaaaaaaaagtagagaaaggagctgaactccactctcgatgctacttacagaggacatctgtaaagtcttcataaaagaccttgaatgatgcctaggatggcagagcccctgggtcctactccatcctccagcctttgtccttgtcctggcctcctgctctccagatctgtaaactgggctcaaggactgtacaagcagagtacaactacccgcctccccggtgccagggcgcctgttgggtttggtcctgtgtagatgattcccagagtctcattcatccagctcctcttcagacagaaggtccccatggtcagacagctggtctgcattgctggtactggttgcatcatcctcatcctcagagctggcttcacaggcagtgtggaagagctgcatgagttctcgaaaatggtgggaaacctaagaaaggaggagggctgtattcactgatccttagtaacatgttaacatttatgaagcactatatattgatttgcaaaatcttttgtttattccacacagcaaggttgaga

SEQ ID NO: 18123 - DNA, 2792 bp, Homo sapiens
cggcgcggctgaggcgcggcggccccgtggagcagcgcagtatggcgggcggggcccgggaggtgctcacactgcagttgggacattttgccggtttcgtgggcgcgcactggtggaaccagcaggatgctgcgctgggccgagcgaccgattccaaggagcccccgggagagctgtgccccgacgtcctgtatcgtacgggccggacgctgcacggccaggagacctacacgccgcgactcatcctcatggatctgaagggtagtttgagctccctaaaagaggaaggtggactctacagggacaaacagttggatgctgcaatagcatggcaggggaagctcaccacacacaaagaggaactctatcccaagaacccttatctccaagactttctgagtgcagagggagtgctgagtagtgatggtgtctggagggtcaaatccattcccaatggcaaaggttcctcaccactccccaccgctacaactccaaaaccacttatccctacagaggccagcatcagggtctggtcagacttcctcagagtccatctccatccccggagcatctgtatgattcagaagtacaaccacgatggggaagcaggtcggctggaggcttttggccaaggggaaagtgtcctaaaggaacccaagtaccaggaagagctggaggacaggctgcatttctacgtggaggaatgtgactacttgcagggcttccagatcctgtgtgacctgcacgatggcttctctggggtaggcgcgaaggcggcagagctgctacaagatgaatattcagggcggggaataataacctggggcctgctacctggtccctaccatcgtggggaggcccagagaaacatctatcgtctattaaacacagcttttggtctcgtgcacctgactgctcacagctctcttgtctgccccttgtccttgggtgggagcctgggcctgcgacccgagccacctgtcagcttcccttacctgcattatgatgccactctgcccttccactgcagtgccatcctggctacagccctggacacagtcactgttccttatcgcctgtgttcctctccagtttccatggttcatctggctgacatgctgagcttctgtgggaaaaaggtggtgacagcaggagcaatcatccctttccccttggctccaggccagtcccttcctgattccctgatgcagtttggaggagccaccccatggaccccactgtctgcatgtggggagccttctggaacacgttgctttgcccagtcagtggtgctgaggggtatagacagagcatgccacacaagccacagactaatggtggttttggctttgttctggcagccagctcaccccagggacacctccaccctctgcccttcatgcatgtaccactggggaagaaatcttggctcagtatttacaacagcagcagcctggagtcatgagttcttcccatctgctgctgactccctgcagggtggctcctccttacccccacctcttctcaagctgcagtccaccgggtatggttctggatggttcccccaagggagcaggtatgtaggaggtgaagaaaactgagatttcaagtatgggagagtttttactatctccattcctggattaaaagtgctgaaaaagtccacagttaaacattcctttattcaccctatggctcccaagaaaagcattcttcctctggagtactggtgtactaaggggacaatacaccaaatttgttgagtttacaatcaagtctactaaggttggacttccttatcagtttggcgagtcccagggcagaataatcatccatctacaggtctctgtttcctctccctccacagcagtggagagcatcccagtgtttggggcactgtgttcctcttcgtccctgcaccagaccctggaagccttggccagagacctcaccaaactcgacttgcggcgctgggccagcttcatggatgctggagtggagcacgatgacgtagcagagctgctgcaggagctacaaagcctggcccagtgctaccagggtggtgacagcctcgtggactaaagttcccagtgtgggagaaaggagctagtttgcaataaaaacagctggatgcaggagcccagtgtcttcatgcagaggagctcaatgtcgcgggactagctacaccaacatatgcactttttacatttagaaacactgtgattagaccacagaacaataaatatgtgccatcagaccaaaaaaaagtagagaaaggagctgaactccactctcgatgctacttacagaggacatctgtaaagtcttcataaaagaccttgaatgatgcctaggatggcagagcccctgggtcctactccatcctccagcctttgtccttgtcctggcctcctgctctccagatctgtaaactgggctcaaggactgtacaagcagagtacaactacccgcctccccggtgccagggcgcctgttgggtttggtcctgtgtagatgattcccagagtctcattcatccagctcctcttcagacagaaggtccccatggtcagacagctggtctgcattgctggtactggttgcatcatcctcatcctcagagctggcttcacaggcagtgtggaagagctgcatgagttctcgaaaatggtgggaaacctaagaaaggaggagggctgtattcactgatccttagtaacatgttaacatttatgaagcactatatattgatttgcaaaatcttttgtttattccacacagcaaggttgaga

SEQ ID NO: 18124 - DNA, 2877 bp, Homo sapiens
cggcgcggctgaggcgcggcggccccgtggagcagcgcagtatggcgggcggggcccgggaggtgctcacactgcagttgggacattttgccggtttcgtgggcgcgcactggtggaaccagcaggatgctgcgctgggccgagcgaccgattccaaggagcccccgggagagctgtgccccgacgtcctgtatcgtacgggccggacgctgcacggccaggagacctacacgccgcgactcatcctcatggatctgaagggtagtttgagctccctaaaagaggaaggtggactctacagggacaaacagttggatgctgcaatagcatggcaggggaagctcaccacacacaaagaggaactctatcccaagaacccttatctccaagactttctgagtgcagaggactgcgactcggtgaacagaaaggaggctatgcggtgtggccagccaactcaaggaggacgaagcaacctttgcctctaaactgcctggaaccaaatgtcgatttttctgacccctcccagggagtgctgagtagtgatggtgtctggagggtcaaatccattcccaatggcaaaggttcctcaccactccccaccgctacaactccaaaaccacttatccctacagaggccagcatcagggtctggtcagacttcctcagagtccatctccatccccggagcatctgtatgattcagaagtacaaccacgatggggaagcaggtcggctggaggcttttggccaaggggaaagtgtcctaaaggaacccaagtaccaggaagagctggaggacaggctgcatttctacgtggaggaatgtgactacttgcagggcttccagatcctgtgtgacctgcacgatggcttctctggggtaggcgcgaaggcggcagagctgctacaagatgaatattcagggcggggaataataacctggggcctgctacctggtccctaccatcgtggggaggcccagagaaacatctatcgtctattaaacacagcttttggtctcgtgcacctgactgctcacagctctcttgtctgccccttgtccttgggtgggagcctgggcctgcgacccgagccacctgtcagcttcccttacctgcattatgatgccactctgcccttccactgcagtgccatcctggctacagccctggacacagtcactgttccttatcgcctgtgttcctctccagtttccatggttcatctggctgacatgctgagcttctgtgggaaaaaggtggtgacagcaggagcaatcatccctttccccttggctccaggccagtcccttcctgattccctgatgcagtttggaggagccaccccatggaccccactgtctgcatgtggggagccttctggaacacgttgctttgcccagtcagtggtgctgaggggtatagacagagcatgccacacaagccagctcaccccagggacacctccaccctctgcccttcatgcatgtaccactggggaagaaatcttggctcagtatttacaacagcagcagcctggagtcatgagttcttcccatctgctgctgactccctgcagggtggctcctccttacccccacctcttctcaagctgcagtccaccgggtatggttctggatggttcccccaagggagcaggtatgtaggaggtgaagaaaactgagatttcaagtatgggagagtttttactatctccattcctggattaaaagtgctgaaaaagtccacagttaaacattcctttattcaccctatggctcccaagaaaagcattcttcctctggagtactggtgtactaaggggacaatacaccaaatttgttgagtttacaatcaagtctactaaggttggacttccttatcagtttggcgagtcccagggcagaataatcatccatctacaggtctctgtttcctctccctccacagcagtggagagcatcccagtgtttggggcactgtgttcctcttcgtccctgcaccagaccctggaagccttggccagagacctcaccaaactcgacttgcggcgctgggccagcttcatggatgctggagtggagcacgatgacgtagcagagctgctgcaggagctacaaagcctggcccagtgctaccagggtggtgacagcctcgtggactaaagttcccagtgtgggagaaaggagctagtttgcaataaaaacagctggatgcaggagcccagtgtcttcatgcagaggagctcaatgtcgcgggactagctacaccaacatatgcactttttacatttagaaacactgtgattagaccacagaacaataaatatgtgccatcagaccaaaaaaaagtagagaaaggagctgaactccactctcgatgctacttacagaggacatctgtaaagtcttcataaaagaccttgaatgatgcctaggatggcagagcccctgggtcctactccatcctccagcctttgtccttgtcctggcctcctgctctccagatctgtaaactgggctcaaggactgtacaagcagagtacaactacccgcctccccggtgccagggcgcctgttgggtttggtcctgtgtagatgattcccagagtctcattcatccagctcctcttcagacagaaggtccccatggtcagacagctggtctgcattgctggtactggttgcatcatcctcatcctcagagctggcttcacaggcagtgtggaagagctgcatgagttctcgaaaatggtgggaaacctaagaaaggaggagggctgtattcactgatccttagtaacatgttaacatttatgaagcactatatattgatttgcaaaatcttttgtttattccacacagcaaggttgaga

SEQ ID NO: 18125 - DNA, 2793 bp, Homo sapiens
cggcgcggctgaggcgcggcggccccgtggagcagcgcagtatggcgggcggggcccgggaggtgctcacactgcagttgggacattttgccggtttcgtgggcgcgcactggtggaaccagcaggatgctgcgctgggccgagcgaccgattccaaggagcccccgggagagctgtgccccgacgtcctgtatcgtacgggccggacgctgcacggccaggagacctacacgccgcgactcatcctcatggatctgaagggtagtttgagctccctaaaagaggaaggtggactctacagggacaaacagttggatgctgcaatagcatggcaggggaagctcaccacacacaaagaggaactctatcccaagaacccttatctccaagactttctgagtgcagagggagtgctgagtagtgatggtgtctggagggtcaaatccattcccaatggcaaaggttcctcaccactccccaccgctacaactccaaaaccacttatccctacagaggccagcatcagggtctggtcagacttcctcagagtccatctccatccccggagcatctgtatgattcagaagtacaaccacgatggggaagcaggtcggctggaggcttttggccaaggggaaagtgtcctaaaggaacccaagtaccaggaagagctggaggacaggctgcatttctacgtggaggaatgtgactacttgcagggcttccagatcctgtgtgacctgcacgatggcttctctggggtaggcgcgaaggcggcagagctgctacaagatgaatattcagggcggggaataataacctggggcctgctacctggtccctaccatcgtggggaggcccagagaaacatctatcgtctattaaacacagcttttggtctcgtgcacctgactgctcacagctctcttgtctgccccttgtccttgggtgggagcctgggcctgcgacccgagccacctgtcagcttcccttacctgcattatgatgcctgaggccaagtgcccatcttggtgtcttcttacaggccactctgcccttccactgcagtgccatcctggctacagccctggacacagtcactgttccttatcgcctgtgttcctctccagtttccatggttcatctggctgacatgctgagcttctgtgggaaaaaggtggtgacagcaggagcaatcatccctttccccttggctccaggccagtcccttcctgattccctgatgcagtttggaggagccaccccatggaccccactgtctgcatgtggggagccttctggaacacgttgctttgcccagtcagtggtgctgaggggtatagacagagcatgccacacaagccagctcaccccagggacacctccaccctctgcccttcatgcatgtaccactggggaagaaatcttggctcagtatttacaacagcagcagcctggagtcatgagttcttcccatctgctgctgactccctgcagggtggctcctccttacccccacctcttctcaagctgcagtccaccgggtatggttctggatggttcccccaagggagcaggtatgtaggaggtgaagaaaactgagatttcaagtatgggagagtttttactatctccattcctggattaaaagtgctgaaaaagtccacagttaaacattcctttattcaccctatggctcccaagaaaagcattcttcctctggagtactggtgtactaaggggacaatacaccaaatttgttgagtttacaatcaagtctactaaggttggacttccttatcagtttggcgagtcccagggcagaataatcatccatctacaggtctctgtttcctctccctccacagcagtggagagcatcccagtgtttggggcactgtgttcctcttcgtccctgcaccagaccctggaagccttggccagagacctcaccaaactcgacttgcggcgctgggccagcttcatggatgctggagtggagcacgatgacgtagcagagctgctgcaggagctacaaagcctggcccagtgctaccagggtggtgacagcctcgtggactaaagttcccagtgtgggagaaaggagctagtttgcaataaaaacagctggatgcaggagcccagtgtcttcatgcagaggagctcaatgtcgcgggactagctacaccaacatatgcactttttacatttagaaacactgtgattagaccacagaacaataaatatgtgccatcagaccaaaaaaaagtagagaaaggagctgaactccactctcgatgctacttacagaggacatctgtaaagtcttcataaaagaccttgaatgatgcctaggatggcagagcccctgggtcctactccatcctccagcctttgtccttgtcctggcctcctgctctccagatctgtaaactgggctcaaggactgtacaagcagagtacaactacccgcctccccggtgccagggcgcctgttgggtttggtcctgtgtagatgattcccagagtctcattcatccagctcctcttcagacagaaggtccccatggtcagacagctggtctgcattgctggtactggttgcatcatcctcatcctcagagctggcttcacaggcagtgtggaagagctgcatgagttctcgaaaatggtgggaaacctaagaaaggaggagggctgtattcactgatccttagtaacatgttaacatttatgaagcactatatattgatttgcaaaatcttttgtttattccacacagcaaggttgaga

SEQ ID NO: 18126 - DNA, 3028 bp, Homo sapiens
cggcgcggctgaggcgcggcggccccgtggagcagcgcagtatggcgggcggggcccgggaggtgctcacactgcagttgggacattttgccggtttcgtgggcgcgcactggtggaaccagcaggatgctgcgctgggccgagcgaccgattccaaggagcccccgggagagctgtgccccgacgtcctgtatcgtacgggccggacgctgcacggccaggagacctacacgccgcgactcatcctcatggatctgaagggtagtttgagctccctaaaagaggaaggtggactctacagggacaaacagttggatgctgcaatagcatggcaggggaagctcaccacacacaaagaggaactctatcccaagaacccttatctccaagactttctgagtgcagagggagtgctgagtagtgatggtgtctggagggtcaaatccattcccaatggcaaaggttcctcaccactccccaccgctacaactccaaaaccacttatccctacagaggccagcatcagggtctggtcagacttcctcagagtccatctccatccccggagcatctgtatgattcagaagtacaaccacgatggggaagcaggtcggctggaggcttttggccaaggggaaagtgtcctaaaggaacccaagtaccaggaagagctggaggacaggctgcatttctacgtggaggaatgtgactacttgcagggcttccagatcctgtgtgacctgcacgatggcttctctggggtaggcgcgaaggcggcagagctgctacaagatgaatattcagggcggggaataataacctggggcctgctacctggtccctaccatcgtggggaggcccagagaaacatctatcgtctattaaacacagcttttggtctcgtgcacctgactgctcacagctctcttgtctgccccttgtccttgggtgggagcctgggcctgcgacccgagccacctgtcagcttcccttacctgcattatgatgtaagtctcggtgctcttgttctgactgcggcaggctacagggcctcctcatgctcccagtcagccgctgtctgttactggctctgttcttgaggcccgagcttgaactcagctgtgatgtggcctctcagatcacactgtcctatgcttgtccagcctggggtcaaacatacccctgattcgtcccctgggtctctctggtgttaatattctgcctccacacattcttttccaggcctgaggccaagtgcccatcttggtgtcttcttacaggccactctgcccttccactgcagtgccatcctggctacagccctggacacagtcactgttccttatcgcctgtgttcctctccagtttccatggttcatctggctgacatgctgagcttctgtgggaaaaaggtggtgacagcaggagcaatcatccctttccccttggctccaggccagtcccttcctgattccctgatgcagtttggaggagccaccccatggaccccactgtctgcatgtggggagccttctggaacacgttgctttgcccagtcagtggtgctgaggggtatagacagagcatgccacacaagccagctcaccccagggacacctccaccctctgcccttcatgcatgtaccactggggaagaaatcttggctcagtatttacaacagcagcagcctggagtcatgagttcttcccatctgctgctgactccctgcagggtggctcctccttacccccacctcttctcaagctgcagtccaccgggtatggttctggatggttcccccaagggagcaggtatgtaggaggtgaagaaaactgagatttcaagtatgggagagtttttactatctccattcctggattaaaagtgctgaaaaagtccacagttaaacattcctttattcaccctatggctcccaagaaaagcattcttcctctggagtactggtgtactaaggggacaatacaccaaatttgttgagtttacaatcaagtctactaaggttggacttccttatcagtttggcgagtcccagggcagaataatcatccatctacaggtctctgtttcctctccctccacagcagtggagagcatcccagtgtttggggcactgtgttcctcttcgtccctgcaccagaccctggaagccttggccagagacctcaccaaactcgacttgcggcgctgggccagcttcatggatgctggagtggagcacgatgacgtagcagagctgctgcaggagctacaaagcctggcccagtgctaccagggtggtgacagcctcgtggactaaagttcccagtgtgggagaaaggagctagtttgcaataaaaacagctggatgcaggagcccagtgtcttcatgcagaggagctcaatgtcgcgggactagctacaccaacatatgcactttttacatttagaaacactgtgattagaccacagaacaataaatatgtgccatcagaccaaaaaaaagtagagaaaggagctgaactccactctcgatgctacttacagaggacatctgtaaagtcttcataaaagaccttgaatgatgcctaggatggcagagcccctgggtcctactccatcctccagcctttgtccttgtcctggcctcctgctctccagatctgtaaactgggctcaaggactgtacaagcagagtacaactacccgcctccccggtgccagggcgcctgttgggtttggtcctgtgtagatgattcccagagtctcattcatccagctcctcttcagacagaaggtccccatggtcagacagctggtctgcattgctggtactggttgcatcatcctcatcctcagagctggcttcacaggcagtgtggaagagctgcatgagttctcgaaaatggtgggaaacctaagaaaggaggagggctgtattcactgatccttagtaacatgttaacatttatgaagcactatatattgatttgcaaaatcttttgtttattccacacagcaaggttgaga

SEQ ID NO: 18127 - DNA, 2501 bp, Homo sapiens
cggcgcggctgaggcgcggcggccccgtggagcagcgcagtatggcgggcggggcccgggaggtgctcacactgcagttgggacattttgccggtttcgtgggcgcgcactggtggaaccagcaggatgctgcgctgggccgagcgaccgattccaaggagcccccgggagagctgtgccccgacgtcctgtatcgtacgggccggacgctgcacggccaggagacctacacgccgcgactcatcctcatggatctgaagggtagtttgagctccctaaaagaggaaggtggactctacagggacaaacagttggatgctgcaatagcatggcaggggaagctcaccacacacaaagaggaactctatcccaagaacccttatctccaagactttctgagtgcagagggagtgctgagtagtgatggtgtctggagggtcaaatccattcccaatggcaaaggttcctcaccactccccaccgctacaactccaaaaccacttatccctacagaggccagcatcagggtctggtcagacttcctcagagtccatctccatccccggagcatctgtatgattcagaagtacaaccacgatggggaagcaggtcggctggaggcttttggccaaggggaaagtgtcctaaaggaacccaagtaccaggaagagctggaggacaggctgcatttctacgtggaggaatgtgactacttgcagggcttccagatcctgtgtgacctgcacgatggcttctctggggtaggcgcgaaggcggcagagctgctacaagatgaatattcagggcggggaataataacctggggcctgctacctggtccctaccatcgtggggaggcccagagaaacatctatcgtctattaaacacagcttttggtctcgtgcacctgactgctcacagctctcttgtctgccccttgtccttgggtgggagcctgggcctgcgacccgagccacctgtcagcttcccttacctgcattatgatgccactctgcccttccactgcagtgccatcctggctacagccctggacacagtcactgttccttatcgcctgtgttcctctccagtttccatggttcatctggctgacatgctgagcttctgtgggaaaaaggtggtgacagcaggagcaatcatccctttccccttggctccaggccagtcccttcctgattccctgatgcagtttggaggagccaccccatggaccccactgtctgcatgtggggagccttctggaacacgttgctttgcccagtcagtggtgctgaggggtatagacagagcatgccacacaagccacagactaatggtggttttggctttgttctggcagccagctcaccccagggacacctccaccctctgcccttcatgcatgtaccactggggaagaaatcttggctcagtatttacaacagcagcagcctggagtcatgagttcttcccatctgctgctgactccctgcagggtggctcctccttacccccacctcttctcaagctgcagtccaccgggtatggttctggatggttcccccaagggagcagcagtggagagcatcccagtgtttggggcactgtgttcctcttcgtccctgcaccagaccctggaagccttggccagagacctcaccaaactcgacttgcggcgctgggccagcttcatggatgctggagtggagcacgatgacgtagcagagctgctgcaggagctacaaagcctggcccagtgctaccagggtggtgacagcctcgtggactaaagttcccagtgtgggagaaaggagctagtttgcaataaaaacagctggatgcaggagcccagtgtcttcatgcagaggagctcaatgtcgcgggactagctacaccaacatatgcactttttacatttagaaacactgtgattagaccacagaacaataaatatgtgccatcagaccaaaaaaaagtagagaaaggagctgaactccactctcgatgctacttacagaggacatctgtaaagtcttcataaaagaccttgaatgatgcctaggatggcagagcccctgggtcctactccatcctccagcctttgtccttgtcctggcctcctgctctccagatctgtaaactgggctcaaggactgtacaagcagagtacaactacccgcctccccggtgccagggcgcctgttgggtttggtcctgtgtagatgattcccagagtctcattcatccagctcctcttcagacagaaggtccccatggtcagacagctggtctgcattgctggtactggttgcatcatcctcatcctcagagctggcttcacaggcagtgtggaagagctgcatgagttctcgaaaatggtgggaaacctaagaaaggaggagggctgtattcactgatccttagtaacatgttaacatttatgaagcactatatattgatttgcaaaatcttttgtttattccacacagcaaggttgaga

SEQ ID NO: 18128 - DNA, 2423 bp, Homo sapiens
cggcgcggctgaggcgcggcggccccgtggagcagcgcagtatggcgggcggggcccgggaggtgctcacactgcagttgggacattttgccggtttcgtgggcgcgcactggtggaaccagcaggatgctgcgctgggccgagcgaccgattccaaggagcccccgggagagctgtgccccgacgtcctgtatcgtacgggccggacgctgcacggccaggagacctacacgccgcgactcatcctcatggatctgaagggtagtttgagctccctaaaagaggaaggtggactctacagggacaaacagttggatgctgcaatagcatggcaggggaagctcaccacacacaaagaggaactctatcccaagaacccttatctccaagactttctgagtgcagagggagtgctgagtagtgatggtgtctggagggtcaaatccattcccaatggcaaaggttcctcaccactccccaccgctacaactccaaaaccacttatccctacagaggccagcatcagggtctggtcagacttcctcagagtccatctccatccccggagcatctgtatgattcagaagtacaaccacgatggggaagcaggtcggctggaggcttttggccaaggggaaagtgtcctaaaggaacccaagtaccaggaagagctggaggacaggctgcatttctacgtggaggaatgtgactacttgcagggcttccagatcctgtgtgacctgcacgatggcttctctggggtaggcgcgaaggcggcagagctgctacaagatgaatattcagggcggggaataataacctggggcctgctacctggtccctaccatcgtggggaggcccagagaaacatctatcgtctattaaacacagcttttggtctcgtgcacctgactgctcacagctctcttgtctgccccttgtccttgggtgggagcctgggcctgcgacccgagccacctgtcagcttcccttacctgcattatgatgccactctgcccttccactgcagtgccatcctggctacagccctggacacagtcactgttccttatcgcctgtgttcctctccagtttccatggttcatctggctgacatgctgagcttctgtgggaaaaagttacccccacctcttctcaagctgcagtccaccgggtatggttctggatggttcccccaagggagcaggtatgtaggaggtgaagaaaactgagatttcaagtatgggagagtttttactatctccattcctggattaaaagtgctgaaaaagtccacagttaaacattcctttattcaccctatggctcccaagaaaagcattcttcctctggagtactggtgtactaaggggacaatacaccaaatttgttgagtttacaatcaagtctactaaggttggacttccttatcagtttggcgagtcccagggcagaataatcatccatctacaggtctctgtttcctctccctccacagcagtggagagcatcccagtgtttggggcactgtgttcctcttcgtccctgcaccagaccctggaagccttggccagagacctcaccaaactcgacttgcggcgctgggccagcttcatggatgctggagtggagcacgatgacgtagcagagctgctgcaggagctacaaagcctggcccagtgctaccagggtggtgacagcctcgtggactaaagttcccagtgtgggagaaaggagctagtttgcaataaaaacagctggatgcaggagcccagtgtcttcatgcagaggagctcaatgtcgcgggactagctacaccaacatatgcactttttacatttagaaacactgtgattagaccacagaacaataaatatgtgccatcagaccaaaaaaaagtagagaaaggagctgaactccactctcgatgctacttacagaggacatctgtaaagtcttcataaaagaccttgaatgatgcctaggatggcagagcccctgggtcctactccatcctccagcctttgtccttgtcctggcctcctgctctccagatctgtaaactgggctcaaggactgtacaagcagagtacaactacccgcctccccggtgccagggcgcctgttgggtttggtcctgtgtagatgattcccagagtctcattcatccagctcctcttcagacagaaggtccccatggtcagacagctggtctgcattgctggtactggttgcatcatcctcatcctcagagctggcttcacaggcagtgtggaagagctgcatgagttctcgaaaatggtgggaaacctaagaaaggaggagggctgtattcactgatccttagtaacatgttaacatttatgaagcactatatattgatttgcaaaatcttttgtttattccacacagcaaggttgaga

SEQ ID NO: 18129 - DNA, 3170 bp, Homo sapiens
gcgctgccgttatcttcaagaccctcccaccttaccgagctccaggaccggagatgaggagctgagcacaacatgccaacactcgaggggcccacgacagttgctcaagagccatttcgggaataggctgctaggccctggagacagtgaggacttgaactgcagcactcctgtcagacccctggatgtggttccccccgcgtcccacagctaatgactaagctgggaaccgaaagatggaatctagattctcctaagccaaggtttttcccccaactagtgtatatcccagaaagcttggaagagccaagtgctggagagatggtgacagcaggttgtcaggtgatcagaggaaggttagctagaggggaagggtgcccaggctttgacctaacattgtctctgttatttctgtacaggtagtttgagctccctaaaagaggaaggtggactctacagggacaaacagttggatgctgcaatagcatggcaggggaagctcaccacacacaaagaggaactctatcccaagaacccttatctccaagactttctgagtgcagaggtgagggcctctgtcctgaactttttaacccggtgccacaacccgagggtctccataggggcaggtaaacggggattttaatcattttaagtgtcttagaatgatattttgggaaaaagcactccttttcctaaggactgcgactcggtgaacagaaaggaggctatgcggtgtggccagccaactcaaggaggacgaagcaacctttgcctctaaactgcctggaaccaaatgtcgatttttctgacccctcccagggagtgctgagtagtgatggtgtctggagggtcaaatccattcccaatggcaaaggttcctcaccactccccaccgctacaactccaaaaccacttatccctacagaggccagcatcagggtctggtcagacttcctcagagtccatctccatccccggagcatctgtatgattcagaagtacaaccacgatggggaagcaggtcggctggaggcttttggccaaggggaaagtgtcctaaaggaacccaagtaccaggaagagctggaggacaggctgcatttctacgtggaggaatgtgactacttgcagggcttccagatcctgtgtgacctgcacgatggcttctctggggtaggcgcgaaggcggcagagctgctacaagatgaatattcagggcggggaataataacctggggcctgctacctggtccctaccatcgtggggaggcccagagaaacatctatcgtctattaaacacagcttttggtctcgtgcacctgactgctcacagctctcttgtctgccccttgtccttgggtgggagcctgggcctgcgacccgagccacctgtcagcttcccttacctgcattatgatgccactctgcccttccactgcagtgccatcctggctacagccctggacacagtcactgttccttatcgcctgtgttcctctccagtttccatggttcatctggctgacatgctgagcttctgtgggaaaaaggtggtgacagcaggagcaatcatccctttccccttggctccaggccagtcccttcctgattccctgatgcagtttggaggagccaccccatggaccccactgtctgcatgtggggagccttctggaacacgttgctttgcccagtcagtggtgctgaggggtatagacagagcatgccacacaagccagctcaccccagggacacctccaccctctgcccttcatgcatgtaccactggggaagaaatcttggctcagtatttacaacagcagcagcctggagtcatgagttcttcccatctgctgctgactccctgcagggtggctcctccttacccccacctcttctcaagctgcagtccaccgggtatggttctggatggttcccccaagggagcaggtatgtaggaggtgaagaaaactgagatttcaagtatgggagagtttttactatctccattcctggattaaaagtgctgaaaaagtccacagttaaacattcctttattcaccctatggctcccaagaaaagcattcttcctctggagtactggtgtactaaggggacaatacaccaaatttgttgagtttacaatcaagtctactaaggttggacttccttatcagtttggcgagtcccagggcagaataatcatccatctacaggtctctgtttcctctccctccacagcagtggagagcatcccagtgtttggggcactgtgttcctcttcgtccctgcaccagaccctggaagccttggccagagacctcaccaaactcgacttgcggcgctgggccagcttcatggatgctggagtggagcacgatgacgtagcagagctgctgcaggagctacaaagcctggcccagtgctaccagggtggtgacagcctcgtggactaaagttcccagtgtgggagaaaggagctagtttgcaataaaaacagctggatgcaggagcccagtgtcttcatgcagaggagctcaatgtcgcgggactagctacaccaacatatgcactttttacatttagaaacactgtgattagaccacagaacaataaatatgtgccatcagaccaaaaaaaagtagagaaaggagctgaactccactctcgatgctacttacagaggacatctgtaaagtcttcataaaagaccttgaatgatgcctaggatggcagagcccctgggtcctactccatcctccagcctttgtccttgtcctggcctcctgctctccagatctgtaaactgggctcaaggactgtacaagcagagtacaactacccgcctccccggtgccagggcgcctgttgggtttggtcctgtgtagatgattcccagagtctcattcatccagctcctcttcagacagaaggtccccatggtcagacagctggtctgcattgctggtactggttgcatcatcctcatcctcagagctggcttcacaggcagtgtggaagagctgcatgagttctcgaaaatggtgggaaacctaagaaaggaggagggctgtattcactgatccttagtaacatgttaacatttatgaagcactatatattgatttgcaaaatcttttgtttattccacacagcaaggttgaga

SEQ ID NO: 18130 - DNA, 2735 bp, Homo sapiens
cgacgttcagccggcctgcctcgtcctctctgcttccccaggatgctgcgctgggccgagcgaccgattccaaggagcccccgggagagctgtgccccgacgtcctgtatcgtacgggccggacgctgcacggccaggagacctacacgccgcgactcatcctcatggatctgaagggtagtttgagctccctaaaagaggaaggtggactctacagggacaaacagttggatgctgcaatagcatggcaggggaagctcaccacacacaaagaggaactctatcccaagaacccttatctccaagactttctgagtgcagaggtgagggcctctgtcctgaactttttaacccggtgccacaacccgagggtctccataggggcagggagtgctgagtagtgatggtgtctggagggtcaaatccattcccaatggcaaaggttcctcaccactccccaccgctacaactccaaaaccacttatccctacagaggccagcatcagggtctggtcagacttcctcagagtccatctccatccccggagcatctgtatgattcagaagtacaaccacgatggggaagcaggtcggctggaggcttttggccaaggggaaagtgtcctaaaggaacccaagtaccaggaagagctggaggacaggctgcatttctacgtggaggaatgtgactacttgcagggcttccagatcctgtgtgacctgcacgatggcttctctggggtaggcgcgaaggcggcagagctgctacaagatgaatattcagggcggggaataataacctggggcctgctacctggtccctaccatcgtggggaggcccagagaaacatctatcgtctattaaacacagcttttggtctcgtgcacctgactgctcacagctctcttgtctgccccttgtccttgggtgggagcctgggcctgcgacccgagccacctgtcagcttcccttacctgcattatgatgccactctgcccttccactgcagtgccatcctggctacagccctggacacagtcactgttccttatcgcctgtgttcctctccagtttccatggttcatctggctgacatgctgagcttctgtgggaaaaaggtggtgacagcaggagcaatcatccctttccccttggctccaggccagtcccttcctgattccctgatgcagtttggaggagccaccccatggaccccactgtctgcatgtggggagccttctggaacacgttgctttgcccagtcagtggtgctgaggggtatagacagagcatgccacacaagccagctcaccccagggacacctccaccctctgcccttcatgcatgtaccactggggaagaaatcttggctcagtatttacaacagcagcagcctggagtcatgagttcttcccatctgctgctgactccctgcagggtggctcctccttacccccacctcttctcaagctgcagtccaccgggtatggttctggatggttcccccaagggagcaggtatgtaggaggtgaagaaaactgagatttcaagtatgggagagtttttactatctccattcctggattaaaagtgctgaaaaagtccacagttaaacattcctttattcaccctatggctcccaagaaaagcattcttcctctggagtactggtgtactaaggggacaatacaccaaatttgttgagtttacaatcaagtctactaaggttggacttccttatcagtttggcgagtcccagggcagaataatcatccatctacaggtctctgtttcctctccctccacagcagtggagagcatcccagtgtttggggcactgtgttcctcttcgtccctgcaccagaccctggaagccttggccagagacctcaccaaactcgacttgcggcgctgggccagcttcatggatgctggagtggagcacgatgacgtagcagagctgctgcaggagctacaaagcctggcccagtgctaccagggtggtgacagcctcgtggactaaagttcccagtgtgggagaaaggagctagtttgcaataaaaacagctggatgcaggagcccagtgtcttcatgcagaggagctcaatgtcgcgggactagctacaccaacatatgcactttttacatttagaaacactgtgattagaccacagaacaataaatatgtgccatcagaccaaaaaaaagtagagaaaggagctgaactccactctcgatgctacttacagaggacatctgtaaagtcttcataaaagaccttgaatgatgcctaggatggcagagcccctgggtcctactccatcctccagcctttgtccttgtcctggcctcctgctctccagatctgtaaactgggctcaaggactgtacaagcagagtacaactacccgcctccccggtgccagggcgcctgttgggtttggtcctgtgtagatgattcccagagtctcattcatccagctcctcttcagacagaaggtccccatggtcagacagctggtctgcattgctggtactggttgcatcatcctcatcctcagagctggcttcacaggcagtgtggaagagctgcatgagttctcgaaaatggtgggaaacctaagaaaggaggagggctgtattcactgatccttagtaacatgttaacatttatgaagcactatatattgatttgcaaaatcttttgtttattccacacagcaaggttgaga

SEQ ID NO: 18131 - DNA, 2737 bp, Homo sapiens
cggcgcggctgaggcgcggcggccccgtggagcagcgcagtatggcgggcggggcccgggaggtgctcacactgcagttgggacattttgccggtttcgtgggcgcgcactggtggaaccagcaggatgctgcgctgggccgagcgaccgattccaaggagcccccgggagagctgtgccccgacgtcctgtatcgtacgggccggacgctgcacggccaggagacctacacgccgcgactcatcctcatggatctgaagggtagtttgagctccctaaaagaggaaggtggactctacagggacaaacagttggatgctgcaatagcatggcaggggaagctcaccacacacaaagaggaactctatcccaagaacccttatctccaagactttctgagtgcagagggagtgctgagtagtgatggtgtctggagggtcaaatccattcccaatggcaaaggttcctcaccactccccaccgctacaactccaaaaccacttatccctacagaggccagcatcagggtctggtcagacttcctcagagtccatctccatccccggagcatctgtatgattcagaagtacaaccacgatggggaagcaggtcggctggaggcttttggccaaggggaaagtgtcctaaaggaacccaagtaccaggaagagctggaggacaggctgcatttctacgtggaggaatgtgactacttgcagggcttccagatcctgtgtgacctgcacgatggcttctctggggtaggcgcgaaggcggcagagctgctacaagatgaatattcagggcggggaataataacctggggcctgctacctggtccctaccatcgtggggaggcccagagaaacatctatcgtctattaaacacagcttttggtctcgtgcacctgactgctcacagctctcttgtctgccccttgtccttgggtgggagcctgggcctgcgacccgagccacctgtcagcttcccttacctgcattatgatgtaagtctcggtgctcttgttctgactgcggcaggctacagggcctcctcatgctcccagtcagccgctgtctgttactggctctgttcttgaggcccgagcttgaactcagctgtgatgtggcctctcagatcacactgtcctatgcttgtccagcctggggtcaaacatacccctgattcgtcccctgggtctctctggtgttaatattctgcctccacacattcttttccaggcctgaggccaagtgcccatcttggtgtcttcttacaggccactctgcccttccactgcagtgccatcctggctacagccctggacacagtcactgttccttatcgcctgtgttcctctccagtttccatggttcatctggctgacatgctgagcttctgtgggaaaaaggtggtgacagcaggagcaatcatccctttccccttggctccaggccagtcccttcctgattccctgatgcagtttggaggagccaccccatggaccccactgtctgcatgtggggagccttctggaacacgttgctttgcccagtcagtggtgctgaggggtatagacagagcatgccacacaagccagctcaccccagggacacctccaccctctgcccttcatgcatgtaccactggggaagaaatcttggctcagtatttacaacagcagcagcctggagtcatgagttcttcccatctgctgctgactccctgcagggtggctcctccttacccccacctcttctcaagctgcagtccaccgggtatggttctggatggttcccccaagggagcagcagtggagagcatcccagtgtttggggcactgtgttcctcttcgtccctgcaccagaccctggaagccttggccagagacctcaccaaactcgacttgcggcgctgggccagcttcatggatgctggagtggagcacgatgacgtagcagagctgctgcaggagctacaaagcctggcccagtgctaccagggtggtgacagcctcgtggactaaagttcccagtgtgggagaaaggagctagtttgcaataaaaacagctggatgcaggagcccagtgtcttcatgcagaggagctcaatgtcgcgggactagctacaccaacatatgcactttttacatttagaaacactgtgattagaccacagaacaataaatatgtgccatcagaccaaaaaaaagtagagaaaggagctgaactccactctcgatgctacttacagaggacatctgtaaagtcttcataaaagaccttgaatgatgcctaggatggcagagcccctgggtcctactccatcctccagcctttgtccttgtcctggcctcctgctctccagatctgtaaactgggctcaaggactgtacaagcagagtacaactacccgcctccccggtgccagggcgcctgttgggtttggtcctgtgtagatgattcccagagtctcattcatccagctcctcttcagacagaaggtccccatggtcagacagctggtctgcattgctggtactggttgcatcatcctcatcctcagagctggcttcacaggcagtgtggaagagctgcatgagttctcgaaaatggtgggaaacctaagaaaggaggagggctgtattcactgatccttagtaacatgttaacatttatgaagcactatatattgatttgcaaaatcttttgtttattccacacagcaaggttgaga

SEQ ID NO: 18132 - DNA, 2431 bp, Homo sapiens
cggcgcggctgaggcgcggcggccccgtggagcagcgcagtatggcgggcggggcccgggaggtgctcacactgcagttgggacattttgccggtttcgtgggcgcgcactggtggaaccagcaggatgctgcgctgggccgagcgaccgattccaaggagcccccgggagagctgtgccccgacgtcctgtatcgtacgggccggacgctgcacggccaggagacctacacgccgcgactcatcctcatggatctgaagggtagtttgagctccctaaaagaggaaggtggactctacagggacaaacagttggatgctgcaatagcatggcaggggaagctcaccacacacaaagaggaactctatcccaagaacccttatctccaagactttctgagtgcagagggagtgctgagtagtgatggtgtctggagggtcaaatccattcccaatggcaaaggttcctcaccactccccaccgctacaactccaaaaccacttatccctacagaggccagcatcagggtctggtcagacttcctcagagtccatctccatccccggagcatctgtatgattcagaagtacaaccacgatggggaagcaggtcggctggaggcttttggccaaggggaaagtgtcctaaaggaacccaagtaccaggaagagctggaggacaggctgcatttctacgtggaggaatgtgactacttgcagggcttccagatcctgtgtgacctgcacgatggcttctctggggtaggcgcgaaggcggcagagctgctacaagatgaatattcagggcggggaataataacctggggcctgctacctggtccctaccatcgtggggaggcccagagaaacatctatcgtctattaaacacagcttttggtctcgtgcacctgactgctcacagctctcttgtctgccccttgtccttgggtgggagcctgggcctgcgacccgagccacctgtcagcttcccttacctgcattatgatgccactctgcccttccactgcagtgccatcctggctacagccctggacacagtcactgttccttatcgcctgtgttcctctccagtttccatggttcatctggctgacatgctgagcttctgtgggaaaaaggtggtgacagcaggagcaatcatccctttccccttggctccaggccagtcccttcctgattccctgatgcagtttggaggagccaccccatggaccccactgtctgcatgtggggagccttctggaacacgttgctttgcccagtcagtggtgctgaggggtatagacagagcatgccacacaagccagctcaccccagggacacctccaccctctgcccttcatgcatgtaccactggggaagaaatcttggctcagtatttacaacagcagcagcctggagtcatgagttcttcccatctgctgctgactccctgcagggtggctcctccttacccccacctcttctcaagctgcagtccaccggcagtggagagcatcccagtgtttggggcactgtgttcctcttcgtccctgcaccagaccctggaagccttggccagagacctcaccaaactcgacttgcggcgctgggccagcttcatggatgctggagtggagcacgatgacgtagcagagctgctgcaggagctacaaagcctggcccagtgctaccagggtggtgacagcctcgtggactaaagttcccagtgtgggagaaaggagctagtttgcaataaaaacagctggatgcaggagcccagtgtcttcatgcagaggagctcaatgtcgcgggactagctacaccaacatatgcactttttacatttagaaacactgtgattagaccacagaacaataaatatgtgccatcagaccaaaaaaaagtagagaaaggagctgaactccactctcgatgctacttacagaggacatctgtaaagtcttcataaaagaccttgaatgatgcctaggatggcagagcccctgggtcctactccatcctccagcctttgtccttgtcctggcctcctgctctccagatctgtaaactgggctcaaggactgtacaagcagagtacaactacccgcctccccggtgccagggcgcctgttgggtttggtcctgtgtagatgattcccagagtctcattcatccagctcctcttcagacagaaggtccccatggtcagacagctggtctgcattgctggtactggttgcatcatcctcatcctcagagctggcttcacaggcagtgtggaagagctgcatgagttctcgaaaatggtgggaaacctaagaaaggaggagggctgtattcactgatccttagtaacatgttaacatttatgaagcactatatattgatttgcaaaatcttttgtttattccacacagcaaggttgaga

SEQ ID NO: 18133 - DNA, 1703 bp, Homo sapiens
atgaactagaggatcccctagctatacaggtgtcctccagtttccatggttcatctggctgacatgctgagcttctgtgggaaaaaggtggtgacagcaggagcaatcatccctttccccttggctccaggccagtcccttcctgattccctgatgcagtttggaggagccaccccatggaccccactgtctgcatgtggggagccttctggaacacgttgctttgcccagtcagtggtgctgaggggtatagacagagcatgccacacaagccagctcaccccagggacacctccaccctctgcccttcatgcatgtaccactggggaagaaatcttggctcagtatttacaacagcagcagcctggagtcatgagttcttcccatctgctgctgactccctgcagggtggctcctccttacccccacctcttctcaagctgcagtccaccgggtatggttctggatggttcccccaagggagcaggtatgtaggaggtgaagaaaactgagatttcaagtatgggagagtttttactatctccattcctggattaaaagtgctgaaaaagtccacagttaaacattcctttattcaccctatggctcccaagaaaagcattcttcctctggagtactggtgtactaaggggacaatacaccaaatttgttgagtttacaatcaagtctactaaggttggacttccttatcagtttggcgagtcccagggcagaataatcatccatctacaggtctctgtttcctctccctccacagcagtggagagcatcccagtgtttggggcactgtgttcctcttcgtccctgcaccagaccctggaagccttggccagagacctcaccaaactcgacttgcggcgctgggccagcttcatggatgctggagtggagcacgatgacgtagcagagctgctgcaggagctacaaagcctggcccagtgctaccagggtggtgacagcctcgtggactaaagttcccagtgtgggagaaaggagctagtttgcaataaaaacagctggatgcaggagcccagtgtcttcatgcagaggagctcaatgtcgcgggactagctacaccaacatatgcactttttacatttagaaacactgtgattagaccacagaacaataaatatgtgccatcagaccaaaaaaaagtagagaaaggagctgaactccactctcgatgctacttacagaggacatctgtaaagtcttcataaaagaccttgaatgatgcctaggatggcagagcccctgggtcctactccatcctccagcctttgtccttgtcctggcctcctgctctccagatctgtaaactgggctcaaggactgtacaagcagagtacaactacccgcctccccggtgccagggcgcctgttgggtttggtcctgtgtagatgattcccagagtctcattcatccagctcctcttcagacagaaggtccccatggtcagacagctggtctgcattgctggtactggttgcatcatcctcatcctcagagctggcttcacaggcagtgtggaagagctgcatgagttctcgaaaatggtgggaaacctaagaaaggaggagggctgtattcactgatccttagtaacatgttaacatttatgaagcactatatattgatttgcaaaatcttttgtttattccacacagcaaggttgaga

SEQ ID NO: 18134 - DNA, 1529 bp, Homo sapiens
agtacacaggctcaagatggagacacaggctcaagatgaacacgttgctttgcccagtcagtggtgctgaggggtatagacagagcatgccacacaagccagctcaccccagggacacctccaccctctgcccttcatgcatgtaccactggggaagaaatcttggctcagtatttacaacagcagcagcctggagtcatgagttcttcccatctgctgctgactccctgcagggtggctcctccttacccccacctcttctcaagctgcagtccaccgggtatggttctggatggttcccccaagggagcaggtatgtaggaggtgaagaaaactgagatttcaagtatgggagagtttttactatctccattcctggattaaaagtgctgaaaaagtccacagttaaacattcctttattcaccctatggctcccaagaaaagcattcttcctctggagtactggtgtactaaggggacaatacaccaaatttgttgagtttacaatcaagtctactaaggttggacttccttatcagtttggcgagtcccagggcagaataatcatccatctacaggtctctgtttcctctccctccacagcagtggagagcatcccagtgtttggggcactgtgttcctcttcgtccctgcaccagaccctggaagccttggccagagacctcaccaaactcgacttgcggcgctgggccagcttcatggatgctggagtggagcacgatgacgtagcagagctgctgcaggagctacaaagcctggcccagtgctaccagggtggtgacagcctcgtggactaaagttcccagtgtgggagaaaggagctagtttgcaataaaaacagctggatgcaggagcccagtgtcttcatgcagaggagctcaatgtcgcgggactagctacaccaacatatgcactttttacatttagaaacactgtgattagaccacagaacaataaatatgtgccatcagaccaaaaaaaagtagagaaaggagctgaactccactctcgatgctacttacagaggacatctgtaaagtcttcataaaagaccttgaatgatgcctaggatggcagagcccctgggtcctactccatcctccagcctttgtccttgtcctggcctcctgctctccagatctgtaaactgggctcaaggactgtacaagcagagtacaactacccgcctccccggtgccagggcgcctgttgggtttggtcctgtgtagatgattcccagagtctcattcatccagctcctcttcagacagaaggtccccatggtcagacagctggtctgcattgctggtactggttgcatcatcctcatcctcagagctggcttcacaggcagtgtggaagagctgcatgagttctcgaaaatggtgggaaacctaagaaaggaggagggctgtattcactgatccttagtaacatgttaacatttatgaagcactatatattgatttgcaaaatcttttgtttattccacacagcaaggttgaga

SEQ ID NO: 18135 - DNA, 1645 bp, Homo sapiens
ttggtgggataccccttgttctatagacgtggtgacaagagtaagaggctggtgattagacaaaacatctcactgcgggcttcgttaacattagcacgctctgtggtttggtctccctatatattattcactcttgggaacagttgttttatgagctattctactctcgccccgcgccccccgttataaactatttgtgtgtgaggcgtaatgatctactacccaaccgatgacgtgtgttactcggtcgtctatggattcctcaatgagtcggtgcgcctgtttcaatgagagatagccgccactgctgggacgtagttgttgtgctacaaaagccacccggcccttttttatgtcatgacgtggtttttctctttttattctttttttttttttgtcccttctttttttttttttttttgtttttctttttttttttttttttttttttttttttttttttttttttttttttttttttttttttttttttttttttttttttttttttttttccacagttaaacattcctttattcaccctatggctcccaagaaaagcattcttcctctggagtactggtgtactaaggggacaatacaccaaatttgttgagtttacaatcaagtctactaaggttggacttccttatcagtttggcgagtcccagggcagaataatcatccatctacaggtctctgtttcctctccctccacagcagtggagagcatcccagtgtttggggcactgtgttcctcttcgtccctgcaccagaccctggaagccttggccagagacctcaccaaactcgacttgcggcgctgggccagcttcatggatgctggagtggagcacgatgacgtagcagagctgctgcaggagctacaaagcctggcccagtgctaccagggtggtgacagcctcgtggactaaagttcccagtgtgggagaaaggagctagtttgcaataaaaacagctggatgcaggagcccagtgtcttcatgcagaggagctcaatgtcgcgggactagctacaccaacatatgcactttttacatttagaaacactgtgattagaccacagaacaataaatatgtgccatcagaccaaaaaaaagtagagaaaggagctgaactccactctcgatgctacttacagaggacatctgtaaagtcttcataaaagaccttgaatgatgcctaggatggcagagcccctgggtcctactccatcctccagcctttgtccttgtcctggcctcctgctctccagatctgtaaactgggctcaaggactgtacaagcagagtacaactacccgcctccccggtgccagggcgcctgttgggtttggtcctgtgtagatgattcccagagtctcattcatccagctcctcttcagacagaaggtccccatggtcagacagctggtctgcattgctggtactggttgcatcatcctcatcctcagagctggcttcacaggcagtgtggaagagctgcatgagttctcgaaaatggtgggaaacctaagaaaggaggagggctgtattcactgatccttagtaacatgttaacatttatgaagcactatatattgatttgcaaaatcttttgtttattccacacagcaaggttgaga

SEQ ID NO: 18136 - DNA, 1181 bp, Homo sapiens
ggtgggaagtggagaggggagggaggagggaggggaggaagaggaatgtatccacagttaaacattcctttattcaccctatggctcccaagaaaagcattcttcctctggagtactggtgtactaaggggacaatacaccaaatttgttgagtttacaatcaagtctactaaggttggacttccttatcagtttggcgagtcccagggcagaataatcatccatctacaggtctctgtttcctctccctccacagcagtggagagcatcccagtgtttggggcactgtgttcctcttcgtccctgcaccagaccctggaagccttggccagagacctcaccaaactcgacttgcggcgctgggccagcttcatggatgctggagtggagcacgatgacgtagcagagctgctgcaggagctacaaagcctggcccagtgctaccagggtggtgacagcctcgtggactaaagttcccagtgtgggagaaaggagctagtttgcaataaaaacagctggatgcaggagcccagtgtcttcatgcagaggagctcaatgtcgcgggactagctacaccaacatatgcactttttacatttagaaacactgtgattagaccacagaacaataaatatgtgccatcagaccaaaaaaaagtagagaaaggagctgaactccactctcgatgctacttacagaggacatctgtaaagtcttcataaaagaccttgaatgatgcctaggatggcagagcccctgggtcctactccatcctccagcctttgtccttgtcctggcctcctgctctccagatctgtaaactgggctcaaggactgtacaagcagagtacaactacccgcctccccggtgccagggcgcctgttgggtttggtcctgtgtagatgattcccagagtctcattcatccagctcctcttcagacagaaggtccccatggtcagacagctggtctgcattgctggtactggttgcatcatcctcatcctcagagctggcttcacaggcagtgtggaagagctgcatgagttctcgaaaatggtgggaaacctaagaaaggaggagggctgtattcactgatccttagtaacatgttaacatttatgaagcactatatattgatttgcaaaatcttttgtttattccacacagcaaggttgaga

SEQ ID NO: 18137 - DNA, 2101 bp, Homo sapiens
cggcgcggctgaggcgcggcggccccgtggagcagcgcagtatggcgggcggggcccgggaggtgctcacactgcagttgggacattttgccggtttcgtgggcgcgcactggtggaaccagcaggatgctgcgctgggccgagcgaccgattccaaggagcccccgggagagctgtgccccgacgtcctgtatcgtacgggccggacgctgcacggccaggagacctacacgccgcgactcatcctcatggatctgaagggtagtttgagctccctaaaagaggaaggtggactctacagggacaaacagttggatgctgcaatagcatggcaggggaagctcaccacacacaaagaggaactctatcccaagaacccttatctccaagactttctgagtgcagagggagtgctgagtagtgatggtgtctggagggtcaaatccattcccaatggcaaaggttcctcaccactccccaccgctacaactccaaaaccacttatccctacagaggccagcatcagggtctggtcagacttcctcagagtccatctccatccccggagcatctgtatgattcagaagtacaaccacgatggggaagcaggtcggctggaggcttttggccaaggggaaagtgtcctaaaggaacccaagtaccaggaagagctggaggacaggctgcatttctacgtggaggaatgtgactacttgcagggcttccagatcctgtgtgacctgcacgatggcttctctggggtaggcgcgaaggcggcagagctgctacaagatgaatattcagggcggggaataataacctggggcctgctacctggtccctaccatcgtggggaggcccagagaaacatctatcgtctattaaacacagcttttggtctcgtgcacctgactgctcacagctctcttgtctgccccttgtccttgggtgggagcctgggcctgcgacccgagccacctgtcagcttcccttacctgcattatgatgccactctgcccttccactgcagtgccatcctggctacagccctggacacagtcactgttccttatcgcctgtgttcctctccagtttccatggttcatctggctgacatgctgagcttctgtgggaaaaaggtggtgacagcaggagcaatcatccctttccccttggctccaggccagtcccttcctgattccctgatgcagtttggaggagccaccccatggaccccactgtctgcatgtggggagccttctggaacacgttgctttgcccagtcagtggtgctgaggggtatagacagagcatgccacacaagccagctcaccccagggacacctccaccctctgcccttcatgcatgtaccactggggaagaaatcttggctcagtatttacaacagcagcagcctggagtcatgagttcttcccatctgctgctgactccctgcagggtggctcctccttacccccacctcttctcaagctgcagtccaccgggtatggttctggatggttcccccaagggagcaggtatgtaggaggtgaagaaaactgagatttcaagtatgggagagtttttactatctccattcctggattaaaagtgctgaaaaagtccacagttaaacattcctttattcaccctatggctcccaagaaaagcattcttcctctggagtactggtgtactaaggggacaatacaccaaatttgttgagtttacaatcaagtctactaaggttggacttccttatcagtttggcgagtcccagggcagaataatcatccatctacaggtctctgtttcctctccctccacagcagtggagagcatcccagtgtttggggcactgtgttcctcttcgtccctgcaccagaccctggaagccttggccagagacctcaccaaactcgacttgcggcgctgggccagcttcatggatgctggagtggagcacgatgacgtagcagagctgctgcaggagctacaaagcctggcccagtgctaccagggtggtgacagcctcgtggactaaagttcccagtgtgggagaaaggagctagtttgcaataaaaacagctggatgcagga

SEQ ID NO: 18138 - DNA, 1254 bp, Homo sapiens
cggcgcggctgaggcgcggcggccccgtggagcagcgcagtatggcgggcggggcccgggaggtgctcacactgcagttgggacattttgccggtttcgtgggcgcgcactggtggaaccagcaggatgctgcgctgggccgagcgaccgattccaaggagcccccgggagagctgtgccccgacgtcctgtatcgtacgggccggacgctgcacggccaggagacctacacgccgcgactcatcctcatggatctgaaggttacccccacctcttctcaagctgcagtccaccgggtatggttctggatggttcccccaagggagcagcagtggagagcatcccagtgtttggggcactgtgttcctcttcgtccctgcaccagaccctggaagccttggccagagacctcaccaaactcgacttgcggcgctgggccagcttcatggatgctggagtggagcacgatgacgtagcagagctgctgcaggagctacaaagcctggcccagtgctaccagggtggtgacagcctcgtggactaaagttcccagtgtgggagaaaggagctagtttgcaataaaaacagctggatgcaggagcccagtgtcttcatgcagaggagctcaatgtcgcgggactagctacaccaacatatgcactttttacatttagaaacactgtgattagaccacagaacaataaatatgtgccatcagaccaaaaaaaagtagagaaaggagctgaactccactctcgatgctacttacagaggacatctgtaaagtcttcataaaagaccttgaatgatgcctaggatggcagagcccctgggtcctactccatcctccagcctttgtccttgtcctggcctcctgctctccagatctgtaaactgggctcaaggactgtacaagcagagtacaactacccgcctccccggtgccagggcgcctgttgggtttggtcctgtgtagatgattcccagagtctcattcatccagctcctcttcagacagaaggtccccatggtcagacagctggtctgcattgctggtactggttgcatcatcctcatcctcagagctggcttcacaggcagtgtggaagagctgcatgagttctcgaaaatggtgggaaacctaagaaaggaggagggctgtattcactgatccttagtaacatgttaacatttatgaagcactatatattgatttgcaaaatcttttgtttattccacacagcaaggttgaga

SEQ ID NO: 18139 - DNA, 1835 bp, Homo sapiens
cggcgcggctgaggcgcggcggccccgtggagcagcgcagtatggcgggcggggcccgggaggtgctcacactgcagttgggacattttgccggtttcgtgggcgcgcactggtggaaccagcaggatgctgcgctgggccgagcgaccgattccaaggagcccccgggagagctgtgccccgacgtcctgtatcgtacgggccggacgctgcacggccaggagacctacacgccgcgactcatcctcatggatctgaagggtagtttgagctccctaaaagaggaaggtggactctacagggacaaacagttggatgctgcaatagcatggcaggggaagctcaccacacacaaagaggaactctatcccaagaacccttatctccaagactttctgagtgcagagggagtgctgagtagtgatggtgtctggagggtcaaatccattcccaatggcaaaggttcctcaccactccccaccgctacaactccaaaaccacttatccctacagaggccagcatcagggtctggtcagacttcctcagagtccatctccatccccggagcatctgtatgattcagaagtacaaccacgatggggaagcaggtcggctggaggcttttggccaaggggaaagtgtcctaaaggaacccaagtaccaggaagagctggaggacaggctgcatttctacgtggaggaatgtgactacttgcagggcttccagatcctgtgtgacctgcacgatggcttctctggggtaggcgcgaaggcggcagagctgctacaagatgaatattcagggcggggaataataacctggggcctgctacctggtccctaccatcgtggggaggcccagagaaacatctatcgtctattaaacacagcttttggtctcgtgcacctgactgctcacagctctcttgtctgccccttgtccttgggtgggagcctgggcctgcgacccgagccacctgtcagcttcccttacctgcattatgatgccactctgcccttccactgcagtgccatcctggctacagccctggacacagtcactgttccttatcgcctgtgttcctctccagtttccatggttcatctggctgacatgctgagcttctgtgggaaaaaggtggtgacagcaggagcaatcatccctttccccttggctccaggccagtcccttcctgattccctgatgcagtttggaggagccaccccatggaccccactgtctgcatgtggggagccttctggaacacgttgctttgcccagtcagtggtgctgaggggtatagacagagcatgccacacaagccagctcaccccagggacacctccaccctctgcccttcatgcatgtaccactggggaagaaatcttggctcagtatttacaacagcagcagcctggagtcatgagttcttcccatctgctgctgactccctgcagggtggctcctccttacccccacctcttctcaagctgcagtccaccgggtatggttctggatggttcccccaagggagcaggtctctgtttcctctccctccacagcagtggagagcatcccagtgtttggggcactgtgttcctcttcgtccctgcaccagaccctggaagccttggccagagacctcaccaaactcgacttgcggcgctgggccagcttcatggatgctggagtggagcacgatgacgtagcagagctgctgcaggagctacaaagcctggcccagtgctaccagggtggtgacagcctcgtggactaaagttcccagtgtgggagaaaggagctagtttgcaataaaaacagctggatgcagga

SEQ ID NO: 18140 - DNA, 1665 bp, Homo sapiens
cggcgcggctgaggcgcggcggccccgtggagcagcgcagtatggcgggcggggcccgggaggtgctcacactgcagttgggacattttgccggtttcgtgggcgcgcactggtggaaccagcaggatgctgcgctgggccgagcgaccgattccaaggagcccccgggagagctgtgccccgacgtcctgtatcgtacgggccggacgctgcacggccaggagacctacacgccgcgactcatcctcatggatctgaagggtagtttgagctccctaaaagaggaaggtggactctacagggacaaacagttggatgctgcaatagcatggcaggggaagctcaccacacacaaagaggaactctatcccaagaacccttatctccaagactttctgagtgcagagggagtgctgagtagtgatggtgtctggagggtcaaatccattcccaatggcaaaggttcctcaccactccccaccgctacaactccaaaaccacttatccctacagaggccagcatcagggtctggtcagacttcctcagagtccatctccatccccggagcatctgtatgattcagaagtacaaccacgatggggaagcaggtcggctggaggcttttggccaaggggaaagtgtcctaaaggaacccaagtaccaggaagagctggaggacaggctgcatttctacgtggaggaatgtgactacttgcagggcttccagatcctgtgtgacctgcacgatggcttctctggggtaggcgcgaaggcggcagagctgctacaagatgaatattcagggcggggaataataacctggggcctgctacctggtccctaccatcgtggggaggcccagagaaacatctatcgtctattaaacacagcttttggtctcgtgcacctgactgctcacagctctcttgtctgccccttgtccttgggtgggagcctgggcctgcgacccgagccacctgtcagcttcccttacctgcattatgatgccactctgcccttccactgcagtgccatcctggctacagccctggacacagtcactgttccttatcgcctgtgttcctctccagtttccatggttcatctggctgacatgctgagcttctgtgggaaaaaggtggtgacagcaggagcaatcatccctttccccttggctccaggccagtcccttcctgattccctgatgcagtttggaggagccaccccatggaccccactgtctgcatgtggggagccttctggctttgtccttgtcctggcctcctgctctccagatctgtaaactgggctcaaggactgtacaagcagagtacaactacccgcctccccggtgccagggcgcctgttgggtttggtcctgtgtagatgattcccagagtctcattcatccagctcctcttcagacagaaggtccccatggtcagacagctggtctgcattgctggtactggttgcatcatcctcatcctcagagctggcttcacaggcagtgtggaagagctgcatgagttctcgaaaatggtgggaaacctaagaaaggaggagggctgtattcactgatccttagtaacatgttaacatttatgaagcactatatattgatttgcaaaatcttttgtttattccacacagcaaggttgaga

SEQ ID NO: 18141 - DNA, 1487 bp, Homo sapiens
cggcgcggctgaggcgcggcggccccgtggagcagcgcagtatggcgggcggggcccgggaggtgctcacactgcagttgggacattttgccggtttcgtgggcgcgcactggtggaaccagcaggatgctgcgctgggccgagcgaccgattccaaggagcccccgggagagctgtgccccgacgtcctgtatcgtacgggccggacgctgcacggccaggagacctacacgccgcgactcatcctcatggatctgaagggtagtttgagctccctaaaagaggaaggtggactctacagggacaaacagttggatgctgcaatagcatggcaggggaagctcaccacacacaaagaggaactctatcccaagaacccttatctccaagactttctgagtgcagagggagtgctgagtagtgatggtgtctggagggtcaaatccattcccaatggcaaaggttcctcaccactccccaccgctacaactccaaaaccacttatccctacagaggccagcatcagggtctggtcagacttcctcagagtccatctccatccccggagcatctgtatgattcagaagtacaaccacgatggggaagcaggtcggctggaggcttttggccaaggggaaagtgtcctaaaggaacccaagtaccaggaagagctggaggacaggctgcatttctacgtggaggaatgtgactacttgcagggcttccagatcctgtgtgacctgcacgatggcttctctggggtaggcgcgaaggcggcagagctgctacaagatgaatattcagggcggggaataataacctggggcctgctacctggtccctaccatcgtggggaggcccagagaaacatctatcgtctattaaacacagcttttggtctcgtgcacctgactgctcacagctctcttgtctgccccttgtccttgggtgggagcctgggcctgcgacccgagccacctgtcagcttcccttacctgcattatgatgtaagtctcggtgctcttgttctgactgcggcaggctacagggcctcctcatgctcccagtcagccgctgtctgttactggctctgttcttgaggcccgagcttgaactcagctgtgatgtggccttcaaggactgtacaagcagagtacaactacccgcctccccggtgccagggcgcctgttgggtttggtcctgtgtagatgattcccagagtctcattcatccagctcctcttcagacagaaggtccccatggtcagacagctggtctgcattgctggtactggttgcatcatcctcatcctcagagctggcttcacaggcagtgtggaagagctgcatgagttctcgaaaatggtgggaaacctaagaaaggaggagggctgtattcactgatccttagtaacatgttaacatttatgaagcactatatattgatttgcaaaatcttttgtttattccacacagcaaggttgaga

SEQ ID NO: 18142 - DNA, 1177 bp, Homo sapiens
cggcgcggctgaggcgcggcggccccgtggagcagcgcagtatggcgggcggggcccgggaggtgctcacactgcagttgggacattttgccggtttcgtgggcgcgcactggtggaaccagcaggatgctgcgctgggccgagcgaccgattccaaggagcccccgggagagctgtgccccgacgtcctgtatcgtacgggccggacgctgcacggccaggagacctacacgccgcgactcatcctcatggatctgaagggtagtttgagctccctaaaagaggaaggtggactctacagggacaaacagttggatgctgcaatagcatggcaggggaagctcaccacacacaaagaggaactctatcccaagaacccttatctccaagactttctgagtgcagaggactgcgactcggtgaacagaaaggaggctatgcggtgtggccagccaactcaaggaggacgaagcaacctttgcctctaaactgcctggaaccaaatgtcgatttttctgacccctcccagggagtgctgagtagtgatggtgtctggagggtcaaatccattcccaatggcaaaggttcctcaccactccccaccgctacaactccaaaaccacttatccctacagaggccagcatcagggtctggtcagacttcctcagagtccatctccatccccggagcatctgtatgattcagaagtacaaccacgatggggaagcaggtcggctggaggcttttggccaaggggaaagtgtcctaaaggaacccaagtaccaggaagagctggaggacaggctgcatttctacgtggaggaatgtgactacttgcagggcttccagatcctgtgtgacctgcacgatggcttctctggggtaggcgcgaaggcggcagagctgctacaagatgaatattcagggcggggaataataacctggggcctgctacctggtccctaccatcgtgggggccagagacctcaccaaactcgacttgcggcgctgggccagcttcatggatgctggagtggagcacgatgacgtagcagagctgctgcaggagctacaaagcctggcccagtgctaccagggtggtgacagcctcgtggactaaagttcccagtgtgggagaaaggagctagtttgcaataaaaacagctggatgcagga

SEQ ID NO: 18143 - DNA, 358 bp, Homo sapiens
gtaaacggggattttaatcattttaagtgtcttagaatgatattttgggaaaaagcactccttttcctaaggactgcgactcggtgaacagaaaggaggctatgcggtgtggccagccaactcaaggaggacgaagcaacctttgcctctaaactgcctggaaccaaatgtcgatttttctgacccctcccagggagtgctgagtagtgatggtgtctggagggtcaaatccattcccaatggcaaaggtgagacttctccagatactgatggatgggggcttgggtagagcagaaacatggagaaaggtacatttcctctgcttgtcttcaggttcctcaccactccccaccgctac

SEQ ID NO: 18144 - DNA, 447 bp, Homo sapiens
agatgtaagtcttggatcatgtttacttgtggcagggaagcaggtcggctggaggcttttggccaaggggaaagtgtcctaaaggaacccaagtaccaggaagagctggaggacaggctgcatttctacgtggaggaatgtgactacttgcaggtagtggcgtggcaatgtgcactccagggtggaagctcttctcatcctgctaactatcttttgtcactcacccccgtccagggcttccagatcctgtgtgacctgcacgatggcttctctggggtaggcgcgaaggcggcagagctgctacaagatgaatattcagggcggggaataataacctggggcctgctacctggtccctaccatcgtgggtgagtggaacttagagaagtaaacagtcacacagtggggagggagaaatcagaatcccagtgggagagctgcttaata

SEQ ID NO: 18145 - DNA, 1517 bp, Homo sapiens
ctctggccgttgtcactcgactaccaagatggcggcccccgggagctgtgctctatggagctattgcggccgtgggtggtcgcgggcgatgcggggctgccagctcctcgggcttcgtagctcttggcccggggacctactaagtgctcggctcttgtcccaagagaagcgggcagcggaaacgcactttgggtttgagactgtgtcggaagaggagaaggggggcaaagtctatcaggtgtttgaaagtgtggctaagaagtatgatgtgatgaatgatatgatgagtcttggtatccatcgtgtttggaaggatttgctgctctggaagatgcacccgcttcctgggacccagctgcttgatgttgctggaggcacaggtgacattgcattccggttccttaattatgttcagtcccagcatcagagaaaacagaagaggcagttaagggcccaacaaaatttatcctgggaagaaattgccaaagagtaccagaatgaagaagattccttgggcgggtctcgtgtcgtggtgtgtgacatcaacaaggagatgctaaaggttggaaagcagaaagccttggctcaaggatacagagctggacttgcatgggtattaggagatgctgaagaactgccctttgatgatgacaagtttgatatttacaccattgcctttgggatccggaatgtcacacacattgatcaggcactccaggaagctcatcgggtgctgaaaccaggaggacggtttctctgtctggaatttagccaagtgaacaatcccctcatatccaggctttatgatctatatagcttccaggtcatccctgtcctgggagaggtcatcgctggagactggaagtcctatcagtaccttgtagagagtatccgaaggtttccgtctcaggaagagttcaaggacatgatagaagatgcaggctttcacaaggtgacttacgaaagtctaacatcaggcattgtggccattcattctggcttcaaactttaattcctttcctatcatggagcatgaaccagtcatatcctgttgaaagcctggaactgaaggataatctggcaaatgagacagcagcagagcatctcctcttaaggatacgtgccttggactcatgtttgaatcgaacagtctcaaagtggaagaacaaattcttgtcacttttttacagctttctttggagctgcttcagtccatctcccagaggcatttggtctgtatctttgctcaactgctaatttctcttggctgtagggtgtgtggttaaggtacaaccacccctaaagctcagttttgaagtgagtgtatttatagcttctctgctggtgctgccttctagagggatgatagatcatttgaacccaatgacaatttttaaccagaaaatttaattgtacctgaatcaacctttcagcctaggacgaagtctaggcccaagtcagagtattaatgatcatgagaattgtgtgctgaaccagtaaacgagtttaccttttga

SEQ ID NO: 18146 - DNA, 726 bp, Homo sapiens
ctctggccgttgtcactcgactaccaagatggcggcccccgggagctgtgctctatggagctattgcggccgtgggtggtcgcgggcgatgcggggctgccagctcctcgggcttcgtagctcttggcccggggacctactaagtgctcggctcttgtcccaagagaagcgggcagcggaaacgcactttgggtttgagactgtgtcggaagaggagaaggggggcaaagaactcctttaatgtgaaagtttttgctggcatcacttcttctgggacatcttcaacctttttgtcacagctccatttcttgttcatgttgtctatcaggtgtttgaaagtgtggctaagaagtatgatgtgatgaatgatatgatgagtcttggtatccatcgtgtttggaaggatttgctgctctggaagatgcacccgcttcctgggacccagctgcttgatgttgctggaggcacaggtgacattgcattccggttccttaattatgttcagtcccagcatcagagaaaacagaagaggcagttaagggcccaacaaaatttatcctgggaagaaattgccaaagagtaccagaatgaagaagattccttgggcgggtctcgtgtcgtggtgtgtgacatcaacaaggagatgctaaaggttggaaagcagaaagccttggctcaaggatacagagctggacttgcatgagctcattatggtagcatgcttca

SEQ ID NO: 18147 - DNA, 467 bp, Homo sapiens
atcgtctcatgagctagtgtagactgatagaatatgcacggcttgtcacaagggtgacttacgaaagtctaacatcaggcattgtggccattcattctggcttcaaactttaattcctttcctatcatggagcatgaaccagtcatatcctgttgaatgcctggaactgaaggataatctggcaaatgagacagcagcagagcatctcctcttaaggatacgtgccttggactcatgtttgaatcgaacagtctcaaagtggaagaacaaattcttgtcacttttttacagctttctttggagctgcttcagtccatctcccagaggcatttggtctgtatctttgctcaactgctaatttctcttggctgtagggtgtgtggttaaggtacaaccacccctaaagctcagttttgaagtgagtgtatttatagcttctctgctggtgctgccttctagagggatga

SEQ ID NO: 18148 - DNA, 1607 bp, Homo sapiens
ctctggccgttgtcactcgactaccaagatggcggcccccgggagctgtgctctatggagctattgcggccgtgggtggtcgcgggcgatgcggggctgccagctcctcgggcttcgtagctcttggcccggggacctactaagtgctcggctcttgtcccaagagaagcgggcagcggaaacgcactttgggtttgagactgtgtcggaagaggagaaggggggcaaagaactcctttaatgtgaaagtttttgctggcatcacttcttctgggacatcttcaacctttttgtcacagctccatttcttgttcatgttgtctatcaggtgtttgaaagtgtggctaagaagtatgatgtgatgaatgatatgatgagtcttggtatccatcgtgtttggaaggatttgctgctctggaagatgcacccgcttcctgggacccagctgcttgatgttgctggaggcacaggtgacattgcattccggttccttaattatgttcagtcccagcatcagagaaaacagaagaggcagttaagggcccaacaaaatttatcctgggaagaaattgccaaagagtaccagaatgaagaagattccttgggcgggtctcgtgtcgtggtgtgtgacatcaacaaggagatgctaaaggttggaaagcagaaagccttggctcaaggatacagagctggacttgcatgggtattaggagatgctgaagaactgccctttgatgatgacaagtttgatatttacaccattgcctttgggatccggaatgtcacacacattgatcaggcactccaggaagctcatcgggtgctgaaaccaggaggacggtttctctgtctggaatttagccaagtgaacaatcccctcatatccaggctttatgatctatatagcttccaggtcatccctgtcctgggagaggtcatcgctggagactggaagtcctatcagtaccttgtagagagtatccgaaggtttccgtctcaggaagagttcaaggacatgatagaagatgcaggctttcacaaggtgacttacgaaagtctaacatcaggcattgtggccattcattctggcttcaaactttaattcctttcctatcatggagcatgaaccagtcatatcctgttgaaagcctggaactgaaggataatctggcaaatgagacagcagcagagcatctcctcttaaggatacgtgccttggactcatgtttgaatcgaacagtctcaaagtggaagaacaaattcttgtcacttttttacagctttctttggagctgcttcagtccatctcccagaggcatttggtctgtatctttgctcaactgctaatttctcttggctgtagggtgtgtggttaaggtacaaccacccctaaagctcagttttgaagtgagtgtatttatagcttctctgctggtgctgccttctagagggatgatagatcatttgaacccaatgacaatttttaaccagaaaatttaattgtacctgaatcaacctttcagcctaggacgaagtctaggcccaagtcagagtattaatgatcatgagaattgtgtgctgaaccagtaaacgagtttaccttttga

SEQ ID NO: 18149 - DNA, 1165 bp, Homo sapiens
tcgtgccgaattcggcagagggaggcacgtgacattgcattccggttccttaattatgttcagtcccagcatcagagaaaacagaagaggcagttaagggcccaacaaaatttatcctgggaagaaattgccaaagagtaccagaatgaagaagattccttgggcgggtctcgtgtcgtggtgtgtgacatcaacaaggagatgctaaaggttggaaagcagaaagccttggctcaaggatacagagctggacttgcatgggtattaggagatgctgaagaactgccctttgatgatgacaagtttgatatttacaccattgcctttgggatccggaatgtcacacacattgatcaggcactccaggaagctcatcgggtgctgaaaccaggaggacggtttctctgtctggaatttagccaagtgaacaatcccctcatatccaggctttatgatctatatagcttccaggtcatccctgtcctgggagaggtcatcgctggagactggaagtcctatcagtaccttgtagagagtatccgaaggtttccgtctcaggaagagttcaaggacatgatagaagatgcaggctttcacaaggtgacttacgaaagtctaacatcaggcattgtggccattcattctggcttcaaactttaattcctttcctatcatggagcatgaaccagtcatatcctgttgaaagcctggaactgaaggataatctggcaaatgagacagcagcagagcatctcctcttaaggatacgtgccttggactcatgtttgaatcgaacagtctcaaagtggaagaacaaattcttgtcacttttttacagctttctttggagctgcttcagtccatctcccagaggcatttggtctgtatctttgctcaactgctaatttctcttggctgtagggtgtgtggttaaggtacaaccacccctaaagctcagttttgaagtgagtgtatttatagcttctctgctggtgctgccttctagagggatgatagatcatttgaacccaatgacaatttttaaccagaaaatttaattgtacctgaatcaacctttcagcctaggacgaagtctaggcccaagtcagagtattaatgatcatgagaattgtgtgctgaaccagtaaacgagtttaccttttga

SEQ ID NO: 18150 - DNA, 1463 bp, Homo sapiens
ctctggccgttgtcactcgactaccaagatggcggcccccgggagctgtgctctatggagctattgcggccgtgggtggtcgcgggcgatgcggggctgccagctcctcgggcttcgtagctcttggcccggggacctactaagtgctcggctcttgtcccaagagaagcgggcagcggaaacgcactttgggtttgagactgtgtcggaagaggagaaggggggcaaagtctatcaggtgtttgaaagtgtggctaagaagtatgatgtgatgaatgatatgatgagtcttggtatccatcgtgtttggaaggatttgctgctctggaagatgcacccgcttcctgggacccagctgcttgatgttgctggaggcacaggtgacattgcattccggttccttaattatgttcagtcccagcatcagagaaaacagaagaggcagttaagggcccaactgggcgggtctcgtgtcgtggtgtgtgacatcaacaaggagatgctaaaggttggaaagcagaaagccttggctcaaggatacagagctggacttgcatgggtattaggagatgctgaagaactgccctttgatgatgacaagtttgatatttacaccattgcctttgggatccggaatgtcacacacattgatcaggcactccaggaagctcatcgggtgctgaaaccaggaggacggtttctctgtctggaatttagccaagtgaacaatcccctcatatccaggctttatgatctatatagcttccaggtcatccctgtcctgggagaggtcatcgctggagactggaagtcctatcagtaccttgtagagagtatccgaaggtttccgtctcaggaagagttcaaggacatgatagaagatgcaggctttcacaaggtgacttacgaaagtctaacatcaggcattgtggccattcattctggcttcaaactttaattcctttcctatcatggagcatgaaccagtcatatcctgttgaaagcctggaactgaaggataatctggcaaatgagacagcagcagagcatctcctcttaaggatacgtgccttggactcatgtttgaatcgaacagtctcaaagtggaagaacaaattcttgtcacttttttacagctttctttggagctgcttcagtccatctcccagaggcatttggtctgtatctttgctcaactgctaatttctcttggctgtagggtgtgtggttaaggtacaaccacccctaaagctcagttttgaagtgagtgtatttatagcttctctgctggtgctgccttctagagggatgatagatcatttgaacccaatgacaatttttaaccagaaaatttaattgtacctgaatcaacctttcagcctaggacgaagtctaggcccaagtcagagtattaatgatcatgagaattgtgtgctgaaccagtaaacgagtttaccttttga

SEQ ID NO: 18151 - DNA, 1452 bp, Homo sapiens
atttgccaccttcttgtcgtatgaaatatcttttctatgccttggcaaattgccatatttctttctaagtttttatctacttctgatattttatcctttgtgctttcaatgttatgaaatacctccaagaactcctttaatgtgaaagtttttgctggcatcacttcttctgggacatcttcaacctttttgtcacagctccatttcttgttcatgttgtctatcaggtgtttgaaagtgtggctaagaagtatgatgtgatgaatgatatgatgagtcttggtatccatcgtgtttggaaggatttgctgctctggaagatgcacccgcttcctgggacccagctgcttgatgttgctggaggcacaggtgacattgcattccggttccttaattatgttcagtcccagcatcagagaaaacagaagaggcagttaagggcccaactgggcgggtctcgtgtcgtggtgtgtgacatcaacaaggagatgctaaaggttggaaagcagaaagccttggctcaaggatacagagctggacttgcatgggtattaggagatgctgaagaactgccctttgatgatgacaagtttgatatttacaccattgcctttgggatccggaatgtcacacacattgatcaggcactccaggaagctcatcgggtgctgaaaccaggaggacggtttctctgtctggaatttagccaagtgaacaatcccctcatatccaggctttatgatctatatagcttccaggtcatccctgtcctgggagaggtcatcgctggagactggaagtcctatcagtaccttgtagagagtatccgaaggtttccgtctcaggaagagttcaaggacatgatagaagatgcaggctttcacaaggtgacttacgaaagtctaacatcaggcattgtggccattcattctggcttcaaactttaattcctttcctatcatggagcatgaaccagtcatatcctgttgaaagcctggaactgaaggataatctggcaaatgagacagcagcagagcatctcctcttaaggatacgtgccttggactcatgtttgaatcgaacagtctcaaagtggaagaacaaattcttgtcacttttttacagctttctttggagctgcttcagtccatctcccagaggcatttggtctgtatctttgctcaactgctaatttctcttggctgtagggtgtgtggttaaggtacaaccacccctaaagctcagttttgaagtgagtgtatttatagcttctctgctggtgctgccttctagagggatgatagatcatttgaacccaatgacaatttttaaccagaaaatttaattgtacctgaatcaacctttcagcctaggacgaagtctaggcccaagtcagagtattaatgatcatgagaattgtgtgctgaaccagtaaacgagtttaccttttga

SEQ ID NO: 18152 - DNA, 636 bp, Homo sapiens
ctctggccgttgtcactcgactaccaagatggcggcccccgggagctgtgctctatggagctattgcggccgtgggtggtcgcgggcgatgcggggctgccagctcctcgggcttcgtagctcttggcccggggacctactaagtgctcggctcttgtcccaagagaagcgggcagcggaaacgcactttgggtttgagactgtgtcggaagaggagaaggggggcaaagtctatcaggtgtttgaaagtgtggctaagaagtatgatgtgatgaatgatatgatgagtcttggtatccatcgtgtttggaaggatttgctgctctggaagatgcacccgcttcctgggacccagctgcttgatgttgctggaggcacaggtgacattgcattccggttccttaattatgttcagtcccagcatcagagaaaacagaagaggcagttaagggcccaacaaaatttatcctgggaagaaattgccaaagagtaccagaatgaagaagattccttgggcgggtctcgtgtcgtggtgtgtgacatcaacaaggagatgctaaaggttggaaagcagaaagccttggctcaaggatacagagctggacttgcatgagctcattatggtagcatgcttca

SEQ ID NO: 18153 - DNA, 486 bp, Homo sapiens
ctctggccgttgtcactcgactaccaagatggcggcccccgggagctgtgctctatggagctattgcggccgtgggtggtcgcgggcgatgcggggctgccagctcctcgggcttcgtagctcttggcccggggacctactaagtgctcggctcttgtcccaagagaagcgggcagcggaaacgcactttgggtttgagactgtgtcggaagaggagaaggggggcaaagtctatcaggtgtttgaaagtgtggctaagaagtatgatgtgatgaatgatatgatgagtcttggtatccatcgtgtttggaaggatttgctgctctggaagatgcacccgcttcctgggacccagctgcttgatgttgctggaggcacaggtaatgtcgagtttggtatccttcactaccattgagcatgttttacagaaattagtctctcttgtaatgagccagcaccaccaatacaggcagcaccaccaataca

SEQ ID NO: 18154 - DNA, 507 bp, Homo sapiens
gacggtttctctgtctggaatttagccaagtgaacaatcccctcatatccaggttggcattgttaatagggctttatcttcattgtatagccaaggttcccaccccgaaatggattgaaaatagccagtaagctataagcatgaactttgtagttcagagtaccagaggtcagccagttctgaatgacaatacctaggccacaagagtctcaaaccagacccaagttggcttacatatgtatattaagaaattgacttagaagcccctatttaaaaatcaggaaatgcctggtccaatggtagtgggttatcagaacttattagtggcaataacgttgctactcaacccccctctgataaatttgactggcttaaaaaaaaaaaaaatcaggaaatttgggccaagtgcagtggctcatgcttgtaatcccagcactttgggaggctgaggcgggaggatcacttgaggccaggagttcaagaccagcctgggcaaccgtgagaccc

SEQ ID NO: 18155 - DNA, 483 bp, Homo sapiens
attttaaaaatcttttttcttgatggtgaacaagttttgtcctatgctatggaggaggcatagcacagtgattaagagcttgggctctgtagttggactatgtgggtttaaactttaaacccagatcaattgtatattagctacatgagctaatctctttaagcttccatttcctccctggtaaaatgaaattggcaaataactttctaaggttagtgaagataggaaatactcgaaggctgcttactatccttattacattaaagttatgggtatcttgaaactacaaacctgatgtataatttcagttttctctcatggtcttgttactaccatcatactcttgatattttaggatactttaggattacctttgaagaaccctttctagttaattctttgaatatgttttatacttatttgatggtagttgtaactgtgtacatttgaataaaatttctaaccataaaatttcgccattgc

SEQ ID NO: 18156 - DNA, 511 bp, Homo sapiens
cattttaagtcggtaattggcccgacaggggacgtgaactgtacactgagtcacagaatagtacagaaaatctcagaatggcttcacctcccatcaggaaagcctcccgtgtaccaagccctgtagagacacatttctggcatttggaggagtgcagacgttcaaaataagaaagagcttcagaggacaaccgtcccctgggttcccggccttttccacatcagaagactctttgatatgttcccctctttccctagggccccttgttctaaaggatgcagccagcaaactaaactgctctgatcatctaaaaaaaaaggatatgtttcccacagaataaccacagatctatataacgaatgatcactcagttaatatgatgcctctaaaagataagtggcctgtctcatctaaaataatcataatatcaataataatatgattttattgggtgcttactaaagcccagatgagggatttacaatgcttatcttacttaatccttaaaaaa

SEQ ID NO: 18157 - DNA, 396 bp, Homo sapiens
ttttatttctgagtttgaaacgagataacatttttatgatttgtattatgttttctatgagactcatctgaattgcataatctcaatctgctgagtaaaatagtttggccttttgcaaaagccacccctttgctagccttaagcgcttcacttgtttgaaggtggggaatcctgcagagtcttagatcttgggtaccagctgactaaatgtataaattactaattcctacatggatagagggggtgatagccatattacttttaaaataaatgagagaaggaggccacatgaaagaaggcatgaaatatcaaattctctctatgtgaaatagccccctcccgggttcttcctacttatctaactacagatccttcgtagtactcctggcctaggca

SEQ ID NO: 18158 - DNA, 393 bp, Homo sapiens
aagcaagtttcaactttcaccctcatctcagagctctggtaaggattagaacaactcgagtatctttacagaatgacctgtaatctgcaaagtgcttttaattgagaaggatgatgtgttacatgttctgttatgctctttacccaggtctttcatctctgaagaaggcggtgggaaacaaatgttatttctcctcttcatactccttttctcatttattctgcaggtattatattataggtggtacaagtgaatagtaacaatagaggattcattgagtctttagtctgtgttggctacaattctaagctgtttacatatattaactcatttaatccttataacagctctctgagtcaatactgttattgggtccatttttacagatgagta

SEQ ID NO: 18159 - DNA, 365 bp, Homo sapiens
cacccccaccccaatactattgtactgtttattgaataatacttcctttcattgctgatttcagaggacactgtatcataaacttaatattagaataagagctatttcagttcaaaaatgaatttttttctctaattaaaaagaattgttatatttaaacctgatctatttaaatgtagtcagtagtaaaattggctaatgtttaacctgtttgaatggtatttggtgcatattctttcttcccttcaagcacaattaaacataaaagtggctaatcatttcgccctcttgttatccacaaccacagagagcctaccagttttaaacccttgttcatatccagagtaccaccatcttcctggagg

SEQ ID NO: 18160 - DNA, 376 bp, Homo sapiens
cgttcattccacagatactgattgaatgcctgcatgtaacaagccatgcttggggtgctcatgatacagccgtgaatgaaacacacaaaaattgctgctctcatgaaactctcttttttggtgcattgacctttacactgattatatcatctcccccctcaaagaggacaaatctaaggctcagataagttgtatttgtccaaagacaggcacctgggaagtagatgaacagagatcaatatccagttgtctatagcttcaaagcttggtttttttcctctttacctcctaaaagaagtgaggacaagattgctaattaaactgagttcatggaaatattaaaggatatataaacagaaggaagtaataaagaaac

SEQ ID NO: 18161 - DNA, 460 bp, Homo sapiens
tcttttgatggctgttttgtgttcctgccaaggagcagggaggaatgtcatgtctttatgcattatttcttccttcccagcttgtgctaactgcactattttaatatttaaaatcccacgtttttatgactgtatttcaagtcagaatctgacttccttaggaatcccccaaaatgcctttgcatcctgccctgaagggcacctcctttccttttctaacttccccacgtgcttcctctgtgaccttcagccaggaaactacagagcaacaacaggaattagagggaccatggccttcagttagaagacagtagtcaaaagacaggctaaatcacgtgataagtgctaaagtacagtttgtgaggctttttatttaaaatgggagagttgctggttgatatgaaatgatgaaatgactgaatatattaacaagctggattttcactgaagaccacaattt

SEQ ID NO: 18162 - DNA, 401 bp, Homo sapiens
gttggtcaggctggtctcgaactcctgacctcaaggcctgccttggcctcccaaagtgctgggattacaggcataagccaccgtgcccagccacctctgagcactttagatagtatgtcttaagaacaaagacatagcccggcgcaagtggtcacgcctgtaatcccagcagtttgggaggctgagtcgggcggatcaccttaggtcaggagttcgcggcaaaaccccgttactactaaaaatacaaaaaattagctgggtgtggtggcgtgcacctgtaatcccagctactcgggaggctgaggctggagaatcacttgaacccaggaggcagaggctgcagtgagccgagatggcaccactgcactgtagcctgggtgacagagcaagacttggtctca

SEQ ID NO: 18163 - DNA, 424 bp, Homo sapiens
caatgatactttcattacaattttttcagtcaagtatttctttagggaatctttcctataattcatagtgagctaatttgatcatgtattaatagagatttcatggagatttgtttttaaaggtttttatgtgaaacctttaaaaggcctcccaacaaaaactttacttcatgactagatatgatttaatcatgattatgtcaaaattgtaatttttaaaatgccttaagaaaaataatttctgcatacatttgtgtaatttttctaaaatgcaaaatttgtaacaatttctaaggtgtagaaaaaacatttacttaagttgctggtttttttaatattcatgtgtatgttttgggattttgtagatataacctatgccttagattactacatgttgatgtgacttgctgatgtttcaccaaaa

SEQ ID NO: 18164 - DNA, 333 bp, Homo sapiens
agccaattctgacctttaacctttatgcttgactgccaatcagtggctgagaattctggccccagctaaacaaaagttacacactcatcctgccagcatccaacccaaaagctggtagcttctcttctgcttgtctctcatgctactgctgttgtagcatctatgattgctgtgctgagccctcaagaacatggagcagaagcaggataaaaatcttctgatctctagtcagaatcatgtcagccaagtcaatctattcttcataaaccaagagtaatcatagtcacaaacgttgcaataataaaaatgccttattagtacataaaatggaga

SEQ ID NO: 18165 - DNA, 463 bp, Homo sapiens
gtaaccccattacctactcatagaggaggaactggaagccagagagggagatgccttattgacacagagcacaagtggcaggagctggcttcagacctcagtccatccggtgtggcagtccctcttcccaggaccaggtggagctggagagaaggaggaagaggagtctgtgaggtccagatggagatgctcggcaggccctttccaaaggtgggaggtgaggtcggcctggaaccctactggatgcttaagtgtcctgccgcactgctgatgaaagcaggtccccaccgcagtgtatatacattgtgtgtttgcatctaaaacgtctatagttgtttgaaatgtttaaatctttaacccatctgagatgtgttttcatgtatggtgtgacacagagctctaatttgctctttttgcagatatccagtttgctaagcaccatttattgttccaacaccatctt

SEQ ID NO: 18166 - DNA, 521 bp, Homo sapiens
gctgggaagtttggagttcctgggtctttgcctgtgccggagcagctgctctgccaagactccccatatctgtatgtcagactgaaggctctagtggagtggcttcacaagggcgtctcttgacccaagggttgcaaagatccgttggagaagcgtggtttcccagggtcacacgttcactcactgcttccctgggccagagaggttcaccttgctctgtgtcgctccaaggtgggctgtcatcctgcctctcttttctttgttctctgtgggtcaagttgtttccttgattagtcccaatgcaagtacatggatgtttcagatgaaggtgctgtatttactcaccccttttcctgttattttcaagtgtaagttatatgtggctcacattcattttggtttttatgtgggaaatatatacaaagatatctgtcaaatgatagtaactacattttgcttctcaattcagactacatagaaaatggaagacctaaaggaatataatgtaattatcattatag

SEQ ID NO: 18167 - DNA, 496 bp, Homo sapiens
aaacattctaaattttatttttaattattgtaacttcatgagaggtttgttcatgttccttaatttgtagagtttctaattgtcttgagtctctcgggtacaggcttaaggattgatgagttattaaggaaaagaatctacctgctaaatcccccataaaccccccaagagggcctccattttcaatagaagcttaatgaaggagataataaaaaagagaagacaacagaattacagagactaagtaaatatacttatttccttaaatgtacttatttaaatatacttctttaaatatattatataaataaatagaaggagctggggatgtggtggtgcacacctgtagtcctagctactcaggaagttcaggagggatgattgcttgagcccaggacctcaaggctgcagtgaactatgatcacatcactgcattccagcctgggccacagagtgagaccttaaaaaaaagtgagtgagtgagtctctttaaaaa

SEQ ID NO: 18168 - DNA, 929 bp, Homo sapiens
tccgcaagctccctgtgatgcagaatgggaaggcagttcccggcccaagtccccaacgtgttctggccagtttaaaccccactgcgaaccggggaagtggccttattcctgtgacacgggtgagagctgaagtaggtctcggtccctggccgccaggaggtgcaagcaagctaccactactgcagacgctccaggcccgcccgctgtgggtgggactggggaaaggaccccatctcggccttggcaccttctactacaacgcagacaggaatagacaactgcctcaccctgctctgggcctcccctgagctagaccctgtgagattctgggacattgcaagtcaatctggtatgggggacagaattccgaaaatggccccctccgagatttccgtgcccaaatccccagaacctgtaaatatgattatctcacctatgaatagttacactacatggtgaaagggtttttgcggaaataattaaggttactcattagctgatcttaaaataggatatgattctggattattttggtaggtccaaggtatcataagggtccttaaaggcagaagaggaaggtggagaaacttgaagtaggagaagggttccagaggctttgaaggtagagaggtccatgagaggaaatgcaacaggacaggtgtcatgctgagaatctgagaagagctgcaacaacagccagcaagaaaacagacctcatggcccggcgcagtggctcatgcctgtaatcccagcactttgggaggccaaggcgggtggatcacgtcaggagatcgagaccatcctgactaacacagtgaaaccccatctctactaaaaatacagataggccgacccctacagataggccgacccctacagataggccgacccctacagataggccgacccctacagataggccgacccct

SEQ ID NO: 18169 - DNA, 1001 bp, Homo sapiens
tccgcaagctccctgtgatgcagaatgggaaggcagttcccggcccaagtccccaacgtgttctggccagtttaaaccccactgcgaaccggggaagtggccttattcctgtgacacgggtgagagctgaagtaggtctcggtccctggccgccaggaggtgcaagcaagctaccactactgcagacgctccaggcccgcccgctgtgggtgggactggggaaaggaccccatctcggccttggcaccttctactacaacgcagacaggaatagacaactgcctcaccctgctctgggcctcccctgagctagaccctgtgagattctgggacattgcaagtcaatctggtatgggggacagaattccgaaaatggccccctccgagatttccgtgcccaaatccccagaacctgtaaatatgattatctcacctatgaatagttacactacatggtgaaagggtttttgcggaaataattaaggttactcattagctgatcttaaaataggatatgattctggattattttggtaggtccaaggtatcataagggtccttaaaggcagaagaggaaggtggagaaacttgaagtaggagaagggttccagaggctttgaaggtagagaggtccatgagaggaaatgcaacaggacaggtgtcatgctgagaatctgagaagagctgcaacaacagccagcaagaaaacagacctcatggcccggcgcagtggctcatgcctgtaatcccagcactttgggaggccaaggcgggtggatcacgtcaggagatcgagaccatcctgactaacacagtgaaaccccatctctactaaaaatacagaaaattagctgggcgtggtggcaggcgcctgtagtcccagctactcgggagactgaggcaggagactggcatgaacccgggaggcggagcttgaagtgagctgagatcgcgccactgcactccagcctgggcgacagaacgagactccgtctcaaaaa

SEQ ID NO: 18170 - DNA, 368 bp, Homo sapiens
agatcaacgaagaaaagaaggagaaggggaagtaaagaaggggaagaagatcaaaacccaccatgccccaggctcagcggtgtgctgatggaagtggaagagcctgaaatcttgcaggactcactggatagatgttattcgactccgtcaatgttctttgaactacctgactcattccagcactacagaagtgtgttttactcatttgaggaacagcgtgttggctgggctcttgacatggatgaaatggaaaagtaccaagaagtggaagaagaccaagacccatcatgccccaggctcagcagggagctgctggatgagaaagagcctgaagtcttgcgggactccctggatagatgttattcgga

SEQ ID NO: 18171 - DNA, 818 bp, Homo sapiens
aggactctgccggtgcagaatatgaacaacgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttcaaaaaaagtaaaaagataatatagctgcatttctttagttattttgaaccccaaatatttcctcatctttttgttgttgtcattgatggtggtgacatggacttgtttatagaggacaggtcagctgtctggctcaatgatctacattctgaagttgtctgaaaatgtcttcatgattaaattcagcctaaacgttttgccgggaacactgcagagacaatgctgtgagtttccaaccttagcccatctgcgggcagagaaggtctagtttgtccatcagcattatcatgatatcaggactggttacttggttaaggaggggtctaggagatctgtcccttttagagacaccttacttataatgaagtatttgggagggtggttttcaaaagtagaaatgtcctgtattccgatgatcatcctgtaaacattttatcatttattaatcatccctgcctgtgtctattattatattcatatctctacgctggaaactttctgcctctatgtttactgtgcctttgtttttgctagtgtgtgttgttgaaaaaaaaaacattctctgcctgagttttaatttttgtccaaagttattttaatctatacaattaaaagcttttgcctat

SEQ ID NO: 18172 - DNA, 1323 bp, Homo sapiens
agatcaacgaagaaaagaaggagaaggggaagtaaagaaggggaagaagatcaaaacccaccatgccccaggctcagcggtgtgctgatggaagtggaagagcctgaaatcttgcaggactcactggatagatgttattcgactccgtcaatgttctttgaactacctgactcattccagcactacagaagtgtgttttactcatttgaggaacagcacatcagcttcgcccttgacgtggacaataggtttcttactttgatgggaacaagtctccacctggtcttccagatgggagtcatattcccacagtaagcagcccttactaagccgagagatgtcattcctgcaggcaggacctataggcacgtgaagatttgaatgaaactatagttccatttggaagcccagacataggatgggtcagtgggcatggctctattcctattctcagaccatgccagtggcaacctgtgctcagtctgaagacaatggacccaagttaggtgtgacacgttcacataactgtgcagcacatgccgggagtgatcagtcagacattttaatttgaaccacgtatctctgggtagctacaaagttcctcagggatttcattttgcaggcatgtctctgagcttctatacctgctcaaggtcagtgtcatctttgtgtttagctcatccaaaggtgttaccctggtttcaatgaacctaacctcattctttgtatcttcagtgttgaattgttttagctgatccatctttaacacaggagggatccttggctgaggattgtatttcagaaccaccaactgctcttgacaattgttaacccgctaggctcctttggttagagaagccacagtccttcagcctccaattggtgttagtacttaggaagaccacagctagatggacaaacagcattgggaggccttagcccatctgcgggcagagaaggtctagtttgtccatcagcattatcatgatatcaggactggttacttggttaaggaggggtctaggagatctgtcccttttagagacaccttacttataatgaagtatttgggagggtggttttcaaaagtagaaatgtcctgtattccgatgatcatcctgtaaacattttatcatttattaatcatccctgcctgtgtctattattatattcatatctctacgctggaaactttctgcctctatgtttactgtgcctttgtttttgctagtgtgtgttgttgaaaaaaaaaacattctctgcctgagttttaatttttgtccaaagttattttaatctatacaattaaaagcttttgcctat

SEQ ID NO: 18173 - DNA, 373 bp, Homo sapiens
cccttggggtacctctggggctggcgtctttacatcacgacgacagaaagctggcccgcacagactatggccacggcgtcttagaggttttgtttctctgcaggcgtccagtgctctgtttctttccctcctcaccactctccaaaccacactcacacaaatacacgtccctatgtgcaaagacgcgcatatgtatattgtatatcagtgtgacactcacacatacgtgcggtgttagcatagcctttccccctcgagtccctgttgtgcttcccagcacccagcatcctccaaagcaggcagtggcacactatcactcataaactaaatccagccactgcctgctttgtaaataaagttttgctggaacaca

SEQ ID NO: 18174 - DNA, 339 bp, Homo sapiens
tggctaatttttgtatttttagtagagatggggtttcaccatgttgacccaggctggttaactcgaactcctggcctcaagtgattcacccgccttggcttcccaaagtgctgggattatagatgtgagccacggtgcctggccaagaccctgtctcaattaaaaaaaaaaaaaaagggtagggggtgtgttgtaaatacagaaagtagcccaaaggctgggtaccatggtacatgactgtaatcccagctacttgagagtctgagatgggataatcacttgatcccacccaggagtgtgaatcaggcctgggcatcataatgagactatttagtctcc

SEQ ID NO: 18175 - DNA, 1104 bp, Homo sapiens
gccttcatttagcagtaatattcacatttttattttagacagttaagttcatgtgtttgattttgtcatgtcagcataaatgagaaaaagaagtggatcatgcagctaatgagtaaccaacattttgtaaagttttaaagttttagcaaacaacattattccatctcatttaaaggttaaaaaagaagagacaactctagccaaagtagaaatttatattctacacgtccaaactgtctcctagcagcttttggactatatatcacttgatgttaaagtatcttttatttgtaataaatattcaaatttctatttagaagctctaatgtatacctagattaaatcaaatcacagttttatgcttttaaaatatatgtatttcaaactgtatattttaatttctgagtgcatgttatatagtatttaatacttcagatgtcttggcaaattcaatataagtatttattcccacaagcgatatatgggatatctcttaaaaattatgaatatgtaccatttccttcaaagtcatcctagcctatgctgtatcaaaagtattgtatattttatggagatttagtgatatacatgtaaatgttttttaagttattttattgaagttcaatctttacataaaattaaaatctttttttaaaaaaagtgtcagtgccagaactgtaaatgaaaataatcaaataaaagttaaaataattcaaaaaaaaaaaaaaaaaaaaaaaaaaaaaaaaaaaaaaaaaaaaagggggggggggttaaagaattttaccctggggggggcacaattgggtaacccatttttgtggaaagagggggccccataagggaagccgtcgttaaaataaggcagggaagagggcgcgcgacaataaaaacaagctccgatacgataggaaaaccagcgaccgcaagggcacccaatgagggaaagaacccaacaacccgcgagggagcaacaaaatgagacacaaacccccaaacagagaataacagcccgggggaaaataaaaactgtaaagggacaacgtgataacacgccgcgaatataacagcgcagaaaatggcacccggatcgataaagaaataacg

SEQ ID NO: 18176 - DNA, 440 bp, Homo sapiens
aggctgtttgctgctttgtgacaagtgtggcctttattccaagttctagtaccttgctcctcatttccatctgaggcctcttcagaatgacctttacatatttctatcaacattctggtcatgagcacttaagtaatctctaagaagattcaggctgggcacggtggctcacgcctgtaatccctgcactgtgggaggccaaggcaggcagatcacctgaggtttggtgtttgagaccagcctggccaacatggcagaacccctcctctaataaaaatacaaaaattagtggggcttggtggcgcatgcctgtaatcccagctacttgggaggctgaggcaggagaatcacttgaacctggaaggtagaggttgcagtgagctgagattgcaccattgcactccaacttgggcgacagagcaagactgtcttaaaaaaaa

SEQ ID NO: 18177 - DNA, 427 bp, Homo sapiens
gagattccatccgcacgagacaaacccagcagttcggagcagtcaagacaggttggaggaacaaaggaaggaggtcatgttaccagtttctaaggcttggggtcatctggaagaagctggaatcacagtacaggtggaatggaagtgcaatggaagaagtggaaccacagtgaagcatgttccagaaggccagggcggtcggttctgctgcacaaatgaggtcagagcaatcaagagagccaaggaagtcctacttatctggattaaataactcaatctacaaactactcaactttaatataaggtggaaaataggatttcaaaagaaaagaagaaggagaagaacaaggacaagaaactgagttttggcagaaggcaagtgagcaattaaaaataaatctttcatgatttgttcccacaggcaaaa

SEQ ID NO: 18178 - DNA, 1025 bp, Homo sapiens
agtgaggtcggcgcccgccagtaacaaacatggctccctgaagccgctcaggctcaagagcaacatggaggtctgcacttaatcgctcctctccgggggcggccataccgaggaggcgtctcttccgtgcaggcaggctctcctggggacctcagagattctctccagcggcagcggaaaacggacaatgggtggattcgggtccagattctggtaggagggagtttgggatcgagatctggaaaaaagcactagactggaagaggacgcgatggagtcggagccgctggcggggacaaaaaccagaggccggggaaggcgccggtgggaggcaaggcacggatggactttacctgcgcacgcgtcgcagccatctccgcgcacagtggtggccaccgcgactggtgctgaagtgttggcgcgtgccgggcgctccgctgggacccgggttgctggccctgagtctcagctttctcatctgtacggttgggacaagtacagtaaccctcgcccgtcaagacgggccagggctgtggcgagggtccacgccttagagcaggtacctatcttgtgcagggccctgagatggggtctgactcagttcctgcggggaacttcaccagtgacccagtcagtgcccttcagttaaagaccaccaggagcacacttgcaggagtagggctgattggagccattgtacagtgtcgggaacataccaggacactgagaatagtgtcatgtcataaggacccagagcaggtggaccctgctgtgatgcacaaagaggaccacgcaagatatgataaagatctacatcactgaattttggttccatttttgtatctcagcttcccggaaataaaaaagaattctaacattcatactttcagtattttatgtgagaggttttgttgtcaaaatcaagtctgagagcaatgtttgttgggcctttaattggagtcaccaagtgataaaggggacattgtcctcaacaataaccctataataaacacgttttcgacaat

SEQ ID NO: 18179 - DNA, 387 bp, Homo sapiens
  misc_feature (13)..(13): n is a, c, g, or t
tgtgaggaaaggngggtaggataatattcaggcaggagtagggctgattggagccattgtacagtgtcgggaacataccaggacactgagaatagtgtcatgtcataaggacccagagcaggtggaccctgctgtgatgcacaaagaggaccacgcaagatatgataaagatctacatcactgaattttggttccatttttgtatctcagcttcccggaaataaaaaagaattctaacattcatactttcagtattttatgtgagaggttttgttgtcaaaatcaagtctgagagcaatgtttgttgggcctttaattggagtcaccaagtgataaaggggacattgtcctcaacaataaccctataataaacacgttttcgacaat

SEQ ID NO: 18180 - DNA, 502 bp, Homo sapiens
  misc_feature (13)..(13): n is a, c, g, or t
tgtgaggaaaggngggtaggataatattcaggcaggagtagggctgattggagccattgtacagtgtcgggaacataccaggacactgagaatagtgtcatgtcataaggacccagagcaggtggaccctgctgtgatgcacaaagaggaccacgcaagatatgataaagatctacatcactgaattttggttccatttttgtatctcagcttcccggaaataaaaaagaattctaacattcatactttcagtattttatgtgagaggttttgttgtcaaaatcaagtctgagagcaatgtttgttgggcctttaattggagtcaccaagtgataaaggggacattgtcctcaacaataaccctataataaacacgttttcgacaataaatatatgacaatttcttaaaagcaatttcttgggcaatcaagacagtatggcttgagtatggagttatacgatggtttggattaatccagtattaaatctttggttattacag

SEQ ID NO: 18181 - DNA, 246 bp, Homo sapiens
  misc_feature (13)..(13): n is a, c, g, or t
tgtgaggaaaggngggtaggataatattcaggcaggagtagggctgattggagccattgtacagtgtcgggaacataccaggacactgagaatagtgtcatgtcataaggacccagagcaggtggaccctgctgtgatgcacaaagaggaccacgcaagatatgataaagatctacatcactgaattttggttccatttttgtatctcagcttcccggaaataaaaaagaattctaacattcatac

SEQ ID NO: 18182 - DNA, 671 bp, Homo sapiens
  misc_feature (13)..(13): n is a, c, g, or t
tgtgaggaaaggngggtaggataatattcaggcaggagtagggctgattggagccattgtacagtgtcgggaacataccaggacactgagaatagtgtcatgtcataaggacccagagcaggtggaccctgctgtgatgcacaaagaggaccacgcaagatatgataaagatctacatcactgaattttggttccatttttgtatctcagcttcccggaaataaaaaagaattctaacattcatactttcagtattttatgtgagaggttttgttgtcaaaatcaagtctgagagcaatgtttgttgggcctttaattggagtcaccaagtgataaaggggacattgtcctcaacaataaccctataataaacacgttttcgacaataaatatatgacaatttcttaaaagcaatttcttgggcaatcaagacagtatggcttgagtatggagttatacgatggtttggattaatccagtattaaatctttggttattacagaaatcagtggagcctattcttccaaataatccttaaatattacttatctcaactgagattttggtgaaaatttagctttagagcttttattgacctgccaatgacctgaagttaagattattcttttccactgaatgaagacaaaccaccttataaaaattaacccaga

SEQ ID NO: 18183 - DNA, 416 bp, Homo sapiens
ttccacagtctgcagaatataaaataaatgtcttgaataagctacgaagaccaaggcacttttcggagcagatttttttgtcttaaagttttatctcatgcaaacactgcatataacacaaacttatataatcaatgcttttagcaaaatgtcatagtagaaccaaggcccagttgttagctgaaatctatataaatataggcaggagtagggctgattggagccattgtacagtgtcgggaacataccaggacactgagaatagtgtcatgtcataaggacccagagcaggtggaccctgctgtgatgcacaaagaggaccacgcaagatatgataaagatctacatcactgaattttggttccatttttgtatctcagcttcccggaaataaaaaagaattctaacattcatac

SEQ ID NO: 18184 - DNA, 917 bp, Homo sapiens
agtgaggtcggcgcccgccagtaacaaacatggctccctgaagccgctcaggctcaagagcaacatggaggtctgcacttaatcgctcctctccgggggcggccataccgaggaggcgtctcttccgtgcaggcaggctctcctggggacctcagagattctctccagcggcagcggaaaacggacaatgggtggattcgggtccagattctggtaggagggagtttgggatcgagatctggaaaaaagcactagactggaagaggacgcgatggagtcggagccgctggcggggacaaaaaccagaggccggggaaggcgccggtgggaggcaaggcacggatggactttacctgcgcacgcgtcgcagccatctccgcgcacagtggtggccaccgcgactggtgctgaagtgttggcgcgtgccgggcgctccgctgggacccgggttgctggccctgagtctcagctttctcatctgtacggttgggacaagtacagtaaccctcgcccgtcaagacgggccagggctgtggcgagggtccacgccttagagcaggtacctatcttgtgcagggccctgagatggggtctgactcagttcctgcggggaacttcaccagtgacccagtcagtgcccttcagttaaagaccaccaggagcacacttgcaggagtagggctgattggagccattgtacagtgtcgggaacataccaggacactgagaatagtgtcatgtcataaggacccagagcaggtggaccctgctgtgatgcacaaagaggaccacgcaagatatgataaagatctacatcactgaattttggttccatttttgtatctcagcttcccggaaataaaaaagaattctaacattcatacaaaaaaataataataatggcctcgttggcctca

SEQ ID NO: 18185 - DNA, 344 bp, Homo sapiens
aggagactaatgggagactgacacagagcttaggatctctgagggccacagcctcaggggtgataaaacaaaacacactcagcttgtctgtctcagtcttgcccctcagtgggatggaaaggagtctctctcccctcagtgcctacccacagcttgcacttaggtaggtctggggctggtagtcagtctgtgtaagcccaacagttccaagccaaaaatctgaagtattcatagatggtagtattcctagatgcatggcagaaaaaaatgtaaatatgtaaatcctctctgtaggaatgcattttaaatagaggactcagtttccaaagacatgagatggtcac

SEQ ID NO: 18186 - DNA, 299 bp, Homo sapiens
ccagtcatatggtaccctttgaatgccaccgcccccccagcccctgagatggtttttttccagtgtaaaactcatgtaaaccactgaagagatatttcagttgaaggaagaaaacagaagcagcagccatctccgccaccaggagcaaacacactgcgcactttcatccacggcaagggcgaggggtcaacgtggaacttttcaagcatgggttgtggcaagcttatctatccaagtttccctaaaagtccaagctgtttcatttttgattccatctctccttctaccctgatatcgtg

SEQ ID NO: 18187 - DNA, 1091 bp, Homo sapiens
tgtgtgtgtgtgtgtgtgtgtgtgtgtatacacaggatacgtgggaacactacttcctgctccatttttctgttaacttaaaactgctctgaaaaacagtctattatttttttaaaaaatacacccactatatgctatctataaaagatacacaacttaaaactgacaaacccacaagcatagctggagacttaaaacattactagaatagtcaaagaaaaaatacgtgttctgaacaacattatgctccaacttgagttgatattcacagaacactacacccaacaactattacatattcttatcaagtgcatatggaacattcaccaagatagactattggtagtctcagcagatttcaaaggcttaaaacattacacagtacaatttctaaccaccccagagagtaaaatatctagaaaagcctcatatatttggaaactaaacatatttctaaataacccatgggacaaagaagaaaatcacaggagaaattaaaatatagtttcaactaaacaaaagccaaaacatcaaaattttgaaatgcattagttttagagcttagaaggaaatttatatacttaaatgcttataatagaaaagaagaaaagtttaaatcagtgatataagctttcaccttaagctaaaaaaagaaaagcaaattaaacccaaaataagtagacagaagtaggtaagaacagaaatcagtgaagcatacgatagagacaacagaatgaatgctggttctttaaaaagatctaatagatacatctctatacagactgatcaagaaaagtcacatattaagatgtgtaatgggcattatgacatctatatacgtttaaaaggcaaacaggaataatataaacaattttatgccaatatcaaattaccaaaattggcacaagaaaaaaatgatagccctacatcaattaaagaaattgtaaatctttccaaaaagaaacctccaggccctaatggctacactagagaactcttaccaaggccattacgaggaagtaataccagtcttatctaaactcttcagtattaccaagaagacaaaactccacaggccaatatccctcatg

SEQ ID NO: 18188 - DNA, 398 bp, Homo sapiens
ccactactctacttggaggggaaagaggtttctcttaaggaagatggcattgtctggacctgccataatgtttttatacacaacatacaatattcaatcaaaaaggccaggcatggtggctcacgcctgtaatccagcactttgggaggctgaggcaggcaggtcacttgagcccaggagttcaagaccagcctggacaacacagtgaaaccccatctctataaaaaaaagaaaataagaaagaaagaaaaaattagctgggcgtagtgctgtgcacctgtagtcccagctactcaggaggctgtggtgggaggacctcttgagcccaagaagtcaaggctgcagtgagttgtgatcaccactgcactccagtgtgggcaacagagcaagactctgtc

SEQ ID NO: 18189 - DNA, 410 bp, Homo sapiens
tgaacttcaaggctctcctactgccctaactcagtcatgggatatccacaaaaaacttaagagcttagcctttttctctcagctgggcttagccccatagatgaaagacattccttgttaagggtaaggtgtagctgctgcagatacagtttgcctttagagatatggacaggagccctggataacaagacacgtagtgagggaaaacatcttgattggtatcaagagaagacaggggttgagtcctgactaaactatttactaacattaggaattatattagcaaattttctgagcttcagattcctcattctaaagtagaaacaacagtcctttctgcccagccctattcacgatgtaacaagtttcaaatgacctaattggaatgaagactatacgtgctacataaa

SEQ ID NO: 18190 - DNA, 1247 bp, Homo sapiens
acacataaaattaaccatcacaagttcaccccttctcagttgggctcccatacacatcttcaaccatactgaatctccaaatactgacaataacatggccatagttccacctaacatgatgctgctatcctgcatacaccaaaaatgctctgtttctttccccagaagaggatgcaaagtctttgggtgacatttacttttcttgatatcctgtaccttaaatatatgatgtaaagctaacaatacctaaatactataagtcaatatatcttatgttatatgataaagggatgagagggaagaaagcaaagatatttgagatagaaacacacacacacacacacatttcatgtagcttcaggtttctctgataaacattctgaaattgctccttgaattttcagtacctaattaaaggtatggtagtttctctttaatactgtgatgccttgtttgtgagtttggataactcagtggcctttataactccagtcattcattaaagatgctattttgaaagcattgtctgggagtttatattgacttttcttgcaaatggacatccccaacctcctcacagtgagaactaatgaatataattttcacccatttcttctccacccgtttcttcttaacctacaatgcagttaaatccagtggttaaagaatctgttgagcatttcgtgtatgtaattccctaatagtggctctagatgtaatggtttgcattaatctatttaacttagttttatgtaatgaattaaactaaaactcactctatctgtctgtctctctctctctctctctgtgtacatgtctttatttatttatttatttatttatttatttatttattttagacggagtctcgctctgtcgcccaggctggaatgcagtggcacaatcttggctcactgcaacctccgcctcccgggttcaagtgattctcctgcctcagcctcctgagtagctgggactacaggggcacatcactatgcccagctatgttttatattcttaatagagatggggtttcactcttctggccgggctggtcttgaactcccgaccttgcgatccacccaccttggcctcccaaagtcctgggattacagacatgagcaaccacacctggctgtctctttttataaaaaatacaagcatatatatttagggttatgtggaataatatgcctttgccagtttagtgcttttgaacatacatcagtcatggcatttaggcatga

SEQ ID NO: 18191 - DNA, 374 bp, Homo sapiens
gaaatttgttttttaaaaaactcaaatacacaatttattcttctgataatcttcctgtattttttccataaggaggtaggaaaagtaggaaacaaaattttgatggaggatgaataaagatattgtggacatggtttctttattgcaatcagaatcctttctgtttgtcacccttcctaaacaatctgataaatgtgtttattatcacagtaatctgttgtcctgctttgccaagctgtcagtcaggacaagcaattataaggaacaggaagactcatcttggctgatggccaggtgggcaggtgggaataagaggtttattcacctgtggtacaaagtaaatgggtagaaaggaaaattgagttgccagggag

SEQ ID NO: 18192 - DNA, 2701 bp, Homo sapiens
aacgaaattaacgggaggtctgactgcaaggggagggggctcgcgatctaaaacgagaagagatctcggggtctcatactgcgccattcggctgcggtacatctcggcactctagctgcagccgggagaggccttgccgccaccgctgtcgcccaagcctccactgccgctgccacctcagcgccggcctctgcatccccagctccagctccgctctgcgccgctgctgccatcgccgctgccactcaagcatccgtgagtcattttctgcccatctctggtcgcgcggtctccctggtagagtttgtaggcttgcaagatggcagaagcagattttaaaatggtctcggaacctgtcgcccatggggttgccgaagaggagatggctagctcgactagtgattctggggaagaatctgacagcagtagctctagcagcagcactagtgacagcagcagcagcagcagcactagtggcagcagcagcggcagcggcagcagcagcagcagcagcggcagcactagcagccgcagccgcttgtatagaaagaagagggtacctgagccttccagaagggcgcggcgggccccgttgggaacaaatttcgtggataggctgcctcaggcagttagaaatcgtgtgcaagcgcttagaaacattcaagatgaatgtgacaaggtagataccctgttcttaaaagcaattcatgatcttgaaagaaaatatgctgaactcaacaagcctctgtatgataggcggtttcaaatcatcaatgcagaatacgagcctacagaagaagaatgtgaatggaattcagaggatgaggagttcagcagtgatgaggaggtgcaggataacacccctagtgaaatgcctcccttagagggtgaggaagaagaaaaccctaaagaaaacccagaggtgaaagctgaagagaaggaagttcctaaagaaattcctgaggtgaaggatgaagaaaaggaagttcctaaagaaattcctgaggtaaaggctgaagaaaaagcagattctaaagactgtatggaggcaacccctgaagtaaaagaagatcctaaagaagtcccccaggtaaaggcagatgataaagaacagcctaaagcaacagaggctaaggcaagggctgcagtaagagagactcataaaagagttcctgaggaaaggcttcaggacagtgtagatcttaaaagagctaggaagggaaagcctaaaagagaagaccctaaaggcattcctgactattggctgattgttttaaagaatgttgacaagctcgggcctatgattcagaagtatgatgagcccattctgaagttcttgtcggatgttagcctgaagttctcaaaacctggccagcctgtaagttacacctttgaatttcattttctacccaacccatacttcagaaatgaggtgctggtgaagacatatataataaaggcaaaaccagatcacaatgatcccttcttttcttggggatgggaaattgaagattgcaaaggctgcaagatagactggagaagaggaaaagatgttactgtgacaactacccagagtcgcacaactgctactggagaaattgaaatccagccaagagtggttcctaatgcatcattcttcaacttctttagtcctcctgagattcctatgattgggaagctggaaccacgagaagatgctatcctggatgaggactttgaaattgggcagattttacatgataatgtcatcctgaaatcaatctattactatactggagaagtcaatggtacctactatcaatttggcaaacattatggaaacaagaaatacagaaaataagtcaatctgaaagatttttcaagaatcttaaaatctcaagaagtgaagcagattcatacagccttgaaaaaagtaaaaccctgacctgtaacctgaacactattattccttatagtcaagtttttgtggtttcttggtagtctatattttaaaaatagtcctaaaaagtgtctaagtgccagtttattctatctaggctgttgtagtataatattcttcaaaatatgtaagctgttgtcaattatctaaagcatgttagtttggtgctacacagtgttgatttttgtgatgtcctttggtcatgtttctgttagactgtagctgtgaaactgtcagaattgttaactgaaacaaatatttgcttgaaaaaaaaagttcatgaagtaccaatgcaagtgttttatttttttcttttttccagcccataagactaagggtttaaatctgcttgcactagctgtgccttcattagtttgctatagaaatccagtacttatagtaaataaaacagtgtattttgaagtttgactgcttgaaaaagattagcatacatctaatgtgaaaagaccacatttgattcaactgagaccttgtgtatgtgacatatagtggcctataaatttaatcataatgatgttattgtttaccactgaggtgttaatataacatagtatttttgaaaaagtttcttcatcttatattgtgtaattgtaaactaaagataccgtgttttctttgtattgtgttctaccttccctttcactgaaaatgatcacttcatttgatactgtttttcatgttcttgtattgcaacctaaaataaataaatattaaagtgtgttatactataaaaatctagcc

SEQ ID NO: 18193 - DNA, 2731 bp, Homo sapiens
aacgaaattaacgggaggtctgactgcaaggggagggggctcgcgatctaaaacgagaagagatctcggggtctcatactgcgccattcggctgcggtacatctcggcactctagctgcagccgggagaggccttgccgccaccgctgtcgcccaagcctccactgccgctgccacctcagcgccggcctctgcatccccagctccagctccgctctgcgccgctgctgccatcgccgctgccacctccgcagcccgggcctccgccgccgccactcaagcatccgtgagtcattttctgcccatctctggtcgcgcggtctccctggtagagtttgtaggcttgcaagatggcagaagcagattttaaaatggtctcggaacctgtcgcccatggggttgccgaagaggagatggctagctcgactagtgattctggggaagaatctgacagcagtagctctagcagcagcactagtgacagcagcagcagcagcagcactagtggcagcagcagcggcagcggcagcagcagcagcagcagcggcagcactagcagccgcagccgcttgtatagaaagaagagggtacctgagccttccagaagggcgcggcgggccccgttgggaacaaatttcgtggataggctgcctcaggcagttagaaatcgtgtgcaagcgcttagaaacattcaagatgaatgtgacaaggtagataccctgttcttaaaagcaattcatgatcttgaaagaaaatatgctgaactcaacaagcctctgtatgataggcggtttcaaatcatcaatgcagaatacgagcctacagaagaagaatgtgaatggaattcagaggatgaggagttcagcagtgatgaggaggtgcaggataacacccctagtgaaatgcctcccttagagggtgaggaagaagaaaaccctaaagaaaacccagaggtgaaagctgaagagaaggaagttcctaaagaaattcctgaggtgaaggatgaagaaaaggaagttcctaaagaaattcctgaggtaaaggctgaagaaaaagcagattctaaagactgtatggaggcaacccctgaagtaaaagaagatcctaaagaagtcccccaggtaaaggcagatgataaagaacagcctaaagcaacagaggctaaggcaagggctgcagtaagagagactcataaaagagttcctgaggaaaggcttcaggacagtgtagatcttaaaagagctaggaagggaaagcctaaaagagaagaccctaaaggcattcctgactattggctgattgttttaaagaatgttgacaagctcgggcctatgattcagaagtatgatgagcccattctgaagttcttgtcggatgttagcctgaagttctcaaaacctggccagcctgtaagttacacctttgaatttcattttctacccaacccatacttcagaaatgaggtgctggtgaagacatatataataaaggcaaaaccagatcacaatgatcccttcttttcttggggatgggaaattgaagattgcaaaggctgcaagatagactggagaagaggaaaagatgttactgtgacaactacccagagtcgcacaactgctactggagaaattgaaatccagccaagagtggttcctaatgcatcattcttcaacttctttagtcctcctgagattcctatgattgggaagctggaaccacgagaagatgctatcctggatgaggactttgaaattgggcagattttacatgataatgtcatcctgaaatcaatctattactatactggagaagtcaatggtacctactatcaatttggcaaacattatggaaacaagaaatacagaaaataagtcaatctgaaagatttttcaagaatcttaaaatctcaagaagtgaagcagattcatacagccttgaaaaaagtaaaaccctgacctgtaacctgaacactattattccttatagtcaagtttttgtggtttcttggtagtctatattttaaaaatagtcctaaaaagtgtctaagtgccagtttattctatctaggctgttgtagtataatattcttcaaaatatgtaagctgttgtcaattatctaaagcatgttagtttggtgctacacagtgttgatttttgtgatgtcctttggtcatgtttctgttagactgtagctgtgaaactgtcagaattgttaactgaaacaaatatttgcttgaaaaaaaaagttcatgaagtaccaatgcaagtgttttatttttttcttttttccagcccataagactaagggtttaaatctgcttgcactagctgtgccttcattagtttgctatagaaatccagtacttatagtaaataaaacagtgtattttgaagtttgactgcttgaaaaagattagcatacatctaatgtgaaaagaccacatttgattcaactgagaccttgtgtatgtgacatatagtggcctataaatttaatcataatgatgttattgtttaccactgaggtgttaatataacatagtatttttgaaaaagtttcttcatcttatattgtgtaattgtaaactaaagataccgtgttttctttgtattgtgttctaccttccctttcactgaaaatgatcacttcatttgatactgtttttcatgttcttgtattgcaacctaaaataaataaatattaaagtgtgttatactataaaaatctagcc

SEQ ID NO: 18194 - DNA, 2466 bp, Homo sapiens
aacgaaattaacgggaggtctgactgcaaggggagggggctcgcgatctaaaacgagaagagatctcggggtctcatactgcgccattcggctgcggtacatctcggcactctagctgcagccgggagaggccttgccgccaccgctgtcgcccaagcctccactgccgctgccacctcagcgccggcctctgcatccccagctccagctccgctctgcgccgctgctgccatcgccgctgccacctccgcagcccgggcctccgccgccgccactcaagcatccgtgagtcattttagccgcttgtatagaaagaagagggtacctgagccttccagaagggcgcggcgggccccgttgggaacaaatttcgtggataggctgcctcaggcagttagaaatcgtgtgcaagcgcttagaaacattcaagatgaatgtgacaaggtagataccctgttcttaaaagcaattcatgatcttgaaagaaaatatgctgaactcaacaagcctctgtatgataggcggtttcaaatcatcaatgcagaatacgagcctacagaagaagaatgtgaatggaattcagaggatgaggagttcagcagtgatgaggaggtgcaggataacacccctagtgaaatgcctcccttagagggtgaggaagaagaaaaccctaaagaaaacccagaggtgaaagctgaagagaaggaagttcctaaagaaattcctgaggtgaaggatgaagaaaaggaagttcctaaagaaattcctgaggtaaaggctgaagaaaaagcagattctaaagactgtatggaggcaacccctgaagtaaaagaagatcctaaagaagtcccccaggtaaaggcagatgataaagaacagcctaaagcaacagaggctaaggcaagggctgcagtaagagagactcataaaagagttcctgaggaaaggcttcaggacagtgtagatcttaaaagagctaggaagggaaagcctaaaagagaagaccctaaaggcattcctgactattggctgattgttttaaagaatgttgacaagctcgggcctatgattcagaagtatgatgagcccattctgaagttcttgtcggatgttagcctgaagttctcaaaacctggccagcctgtaagttacacctttgaatttcattttctacccaacccatacttcagaaatgaggtgctggtgaagacatatataataaaggcaaaaccagatcacaatgatcccttcttttcttggggatgggaaattgaagattgcaaaggctgcaagatagactggagaagaggaaaagatgttactgtgacaactacccagagtcgcacaactgctactggagaaattgaaatccagccaagagtggttcctaatgcatcattcttcaacttctttagtcctcctgagattcctatgattgggaagctggaaccacgagaagatgctatcctggatgaggactttgaaattgggcagattttacatgataatgtcatcctgaaatcaatctattactatactggagaagtcaatggtacctactatcaatttggcaaacattatggaaacaagaaatacagaaaataagtcaatctgaaagatttttcaagaatcttaaaatctcaagaagtgaagcagattcatacagccttgaaaaaagtaaaaccctgacctgtaacctgaacactattattccttatagtcaagtttttgtggtttcttggtagtctatattttaaaaatagtcctaaaaagtgtctaagtgccagtttattctatctaggctgttgtagtataatattcttcaaaatatgtaagctgttgtcaattatctaaagcatgttagtttggtgctacacagtgttgatttttgtgatgtcctttggtcatgtttctgttagactgtagctgtgaaactgtcagaattgttaactgaaacaaatatttgcttgaaaaaaaaagttcatgaagtaccaatgcaagtgttttatttttttcttttttccagcccataagactaagggtttaaatctgcttgcactagctgtgccttcattagtttgctatagaaatccagtacttatagtaaataaaacagtgtattttgaagtttgactgcttgaaaaagattagcatacatctaatgtgaaaagaccacatttgattcaactgagaccttgtgtatgtgacatatagtggcctataaatttaatcataatgatgttattgtttaccactgaggtgttaatataacatagtatttttgaaaaagtttcttcatcttatattgtgtaattgtaaactaaagataccgtgttttctttgtattgtgttctaccttccctttcactgaaaatgatcacttcatttgatactgtttttcatgttcttgtattgcaacctaaaataaataaatattaaagtgtgttatactataaaaatctagcc

SEQ ID NO: 18195 - DNA, 423 bp, Homo sapiens
ctgtgatattacaaataaaatccaaaagttgtaagttcttatttttggagagaaaacgtcatttcacttatgctcatagcatttctttcagtaccttttctgatttattaaaaatttacatctgaaagacatacaaaataaaacctcagtactttctacatgtgttttctgtacacactaaataatactggaggaaattacacatctaagacttaacagacatgcaaggtaattggagaattaaactctagtgaaggagtcaataagtaacataaataatactagtactctaaacatataatgtgactagatagtgtgatcattgtggtcagtatctggcttaagctaaacaaaaagctttagaaaagttcattttcacttggttaatttccttactgggtacatggttgatgaattcagttc

SEQ ID NO: 18196 - DNA, 1501 bp, Homo sapiens
  misc_feature (1319)..(1319): n is a, c, g, or t
agaatgggtatctcaggctgtgagtaatttgatatagaacttttcacctccaggtcagtgggaacacagtaggagcaagggaagggcagaggggcttatttcatataagggcttcttgtcgcctgaactatggttgaagttccctcacagaacagagcagctggtcacagctctgcccaggcatttctgtgtctgcatcttcctgctgtacttgcatatcaagaagcatttcagaccacaggaatgcaggattccaaggcgccaatttaccttggaatttgaaaagatgatggaaatgatgttaaagaaaaagaaaattcgagtgattttcttatttgaggtcaaaatgggtcataaagcagtggagacaactcgcaaaatcaacaacacatttggttcaggaactgctaacaaatgtacagtgcagtggtggttcaagaagttttgcaaaggagaggagagccttgaaaacgaggaaaacagtggctggctataggaagttgacaatgaccaactgagagcaaccatggaagctgatcctcttacaactgcgtgagaagttgccaaggaactcagcgttgagcattctagagtctttcagcatttgaagcaaattgggaaggtgaaaaagctggataagtggatgcctcatgagatgagtgaaaatttaaaaaaaaataaaataaaaaacaaaattgtcattttgaagtgtcatcttctcttactctaagcaacaacaacaaatcatttctcaatcagtttgtgacgttcaatgaaatgtggattttatacgacaactggtgatgaccagctcagtggctagaccaagaagctccaaaacacttcccaaagccaaacttggaccaaaaaaaggtcatgttcgctgtttggtggtctgctgctggtctgatccactattgctttctgactcccggcgaaaccattacatctgagaagtatgctcagcaattcaaagagatgaccgaaaacttcaacccctgcagtcagcaatggtcaacagaaagggcccaattctccacgacaatgcatgatcgcacattacacaactaaagcttcaaaagttgaactaactgggctacgaagttttgcctcatccaccatattcacctgacctcccgccaaccgactaccacttcttcaatcatctcgacaactttttgcaaggaaaacacttccacaaccagtagaatgcaaaaagtgctttccaagagttcactgaatcctgaagcacggatttttatgctacaggaataaacaaacttatttttcattggtaaaaatgtgttgattgtaatggntcctattttgattaatgaagatgtgtttgagcctagttataatgatttaaaattcacgatccaaaaccgcaattacttttgcatcagcctaatatgaggaagtaatagttgaacagaataattctttcctggaagtctggcattttgcctggggagaaggatcattaaaaacttaaacattt

SEQ ID NO: 18197 - DNA, 1504 bp, Homo sapiens
  misc_feature (1322)..(1322): n is a, c, g, or t
cagactatatggtgcagctgactggtggaagagatgaggctgagaagacacgaaaggcttatgggaacacagtaggagcaagggaagggcagaggggcttatttcatataagggcttcttgtcgcctgaactatggttgaagttccctcacagaacagagcagctggtcacagctctgcccaggcatttctgtgtctgcatcttcctgctgtacttgcatatcaagaagcatttcagaccacaggaatgcaggattccaaggcgccaatttaccttggaatttgaaaagatgatggaaatgatgttaaagaaaaagaaaattcgagtgattttcttatttgaggtcaaaatgggtcataaagcagtggagacaactcgcaaaatcaacaacacatttggttcaggaactgctaacaaatgtacagtgcagtggtggttcaagaagttttgcaaaggagaggagagccttgaaaacgaggaaaacagtggctggctataggaagttgacaatgaccaactgagagcaaccatggaagctgatcctcttacaactgcgtgagaagttgccaaggaactcagcgttgagcattctagagtctttcagcatttgaagcaaattgggaaggtgaaaaagctggataagtggatgcctcatgagatgagtgaaaatttaaaaaaaaataaaataaaaaacaaaattgtcattttgaagtgtcatcttctcttactctaagcaacaacaacaaatcatttctcaatcagtttgtgacgttcaatgaaatgtggattttatacgacaactggtgatgaccagctcagtggctagaccaagaagctccaaaacacttcccaaagccaaacttggaccaaaaaaaggtcatgttcgctgtttggtggtctgctgctggtctgatccactattgctttctgactcccggcgaaaccattacatctgagaagtatgctcagcaattcaaagagatgaccgaaaacttcaacccctgcagtcagcaatggtcaacagaaagggcccaattctccacgacaatgcatgatcgcacattacacaactaaagcttcaaaagttgaactaactgggctacgaagttttgcctcatccaccatattcacctgacctcccgccaaccgactaccacttcttcaatcatctcgacaactttttgcaaggaaaacacttccacaaccagtagaatgcaaaaagtgctttccaagagttcactgaatcctgaagcacggatttttatgctacaggaataaacaaacttatttttcattggtaaaaatgtgttgattgtaatggntcctattttgattaatgaagatgtgtttgagcctagttataatgatttaaaattcacgatccaaaaccgcaattacttttgcatcagcctaatatgaggaagtaatagttgaacagaataattctttcctggaagtctggcattttgcctggggagaaggatcattaaaaacttaaacattt

SEQ ID NO: 18198 - DNA, 1401 bp, Homo sapiens
cctcaaaggttttaatttctcaggtctggagagatcgcagaaattctgatgcaggggtctgagaaacatacttagggagataatccaagagaattggacctgcttttcagtctgctgacaagtggataccactttactccagctacccagtgcccacgagcccctgcttggacatctgtcctctttagagtctgtgcctgaaagcctatgccccatatttgagagatgaagctgtagtgtgggaggggagtggggcttgcttaatggttgccttcttggttagccagcttcagagtttccattatggcctgtaaagaggtctttttacctgcagtgtcttccatcgatattctgcctcatatacactctacttctgcctcaaggcccagtatgaatctgaagtcgaagtgacttttgtagcccatacttggttcctgctcacaacttctctatgaatgatgatgggtcttctggtttttcttttgccttgtatggctgtctgattagcttccattgggctgattttatctctgaaattatattgtaagcatcatgaaggttgtggggtctgcatggtgttgggcatacagttatcgatgattatggataacttggttcaccgtgatgtttctggggtggagtgaccactgtttgatacctggtttgacagatatcaaaaccatggcaataagggtctagaattggcttgatctccacagtatctcttagatgcaaagatgttttaggtatagggctttgagtatcagtgccatcaaatagtacttccagggggaaccccagacaagtctgggtcctaagtgaaaccagaggttttagccagaaataaaccagcatcaggaagggagctggtcaaacactgttccactgcatcagtgggtggcagaggttgctggcaggacagagttagctggcatcagtcatggcagaagatgactcataaggctagttgaatgtgtgtgtatgagtttgtgtgtgtcagagacagagagaaaaaagattcttacttcaaacggcattcttcctgtgtctcccgaggatgtattttttcccctcagatgtttctttttttctacataatagtcaatgttcaagattgtgtaaaaaaaaaaaattaggaaataatccaagaacccaatattcaaaagggcctgggcagactgtcagcattttgtcaatggctctttctagcctgggttgcttgtgtggtagcatgccagatctatccaacaagattgccacttgctttgcctgttctttgctctcagtctaaataacttctcaattcattctagtccttttaaattttcatggcttgctgcatttcgttagctcacttaaaatgagaacatggaatcaatacagtacaaccacagacccaaa

SEQ ID NO: 18199 - DNA, 599 bp, Homo sapiens
cctcaaaggttttaatttctcaggtctggagagatcgcagaaattctgatgcaggggtctgagaaacatacttagggagataatccaagagaattggacctgcttttcagtctgctgacaagtggataccactttactccagctacccagtgcccacgagcccctgcttggacatctgtcctctttagagtctgtgcctgaaagcctatgccccatatttgagagatgaagctgtagtgtgggaggggagtggggcttgcttaatggttgccttcttggttagccagcttcagagtttccattatggcctgtaaagaggtctttttacctgcagtgtcttccatcgatattctgcctcatatacactctacttctgcctcaaggcccagtatgaatctgaagtcgaagtgacttttgtagcccatacttggttcctgctcacaacttctctatgaatgatgatgggtcttctggtttttcttttgccttgtatggctgtctgattagcttccattgggctgattttatctctgaaattatattggtaccatatgagtgtacttgtgagtttggagaaaacactaacacttaagtctggc

SEQ ID NO: 18200 - DNA, 205 bp, Homo sapiens
tatgtaactaattcagtggggtatatcagttagctcaggggtggacaaatttccagtgaaacaagatatagagcctagaaagaaacctatccatatctgaagacctggcttatgacagagctggagatgatgctgagtggaaagaaaatgaacttcacagtacttggctctggagcaaatggttatccacgtggaaaaacatgaa

SEQ ID NO: 18201 - DNA, 338 bp, Homo sapiens
ggcatggagaaattggaatccttgtgcattattcacgggattctgagattatgcaaccactatggaaatgtggtggttgcttaaggaattaaatatagaactatcacatgatccagaaatctctcttctgggtagatatgcaaaatagttgaaaccagggtcttgaagagatatttgcatactcaacttcacagcattagtcacaagagccaagaggtaggagcaagcctagtgtccacggatggatgaatggataaacaaaatgtggtatatccatacaatggaatataattcaaccttaaaaaggaaggaactataaatgttgtcttttttatatt

SEQ ID NO: 18202 - DNA, 730 bp, Homo sapiens
cttcctttgaactgcttccttcctttggttttgaaacttgttccagtcttctgtttttttcatgtaatttcttttaaaggatattttaaattgttaatacagtgcctgctttttgtatcaagtgtaccttatgcagatgtctaaagaaaaagtaattccaccaatacttccatctctcttgaggcaagcagtgtgtgcgctgttcacgttgctgaaatgtttcctccatactcacacacacatgggtttttctgcacatggactcataaccagcggtgcttcgttaagctccattctggactcagaggaatgctaagcctcttgaggtgacggtctggagctcaccttgtgattagtgtgttgtgcctctgggacttgatattggtctctgccagagagactgagttgccttctatccatctgttcttgtttccgcttaaatgaacttttcaaaatgtaagccttaccatgtcatgctcctgtgtgcggcacggtcactctgtgtagaatgtcatcgctgctttattcccctgtagcagttacccccattcattctgtatgtttagctgttgctgtccctctctgcccacaggaatataaattccacagggagagcgtctgttgtggtccctgctgtggccccaggacccgtggcaaagagtaggcatgcagtaaacttaggtgaaaaactgaatgaaacccccggctgaactgaaattacctcagtgaa

SEQ ID NO: 18203 - DNA, 172 bp, Homo sapiens
gagtgagctgaaccatacatgcttgtagtaaagattgtatgtatgtcatatatgtatatctatatataatatatctacccatgattatacgttgtctataaagccccttcacacttttttttaacctcatagcagctcagcaggtcagtttaatatgatcattatttttcag

SEQ ID NO: 18204 - DNA, 476 bp, Homo sapiens
acagaattggtcttgaattccaaacctgctatttacattctgtttcacaaggtgagataatgtatgaaaaattgcttaaggcagtgtcttcctcccacaaagaaaaggcagctacagatgcagttatttgctattatgcaattcagtgagaggccattgtagaggatattctccaaaactccctgacaatgagtcacttcctgattgataatttcacatagctgcattcttaggagctcacttgggaacctaaaccatggagaagttaagattttgtctcagaagtctcctctgagacataggtcctctgagacacaggctactttaaggaaaagaaaaaaaatcacctgggttctgttcctgactactgctgactagctgtgctgtatggagtgggttcactttcctttccttttctttctttcttttttttttcttccagccggggtgacagagtgagactctgtctcaaaaca

SEQ ID NO: 18205 - DNA, 405 bp, Homo sapiens
tgctctcaaatccccttttccacacttgaacaaaactctattgtcaacataaaagaacaagtcaaagagctataaactccccctctaaacttggccttggtgttctcactttttctgtgatagtatatgagaaaaatgaatataatgttgccctgataggaagtttaatgaattttaaaagaaagcaatgttgcttttataaaatataaaatttattatttttcttgggtggggagacagtgtctctctgttgcccagactggagtgcaatggtgcaatttcagctcaccgcgatatctgcctcccaggttcaagcgatccttctgcctcagcctcccgagtagttgggactataggcgtgcaccaccacacccagctttctatttttagtagagacggggtttc

SEQ ID NO: 18206 - DNA, 212 bp, Homo sapiens
gtttgaatttgctaagttaaaagggatatcactttgatgacatgggattacattattttcctgttgatttattaagtatttatatgtcctttgaaatttttttggcggtggcattctttttattttaatatataaggttttgttactttttgataaacagtctttttacatacaaaatttattactgtttgccatatttatagcaaacatag

SEQ ID NO: 18207 - DNA, 349 bp, Homo sapiens
gctggagagagcggggtttgggtactgcgcctgctgggatctggaattcgccttacgttccctggatgtgcggatgtctgtttttaacagcatgctgctatggttcctaaggagagaattcgatcggcctgtgcttacgagttggtttattttttatttatttcgtgctccgggaacacagcctcaggcaccttctctccctcccacctgtgtctggaatctctccatcgtgcccctcctctcctactcactctgtcccttgactcaaatgcctctccttcgttcctcttcttacttctcctagacactttttccccccagcggtggtggtggtgattatcctttccgg

SEQ ID NO: 18208 - DNA, 354 bp, Homo sapiens
taattaggcggatgtgatggtacacactggttgtctcaactactagggaggctgaggcaggagaatcacttgagcccaggcgtctgaggctgcagtgagctatgatcatgtcactgcactccagcctgggtgacagcgagaccctgtctcttaaaaaaaaaaacagaatttctaaaactcaacaaaattcaaaattgggcaaaagaatagatatttctccaaagaagaaacacaaatggccaataagctcacaaaaagatgctcagcatcactagttatgatgaaaatgtaagtcaaaatcacaattagagaagattcttcattataatttattaattaggagggctttcatag

SEQ ID NO: 18209 - DNA, 364 bp, Homo sapiens
gcaactgacctccagggcagacatggggcccaggaagcctgattacatctgtattgtatccagaggaacaaacagggcccagaaaggttgccactaaaagtatggcaaaaaccacaattacttttgcaccaacctaatactaactactctctagggctgctgtgaggatttagtgaattaatacatgtaaaagactcagcattgtgcactcactactattattactgttaactttagatacttgcggttagtatccaaaacatatcaaaaagtgactacttggttttaagtacatcaaattatgccttctaaaaaatattgtaatattttaacagttttttccataaatttgctttttcaaatt

SEQ ID NO: 18210 - DNA, 370 bp, Homo sapiens
tgtcaacatggatggacactctacttgtgcgtatgtatgtggggtatgtgtgcttagtaatatctgggtccaagttggattctgaaagtgaacccaaatcctaccttcttttacacttttttctcccaagatctaaactcttactactcaaaactatgacctgcagcccagtggcatcagcatcacctagaagcttattaggaatgcagagttccaggcctacccaagccctgattcagattctgcattttgagaagatgcctaggtgactcctatccacattaaagtttgagaagccttgctcatgtcggtattgaaaaatccttgccgacttgacaagaaggcaataatataattagtgtgtgtagca

SEQ ID NO: 18211 - DNA, 386 bp, Homo sapiens
ctcttcaggtggactctatcagtgtctgtgtctcacggtagctgtcatagcattgtggagttactcttcgtttggaaacagcaattaagaaatttgagggattatccatagactcaaaatggttagaggtcaggtagtattctgtgacacacacttagggttagagtaagtcagaatggtttaaggttcggaaagagaagataccaaggttcctgcagataccaaggaaagagaatcttagtcttgtaatgtatgagccttcaaatattgtggatattaaatgagttgttacatgtggagtgctcacaatagtcccgggtacagagtaagagatcagtgaacatcaatagttagaattatttctgtctatgaagtgatactgaaca

SEQ ID NO: 18212 - DNA, 1753 bp, Homo sapiens
ttttcacaatgggtttgccgccagaacacaggtgttgtgaaaactacccctaaaagccaaaatgggaaaggaaaagactcatatccacattgtcgtcattggacacgtagattcgtacaagtccaccactactggccatctgaactacaaatgtggtagcatcaacaaaagaaccattgaaaaaattgagaaggaggctgctgagatgggaaagggctccttcaagtaggcctgggtcttggataaactgaaagctgagcgtgaacgtggtatcaccattaatacctccttgtggaaatttgagaacagcaagtgctacgtgactatcattgatgccctaggacacagagacttaaccacagagacttcatcaaaaacatgattacagggacatctcaggctgactgtgctgtcctgattgttgctgctggtgttggtgaatttgaagctggtatctccaagaatggacaaacctaggagcatgcccttttggcttacacactgggtgtgaaacaactaattgtcggtgttaacaaaatggattccactgagccaccctacagccagaagagatatgaggaaattgttaaggaagtcaacacttaaattaagaaaattggctacaaccccgacacagaagcatttgtgccaatttctggttggaatggtgacaacatgctggagccaagttttaacatgccttggttcaagggacgaaaatcctcctgtaaggatggcaataccagtggaaccatgctgcttgaggctctggactacatcctaccaccaactcatccaactaacaagcccctttgcctgcctctccaggatgtctacaaaaattggtggtattggtactgttcctgttggccgagtggagactggtgttctcaaacctggtatggtggtcacctttgctccagtcaacattaaaactgaagtaaaatctgtcgaaatgcaccatgaagctttgagtgaaactctttctggggacaatgtgggcttcaatgtcaagaatgtgtctgtcaaggatgttcgtcatggcaatgatgctggtgacagcaaagatgacccaccaatggaagcggctggcttcactgctcaggtgattatcctgaaccatccaggccaaataagtgctggctatgccctgtatggattgccacacggctcacatgcatgcaagtttgctgagctgaaggaaagattgatcgccgtttggtaaaagctggaagatggccctaaattctgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaaa

SEQ ID NO: 18213 - DNA, 451 bp, Homo sapiens
aactgggggagtacagccagtaaactgtgctttaatagcgttccaggtgattctgatggtcccaaagtgtgagacttagtgtgctaggtcagttgtttgcactttgcggtttgatccaatgaccttctgcatcagaatcacctgggcctaatgaatcagaatttatgggtcaagggtcttggaaatagatctgagtcacttgcacagtgttctaaggctcttctctggcactgtgctagaaaagattgtagtggctttgctcccatgaggaatagaaacatcaaataaaatgttagtgttccggctgccatacatacagatcttttatttctttggcctgttgatactttttagaaactaaaaatttagtagtatgttaataattatacttactagtaattggcttttacctgtgttaacatttcagaatttaagaattaggttatgttag

SEQ ID NO: 18214 - DNA, 313 bp, Homo sapiens
ataatcacatgactactgacttttcagcatgcaggagaaaaagcaaatatttccactgttgaaaggttttattggagaaacttgatgaatacaatgacttcatggcttagtgaagacaaccacggtggttaaaatacagtgaaccctcatttagctgtatccattcaaagtatttgagcatctcctatgtataatgtcaatttatttgatgctggttaaatgtgtaacaagttacttaaaaccaactgtaataccaaaaagtcattgaacacacttctaaagtatactgcctgaataaaaggtatctataaaa

SEQ ID NO: 18215 - DNA, 295 bp, Homo sapiens
ctggtctctactcctgtctttttctctctacagcctattctccatacggcaaccacagtgattcttttaaaatagaagccagtcatgttattctctgctcagaactctgtaatgtgtcctcatttcactgaaaacaaaaatctaagtccttatagtttcctacaaagccctttatgatctgattttctgcatccccttcctccttctgacctcatctcccaccattctcctcctccatcccttactgacttctttgctgttccttgaaaatgtcagatatgctcccatcaaaagg

SEQ ID NO: 18216 - DNA, 487 bp, Homo sapiens
catcagaacagaccagcttatccggttataaatctaggataacatgatgagcttcagagccaggggttgagctctcctgggactcctcccctccaaaggatgtgttccattgccaaacattaaaagctccgaattcttgttttctcgccaaaaggtattgtagacatgatggcagtgaaattatttttttcgcatttaaagttacccttaataaaatcactttcttcaggtggtgtaccaagttagtaaaacatacctgtttgaatctatattccatcaaccatgaacttatgcctggggatcaaaaatttcttaaaacccaccaggcgtgatcctaatacttttttcacagtttctcggggtgtttcagtaggttaggattacctccaaagacatttaaatgatgtttctggttcaaacggaaatgaaaagcacataaaattgtaagacataagaattccaagaatttggcagaggtgaaaacaca
